United States Patent 10,766,935 (PLANT TRAITS CONFERRED BY ISOLATED POLYNUCLEOTIDES AND POLYPEPTIDES) - sequence listing, part 3

SEQ ID NO: 2983 - DNA, 1076 bp, Brassica napus
agacgatctggattagctaaaacctaagctggacgattattattattttctttttaattaagaggaaatcaaaatttatatataaaaccttctctgaaattatcatcatcttcgtaggaagatcgagtatcgtctaggaaggatggggcgtgtggattatctggcgatgaagacagacgtggataaggttgctttagtcaattccgacgtggaggagctcaagatcgctgccaagaaactcctcaccgatgtttcgaaacttggtggtttagcctttggtgtttccttcgtcaaatggatcgcttctttctccgccatttacttgttgatattggatcgtaccaattggagaaccaagatgcttacttcactcttgattccatacatcttcctcacccttcctggtgtcatttttaatttcctcagtggagacgttgggaaatggatagctttcgttgcagttgtactcagacttttcttccctaagcatttcccagattggcttgagatgcctggttctctgatccttctgctggtagtttctccacacttccttgttcaccatattcgcggaggctggattggctctgtcatcagccttttcattggttgttaccttcttcaagaacatatcagagtgtcaggtggattcaggaactcgttcacgcagccccgtggagtttcaaacactttggggatcatccttcttcttgtctaccctgtttgggctctaatcatccgtgtctcataatcaccaccattcaacttcccatctccaagttgtgtccaataaactttcaatcgatagcaagaacctcggacatctttggtgttcctttgttcttgcttctgttacatacccaaatacttagtgcgtgaagctcaatcaatgttctacataaaaaaaaaaaagaatcacattatttttccaactgtttgtttgtctctgttgtaataagacgaacttctatgtgtaaaaattgcttgtatggattctgtttcgtatggaatgtttgtccttcggatatagcaaaaggaataaataaactgcacgctgttttgtcacaaagaaaaat

SEQ ID NO: 2984 - DNA, 781 bp, Brassica oleracea
cgaagatcgattattcagctgaggaaagaagaaagtaatggggcgtgtggattacctagcgatgaagaccgacgtcgacacggttgctctggtcaattccgacgtggaggagcttaagatcgctgccaagaaactcttaagcgatgtgaccaagcttggtggagcagcctttggtgtttctttcgtcaaatggttggcttgcttcgctgccatttacttgttgatattggatcgtacaaattggagaagcaagatgctaacatcactcttgataccatacatcttccttagccttcctggtgtgcttttcaacttccttagtggagacgttgggaaatggattgctttcgttgcagttgtactcagacttttcttcccaaaacatttcccagattggctagagatgcctggttctctgatccttctgctagtggtatctcctcactttctagctcaccatatacgtggaacctggattggctctatcatcagtcttttcataggctgttaccttcttcaagaacatatccgagtctcgggtgggttcaggcattcgttcacgcagccccgtggtgtatcaaacactctagggatcatccttattctggtctaccctgtttgggctctaatcgttcgtgtcttaaaatagacatctgcctcttccatatcccccaagctgtatatgtctttgtccaataaactccgtgaagcaccgggcaaaagctctttgctctgcttctgttactatctcaagctcaatcaatgttccatatatttaaaa

SEQ ID NO: 2985 - DNA, 1045 bp, Brassica rapa
aagagaactatttatgagaacttgagaagaaaaagcaagttgaaaagcagagaagacgatctgatagtgatagataggctggggggataattttttcgaagaataaaatataaaaacctcgaaattattgtctttcacataataagaagatcgattattcagctgaggaaagaagaaagtaatgggtcgtgtggattacctagcgatgaagaccgacgtcgacaaggttgctctggtcaattccgacgtggaggagctcaagatcgctgccaagaaactcttcagggatgtgaccaagcttggtggagcagcctttggtgtttctttcgtcaaatggttggcttgcttcgcggccatttacttgttgatattggatcgtacaaattggagaagcaagatgcttacatcactcttgataccatacatcttccttagccttcctggtgtgattttcaacttccttagtggagacgttgggaagtggattgcttttgttgcagttgtactcagacttttcttcccaaaacacttcccagattggctagagatgcctggttctctgatacttctgctagtagtttctccacactttctagctcaccatatacgtggaacctggattggctctatcatctgtcttttcataggctgttaccttcttcaagaacatatccgagtctccggtgggttcaggaattcgttcacgcagccccgtggagtatcaaacactttagggatcatccttattctggtctaccctgtttgggctctaatcgttcgtgtcacaaaatagacattttgcctcttccatatcccccaagttgtatatgtctttgtccaataaactccgtgaagcactgggcaaaacctcattgctctgcttctgttgctacacgtatactactatctcaagctcaatcaatgttccatatatttaaaagaaaaaaaccctcattttttaaaaactattgtttgtacttatcaacagaaaaaaaaaaactatttgtttgtctattgtaataagaactgtttaagctctttaaat

SEQ ID NO: 2986 - DNA, 848 bp, Brassica napus
cgaagatcgattattcagctgaggaaagaagaaagtaatggggcgtgtggattacctagcgatgaagaccgacgtcgacacggttgctctggtcaattccgacgtggaggagcttaagatcgctgccaagaaactcttaagcgatgtgaccaagcttggtggagcagcctttggtgtttctttcgtcaaatggttggcttgcttcgctgccatttacttgttgatattggatcgtacaaattggagaagcaagatgctaacatcactcttgataccatacatcttccttagccttcctggtgtgctttttaacttccttagtggagacgttgggaaatggattgctttcgttgcagttgtactcagacttttcttcccaaaacatttcccagattggctagagatgcctggttctctgatccttctgctagtggtatctcctcactttctagctcaccatatacgtggaacctggattggctctatcatcagtcttttcataggctgttaccttcttcaagaacatatccgagtctcgggtgggttcaggcattcgttcacgcagccccgtggtgtatcaaacactctagggatcatccttattctggtctaccctgtttgggctctaatcgttcgtgtcttaaaatagacatctgcctcttccatatcccccaagctgtatatgtctctgtccaataaactccgtgaagcaccgggcaaaagctctttgctctgcttctgttactatctaaagctcaatcaatgttccatatatttaaaagaaaaaaaaaaatctcatttttacaacttatttgtaaagcaaaaaaaaactatttgtttgtctattg

SEQ ID NO: 2987 - DNA, 903 bp, Brassica juncea
cattattttacaagctgagaagacgatctggatagctaaaacctagctggacgattattattattttctttttaattaaaatttatatataaaacctttaaatctatcatcatcttcgtacgaagatcgagtatcgtctacaaagtatggggcgtgtggattatctggcgatgaagacagacttggataaggtggctttagtcaattccgacgtggaggagctcaagatcgctgccaagaaactcctcaccgatgtttcgaaccttggtggtttagcctttggtgtttccttcgtcaaatggatcgcttctttctccgccatttacttgttgatattggatcgtaccaattggagaaccaagatgcttacttcactcttgattccatacatcttcctcacccttcctggtgtcatttttaatttcctcagtggagacgttgggaaatggatagcttttgttgctgttgtactcagacttttcttccctaagcatttcccagattggcttgagatgcctggctctctgatccttctgctggtagtttctccacacttccttgttcaccatatacgcggaggctggatcggttctgtcatcagccttttcattggatgttaccttcttcaagaacatatcagagtgtcaggtgggttcaggaactcgttcacgcagccccgtggagtttcaaacactttggggatcatccttcttcttgtctaccctgtttgggctcttatcatccgtgtctcataatcaccaccattcaacttcccatctccaagctgtgtccaataataaactctctctcaatcaaccaagaacctcggacatctttggtgttcctttgttcttgcttctgttacatacccaaatactagtgcgtgaagctcaatcaatgttc

SEQ ID NO: 2988 - DNA, 1126 bp, Brassica rapa
aatcatcatcatcattattattttacaagctgagaagacgatctggatagctaaaacctagctggacgattattattattttctttttaattcagagaaaatcaaaattcatatataaaacctttaaatttatcatcatcttcgtacgaagatcgagaatcgtctacaaagtatggggcgtgtggattatctggcgatgaagacagacgtggataaggttgctctagtcagttccgacgtggaggagctcaagatcgctgccaagaaactcctcaccgacgtttcgaaccttggtggtttagcctttggtgtttccttcgtcaaatggatcgcttctttctccgccatttacttgttgatattggatcgtaccaattggagaaccaagatgcttacttcactcttgattccatacatcttcctcacccttcctggtgtcatttttaatttcctcagtggagacgttgggaaatggatagctttcgttgcagttgtactcagacttttcttccctaagcatttcccagattggcttgagatgcctggttctctgatccttctgctggtagtttctccacacttccttgttcaccatatacgcggaggctggattggctctgtcatcagccttttcattggttgttaccttcttcaagaacatatcagagtgtcaggtgggttcaggaactcgttcacgcagccccgtggagtttcaaacactttggggatcatccttcttcttgtctaccctgtttgggctcttatcatccgtgtttcataatcaccaccattcaacttcccatctccaagctgtgtccaataataaattctcaatcaagcaagaacctcggacatctttggtgttcctttgttcttgcttctgttacatacccaaatactagggcgtgaagctcaatcaatgttccacattacaaaaaaatgaatcacatttttttccaactgtttgtttgtctatgttgtaataagacgaacttctatgtgtaaaaattgcttgtatggattctgtttcgtattgaatgtttgtcattcggatatagcaaaaggataaataaactgcacgctgtttctgcacaaagaaaaaataaaactgcacactgttcagatt

SEQ ID NO: 2989 - DNA, 849 bp, Brassica napus
ggaaaagcagagaagacgatctgatagtgatagataggctgggggaatatatttttcgaagaataaaatattaaaaacctcgaaattattgtctttcacataatacgaagatcgattattcagctgagaaaagaagaaagtaatgggtcgtgtggattacctagcgatgaagaccgacgtcgacaaggttgctctggtcaattccgacgtggaggagctcaagatcgctgccaagaaactcttcagggatgtgaccaagcttggtggagcagcctttggcgtttctttcgtcaaatggatggcttgcttcgctgccatttacttgttgatattggatcgtacaaattggagaagcaagatgcttacatcactcttgataccatacatcttccttagccttcctggtgtgattttcaacttccttagtggagacgttgggaagtggattgcttttgttgcagttgtactcagacttttcttcccaaaacacttcccagattggctagagatgcctggttctctgatacttctgctagtagtttctccacactttctagctcaccatatacgtggaacctggattggctctatcatctgtcttttcataggctgttaccttcttcaagaacatatccgagtctccggtgggttcaggaattcgttcacgcagccccgtggagtatcaaacactttagggatcatccttattctggtctaccctgtttgggctctaatcgttcgtgtcacaaaatagacattttgcctcttccatatcccccaagttgtatatgtctttgtccaataaactccgtgaagcactgggcaaaacctcattgctctgcttctgtt

SEQ ID NO: 2990 - DNA, 833 bp, Brassica napus
aaaatttatatataaaacctttaaatctatcatcatcttcgtacgaagatcgagtatcgtctacaaagtatggggcgtgtggattatctggcgatgaagacagacttggataaggtggctttagtcaattccgacgtggaggagctcaagatcgctgccaagaaactcctcaccgacgtttcgaaccttggtggtttagcctttggtgtttccttcgtcaaatggatcgcttctttctccgccatttacttgttgatattggatcgtaccaattggagaaccaagatgcttacttcactcttgattccatacatcttcctcacccttcctggtgtcatttttaatttcctcagtggagacgttgggaaatggatagctttcgttgcagttgtgctcagacttttcttccctaagcatttcccagattggcttgagatgcctggctctctgatccttctgctggtagtttctccacacttccttgttcaccatatacgcggaggctggattggctctgtcatcagccttttcattggctgttaccttcttcaagaacatatcagagtgtcaggtgggttcaggaactcgttcacgcagccccgtggagtttcaaacactttggggatcatccttcttcttgtctaccctgtttgggctcttatcatccgtgtctcataatcaccaccattcaacttcccatctccaagctgtgtccaataataaactctcaatcaagcaagaacctcggacatctttggtgttcctttgttcttgcttctgttacatacccaaatactagtgcgtgaagatcaatcaatgttccacataaaaaa

SEQ ID NO: 2991 - DNA, 961 bp, Raphanus sativus
acgattattattattattattttcaatttataagaaaatcaaaattcatataaaatcttgaaattatcattacgaagatcgagagtattatcgtgaacaaagggatggggcgtgtggattatctggcgatgaagacagacgtggatacggctgctttagtcaattccgacgtggaggagctcaagatcgctgccaagaaactcctcaccgatgtttcgaacctcggtggtttagcctttggcgtctccttcgtcaaatggatcgcttctttctccgccatttacttgttgatattggatcgtaccaattggagaaccaagatgcttacttcactcttgattccatacatcttcctcacccttcctggtgtgatctttaacttcctcagtggagacgttgggaaatggatagctttcgttgcagttgtactcagacttttcttccctaagcatttcccagactggcttgagatgcctggttctctgatccttctgctggtagtttctccaaacttccttgttcaccatatacgcggaggctggatcggctctgtcatcagccttttcattggttgttaccttcttcaagaacatatccgagtgtctggtgggttcaggaactcgttcacgcagccccgtggagtttcaaacactttggggatcatccttcttcttgtctaccctgtttgggctctaatcatccgtgtctcataataattataccattcgtcttcctgtctccaaagttgtgttaattactcggcatgtcaaataagcgttagccagaaacctcggagatctttggtgttcctttgttcttgcttctgttacaatacatacccaaatattcgtgcgtgaagctcaatcaatgttatattgttttacataaataaaagaatctcatttttttcaactatttctttgtctctgttgtaataagacggaatttttatgtgtaaaaa

SEQ ID NO: 2992 - DNA, 1045 bp, Raphanus sativus
agctggacgattattattattattatttttaatttataagaaaatcaaaattcatataataccttgaaattatcattacgaagatcgagagtattatcgtgaacaaagggatggggcgtgtggattatctggcgatgaagacagacgtggatacggctgctttagtcaattccgacgtggaggagctcaagatcgctgccaagaaactcctcaccgacgtttcgaacctcggtggtttagcctttggcgtctctttcgtcaaatggatcgcttctttctccgccatttacttgttgatattggatcgtaccaattggagaaccaagatgcttacttcactcttgattccatacatcttcctcacccttcctggtgtcatctttaacttcctcagtggagacgttgggaaatggatagctttcgttgctgttgtactcagacttttcttccctaagcatttcccagattggcttgagatgcctggttctctgatccttctgctggtagtttctccaaacttccttgttcaccatatacgcggagggtggatcggctctgtcatcagccttttcattggttgttaccttcttcaagaacatatccgagtgtcaggtgggttcaggaactcgttcacgcagccccgtggagtttcaaacactttggggatcatccttcttcttgtctaccctgtttgggctctaatcatccgtgtctcgtaataattacaccgttcctcttcctgtctccaaagttatgtgttacttactctcggcatgtcaaataagcgttagcaagaacctcggagatctttggtgttttcctttgttcttgcttctgttacatacccaaatattcgtgcgtgaagctcaatcaatgttatattgttttacataaataaaagaatctcatttttttcaactatttgtttgtcgcgttgtaataagacggaatttttatgtgtaaaaattgcttgtaaggattatgtttcgtgtatgcacttttgggtatagcaaaggtaggtctggacattcaggtcctaatgagc

SEQ ID NO: 2993 - DNA, 920 bp, Raphanus sativus
gagagtatcgtcaacaaaggaatggggcgtgtggattatctggcgatgaagacagacgtggatacggctgctttagtcaattccgacgtggaggagctcaagatcgctgccaagaaactcctcaacgatgtttcgaacctcggtggtttagcctttggcgtctctttcgtcaaatggatcgcttctttctccgccatttacttgttgatattggatcgtaccaactggagaaccaagatgcttacttcactcttgattccatacatcttcctcacccttcctggtgtgatctttaacttcctcagtggagacgttgggaaatggatagcgttcgttgctgttgtgctcagacttttcttccctaagcatttcccagattggcttgagatgcctggttctctgatccttctgctggtagtctctccaaacttccttgttcaccatatacgcggaggctggatcggctctgtcatcagccttttcattggttgttaccttcttcaagaacatatccgagtgtctggtgggttcaggaactcgttcacgcagccccgtggagtttcaaacactttggggatcatccttcttcttgtctaccctgtttgggctctaatcatccgtgtctcgtaataattacaccgttcctcttcctgtctccaaagttatgtgttacttactcggcatgtcaaataagcgttagcaagaacctcggagatctttggtgttcctttgttcttgcttctgttacatacccaaatattcgtgcgtgaagctcaatcaatattatattgttttacataaataaaagaatctcatttttttcaactatttgtttgtctctgttgtaataagacggaatttttatgtgtaaaaattgcttgtaaggattatgtttcgtgtatgcacttttgggtatagca

SEQ ID NO: 2994 - DNA, 594 bp, Brassica juncea
atggggcgtgtggattacctagcgatgaagaccgacgtcgataaggttgctctggtcaattccgacgtggaggagctcaagatcgctgccaagaaactcctcaccgacgtttcgaaccttggtggtttagcctttggtgtttccttcgtcaaatggatcgcttctttctccgccatttacttgttgatattggaccgtaccaattggagaaccaagatgcttacttctctcttgattccatacatcttccttacccttcctggtgtcatctttaacttcctcagtggagacgttgggaaatggatagcttttgttgctgttgtactcagacttttcttccctaagcatttcccagattggcttgagatgcctggttctctgatccttctgctagtagtttctccacacttcctagctcaccatatacgtggaacatggattggctctgtcatcacccttttcataggttgttaccttcttcaagaacatatccgagtctcaggtgggttcaggaattcgttcacgcagcctcgtggagtatcaaacactctagggatcatccttatcttggtctaccctgtttgggctctaatc

SEQ ID NO: 2995 - DNA, 1536 bp, Secale cereale
aaaatccgtgctggtgtccatcgcccggccgcaagcatcggaaaacgaacccatctttcctacttaacccccgcgcttttccagtaatccagagacaccgcggcaagagaggagacgcggcggcggccatggcgattcccctcgtgctcgtcctgctcccgctcggcctcctcttcctcctctccggtctcgtcgtcaacactgtccaggccgtattgttcttgaccataaggccattctcgaagcgactgtaccggcagatcaacgtattcctggccgagttgttgtggcttcagctgatctggcttgtggactggtgggcaggcattaaggtacaggtgtatgcggatccagaaacttggaaactaatgggcaaagagcacgcccttctcatatccaatcatcgaagtgacattgattggctggttggatggattttagcacagcgttcaggatgtcttggaagcgcaatagctataatgaagaaatcctcgaagttccttccagttattggttggtccatgtggtttgcagaatacctctttttggagagaagctgggcaaaggatgaaaaaacacttaaatcgggtcttcaaaggttgaaagacttccccagatcattttggcttgccctttttgttgagggtacaagatttactccagcaaaacttttagcagctcaagaatatgctgtctcacagggtttgacagcgcctaggaatgtgctgattccacgaacaaagggatttgtatcagctgtaagtattatgcgtgactttgtcccagctatctacgatacaacagtgattattccggaagattcgcctaaaccaacaatgctgcgcattcttcagggacaatcatcagttgttcatgtccgcataaaacgccattcaatgagtgatatgcctaactcggatgaggatgtttcaaaatggtgcaaagatatatttgtagcaaaggacgcgttattggacaaacatatagcaactggtacttttgatgaggaaattataccaattggtcgtccagtgaaatctttgatggtggtcctgtcttggtcatgtctcctcctatatggtgctcatagattcttacagtggacccagctcttgtcgacgtggaaaggagtgatcctctttgctactggattggcaatggtgacagccgttatgcatgtattcatcatgttctcgcaggctgagcggtcaagctccgctaaagcagcaagggaccgagtgaagagggattgatagctcgtgtgaaattcagtctataggggaactgccaatttattatgttcagaatatatgtagacacaggctccatgggtcaaatctagtatgtccttgttgtcctcggtaagagcttcaggaattttgtgtggcgagaactgtgagcttccttctttctctactttgtaatgacttgtaaagatttgctttgccataccaggaatcgctgcttgaatttatcgaagctttcttttatcagactgttcagacaatccttggtacagattgctattgccaacct

SEQ ID NO: 2996 - DNA, 1506 bp, Triticum aestivum
aaaatgaaaatccgtgttggtgtccatcgcccggccgcaagcagcggaaaacgaacccatctttcctacttaacccccgcgcttttcagtaatccagagacaccgcggcaagagaggagacgcggcggcggccatggcgattcccctcgtgctcgtcctgctcccgctcggcctcctcttcctcctctccggcctcgtcgtcaacactgtccaggccgtattgttcttgacgataaggccattctcgaagcgattgtaccggcagatcaacgtattcctggccgagttgttgtggcttcagctgatctggcttgtggactggtgggcaggtattaaggtacaggtgtatgcggatccagaaacttggaaactaatgggcaaagagcacgcccttctcatatccaatcatcgaagtgacattgattggctggttggatggattttagcacagcgttcaggatgtcttggaagcgcaatagctataatgaagaaatcctcaaagttccttccagttattggttggtccatgtggtttgcagaatacctctttttggagagaagctgggcaaaggatgaaaaaacacttaaatcgggtcttcaaaggttgaaagacttccccagatcattttggcttgccctttttgttgagggtacaagatttactccagcaaaacttttagcagctcaagaatatgcagtctcacagggtttgacagcgcctaggaatgtgctgattccacgaacaaagggatttgtatcagctgtaagtattatgcgtgactttgtcccagctatctacgatacaacagtgattattccggaagattcgcctaaaccaacaatgctgcgtattcttcagggacaatcatcagttgttcatgtccgcataaaacgccattcaatgagtgatatgcctaactcggatgaggatgtttcaaaatggtgcaaagatatatttgtagcaaaggacgcgttattggacaaacatatagcaactggtacttttgatgaggaaattataccaattggccgtccagtgaaatctttgatggtggtcctgtcttggtcatgtctcctcctatatggtgctcatagattcttacagtggacccagctcttgtcgacgtggaaaggagtgatcctctttgcttctggattggcaatggtaaccgccgttatgcatgtattcatcatgttctcgcaggccgagcgctcaagctctgcgaaagcagcaagggaccgagtgaagaaggattgatagctcgtgtgaaattcagtctataggggaactgccaatttattatgttcagaatatatgtagacacaggctccatgggtcaaatctagtatgtccttgttgtcctcggtaagagcttcaggaattttgtgtggcgagaactgtgagctttcttccttctttctctactttgtaatgacttgtaaagatttgctttgccataccaggaatcgctgctcgaatttatcgaagcttttttttaatcagac

SEQ ID NO: 2997 - DNA, 1621 bp, Triticum aestivum
gcaagcagcggaaaacgaacccatctttcctacttaacccccgcgcttttccagtaatccagagacaccgcggcaagagaggagacgcggcggcggccatggcgattcccctcgtgctcgtcctgctcccgctcggcctcctcttcctcctctccggcctcgtcgtcaacactgtccaggccgtattgttcttgacgataaggccattctcgaagcgattgtaccggcagatcaacgtattcctggccgagttgttgtggcttcagctgatctggcttgtggactggtgggcaggtattaaggtacaggtgtatgcggatccagcaacttggaaactaatgggcaaagagcacgcccttctaatatccaatcatcgaagtgacattgattggctggttggatggattttagcacagcgttcaggatgccttggaagcgcaatagctataatgaagaaatcctcaaagttccttccagttattggttggtccatgtggtttgcagaatacctctttttggagagaagctgggcaaaggatgaaaaaacactcaaatcgggtcttcaaaggttgaaagacttccccagatcattttggcttgccctttttgttgagggtacaagatttactccagcaaaacttttagcagctcaagaatatgcaatctcacagggtttgacagcgcctaggaatgtgctgattccacgaacaaagggatttgtatcagctgtaagtattatgcgtgactttgtcccagctatctatgatacaacagtgattattccagaagattcgcctaaaccaacaatgctgcgtattcttcagggacaatcatcagttgtacatgtccgcataaaacgccattcaatgagtgatatgcctaactcggatgaggatgtttcaaaatggtgcaaagacatatttgtagcaaaggacgcgttattggacaaacatatagcaactggtacttttgatgaggaaattataccaattggtcgtccagtgaaatctttgatggtggtcctgtcttggtcatgtctcctcctatatggtgctcatagattcttacagtggacccagctcttgtcgacgtggaaaggagtgatcctctttgcttctggattggcaatggtgaccgccgttatgcatgtattcatcatgttctcgcaggccgagcgctcaagctccgctaaagcagcaagggaccgagtgaagaaggattgatagctcgtgtgaaattcagtctataggggaactgccaatttattatgttcagaatatatgtagacacaggctccatgggtcaaatctagtatatccttgttgtcctcggtaagagcttcaggaattttgtgtggcgagaactgtgagctttcatccttctctactttgtaatgacttgtaaagatttgctttgccataccaggaatcgctgctcgaatttatcgaagcttttttttaatcagactgttcaggcaatccttggtacagattgctattgccaacctggttattctgcgctttggtgttgctatgacatcgtgtctgcgctggctcaaggagggaaatgtgaacgccaaactttttcacctcgtggctaatggacgagtgtgctaagggca

SEQ ID NO: 2998 - DNA, 1562 bp, Triticum aestivum
aagtgtcgccgttgcttgaaatctgttgcatttcatctagacccttaaggaaaatgaaaatccgtgttggtgtccatcgcccggccgcaagcagcggaaaacgaacccatctttcctacttaacccccgcgcttttccagtaatccagagacaccgcggcaagagaggagacgcggcggcggccatggcgattcccctcgtgctcgtcctgctcccgctcggcctcctcttcctcctctccggcctcgtcgtcaacactgtccaggccgtattgttcttgacgataaggccattctcgaagcgattgtaccggcagatcaacgtattcctggccgagttgttatggcttcagctgatctggcttgtggactggtgggcaggtattaaggtacaggtgtatgcggatccagcaacttggaaactaatgggcaaagagcacgcccttctaatatccaatcatcgaagtgacattgattggctggttggatggattttagcacagcgttcaggatgtcttggaagcgcaatagctataatgaagaaatcctcaaagttccttccagttattggttggtccatgtggtttgcagagtacctctttttggagagaagctgggcaaaggatgaaaaaacacttaaatcgggtcttcaaaggttgaaagacttccccagatcattttggcttgccctttttgttgagggtacaagatttactccagcaaaacttttagcagctcaagaatatgcagtctcacagggtttgacagcacctaggaatgtgctgattccacgaacaaagggatttgtatcagctgtaagtattatgcgtgactttgtcccagctatctacgatacaacagtgattattccggaagattcgcctaaaccaacaatactgcgtattcttcagggacaatcatcagttgttcatgtccgcataaaacgccattcaatgggtgatatgcctaactcggatgaggatgtttcaaaatggtgcaaagatatatttgtagcaaaggacgcgttattggacaaacatatagcaactggtacttttgatgaggaaattataccaattggtcgtccagtgaaatctttgatggtggtcctgtcttggtcatgtttcctcctatatggtgctcatagattcttacagtggacccagctcttgtcaacatggaaaggagtgatcctctttgcttctggattggcaatggtgactgccgttatgcatgtattcatcatgttctcgcaggccgagcgctcaagctccgctaaagcagcaagggaccgagtgaagaaggattgatagctcgtgtgaaattcagtctataggggaactgccaatttattatgttcagaatatatgtagacacaggctccatgggtgaaatctagtatgtccttgttgtcctcggtaagagcttcaggaattttgtgtggcgagaactgtgagctttcttccttctttctctactttgtaatgacttgtaaagatttgctttgccataccaggaatcgctgctcgaatttatcgaagcttttttttttatcacacacca

SEQ ID NO: 2999 - DNA, 1373 bp, Festuca arundinacea
gagagaggagacgcggcggcggccatggcgattcccctcgtgctcgtcctgctcccgctcggcctcctcttcctcctctccggcctcgtcgtcaacaccgtccaggccgtactgttcttgacgataaggccaatctcgaagagactgtaccggcagatcaacgtcttcttggctgagctgctgtggcttcagctgatctggcttgtcgactggtgggcaggtgttaaggtaaaattgtatggagatccggaaacttttaaactaatgggcaaagagcatgcccttctcatatccaatcatcggagtgacattgattggctggttggatggattttagcacagcgatcagggtgtcttggaagcgcaatagctatcatgaagaaatcttcaaagttccttccagttattggttggtccatgtggtttgcagaatacctttttttggagagaagctgggcaaaggatgaaaaaacacttaaatcgggtcttcaaaggttgaaagacttccccagatcattttggcttgccctttttgttgagggtacaagatttactccagcaaaacttttagcagctcaagaatatgcagtctctcagggtttgacagcacctagaaatgtgttgattccgcgaacaaagggatttgtatcagctgtaagtattatgcgtgactttgtcccagctatctacgatacaacagtgattattccagaagattcgccaaaaccaacaatgctgcgtattcttcagggacaatcgtcagtggttcatgtccgcataaagcgccatgcaatgagcgatatgcctaaatcggatgaggacgtttcgaaatggtgcaaagacatcttcgtagcgaaggacgcgttattggacaggcatttagcaactggtactttcgatgaggaaattataccaattggtcgtccagtgaaatctttggtggtggttctgtcttggtcatgcctactcctatttggtgctcatagattcttacagtggacccaactcttgtcgacatggaaaggagtcatcatcttctctactggactggcaatggtgacagctgttatgcatgtattcatcacgttctcacaggcagaacgctcaagctccgctaaagcagcaagggatcgagcgaagagagattgagagctctcgtgtgaaatttggtctataggtgaactgccaatttattatgttcagaatatatgtagacacaggcatcatattggtctgttattgtactcgttaagaggtacatgaattttgtgtggcaagaaccgtgaacttactttcttgtttatgtactttgtaactgaacgggcaaagatttgtcttgtcatagaaagaattgatgcttgaatttattgaag

SEQ ID NO: 3000 - DNA, 1363 bp, Avena sativa
gcggcgagagaggagacgcggcggcggccatggcgattcccctcgtgctcgtcctgctcccgctcggtctcctcttcctcctctccggcctcgtcgtcaacgccttccaggccgtattgttcttgacgataagaccactatcgaagagactgtaccggcagatcaacgtgttcttggctgagctgctgtggcttcagctgatctggctggtggactggtgggcaggcgtcaaggtacaattgcatggagatccggaaacttttaaactaatgggcaaagagcacgcccttctcatatccaatcatcggagtgacattgattggctggttggatggattttagcacagcgttcaggatgtcttggaagcgcaatagctatcatgaagaaatcttcaaagttccttccagttattggttggtccatgtggtttgcagaatacctctttttggagagaagctgggcaaaggatgaaaaaacgcttaaatggggtcttcaaaggttgaaagacttccccagatcattttggcttgccctttttgttgagggtacaagatttactccagaaaaacttttagcagctcaagaatatgcagtctcacagggtttgacagcacctagaaatgtgctgattccacggacaaagggatttgtgtcagctgtaagtattatgcgtgactttgtcccggctatatacgatacaacagtgattattcccgaagattctcctaaaccgacaatgctgcgtattcttcagggacaatcatcggttgttcatgtccgcataaaacgccatgcaatgaatgatatgcctaaatcggatgaggatgtttcaaaatggtgtaaagacatcttcgtacagaaggatgcattattggacaggcatatagcaactggtacttttgatgaggaaattataccaattggtcgtccagtgaaatctttggtggtggttctgtcttggtcatgtctcctcctatatggtgctcatagattcttacaatggacccaactcttgtcgacgtggaaaggagtcatcctcttcgctactggactggcaatggtgaccgccgttatgcatgtattcatcatgttctcacaggcggagcgctcaagctcagctaaagcagcaagggaccgagtgaagagagactgagagctcgtgtgaaattcagtctataggtgaattgccaatttattatgttcagaatatatgtagacacaggcttcatgggtctgttcttgttgtactcgttaagggctacaggagttttgtgtggaaagaactgggaacttcctttcttctttatgtactttgaaatggaacatgcaaatatttgtcttgtcatagaaataattgatgct

SEQ ID NO: 3001 - DNA, 1398 bp, Brachypodium distachyon
gagacacggcgccaagataggaagacgcggcggcggccatggcgattcccctcgtgctcgtcgtgctcccgctcggtctcctcttcctcctctccggtctcgtcgttaacgccatccaggctgtattgttcttgtcgataaggccattctcgaagagattataccggcagatcaatgtattcgtggctgagctgctgtggcttcagctgatctggcttgtggactggtgggcaggtgttaaggtacaattacatgcagatcaagaaacttacgaatcaatgggcaaagagcatgcccttctcatatcaaaccatcggagtgacattgattggctggttgggtggattttagcacagcgttcaggatgtcttggaagtgcaatagctatcatgaagaaatcttcaaagttccttccagttattggctggtccatgtggtttgcagagtacctctttctggagagaagctgggcaaaggatgaaaaaacacttaaatcgggtcttcaaaggttgaaagacttcccccggtcattttggcttgccctttttgttgagggtacaagatatactccagcaaaacttttagctgctcaagaatatgcagtctctcagggtttgacagcccctagaaatgtgctgattccacgaacaaagggatttgtatcagctgtaagtattatgcgtgattttgtcccagctatctacgatacaacagtgattattcctgaagattcacctaaaccaacaatgctgcgtatttttcagggacaatcatcagttgttcatgtccggataaaacgccatccaatgagtgatatgcctagctcagatgaggatgtttcaagatggtgcaaagacatctttgtagcaaaggatgcgttattggacaggcatatagcaactggttcttttgatgaggaaattagaccgattggtcgccccgtgaaatctttggtggtggttctgtcttggtcatgtctcctcctgtatggtgcccatagattcttacagtggacccaactcttgtcaacatggaaaggagtcatcctcttcgttgcgggactagcgatggtgactgccgttatgcatgtattcatcatgttctcgcagtcggagcgctcaagctctgctaaagcagcaagggaccgtgtgaagaaagactgagaaatcatatgaaattcagtctatttgggaactgccaattcattatgttcagaatatatatatatgtgcaggtacaagcttgaaggggcaaattttctctatcctggttgtgctcattaagagctcctgtagttttgtgtgttaagaactgttagccttttccctctttgtgtacttcgtagtttgcaatgacaatggtaaagattttaattttgcagcaggaattgacatttgc

SEQ ID NO: 3002 - DNA, 1631 bp, Setaria italica
cacactttctcgtaatccggggaacagggtcaagactcaagaagacaggaggcgcggccagtgcggcggcggcgtcggccatggcgatgcccctcgtgctcgtcgtgctcccgctcggcctcctcttcctcctctccggcctcatcgtcaatgctgtccaggctgtcctgtttgtgtctataaggcccttgtcgaagagcttgtatcggcggatcaacagattcttggccgagctgctatggcttcagttaatctggcttgtggattggtgggctggtgttaaggtacaattgcatgcagatcaagaaacttatcagctaatgggcaaagagcatgcccttataatatcaaatcaccggagcgacattgactggcttactggatggattttagcacagcgttcaggatgccttggaagcacactagctattatgaagaaatcgtcaaagttccttcctgttattggctggtccatgtggtttgcagaatacctctttttggagagaagttgggcaaaggatgaaaagacacttaaatggggtctcaaaaggttgaaggacttccccagatcattctggcttgccctttttgttgagggtacacggtttacgccagcaaaacttctagcagctcaagaatatgcagcctcacagggtttgccagcccctagaaatgtgttgattccacggacaaagggatttgtatcagcagtaagtattatgcgtgattttgtcccagctatctatgatacaacagtgataatccctaaagattcacctgcaccaacaatgctgtgtattctcaagggacagtcatcagtagttcatgtccgcataaaacgtcatgcaatgagtgatatgcctaaatctgatgaagatgtttcaaaatggtgtaaggacatatttgtggcgaaggatgcattattggacaagcatatagcaactggtacttttgatgaggaaattagaccgattggtcgtccaataaaatctttgctggtggttctgtcttggtcatgcctcctcctatatggtgcctgtagattcttacagtggactcagctcctgtcgacatggaaaggcgttatcctctttgttgctggattgactctggtgaccggcattatgcatgtctttgttttgttctcccaatcagaacgctcgagctctgccagagcagcgaggaatcgagtgaagaaagattgagggactcccaactcgttacttgaccaattatgtaggcacaggtgtgatggaaaaaaaaattctcagtgcttgtgctctataggaactgaaattttttgtgtggcaagaactgtcatctcccaacctcttcttgtacttgtatgacacaattgtagatttgtttttggtacagcagaaactagtacatgaacttattgaacttgtagactgaatctgccaaaagtgacaaacaaagaaaaaggtgttgtattgttttatttagattacaaaaggcaacattttaaattacatttccactgtgtctcaagctaaattacctggtgggtgtatgggtgacagcttacaggattggatggtcaattacagcagacagattgttattagtgatggtaaaaaataaaaacaaggctgtgggaagataagtgg

SEQ ID NO: 3003 - DNA, 1543 bp, Saccharum officinarum
cgatcacataagcgtatctttcgtgtttacccccgcgttttcgtaatccggaaacagggccaagaagagaggagacgtggccggtgcggcggcggcggcggccatggtgatccccctggtgctcgtcgtgctcccgctcgggctcctcttcctcctttccggcctcatcgtcaacgcaatccaggctatcttgttcgtgtctgtaaggccattatcgaagaccttgtatcgtcggatcaacagattcttagtcgagctgctatggcttcagctaatctggcttgtggactggtgggctggtgttaaggtacaattgcatgcagatcaagaaacttatcagctaatgggaaaagagcatgcccttatcatatcaaatcaccggagcgacattgattggcttattggatggattttggcacagcgttcaggatgtcttggaagcacactagctatcatgaagaaatcttcaaagttccttccagttattggctggtctatgtggtttgctgaatatctatttctggagagaagttgggcaaaggacgaaaagacacttaaatggggtctcaaaaggttgaaggacttccccagatcattctggcttgccctttttgttgagggtacacggtttacacctgcaaaacttctagcagctcaagaatatgcagcctcacagggtttgccagcccctagaaatgtgttgattccacggaccaagggatttgtatcagcagtaggtattatgcgtgattttgtcccagctatctatgatacaacagtgataatccctaaagattcacctgcaccaacaatgctgcgtattctcaagggacaatcatcagtagttcatgttcgcataaaacgccatgcaatgagtgatatgcctaaatccgaggaagatgtttcaaaatggtgtaaggacatctttgtggcaaaggatgctttattgaacaagcatatagcaattggcacttttgatgaagaaattagaccaatgggtcgtccaatgaaatctttgctggtggttctgtcttggtcatgccttctcctatatggtgcctacagattcttacagtggactcaactcttgtcaacgtggaaaggcattatcctctttgcttctggattggcactggtgactggcgttatgcatgtcttcatcatgttctctcagtcagagcgttcaagcaccgccagagcagcgagaaatcgggtgaagaaagattgatgactcttgattcccagctggcaatttgttaggcacaagcatgaggcaatttttctcagtgcttgtactcactagtctaggaacagaagaagttgtgtgtcaagaattgtgatctcctggcctcatcttgtacttgtatccataacacaagtgtaaatttgttttcagaatagcaggaactagtacattagtctattgattgatttttttcttgcagactggatgtgcagacaatcttttatggttcactgcttggtgtatctccgcattgtctgagacctcaccgtactcagaaattccagaattgcttcagtt

SEQ ID NO: 3004 - DNA, 2151 bp, Sorghum bicolor
tttcaatatatctgatgtgctaatttttttttatctaaaatctaaacagggccttatttccccagcgcttttctcgtaatccgggaacaggaccgagaagagaggagacgtggccggtgcggcggcggcggcggccatggtgatccccctggtgctcgtcgtgcttccgcttgggctcctcttcctcctttccggcctcatcgtcaacgcaatccaggctatcttgctcgtgtctgtaaggccattatcgaagagcttgtatcgtcggatcaacagattcttagtcgagctgctatggcttcagctaatctggcttttggactggtgggctgttgttaaggtacaattgcatgcagatcaagaaacttatcagctaatgggaaaagagcatgcccttatcatatcaaatcatcggagcgacatcgattggcttattggatggattttggcacagcgttcaggatgtcttggaagcacactagctatcatgaagaaatcttcaaagtttcttccagttattggctggtctatgtggttttctgaatatctatttctggagagaagttgggcaaaggacgaaaagacacttaaatggggtctcagaaggttgaaggactttcccagatcattctggcttgccctttttgttgagggtacacggtttacaccagcaaaacttctagcagctcaagaatatgcagcctcacagggtttgccagcccctagaaatgtgttgattccacggaccaagggatttgtatcagcagtaggtattatgcgtgattttgtcccagctatctatgatacaacagtgataatccctaaagattcacctgcaccgacaatgctgcgcattctcaagggacagtcatcagtagttcatgttcatataaaacgccatgcaatgagtgatatgcctaaattcgatgaagatgtttcaaaatggtgtaaggacatctttgtggcaaaggatgctttattggacaagcatatagcaactggtacttttgatgaagaaattagaccaattggtcgtccagtgaaatctttgctggtggttctgtcttggtcatgcctcctcctatatggtgcctacagattcttacagtggactcaactcttgtcaacgtggaaaggcattatcctcctcgctgctggattggcactggtgactggcgttatgcatgtcttcatcatgttctctcagtcagagcgttcaagctccgccagagcagcgaggaatcgggtgaagaaagattgatgactcttgattccagtccatccccagctgccaatttgttaggcacaagcatgaggcaaattttctcagtgcttgtactctctagtctaggaacagaagtcaagaattgtgatgccctggcctcttcttgtacttgtatacataacacaagtgtagatttgttttcagtatagcaggaactagtacattagtctattgattgattttttttcttgcagattggatgcacagacaatcttttatggttcactgcttggtctattccggcattgtctgagacctcaccgtacaaatttcagaattccttcaggagaacataaggctgatgacccaccttgttgggctggtctatactattgcttcagtaatatacaagcctgatacatgtacatgagtatagcagaaagattattactggtgatgataaaaaaaaagtgttgtgtggtgaccacaaatacaacacagatggacctaatatcttttataatttgacattaggggcctcgcaatttttcaaaggttgtgggcagcttctgcagcgaaaatgggttttagatggaaaataggaaacaacaagaaggtgaagttttggggagacaactggctggttacctcaaatctaacaattcagttttgggagatttacattctgatcaatgaaaagtctgaaacagtggctaatttttgagatggaactaactttaaatgtacctttagaagatgttttgataattggcttatgaacctctggttagagatagtgcagttagcctctactatttgttttcttgatgagaaagattccttaatttagcagtttactttaaatggtgtatattcctctcaatccatgtataaagtaatcaattttagaggtgtgttacctatgc

SEQ ID NO: 3005 - DNA, 1627 bp, Oryza sativa
ctcgtctcgtctcttctcgtcgccggtggattcgccgccgcctccgccgccgccgccggaggaggaggacgaggagagggcgctccctcgggggtgagcatccagccacctcggcccgttgcctcctcttcgcatctcggccccgcgagattggaagtgagggcagggcagggcggcaggggccatggcggtcccactcgtgctcgtcgtgctcccgctcggcctcctcttcctcctctccggcctcatcatcaacgccatccaggccgtcctgtttctctcgataaggccgttctcgaagagcttgtaccggcggatcaacaggttcttggccgagctgctgtggcttcagctggtctggcttgtggattggtgggcaggagttaagatacaactgcatgctgatgacgaaacttacaaggcaatggggaatgagcatgcacttgtcatatcaaatcatcggagcgatatcgattggcttattgggtggattttggcacagcgctcaggatgccttggaagtacacttgctgttatgaagaaatcatcgaaattccttccagttattggctggtccatgtggtttgcagaatacctctttttggaaaggagctgggcaaaggatgaaaagacattgaaatggggcctccaaaggttgaaggacttccccagaccattttggctagccctttttgttgagggcactcgctttactccagcaaagcttctagcagctcaggagtatgctgtttcacagggtttgccagcacccagaaatgtattgattccacgtacaaagggatttgtatcagctgtaactattatgcgggattttgttccagctatttatgatacaacagtaattattccaaaagattcacctcaaccaacaatgctgcggattttgaaagggcaatcttcagtggtacatgttcgcatgaaacgtcatgcaatgagtgagatgccaaagtcagaagacgatgtttcaaaatggtgcaaagacatctttgtagcaaaggatgcattactggataagcatttggcgacaggcacttttgatgaggagattagaccaattggccgcccagtaaaatcattgctggtgactttgttttggtcatgtctccttttatatggcgccgtcaagctcttcctatggactcaactcctgtcgacatggaaaggagtcgggtttacgggccttgggctcgcactggtgacggcggtcatgcatgtcttcatcatgttctcgcagtcagagcgatcgagctcagccaaggcggctcggaaccgtgtcaagaaagattgaaagagatgaagatagagtctgcagcttatcaatgggagctaccaattaattgggtattgaattcatgtaggcaacaaaattgagggcctaatctttcctgtataatgcaccaaaagggttcttacagaactgaatgcctgaatagagagattctaggagatttggtgaactagcaactctgagctctgttgtgctgtattttcagagaatgtttttttttggcagaacaggaattgtactacttgtatttattggaacttctacatcagtctggatttgttcagaagacctttagtgatttatgtatcagtgaaactt

SEQ ID NO: 3006 - DNA, 1588 bp, Brachypodium distachyon
aatccggcctcctataaaacctccaaccaaattcgccccgccgtggctcgcgtcgcgtctgccgggtcctcgccggcggagtccaaacgcgaaaccacccgaggaaccactgccacaggaggagaggagaagagtggcggcggcgaggcccttcttcttcttcttcccttgctgctcgccgccgcgagattggaaccaatcatccacccatggccgtgccgcttgtgctcgtcctgctccccctcggcctcctcttcctcctctccggcctcatcgtcaacgccgtccaggccgtcctgtttgtgtcaataaggcccttctcgaagagcttttaccggcggatcaacaggttcttagctgagcttctgtggcttcagctggtatggcttgtagactggtgggcaggcgttaagatacaactacatgccgatgaggaaagttatcagtcaatgggtaaagagcatgcacttgttatatcgaatcatcgtagtgatattgattggctcattggatggattttggcacagcgctcaggatgccttggaagtacactagctgttatgaagaaatcatcaaaattccttccagttattggctggtccatgtggtttgcagaatacctctttttggagaggagctgggcaaaagatgagaagacattaaaatggggccttcaaaggttgaaagacttccccagaccattttggctagcccttttcgttgagggtactcgttttactccagcaaagcttctagcagctcaggagtatgcagtttcacagggcttgccagcccctagaaatgtacttattccacgcactaagggatttgtctcagctgtaactattatgcgagattttgttccagctatttatgatacaacagtaataattccaaaagattcacctcaaccaacaatgctgcggattttgaaagggcaatcatcagtggtacatgttcgaatcaaacgtcatgctatgagtgagatgccaaagtcagaggaagatgtttcaaaatggtgcaaagacatctttgtggcaaaagacgcattactagataagcatttggcaactggcacttttgacgaggagattagaccgattggccgtccaatgaaatcattgctggttactctgttttggtcatgcctccttttatacggcgtgaccgagttcttcaagtgggcccaactcctgtcgacatggaaaggagtagggttcactgctgtgggcctggcgctagtgaccggtatcatgcatgtgttcatcatgttctcgcagtcagagcgatccagctcagccagggcagcacgggaccgagtcaagaaagattgaaagggatgctgatgttacgctagaacccaccaagcaagaactctcaaattgattccgcgctgaattcgcataggggccaaagtggaggccacacttctgtgaaccaaacaccaaaagaatcattgttgttacaaaaattggttttgcctcaatagggtagttagatttgatgagtagaaactgtctgagctccattcttcccgtattttgtatggaggaacatctttaaaaaaaatcattttagcagagcagga

SEQ ID NO: 3007 - DNA, 1681 bp, Oryza sativa
atccaaccccctataaaatctccaaatccaacaccccacctcacctcttcctcctcgtctcgtctcttctcgtcgccggtggattcgccgccgcctccgccgccgccgccggaggaggagagggcgctccctcgggggtgagcatccagccacctcggcccgttgcctcctcttcgcatctcggccccgcgagattggaagtgagggcagggcagggcggcaggggccatggcggtcccactcgtgctcgtcgtgctcccgctcggcctcctcttcctcctctccggcctcatcatcaacgccatccaggccgtcctgtttctctcgataaggccgttctcgaagagcttgtaccggcggatcaacaggttcttggccgagctgctgtggcttcagctggtctggcttgtggattggtgggcaggagttaagatacaactgcatgctgatgacgaaacttacaaggcaatggggaatgagcatgcacttgtcatatcaaatcatcggagcgatatcgattggcttattgggtggattttggcacagcgctcaggatgccttggaagtacacttgctgttatgaagaaatcatcgaaattccttccagttattggctggtccatgtggtttgcagaatacctctttttggaaaggagctgggcaaaggatgaaaagacattgaaatggggcctccaaaggttgaaggacttccccagaccattttggctagccctttttgttgagggcactcgctttactccggcaaagcttctagcagctcaggagtatgctgtttcacagggtttgccagcacccagaaatgtattgattccacgtacaaagggatttgtatcagctgtaactattatgcgggattttgttccagctatttatgatacaacagtaattattccaaaagattcacctcaaccaacaatgctgcggattttgaaagggcaatcttcagtggtacatgttcgcatgaaacgtcatgcaatgagtgagatgccaaagtcagaagacgatgtttcaaaatggtgcaaagacatctttgtagcaaaggatgcattactggataagcatttggcgacatgcacttttgatgaggagattagaccaattggccgcccagtaaaatcattgctggtgactttgttttggtcatgtctccttttatatggcgccgtcaagctcttcctatggactcaactcctgtcgacatggaaaggagtcgggtttacgggccttgggctcgcactggtgacggcggtcatgcatgtcttcatcatgttctcgcagtcagagcgatcgagctcagccaaggcggctcggaaccgtgtcaagaaagattgaaagagatgaagatagagtctacagcttatcaatgggagctaccaattaattgggtattgaattcatgtaggcaacaaaattgagggcctaatctttcctgtataatgcaccaaaagggttcttacagaactgaatgcctgaatagagagattctaggagatttggtgaactagcaactctgagctctgttgtgctgtattttcagagaatgtttttttttggcagaacaggaattgtactacttgtatttattggaacttctacatcagtctggatttgttcagaagacctttagtgatttatgtatcagtgaaacttatatcctgtc

SEQ ID NO: 3008 - DNA, 1593 bp, Zea mays
gcaataataattacggagtataataataataaaaaaactccgaatccgccgcgcgcgccccgtcctcgtcgccggcggaggcgcccgccaccgcccacagcagcctatcgccggagaaggaacgccgcggggagcttttccactgccatctcccgtctgacccctccgagatcggaagcggcggccatggcgatcccgctcgtgctcgtcgtgctcccgctcggcctcctcttcctcctgtccggcctcatcgtcaacaccatccaggccatcctatttgtgacaataaggcccttttccaagagcttgtatcgccggatcaacaggttcttggccgagctgctgtggctccagcttgtctgggtggtggactggtgggcaggcgttaaggtacaactacatgcggatgaggaaacttaccgatcaatgggtaaagagcatgcactcgtcatatcaaatcatcgaagtgatattgattggcttattggatggatattggcccagcgctcagggtgccttggaagtacgctcgctgtcatgaagaagtcatccaagttccttccagtcattggctggtcaatgtggtttgcagagtacctctttttggagaggagctgggccaaggatgaaaagacactaaagtggggtctccaaaggttgaaagacttccctagaccattttggctagctctttttgttgagggtactcgctttactccagcaaagcttctcgcagctcaggagtatgcagcttcccagggcttaccagctcctagaaatgtacttattccacgtaccaagggatttgtatctgccgtaagtattatgcgagattttgttccagccatttacgatacaactgtaatagttcctaaagattcccctcaaccaacaatgctgcggattttgaaagggcaatcatcagtgatacatgtccgcatgaaacgtcatgcaatgagtgagatgccaaaatcagatgatgacgtttcaaaatggtgtaaagacatttttgtggcaaaggatgccttactggacaaacatttggcaacaggcactttcgatgaggagattagacctatcggccgcccagtgaaatcattgctggtgaccctgttttggtcgtgcctcctgttgtttggtgccatcgagttcttcaagtggacgcagctcctatcgacatggagaggagtggcattcactgccgcagggatggcgctcgtgacagggctcatgcacgtcttcatcatgttctcccaggctgagcggtcgagctcagccaaggcggcacggaaccgggtcaagaaggaatgaaaacggagggtggagatgtgattctgggctctatttatgggcagctttcaaaatgactcgattcatattaatgtatacagcaccaaattccagacagaaacaggatgctctgctcctcttgtatttgtgtgcaggaaagaattttagggagttcatttttgcccccctcttttgggcagaggaactgtaggacatgaacttgatgttggtacatttgccctgtagacattctggaagcctttcagtagttcatttatcagtaaagcttgcatctttcatcca

SEQ ID NO: 3009 - DNA, 1468 bp, Zea mays
agcgctcatccatccacccccatcctataataaaacctccgaatgcgcctcgcgtgccccgtcctcctcgtcgccggcggagccgcctactatcgcctggagaaggagcgccgcggggagcttttcccactgccgactgccgtctgaccctccgagatcggaagcggcgccggcgccggccggcgatggcgatcccgctcgtgctcgtcgtgctcccgctcggcctgctcttcctcctgtccggcctcatcgtcaacgccatccaggccgtcctatttgtgacgataaggcccttttcgaagagcttctaccgtcggatcaacagattcttggccgagctgctgtggcttcagcttgtctgggtggtggactggtgggcaggtgttaaggtacaactgcatgcagatgaggaaacttacagatcaatgggtaaagagcatgcactcatcatatcaaatcatcggagtgatattgattggctcattggatggatattggcccagcgttcagggtgccttggaagtacacttgctgtcatgaagaagtcatccaagttccttccagttattggctggtcaatgtggtttgcagagtacctctttttggaaaggagctgggccaaggatgaaaagacactaaagtggggtctccaaaggttgaaagacttccctagaccattttggctagctcttttcgtcgagggtactcgctttactccagcaaagcttctcgcagctcaggaatatgcggcctcccagggcttaccggctcctagaaatgtacttattccacgtaccaagggatttgtatctgctgtaagtattatgcgagattttgttccagccatttatgatacaactgtaatagtccctaaagattcccctcaaccaacaatgctgcggattttgaaagggcaatcatcagtgatacatgtccgcatgaaacgtcatgcaatgagtgagatgccaaaatcagatgaggatgtttcaaaatggtgtaaagacatttttgtggcaaaggatgccttactggacaagcatttggcaacaggcactttcgatgaggagattagacctattggccgtccagtgaaatcattgctggtgaccctgttctggtcgtgcctcctgctgtttggcgccatcgagttcttcaagtggacacagcttctgtcgacgtggaggggtgtggcgttcactgccgcagggatggcgcttgtgacgggtgtcatgcatgtcttcatcatgttctcccaggctgagcggtcgagctcagccagggcggcacggaaccgggtcaagaaggaatgaaaaatggagggtggagatgaggttctcgtggggtttgttatgggcaaccttcaaaaggactctccattcatattagtattaattcatatatatgcagcgccaaattccagacattgatatgctctcaaataggatgttctgctcccctcttgtatttg

SEQ ID NO: 3010 - DNA, 1698 bp, Saccharum officinarum
cccacgcgtccgcttcctcccagcgctcatccatccaccgcctccctacaataaaaaacctccgaatccgcctcgcgtgccccgtcgtcctcgtcgccggcggagccgcccgccacctcccaccgccgccgagccacctatcgccggagaaggagcgccgcggggagctattccactgccgcctcccgtctgagcgatccctccgagatcggaagcgccggcgccggcgccggggggccatggcggtcccgctcgtgctcgtcgtgctcccgctcggcctgctcttcctcctgtccggcctcatcgtcaacaccatccaggccatcctatttgtgacaataaggcccttctcgaagagcttctaccgccggatcaacagattcttggccgagctgctgtggcttcagcttgtctgggtggtggactggtgggcaggtgttaaggtacaactgcatgcagatgatgaaacttaccgatcaatgggtaaagagcatgcactcatcatatcaaatcatcggagtgatattgattggcttattggatggatattggcccagcgctcagggtgccttggaagtacgcttgctgtgatgaagaagtcatcgaagttccttccagttattggctggtcgatgtggtttgcagagtacctctttttggagaggagctgggccaaggatgaaaagacactaaagtggggtctccaaaggttgaaagacttccctagaccattttggctagctcttttcgttgagggtactcgctttactccagcaaagcttctcgcagctcaggagtatgcggcttcccagggcttaccggctcctagaaatgtacttattccacgtaccaagggatttgtgtctgccgtaagtattatgcgagattttgttccagccatttatgatacaactgtaattgttcctaaagattcgcctcaaccaacaatgctgcggattttgaaagggcaatcatcagtgatacatgtccgcatgaaacgtcacgcaatgagtgagatgccaaaatcagatgaggatgtttcaaaatggtgcaaagacatttttgtggcaaaggatgccttactggacaagcatttggcaacaggcactttcgatgaggagattaggcctattggccgtccagtgaaatcattgctggtgaccctgttttggtcattcctcctgttgtttggtgccatcaagttcttcaagtggacacagctcctatcgacatggagaggtgtggcgttcactgctgcagggatggcacttgtgacaggggtcatgcatgtcttcatcatgttctcccaggctgagcggtcgagctcagccaaggcggcacggaacagggtcaagaaggaatgaaaatggagtgtggaaatgagattctgggatttattatggccaaccttcaaaaggagtgcaagtcaaattcatattaatatatacagcaccaattccagacattgatatgctctcaaataggatgcctctgctcttgtatttgtatgcaggaaagaattgtagggtttattgttcccccttcttttgggcagaggaactgtagcacatgaacttgatgttggtacatttgccctgtcagacatattctggaagcctttcagtagttcatttatcagtaaagcttgcatctttcttccatggaagtgtgaaccttggctggcactcatcacaatat

SEQ ID NO: 3011 - DNA, 1596 bp, Sorghum bicolor
ccaccgcccatccatccaccgcctcctcacaataaaaaaaaaaacccctccgaatccgcctcgcgtgccccgtcctcctcgtcgccggcggagccgcccgccaccgcccacctatcgccggagaaggagcgccgcggggagcttttccaccgccgcctcccgtctgactgacccctccgagatcggcggcggccggccatggcggtcccgctcgtgctcgtcgtgctcccgctcggcctgctcttcctcctgtccggcctcatcgtcaacaccatccaggccatcctatttgtgacaataaggcccttttccaagagcttctaccgtcgggtcaacagattcttggctgagctgctgtggcttcagcttgtctgggtggtcgactggtgggcaggtgttaaggtacaacttcatgcagatgaggaaacttaccgatcaatgggtaaagagcatgcacttatcatatcaaatcatcggagtgatattgattggcttattggatggatattggcccagcgttcagggtgccttggaagtacgcttgctgtcatgaagaagtcatccaagttccttccagttattggctggtcaatgtggtttgcagagtacctctttttggagaggagctgggccaaggatgaaaagacactaaagtggggtctccaaaggttgaaagacttccctagaccattttggctagctcttttcgttgagggtactcgctttactccagcaaagcttcttgcagctcaggagtatgcggcttcccagggcttaccggctcctagaaacgtacttattccacgtaccaagggatttgtatctgccgtaagtattatgcgagattttgttccagccatttacgatacaactgtaattgttcctaaagattcacctcaaccaacaatgctgcggattttgaaagggcaatcatcagtgatacatgtccgcatgaaacgccatgcaatgagtgagatgccaaaatcagatgaggatgtttcaaaatggtgcaaagacatttttgtggcaaaggatgccttactggacaagcatttggcaacaggcactttcgatgaggagattagacctattggtcgtcctgtgaaatcattgctggtgaccctgttttggtcattcctcctgttgtttggtgccatcaagttcttcaagtggacacagctcctatcaacatggagaggtgtagcattcactgccgcagggatggcacttgtgacaggggtcatgcatgtcttcatcatgttctcccaggctgagcggtcgagctcagccaaggcggcacggaaccgggtcaagaaggaatgaaaatggagggtggagatgagatgctggggtttattattgccgaccttcaaaagggttgcagattgaattcatattaatgtatacagcaccaaaattccagacattgatatgctctcaaataggatgctctgctcctcttgtatttgtatgcaggaaagaattgtagggagtttattttttcccccgctcttttgggcagaggaattgtagcacatgaacttgatgttggtactttgctctgtcagacatattctggaagcctttcagtagttc

SEQ ID NO: 3012 - DNA, 1954 bp, Panicum virgatum
aaaaaatcttttttttttggaaatgagctatccgacgtggcacaccagcctctcgtgttgccaagccaaccgtggacgcatacacgcatccgcttcactccgtctcctgcctcccagcgctcatccatccaccaccgcccctgtaataaaagcctccgaatccgggggcctcgtgtgccccgtcctcctcgtcgccggcggagccacctccgcccaccgcagctcgctgacctctcgccggggaaggagcaccgcggcgagcttctccaccgccgccttccacctgaccccaccctccgagattggaagcggcggcggcggcggcggctgccggccatggcgatcccgctcgtgctagtcgtgctccccctcggcctgctcttcctcctctccggcctcatcgtcaacaccatccaggccattctatttgtgacaataaggcccttctcaaagagcttctatcggcggatcaacagattcctggccgagctgctgtggcttcagctggtttgggttgtggactggtgggcaggcgttaaggtacaacttcatgctgatgaggaaacttaccgatcaatgggtaaagagcatgcactcatcatatcaaatcatcggagtgatatcgattggcttattggatggatattggcacagcgctcaggatgccttggaagtgcgcttgctatgatgaagaagtcatcaaagttccttccagttattggctggtccatgtggtttgcagaatacctctttttggagaggagctgggcaaaggatgaaaagacactaaagtggggcctccaaaggctgaaagacttccccagaccattttggctagcccttttcgttgagggtactcgctttactccagcaaagcttctcgcagctcaggagtatgcagcttcacagggattgccagctccgcgaaatgtacttattccacgcaccaagggatttgtatctgctgtgagtattatgcgggattttgttccagccatttatgatacaactgtaatagttccaaaagactctcctcaaccaacaatgctgcggattttgaaagggcaaccatcagtgatacatgttcgcatgaaacgccatgcaatgagtgagatgccaaagtcagatgaggatgtttcaaagtggtgcaaagatatatttgtagcaaaggatgccttgctggataagcatttggcaacaggcacatttgatgaggagattagaccaattggtcgcccggtgaaatcattgctggtgaccttgttttgggcatgtctcctcctattcggcgccatccagttcttcaagtggacgcaactcctatcgacatggagaggcgtagcgttcaccgctgccgggatggccctagtaacgggggtcatgcatgtgtttatcatgttcacccaggcggagcggtcgagctccgcaagggcagcacgcaaccgggtgaagaaagaatgataggatgacggtattccgggtctggtaaaaggcaatccactgaatggctgcagattcaattcatagacaccaaatttgagggtctctgggccagacaccaaacttgttgtactcaacaggaagcgcatagcgctattcttgtattctgtattctggaagggagttgttttctttgttttccttttgtcagcggaactgtaggatatggattcgttggtaattttacccctgccgccgtgccgcgttatgtggaagtcttcagtgatttatggattagctaagctttccatctttactagtggcgtgtgattttttttgcagtaaaagttgtgtgactctggagcctgtgttcaggcatgtctgtttctgacaaggggaatgttcagtaggagaccggcacatcctcctgcgcatgctgaaggggaaggtgtgcgaactgagagcttttgatctgtctctccagcaattcacatcacactgacgccgacacccg

SEQ ID NO: 3013 - DNA, 1586 bp, Echinochloa colona
ccccacctccgagattggaataagcggcggcggcggtggccggccatggcgatcccgctcgtgctcgtcgtgctccccctcggcctgctcttcctcctctccggcctcatcgtcaacaccatccaggccatcctgtttgtgacaataaggcccttctcaaagagcttctaccggcggatcaacagattcttggccgagctgctgtggcttcagctggtttgggtcgttgattggtgggcaggtgtcaaggtacaattacatgctgatgaggaaacttaccgatcaatgggtaaagagcatgcactcatcatatcaaatcatcggagtgatattgattggcttattggatggatattggcacagcgctcgggatgccttggaagtacgcttgctgtgatgaaaaagtcatcaaagttccttccagttattggctggtccatgtggtttgcagaatacctctttttggagaggagctgggcaaaggatgaaaagacattaaagtggggcctccaaaggttgaatgacttccctaggccattttggctagcccttttcgtggagggtactcgctttactccagcaaagcttcttgcagctcaggaatatgcagcttcacagggcttaccagctccgcgaaatgtacttattccccgcactaagggattcgtatctgctgtgagtattatgcgagattttgttccagccatttatgacacaactgtaatagttccaaaagattcacctcaaccaacaatgctccggattttgaaagggcaaccttcagtgattcatgttcgcatgaaacgccatgcaatgagtgagatgccaaagtcagatgaggatgtttcaaagtggtgcaaagacatctttgtagcaaaggatgccttactggataagcatttggcatcaggcacgtttgatgaggagattagaccgattggtcgtccggtgaaatcattactggtgacactattttgggcatgcctccttttgttcggtgccattgagttcttcaagtggacgcaactcctatcgacatggagaggcgtagcattcaccgccgctgggatggccctcgtgacaggggtcatgcatgtgttcatcatgttctcccaggcggagcggtcaagctcagccagggcggcacgcaaccgggtgaagaaagattgataaaggacaatccaccaaatagctgcagattaaattcatacagatgccaaatttgagggtctctgtgggctagacaccgaacttgatgtactcaacaggaagcgctattcttgtattttgtatgcaggaagggagttgttttctttgttctttttttggcagcagaattgtaggacatgaatctgttgatacccctacccaccttctgtcgaagtctccaatgatttatggattagttaagctttgcatcttctccagggatgtgtgaatttgaagtatgtgttgaggcagtcagataccgctgtctgtttttggcatgggcaatgttcagttggagacctgctgatccgcctgtacatacagaacgtgaagctatgcagagtgtcagagactcagagtgagcttttgttctggtc

SEQ ID NO: 3014 - DNA, 1767 bp, Echinochloa colona
ccatctccatcgcctgcctcccagcgctcatccatccaccgcaccgcccccataataaaagagcgcctccgaatccgccccgcgtgcccccgtcctcctcgtcgccggcggagccgcctccgcccaccgcagctcgccgaccgagccgcctctcgctggggaagaagcgccgccgcggcgagattgtccactgcccttgagcccacctccgagattggagtaagcggccggccatggcgatcccgctcgtgctcgtcgtgctccccctcggcctgctcttcctcctctccggcctcatcgtcaacaccatccaggccatcctgtttgtgacaataaggcccttctcaaagagcttctaccggcggatcaacagattcttggccgagctgctgtggcttcagctggtttgggtcgttgattggtgggcaggtgtcaaggtacaactacatgctgatgaagaaacctaccgatcaatgggtaaagagcatgcactcatcatatcaaatcatcggagtgatattgattggcttattggatggatattggcacagcgctcgggatgccttggaagtacgcttgctgtgatgaaaaagtcatcaaagttccttccagttattggctggtccatgtggtttgcagaatacctctttttggagaggagctgggcaaaggatgaaaagacactaaagtggggcctccaaaggttgaatgacttccctaggccattttggctagcccttttcgtggagggtactcgctttactccagcaaagcttcttgcagctcaggaatatgcagcttcacagggcttaccagctccgcgaaatgtacttattccccgcactaagggattcgtatctgctgtgagtattatgcgagattttgttccagccatttatgacacaactgtaatagttccaaaagattcacctcaaccaacaatgctgcggattttgaaagggcaaccttcagtgattcatgttcgcatgaaacgccatgcaatgagtgagatgccaaagtcagatgaggatgtttcaaagtggtgcaaagacatctttgtagcaaaggatgccttactggataagcatttggcatcaggcacgtttgatgaggagattagaccaattggtcgtccggtgaaatcattgctggtgaccctgttttgggcatgcctccttttgttcggtgccatcgagttcttcaagtggacgcaactcctatcgacatggagaggcgtagcgttcacagccgctgggatggccctcgtgacaggggtcatgcatgtgttcatcatgttctcccaggcggagcggtcaagctcagccagggcggcacgcaaccgggtgaagaaagattgataaaggacaatccaccaaatagctgcagattaaattcatacagattccaaatttgagggtctctgtgggctagacaccgaacttgatgtactcaacaggaagcgctattcttgtattttgtatgcaggatgggagttgttttctttgttctttttttggcagcagaattgtaggacctgttgatacccctacccaccttctgtggaagcctccagtgatttatggattagttaagctttgcatcttctccagggatgtgtgaatttgaagcctgtgttgaggcagtcagatacggctgtctgttttttggcatgggcaatgttcagttggagacctgctgatctgcctgtacatacagaacgtgaagctgtgcagagtgagctttttgttctggttcctgtagcaatgt

SEQ ID NO: 3015 - DNA, 1575 bp, Setaria italica
aatccgcctcgcgtgccccgtcctcctcgtcgccggcggaaccgcctccgcccaccgcagctcgccgaccgagccgcccctcgccggggaaggagcgccgcgccgcagcttctccaccgccgcctcccgccggaccccacctccgagattggaagcggcggcgccggtcggacatggcgatcccgctcgtgctcgtcgtgctccccctcggcctgctcttcctcctctccggcctcatcgtcaacaccatccaggccatcctatttgtgacaataaggcccttctcaaagagcttctaccggcggatcaacagattcctggccgagctgctgtggcttcagctggtttgggttgtggactggtgggcaggtgtcaaggtacaactgcatgctgatgaggaaacttaccgatcaatgggtaaagagcatgcactcatcatatcaaatcatcgtagtgatattgactggcttattggatggatattggcgcagcgctcgggatgccttggaagtacacttgctgtgatgaagaagtcatcaaagtttcttccagttattggctggtccatgtggtttgcagaatacctctttttggagaggagctgggcaaaggatgaaaagacactaaagtggggcctccaaaggttgaatgacttccctagaccattttggctagcccttttcgttgagggtactcgctttactccagcaaagcttctcgcagctcaggagtatgcagcttcacagggcttaccagctccgcgaaatgtacttattccacgcaccaagggattcgtatctgctgtgagtattatgcgagattttgttccagccatttatgacacaactgtcatagttcccaaagattcacctcaaccaacaatgctgcggattttgaaagggcaaccgtcagtgatacatgttcgcatgaaacgtcatgcaatgagtgagatgccaaagtcagatgaggatgtttcaaaatggtgcaaagacatttttgtagctaaggatgccttactggataagcacttggcaacaggcacatttgatgaggagattagaccaattggtcgtccggtgaaatcattgctggtgaccctgttttgggcatgcctccttttatttggtgccatccagttcttcaagtggacgcagctcctatcgacatggagaggcgtagcgttcaccgctgccgggatggccctcgtgacaggggttatgcatgtgttcatcatgttctcccaggcggagcggtcgagctcagcaagggcggcacgcaaccgggtgaagaaagaatgatgaggcaacggtagtctgggtctgctaaaagacaatccaccaaactggctgcagattaaattcatacaggcaccaaatttgagggtctgtgtgggctaggacacaaaagttgatgtacccaacaggaagcggtattcttgtatttggtatgctgggaagggagttgttttcttttcttttctttggcagcgaaactgtaggatataaattcattggtacttttacccaccccaccttttgtggaagtcactagtgattttgttatgcattagttaaa

SEQ ID NO: 3016 - DNA, 1602 bp, Pennisetum glaucum
caataaaaacctccgaatccgccgcctcgcgcgccccgtcctcctcgtcgccggcggagccgcttccgcccaccgcagctcgccgacagagcctcccctcgccggggaaggagcgccgcgccgcagcttctccaccgccgcctcccgccggaccccccacacctcctccgagattggaacaagcggcggcggcggtcggacatggcgatcccgctcgtgctcgtcgtgctccccctcggcctgctcttcctcctctccggcctcatcgtcaacaccatccaggccatcctgtttgtgacaataaggcccttctcaaagagcttctaccggcggatcaacagattcctggccgagctgctgtggcttcagctggtttgggttgtggactggtgggcaggagtcaaggtacaactgcatgctgatgaggaaacttaccgatcaatgggcaaagagcatgcactcatcatatcaaatcatcggagtgatattgactggcttattggatggatattggcacagcgctcgggatgccttggaagtacacttgctgtgatgaagaagtcatcaaagtttcttccagttattggctggtccatgtggtttgcagaatacctctttttggagaggagctgggcaaaggatgaaaagacactaaagtggggcctccaaaggttgaatgacttccctagaccattttggctagcccttttcgtcgagggtactcgctttactccagcaaagcttctcgcagctcaggagtatgcagcttcacagggcttaccggctccgcgaaatgtacttattccacgcaccaagggattcgtatctgctgtgagtattatgcgagattttgttccagcaatttatgacacaactgtcatagttcccaaagattcacctcaaccaacaatgctgcggattttgaaaggccaaccctcagtgatacatgttcgcatgaaacgccatgcaatgagtgagatgccaaagtcagatgaggatgtttcaaagtggtgcaaagacatctttgtagctaaggatgccttactggataagcacttggcaacaggcacatttgatgaagagatcagaccaattggccgtccggtgaaatcattgctggtgaccctcttttgggcatgcctccttttattcggcgccatccagttcttcaagtggacacagctcctatcgacatggagaggtgtagcgttcacggctgtcgggatggccctcgtgactggggttatgcatgtgttcatcatgttctcccaggcggagcggtcaagctcagcaagggcggcacgcaaccgggtgaagaaagaatgattggggaacggtagtctggatctgctaaaagacaatccaccaaattggctgcagattaaattcatacaggcaccaaatttgagggtctgtgtgggctagggacaccaaagttctaaagttgatgtacccaacaggaagcggtattcttgtattttgtatgtgggaagggagctgttttcttttcttttctttggcagcgaaactgtaggatgtgaatttgttggtacttttaccctgcccaccttttgtggaagtcactagtgattttaatatgca

SEQ ID NO: 3017 - DNA, 1300 bp, Cynodon dactylon
gtcgccggcggagccgccccgaagctgcctctccacccaccgcccgccggaggagaaggggcgaggtgttccgctgttgccttccgcctgacccccgcccgagattggaagcggcggcagcgggcggccatggcgatcccgctcgtgctcgtcgtgctccccctcggcttgctcttcctcctctctggactcaccgtcaacgccatccaggccatcatgtttgtgacaataaggcccttctcgaagagcttataccggcggatcaatagattcgtggccgagctgctgtggcttcagctggtctggcttgtggactggtgggcaggcgtgaaggtgcagctgcacgctgatgaggaaacttaccgatcaatggggaaagagcatgcactggtcgtatcaaatcatcgacgccacattgattggttgattggatggattttggctcagcgctcgggatgccttggaagtacactcgctgtcatgaaaaaatcgtcgaagttccttcctgttattggctggtccatgtggtttgcagagtacctctttttggagaggagctgggcgaaagatgaaaagacattaaagtggggcctccaaaggttgaaagacttccccaggccattttggctagccctatttgttgagggtactcgctttactccagcaaagcttctagcagcccaggagtatgctgcttcacagggcttgccagcccccagaaatgtactaattcctcgtactaagggattcgtgtcagccgtcagcatcatgcgagattttgttcctgctatttatgacacaacagtgataattccaaaagattcaccccaaccaacaatgctgcggattttgaaaggacaatcatcagtgatacatgttcacataaaacgacgtgccatgagtgaactgccggagtcggatgaggacgtttcaaaatggtgtaaagacatcttcgtggaaaaggatgcattactggataagcatttggcgacaggcacttttgatgaggagattagaccaattggtcgcccagtgaaatcattgctggtgaccctgttctggtcgtgcctcctcctgtacggtgccactgagttcttcaagtggacacaactcctgtcaacatggaaaggagtcgggttcactgctgctgggatggcgctggttacaggggtgatgcacattttcatcttattctctcaagcggagcggtcaagctcagccaaggcggcccgaaaccgggtgaagaaggattgataaggaatgggtggtttcatttgcgggtcgattttattcattgtgg

SEQ ID NO: 3018 - DNA, 1483 bp, Leymus cinereus x Leymus triticoides
gccccattgagccgtccatcgccggtgaagaagcgccgcggcgagttttccgctgccgcctcccttctgacccctctgagattggaagcggctgcggcggcagaggccggccatggcgatcccgctcgtgctcgtcatgctccccctcggactgctcttcctcctctccggcctcatcgtcaacaccgtccaggccatcctatttgtgacaatgaggcccttttcgaagagcttctaccggcggatcaacagattcttggccgagctgctatggcttcagcttgtctggctggtggactggtgggcaggcatcaaggtgcaactgcatgctgatgatgaaacttaccgatcaatgggtaaagtgcatgcactcatcatatcaaatcatcggagtgacattgattggcttattggatggatattggctcagcgctcagggtgccttggaagtacacttgctgtgatgaagaagtcatcaaagttccttccagttattggctggtccatgtggtttgcagagtacctcattttggagaggagctgggcaaaggatgaaaagacactaaagtggggtctgcaaagattgaaagacttccctagaccattttggttagcactcttcgttgagggaactcgctttactccggcaaagcttcttgcagctcaggagtatgcggcttcacaaggcttaccggctcctagaaatgtacttattccacgtaccaagggatttgtatcttctgtaagtattatgcgagattttgttccagccatttacaatacaactgtaatagttccaaaagattcacctcaaccaacaatgctgcgcattttgaaagggcaaccatcagtgatacatgttcgcatgaaacgccatgcaatgagtgagatgccaaagtcagatgaggatgtttcaaaatggtgcaaagacatctttgtggcaaaggatgccttactggacaagcatttagcaacaggcactttcgatgaggagattagacctattggccgtccagtgaaatcgttgctggtgaccctattttggtcatgcctcctgctgttcggtgccatcgagttcttcaagtggacacaactcctgtcgacatggcgaggcgtcgcattcactgccgccgggatgggcctcgtgactggggtcatgcacgtgttcatcatgttctcccaggcggagcggtcgagctcagccaaggcggcgcgcaaccgggtcaagaaggattgagtgtgggggtggagatgtcatcccagggttttgttaagctcaatgttcaaagggggttgcaagtcaaaattcatttaaaccgcaccaaattccagactttgatatgctctctcagtaggaagctctacttctcttgtattttgcatgcaggaaagaattgtagggagttgttttttcaccccttttggcagaggaactgtagcacatgaacttgttggtatttatacaccgttcagtgatttatta

SEQ ID NO: 3019 - DNA, 2290 bp, Panicum virgatum
tccctcctcattggacttggaggactgctgatgccggcccatgcaaatagccattgagcccagtgggccaattaccaagcaggcccgttcgcctatccagcggcacgtcgccgaaaaccgggcggcaaaacggcgacaagccccaccgttcccgtgcaaacaattcgacggccagtgccctgtggtccgccaacgggcccgctcgccagccaccccgcgcacggctccccgtagaccaccagtctctggtccgccctcctcccgttccgcttccccacgacacagctgacagctcacgagggataacgccaaaccagaccaaaaccctcctctcctctcccccccacaacccaaaccctagccggcagcccccttgatgaccgccgccgtagatgcacaggctctccctcaccgtcattgacgccgctgccgtcgccatgcccgcggcgctccggctcgggggctccccggcgccccgcctcgccgccgcgcgccgccagggcccgcgccctccgccgtggctgcgcttcggctggggcggcggggcgcggagggggctgctctgttccgccgaggccgccaggcggggcggcgacggcgacgacgcggaggcggaggtggaggaggcgcggaggggaggcgggggccgcgcggcgacggagaggaggatgaggagcggggccgcggccgccgcggtggggacgagcgtcgagctgctggcgattcccggggtcgggccgcgcaacctcaggaagctcgtggacaatggcttcgagggcgtcgcgcagctcaagcagctctacagggataagttctttggcaagtctagtgagcagatggttgagttcttacagagttctgttggcattgtacataagaaccatgctgagagtataacttctttcatcaaagagagtgtcgatgaggagctgaaggatacagattcatctaaacccactcagaagaagaggcttaccttttgtgtggaagggaatattagcgttgggaagactactttcctccaaagaatagctaatgagactattgaactgcgtgatcttgtagagatagttcctgagcctattgataagtggcaggatgttggacctgatcacttcaatatattggatgccttctatgctgagccacataggtatgcatacactttccaaaactatgtgtttgtgacaagggtcatgcaagaaagggaatctcaagctggaataaaacctctcaggctgatggaaagaagtgtattcagtgatcggatggtgtttgtccgtgccgttcatgaagctaattggatgaatgagatggagatcagcatctatgattcctggtttgatcccgttgtgtcatcgctcccaggtctcattccagatggatttatctatctaagagctagtccagatacttgccacaaaagaatgatgcatcggagaagatcagaagaaggtggtgttacacttgactacttgcaaggtttgcatgagaagcatgagagctggttgcttccttcaaaaggttcaggtcctggtatattatcagtcagtcaactgcccatgcatatggaaggctccttgcctccagaaatacaggatcgtgtattttacttggaaggaaatcacatgcactctagtatccaaaaggtccctgcccttgtcctggattgtgaacctgacattgatttcaacaaagacatagaagctaaacgacaatatgctcggcaagttgcagagttctttgaattcgtcaagaaaaagaaggaagaagctccatctgagcaatcgggtgccaacaagggtcgcatgaacccacaggtcatgcttcctaagagaggccgcctgtgggtccctgaaggcaaccctttcgcgggctcccctatgaacctggatttcagaagagccatgtcttcatacatttcaacctaggactccatgcggaaagaaacttgccatcctcactcattgacctcgcagctcaaaccgcctatgcttttaaggtaaaccttaggttgctcgatgctagccactgatgtaaaatagcccagctgtggctccgtcctgtaaattatgatcgtagcgctagttccacgttttgcagcactagcatcagcgtctttctgatttgatactaatctgtaccttacgttcggctgcttgaagcattctgttgaacagatctggaacgagaacatgtgcatgtgctgcttgccttcttggaccagagcatgcaccatgtgtatcaccttgaaggttcctgttgatgatgctatgcgttttagtttcct

SEQ ID NO: 3020 - DNA, 2294 bp, Sorghum bicolor
ccccactcgccagccacagccaccagtctcctcgcctcctcggctcggctgttccccctcccgcttcccgacgacacagcccgacagcccacagctcacaagggagggataacgccaaacccaaccaaaaccctagcgaccagccacattgatgacctccggccctcctcctccgccgccgccgccgacgacgacgtagatgcacaggctctccctcaccgtcattgacgccaccgccgccatgccctttgcgctccggctcggcggttccccagcggtccgcctcgccgccgcgcgccgcgcgggcccgcggcccctggcgtggctgcgcttcggcagcggggccggggcgcggaggctctgctccgccgaggccgccaggcggggtggcggtggcgaggatgcggaggcggagggagggtcggaggggaggcgggagccgcgtgccgtcggagaggaggatgaggggcggggggaacgcggccgccgccgcggtggggacgagcatcgagctgctggcgattcccggtgtggggccgcgcaaccttaggaagctcgtggacaatggcttcgagggcgtcgcgcagctcaagcagctctacagggacaagttctttggcaagtctagtgggcagatggttgaattcttacagtgttctgttggcattgtacataagaatcatgctgagagtataacctcgttcattaaagagagtgttgatgaggagctgaaagatacagattcatctaaacccactcagaagaagaggctgaccttttgtgtggaagggaatatcagcgttgggaaaaccactttcctccaaaggatagctaatgagacaattgaactgcgtgatcttgtagagatagttcctgagcctattgataagtggcaagatgttggccctgatcacttcaatatattggatgccttctatgctgagccacataggtatgcatacactttccaaaactatgtgtttgtgacaagggtcatgcaagaaagggaatctcaagctggaattaaacctctcagactgatggaaagaagtgtattcagtgataggatggtattcgtccgtgctgttcacgaagctaattggatgaatgagatggagatcagcatctatgattcttggtttgatccagttgtgtcatcactcccaggtctcatcccagatggatttatctatttaagagctagcccagatacttgccacaaaagaatgatgcataggagaagatcagaggaaggtggtgttacacttgattacttgcaaggtttgcatgagaagcatgagagctggttgcttccttcgaaaggatcgggtcctggtgtattatcggtcagtcaactgcccatgcatatggagggctccttgcctccggaaatacgggatcgtgtattttacttggaaggaaatcacatgcactctagcatccagaaggttcctgctctcatcttggattgtgaacctgacattgatttcagcagagacatagaagctaaacgacaatatgctaggcaagttgcagagttctttgaatttgtgaagaaaaagcaggagcaagctccatcggagcaaacaagcaatgacaaggaccgcatgaacccacaggtattgcttcctaacagcagccgcttgtgggggtccctaaaggcaagccttttgcaggctatccaatgaatctggatttcagaagagccatgtcttcatacctctcaacttaggactcccagctgctaaaagaaattagcccctcgctcactgaccttgcaaagagtctatgcatcaagttcaaccttaggtcgcccgatgctagccactgatgtaaaataggttgcttcccccttgtgtaaattatgatcttagcgctagttccacgttttgcagcattttccacgttttgcagcactagtatcagcgtttatcagatctgatcggatgacaggtgtaatctgtaccgtagcttctttgcttgaatcattctgttgaacagattttgtggagggcgtgtgctgcttcgacttgtactatgtgtggaagattcctgatgatgttatgttgtgcgtttgttcacctggtggaaaagctgctttgggccgcctcgaggattgaccggggagccgctgaaatgcttgtgctggtcaatgtgaaatgcttgtgtttggcaaactgacattcagctttcaaatttgtcgtccgtggcgtctgatgctcatgctctgatctgatgccctgtggcatgaggccgtcagaactggtgccctggtgaacgcgtcagtatacggt

SEQ ID NO: 3021 - DNA, 3489 bp, Zea mays
gttgtcgtgcaagcccaccgttcctaaatccctctcagcggcaaaacgcaaaacggcgacaagccccaccgttcccgcacaaacaattgcttggcccggccctgcgtgtcacggacgggagggcgcactcgccatccatccccgcgcacctaggccagtggcggagtggccaccagtttcctcggctgctcccctcctgcttccccgatgacacagctggacctggacagcccacagctcacaagggatgaccaaaacccccaacccaaaaaccctagcgaccagccacattgataacctccgccgccgccgacgtcgatgcccaggctctccctcaccgtcactgacgccgccgctgccatgccctttgcgctccggcttggtggttccccagcgctccgcccgggcccgcggtccccgtcgtggctgcgctttggcggcatggccggggcgcggagggcgctgttctgctccgccgaggacgccaggcggtgtggctcggacgactacgcggaggcggaggagggtcggaggggaggcgggagccgcgtgccatcggagaggaggataaggggcgggaatgcggccgccgcggtggggacgagcgtcgagctactggggattcctggtgtggggccgcgcaaccttaggaagctcgtggacaatggcttcgagggcgtcgcgcagctcaagcagctctacagggacaagttctttggcaagtctagtgggcagatggtggaattcttacagtgttctgttggcattgtacataagaatcatgctgagagtataacctcattcattaaagagagtattgatgaggagctgaaagatacagattcatctaaacccactcagaagaagaggctaaccttttgtgtggaagggaatatcagcgttgggaaaaccactttcctccaaagaatagctaatgagacaattgaactgcgtgatcttgtagagatagttcctgagcctattgataagtggcaagatgttggccctgatcacttcaatatattggatgccttctacgctgagccacataggtatgcatacacttttcaaaactatgtgtttgtgacgagagtcatgcaagaaagggaatctcaagctggaataaagcctctcagactgatggaaagaagtgtattcagtgataggatggtattcgtccgtgctgttcacgaagctaattggatgaatgagatggagatcagcatctatgattcctggtttgatccagttgtgtcatcactcccaggtctcatccctgacggatttatctatttaagagctagtccagatacttgccacaaaagaatgatgcataggagaagatcagaggaaggtggtgttacacttgattacttgcaaggtttgcatgagaagcatgagagctggttgcttccttcgaaagggtcgggtcctggtgtattatcggtcagtcaactccccatgcatatggagggctccttgcctccagaaatacgggatcgtgtattttacctggaaggaaatcacatgcactctagcatccagaaggttcctgctctcatcatggattgtgaaccagacattgatttcagcaaagacatagaagctaaacggcaatatgctaggcaagtcgcagagttctttgaattcgtgaagaaaaagcaggaacgagctccatctgggcaaacaagcaatgacaaggaccggatgaacccacaggtattgcttcctaacagcggccgcctgtgggcccctaaaggcaacccttttgcaggctcccccgtgaatctggatttcaaaagagccatgtcttcgtacctctcaacttaggactcccagctgctataagaaaatcagctgtcctcgctcactgaccttgcaaacagcctatgcatttaggtactatgcatttaggtagtgtttggtttcggagtatggtaggacagagtcgctctgcttttaatttgttgctgtctggattgattctacataggacagagtggctctaaaaaagaaacaatatgtccaaatgttgaaccaactggttttccaaaatctcccagacggagccgctttctagtatagagccgctctatcccaactggctctggaaccaaacactatattagttcacccttaggtcgcccgatgctagctactgatgtaaaataggatgcttccccttgtgtaaattatgatcttagcgctagttccacgttttgcagcactagcatcagcctttatcaggccagatcggacgacaggtctaatctgtgtcgtagtttctttgcttgaatcattctgtggaacatatttgtgtagcgcgtgtgctgcgtcgacttgcactatgtgtggaacattcctggtgatatcatgttatgcgtttgttcaccttgtgtcatgttatggaagattcacctgctttgggccgcctcgatgattgaccgaggagccgttcaaaattgaaatgcttgtgttggtcattgtgaaacgtgcgcgctgcagtccgcgaacccgcggtgttggcagattaaggttgtgattgacttgtcttttggctttgacttttgtcccctaaaagctaaacgaggaaataactttttctaaagcgattttctggcagtgtaaaattgaaattatctcgggttctccttttagcggcttttagatggaattgcaaaaatttatatatatatgtacgaattgtggattttaatgagttctactaaacggttttagaatttttaacaactcagtgcacacgggctttttccacgggccaaccaaacaaaccctaacattcaacttccgaatttgtatgtggcctctgatcatgttctgatctgatgccttgtgtcttggggccgtcatcccggtaatctacccaaataaatttgagtacaagacaattctttttttcagtccaacaaaattacatctttttcgggctaaaaccatccaaagaaaataaacgtgtggaggccgaaaaaataacccagaaacatcgggctcctccagcgcctctcgcatgtccctctcggttgccgcggcgatcgcaatcccgaatcccctagcgccgtctagccgatggcacccagttccgcgtacttctgcagcagcgctgtgccgctgtggacgacatgctcgccgaggcgccaccgtccatgctgagcgacggcgggagcagcgggttggcggaggtgtcatcgaacatggtggggagcatgagcatcgtcagacctgagctatgggctcttgcgtcttggtgtaaagtgtgaagttgtcggagtcgaggtcgtcggcttggggcggtgtcagcgcgcgaggtggtgggcagggcttgcccctggaggccactggcctggccaccatcgccatgttcacgggtttggatagcagctagcttgctgttctcctggggaagccgtcacgtttaccaaaacaagatgtttaccactgaaaaagatattatatcatgcagtctacagg

SEQ ID NO: 3022 - DNA, 1943 bp, Saccharum officinarum
gcgaaaacccccaacccagaccctagcgaccagccacattgatgacctccgccgccgccgacgtagatgcacaggctctccctcaccgtcattgacgccgcctccgccaccgccgccgctatgccctttgcgctctggttcggtggatccccagcgctccgcctcgccgccgcgcgccgccgcccgggcccgcggcccccggcgtggctgcgctttggtggcggggccggggcgcggaggctgctctgctccaccgaagccgctaggaggggtggcggtgacgaggatgcggaggcggaggcggaggagggtcggaggggaggcgggagccgcgtgccatcggagaggaggatgaggggcggggggaacgcggctgccgcggtggggacgagcgtcgagctcctggagattcctggtgtggggccgcgcaaccttcggaagcttgtggacaatggcttcgagggcgtcgcgcagctcaagcagctctacagggacaagttctttggcaagtctagtgggcagatggttgaattcttacagtgttctgttggcattgtacataagaatcatgctgagagtataacctcattcattaaagagagtgttgatgaggagctgaaagatacagattcatctaaacccactcagaagaagaggctgaccttttgtgtggaagggaatatcagtgttgggaaaaccactttcctccaaagaatagctaatgaggcaattgaactgcgtgatcttgtagagatagttcctgagcctattgataagtggcaagatgttggccctgatcacttcaatatattggatgccttctacgctgagccacataggtatgcatacactttccaaaactatgtgtttgtgacgagggtcatgcaagaaagggaatctcaaactggaataaaacctctcagactgatggaaagaagtgtattcagtgataggatggtattcgttcgtgctgttcacgaagctaattggatgaatgagatggagatcagcatctacgattcctggtttgatccagttgtgtcatcactcccaggtctcatcccagatggatttatctatttaagagctagtccagatacttgccacaaaagaatgatgcataggagaagatcagaggaaggtggtgttacacttgattacttgcaaggtttgcatgagaagcatgagagctggttgcttccttcgaaaggatcaggtcctggtgtattatcggtcagtcaactgcccatgcatatggagggctccttgcctccagaaatacaggatcgtgtgttttacttggaaggaaatcacatgcactctagcatccagaaggttcctgctctcatcttggattgtgaacctgacattgatttcagcaaagacatagaagctaaacgacaatatgctaggcaagtagcggagttctttgaattcgtgaagaaaaagcaggagcaatctccatccgagcatacaagcaatgacaaggaccgcatgaacccacaggtattgcttcctaacagcagccgcttgtgggggtccctaaaggcaacccttttgcaggctctccaatgaatctggatttcagaagagccatgtcttcgtacctctcaacttaggactcccagctgctaaaagaaattagctgtcctcgctcactgaccttgcaaacagcctatgcattaagttcaaacttaggtcgcccgatgctagccactgatgtaaaataggttgcgtctcccttgtgtaaatatgatcttagcgctagttccacgttttgcagcactagcatcagcgtttatcagatctcattggttgacaggtctaatctgtaccgtagtttctttgctcgaatcattctgttgaacgaatttgtggagtgcgtgtgctgcttcgacttgtactatgtgtggaagaattctgatgatgcctatgtatgcgtt

SEQ ID NO: 3023 - DNA, 1701 bp, Pennisetum glaucum
gcgcggaggggtctgctctgctccgctgaggccgccaggcggggcgccgatggcgaggacgcggaggcggaggaggggcggagggcaggcgggagccgcgcggcagcggagaggaggatgaggggcgggagcgcggccgccgcggtggggacgagcgtcgagctgctggcgattcccggtgtggggccgcgcaacctcaggaagctcgtggataatggattcgagggcgtcgcgcagctcaagcagctctacagggataagttctttggcaagtctagtgagcagatggttgagttcttacagagttctgttggcattgtacataagaaccatgctgagagtataacatcattcattaaagagagtgtcgatgaggagcagaaggatacagattcatctaaacccactcagaagaataggttgaccttttgtgtggaagggaatattagtgttgggaagaccactttccttcgaagaatagctaatgagactattgaactgcgtgatcttgtagagatagttcctgagcctattgataagtggcaggatgttggacctgatcacttcaatatattggatgccttctatgctgagccacataggtatgcatatactttccaaaactacgtgtttgtgacgagggtcatgcaagaaagggaatctcaagctggaataaaacctctcagactgatggaaagaagtgtattcagtgatcggatggtatttgtccgtgctgttcatgaagctaattggatgaatgagatggaaatcagtatctatgattcctggtttgatccagttgtctcatcactcccaggtctcattccagatggatttatctatctaagagctagtccagatacttgccacaaaagaatgatgcatcgcagaagatcagaggaaggtggtgttacacttgactacctgcaaggtttgcatgagaagcatgagagctggttgcttccttcaaaaggatcaggtcctggtgtattatcagtcagtcaactgcccatgcatatggaaggttccttgcctccagaaatacgggatcgtgtattttacttggaaggaaatcacatgcattcaagtatccaaaaggtccctgctcttatcttggattgtgaacctgacattgatttcaacaaagacatagaagctaaacgacaatatgctcggcaagttgcagagttctttgaattcgtgaagaaaaagaaggaagaagctccgtccgatcaaacaaacactgacaaggaccggatgaacccgcatgtcatgcttcctaacagaggtcggctatgggtccctgatggcaaccccttcgcaggctccccaatgaatctggatttcagaagagccatgtcttcatacctctcaacctagcactcagctgcagaaataaactagctgccctcgctcagtgtcactgacctctcaacgcaaaccgcttgctatgcctcaagttaaaccctaggcggcccgatgctagccactgatgtaaaatagcccggctgtgtccccgtcgtgtaaattactatgttagccctagtcccacgttttgcatcctcctgtctgacttgatccgatggcgggtcgatctgtaccttatgctcgctttcttgaagcattctgttgaacagatctggagtctgggacgagaacacgtgcatgtgctgcctggacctctacttgtgtcatgaaatg

SEQ ID NO: 3024 - DNA, 2031 bp, Oryza sativa
cgagtcccgacgacgcctcgactcgcaaggggataacaccaaaaccctcccccctccaaaccctagtcccccattgatgacctccgccgccaccgccgtagatgcacaggctctccttcctccaggccaccatcattgacgcgccgctgctcctctcctccgcctccatggccaccgtgccggcgctgcggctcggctcccccgccgcgctcctcgccgcgcgccgcccgccgcggtggctgcggtgcggcggcggcggtgtcgggggagggggagggggagtgggagtggcgcggagggggatggcgtgctccgtggaggccttggcgaggcgcggtgggggcggcgagtcggagtcggagaatgaggaggaggaggagaagcggaggggcagggcgggggagaggaggctcagaggcggcgggagcgccgcggcggcggcggcggcggcggggagcggggagctcctctccatccccggcgtggggcctcgcaaccagaggaagctcgtggacaacggattcgagggcgtcgcgcagcttaagcagctctatcgggataagttctttggaaaatatagcgagaagatggttgagtttttacagagctcggttggcatcattcataagaaccatgctgagagtataacttctttcattaaggagagtgttgatgaggagctgaaggatgcagactcatctaaggcttctcagaagaagaggctcaccttttgcgtggaagggaatattagtgttgggaagtctacctttctccaaagaatagctaatgagaccatcgaactgcgtgatcttgtagaaatagtgcctgaacctgttgctaagtggcaggatattggccctgaccacttcaatatattggatgctttctatgctgagccacataggtatgcctatacctttcaaaattatgtgtttgtgacaagggtcatgcaagaaagggaatcttcaggtggaataaaacctctcagactgatggaaagaagtgttttcagtgataggatggtatttgttcgtgctgttcatgaagctaactggatgaatgagatggagatcagcatttacgactcatggtttgatcctgttgtgtcatcgcttccaggtcttatccctgatggatttatctatctaagagctagcccagatacttgccacaaaagaatgatgctccggaaaagagcagaggaaggtggtgttactcttgactacttgcaaggtttgcatgagaaacacgagagctggttgcttccttcaaaaggaggaggtactggtgtgttatctgtcagtcagctgcccacacatttggaaggttccttgcctccagcaattcgagatcgtgtcttttacttggaaggagatcacatgcactcaagcatccagaaggtccctgctctggtcttggattgtgaacctgacattgatttcaacaaagatatagaagctaaacggcaatatgctcagcaagttgcagaattctttcaatttgtgaagaaaaagaaggaagctccatctgaacaaacaagcactgacaagaaccgtatcaatccacagatcatgcttcctcacaaaggcggattgtgggttcctgatggaagaaaccctttctcaggatctgctatgaatctgaacttcagaagagccatgtcttcctatctctcgacataggatttcagctccagaatgaacgtaggatcttacaaatcccactctcactgaccttgtaaatgggcctatgcgttaagttaaacctaggtatgttagccactgatgtaagatagtctgccaccgcatctccatcttttgtaaatgatcatcttccaccctttccgagttccatgttttgtagtagcgtcagcttccgtttgtctgagttctggtatctgtatcgttatgttggttgctgactacattctgttagatgatccggaactctttgacatttctgggaaagatgcttcagtacttgccgtttgtttgtcatcaaggttgccatgattggtcatgcatttgttcc

SEQ ID NO: 3025 - DNA, 2271 bp, Hordeum vulgare
gacagtcacaggccgcgggggataactcctagccaaaaccctccccaaaccctagctagcccccacccgcacccacccattgatgaccgccgccgccgccgccgccgtagatgcacaggctctccctcctccccgccgccgcgtccaccttcattgacgccgccacggcgccctttctgctcccctcctcctccatgccctccctccgcctcggctcccccgcgcggctcctcgccgcgcgccggggcccgccgccgtcgctgcgctgcgcagggggggcgaggaaggggacgttctgcaccctcgaggcggcctccaggcgcgggggggacgccgccgggtcagaggaggagaggcggggcggggacgggccccgcgcggtggccgagaggaggctgcggggcgtcggcgccgtggccggcagcggggagctcctcgccatccccggggtcggcccgcgcaacctcaggaagctcgtcgacaacggcttcgagggcgtcgcgcatctcaagcagctctacagggataagttctttggaaagtctagtgagaagatggttgagttcttgcagagctcagttggcatcatacataagaatcatgctgagagtataacttcattcatcaaagagagtgttgttgaggagttagaggataccaactcatccaagcctcctcagaagaagaggctaaccttttgtgtggaaggaaatatcagtgttggaaagagcacctttctccagagaatagctaatgagactattgaactacgtgatcttgtagaaatagtacctgaacctgttgctaagtggcaggatgtcggccctgaccacttcaatatactggatgcattctatgccgagccccaaagatatgcttacacattccagaactatgtctttgtgacaagggttatgcaagaaagggaatcttcaggtggcatcaaacctctcagactaatggaaagaagtgttttcagtgacaggatggtatttgtccgtgctgttcatgaagctaactggatgaatgagatggagatcagcatctatgattcctggttcgatccagtggtgtcatcgctcccaggccttattccagatggatttatttacttaagagccagcccagatacttgccataaaaggatgatgctccgaaaaagatcagaggaaggtggtgttagccttgactacttacaaggtttgcatgagaaacatgagagctggctatttccttcgaaaggaggaggcagtggtgtattatcagttagtcagctgcccacgcatatggatggctccttgcctccaggaatacgggatcgtgtcttttacctggaaggagatcacatgcattctagcatccaaaaggttcctgctctggtcttggattgtgaacctgacattgatttcaacagagacatacaagccaaacgaaaatatgcccagcaagttgcggagttctttgaattcgtgaatagcaaaaaggaagcgccatccgagcagacaagcactgagaaggaccgcatgaatcccaagatcatgttccctaacagaggtggtttgtgggtccctgacggcgtgccacctttcgcaggctctgcaatgaatctggatttcagaagggccatgtcttcatatctcccaacttgagacttcagcttcgaaactacccgggcctgtttggttgaatgctaaaaaagtcataatcatgctaacttttttcggaaatgagcctacttgcggccaagggagaaaagaaagagccacaagtgtggcatgctgagctatacgatgaccaagtctaatgacacacgtgccatgaggctaagcaagttgtgacagtcaaccaaacacaagaccctcagctcactgaccttgtaaaaatcgctgatgtttttccgtagacttgttagttcgcctagtgcctagccgacgatgtagagtagtagtgtgtctgcgcctccgtcttgtaaattggccctctcactggtagtttcatattccgtggtagcacgagcttctgtttgtctgcactatggtggtgtaccgcatgttttgttgctggctgcattctgttcggaggtttcagaactgttacaccgtcgttggcttagcacgttgtccacttgcttcttgttgtgattgtcatctggaatgttacctacctgtgcgtcatgtgtttggttcaaaaaatgtcgccggacgtgttactcaggattaactttacagaaagattctttggacagttgtaaaatattgtggctgcttgatt

SEQ ID NO: 3026 - DNA, 2516 bp, Brachypodium distachyon
agaccgctgcctcggcctcctcccctcccgcttcccgacgacacagctcacagacggggataactccgaaccaaaaccctccccaaaccctaggacccccccccccccccacccccacccattgatgacctccgccgccgccgtagatgcacaggctttccctcctccccgccgccgccgcagcatccaccttcattgacgccgcctccatcgccacggcgccactcttgctcccgtcctccatgccctccctccgcctcggctcccccgccgcgctcctcgccgcccgccggggcccgcgcccgccgccgtggcttcgctgcggcggtgggggagcgaggaggggcatgttctgctccgtccagcccgcgaggcgtgaggacggcgaggcggaggaggagaagcgaatgggagccggagctcgcgcggcggcggagaggaggctcaggggcgggaatgccgtgccggggagcggggagctcctcgccattcctggagtcgggccgcgcaacctgaggaagctcgtcgacaatgggttcgagggcgtcgcacatctcaagcagctctacagggataagttctttggaaagtctagtgagaagatggttgagttcttacagagctcggttggcatcatacataagaaccatgctgagagtataacttcattcattaaagagagtgttgttcaggagctagaggataccaattcatgtaagcctcctcgcaagaagaggctaaccttttgtgtggaaggaaatattagtgttgggaagagcaccttcctccaaagaatagctaatgagactattgaactgcgtgatcttgtagaaatagtacctgaacctgttgcaaagtggcaggatgttggccctgatcacttcaatatactggatgccttctatgctgagccccaaagatatgcttacacgttccagaactatgtgtttgtgacaagggttatgcaagaaagggaatcttcaggtggcataaaacctctcagactaatggaaagaagtgttttcagtgacaggatggtatttgtccgtgctgttcatgaagctaactggatgaatgagatggagatcagcatttatgattcctggttcgatccagtggtgtcatcgctcccaggtcttattccagatggatttatttatttaagagccagcccagatacttgccataaaaggatgatgctccggaaaagatcagaggaaggtggtgttagtcttgactacttgcaaggtttgcatgagaaacatgagagctggctatttccctcgaaaggaggaggccgtggtgtattgtcagttagtcagctgcccacacatatggagggctctttgcctcctggaatacgggatcgtgttttttacttggaaggagatcatatgcactctagtatccagaaggtgcctgctctggtcttggattgtgaacctgacattgatttcaacaaagatatacaagcgaaacgacagtatgctcagcaagttgcagagttctttgaattcgtgaatagcaaaaaggaagatccatctgagcaaacaagcactgagaaggaccgtatgaatccagagatcatgtttcctaacagaagtggtttgtgggtccctgaaggtgtgccaccttttgcaggctcagcaatgaatctggatttcagaagagccatgtcttcatatctctcaacttaagagctaagacgcttcaaaagtacttgggcctgtttggttaaagaagaaagtcataagcatgctaacttccccctacaggcctacttatggccaaggaaaaaagaggacgagtctggcacatgggcgatgaggctaagaaagtgtggcaagccgtatttgcagtagtgaaccagacacaagacactcaactcactgaccttgtaaaaatcgctgatgcttctctctagacctagcttgccagatgctagcgtatgatgtagaatagtctgtctccgtatctccatcttttgtaaattggtgatcaagctggtagtttcacgtttgtggtagcatcagctcctgttcacaagtatcgtgaggaggatgttgggttgctggctgctatcatgttgaaaaaagaagaaaagattcagaactacgacgttgttagctagagatgctgtgtgtacttgtgtgctttctgtttattatctggatggtcgcctgttagtcatgcatatgtttcccaactgttgcggaccgtgttactcacgactgacattagggcaagatactttggacccttcctaaaagattgagatcggacgagtatgtttggatggtgaccaaagcccatcctaccaaggctttagtcgtcttgacgaaaacttggtcaaatgaactaatatttcggcaaagccacaattttttggcaaatcaatgcttcttggtaaattttggtttattttccttgtcaaactgaaaactcattggtaactgaaacattcacattgaacaagaaaatatttagcacggcaaatatgtgctaggatgttgggc

SEQ ID NO: 3027 - DNA, 2123 bp, Secale cereale
tcgtcgtagatgcacaggctctccctcctccccgccgccgccgcagcgaccaccttcattgacgccgccacggcgcccttcctgctcccctcctcctccatgccctccctccgcctcggctcccccgcgctcctcgccgcgcgccggggcccgccccctggctgcgctgcgctggcggcggggccaggaggggcgcgttctgcacctcgaggcctccaggcgcgcggacggcgggtcggaggacgagaagcgcggcggggacgggccccgcgcggtcgccgagaggaggctgcggggcttcggcgccgtggccggcagcggcgagctcctcgccatccccggcgtcggcccgcgcaacctcaggaagctcgtcgacaacggcttcgagggcgtcgcgcatctcaagcagctctacagggataagttcttcggaaagtccagtgagaagatggttgagttcttgcagagctcggttggtattatacataagaaccatgctgagagtataacttcattcattaaagagagtgttgttgaggagttggaggataccaactcatctaagcctcctcagaagaagaggctaaccttttgcgtggaaggaaatatcagtgttggaaagagcacctttctccagagaatagctaatgagactattgaactacgtgatcttgtagaaatagtacctgaacctgttgctaagtggcaggatgttggccctgaccacttcaatatactggatgccttctatgctgagccccaaagatatgcttacacgtttcagaactatgtgtttgtgacaagggttatgcaagaaagggaatcttcaggtggcatcaaacctctcagactaatggaaagaagcgttttcagtgacaggatggtgttcgtccgtgctgttcacgaagctaactggatgaatgagatggagatcagcatctatgattcctggttcgatcctgtggtgtcatcgctcccacggtcttatcccagatggatttatttatttaagagccagcccagacacttgtcacaaaaggatgatgctccgaaaaagatcagaggaaggtggtgttagtcttgactacttgcaaggtttgcatgagaaacatgagagctggctgtttccttcgaaaggaggaggccgtggtgtgttatcagttagtcagctgcccacgcatctggagggctccttgcctccaggtatacgggaccgtgtcttttacctggaaggagatcacatgcattctagtatccagaaggttcctgctctggtcttggattgtgaacctgacattgatttcaacagagacatacaagcgaaacgacagtatgcccagcaagttgcagagttctttgaattcgtgaacaacaaaaaggaagctccatccgagcaaacaagcactgagaaggaccgcatgaatccaaagattatgttccctaacaaaggcggtttgtgggtccctgaaggtgtgccgcctttcgccggctctgcaatgaatctggatttcagaagagccatgtcttcatacctcccaacttaaggccccagcttcggaagtacctgggcctgtttggttgaaggctaagaatgccataatcatgctaactttttgtcgaaatcgtctcatggccaaggagaaggagccacaagcacggcaagcttagctaaaaagaccagtgcctgtgacagacgggccatgaggctaagcaggctgtggcaagccatagttgtggtaggcaaccaaacacaggactcagctcactgaccttgtaaaaatcgctgatgcttttcgctagacctgttagctttgcctgatgctagccgatgatgtagaatagttgtaaattggcgatctcgctggtagtttcacgttctgtggtagcagtagcctatgtttatctgaaccatggtgaggaccgatgtgtgtaccgcatgttttgttgctggctgcattctgttcagaagattcagactgctacaaatgcgctgtccacttgtttactgtgattttgtcatctggagtttacctgtgtgtcatgcgtaaggtttaaaatgtggagagcttcacttatttcgcttgctaagatacgtgactacatcgtatgtatattaatttaaa

SEQ ID NO: 3028 - DNA, 2302 bp, Panicum virgatum
cggcccgcctcgtctaagcgatttgatttcccgtggaccacgacgacacacgtcgtccccgtagaccgcgccattctctcctttgctcctcggctcctcctccgggcctcgggacgaagacagcaacagcctgagactactcatggcgagatggatgtgacacgcccaaaaccctaaacccacgccactcggagccgcccccgccgcccctgcgtgggcaggtggcctcaatcgctgccgaacctccgttgatgggaccctcccctgccgtcgcctcagccagcgatgcacaagctcctcccccgcgcagcctccatcctcgacgccgccgccgcggctccactgcttctctcctcaccacgcctgcccgcgctacgtctggcctgcagcccgtttctagccgcacgcccgggcgcaaaccctagcggcacccgcacctcacagtggctgcgctgtgacggccagaggaggaggggactctgctccaccgaggcggcgaggcgcgggggcgatacggaggagggggagaagggtcgcgcggtgccggagaggaggcagcgaggtcggagtgatgcactggcgggaagtggggagctgcttgccattcccggggtgggaccgcggaacctgaggaagctcgtggacaagggattcgatggcgtcgcgcagctcaagcagctctacagggataagttctttggcaagtctaaggacaggatggttgaattcttgcaaaattcagttggcatcattcacaagaaccatgctgagagtataaccttgttcattaaagagagtgttgatgaagagctgaaaggcatcgatacatctaagcttcctaaaaggaggctgaccttttgtgtggaagggaatatcagtgttggaaaaactaccttccttcaaagaatagccaatgaaactattgaactacgtgaccttgtagaaatagtacctgaacctattgcaaagtggcaggatgttggccctgaacacttcaatatacttgatgctttctatgctgagccagagaggtatgcatacaccttccagaattatgtatttgtgacgagggtcatgcaagagaaggaatctgcaagtggaataaaacctctccgactgatggaaagaagtgttttcagtgatcgaatggtttttgttcgtgctgttcatgaagcaaactggatgaatgagatggagatcagcatctatgactcctggtttgaccctgtcgtgtcatcactcccaggtcttatccctgatggttttatttatctaagagctagccctgatacttgccacaaaagaatgatggtgcggaaaagagcagaggagggtggtgttactcttgattaccttcgaggtttgcatgagaaacatgagagctggctgcttccttccaagggaggaggttctggtgttttgtcagtcagtcagcttccagttcatttggagggctccctgcctgtggatatacgagatcgggtattttacttggaaggagatcacatgcattcttgtatccagaaggttcctgctctggtcttggattgcgaacatgacattgattttaacaaggatattgaagccaaaagacaatatgcccggcaagttgcagagttttttgaatttgtaaagaaaaagaacgaatcttcaacagagacgactgatggtgataagagtacaaacaaacagattatgcttcccaagggaggtggcttgtgggtacctggaaacagccctctaccagaatcagctctgaagtcctttgatttcaggaggacaatgtcttccttcctctcaacttagggggtttaacgtctgatatgtgccatcagtttctgccgacaacctgaattcatgtggtgcatcaatgcatctcgattgtagaatatataggatttttttaaaaaaaaatacatatataggatcttttaactgacgaccttgtaaatgtctaaagattacatgcaaagttagggttttagctagggctagcgtgcgatgtatagttcgtatccaactctgtttgcctgtaaatgtgatcggtctgctttcgtgacagtatatacttggtgctttgggcctttggggtggcatggcatgtgcggaactgtctttatttgtggtgttgcagcagaatctcccttcaccggttagtggttacttgtgacggcccaaatgtttgatgcgctgtggacctgtggtgctgccttaggttatctccaaccattctcccatccaactccccccaaacgtactatttactatattttactatcttccttcaaaagattcctccccc

SEQ ID NO: 3029 - DNA, 1824 bp, Pennisetum glaucum
cgccgcggaggcccccctgctgctctcctccccacggatgcctgcgctgtgcctgcccggcagcccgttcgcgaccgcgcgtccattcgcgggccctagccgcgtccgctccccgctgtggctgcgctgtgacggcgggaggaagggactctgctccgccgaggcggcgaggcgcgcgggtgacgcggaggaggagaaggagaagggtggtgggggtagcgcggtgccggagaggaggcagcgaggtcggagtgatgcactgggggaaagtggggagctgcttgccatccctggggtcgggccgcggaacctgaggaagctcgtggataagggattcgatggtgtcgcgcagctcaagcagctctacagggataagttctttggcaagtctagtgagaagatggttgagttcttgcgaaattccgttggcatcattcacaagaaccatgctgagagtataaccttgttcatcaaagagagcgttgatgaagagctgaaaggcactgatgcatctaagctcccaaaaaataggaggctgaccttttgtgttgaagggaatatcagtgttggaaaaactacctttcttcaaagaatagctaatgaaactattgagctgcgtgaccttgtagaaatagtacctgaaccaattgcaaagtggcaggatgttggccctgaacacttcaatatacttgatgcttactatgctgagccagagaggtatgcatacaccttccagaattatgtatttgtgactcgggtcatgcaagagaaggaatctgcaagtggaataaaacctctccgactgatggaaagaagtgttttcagtgatcgaatggtttttgttcgtgctgttcatgaagcgaagtggatgaatgagatggagatcagcatctatgactcctggtttgaccctgtcgtgtcaacactcccaggtcttgtccctgatggttttatttatctaagagctagtcctgacacttgccacaaaagaatgatgacgcggaaaagatcagaggaaggtggtgttactcttgattaccttcaaggtttgcatgagaaacatgagagctggttgcttccttccaagggaggaggttctggtgttttgtcagtcagtcagcttccagttcatttcgggggctccctgcctgcggatatacgggatcgggtattctacctggaaggagatcacatgcattctagtatccagaaggttcctgctctagtcttggattgtgagcatgacattgattttaacaaggatattgaagccaaaagactatacgcccggcaagttgcggagttctttgattttgtgaagaaaaagaaggaatcttcaacatcagagacggttgatggtgataagagtgtaaacaagcagattatacttccccaaagtggtggtttgtgggtacctggaagcagccctttaccagaatcagctctgaagtccttcgatttcaggaggacaatgtcttccttcctctcaacttagggttggttaacacctggcgtgccataccggcataccgcccccagtttctgggcacaacctgaattcacgtggtccatcaacacatctcgattgcagaatagtatgtataggatcttttatctgacgaccttgtaaatatctaaagattacttgcaaattaggggtttagctagtgctagcgtgcagtgtatagtccgtatccaactcggtttgcctgtaaatgtgatctgactgctttcgtgacagtactcggtagtactttgggggtggcatcagtccatcacatgtgccgaactttgtgctttctcggtgttgcagcacaatctcat

SEQ ID NO: 3030 - DNA, 2276 bp, Sorghum bicolor
taagcgattcgatttctcgtggaccacgactcacgttggcgtcgtagaccactcgtgcgccaattcctcctccccctcctgctccccgacaaggcagcagcaacaacctgattacctgactcatggcgggacggatgacatccccaaaaccctaaccccgcgccactcgccgtcacagccgcacccgcgtgggccggcccagcggcctcaaccggagccgaagcgccattgatgagcccagagcctgccgtcgccgcagccagcgatgcacaagctcctcccacgcgccgcctccttcctcgacgccgcggcccccgtgctgctctcctccccacgcatgcccacgctgtgcctggttggtagcccgttcgtacccgcgtgctctggcgcaaactctggccgcatccgctcgccgccgtggctgcgctgtgacgctgggaggaggcggggactctgctccgccgaggcggccaggcgcgggggcgatacggaggagagggagaagggtggcgggggtggcgcggcgccgcagaggaagcagagaggtcggagtgatgcgctggtgggaagtggggagctgcttgccattcccggagtcgggccacggaacctgaggaagctcgtggacaagggattcgatgacgtggcgcagctcaagcagttctacagggataagttctttggcaagtctaatgagaagatggttgagttcttgcaaaattcagttggcatcattcacaagaaccatgctgagagtataactttgttcattaaagagagtgttgatgaagagctgaaaggcactgatacatctaaccttcctaaaaataggaggctgaccttctgtgtagaagggaatatcagtgttgggaaaactaccttccttcaaagaatagccagtgaaactattgaactacgtgaccttgtagaaattgtacctgagcctattgctaagtggcaggatgttggccctgaacacttcaatatacttgatgctttctatgcagagccacagaggtatgcatacaccttccagaattatgtatttgtgacaagggtcatgcaagagaaggaatctgcatgtggaataaaacctcttcggctaatggaaagaagcgttttcagtgatcgaatggtttttgttcgtgccgtgcatgaagcaaactggatgaatgagatggagatcagcatttatgactcttggtttgacccagttgtgtcatcactcccaggtcttatccctgatgcttttatttatctaagagctagccctgatacttgccacaaaagaatgatggtgcgaaaaagatcagaggagggtggtgttactcttgattaccttcgaggtttgcatgagaaacatgagagctggttacttccatccaagggaggaggttccggcgtgttgtccgtcagtcagcttccagttcatatggagggctccctgcctgcggatatacgagatagggtattctacttggaaggagatcatatgcattcaagcattcagaaggttcctgctcttgtcctggactgcgaacatgacattgattttaacaaggacattgaagccaaacagcaatatgctcggcaagttgcggagttctttgaatttgtgaagaaaaagaaggaatctcctacagcagagatgactgatggcaataacaagagtatcaacaaacagattgtgctgccgcacagaggtggtttgtgggtgcccggaggcagcccattaccagaatcagctctaaagtcgtttgatttcaggagaacaatgtcttccttcctctcaacttaagggggctaggcgctatcaatttgtgcccacaccctgaattggtgcgctccagcaatgtatctcgattgcaaaatgtatagacctttaactgtcgaccctgtaaatgtgtaaagattacatataaatttaggctttttagatggtgttggcgtacaatgtattatactagtggtatccaactcttgcctgtaattgttgatcgtgctgctttctgtttgcctgtaaatgttgatcgagtgctttctgtttgcctgtaaatgttgatcgagctgctttcgaggcagtacttgctaaatttgggggtggcatcagaggcgcagaacttttttgttttatcttggcctttgcgccacaagcttgtggcttggtccaatcgtgccttgttattttgtgggttcagtactgtgcttcactcttacagaaattgtaagtgaaaccatgaattttatcagtgtttggttgttctactggaccacta

SEQ ID NO: 3031 - DNA, 2599 bp, Zea mays
ggaggttgaggaggaggcttttgcgcgatggcaaagccacgccgcgcgtttatgtttgtgtgggctgcgaagggaattcgatgcgctgcgatggggtgggccggtggcggtgaggcatcaaatcgggtggactgcgggttgatgagtaaaaatgtaagagggttttttttgcaaaaaaatgacgcacgacgatcgttgaaactgatgcactgatgctttaagtatagtatagaagtatagatataataaaaactccagacaacgactggttcgccgattccccctccccctccccttctgcccccggcaagacggcaaggcattaacaacctaacctgactcgtggcgggacggatgacatccccaaaaccctaaccacgcgacgctcgccgactcgccgtcacagccgcacctcaaccggagtcgaagcgccattgatgaactccgagcctgccgtcgccgcagctagcgatgcacaagctcctcccacgcgccgcctccttcctcgacgcagccgccgccgccgccgcggcccccctgctgctctccttcccacgcatgcccacgctgcgcctgtctggtagcccgttcgtagccatgcgtcctggcggaaaccctagccgcatccgtgcgccgccgtggctgcactgtgacgctgggtggaggcgaggactctgttccgccgaggctgcgaggcgcgggggcgatacagaggagatggagaaggatggcgggggtcgctcggcgccggagaggaagcagagatgtcggaatgatgcgctggtgggaaggggggagctgcttaccattcccggagtcgggccacggaacctgaggaagctcgtggacaagggattcgatgacgtggcgcagctcaagcagctctacagggataagttctttggcaagtctaatgagaagatgattgaattcttgcaaaattcagttggcatcattcacaagaatcatgctgagagtataactttgttcattaaagagagtgttgatgaagagctgaaaggcaccgatacatctaagcttcctaaaaataggaggttgaccttttgtatagaagggaatatcagtgttgggaaaactaccttccttcaaagaatagctaatgaaactatcgaactacgtgaccttgtagaaattgtacctgaacctattgctaagtggcaggatgttggccccgaacacttcaatgtacttgatgctttctatgcagagccacagaggtatgcatacaccttccagaattatgtatttgtgacaagggtcatgcaagagaaggaatctgcgtgtggaataaaacctcttaggctgatggaaagaagcgttttcagtgatcgaatggtttttgttcgtgctgtgcatgaagcaaactggatgaacgagatggaaatcagcatttatgactcttggtttgacccagttgtgtcatcactcccaggtcttgtacctgatggttttatttatctaagagctagccctgatacttgtcacaaaagaatgatggtgcgaaaaagatcagaggaggctggtgttactcttgattaccttcgaggtttgcatgagaaacatgagagctggttacttccatccaagggaggaggttctggcgtgttgtccatcagtcagcttccagttcatatggagggctccctgcatgcggatatacgagatagggtattctacttggaaggagatcacatgcattcaagtatccagaaggttcctgctcttatcctggactgtgaacatgacattgattttaacaaggacatcgaagccaaacgacaatatgctcggcaagttgcggagttctttgactttgtgaagaaaaagaaggaatctcttacagcagagtcagagacggctgatggtgataagagtataaacaaacagattgtgctgccgcacggaggtggtttgtgggtgcccggaagcagcccgttaccagaatcagctctaaaatcatttgatttcaggagaacgatgtcttcctcgacttaaggtgggcaaacatcccaatggcgctatcaatttctgccgacaacctgcattggtgtggtccagcagcgtatcttgattgatatatatataccctgtaaatatttaaagattatataaagatttaggcttttagctagtgttggcgtacaatgtattatactagtggtatccaactctgttgcctgtagatgatcgagctgctttctgtttgcctggaaatgttgatcgaaccgctttcgagacagtgcttttgtaaatttggggtgcatcataggcgcagaatcttttgttttatcgttgtctcgccgcacaatctcacttctctggtttgttattagttactatgtgtctgattggttattcgcacaatccatatttgagattatgttttgttccttgtatgtagaagtcacagtctatataggtggaaacgaaataaatcattttaatgctactaacctatatccactcgtacgctcaaaattatcgtatctagctaatcagagcggcgccaggctacgtatggacacgtagccatctaatcagcatgtacaatactttctgtcggtggcgaagctagagc

SEQ ID NO: 3032 - DNA, 1695 bp, Panicum virgatum
ggctgcgcaaaccctagcggcgccctctccgcacagtggctgcgctctgacggcgcgagggggaggggtctctgctccaccgaggcggcgaggcgcgggggcaatacggaggaggaggacggggagaagggtcgcgcggtgcccgagaggaggcagcgtggtcggagtgatgcgttggcgggaagtggggagctgcttgccattcccggggtgggaccgcggaacctgaggaagctcgtggacaagggattcgatggcgtcgcgcagctcaagcagctctacagggataagttctttggcaagtctaaggagaagatggttgaattcttgcaaaattcagttggcatcattcacaagaaccatgctgagagtataaccttgttcattaaagagagtgttgatgaagagctgaaaggcatcgatacatctaagcttcctaaaaggaggctgaccttctgtgtggaagggaatatcagtgttggaaaaactaccttccttcaaagaatagccaatgaaactattgaactacgtgaccttgtagaaatagtacctgaacctattgctaagtggcaggatgttggccctgaacacttcaatatacttgatgctttctatgctgagccagagaggtatgcatacaccttccagaattatgtatttgtgacgagggtcatgcaagagaaggaatctgcaagtggaattaaacctctccgactgatggaaagaagtgttttcagtgatcgaatggtttttgttcgtgctgtccatgaagcaaactagatgaatgagatggagatcagcatctatgactcctggtttgaccctgtcgtgtcatcactcccaaggtcttatccctgatggttttatttatctaagagccagccctgacacttgccacaaaagaatgatggtgcggaaaagatcagaagagggtggcgttactcttgattaccttcgaggtttgcatgaaaacatgagagctgtctgcttccttccaagggaggaggttctggtgttttgtcagtcagtcagcttccagttcatttggagggctccctacctgcggatatacgagatcgggtattttacttggaaggagatcacatgcattctagtatccagaaggttcctgctttggtcttggattgcgaacatgacattgattttaacaaggatatcgaagccaaaagacaatacgcccggcaagtagcagatttctttgaatttgtaaagaaaaagaaggaatcttcaacagagacgactgatggtgataataggagtacaaacaaacagattatgcttcccaagggaggtggtttgtgggtacctggaaacagccctctaccagaatcagctctgaagtcctttgatttcaggaggacaatgtcttccttcctctcaacctaggtggtttaacgtctgatatgtgccatcagtttctgcccacaacttgaattcatgtggcgcatcaacacatctcgattgctgaatatatataggatcttttactgacgaccttgtaaatttctaaagattacatgcacagttaggtttttttagctagggctagcgtgctatgtgtagttggtatccaactctgtttgcctgtaaatgtgatcggtctgctttcgtgacagcatatgcttggtgctttgggcctttggggagctttgtgtcaatttgtggtattgtagc

SEQ ID NO: 3033 - DNA, 2366 bp, Brachypodium distachyon
aggctcaagtcccggcctcgcgtagaccactcgtgtcatcgtgtgcactggcaacctctcccttcctcctccggtcctacggtttcccggcaaccccgcgagatgatgtcgccaaaaccctaaacccctcccccgccgccgtcacctgggccagcgccctcccggagctggagctccgctcatgaacccctcccttaccgcctcagccagcgatgcacaagattctccctcgagccgcgtcctaccttgacgcggccgcgggccagccgctgctgtcctcccacatgcccgcgctccgcctggccgggccgtttctcgccacctgctccataccgcgcaccggtctcctccgccagagacagcggccgtggctgcgctgcggcggtggcggcgcggtcgcgaggagggggctctgctccctcgaggcagcgaggcgcggggatgctgccgaggagggagaggagagggttcccggaggaggtgggggtcgtatttcgccggagaggaggcagagaggtcggggcgatgcggcgatgggaagcagcggggagctgctcgccattcctggagtcgggccgcggaaccagaggaagctcgttgacaagggattcgatggcgtggcgccgctcaaggagctctatcgtgataagttctttggcaagtctaatgagaagatggttgagtttttgcaaagttcagttggcatcatacacaagaaccatgctgagagtattactttgttcatcaaagagagcgttgatgaggagctgaaaggcactgatacatctaagcctcgtggaagtaagaggcttaccttttgtgttgaggggaatatcagtgttgggaagtctacattccttcaaagaattgccaatgagactatcgaactacgtgaccttgtggaaatagtacctgaacctgttgctaagtggcaggatgttggccctgatcactttaacatactggatgctttctatgctgaaccacagaggtatgcatacactttccaaaattatgtctttgtgacaagggtgatgcaagagaaggaatcttcaagtggaataaagcctctccggctgatggaaagaagtgttttcagtgatagaatggtttttgtgcgtgctgttcatgaagctaaatggatgaatgagatggagatcagcatttatgactcctggttcgacccagttgtatcttcactcccaggtcttatccccgatggttttatttatctaagagctagccctaacacttgccacaaaagaatgatgattcggaaaagatcagaggagggtggtgttagccttgattaccttcaaggtttacatgagaagcatgaaagctggctacttccgtccaaagggcaaggttctggtgtgttgtcagtcagtcagctcccaattcacatggagggctccctgcacccagaaatacgagatcgagttttcttcttggaaggagatcacatgcattctagtatccagaaggttcctgctttggttctggactgcgaaaacgacatcgattttaacaaggatattgaagctaagcgacaatatgctcggcaagtttcggagttctttgaatttgtgaggaaaaagaatgaagctactgtggagacaagtgacggtgataagagtataagccaaccgattaagcttcccagcaggcgtgatttgtgggtccctggaggcagctctttaccaaaatctgctctaaattctcttgaattcagaagagcaatgtcttccttcctctcaacataagggccgacatcccatgagcaactatcaattgctacgcatggtatggcatctggatctcaaaatacgacctctaactgacgaccgtcgagtgttgtataatcccaaagtctaggatttcatctctactggtagccaacgctgtatgatagtatctagctctgtgtgcctgtaaatactgacctcactacttgtttcgcggtacctggtagtagtagcataaaaaagtaaagaaccatatgttgtttgtatctaagcttcattttgttgtttgtttgcctgggctcgatgatgcaacacatctcttctttacaagaaacagaaccatatttctgaggtctgtctctcctaagtagctgccacgtttgagtgtttgtctgcttgttttccaccgttttagaataccaacaaaaataagatcatcaactggtatctagattttggctggtgagcgaaaggggcactggtccatctatctactttttccctgaagccaatgcgtgataataataatagatagtacaccgtgtaatatggttagtggttggttgtgtactcgcagcataccaacatacagttgcaggtgtcatcctcccagaacag

SEQ ID NO: 3034 - DNA, 1996 bp, Oryza sativa
cttccccttcctccccttccttctcctcacttttcgcggcaacctcagtgaagtcagcgaggtgatagcgccagcaaaaccctgaacccctccaaccaccgcagccgcaattccgccgccgccgcagccacgttggccggcggcctactgggggtgctggaggcgcgattgatgagccctgcagccgacgccgcgggcagcgatgcacaggctcgtaccccgcgccgccgcctccttcctcggcgccccgccgctgctcaccacccaggcgggcccgcttctcgccgcgcgttcgggcccaccaaaccctagccgcctccgcctccgcctctccccgtggcggctgctgcgctcgaggagggggctctcctgctccgccgatgcggcgaagaggtgcggggatgatgatgccgaggaggatggcgagcagagcgtcgccgggggaggtgggagccgtccggtggtggataggaggcagagaagtcggggcgatgcggcgatggggagcggcgagctgctcgcgattcctggagtcgggccgcgcaacctgaggaagctcgtggacaagggattcgatggcgtggcacagctcaagcagctgtacagggataagttctttggcaagtccaatgagaaaatggttgagttcttgcaaagttctgttggcatcatacacaagaatcatgctgagagtataactttgttcattaaagaaagtgttgatgaagagctgaaaggaactgactcaccaaatgtttccaaaaataagaggctgaccttttgtgtggaagggaacatcagtgtcggaaaaactacattccttcaaagaattgccaatgagaccatcgaattacgtgaccttgtagagatagtgcctgaacctattgctaaatggcaagatgttggccctgatcacttcaacatacttgatgctttctatgctgagccacagaggtatgcatacactttccagaattatgtgtttgttacaagggtcatgcaagagaaggaatcttcaagtggcataaagcctctcaggttgatggaaagaagtgttttcagtgatagaatggtttttgttcgtgctgtccatgaagccaactggatgaacgagatggagatcagcatctatgactcctggtttgacccagtggtgtcatcactcccaggacttattccagatggttttatttatctaagagctagtcccgacacttgccacaaaagaatgatggttcggaaaagatctgaagagggtggtgttactcttgattaccttcgaggtttgcatgagaaacatgagagctggctgcttccttccaaaggacaaggttctggtgtattatcggtcagtcaagttccagtccatatggagggctctttgcctccagatataagagaacgagtattctacttagaaggagatcatatgcattctagtatccagaaggttcctgctctggtcctcgactgcgaacatgacattgattttaacaaggatattgaagccaaacgacaatatgcccgacaagttgcggagttctttgaatttgtaaagaaaaagaaagaagatccttctgcggagtcaagtggtggtgataagagtaccaacaaacagattatgcttccccacagaggtggtttgtgggttcccgaaggtaaccctttaccaggatctgctctgaactctctggatttcagaagagcaatgtcttccttcctctcagcttaggggccaacatcccatatgaaatagccaattcctggccaccatatgttccagtattacaaattctgaatggtccatcgtcacatctgcgtctcagatagccttgaactgacgaccctgtaaatgctgaagatttattgaaatataggtttctgtatagcgctagccaatgctgtacaatagtagtatcaaactcgtccatgtaaatgttcactcttcttcgtcgtcaataaaaggcgtccctgtaaatgattatttggctgcttc

SEQ ID NO: 3035 - DNA, 2646 bp, Oryza sativa
ctcttttcatcctcaatcgtcattgataggtgggccactagtccaaattgtaattttgggtaaaaagatctggtgttaaatgaaaatgttgaaccagttcaatgtgaaactacggtcaaaaaatacatggtccaatctgtaatttactaaaaaaaaaatcccgtggaccgctcgtgcaccgcttccccttcctccccttccttctcctcacttttcgcggcaacctcagtgaagtcagcgaggtgatagcgccagcaaaaccctgaacccctccaaccaccgcagccgcaattccgccgccgccgcagccacgttggccggcggcctactgggggtgctggaggcgcgattgatgagccctgcagccgacgccgcgggcagcgatgcacaggctcgtaccccgcgccgccgcctccttcctcggcgccccgccgctgctcaccacccaggcgggcccgcttctcgccgcgcgttcgggcccaccaaaccctagccgcctccgcctccgcctctccccgtggcggctgctgcgctcgaggagggggctctcctgctccgccgatgcggcgaagaggtgcggggatgatgatgccgaggaggatggcgagcagagcgtcgccgggggaggtgggagccgtccggtggtggataggaggcagagaagtcggggcgatgcggcgatggggagcggcgagctgctcgcgattcctggagtcgggccgcgcaacctgaggaagctcgtggacaagggattcgatggcgtggcacagctcaagcagctgtacagggataagttctttggcaagtccaatgagaaaatggttgagttcttgcaaagttctgttggcatcatacacaagaatcatgctgagagtataactttgttcattaaagaaagtgttgatgaagagctgaaaggaactgactcaccaaatgtttccaaaaataagaggctgaccttttgtgtggaagggaacatcagtgtcggaaaaactacattccttcaaagaattgccaatgagaccatcgaattacgtgaccttgtagagatagtgcctgaacctattgctaaatggcaagatgttggccctgatcacttcaacatacttgatgctttctatgctgagccacagaggtatgcatacactttccagaattatgtgtttgttacaagggtcatgcaagagaaggaatcttcaagtggcataaagcctctcaggttgatggaaagaagtgttttcagtgatagaatggtttttgttcgtgctgtccatgaagccaactggatgaacgagatggagatcagcatctatgactcctggtttgacccagtggtgtcatcactcccaggacttattccagatggttttatttatctaagagctagtcccgacacttgccacaaaagaatgatggttcggaaaagatctgaagagggtggtgttactcttgattaccttcgaggtttgcatgagaaacatgagagctggctgcttccttccaaaggacaaggtcctggtgtattatcggtcagtcaagttccagtccatatggagggctctttgcctccggatataagagaacgagtattctacttagaaggagatcatatgcattctagtatccagaaggttcctgctctggtcctcgactgcgaacatgacattgattttaacaaggatattgaagccaaacgacaatatgcccgacaagttgcggagttctttgaatttgtaaagaaaaagaaagaagatccttctgcggagtcaagtggtggtgataagagtaccaacaaacagattatgcttccccacagaggtggtttgtgggttcccgaaggtaaccctttaccaggatctgctctgaactctctggatttcagaagagcaatgtcttccttcctctcagcttaggggccaacatcccatatgaaatagccaattcctggccaccatatgttccagtattacaaattctgaatggtccatcgtcacatctgcgtctcagatagccttgaactgacgaccctgtaaatgctgaagatttattgaaatataggtttctgtatagcgctagccaatgctgtacaatagtagtatcaaactcgtccatgtaaatgttcactcttcttcgtcgtcaataaaaggcgtccctgtaaatgattatttggctgcttctgttgtgttggtggtagcttcatgagtgccaatgtggtgcagttgtgatgttgcttccttttcttgtctatttcatgattttgccactggttgctcctcttgaatgccgaggaggcgaggacagttgtagggacgtatggtggtcctgaattcctgccacaggaaagttcttgttgtttatttcttcatctgtaaattatggccggtgaaaatacatggcaactgtaccatacctctggccctactcaccatcatttattcataacggagcatttaagttttccgactttgttgaacaatgctttttctacagaagcatttttattttcagaggaccgaacgaccgtccctctcaaagcacgaaagtaactattttccagtcagtgtcagatacaacaaatatggacagcttaaattttgaattaaaaggacaaacagtactttcacatccaaacgaaattcaagtaaa

SEQ ID NO: 3036 - DNA, 1921 bp, Panicum virgatum
caggtccgttcttggatcaccacgtttcgcaagcgaggaggaggaggaggaggaggaggaggaggagatcgaggccacgatgatgcagcaggagccgtggaacgccgccgccgtggggctcctccggccgaccaagtcggcaccctgctcgcccatcaagccggcggcggcggccatggtccggacccactccgactccttccacgtcgcgcacaaggtgcccgtcggcgacacgccctacgtgcgcgccaagcgcgtccagctagtggacaaggacccggagaaggccatcgcgctgttctggtcggcgatcaacgccggcgaccgcgtggacagcgcgctcaaggacatggccatcgtgatgaagcagcagaaccgcgccgaggaggccatcgaggccatcaagtcgctgcgcagccggtgctccgaccaggcgcaggagtcgctcgacaacatcctcctcgacctctacaagagatgcgggcgactggacgaccagatctcgctgctcaagcacaagctgcagctgatccaccagggccacgccttcaacggcaagcgcaccaagacggcgcggtcgcagggccgcaagttccaggtcaccctcgagcaagaagccaccaggctccttggtaacctgggatgggcgctgatgcagaaggagaactacacggaggcggagggggcgtaccgccgggcgctgctcatcgggccggacaacaacaagatgtgcaacctgggaatctgcctcatgaagcagggccgcgtgctcgaggccaaggacgtgctcaagcaggtgcgccccgcggcggtcgacggcctgcgcggcgccgactcgcacctcaaggcctacgagcgcgcgcaggagatgttgcgggacctcgaggccaagctcgtcggtcgcccgcgcgccgaccagctcgacacgagctggctcttcgacgcgctgctgctgggatcttcatcaagtatctggcagccgcagccgtgcattgaccacttgctgccacctccggctccggtctcagcgccggcttcggcgcggcgcgacaacttcgccgatgaaaacgccgccatgagcaagaagctggcggcgctccaggcgaacatgctcaatgtggacgcgcagcccttctactccctgcggatgccgccacttgcagcgaagccactgaacaccctgcctcagcagcagcagccgcaccagctgcagaagcctgctccggtccatgatcccttgggcaacctgaagaggacacggtccggcaattgcatggacaaggcaggagcagtggcgaacaaggagcagagcaccgacgagaacagcggccggaggaagtcgctctcggctgaggacagatggccggagctgcccgaccacagcgcgttcgacgaggcccttgtcgcggatgtcctgggcccggtgctcgacgaggagccagcagccaccgaagggacgaacggccacggcaagctgccggcgatctgcgacacgagcccagtggtgaaggagaagatcggcaagaggctgaggatcttccaggacatcacacagacagtgaacaacttctgattctttcagttttcttcacattcctactcacaacaggcaggctcgaggtggtgacgccgcggaggagatgggcttgttctcctgggagctcctgtctggcaactaagttaatcaggaattcaattcacgttaatttatctccaattcgattttaacacaccaaaataacagctgattcttttgctcgcttcttcagcttgggcacttcaggaagcgtctgtttactgcttctttgccataaggctctccttgtaatagaagcggaccgcatcgtgttataattatgtttggttaaacacttgaataacaaagctcatttattttgactcttctattattttgacgtgt

SEQ ID NO: 3037 - DNA, 2313 bp, Panicum virgatum
ggcggccgcccgcgccgtcacgaggaagcgaggccggcgtcgacagcgacagcacgacgggatcaacgtgccatgccggcggcgacggcgaggaaacagacgggcgcgggcactcctcgatggatggctcggcccattcgattaggggccaggcccaggaagagctggtgggccgtgacagctgtaatcagaagtcagaacggaaggggccgaggcccaggaggttcccaacggctagttccccaaacggctagctcctccaacggtcggaccccctcctcgacccgattcatatatctcctgcggaatccgatgtccccgctaccagcctactgccaccgctccgctttcccctcctctcgctcagctccgttcttggatcacctcggatcgcaagcgaggaggaggaggagaccgaggccacgatgatgcagcagatgcagcaggagccgtggaacgccgccgccgcggggctcctccggccgaccaagtcggcgccgtgctcgcccatcaagccggcggcggcggccatggcccggacccactccgactccttccacgtcgcgcacaaggtgcccgtcggcgacacgccctacgtgcgcgccaagcgcgtccagctagtggacaaggacccggagaaggctatcgcgctgttctggtcggcgatcaacgccggcgaccgcgtggacagcgcgctcaaggacatggccatcgtgatgaagcagcagaaccgcgccgaggaggccatcgaggccatcaagtcgctccgcagccggtgctccgaccaggcgcaggagtcgcttgacaacatcctcctcgacctctacaagagatgcgggcggctggacgaccagatctcgctgctcaagcacaagctgcagctgattcatcagggccacgcattcaacggcaagcgcaccaagacatcgcggtcgcagggacgcaagttccaggtcaccctcgagcaagaagccaccaggctccttggtaacctaggatgggcgctgatgcagaaggagaactacacggaggcggagggggcgtaccggcgggcgctgctcatcgggccggacaacaacaagatgtgcaacctgggcatctgcctcatgaagcagggccgcatgctcgaggccaaggacgtgctcaagcaggtgcgccccgccgcggtcgacggcctgcgcggcgccgactcgcacctcaaggcctacgagcgcgcgcaggaaatgctgcgggacctggaggccaagctcgtcggccgcccgcgcgccgaccagctcgacacgagctggctcttcgacgcgctgctgctgggatcttcatcaagtatctggcagccgcagccgtgcatcgaccacttgctgccacctccggctccagctcccgtctcggcgccggcgaggcgcgaccacttcgccgatgaaaacgccgtcatgagcaagaaactggcggcgctccaggcgaacatgctcaatgtggacgcgcagcccttctactccctgcggatgccgtcacttgcagcgaagccacagaacacactgcttcagcagcagcagtcgcagcagaagacacagaacacactgcttcagcagcagcagccgcagcagaagccagctccggtccatgatcccttgggcaacctgaagaggacacggtccggaaattgcatggacaaggcaggagcagtggcggacaaggagcacagcaccgacgagaaccgcggccggaggaagtcgctctcggctgaggacagatggccggagctgcctgaccacagcgcgttcgacgaggcactcgtcgcggctgtcctggccccggtgctcgacgacgagccagcagccaccgaagggaggaatggccacggcaagctgccggcaagctgcgacacgagcccagtggtgaaggagaagatcggcaagaggctgaggatcttccaggacatcacacagacagtgaacttctgattcgtttcggttttcttcactttcctactcacaacaggcaggctcgaggtggtgaacgccgcggaggagataggcttgttctcctgggagctcctgtctggcaactaagttaatcaggacttcgattcgattcgagttaatttgatttccaattcgattttaacacaccaaaataacagatgattcttttgttcgcttcttcagcttgggcacttcaggaagcgtctgtttactgcttctttgccataaggcttctccttgtatgtaatagaagtggaccgcatcgtgttctaattatgttaggttaaacacttgaataacaaagctcatttattttgactcttctgttatt

SEQ ID NO: 3038 - DNA, 2165 bp, Sorghum bicolor
ggaactcccaacggctagttcgcccaaacggctagctctccaacggtcggacgaccccccaagcagattcatatagagatctcctgcggaatccaatgccgcctgctaccagcgtactgccaccactcctccgctttcccgtcatctccctccctgttgctctgctgcacagcaatcgcctcgtttcataataataataaggggaagtgaggaggagattgaggcgaagatgatgcagcagatgcagcaggagccgtggaacgccgccgccgtggggctcctccggccgaccaagtcggcgccctgctcgccaatcaagccggcggcggcggcggccatgctgcgaacccactccgactccttccacgtcgcgcacaaggtgcccgtcggcgacacgccgtacgtgcgagccaagcgcgtccagctggtggacaaggatccggagaaggcgatcgcgctgttctggagtgcgatcaatgccggcgaccgcgtcgacagcgcgctcaaggacatggccatcgtgatgaagcagcagaaccgcgccgaggaggccatcgaggccatcaagtcgctgcgcagccggtgctccgaccaggcgcaggagtccctcgacaacatcctcctcgatctctacaagagatgcgggcggctggacgaccagatctcgctgctcaagcacaagctgcagctgatccaccagggccacgccttcaacggcaagcggaccaaaacggctcgctctcagggccgcaagttccaggtcaccctcgagcaagaagccaccaggctccttggtaacctgggatgggcgctgatgcagaaggagaactacacggaggcggagggggcgtaccgtcgggcgctgcttatcgggccggacaacaacaagatgtgcaatctgggcatctgcctcatgaagcagggccgcgtgctcgaggccaaggatgtgctcaagcaggtacgccccgcggcggtcgacggtctgcgcggcgccgactcccacctcaaggcctacgagcgcgcgcaagagatgctgcgggacctcgagaccaagctcgtcggccgcccgcgcgctgaccagctcgacacgaactggctcttcgatgcactgctgctgggatcgtcctcgagcatctggcagccgcagccgtgcatcgaccacttgctgccacctccggctccggctccggcttcggctccagcaccagccccggcgccgcgcgaccgcttcgccgatgaaaacgccagtgtcagcaagaagctggcggcgctccaggcgaacatgcttaatgtggacgcgcagcccttctactctctgcgagtgccgccgcttgcagcgaagcctcataacacgctgcctcagcagcagccgcagcagaaaccacataacacgctgtctcagcagcagcagcagcagaagccagctcctgcccatgatcccttgggcaacctgaagaggacacggtccggcaattgcatggacaaggcaggagcagtggtggacaaggagcaggagcagagcatcgacgagaacagcggcaggaggaagtcgctctctgctgaggacagatggccagagctgcccgaccacagcgcgttcgacgaggccatcgtcgcggctgtcctgggcccagtgctcgacgacgaaccagcagctgctgaagggaacggccatggcaagctgccgacgagctgcgacacgagcccagcggtgaaggaaaagatcggcaagaggctgaggatcttccaggacatcacacagacagtgaacaatttctgattcgtttcggttttgttactcacaacaggcaggcttgaggtggcgatacagagaaggagaaagggcttgttctcctgggagctcctgcctggcaactaaattaatcagggattcaattcgattttaattttaatcagggatttaattaacacaccaaaataacagctgattcttttgttcgcttcttcagcttgacactttaggaagcgtgttcttcctttgccacaaggctctccttgaaatagaagtggactgcatcttgttctaatttcgtttcttttgaaataacaaagttcatttgtgcttatccggcgactcatctgctgttttgactttcactgcaatcgtgtatgcattcttcctgttcttcgtctgtgaaattacg

SEQ ID NO: 3039 - DNA, 2304 bp, Zea mays
gctaccagcgtactgccacggctccgctttcccgtcaactccctgttgctctgctgcacagcaatcgcctcgtttcatagtaaggaggaggaggttgaggcgaagatgatgcagcagatgcagcaggagcagtggaacgccgccgccgcggggctcctccggccgaccaagtcggcgccctgctcgcccatcaagccagcggcggcggcggccatgctgcggacccactccgactccttccacgtcgcgcacaaggtgcccgtcggcgacacgccctacgtgagagccaagcgcgtccagctggtggacaaggatccagagaaggcgatcgctctgttctggagtgcgatcaacgccggcgaccgcgttgacagcgcgctcaaggacatggccatcgtgatgaagcagcagaaccgcgccgaggaggccatcgaggccatcaagtcgctgcgaagccgatgctccgaccaggcgcaggagtccctcgacaacatcctcctcgatctctacaagagatgcgggcggctggacgaccaaatctcgctgctcaagcacaagttgcagcggatccaccagggccacgccttcaatggcaagcggaccaaaacggctcgctctcagggccgcaagttccaggtcactctcgaacaagaagccaccaggctccttggcaatctgggatgggcgctgatgcagaaggagaactacacagaggcggagggggcgtaccgtcgtgcgctgctcatcgggccggacaacaacaagatgtgcaatctgggcatctgcctcatgaagcagggccgcgtgctcgaggccaaggatgtgctcaagcaggtacgccccgcgggggtcgatggtctgcgcggtgccgactctcacctcaaggcctacgagcgagcgcaagagatgctgcgggacctcgagaccaagctcgtcggccgcccgcgcgctgaccagctcgacacgaactggctctacgatgcgctgctgctgggatcgtcctcgagcatctggcagccgcagccgtgcatcgaccatttgctgccacctccggctccggcatcaatcccagccctggccccggcgccgcgcgaccacttcgccgatgaaaacgccggactcagcaagaagctggcggcgctccaggcgaacatgcttaatgtggacgcgcagcccttctactctctgcgggtgccgccgcttgcagcgaagcctcataacacgctgcctcagcagaagccacatagcacgctgcctcagcagcagcagcagaagaagaagccagctcctgtccatgatcccttgggcaacctgaagaggacacggtccagcaattgcatggacaaggcaggagcagtggtggacaaggcgcaaagcatcgacgagaacagcggcaggaggaagtcgctctcagctgaggacagatggccagagctgcccgaccacagcgcgttcgacgaggccctcgtcgcggatatcctgggcccggtgttcgacgacaaaccaacagctgctggaactaacggccacggcaagctgccggcgagctgcgacacgagcccagcagcgaaggagaagatcagcaagaggctgaggatcttccaggacatcacaaagacagtgaacaatttctgattcggtttcggttttcttcacgttcctactcacaacaggcaggctcgaggtggcgatacacagagaaggagaaagagcttgttctcctgagagctcctgtctggcaactaaattaaacagggattctattcagtttaaatttaatgctgattttgattcaatttattaacaccaaaataacagctgattctttttccacgaggctctccttgtaatagaactatagaagtgggctgctgcatctcgttctaatttcgtttcttttgaataacaaaaagttcatttataatcccgtgactcatctgttgttttttattttcactgcaatcgtgtattagctagcattgcagcttgcgtacctgttaatcgatggaattgatcgcatcaattgaaaatgacagccttatctatttggccaatacttcacagtgtctcacgacgctctatttgatttatctatttggccaatactttacagtgtctcgtgacgctctatttgttcagtgaaaatagagcgtcgtgagacactgtgaagtattggccaaatagataaatcattttcgcagattctctttgttgaacagaagctcgttcacgaggatgttactgttggggatccatgtctctcaagacatcttctgtgcgttaacagcgtccaaccgtccacga

SEQ ID NO: 3040 - DNA, 1841 bp, Zea mays
tactgccactgccaccgctccgctttcccgtcgtctccctgttgctctgctgcacagcaatcgtctcgtttcatacagggcagggaagtcaggaggaagatgatgcagcaggagccctggaacgccgccgccgccatggggctcctccgcccgaccaagtcggcgccctgctcgcccatcaagccgccgccggcgaccatgctgcggactcacttccacgtcgcgcacaaggtgccggtcggcgacacgccctacgtgcgagccaagcgcgtccagctggtggacaaggatccggagaaggcgatcgcgctgttctggagtgcgatcaacgccggagaccgcgttgacagcgcgctcaaggacatggccatcgtgatgaagcagcagaaccgcgccgaggaggccatcgaggccatcaagtcgctgcgcagccgatgctccgaccaggcgcaggagtccctcgacaacatcctcctcgatctctacaagagatgcgggcggctggacgaccaaatctcgctgctcaagcacaagctgcagctgatcaaccagggccacgccttcaacggcaagcggaccaaaacggctcgctctcagggccgcaagttccaggtcaccctggagcaagaagccaccaggctccttggtaacctggggtgggcgctgatgcagaaggagaactacacggaagcggagggagcgtaccgtcgggcgctgctcatcgggccggacaacaacaagatgtgcaatctgggcatctgccttatgaagcaggcccgcgtgctcgaggccaaggatgtgctcaagcaggtacgccccgcggcggttgatggtctgcgcggcgccgactctcacctcaaggcctacgagcgagcgcaggagatgctgcgggacctcgagaccaagctcatcggccgcccgcccgctgaccagctcgacacgaactggctcttcgatgcgctgctgctgggatcgtcctcaagcatctggcagccgcagccgtgcaccgatcacttgctgccacctcctgttccggctccagccacggcgccgcgcggccacttcgccgatgaaaacgccggtgtgagcaagaagctggcggtgctccaggagaacatgcttaatgtggacgcgcagcccttctactctttgcgggtgccgtcgcttgcagccaagtcacataacacgctgcctcagcggcaacagcagcagaagccagctcctgtccatgatcccctgggcaacctgaagagaacacggtccggcaattgcatggacaaggcaggagcagtggtgttcaaggagcagagcatcgacgagaacagcggcaggaggaagtcgctgtcagctgaggacaggtggccagagctacccgaccacagcgcgttcgatgaggccctcgtcgccgtcgtcctggctccagtgctcgacgacgaaccaacagctactgaagtcaagctgccggcgagctgcgacacgagcccagcggtgaaggaaaagatcggcaagaggctgaggatcttccaggacatcacacagacagtgaacagtttctgattcgttttggttttcttcaatttcctactcacaaattaatcagggaaggagaaaggacttgttctcctgggacctaaattaatcagggattcgattcgatttttaatttgatgctgattttaatttaatttattaacacacaaaaataacagctgattcgcttcttcagcttgacactttagaagcgcgtgcttcctttaccgcaagattctcctcgtaatagaagttgcatcttgttctaatttcatttcttttgaaataacaaagttcatttgtgtatcggc

SEQ ID NO: 3041 - DNA, 1716 bp, Echinochloa colona
gcggcggcggcggccatgctccggacccactccgactccttccacgtcgcgcacaaggttcccgtcggcgacacgccctacgtgcgcgccaagcgcgtccagcttgtggacaaggatccggagaaggccatcgcgctgttctggtcggcgatcaacgccggcgaccgcgtggacagcgcgctcaaggacatggccatcgtgatgaagcagcagaaccgcgccgaggaggccatcgaggccatcaagtcgctgcgcagccggtgctccgaccaggcgcaggagtcgctcgacaacatcctcctcgacctccacaagaggtgcgggcggctggacgaccagatctcgctgctcaaacacaagctgcagctgatccaccagggccacgccttcaacggcaagcgcaccaagacggcgcggtcgcaaggacgcaagttccaggtcaccctcgagcaagaagccaccaggctccttggtaacctgggatgggcgctgatgcagaaggagaactacacggaggcggagggggcgtaccggcaggcgctgctcatcgggccggacaacaacaagatgtgcaacctgggcatctgcctcatgaagcagggccgcgtgctcgaggccaaggacgtgctcaagcaggtgcgccccgcggccgtcgacggcctgcgcggcgccgactcgcacctcaaggcctacgagcgtgcgcaggagatgctgcgggacctcgaggccaagctcgtcggccgcccgcgcgccgaccagctcgacaccagctggctcttcgacgcgctgctgctggggtcgtcctcaagtatctggcagccgcagccgtgcatcgaccacctgctgccgccaccttctgctccggctcctgccccggccccagctccggcgcgacgcgaccacttcgccgatgaaaacgccgccagcgtgagcaagaagctgtcgttcctccaggctaacatgctcaatgtggacgcgcagcccttctactcgcactcgctgcggatgccgccgctcgcgaccaagccacagaacacgcagcctcagcagcagaagcagcagaagcctgctccggtccatgatcccttggccaacctgaagaggacacggtccggcaattgcatggacaaggcagcagcagcagtggtggacaaggagcagagcactgacgagaacagcggcaggaggaagtcgctatcggctgaggacagatggccggagctgcccgaccacagcgcgttcgacgaggccctcgttgcggctgtcctggccccggtgctcgacgacgagccaaaagccaccgaaggcggccacggcaagctgccggcgagctgcggcgcgagcccattggtgaaggagaagatcggcaagaggctgaggatcttccaggacatcacacagaccgtgaacaatttctgattcgtttcggttttcttcgcttttcctactcacaacaggcaggcttgaggtggcgacgcagcgaaggagatgggcttgttctcctgggagctcctgtctggcaactaagttaatcagggattcgattcgattcgactcgattcaatttaaattttatgctgatttccaattcaattttaacacaccaaaataacagctgattcttttgttcgctccttcagcttggcagttttaggaagcgtgtgtttctgtttcctgcttctttgccataaggctccttgtaatagaagtggactg

SEQ ID NO: 3042 - DNA, 1947 bp, Oryza sativa
agtagtcgagcacaagccgctccgccgccacctcctcctctcagctccgccgccgctgcctcctcctcctccgttctcgggtcgacagcgacgatgatgcagcagcagcagcagcaggagacgtggctcgcggccgccgcggcggtggggctccggccgaccaagtcggcaccctgctcgcccatcaagcctgcggagtcgtcggcgtcggctgcggcggcggcggccatgctccggaccaactccgactccttccacgtcgcccacaaggtccccgtcggcgacacgccgtacgtgcgcgccaagcgcgtccagctggtggacaaggatccggagaaggcgatcgcgctgttctgggcggcgatcaacgccggcgaccgggtggacagcgcgctcaaggacatggccatcgtgatgaagcagcagaaccgcgcggaggaggccatcgaggccatcaagtcgctgcgaagccgctgctccgaccaggcgcaggagtccctcgacaacatcctcctcgacctctacaagagatgcgggcggctggacgaccagatctcgctgctcaagcacaagctgcagctcatccaccagggccacgccttcaacggcaagcgcaccaagacggcgcgttcgcagggccgcaagttccaggtcaccctggagcaagaagcaaccagacttcttggaaatctggggtgggcgctgatgcagaaggagaactacacggaggcggagggggcgtaccggagggcgctgctgatcgggccggacaacaacaagatgtgcaacctggggatctgcctgatgaagcaggggcgcgtgctggaggccaaggacgtgctcaagcaggtgcggccggcgggggtggacggcctccgcggcgccgactcgcacctcaaggcgtacgagcgcgcgcaggagatgctccgggacctcgaggccaagctcgtcggccgccgcctcccgcgcgccggcgaccagctcgtcgacaagagctggctcttcgacgcgctgctgctcggctcctcctccagcatctggcagccgcagccgtgcatcgaccacatgctgcccccgcccccgccgccgccgcgcgaccagttcgccgacgagaacgccgccgccgccgccgccaacaagaaggcggccgcgaccgcgctgcagcccaacatcctccgggtcgacgcgcagccgttctactcgctgcgcatgccgccgctggcgacgaagccacagaacattcagcagaagccgccgacgccgcagccgcaggtgcacgatccgatgggcaacctgaagaggacacggtccggcaacgccatggacaaggcggcggcggcagctgccggaccagtggagaaagaaccgatcaacgacgagaacagcgggaggaggaagtcactctccgccgaggaaagatggccggagctgcccgaccacagcgcgttcgacgaggccctcgtcgcggcggtcctcgccccggtcctcgatgactccgccgccgccgccgcagaacggaacgacaattgctgcaagccggcgccgccggcgagctgcgacacgagcccggcgatgaaggagaagatcgggaagaggctgaggatcttccaggacatcacacagacactgaacactttctgatttgagttcttgatttttttttcttttctttgcaactcacagcagcagccgtggcgacgccgcgaaggagatgggcttgttctcctgcgagctttctatgtcgccgctaagttaatttaggattcgattgggttttagttcgctgatgattcttgatttgattttttttaacacaccctaataacagctgattgctcactttcttcagcttgacaccaaagctcttcttgtaacagaacacgattgattttcatcttgttctaattcagtttgttaacagttgaataacaaagtgtcattaattta

SEQ ID NO: 3043 - DNA, 2258 bp, Oryza sativa
cgagaatgcgagaatggcggcgagtagaagaaatgaaataaagtctaatatgactcccccgactatagctcgaactaggccagaagggctaggcgttaaatgggccggaattatctggcccgcagatccagcacgagaggtttccaacggctagttttttcgcaaacggctagttcgggcaacggtcggggaacccaagcttggattcatatatctcctgtggaagggaatccaatgcctagtagtagtcgagcacaagccgctccgccgccacctcctcctctcagctccgccgccgctgcctcctcctcctccgttctcgggtcgacagcgacgatgatgcagcagcagcagcagcaggagacgtggctcgcggccgccgcggcggtggggctccggccgaccaagtcggcaccctgctcgcccatcaagcctgcggagtcgtcggcgtcggctgcggcggcggcggccatgctccggaccaactccgactccttccacgtcgcccacaaggtccccgtcggcgacacgccgtacgtgcgcgccaagcgcgtccagctggtggacaaggatccggagaaggcgatcgcgctgttctgggcggcgatcaacgccggcgaccgggtggacagcgcgctcaaggacatggccatcgtgatgaagcagcagaaccgcgcggaggaggccatcgaggccatcaagtcgctgcgaagccgctgctccgaccaggcgcaggagtccctcgacaacatcctcctcgacctctacaagagatgcgggcggctggacgaccagatctcgctgctcaagcacaagctgcagctcatccaccagggccacgccttcaacggcaagcgcaccaagacggcgcgttcgcagggccgcaagttccaggtcaccctggagcaagaagcaaccagacttcttggaaatctggggtgggcgctgatgcagaaggagaactacacggaggcggagggggcgtaccggagggcgctgctgatcgggccggacaacaacaagatgtgcaacctggggatctgcctgatgaagcaggggcgcgtgctggaggccaaggacgtgctcaagcaggtgcggccggcgggggtggacggcctccgcggcgccgactcgcacctcaaggcgtacgagcgcgcgcaggagatgctccgggacctcgaggccaagctcgtcggccgccgcctcccgcgcgccggcgaccagctcgtcgacaagagctggctcttcgacgcgctgctgctcggctcctcctccagcatctggcagccgcagccgtgcatcgaccacatgctgcccccgcccccgccgccgccgcgcgaccagttcgccgacgagaacgccgccgccgccgccgccaacaagaaggcggccgcggccgcgctgcagcccaacatcctccgggtcgacgcgcagccgttctactcgctgcgcatgccgccgctggcgacgaagccacagaacattcagcagaagccgccgacgccgcagccgcaggtgcacgatccgatgggcaacctgaagaggacacggtccggcaacgccatggacaaggcggcggcggcagctgccggaccagtggagaaagaaccgatcaacgacgagaacagcgggaggaggaagtcactctccgccgaggaaagatggccggagctgcccgaccacagcgcgttcgacgaggccctcgtcgcggcggtcctcgccccggtcctcgatgactccgccgccgccgccgcagaacggaacgacaattgctgcaagccggcgccgccggcgggctgcgacacgagcccggcgatgaaggagaagatcgggaagaggctgaggatcttccaggacatcacacagacactgaacactttctgatttgagttcttgatttttttttcttttctttgcaactcacagcagcagccgtggcgacgccgcgaaggagatgggcttgttctcctgcgagctttctatgtcgccgctaagttaatttaggattcgattgggttttagttcgctgatgattcttgatttgattttttttaacacaccctaataacagctgattgctcactttcttcagcttgacaccaaagctcttcttgtaacagaacacgattgattttcatcttgttctaattcagtttgttaacagttgaataacaaagtgtcattaatttatctttgctgtgtttgtttggactcaatttctgaattgatctcacttaaactgtcatttcatagctggc

SEQ ID NO: 3044 - DNA, 2118 bp, Panicum virgatum
tggcactgttctctctcactctcacaccattacaatctctctcaagaacagtgcaacgaccgggagggtggtgccggcctgttcccggcggcggcgatgaggtacggcgaggtggcgcacttcagccacccgcagcaccgcctccggctggagcaccacgatacgccgttccggtgcgacgggtgccgcgaggtgggcatcggcgcgcgcttccgctgcccgcacccgggctgcgaccatgacctgcaccggcagtgcgcgctcccgctgtcgccgccgccgccgccgctccggcacccgttctatccgcgctgcgcgttcgccttcctcgcgcgggcgcccgggccgcgctactgcaacgcgtgcggccgcgacgtcgccggcttcgtctaccactgccgcgcgtgcgggttcgacctgcacccgtgctgcgccgcgctcccgcacgcgctcgacgccggcggcggggtccggctgtacctgcacccggactccaaggccggcgtcgcgtgccaccgatgcggccaccgcgggcgcagctggagctaccggagccactgcgggagcttcagcctccacgtggcgtgcgtcgtggacatgctcgtcgagagctggcacggcgtcggccgccgcaagggcgtgtacgacggcgggctggtggtgcccggggccggcgggtacagggtgccggcgatccgcggcgcggcaaagagcgtccacgcgggcaggggaggagggtacgcgtcctggggcaggaagaagggcaaggtgaggcgctgctgcgagatcgccgggttcgcggggcaggtggtcatctcggcggtgctcggcgaccccaccgcgctcatcgccggcgtcatagggtccctcatcgcgctgtgacggacggacgccggccgagggcaccatggcaacatgccgacatgatcaaacgtgcaaaacactgtacatgtatcttgtatgtgcatcgcgcggtcgcatggcatggccgggcagatagggacttcgtggtgaagtaccgagcagtaaacagtaataacatgttcggggcaaactgtaaagttaatctctggtgctccctccattctaaattataagtcattccaaaaatcttggagagtcaaaccatttcaaaatttgaccaaaattatagagagaaatacaaagatttatgacatcaaatagatatactataaaaatataactaacaaagaatctaataatacttaattggtatcgtaaatattattatcttgttgtatacatttggtcaaacttggaaaattttaactctccaagattcttggaatgacttataatacgaaacgggggagtaacatatttcggtggatgtaagcgcaaactcatcgatattctagtcttccatggggccataactcatttctatccgctcatgtattaatcgaacttgttgtttatcaaccaaactgctagtgccccgacatccgataagacgatattgcatcgtcagaactaccaaaccattaggtgtttgtactgtgacaacctactttacagggcccacttaaataattcaattgatatctattatattttcaaaagattttatgtataactatttatagtttaaagcatgtaaatgtatttaaaaatcgaaaatagcacgacataacgggcttgccaatccctcgttctgttcttcagagcaaacggacatatcagccagcccacctttcgctccttatccgacggcccatacgtggcccaagggcccaatttcagtcagaactgaggaggatcatccagtccatcccccaaatcgaccactccccgacgcggcgagccctaggtggccggcaggcagcgacggcggccgagcttgcagggcacagagggcggccaagcggcgcgccacagcgccagcgcgtgcgcctgcagcagcgcagggcggggccgcagggggctcggcagcggccgagcacccgcgccgaaggggctccgcggccggcgggcgtagccggcctacggcatcgactccatccatcgtccctctgcgccttcgccggtactccctttctctgctccggcctcagcacaggcgcacggcaagtcagcagctgagttactgaggtgagc

SEQ ID NO: 3045 - DNA, 1189 bp, Panicum virgatum
tctcgagaacagtgtgtcagtgtgcaacgaccacgggcaatagcatcagctcggaggcactcgaccgggcgcccgttccagtgccggcctcttcccggcggcggcgatgaggtacggcgaggtggcacacttcagccaccggcagcaccgcctccggctggagcaccacgacacgccattccggtgcgacgggtgccgcgaggtgggcatcggcgcgcgcttccgctgcccgcacccgggctgcgaccacgacctgcaccggcagtgcgcgctcccgctctcgccgccgccgccgccgctccggcacccgttctacccgcgctgcgccttcgccttcctcccgcgggcgcccgggccgccgcgctactgcaacgcgtgcggctgcggcgtcgccggctacgtctaccactgccgcgcgtgcggcttcgacctgcacccgtgctgcgccgcgctcccgcccgcgctcgacgccggcggcggcgtccggctgcacctgcacccggactccagggccggcgccgcgtgccaccggtgcggccaccgcgggcgcagctggagctaccggagccactgcgggagcttcagcctccacgtggcgtgcgtcgcggacatgctcgtcgagagctggcacggcgtcggccgccacaagggcgcgtgcggcggcggactggtggtgcccgggggcggcgggtgcagcaggccggcgccggcgatccgcggcgcggcgaagagcatccacgcgggcaggggaggagggtacgcgccctggggcaggaagaagggcaaggtgaagcgctgctgcgagatcgccgggttcgcggggcaggtggtcatctcggcggtgctcggcgaccccaccgcgctcatcgccggcgccatagggtccctcatcgcgctgtgacggacggcagcccggccgaggggagaaatttgagattttgacattctcggaagtaggcttcgacagtttgccatcaaataattagacttcgctgttttgtcattatgaaacgaggtcactccgctgctttgcctttccaccccttttcaattcatttttcattttcttcttctatttgcaacatgagatgactattttgcccctcccacattcacccttcttctttcttggtcacgagagccccatgcccccgccttctctttctgctccggtagccggcggcggctg

SEQ ID NO: 3046 - DNA, 1346 bp, Oryza sativa
attctcacgcgtacacgtagtggcagaatagtaccacctcgagaaactcggcaactcgcccgccgccgccgccgccggcggcgaggatgaggtacggcgaggtggtgcacttcagccacccgcaccaccggctgcggctggagcacgccgacacgccgttccggtgcgacgggtgccgcgaggtcggcatcggcgcgcgcttccgctgcccgttcgccggctgcgaccacgacctccaccgccagtgcgcgctcccgctgtccccgccgccgccgccgctccgccacccgttctacccgcgctgcgccttcgtcttcctcgcgcgggcgcccggcgcgccggggacgcgctactgcaacgcctgcggccgcgacgtcgccggcttcgtctaccactgccgcgcctgcggcttcgacctccacccctgctgcgccacgctcccacacgtcctcgacgccgccgccggcgccgcctccggcggcggcggcggaggcgcgaggctgtacctgcacccgaaggcgacggcggcgtgccaccggtgcgggcaccgggggcggagctggacgtaccggagcagctgcaagagctacagcctccacgtggcgtgcgtcatggacatgctcgtcgagagctggaacggcgtcggccgccacaagggcggcgtcgccggcggcggcaatgtgtacgacggcgtgacggtggcggggagcggcgggtacagggtgccggtgatacgcggcgcggcgaagagcagccacgcgagcaggggagggtcctactggggaaggaaggggaaggtgaagcggtgctgcgagatcgccggcttcgcggcgcaggtggtcatctccgccgtgctcggcgaccccaccgccctcatcgccggcgtcatcggctcgctcatcgcgcggtgaccggcgccgccgccgccgccttcgcgccgcggcggaggggggtaaaaaaaaaatgtaaattaactaccacgtgtacacacgtacgtagcccacgtggcagaatttaactcgtgcaataacattaacccgtgtacacgtcatctaatcgcatcggagccgcacaatgttgatcggacggcgtggacgtggatcgcaatctgcttgcgatccaagcccggaagggtgtaatgtgtaagagattaagattagtacagtataattcagggttgttacccaaaaatagcacgcaattgatctctctactgcattcaaacagcttgaattcagtcagttcactcccatggaacatgtgaaaatgcaggaaaataagctgaattttcagatggatgcgaggattctttttcagggaatatgtagcaaattcgcatcgattct

SEQ ID NO: 3047 - DNA, 1012 bp, Triticum aestivum
gccatgaggtacggcgaggtggcgcacttcagccacccgcagcaccggctccggctggagcaactggacacgcgttccgctgcgacggctgcaaggaggttggcatcggcgcgcgttaccggtgccccgtccagggctgcgccgccgaccacgacctccaccgccaatgcgcgctcccgctctccccgccgccgccgccgctccggcacccgttctaccccaagtgcgccttccacttcatggcgcgcgcgccgggcgcccccgggacgcgctactgcaacgcgtgcggccgcgacgtcgccggcttcgtctaccactgccgcgcctgcggcttcgacctgcacccctgctgcgccacgctcccgcacgccctcgacgccagcgaccgcggaggcagagtcggcgtgaggctgtacctgcaccccaaggccgaggccgcgtgccaccggtgcggccaccgcgggcggagctggacgtaccggagccactgcaagagctacagcctccacgtggcgtgcgtcatggacatggtcgtcgagagctggaacggcatcgggcggagcaagggcgctagcgccggaggaaggggcgtgtacgacggcgcgttggtggcggggagcggcgggtacagggtgccggtgataaggggcgcggcgaagagcagccacgcgagcaggggagggtcgtactgggggatgaggaagggcaaggtgaagcgctgctgcgagatcgccgggttcgcggcgcaggtggtcatctccgcggtgctcggtgaccccaccgcgctcatagccggcgtcgtcggctcgctcatagcgcggtgaccaccgccggccgccgccgcgctcttggaatgaaacatgttgtaaatactactcctgctccgtactccggacgtaacctacgtggcgctgcatgcaaattatataaccggtgtccacgtcagtgcatcaatgtcccccacgtgtcagtgtagcgtagttgtctttaaaaccttattatcgtgttccgg

SEQ ID NO: 3048 - DNA, 1679 bp, Zea mays
cgggtctccagctctccatcacaaatggcctagataaacacagctacacaggtgacagctatgttgaacgtgctgggggacattccaatcttacgcagcatggaatttgtgcgctcttatcatcctctgctcggcctccatccatcatgaaggcacgcaagatcacctcaccgaaatccaggaccagatgctcctcaactggctgcctacgtatagaagggaatgtcgtgcgggattaccagctagctggcctccaactccaatacaaacatttgcctctctctctctctcgcccacagccacccccgcagccagaaatgaggtacggcgagctggcgcacctgagccacccgcagcaccgtctccggctggagcacgcggagacgccgttccggtgcgatgggtgcggcgaggtgggcatcggggcgcgtttccgctgcccgcacccgggctgcgaccacgacctgcaccggcagtgcgcgctgccggcgccggcgccgctgcggcacccgttctacccgcgctgcgcgttcgtgttcctggcgcgcgcgccggggggcgcgggggcgcgctactgcaacgcgtgcggccgcgacgtggccggctacgtctaccactgccgcgcctgcggcttcgacctgcacccgtgctgcgccgcgctgccgcacgcgctggacgccggcgccggggtcaggctgcacctgcacccggacaccggctctggcgccgcgtgccaccgctgcgggcaccgcggccgcggctggagctaccggagccagtgcaggtgctacagcctccacgtggcgtgcgtcatggacatgctcgtcgagagctggcactccgtcgggcgccaaaagggcgaccaggggatggcgggccacgtggtggtgcccggcagcggcgggtactgggtgccggcgatgatcaggggcgcggcgaagagcagccacgccagcgggggagggaggtactcgtactggggcaagcacaagggcaaggccaagcgctgctgcgagatcgccgggttcgccgcgcaggtcgtcatctccgcggtgctcggcgatcccaccgcgctcatcgccggcgccataggctcgctcatcgcgcggtgacacgcggacgccggcataatatgtagtccttttttttctctcttttagaccagtggcaaacatgtttgttccttgcatctttcgcgagcgtgaggctcagcgctacccctacccgcttccgtggcgtgctggctgcaaacaactccggcagggcacctcacgtacgtgtacgcccttggttagctgccggcatgcaaggaacaaggagcagggctgccgccgcggcggccgtgaaaacaacggatgggctgctgtacaaatccgaagactcgatcggtggtgcccgttgtaagaaacagagaataggaataggaagaactgttctctctgtattgctttattgatgtgtcgagtacaaatatatataaactaggtaggtgcccgtgcgttgcgacgacacataaattgttgagggagatctatgactactcgtccggatcgatgacagactattattgttgctaggcaccatcatccgtataaggatagaagtatctgggataggatgagcgtgaagttctacacaaagccaaacaggtgcttggtggctcttatcttacgaaacac

SEQ ID NO: 3049 - DNA, 4295 bp, Panicum virgatum
cgcagcgccgaacacaaaagctcaccaccaccgcaaccgcaaccgcaacccacaaacctcgcctgcacgtcaccgataccgaggcgaagccgaggcaggcaggcacactcccccctcctcgctctgcagccctcaccggccaccgcaggccaagaaagaagcaaaagcggcgacgccgtctccaatgcctcagggcgccgcggcggcggcctgagagcggcggacggcgagccgcgctgtcgactgtcgaggtcgggcgggggagcgcattgcgatggcggagtcggcggcggcggacgggaaggcggcgaacggagcagggggagggggtgatgcggcgggggacgggaagaagagggtcgaccaggccgtggcgttccacgagctcttctggttcgccgacaagtgggatctcatgctcatggcggcgggcagccttggcgcgctggcgcacggcgccgccatgccgctcttctttctcctgttcggggatctcatcaacggcttcggcaagaaccagaccgacctccgcaccatgaccgacgaagtcgccaagtatgcgctctacttcgtctacctcgggctggtggtctgcgtctcctcctacgcagagatcgcgtgctggatgtacaccggggagcggcaggtgatcgcgctccggaaggcgtacctggacgccgtgctgcggcaggacgtggggttcttcgacacggacgcgcgcacgggcgacatcgtgttcggcgtctccaccgacacgctgctcgtgcaggacgccatcggcgagaaggtcggcaacttcatccactacatcgccaccttcctggccgggctggtcgtggggttcgtagcggcatggcggctcgcgctgctcagcgtggccgtcatccccgccatcgcctttgccggtggcctgtacgcgtacacgctcaccggcctcacttccaagagccgggagtcctatgccaatgccggcgtcgtcgcggagcaggcaattgcccaagtaagaacagtttactcttttgttggagagagcaaagcactcaattcctattctgaggcgattcagaacacactgaagctcggttacaaagctgggatggctaaaggtcttgggatcggatgtacttatgggatagcatgcatgtcctgggcattggtattctggtatgctggtgttttcatcaggaatgggcagactgatggtggaaatgcttttacagcaatcttttctgcaattgtcggtggcatgagccttgggcaggctttctcaaaccttggagccttcagcaaagggaaaattgctggttacaaactgcttgaggtcattcgccagaaaccgtctatagtcaacgatcacaaggatgggaagtggttggctgaggtccatggaaacatagaattcaaggaagttacattcagttatccttcaaggcctgatgttatgatctttcgggatttctctcttttcttccctgctggtaaaactgtcgcggtcgttggaggcagtggatctggaaaaagcactgttgtggctttgatagaaaggttttatgatcctaatgaaggccaggttttgcttgacaatgttgacataaaaacactccaattgaggtggctgagagatcagattggtctagtaaaccaagaacctgctctttttgcaaccactatcctagagaatatactgtatggaaagccagatgccactattgcagaagttgaggctgcagcgactgcatccaatgctcatagtttcatatctcttcttccaaatggctacaacacaatggtaggtgagcgaggcatccaactttctggtggtcagaagcaacgtatagcgatagctcgtgctatgctgaagaacccgaagattctgctccttgatgaagctaccagcgctttagatgcagactcagaaagcattgtgcaagaagctcttgaccgcttaatggttgggaggacgactgtagttgttgcccaccgtctgttcactataagaaacgtgaacatgattgctgtgatccaacaaggccaagttgttgagactgggacacatgatgaactcctagcaaaaggcagcactggagcatatgcctccctggtccgttttcaggaatcaacgtggaatagggatcttggaggtgcatctacccgcaggtcacgatcgatgcacttgacaagctcactttccaccaaatctcttagcctgaggtctggaagtctaaggaacttgagctatcagtacagtactggagcagatggtcgcatcgagatgatctccaatgcagataatgaccgcaaatacccagcaccacgtggttacttcttgaagctcctgaaattgaatgctcctgaatggccttatgctgtgttgggcgccattggttctgtcctttcaggatttattggtccaacatttgccattgttatgggtgaaatgcttgatgtgttctactacagggaccccaatgaaatggagaagaagacaaagctatatgtgttcatctatattggcacaggcatatatgctgttgttgcttatcttgtgcagcattacttcttcagcatcatgggagaaaatcttacaaccagggttaggaggatgatgttatccgcaatacttaggaatgaagtgggttggtttgacgaagaagaaaacaactcaagtcttgtggctgctcgtctagcagtcgatgcagcagatgtgaagtcggctatagctgagagaatatcagtcatcctgcagaacatgacgtcccttatgacttcattcgttgtcggttttatcattgaatggagagtggcactccttattctggctactttcccgcttcttgtgcttgccaactttgcccagcaaatttcaatgaagggcttcgctggtgacacagcaaaggcacatgccaagagcagtatggtcgcaggtgaaggagtgagcaatatccgcactgtggctgccttcaacgctcaaagcaagatcttgtcactcttcagccatgaactgcgcataccagagcagcaaatccttcgacgtagccagacatcaggtcttctgtttggcctttcacagctctgcctgtactcctcagaagcgctcattctctggtatggttctcatctcgtccggtcacatggatccaccttctccaaggtcatcaaggtttttgttgtccttgtggtgactgccaactccgtagctgagacagtgagcctagccccagagatcgtccgcggaggtgaatcgatccgatccatctttggcatcctcgacagggcaacaagaattgagcctgatgatccagagtcggagcgtgtcaccgccatccgaggggacattgagttgcggcatgtggactttgcctatccagcacgcccggacattcagatcttcaaggatttcaacctgaaaatccaagctgggcgcagccaagctctagtcggagccagcggttcagggaagagcactgtcattgctctcattgagcgattctatgatccgactgggggaaaagttagtattgatggaaaggacatcaggaggctgaacttgaagtccttgcggctcaagattggcctggtgcagcaggagccggtcctctttgcagcgagcatactagaaaacattgcttatggcaaggatggtgcgacccaggaggaggtgatcgaggcggcaaagacagcaaatgtccacggcttcgtcagccagcttcctgacggctacaagactgcagtcggcgagcgtggcgtgcagctctcgggtgggcagaagcagcggatcgccatcgccagggcagtgctcaaggacccggccatcctgctgctggacgaggcaacaagcgccctggacgcggagtccgagtgcgtgctgcaggaggcgctggagcggctgatgaaggggcggaccaccgtcctggtggcgcaccgcctctcgacgatccgaggcgtggaccgcatcgcggtggtgcaggacgggcggatcgtcgagcacggcagccactcggagctcctgacccggccggagggcgcgtactcgcggctgctgcagttgcagcaccaccgtgtctgacggcgaagtgcagccgcatcctctgattaatacatgatgacaccttcgttttggagactgggatggccggaatttttcggttggcggtggtcgtgcggatgtagatactagggcaaccgtgtatgttcctaatgctgtcgatcgcaagcttaaacttggaacctgcgatctgtatcttctccccggaatgtacgatgcgactcttctttttgttaactccccctttcct

SEQ ID NO: 3050 - DNA, 4397 bp, Sorghum bicolor
cccacactgcactgccctcctctttatcacttgccccgacgccgcgctagcttctgacctgaccaccgcagcgcggaacacaagctcaccaccaccagcaccacccccacaaacctcgcctgcacgtcacggttaccgaggctaatcccaagcaggcgcttccggcttccggatttccccctctcccgttgcaagcaaaagcggcgacaccttcccaaatgccgcggggcgccgcggctgcggcctgagagtgcgagccgcgctaccggaggtccaggtcaggcggcgggggagcgcattgcgatggcggagacggcggcggcggatgggaaggcggacaaggtggcgaacggaggagggggaggcggcgatgcggcgggggaggggaagaagaggggggaccaggccgtggcgttccacgagctcttctcgttcgccgacaagtgggacctgatgctcatggccgcgggcagtctgggcgcgctggcgcacggcgctgccatgccgttcttcttcctgctcttcggggacctcatcaacggcttcggcaagaaccagaccgacctccgcaccatgaccgacgaggtcgccaagtatgcgctctacttcgtctacctggggctggtggtttgcgtctcctcctacgcagagatcgcgtgctggatgtacaccggggaacggcaggtgatcgcgctccggaaggcgtaccttgacgccgtgctgcggcaggatgtggggttcttcgacacggacgcgcgcacgggcgacatcgtcttcggtgtctccaccgacacgctgctcgtgcaggatgccatcggcgagaaggtcggcaacttcatgcactacatcgccaccttcctggccgggctcgtcgtcggattcgtctcggcgtggcggcttgcgctgcttagtgtggccgtcatcccggccatcgccttcgccggcggcctgtacgcgtacacgctcactgggctcacttccaaaagccgggagtcctatgctaatgctggcgtcgtcgcggagcaggcaattgcacaagtaagaacagtgtactcttttgttggagagagcaaagcgctcaattcctattctgaagcaatccagaacacactgaagcttggttacaaagctgggatggccaaaggtcttggaattggatgtacttatgggatcgcttgcatgtcttgggcacttgtattttggtatgccggggtcttcatcaggaatgggcagactgatggtggaaaggcttttaccgcgatcttttctgcaattgtcggtggcatgagtcttggccaggctttctcaaacctcggagccttcagtaaaggaaagattgctggttacaaactgttggaggtcattcgccagaaaccctccatagtgaatgaccataaggatggaaagtggttggcagaggtccatggaaacatagaattcaaggaagttactttcagttatccatcaaggcctgatgttataatctttcgggatttctctcttttcttccctgctggtaaaacggttgcagttgttggaggcagtgggtctggaaagagcactgttgtggctttgatagaaaggttctatgatcctaatgaaggccaggttttgctagacaatgttgacataaagacactccagttgaggtggctcagagatcagattggtctggtaaaccaagaacctgctctttttgcaacaacaatccttgagaatatactgtatggaaagccagatgcaactattgcagaagttgaggctgcagcgactgcatccaatgcccatggttttatatctcttcttccaaatggttacaacacaatggtaggtgagcgaggcatccagctttctggtggtcagaaacaacgtatagcaatagctcgtgctatgctgaagaatccaaagattctgctccttgatgaggctaccagtgcattagatgcagactcagaaagcattgtgcaagaagctttagaccgtttgatggttgggaggacgactgtagttgttgcccaccgtctgtccactataagaaacgtgaacatgatcgctgtgatccagcaaggccaagttgttgagacgggcacacatgatgaactcctagcaaaaggaacctctggagcatatgcctcccttgtccgttttcaggaaacggcgcgtaatagggatcttgcaggtgcatctacccgcaggtcacggtcaattcacttgacaagctcactttccaccaaatctctcagcctcaggtctggaagtctaaggaacctcagttatcagtacagtactggagcagatggtcgcattgaaatgatttctaatgctgataatgaccgcaaatacccagcaccacgtggatacttcttcaagcttctgaaactgaatgcacctgaatggccttatgcagtgttgggggccattggttccgtcctctcaggatttattggcccaacttttgccattgttatgggtgaaatgcttgatgtgttctactacagggaccccaatgaaatggagaagaaaaccaagctatatgtgttcatctatattggcactggcatatatgctgtcgttgcttatcttgtgcagcattacttcttcagcatcatgggagaaaatcttacaaccagggttaggcggatgatgttgtctgcaatacttaggaatgaagttggttggtttgatgaagaagaaaacaattcaagtcttgtggctgcacgtctagctgttgatgcagctgatgtgaagtcggctatagctgagagaatatcagtcatcctgcagaacatgacatcccttatgacttctttcgttgttggatttatcattgaatggagagtggcaatacttattctggccactttccctctacttgtgcttgccaactttgctcagcaactttcaatgaagggctttgctggtgacacagcaaaggcacatgccaagagcagtatggttgcaggtgaaggagtgagcaatatccgcaccgtagcggccttcaacgctcaaagcaagatcttgtcactcttcagccatgaactgcgtgtaccagagcagcaaatcctccgccgcagccagacatcaggtcttttgtttggcctgtcacagctctgcttatactcctcagaagcgctcatcctctggtatggttctcatcttgtgcggtcacacggatccaccttctctaaggtcatcaaggtttttgttgtccttgtggtgactgccaactccgtagctgagacggtgagcctggccccagagatcatccgcggaggtgaatccatccgatccatctttggcatcctcaacagagcaacaagaattgagcctgatgatccggagtcagagcgggtcaccaccatccgaggcgacattgagttgcggcacgtcgacttttcatatccagcacgcccagacattcaaatcttcaaggacttcaacctgaaaatccatgccgggcgcagccaagcactagtcggagccagcggttcagggaagagcactgtcattgctctcattgagcggttctacgacccgtgtggggggaaagtggccattgatggcaaggacatccggacgctgaacttgaagtccttgcggctgaagatcggcctcgtgcagcaggagccagtcctcttcgcttcgagcatcctagaaaacattgcatacggcaaggaaggtgcgactgaggaggaggtgatcgaggcagcgaagacggcgaacgtgcacggcttcgtcagccagctgcccgatggctacaagacggcggtcggcgagcggggcatgcagctgtcaggcgggcagaagcaacggatcgccattgccagggcggtgctcaaggacccagccatcctgctgctggacgaggcaacgagcgcgctggacgcggagtccgagtgcgtgctgcaggaggcgctggagcggctgatgaaggggcggaccaccgtgctggtggcgcaccggctgtcgacgatccgaggggtggaccgcatcgcggtcgtgcaggacgggcggatcgtggagcacggcagccacaacgacctcctggcccggccggagggcgcctactcgcggctgctgcagttgcagcaccaccgtgtctgacgccgccgccgtgcatgcatcctctgatgatatattaatttaacgatgacatcttcattttggaggtctggtgtggcggcttcttttttcggtttcttgggttggccggtggtcgtgcggatgtagatactagggcaaaccgtgtgtgttcttctgaatgaacttggaaaatgtgatctgtatcttctccctgggatggaatgtaccatgcaatgcaactcttttcgtccacatttactcatctgtcctcgaattctttagcattaggtttaattagatctctaaaaaaaaga

SEQ ID NO: 3051 - DNA, 4763 bp, Zea mays
tagcaatccaggtgaaagagcggagcgagcggtaaagctcaccgccagtgagcggaagtggcctgtggctctccctgaccccgcgcccacactgcactgcactgcccttcctctttatcactcgcctcgactccgcgctagcttctctgagcatcgcagcgccgaacacaaaagctcaccaccaccaccaaaaacctccactgcacgtcacagataccgagggcgcttccgaatttctccctctccctcactttgcagaccgccagccctaccggaggccaggaggcaagcaaaagcggcgacatcttcacagatgccgcagggcgcggcggctgcggcctgagagtgagagcgcgctgtcgaggtccgactccgggtcaggcgggggagcgcattgcgatggcggagtcggcggcgacggacggcaaggcggataaggtggcgaacggaggagggggaggcggcgatgcggcgggggaggggaagaagaggggggaccaggccgtggcgttccacgagcttttctcgttcgccgacaagtgggacctgatgctcatggccgcgggcagcctgggcgcgctggctcacggcgccgccatgccgttcttcttcctgctcttcggcgacctcatcaacggtttcggcaagaaccagaccgacctccgcaccatgaccgacgaggtcgccaagtatgcgctctacttcgtctacctggggctggtggtctgcgtctcttcctacgcagagatcgcgtgctggatgtacaccggggagcggcaggtgatcgcgctccggaaggcgtacctggacgccgtgctgcggcaggacgtggggttcttcgacacggacgcgcgcacgggtgacatcgtcttcggcgtgtccaccgacacgctgctcgtgcaggatgccatcggcgagaaggtcgggaacttcatgcactacatcgccaccttcctggccgggctggtcgtcggcttcgtctcggcgtggcggcttgcgctgctcagtgtggccgtcatcccggccatcgccttcgccggtggcctgtacgcgtacacgctcactgggctcacttccaaaagccgggagtcctataccaatgctggtgtcgtcgccgagcaggcaattgcacaagtaagaacagtgtactcttttgtcggagagagcaaagctctcaattcctattctgaagcaattcagaacacactgaagcttggttacaaagctgggatggccaaaggtcttggaattggatgtacttatgggatagcttgcatgtcatgggcactggtattttggtatgccggggtcttcatcaggaatgggcagtccgatggtggaaaggcttttaccgcgatcttttctgcaattgtcggtggcatgagtcttggccaggctttctcaaaccttggagccttcagtaaaggaaagattgccggttacaaactgttggaggtcattcgccagaaaccctccatagtcaatgatcataaggatggaaagtggttggctgaggtccacggaaacatagaattcaaggaagtcactttcagttatccatcaaggcctgatgttataatctttcgggatttctctcttttcttccctgctggtaaaactgttgcagtcgttggaggcagtgggtctggaaagagcactgttgtggctttgatagaaaggttctatgatcctaatgaaggccaggttttgctagacaatgttgacataaagacactccagttgaggtggctgagagaccagattggtctggtaaaccaagaacctgctctttttgcgacaacaatcctagagaatatactgtatggaaagccagatgcaactattgcagaagttgaggctgcaacgactgcatccaatgctcatagttttatctgtcttcttccgaatggttacaacacaatggtaggtgagcgaggcatccagctctctggtggtcagaaacaacgtatagcgatcgctcgtgctatgctgaagaacccaaagattctgctccttgacgaggctaccagtgcattagatgcagactcagaaagcattgtgcaagaagctttagaccgtttgatggttgggaggacgactgtagttgttgcccaccgtctgtccactataagaaacgtgaacatgatcgctgtgatccaacaaggtcaagttgttgagactgggacgcatgatgaactccttgcgaaaggaacctctggagcatatgcctcccttattcgttttcaggaaacggcacgtaatagggatcttggaggtgcatctagccgcaggtcacggtcaattcacttgacaagctcactttccaccaaatctctcagcctcaggtctggaagtctaaggaacctcagctatcagtacagtactggagcagatgggcgcatcgagatgatctctaatgctgataatgaccgcaaatacccagcaccacgtggctacttcttcaagcttctgaaactgaatgcacctgaatggccttatgcagtattgggggccattggttctgtcctctcaggatttattggcccaacttttgccatcgttatgggtgaaatgctcgacgtgttctactacagggaccccaatgagatggagaagaaaaccaagctatatgtgttcatctatattggcacaggcatatacgccgtcgttgcttatcttgtgcagcattacttcttcagcatcatgggagagaatcttacaaccagggtcaggcggatgatgttgtctgcaatacttaggaatgaagttggttggtttgacgaagaagaaaacaattcaagtctcgtggctgcgcatctagctgttgatgcagctgatgtgaagtcggccatagctgagagaatatcggtcatcctgcagaacatgacttccctcatgacttctttcgtggttggatttatcattgaatggagagtggcaatacttattctggccactttccctctgcttgtgcttgccaactttgctcagcaactttcaatgaagggcttcgctggtgacactgcaaaggcacatgccaagagcagtatggttgctggtgaaggagtgagcaatatccgcaccgtggcggccttcaacgctcaaagcaagatcttgtcactcttcagccatgaactgcgtgtcccagagcagcaaatcctccgccgcagccagacatcaggtcttctgtttggcctgtcacagctctgcttatactcctcggaagcgctcattctctggtatggttctcatcttgtgcggtcacatgggtccaccttctccaaggtcatcaaggtttttgttgtccttgtggtgaccgccaactccgtagccgagacggtaagcctggccccggagatcatccgtggaggtgaatccatccgatccatctttggcatcctcaacagagcaacaagaatcgagcctgacgatccagagtcagagagggtcaccaccatccgaggtgacattgagttgcggcatgtcgacttttcgtatccagcacgcccggacatccaaatcttcaaggacttcaacctgaaaatccaagctgggcgcagccaggcgctagtcggagccagcggctcagggaagagcaccatcattgctctcatcgagcggttctacgacccgtgcggagggaaagtggccatcgatggcaaggacatccggacgctgaacttgaagtccctgcggcgcaagatcggcctggtgcagcaggagccagtcctcttcgcgtcgagcatcctggaaaacatcgcgtacggcaaggaaggcgcgagcgaggaggaggtggtcgaggcggcgaagacggcgaacgtgcacggcttcgtgagccagctgcccgatgggtacaggaccgcggtcggcgagcggggcatgcagctgtcgggcgggcagaagcagcggatcgccatcgccagggcggtgctcaaggacccggccatcctgctgctggacgaggcgacgagcgcgctggacgcggagtcggagtgcgtgctgcaggaggcgctggagcggctgatgaaggggcggaccaccgtcctggtggcgcaccggctgtcgacgatccgaggggtggaccgcatcgcggtcgtgcaggacgggcgggtcgtggagcacggcagccactccgacctcctggcccggccggagggcgcgtactcgcggctgctgcagttgcagcaccaccgtgtgtgacgacgacgagcctctcctccctctgatgataaaaatcttcggtttggaggcctgggcgaggtggcgggttcttcttcggtttcttgggttggttgggcggtggtcctgtcgtgcggatgtagatactaggccaaaccgtgctgtgttcttatgcataaacttggaacatgtgtgatctgtatcttctccctgggatgggatgtactaccatgaaatgcaactcttttggtccacctcgcctcatctgtcctctcaatctctagcagttaggttatcgccgagctcctcctacgatgatggaagacgagagaaaagaaaatgaattccgctgacagaagggtatggcttgccattaaaaattgaaaaaaaaacttggtcgtgaaatggaaacctaatgctcaagttggagcacaagtttttaactatttaaggattggaaaaaacaagggagacactgaaatcttcatgagacgtccatgtagggccattgctggagtgttgagatgctacaacgcatgaacaaagtttagtttaaacgtctttcgattattttttcagaggaa

SEQ ID NO: 3052 - DNA, 4811 bp, Oryza sativa
gtttttttaattttttatataatttttttaaataagacggatagtcaaacattaaacacggaaaccaggtttgtctctctctctctttttttacggagtgagtagttttcactggcaccgcgccgcgcactgccagcatctctctcctcctctttatctctcgccccgacgccgcgccctacttcctctgaagtctgacctgacctccgcagcgcggaacacaaaagcaccaccaccaccaccctctccctgcacgtcacgaagcccgaggcgaaccaaagcccctcctcctcctcctcctcctctctgtaaccccaccaagaaagcgaagcggagcccggagagtggggagagtgtgtgcgtgtgtgtgtgtgattctccaatgccgcagggcggcgcggcggcggcgtgagaagctgaggcgggtgtgagccgcgcgcgcgcgttgttggctctcggctctgcaagaagggtcaggagggttgggaggggacgcattgcaatggcggagtcggcggcggcggcggcgggggacgggaaggtggagaaggcggcgaacggcggcgtgaacgggtgcgatgcggcgggggaggggaagaagagggcggaccaggcggtggcgttccacgagctgttcacgttcgccgacaagtgggacctggtgctcatggcggcggggagccttggcgcgctcgcccacggcgccgccatgccgctcttcttcctcctgttcggtgacctcatcaacggcttcggcaagaaccagaccgacctccgcaccatgaccgacgaggtctccaagtatgccctctacttcgtctacctcggactggtggtgtgcgcctcctcatacgcagagatcgcgtgctggatgtacaccggggagcggcaggtgatcgcgctgaggaaggcgtacctggacgccgtgctgcgccaggacgtggggttcttcgacacggacgcgcgcacgggggacatcgtgttcggggtctccaccgacacgctgctcgtgcaggacgccatcggcgagaaggtcggcaacttcatccactacatcgccaccttcctcgccgggctggtggtcgggttcgtcgcggcgtggcggctcgcgctgctcagcgtggccgtcatcccggccatcgccttcgccggcggcctgtacgcctacacgctcaccgggctcacctccaagagccgggagtcctatgccaatgccggcgtcgtggcagagcaggcaattgctcaagttagaacagtttactcatttgctggagagagcaaagcactcaattcctactctgaagcaattcagaataccctgaagcttgggtacaaagctgggatggcaaaaggtttgggtattgggtgtacatatggtatagcatgcatgtcatgggcattggtattctggtacgctggtgtcttcatcaggaatgggcagactgacggtggcaaagcctttacagctatcttctctgctattgttggtggcatgagtcttggccaggcattctcaaatcttggagccttcagcaaagggaagattgctggttacaaactgttggaggtcattcgccagaaaccctctatagttcatgatcataaggatgggaagttgctggcagaggtccatggaaacatagaattcaaagatgttacttttagttatccgtcaaggcctgatgtcatgatctttcgggatttctcccttttcttccctgctgcgaaaactgttgcggttgttggaggaagtgggtcgggcaagagtactgttgtggctttgatagaaaggttttatgatcctaatgaaggccaggttttgcttgacaatgttgatattaagacacttcagttgaggtggctgagagatcagattggtcttgtaaaccaagaacctgctctttttgcaacaactatacatgagaacatattgtatggaaagcctgatgctacaatggctgaagtcgaggctgcagcaactgcatccaatgctcatagttttatatctactcttccgaatggctacaacacgatggtaggggaacgaggaatacagctgtctggtggtcagaaacagcgtattgcaatagctcgtgctatgctgaagaaccctaagatactgctccttgatgaagctacaagtgctctagatgcaggctcagaaaacattgtccaagaagctctagaccggctgatgactggaagaacaacggtagttgttgcccaccgtctctccactataagaaatgttaacatgatcgcagtcatccagcagggccaagttgttgagactggcacacatgatgaacttctagcaaaagggagctctggagcgtatgcctccctgattcgttttcaagaaatggcacaaaacagagaccttggtggtgcatctacccgcaggtcacgctcgatgcacctgaccagttcactttccacaaaatctctcagcctcaggtctggaagtttaaggaacctgagctatcagtacagtactggggcaaatggtcgcattgagatgatttcaaatgcagataatgaccgtaaatacccagcaccacgaggttacttcttcaagctcctgaaattgaatgctcctgaatggccttatgcagtgttgggcgctgttggttctgtcctctctggattcattggtccaacattcgccattgttatgggagaaatgcttgatgtgttctactacagggaccccaatgaaatggaaaagaaaacaaaattgtatgtgttcatctatattggcactggcctatatgctgttgtagcttatctcgtgcagcattacttcttcagcatcatgggagaaaatcttacaaccagggttaggaggatgatgctttccgcaatacttacgaatgaagttggttggttcgatgaagaagagaacaactcaagtcttgtggctgctcgtctagcagttgatgcagctgatgtgaagtctgcaatagctgagaggatatcagtgattctgcagaacatgacctcccttatgacatcgttcatcgttggttttattattgagtggagagtagcactgcttatcctggccaccttccctcttcttgtgcttgctaactttgcccagcaactttcgatgaagggcttcgctggtgacacagcaaaggcgcatgccaagagcagcatggttgccggtgaaggagtgagcaacatccgcacagtggcagcattcaatgctcagaacaagatcctttctctgttcagttatgaattgcgcatacctgaacagcagatcctccgccgcagccagacatcaggccttctgtttggcctctcacagctctgcctgtactcatcagaagcactcattctgtggtatggttctcatctggtccggtctcatggatccaccttctccaaggtcatcaaggtctttgttgtccttgttgtgactgccaactccgttgccgagacagtcagccttgccccagagatcgtccgtggaggtgaatccatccgctccatctttggcatcctcaacagggcgacaagaatcgagcctgatgatccagagtcagagcgtgtcaccaatgtccgtggggacattgagcttcggcatgtcgacttcgcctacccggctcgccctgacatccaaatcttcaaggacttcaacctaaaaatccaagctgggcgcagtcaagctctggtgggagccagtgggtctggtaagagcactgtgattgctctcattgagcggttctatgatccgaccgggggcaaggtcaccattgacggcaaggacattaggaggctgaacttgaaggccttgcggctgaagataggcctagtgcagcaggagcctgttcttttcgcagccagcattcttgagaacattgcctatggcaaggacggtgcaacggaggaggaggtgatccaggcggcaaaaacagcaaatgtgcacggcttcgtcagtcagctacccaacggctacaagacggcggtcggcgagcgaggcgtgcagttgtccggtggccagaagcagcggatcgccattgccagggcggtgctcaaggacccggccatcctgctgctggacgaggcgacgagcgcgctggacgccgagtcggagtgcgtgctgcaggaggcgctggagcggctgatgaaggggcggaccaccgtgctggtggcgcaccgcctgtcgacgatccgaggcgtggaccgcatcgccgtcgtgcaggatggccggatcgtcgagcacggcagccactctgatctcgtgtccaggccggagggggcgtactcgcggttgctgcagctgcaacaccacgcctgacgatgattagtatgacataagtcttttgctcttgtgattggaatggttacttgtttcacttcttcttcttcttcttcttcttcttgtggcttggtggttaagttgatgtagataactagggcaaacttctatggtcgttgtgctatctacctaagtttaaactggaacggtgtaagatgtgtcttcctcctgaaacgtatgatgcaaaattgagatgcaattcctctgtctgtcccctatctgttcgtgctactttcaaaattgagatgcaactcctctgcctgaccactatctgttcgtgcgtgctactttctgcgatctctatcaatcgtcaaccgtgcattgcatttctgcgacggaatttatctatgggccactttttcgcaccgaagttctgggaagctggcccatccaaagaaaatcggcttaaatctcggcccaaacgatcaaggcacgaagtgacaaaccaagcttccgaaatgttttctcaacaagcgcctca

SEQ ID NO: 3053 - DNA, 4460 bp, Oryza sativa
cggagtgagtagttttcactggcaccgcgccgcgcactgccagcatctctctcctcctctttatctctcgccccgacgccgcgccctacttcctctgaagtctgacctgacctccgcagcgcggaacacaaaagcaccaccaccaccaccctctccctgcacgtcacgaagcccgaggcgaaccaaagcccctcctcctcctcctcctcctctctgtaaccccaccaagaaagcgaagcggagcccggagagtggggagagtgtgtgcgtgtgtgtgtgtgattctccaatgccgcagggcggcgcggcggcggcgtgagaagctgaggcgggtgtgagccgcgcgcgcgcgttgttggctctcggctctgcaagaagggtcaggagggttgggaggggacgcattgcaatggcggagtcggcggcggcggcggcgggggacgggaaggtggagaaggcggcgaacggcggcgtgaacgggtgcgatgcggcgggggaggggaagaagagggcggaccaggcggtggcgttccacgagctgttcacgttcgccgacaagtgggacctggtgctcatggcggcggggagccttggcgcgctcgcccacggcgccgccatgccgctcttcttcctcctgttcggtgacctcatcaacggcttcggcaagaaccagaccgacctccgcaccatgaccgacgaggtctccaagtatgccctctacttcgtctacctcggactggtggtgtgcgcctcctcatacgcagagatcgcgtgctggatgtacaccggggagcggcaggtgatcgcgctgaggaaggcgtacctggacgccgtgctgcgccaggacgtggggttcttcgacacggacgcgcgcacgggggacatcgtgttcggggtctccaccgacacgctgctcgtgcaggacgccatcggcgagaaggtcggcaacttcatccactacatcgccaccttcctcgccgggctggtggtcgggttcgtcgcggcgtggcggctcgcgctgctcagcgtggccgtcatcccggccatcgccttcgccggcggcctgtacgcctacacgctcaccgggctcacctccaagagccgggagtcctatgccaatgccggcgtcgtggcagagcaggcaattgctcaagttagaacagtttactcatttgctggagagagcaaagcactcaattcctactctgaagcaattcagaataccctgaagcttgggtacaaagctgggatggcaaaaggtttgggtattgggtgtacatatggtatagcatgcatgtcatgggcattggtattctggtacgctggtgtcttcatcaggaatgggcagactgacggtggcaaagcctttacagctatcttctctgctattgttggtggcatgagtcttggccaggcattctcaaatcttggagccttcagcaaagggaagattgctggttacaaactgttggaggtcattcgccagaaaccctctataattcatgatcataaggatgggaagttgctggcagaggtccatggaaacatagaattcaaagatgttacttttagttatccgtcaaggcctgatgtcatgatctttcgggatttctcccttttcttccctgctgcgaaaactgttgcggttgttggaggaagtgggtcgggcaagagtactgttgtggctttgatagaaaggttttatgatcctaatgaaggccaggttttgcttgacaatgttgatattaagacacttcagttgaggtggctgagagatcagattggtcttgtaaaccaagaacctgctctttttgcaacaactatacatgagaacatattgtatggaaagcctgatgctacaatggctgaagtcgaggctgcagcaactgcatccaatgctcatagttttatatctactcttccgaatggctacaacacgatggtaggggaacgaggaatacagctgtctggtggtcagaaacagcgtattgcaatagctcgtgctatgctgaagaaccctaagatactgctccttgatgaagctacaagtgctctagatgcaggctcagaaaacattgtccaagaagctctagaccggctgatgactggaagaacaacggtagttgttgcccaccgtctctccactataagaaatgttaacatgatcgcagtcatccagcagggccaagttgttgagactggcacacatgatgaacttctagcaaaagggagctctggagcgtatgcctccctgattcgttttcaagaaatggcacaaaacagagaccttggtggtgcatctacccgcaggtcacgctcgatgcacctgaccagttcactttccacaaaatctctcagcctcaggtctggaagtttaaggaacctgagctatcagtacagtactggggcagatggtcgcattgagatgatttcaaatgcagataatgaccgtaaatacccagcaccacgaggttacttcttcaagctcctgaaattgaatgctcctgaatggccttatgcagtgttgggcgctgttggttctgtcctctctggattcattggtccaacattcgccattgttatgggagaaatgcttgatgtgttctactacagggaccccaatgaaatggaaaagaaaacaaaattgtatgtgttcatctatattggcactggcctatatgctgttgtagcttatctcgtgcagcattacttcttcagcatcatgggagaaaatcttacaaccagggttaggaggatgatgctttccgcaatacttacgaatgaagttggttggttcgatgaagaagagaacaactcaagtcttgtggctgctcgtctagcagttgatgcagctgatgtgaagtctgcaatagctgagaggatatcagtgattctgcagaacatgacctcccttatgacatcgttcatcgttggttttattatcgagtggagagtagcactgcttatcctggccaccttccctcttcttgtgcttgctaactttgcccagcaactttcgatgaagggcttcgctggtgacacagcaaaggcgcatgccaagagcagcatggttgccggtgaaggagtgagcaacatccgcacagtggcagcattcaatgctcagaacaagatcctttctctgttcagttatgaattgcgcatacctgaacagcagatcctccgccgcagccagacatcaggccttctgtttggcctctcacagctctgcctgtactcatcagaagcactcattctgtggtatggttctcatctggtccggtctcatggatccaccttctccaaggtcatcaaggtctttgttgtccttgttgtgactgccaactccgttgccgagacagtcagccttgccccagagatcgtccgtggaggtgaatccatccgctccatctttggcatcctcaacagggcgacaagaatcgagcctgatgatccagagtcagagcgtgtcaccaatgtccgtggggacattgagcttcggcatgtcgacttcgcctacccggctcgccctgacatccaaatcttcaaggacttcaacctaaaaatccaagctgggcgcagtcaagctctggtgggagccagtgggtctggtaagagcactgtgattgctctcattgagcggttctatgatccgaccgggggcaaggtcaccattgacggcaaggacattaggaggctgaacttgaaggccttgcggctgaagataggcctagtgcagcaggagcctgttcttttcgcagccagcattcttgagaacattgcctatggcaaggacggtgcaacggaggaggaggtgatccaggcggcaaaaacagcaaatgtgcacggcttcgtcagtcagctacccaacggttacaagacggcggtcggcgagcgaggcgtgcagttatccggtggccagaagcagcggatcgccattgccagggcggtgctcaaggacccggccatcctgctgctggacgaggcgacgagcgcgctggacgccgagtcggagtgcgtgctgcaggaggcgctggagcggctgatgaaggggcggaccaccgtgctggtggcgcaccgcctgtcgacgatccgaggcgtggaccgcatcgccgtcgtgcaggatggccggatcgtcgagcacggcagccactctgatctcgtgtccaggccggagggggcgtactcgcggttgctgcagctgcaacaccacgcctgacgatgattagtatgacataagtcttttgctcttgtgattggaatggttacttgtttcacttcttcttcttcttcttcttcttcttgtggcttggtggttaagttgatgtagataactagggcaaacttctatggtcgttgtgctatctacctaagtttaaactggaacggtgtaagatgtgtcttcctcctgaaacgtatgatgcaaaattgagatgcaattcctctgtctgtcccctatctgt

SEQ ID NO: 3054 - DNA, 4331 bp, Hordeum vulgare
cttccctccctcacagagctctgagctctgaccccgccgcgcctcggcactctcctctttatctctcgccccaaggccgtgcctacttctgaccaccgcggcgcggagcacaaaggcaccaccagtcagtccgccaccaccctccctcccacaaacctctcctgcacgtcacgaaacccgaggcgagagccagagccccaatccaaccaagaaagcaaaaggccaagcagtgccctcgccgtccaatgccccagcgcgcggcggcgtcaatggcggcctgagagcgcgagcgagctagcgagggtgggcgaacgggctgcgcactgcgatggcggacccggcggcggcggagaagatggagaaggcggcgaacgggtcggcggcaggtgggtgcgatgcggcggcgccggcggccgggcagggcaagaagcgggcggaccaggcggtggcgttccacgagctcttctcgttcgccgaccggtgggacctggcgctcatgtcgctcggcaccgtcggcgcgctggcgcacggcgccgccatgccctgcttcttcctgctcttcggggacctcatcaacggcttcggcaagaaccagaccgacctccgcaccatgaccgacgaggtcgccaagtatgcgctctacttcgtctacctcggactggtggtctgcgtcgcctcctacgcagagatcgcgtgctggatgtacaccggggagcggcaggtgatcgcgctccggaaggcgtacctggacgccgtgctgcggcaggacgtggggttcttcgacacggacgcgcgcacgggggacatcgtcttcggcgtgtccaccgacacgctgctcgtgcaggacgccatcggcgagaaggtgggcaacttcatgcactacctggccaccttctttgcggggctcgtcgtcggtttcgtctccgcgtggcggctcgcgctgctcagcgtcgccgtcatccccgccatcgccttcgccggcggcctctacgcctacacgctcaccgggctcacctccaagagccgcgagtcctacgccaatgccggcgtcgtcgccgagcaggcaattgcacaagttagaacagtttactcatttgttggagagagcaaagcactcaattcgtactccgaagcaatccagaatacactgaagcttggttacaaagccgggatggcaaaaggtcttggtattgggtgcacttacgggatagcgtgcatgtcatgggcgctagtattctggtatgccggtgtcttcatcaggaatgggcagagcgatggtggcaaggcgtttactgcaatcttttctgcaattgttggtggcatgagtcttggccaggcattctcaaaccttggagccttcagcaaagggaagattgccggatacaaactgctggaggtcattcgtcagaagccctccatagttcatgatcataaggatggcaagttgttggcggaggtccatgggaatattgaattcaaggatgttactttcagttatccatcaaggcctgatgctatgatctttcgggatttctctctgttctttcctgccgggaaaactgttgcagttgttggaggcagtggatctggaaagagcactgttgtggctctgatagaaaggttctacgatcctaatgaaggccaggttttgctggacaatgttgatatcaagacactccagttgaggtggctgagggatcaaattggactagtaaaccaagaacctgccctttttgcaaccactatcattgagaatatactgtatggaaagcctgatgccacaattgcagaagttgaggctgcagcaactgcatccaatgctcatagttttatctctctcctgcccaatgggtacaacacaatggttggagagcgaggaattcagctatctggtggtcagaaacagcgtattgcaattgctcgtgctatgctgaaggaccccaagatactgctccttgatgaagcgaccagtgctttagacgcagactcggaaaacattgtgcaagaagctctagaccgcctgatggttgggaggactacagttattgttgcacaccgtctgtgtactatcagaaatgtgaacatgatcgcagtgctacaacagggccaagttgttgagactgggacacatgatgaacttctagcaaaaggatcctctggagcatatgcctcactgatccgctttcaggaaacggcacgtaacagagatcttggtgctgcatctacacgtaggtcgcgctcgatgcacttgacaagctctctctccaccaaatctctgagcctcaggtcaggaagtttacggaacctgagctatcagtacagtactggagcagatgggcgcattgagatgatatcaagtgcagacaatagcctgaaatacccagcaccacgtggttactttttcaagctcctaaaactgaatgctcctgaatggccatatgcggtgttgggtgctatcggttctgttctatctggattcatcggtccaacatttgccattgttatgggtgaaatgctcgatgtgttctactacaaggaccccgttgaaatggagaagaaaaccaagctttatgtgttcatctatattggcacaggcatctacgctgtagttgcttatcttgtgcagcattatttcttcagcataatgggagaaaatcttacaaccagagttaggaggatgatgctatctgcgatacttcggaacgaagttggttggtttgatgaagaagaaaacaactctagtcttgtggctgctcgggtagcagttgatgctgctgatgtgaaatcagcgatagctgagaggatatcagtgatactgcagaacataacatccctgatgacatctttcgtcgtcggttttatcatcgagtggagagtggcgatccttattctggccactttccctcttcttgtgcttgccaacttcgctcagcaactttcgatgaagggctttgctggtgacacagcaaaggcacacgccaagagcagcatggttgccggtgaaggcgtgagcaacattcgcaccgtggcggccttcaacgctcaaaacaaggtcatgtctctcttcagccacgagctgcgcataccagaggagcagatcctgcgccgcagccagaccgcgggtctcctgtacggcctctcgcagctctgcctttactgctcagaagcgctcattctctggtatggttctcacctcgtccggtcacatgggtcgaccttctccaaggtcatcaaggtcttcgtcgtccttgtggtgaccgccaactccgtggctgagacggtcagccttgcgccggagatcatccggggaggcgaatctattcgctccatcttcggcatcctcaacagggcgacgaggatcgagcctgatgatccggaggcagagcgtgtcaccactgttcgtggcgacattgagctgcggcatgtggacttctcttatccgtctcgacctgacattgagatcttcaaggatttcaacctgaagatccaggccgggcgcagccaggctctggtcggagccagtggttccggcaagagcaccgtcatcgccctcatcgagcggttctacgacccgacaggcggcaaggtgatgatcgacggcaaggacatcaggaggctgaacctcaagtccctgcgtcgcaagatcgggctggtgcagcaggagccggtcctcttcgcctccagcatcctggagaacatcgcgtacggcaaggaaggcgcgacggaggaggaggtgatcgatgcggccaagacggccaacgtgcacgcgttcgtgagccagcttcccgacgggtaccggacggcggtgggcgagcgtggcgtgcagctgtcgggcgggcagaagcagcggatcgccatcgccagggcggtgctcaaggacccggccatcctgctgctggacgaggcgacgagcgcgctggacgccgagtcggagagcgtgctgcaggaggcgctggagcggctgatgaaggggcggacgacggtgctggtggcgcaccggctgtcgacgatccgcggcgtggaccgcatcgccgtggtgcaggacgggcgcgtcgtggagcacggcgggcactcggagctcgtcgcgcggcccgagggggcctactcgcggctgctgcagctgcagaaccaccgcaactgattgataccatttgatcttggtgatttttgtgggtggtggtggtctggtctggtctagtgggggtgtagatactagggcgaccgtgtgttactggtcttattatctttgtgcttgaactgccaccttgtgatctgatcttgatctgtatcttctccatgatgaaaatgcatgatgcaattctcgttttcct

SEQ ID NO: 3055 - DNA, 4358 bp, Hordeum vulgare
ccgcgcctcggcactctcctctttatctctcgccccaaggccgtgcctacttctgaccaccgcggcgcggagcacaaaggcaccaccagtcagtccgccaccaccctccctcccacaaacctctcctgcacgtcacgaaacccgaggcgagagccagagccccaatccaaccaagaaagcaaaaggccaagcagtgccctcgccgtccaatgccccagcgcgcggcggcgtcaatggcggcctgagagcgcgagcgagctagcgagggtgggcgaacgggctgcgcactgcgatggcggacccggcggcggcggagaagatggagaaggcggcgaacgggtcggcggcaggtgggtgcgatgcggcggcgccggcggccgggcagggcaagaagcgggcggaccaggcggtggcgttccacgagctcttctcgttcgccgaccggtgggacctggcgctcatgtcgctcggcaccgtcggcgcgctggcgcacggcgccgccatgccctgcttcttcctgctcttcggggacctcatcaacggcttcggcaagaaccagaccgacctccgcaccatgaccgacgaggtcgccaagtatgcgctctacttcgtctacctcggactggtggtatgcgtcgcctcctacgcagagatcgcgtgctggatgtacaccggggagcggcaggtgatcgcgctccggaaggcgtacctggacgccgtgctgcggcaggacgtggggttcttcgacacggacgcgcgcacgggggacatcgtcttcggcgtgtccaccgacacgctgctcgtgcaggacgctatcggcgagaaggtgggcaacttcatgcactacctggccaccttctttgcggggctcgtcgtcggtttcgtctccgcgtggcggctcgcgctgctcagcgtcgccgtcatccccgccatcgccttcgccggcggcctctacgcctacacgctcaccgggctcacctccaagagccgcgagtcctacgccaatgccggcgtcgtcgccgagcaggcaattgcacaagttagaacagtttactcatttgttggagagagcaaagcactcaattcgtactccgaagcaatccagaatacactgaagcttggttacaaagccgggatggcaaaaggtcttggtattgggtgcacttacgggatagcgtgcatgtcatgggcgctagtattctggtatgccggtgtcttcatcaggaatgggcagagcgatggtggcaaggcgtttactgcaatcttttctgcaattgttggtggcatgagtcttggccaggcattctcaaaccttggagccttcagcaaagggaagattgccggatacaaactgctggaggtcattcgtcagaagccctccatagttcatgatcataaggatggcaagttgttggcggaggtccatgggaatattgaattcaaggatgttactttcagttatccatcaaggcctgatgctatgatctttcgggatttctctctgttctttcctgccgggaaaactgttgcagttgttggaggcagtggatctggaaagagcactgttgtggctctgatagaaaggttctacgatcctaatgaaggccaggttttgctggacaatgttgatatcaagacactccagttgaggtggctgagggatcaaattggactagtaaaccaagaacctgccctttttgcaaccactatcattgagaatatactgtatggaaagcctgatgccacaattgcagaagttgaggctgcagcaactgcatccaatgctcatagttttatctctctcctgcccaatgggtacaacacaatggttggagagcgaggaattcagctatctggtggtcagaaacagcgtattgcaattgctcgtgctatgctgaaggaccccaagatactgctccttgatgaagcgaccagtgctttagacgcagactcggaaaacattgtgcaagaagctctagaccgcctgatggttgggaggactacagttattgttgcacaccgtctgtgtactatcagaaatgtgaacatgatcgcagtgctacaacagggccaagttgttgagactgggacacatgatgaacttctagcaaaaggatcctctggagcatatgcctcactgatccgctttcaggaaacggcacgtaacagagatcttggtgctgcatctacacgtaggtcgcgctcgatgcacttgacaagctctctctccaccaaatctctgagcctcaggtcaggaagtttacggaacctgagctatcagtacagtactggagcagatgggcgcattgagatgatatcaagtgcagacaatagcctgaaatacccagcaccacgtggttactttttcaagctcctaaaactgaatgctcctgaatggccatatgcggtgttgggtgctatcggttctgttctatctggattcatcggtccaacatttgccattgttatgggtgaaatgctcgatgtgttctactacaaggaccccgttgaaatggagaagaaaaccaagctttatgtgttcatctatattggcacaggcatctacgctgtagttgcttatcttgtgcagcattatttcttcagcataatgggagaaaatcttacaaccagagttaggaggatgatgctatctgcgatacttcggaacgaagttggttggtttgatgaagaagaaaacaactctagtcttgtggctgctcgggtagcagttgatgctgctgatgtgaaatcagcgatagctgagaggatatcagtgatactgcagaacataacatccctgatgacatctttcgtcgtcggttttatcatcgagtggagagtggcgatccttattctggccactttccctcttcttgtgcttgccaacttcgctcagcaactttcgatgaagggctttgctggtgacacagcaaaggcacacgccaagagcagcatggttgccggtgaaggcgtgagcaacattcgcaccgtggcggccttcaacgctcaaaacaaggtcatgtctctcttcagccacgagctgcgcataccagaggagcagatcctgcgccgcagccagaccgcgggtctcctgtacggcctctcgcagctctgcctttactgctcagaagcgctcattctctggtatggttctcacctcgtccggtcacatgggtcgaccttctccaaggtcatcaaggtcttcgtcgtccttgtggtgaccgccaactccgtggctgagacggtcagccttgcgccggagatcatccggggaggcgaatctattcgctccatcttcggcatcctcaacagggcgacgaggatcgagcctgatgatccggaggcagagcgtgtcaccactgttcgtggcgacattgagctgcggcatgtggacttctcttatccgtctcgacctgacattgagatcttcaaggatttcaacctgaagatccaggccgggcgcagccaggctctggtcggagccagtggttccggcaagagcaccgtcatcgccctcatcgagcggttctacgacccgacaggcggcaaggtgatgatcgacggcaaggacatcaggaggctgaacctcaagtccctgcgtcgcaagatcgggctggtgcagcaggagccggtcctcttcgcctccagcatcctggagaacatcgcgtacggcaaggaaggcgcgacggaggaggaggtgatcgatgcggccaagacggccaacgtgcacgcgttcgtgagccagcttcccgacgggtaccggacggcggtgggcgagcggggcgtgcagctgtcgggcgggcagaagcagcggatcgccatcgccagggcggtgctcaaggacccggccatcctgctgctggacgaggcgacgagcgcgctggacgccgagtcggagagcgtgctgcaggaggcgctggagcggctgatgaaggggcggacgacggtgctggtggcgcaccggctgtcgacgatccgcggcgtggaccgcatcgccgtggtgcaggacgggcgcgtcgtggagcacggcgggcactcggagctcgtcgcgcggcccgagggggcctactcgcggctgctgcagctgcagaaccaccgcaactgattgataccatttgatcttggtgatttttgtgggtggtggtggtctggtctggtctagtgggggtgtagatactagggcgaccgtgtgttactggtcttattatctttgtgcttgaactgccaccttgtgatctgatcttgatctgtatcttctccatgatgaaaatgcatgatgcaattctcgttttcctcgctggtttcctgtgtgatgtgtgatgcaacctttctgtctcgaattgattcggtcagcccag

SEQ ID NO: 3056 - DNA, 4692 bp, Zea mays
cccgcgcccacgctgcagtgcccagtgccctcctcttttttattactcgccccgacgcagtagcttctgactgaccaccgcagtgcggaacacaaaagctcaccagtcacccctgcggcgccacccccacaaacctcgcctgcacgtcaccaataccgaggctatccccggcaggcgcttccggattcccccctttcttcctttgcagcctgccaggcaccgctggccaagagacaagcaaaaacggcgacaccttcaccaatgccgcagggcgccgctgctgcggcctgagagtgcgagccccgctaccgaggtccgggtcaggcggggggtgtggggggggggagcgcattgcgatggcggagtcggcggcggctgacgggaagtcggacaaggtggcgaacggaggagggggaggcggcgatgcagcgggggaggggaagaagcggggggaccaggccgtggcgttccacgagctcttctcgtttgccgacaagtgggacctgatgctcatggcggcgggcagcatgggtgcactggcgcacggcgccgccatgccgttcttcttcctgctcttcggggacctcatcaacggcttcggcaagaatcagaccgacctccgcaccatgaccgatgaggtcgcaaagtacgcgctctacttcgtctacctggggctggtggtctgcgtctcctcctacgcagagatcgcgtgctggatgtacaccggggagcggcaggtgatcgcgctccggaaggcttacctggacgccgtgctgcggcaggacgtgggtttcttcgatacggacgcgcgcacgggcgacatcgtcttcggcgtctccaccgacacgctgctcgtgcaggatggcatcggcgagaaggtcggcaacttcatgcactacatcgccaccttcctggcggggctcgtcgtcgggttcgtctcggcatggcggcttgcgctgctcagtgtggccgtcatcccggccatcgccttcgccggcggcctgtacgcgtacacgctcaccgggctcacttccaaaagccgggagtcgtatgctaatgccggcgtcgtcgcggagcaggcaattggacaagtaagaacagtgtactcttttgtcggagagagcaaagcgctcaattcatattctgaagcaatccagaacacactgaagcttggttacaaagctgggatggccaaaggtcttggaattggatgtacttatgggatagcttgcatgtcatgggcactggtattttggtatgctggggtcttcatcaggaatgggcagactgatggtggaaaggcttttaccgcgatcttttctgcaattgtcggtggcatgagtcttggtcaggctttctcaaaccttggagccttcagtaagggaaagattgctggttacaaactgttggaggtcattcgccagaaaccctccatagtcaatgatcataaggatggaaaatggttggcagaggtccatggaaacatagaattcaaggaagttactttcagttatccatcaaggcctgatgttataatcttccgggatttctctcttttcttccctgctggtaaaacagttgcagttgttggagggagtgggtctggaaagagcactgttgtggctttgatagaaaggttctatgatcctaatgaaggccaggttttgctagacaatgttgacataaagacactccagctgaggtggcttagagaacagattggtctggtaaaccaagaacctgctctttttgcaacaacgatcctcgagaatatactgtatggaaagccagatgcaactattgcagaagttgaggctgcagcgactgcatccaatgcacatagtttcatatctcttcttccgaatggttacaacacaatggcaggtgagagaggaatccagctctctggtggtcagaaacaacgtatagcaatagctcgtgctatgctgaaaaacccaaagatcctgctcctggatgaggctaccagtgcattagatgcagactcggaaagcattgtgcaagaagctttagaccgtttgatggttgggaggacgactgtagttgttgcccaccgtctgtcgacgataagaaacgttaacatgatcgctgtgatccaacaaggccaagttgttgagactgggacgcatgatgaactcattgcaaaaggaacctctggagcatatgcctcccttgttcgttttcaggaaacggcacggaacagggatcttggaggtgcatctagccgcaggtcacggtcaattcacttgacaagctcactttccaccaaatctctcagcctcaggtctggaagtctaaagaacctcagctatcagtacagtactggagcagatggtcgcattgagatgatttctaatgctgataatgaccgcaaatacccagcgccacgtggctacttcttcaagcttctgaaactgaacgcacctgaatggccatatgcagtgttgggggccattggttctgtcctctccggatttattggcccaacttttgccattgttatgggtgaaatgcttgatgtgttctactacagggaccccaatgaaattgagaagaaaaccaagctatatgtgttcatttatattggcacaggcatatatgccgttgttgcttatcttgtgcagcattacttcttcagcatcatgggggaaaatcttacaaccagggttcggaggatgatgttgtccgcaatacttaggaatgaagttggttggtttgacgaagaagaaaacaactctagtcttgtggctgcgcgtctaggtgttgatgcagctgatgtgaagtcggctatagccgagagaatttcagtcatcctgcagaacatgacttctcttatgacttctttcgtcgttggatttatcatcgagtggagagtggcaatacttattctggccactttccctctgcttgtgcttgccaactttgctcagcaactttcaatgaagggctttgctggtgatacggcaaaggcacatgccaggagcagtatggttgcaggtgaagcagtgagcaatatccgcaccgtagcggcgttcaacgctcaaagcaagatcctgtcactcttcagccatgaactgcgtgtgccagagcagcaaatcctccgccgcagccagacatctggtcttctgtttggcctgtcacagctctgcttatactcctcagaagcgctcatcctctggtatggttctcatctcgtgcggtcacatgggtccaccttctccaaggtcatcaaggtttttgttgtcctggtggtgactgccaactcggtagccgagacggtgagcctggccccagagatcatccgcggaggtgagtccatccgatccatcttcggcatcctcaacagagcaacgagaatcgagcctgacgatccagagtcagagcgtgtcaccaccatccgaggggacatcgagctgcggcatgtagacttctcgtatccagcacgcccagacattcaaatcttcaaggacttcaacctgaaaatccaagctgggcgcagccaggcactagtcggagccagcggttcaggcaagagcaccgtcattgctctcatcgagcggttctatgatccatgcgggggcaaagtggccatcgacggcaaggacatccggacgctgaacctgaagtccttgcggctcaagatcggactcgtgcagcaggagccggtcctcttcgcatcgagcatcctagagaacattgcgtacggcaaggaaggcgcgagcgaggaggaggtggtggaggcggcgaagacggcgaacgtgcacggcttcgtcagccagctgcccgacggctacaggacggcggtcggcgagcaggggatgcagctgtcaggcgggcagaagcaacggatcgccatcgccagggcggtgctcaaggacccggccatcctgctgctggacgaggcgacgagcgcgctggacgcggagtccgagtgcgtgctgcaggaggcgctggagcggctgatgaaggggcggaccaccgtgctggtggcgcaccggctgtctacgatccgaggggtggaccgcatcgcggtggtgcaggacgggcgggtcgtggagcacggcagccactccgacctcctggcccggccggagggcgcctacttgcggctgctgcagttgcagcaccatcgtgtctgacggcgccgtgcatcctctgatgatgtatattaattacacgatgacatcttagtttcggaggtctggggcggtggcggcttccttttcggtttcttgggttggcggtggccggtggtcgtgcatggggatgttgatactagggcaaaacgtgttgcgttcttatgcataaacttggaacatgtgatctgtatcttcacctcttctcgtccacctcgatctcctcatcagccctcctctcattctttagcagtaataagttcaccgtgagatcaatggtaatgtggtttatgaagaggaacagatccgagtgccccgagcaagcgcaagaacagatatggaaacagaaatttcattaaaaaaccacgctctatatctttctatactccaatatttttttgatgtattatgtacactctaaagagctgatctaaatctctaattttgactagcgaaaatctaaaataaaatatcaatatttaaagttctaaaagcaactccaacaacctcttttacatcctttctaacacgtaggaat

SEQ ID NO: 3057 - DNA, 4560 bp, Brachypodium distachyon
acaccacaccacttggtccgatcttccctgaccccgccgcaccccctctccaccctttatctctcgccccaaggccgcgcctacttctgaccaccgcggtgctgaaccaaaagctccacaccacccccacatacctctgcctgcacgtcacgaaacccgaggcgaaccccaaagctttctcccccctctcaatccaagaaagcaaagcccagcccagacaggagagcgagagacgcctcctccaatggcggcggcggcggtggcctgagagcgcgagcgaggggggcgggcttggccgaaaggccggaaaggcgggagcgcattgcgatgggggactctgcggcggaagggaaggcggcgaacgggacggcgggaggaggtgatgcggcggcggcagggcaggggcaggggaagaagcgggcggaccaggcggtggcgttccacgagctgttctcgttcgcggacaggtgggacctggcgctgatggcggcgggcagcctgggcgcgctggcgcacggcgccgccatgccctgcttcttcctcctcttcggggacctcatcaacggcttcggcaagaaccagaccgacctccgcaccatgaccgacgaggtcgccaagtacgccctctacttcgtctacctcggactggtggtctgcgtcgcctcctactcagagatcgcgtgctggatgtacaccggggagcggcaggtgatcgcgctccggaaggcgtacctggacgcggtgctgcggcaggacgtggggttcttcgacacggacgcgcgcacgggggacatcgtcttcggcgtctccacggacacgcttctggtgcaggacgccatcggcgagaaggtcggcaacttcatccactacctcgccaccttcttcgcggggctcgtcgtggggttcgtctcggcctggcggctcgcgctgctcagcgtcgccgtcatccccgccatcgccttcgccggcgggctctacgcctacacgctcaccgggctcacctccaggagccgggagtcctatgccaatgccggcgtcgtcgcggagcaggcaattgcacaagttagaacagtttattcatttgttggagagagcaaagcactcaattcatactccgaagcaatccagaacacactgaagcttggttacaaagctgggatggcaaaaggtcttggtattggatgcacttatgggatagcgtgcatgtcatgggcactagtgttctggtatgctggtgtctttatcaggaatggacagagtgatggtggcaaggctttcacggcgatcttttctgccattgtcggtggcatgagtcttggccaggcattctcgaaccttggagcctttagcaaagggaagattgctggttacaaactgctggaggtcattcgccagaaaccttccatagtcaatgatcataaggatggcaagttgttggctgaggttcatggaaatatagaattcaaggatgttattttcagttatccgtcaagacctgacgttatgatctttcgggatttctctttgttctttcctgccgggaaaactgttgcagttgttggaggaagtgggtctgggaagagcactgttgtggctttgatagaaaggttctatgatcctaatgaaggccaggttttgctggacaatgttgacatcaagacactccaattgaggtggctgagagatcagattggtctagtgaaccaagaacctgctctgtttgcaactaccatccttgagaatatactgtatggaaagcctgatgccacgattgcagaagttgaggctgcagcaacggcatccaatgctcatagctttatttctctcctcccgaatgggtacaacacaatggttggggagcgaggaattcagttatctggtggtcagaaacagcgtattgcaatagctcgtgctatgctgaaggaccccaagatactgctccttgatgaagctacaagtgctttagatgcagactcagaaagcattgtgcaagaagctctagaccgcctcatggttgggaggactactgtagttgttgcccaccgtctgtctactataagaaatgtgaacatgattgcagtaatacaacaaggccaagttgttgagactgggacacatgatgaacttgtagtgaagggaagctctggagcatatgcctccctgatacgttttcaggaaatggcacgtaatagagatcttgctgctgcatctacacgcaggtctcgctcgatgcacttgacaagttctctttccaccaaatctctcagcctcaggtcgggaagtttacggaacctgagctaccagtacagcactggagcagatgggcgcattgagatgatctcaaatgcagataatagcctcaaatacccagcaccacgtggttattttttcaagctcttgaaattgaatgctcctgaatggccttatgctgttctgggtgccattggttctgttctctctggattcatcggtccaacatttgccattgttatgggtgaaatgcttgatgtgttctactataaggaccccaatgaaatggagaagaaaaccaagctttatgtgttcatctacatcggcacaggcatatatgctgtagttgcttatcttgtgcagcactacttcttcagcataatgggagaaaatcttacaaccagggttaggaggatgatgctgtcagcaatacttaggaacgaagtcggttggttcgacgaagaagaaaacaactcaagtcttgtggctgctcgtgtagcagttgatgcagctgatgtgaagtcggcgatagccgagaggatttcagtgatattgcagaacattacctcccttatgacatccttcatcgttggttttgtcattgagtggagagtggccctccttattctggccactttccctcttcttgtgcttgccaactttgcccagcaactttcaatgaagggctttgctggcgacacagcgaaggcgcatgccaagagcagcatggtcgccggtgaaggtgtgagcaacatccgcactgtggcagccttcaacgctcaaaacaagatcatgtctctcttcagccatgagttgcgcataccagaggagcagatcctgcgccgcagccagaccgcaggtcttctgtatggcctctcacagctctgcctttactgctcagaagcactcattctctggtatggttctcatttggttcgggcacatgggtcaaccttctccaaagtcatcaaggtttttgttgtccttgttgtgactgccaactccgtagctgagacggtcagccttgcccccgagatcatccgtggaggtgaatctatccgctccatctttggcatcctcaacagggcaacaagaattgagcctgatgatccagagtcagagcgtgtcaccactgttcgtggtgacattgagcttcgccatgttgacttctcctacccatcccgccctgacattgagatcttcaaggatttcaacctgaaaatccaggctgggcgaagccaagctctagttggagctagcggttctggaaagagcactgtcattgccctcattgagcggttctacgacccaactgggggcaaggttatgattgatggcaaggacatcaggaggctgaacctgaagtccctgcggctcaagataggccttgtgcagcaggagcctgtcctgtttgcgtcgagcatccttgaaaacattgcatatggcaaggaaggcgcgaccgaggaagaggtgatcgaggcggcgaagactgcaaacgtgcacacctttgtcagccagctgcctgacggctacaagacggcggtcggcgagcgaggtgtgcagctgtcaggtggacagaagcagcgcatcgccatcgccagagctgtgctcaaggacccggccatcctgttgctggacgaagcgacgagtgcgctggacgccgagtccgagtgcgtgctgcaggaggcgctggagcggctgatgaagggccggaccaccgtcctggtcgcgcaccgcctctcgacgatccgaggggtggaccggatcgccgtcgtccaggacgggcggatcgttgagcacggcggccactcggagctcgtggcacggccagagggcgcgtactcgcgactgctacagctgcagcagcaccgcaactgacgaggccgtcgtgcctgaacctgattagttatgacagcactggaaatttggtggctggagcggtggatttcggttcttttttgttgtggttggtggtgaatgtggatgtaggtactagggtgaccgtgtgtattctcttgtgctgtcctgtcctacctacgcttaaactgcaacttgcaatgtgtttcttcttgctagatgaaatacatgatgatgcaacctctcatttttcatccagtcatgctgtaatatatcatctcttgttattagatgatcacagttgtgctgtagagtgtcattgctaaatcagaagcttctaaagttgtaaaaaagaaaaacttaatttttagatgaagatgatcatcgcaccagaaacacgagtagtttaattattcgtgaaaattctgacaaatccaactagtcacgcgcaca

SEQ ID NO: 3058 - DNA, 4025 bp, Ananas comosus
ggggagggggagaagaagaggcaggagcagagcctggcgttccacgagctcttctccttcgcagacaagtgggattggatgctaatggcggcggggagcgtcggcgccgtcgtgcatggctccgccatgcccgtgttcttcctcttcttcggcgacctcgtcaatggcttcggcaagaaccagtacaacctccgcaagatgaccgacgaagtctccaagtacgctctctatttcgtgtacctagggctagtggtgtgcgtgtcttcgtacgcagagatcgcatgctggatgtacaccggggagcggcaggtgatcgcactccggaagcggtatctcgaagcggtgctgcgacaggacgtagggttctttgatactgacgctcgcacgggcgacatcgtcttcagcgtctccaccgacaccctccttgtccaagacgccattagcgagaaggtcggtaactttatccactacctctccacgttcttggcggggttggtggtgggattcatctccgcgtggcgattggcgcttctcagcgtcgcggttatacccgggatcgccttcgccgggggtctctacgcttatacgctcaccggtctcacctccaagagccgagaatcctacgccaatgccggcatcatcgccgaacaggcaattgcacaagtccgaactgtgtattcatttgtgggagaaagcaaagctcttaattcatactctgaagcaattcagaatacactgaagctcggttataaggctgggatggctaaaggtttagggattgggtgcacctatggaatagcatgtatgtcatgggctttggtgttttggtatgctggcgttttcatcaggaatgggcagactgatggtggaaaggcttttacagcaatattttctgctattgttggtggcatgagtctaggccagtcattctccaaccttggagcctttagtaaagggaagacagcgggttacaagcttttggagataattcgtcaaaaaccctctataattcaagaccaagaagatggaaagtgcttggcagaggtgcatggaaacatagaattcaaggaagttaccttcagctatccttcaagacctgatgtcattatctttcgggacttttccctcttcttccctgctgggaagactgctgcggttgttggaggtagtggatcagggaagagtactgttgtggctctgatagaacggttctatgatcctaatcaagggcaggttttgctggacaatgtggacataaagacgttgcaattgagatggctgagagatcaaattggtctggtaaatcaagagccagctctttttgcaaccactattcttgagaacatactatatggaaagccagatgccaccatggccgaggttgaagctgctgcatctgcttccaatgcccatagcttcattgctcttcttccaaatggctacaacactcaggtgggtgagagaggagtccagctatcgggtggccagaaacaacgtattgctattgcccgtgcgatgttaaagaaccccaagatacttctccttgatgaagccaccagtgcgctggatgctggttccgagagcatagtccaagaagctttggaccgccttatggtgggcagaacaactgttgttgttgctcaccgtctttccaccattagaaatgttgacatgattgctgtgatccaacaaggccaagtcgtcgagactgggacccatgaagaacttcttgcgaaaggaagctcaggagcatatgcctctctaattcggttccaagaaatggctaggaacagggactttggtggcccatcaactcgtagatcccgatcatcacgcttgagccattctctttctaccaaatctctaagcctcagatctgggagtttaaggaacctgagctatcagtacagtactggagcggacggccgaatagagatggtttctaatgcagataatgaccggaagtatccagcaccacggggttactttttcaagcttctgaagctaaatgcaccggagtggccctacaccatattgggtgccatcgggtctgtcctctctgggttcattggtccaacgtttgcactagtgatgagcaatatgattgaagtgttttactatagggaccctaatgcaatggagagaaagataaaaaagtatgtgtttatctatattggcacggggctttatgcagtgggtgcttatcttgtgcagcattacttcttcagcatcatgggggaaaatctgactaccagggttcgaagaatgatgcttgctgctatatttagaaatgaagtgggttggtttgatgaggaggagaataattcaagtcttgtggctgctcgtttagctacggatgccgctgacgtgaagtccgcaatagctgagaggatctctgttattctacagaacatgacctccctccttgcatctttcatagtcgggtttgtcgttgaatggcgggtcgcacttcttattcttgccactttccctcttcttgtgcttgccaacttcgcccagcaactctcgatgaaggggtttgctggcgacacagcaaaggcacacgccaagaccagcatgattgcaggagagggtgttagtaatatccgcacggtggcagccttcaatgcacaggacaagatcctctctctcttccgccaggagctgcacgtccctcaaaagcgcagcctccgccggagccagacctctgggctcctcttcggcctctcacagctttgtctatacgcatccgaggccctcatcctgtggtatggagcgcatcttgtccgctcccatgtgtctaccttctccaaggtcatcaaggtctttgttgtcctcgtcatcactgccaactcagtcgccgaaacagtgagccttgctcctgagatcatccgtggtggggagtccatccgctctgttttctccatcctcaatcgtggaacacgaattgaccccgatgaacctgaatccgaaccagttgactccattcgtggggagattgagcttcggcacgtcgactttgcctacccatctcggcctgacctccaaatcttcaaggacttcaacctaagaatacgagccggccagagtcaagcacttgttggagccagtggatctggaaaaagcaccgtcatttctcttatcgagcgcttctacgatcccacagcaggcaaggtcatgatagatggcaaggacatccggcggctgaacctgaagtccctgcggctaaagatcggcctcgtgcagcaggaacctgtgctgttcgcagctagcattatggagaacattgcctatggtaaagacagcgcaacagaggaggaactgatcgaggcggcgaaggcggctaacgttcacgggtttgtgagccaactgccggaggggtacaagacggcagtcggggagagaggggtgcaactgtcgggcgggcagaagcaaagaattgcaatagctagggcagtgctcaaggacccgacgattcttcttcttgatgaggcgacaagtgcgttagacgccgaatcggagtgcgtccttcaggaggctctcgagcggctcatgaaggggcggactacggttctggttgctcaccgcctctccactattcggggtgtggattgtattggcgtggtccaagatggccggattgtcgaacaaggtagccattctgagctcgtggcgcggcctgacggggtgtattcgcggttgctacagctgcagaaccatcacgtttgatccctagccatagtgaatttgacatccctcttttgttgttctgagatgatttaaccgattttcgggttcctaaacgtggagaactttggatgtagatagaagagggggctaagcgtatattatgtgtgatgcaaaattggacttagcttaatcctccttaattagggatgcagctatgtatcggatatgctcgttgtggtaatatatttatgatcttaggtgaacaattttcctagtggcaattgacttcaacgtaacatgccatcacactattagatttagcaagtcgggccggg

SEQ ID NO: 3059 - DNA, 4226 bp, Cocos nucifera
acttatttttggagaagaagaggcaggagcagagcgtggcgttctacgagctgttcacgttcgcggaccgctacgatctggctctcatggcggcgggaagtctcggtgcggtggtccatggatcggcgatgccggttttcttcctattattcggcgatctcgtcaatggattcggcaagaaccaggcggatctcggcaagatgaccaacgaggtctccaagtatgctctctactttgtctatctcgggctcattgtgtgcttgtcctcgtacgccgagatcgcctgctggatgtatactggagaaaggcaggtgggtacgtttcgacggcggtacctggaagcagttctgaagcaagacgttggattcttcgacaccgatgcccggacgggggacatagtcttcagcgtctccaccgacaccctgctggtccaggacgccatcagcgagaaggtcggtaactttatccactacctctcgacgttcctggccgggctcgtggtgggtttcatctccgcctggaggctggctctcctcagcgtggctgtgatccctggcatcgccttcgccggcggcctctacgcctatactctcaccggcctcacctccaagggccgggaatcctatgccaacgccgggatcatcgcagagcaggcaattgcacaagtgcgaaccgtatattcatttgttggagagagcaaagccctcacttcctactcagaagcaattcagaacacgctgaagcttgggtacaaagcagggatggcaaaaggtttgggaattgggtgcacatatgggattgcatgcatgtcatgggccttggtgttctggtatgctggcgtcttcatcagaaatgggcagactgatggtggaaaagcttttacagccatattttctgcaattgttggtgggatgagcctaggccaagcattttcaaatcttggagcctttagcaaagggaagattgctggatacaagctgatggagatcattcggcaaaaaccatctattactcaagaaccctccgatgggaaatgtttggctgaggtccatggaaacattgagttcaaagatgttacttttagctacccatcaagacctgatgtcattattttccgagatttctctcttttctttcccgctgggaagacagctgcagttgtcggaggtagtgggtctggaaagagtactgttgtggctctgattgaaaggttttatgatcctaaccaggggcaggttttgctagataatgcggatataaagacactacaactgaaatggctgagagagcaaattggtttggtgaaccaagaacctgcactttttgcaacaaccatacttgagaacatactatatggaaagcctgatgccacaattgctgaaattgaagctgctgcatcggcagctaatgctcatagcttcatttctctacttccgaatgggtacaacacccaggcaggagaaagaggagtacagctatctggtggccagaaacagcgaattgctattgctcgtgccatgctgaagaacccgaagatcctgctccttgatgaagccaccagtgccctggatgctggttctgagagcatcgttcaagaagccctagaccgcctcatggttgggagaacaactgtagttgttgcacaccggctctccactataaagaacgtagatatgatagctgtgatacagcagggtcaagttgttgagactgggacccatgaagagcttcttgcaaagggcagctcaggagcttatgcctctcttattcggttccaggagatggcaagaaacagggactttggtgctccatcaactcgcagatcccggtcttcacgcctgagccattcactttccacgaaatctctaagccttcggtctggaagtttgagaaacttgagctatcagtacagcaccggagcggatggccgtatagagatggtttctaatgcagataatgatcgcaagtatccggcaccacgaggttacttttttaagcttttgaagctaaatgcaccagagtggccttacagtatcttgggtgccatcggatctgtactctctgggttcataggtccaacttttgcaattgtgatgagcaatatgattgaagtgttctactatagagacccaaatgcaatggagaggaagacaagagagtacgtgttcatatacatcggcacagggctttatgctgttgttgcttatctggtgcagcattacttcttcagcatcatgggggaaaatctcaccaccagggtgaggaggatgatgcttgctgcaattctaaggaatgaagtgggctggtttgacgaggatgagaacaattccagccttctagccgcccgcctggctacagatgcagctgatgtgaaatctgcgatcgccgagaggatatcagtgatcctgcagaacatgacttctctccttacgtccttcatagttggcttcatcgttgaatggcgggttgctctccttattcttgccacctttcctcttctcgtcctggctaactttgcacagcaactctcactgaaggggtttgcaggggacacggcaaaagcccatgcaaagacaagcatgattgccggggagggtgtgagcaacatccgcaccgtggcagccttcaacgcacaagaaaagatcctctcgctctttcaccatgagcttcgagttccccagcgccgcagcctccgtcggagccagacatccggccttcttttcggtgtgtcccagctttccctctattcctcggaggctctcatcctctggtatggtgctcatctagtccgctctggtgcttccaccttctccaaggtcatcaaggtctttgttgtccttgtcatcactgccaactccgtcgctgaaacagtcagccttgcaccagagatcatccgaggtggcgaatccattcgctctgtcttctctatcctcaaccgggcaacccgcatcgaccctgatgatcctgaagctgagcccgttgaatccattcgcggtgagattgagctgaggcatgtcgattttgcttatccatctcggcctgatgtgcccattttcaaggacttcaacctaagaatccgcgctggccagagccaagctcttgttggggctagtggatctgggaagagtaccgtcgttgcgctcatcgagcggttctatgatcccactgcagggaaggtcatgatagatggcaaagacgtccggaggctgaacttgaagtccttgagactcaaaattggacttgtacagcaggagcctgcgctctttgctgcgagcatttttgagaacattgcctatggaaaggatggggcggctgaggaggaggtggttgaggcggcacgggctgccaatgtgcatgggttcgtgagtgcactgcccgaggggtacaagacggcagtgggtgagagaggggtgcagctatcgggtggccagaagcagaggatcgctatcgcaagggcggtgcttaaggatccagcggtgctgcttttggatgaggcaacgagcgcattggatgctgaatcagaatgtgttctgcaggaggctttggagcggttgatgagagggcggacgaccatcctagtggcgcaccgcctctctacaattcgaggggtggactccattgcagtggtgcaggatgggcgtatcgtggagcaagggagccactcagagctggtggcccgggctgatggggcatactcccggcttttgcagctgcagcaccatcatgtctgatggaatgtcatcacctccagttgagcctccctccctaccctcatggtagataatttgacatccggttttttgggtgttattttgaagatttgtggttgtagatatgggtgaggggtttagcttctatcttgtcttggtacttaactgaactctgcactgctccttttctccagggagagagaggggtgagcgttggatattgttgttatcataattctcgtatggacttaatttaaactgttttctctgacttggagcggtcgaacggtattattagaacaaaagaaaaaatcagcctcgagtcatcctaatatgtgcgtgggactcagcaggtgttccaaatgtataacttgagttgctctgtcattccttcgtaactttgtacttggaattggaacagcatccctcaatctggacatctgaatgcagccaattagttaatgaagagtgatatgaccccctcccatatcagcttttctaactgaattagaaatg

SEQ ID NO: 3060 - DNA, 4707 bp, Setaria italica
caggagtttagacccgctgatgccgaggggcgccggagcccggagggctacgctcgccgcgcgtgacctgacccctcgagctcagcctcaaactcctatgctatgctgccactcctacttcactcgccccgaagaacggagcgagctttttttttaagcacgcccccaagtgcccggccaaaataatccgcgcactctgcgacggtagtggtgtgctcgaccgcggtataagatcaaaggcgagcagcgggggtgctgctcgaggaggaagaagaggaggggagcggcttttgagccccgagcatacgccggcctcccgtgggttctttagatccgatgccaaggcggtgagggccgcgccacctcttgttgtcgtgaggaggacccgggccgcggagaagggggcgtcgtggcaatggcggaggatgcggggaaggcggaggcggggagctgcagcggcggtggcgggtgcgaggcggtcaagaagcggccggagcagagcgtggcgttccacgagctgttcggcttcgcggacccgctggactggctgctcatggcggccgggagcgcgggcgccgtcgtgcacggcgccgccatgccggtcttcttcctcctcttcggcgagctcgtcaacggcttcggcaagaaccagcacaacctccgacgcatgacggacgaggtgtccaagtactcgctctatttcgtctacctcggcctcgtcgtctgcgcctcgtcgtacctggaaatcgcgtgctggatgtacacgggggagcgccaggtgggcgcgctgcggcggcgctacctggaggccgtgctgcggcaggacgtgggcttcttcgacaccgacgcgcgcaccggcgacgtcgtcttcagcgtctccacggacacgctcctcgtccaggacgccattggcgagaaggtcggcaacttcatccactacctcgcgacgttcctggccgggctggtcgtcgggttcgtctcggcctggcggttggcgctactcagcatcgccgtcatcccgggcatcgccttcgccggcgggctgtacgcatacacgctcaccggcctcacctccaagagccgggactcgtacgccaatgccggaatcatagccgagcaggctatcgcccaggtgaggacggtctactcttatgtgggggagaccaaggctctgaattcgtactcggaggcgattcagaacacactgaagcttgggtacaaggccgggatggcgaaggggcttggcattggctgcacctatggaattgcttgtatgtcatgggcattggtgttctggtatgctggcgtgttcatccggaatggccagacagatggtgggaaggccttcactgcaattttctcagcaatcgtcggcggactgagcctggggcaatcattttcaaatcttggagcattcagcaaagggaaaattgcgggctacaagctgctggaggtgataaggcagaggccaacgatagttcaggacactgcggatggaaggtgcctcgatgaagttcatggcaacatagaattcaaggaagtggcattcagctatccttcacgcccggatgtcatgattttccgtgacttttctctcttcttccccgctggaaaaactgctgcagttgttggaggcagtgggtctggaaagagcactgttgttgctctcattgagcggttttatgatcctaatcaggggcaagttttgctggacaatgtggacatcaagacgctgcaattgaagtggctcagggatcagattggtttggtgaatcaagagccggccctttttgcaactacaatccttgagaatattctttatggcaagcctgatgccacgatggctgaggttgaggctgctgctacttcagccaatgcccatagcttcattgctcttcttcctaacggctacaacactcatgtgggtgagagggggctgcagctctctggtggtcagaagcaacgtattgccattgcccgtgcaatgctgaagaatccaaagatcctgcttctagatgaggccacaagtgcacttgatgctggttcagagagtattgttcaagaagcccttgatcgcttaatggttggaaggaccaccgttgtggttgcacatagattatcgaccataagatgtgttgacatgatcgccgtgatccagcaagggcaagttgttgagactggtactcatgatgaactccttgccaagggtagctcaggagcttatgccgctctcataagatttcaagagacagctagaaaccgtgcgtgcccatcaacccgcaagtcccggtcatcccgcttgagcaactccctgtccacgcggtcactgagcctcaggtcaggaagcttgaggaacctgagctactcatacagcacgggcgctgacggccgcattgagatggtttccaacgccgacaatgaccggaagtacccagcaccaaggggttacttcttcaaactccttaagctgaatgcaccggagtggccctacaccatactgggcgccattgggtccatcctgtctgggtttattggaccgacattcgccattgtgatgagcaacatgatcgaagtgttctattaccggaaccccaacaaaatggaaagcaagaccagggagtacgtgttcatttacatcggcactgggctgtatgccgttgtcgcgtacctcgtccagcactacttcttcagcatcatgggcgagaacctgaccaccagggtgcggaggatgatgctcgccgtgatcttgaggaacgatgtgggatggttcgatcaggaggagaacaattccagcctagttgcggctcgcctcgccaccgacgctgcggacgtgaagtctgccatcgctgagcgcatatcggtcatcctgcagaacatgacctccctcctcgtgtccttcgtggtcggcttcatcattgagtggcgggtcgccctcctcatcctcatcaccttcccactcctcgtgcttgccaacttcgcccagcaactgtcgatgaagggcttcgcgggcgacaccgccaaggcgcacgccaagacgagcatgatcgccggggagggcgtgagcaacatccgcacggtggcggcgttcaacgcgcaggacaagatcctgtccctcttctgcggcgagctgcgcgtgccgcagatgtacagcctgcgccgcagccagatctccggcgcgctcttcggcctctcccagctctcgctgtacgcctcggaggcgctcatcctctggttcggtgcgcacctcgtccgcacccacgtgtccaccttctccaaggtcatcaaggtgttcgtggtcctggtgatcacggccaactccgtcgccgagaccgtcagcctcgcgccggagatcgtccgcggcggggagtccatccgctccgtgttcgccatcctcaacagccggacgcgcatcgaccccgacgagccggacacggagcaggtggagtcggtccgcggcgagatcgacttccgccacgtcgacttcgcgtacccgacgcgccccgacgtgatggtgttcaaggacttcagcctgaggatccgggccgggcagagccaggcgctggtcggcgccagcgggtccgggaagagcaccgtcattgccctcatcgagcgcttctacgacccgctcgccggcaaggtgatgatcgacggcagggacatccggcggctcaacctcaagtcccttcgcctcaagatcgggctggtgcagcaggaacccgtgctgttcgccaccagcatcctggagaacatcgcctacgggaaggacggcgcgacggaggaggaggtggtggaggccgccaaggcggccaacgtgcacggcttcgtcagcgcgctccccgacgggtaccggacccccgtgggcgagcgcggcgtgcagctctccggcgggcagaagcagcgcatcgccatcgcgcgcgcggtgctcaaggaccccgccgtgctgctgctggacgaggcgaccagcgcgctggacgccgagtccgagtgcgtgctgcaggaggcgctggagcgcatcatgaagggacgcacggcggtgctggtggcgcaccggctgtccacgatccggggcgtggactccatcgccgtcgtgcaggacgggcgcgtggtggagcagggcagccacggggacctcgtgtccaggcccgacggtgcctactcgaggctgctgcagctgcagctacaccacggctgatttctcttactggcgttcgagctcccggcgcgcggccggtgtagatactggaaggcggtgtagcgtgggcgtggcactggcccaaccgtggccggaagacgttagacgtgtttcgatgtaaacgacgatcaggaaggattgtgccgacgagtgatgcgggagttgtgctggcactgctggcggctccggcgattttagatcatcctaattctcagatgaaatattcgacccatttggatgcgtatgcttcaaatcgatctgaattctgaacccaacattcgtgtcctaggagctgcagaaattagcttcagatctgaatcatctagggatccaacacgcgcgcagctaaagagtagaaacgatgaaaggaaacgaggttgattgcatgaatctccaacagcggaagccatataggattggcgccgtacgccactaacgggcaaggctttggatcgggccatattttctggcaggctggcccacattcacttggacttggaccgaccgacccatga

SEQ ID NO: 3061 - DNA, 4391 bp, Musa acuminata
acgggatctcactggagctctatatctctctctttgctggctctcatctcaagcaaagcacacacatacacactctcttcttccaagttctaatggcggagatcctgtgcctcgcagcgtcgatccgagctctcaccgcataaggcttggcgcggcagcagatctgaagagaagtggtgaagtgggaacggcgatggcggacgctggggacgggaagacggcggcggcggcgggggacgggggcgagaagaagaggcaggagcagagcgcggcattccacgagctgttctccttcgcggaccggtgggactgcctgctgatggcggcggggagcgtgggggcggtggtgcacggctccgccatgcccgtcttcttcctcctcttcggcgacctcgtcaatggcttcggcaagaaccaaacccacctctccgtcatgacccatgaggtgtccaagtacgccctctatttcgtctacctcgggttggtggtttgcttgtcctcttacgcagagatcggttgctggatgtacaccggggagcggcaggcgagcgcgctccggcggcggtacctggaggcagtgctgcggcaggacgttggcttcttcgacaccgacgcgagaaccggcgacatcgtcttcagtgtctccaccgacaccctcctcgtccaagacgccattagcgagaaggtagccccgccaccccgtctctccttatgccatcatgaccttttgcttcaatgtgagcaggtcggtaacttcattcactacctgtcgacgttcttggccgggctggtggtcggattcatctcggcgtggagactagccctcctcagcgtggccgtcatccccggaatcgcgttcgccggaggtctctatgcctacactctcaccggcctcacctcgaagagccgcgagtcctacgccaacgccggcatcgtcgccgaacagactattgcacaagttcggaccgtatattcttttgttggagaaaacaaagcactcaattcctactctgaagcaattcaaaacacattgaagctcggatacaaagcggggatggcaaaaggtctcggtattggctgcacatatgggattgcttgcatgtcatgggctttggtattttggtatgctggtgtttttattaggaacggacaaactgatggcgggaaggccttcacagccatattttctgctattgtcggtggcatgagcctaggtcagtcattctcaaaccttggggccttcagcaaaggaaaggctgctggatacaagctattggagattatccggcaaaaaccctctataattcaggaccaatcagatgggaagtgtttggaagaggtccacggaaacatagaattcaaagacgtaacctttagctacccgtcacgacctgatgtcattatcttccgagatttctctcttttctttccagcagggaagacagttgctgtcgtgggaggtagtggatctggaaaaagcacagttgtggctttgatagaaagattttatgatcctaaccaagggctggttctgctcgataatgtggatataaagactttacaactaaaatggctaagagaacaaattggtttggtgaatcaagaaccagcactttttgctaccaccatacttgagaacatactctacggaaaacctgatgcaacaattggtgaagttgaagctgctgcctctgctgctaatgctcatagcttcatatcacaacttccaagtgcttacaacactcaggtaggagaacggggagttcagctatctggtggacagaaacagcgtattgccattgcccgagccatgcttaagaatcccaagatccttctccttgatgaagctaccagtgccctggatgcaggatccgagagcattgtccaggaagctctagatcgtctgatggttggaagaaccactgttgttgttgcacaccgactgtcgactataagaaatgtcgacatgattgctgtcattcagcaggggcaagttgttgaaactggagcacatgaggatctcctggcgaaagggagctccggagcctatgcatctctgatacggttccaagagatggcgaggaacagagacttcggcggtccatccactcgcagatcccggtcttcacgcctgagccattcactttccacaaaatctttgtctcttcgatctggcagtttaaggaacttgagctatcagtacagcactggagcagatggtcgtatcgagatggtgtccaatgctgataacgttcgcaagtatccagcacctcgtggctatttcttcaagcttctgaagctaaacgcaccagagtggccttataccattatgggtgccataggatcagttctatctgggttcataggtccaacatttgcaattgtcatgagcaacatgattgaagttttctattacagagacccaaatgctatggagaggaagacaagggagtatgtcttcatatatatcggtacagggctctatgcagttgttgcttatttggtccagcattacttctttagcatcatgggggaaaaccttacaaccagggtgagaaggatgatgcttgccgctatcttacggaacgaagttggctggtttgatgaggaagagaacaattcaagccttgtggctgctcgtttagccaatgatgcagctgatgtgaaatctgcaattgccgagaggatatctgtaatcctgcagaacatgacttcacttcttacttccttcatagttggctttgtagtcgaatggcgtgttgctcttctcattctcgccaccttccctcttctggtgcttgccaacttcgcccagcaactgtcgctgaagggcttcgccggggacacagccaaggcccacgccaagaccagcatgatcgcgggggagggcgtgagcaacatccgcacggtagcggccttcaatgcgcaggccaagatcctgtccctcttctgcaacgaactccgtattccccaacgccgcagcttccggcggagccagacgtcgggcatcctttacggcctctcccagctgtccctctatgcctctgaggccctcatcctctggtacggtgctcatctcgtacgctctggcgcctccaccttctccaaggtcatcaaggtgttcgtggtcctcgtcgtcactgccaactccgtcgccgagacggtcagcctcgcccctgaaatcgtccggggaggagagtccatccgctccgtcttcgccatcctcaaccggggcacacgggtcgagcctgatgacccagaggccgagcacgttgactccgttcgtggggagatcgagctgaggcacgtcgacttcgcctacccatcccggcctgatgtccccatcttcaaggacttcaaccttcgtatccgtgccggccaaagccacgctctcgtcggcgccagtggttccgggaagagcaccgtcattgcactgatcgagcggttctacgaccccacagcggggaaggtcttgatcgacggcaaggacatcaagcggctcaacctgaagtctttgcggctcaagatcgggctggtgcagcaggagccggtgctcttcgccgcgagcatcatggagaacattgcctacggcaaggacggcgcgacggaggaggaagtaatcgaagcagcacgcgccgccaatgtgcacggcttcgtgagcgcgctaccggacggctacaagacagcggtgggcgagaggggggtgcagctatcgggagggcagaagcagcggatcgccatcgccagggcggtactgaaggatccagcggtgctgctgctggatgaggcgacgagcgcgctggatgcggagtcggagtgcgtgctgcaggaggcactggagcggctcatgaagggccggaccaccgtgctggtggcgcaccgcctctccaccatccgaggggtggactccatcggggtggtccaggaaggccgcatcgtggagcaagggagccactccgagctcgtcgcccggcccgacggagcctactcgcggttgctgcaactgcaacactaccatgtttgacaatagaacggcgccatcgacatgaacagactttgagaacggtggattcagatgcaacgaggttaattactgctatctaatctcactggtgccgcatctcgacgttacatatcaaatggggtgttggaggagaggggaagtgtattgggtcatgttgtggtggtaatatttgtatggaccaaagtgatcttttcgactttgaagccgtagagattttagcttgaatcaagcttgatggtaatctcgggcctcgtagggccaccttggccccaccgttggggccaccatcgtgaccactgatagaacaggtatgttggacgggcggctcccaagtgttgtgttcttgcttgcttgcatttacagtggt

SEQ ID NO: 3062 - DNA, 4243 bp, Oryza sativa
agtttggttaagcacacccaaccaaaataatccgcagttgcgctgcttgcgttgcgcacactggaatagccgctctctcagtataagacgaggagggagcagccggagcgcgagagggagagaagcggcggcttgggagaggctgcgtttgggtgagctgagagatccaatgccaaggccgtgaggtgatcctgtggctcgggagagggggagaggaagagagagcgagagagagaggtgagcgtgcgtggcggcgatggcggatgagtcagggagctgcggcggcggcggcggtggcggagggggatgcgaggcggtgaagaagagggtggaccagagcgtggcgttccatgagctgttcgggttcgcggacccgctcgactggctgctcatggcggccgggagcgccggggcggtggtgcacggcgccgccatgccggtgttcttcctcctcttcggcgagctcatcaatggcttcggcaagaaccagcacagcctccgccggatgaccgacgaggtgtccaagtactcgctctacttcgtctacctgggcctcgtggtgtgcgcctcgtcttaccttgagatcgcttgctggatgtacaccggggagcgccaggtgggcgcgctgcggcggcgatacctggaggccgtgctgcggcaggacgtggggttcttcgacaccgacgcgcgcaccggcgacgtcgtcttcagcgtctccacggacaccctccttgtccaggacgccatcggcgagaaggtcggcaacttcatccactacctatcgacgttcctggcgggtctcgtcgtcgggttcgtctccgcctggcggctcgcgctgctcagcatcgccgtcatcccgggcatcgccttcgccggcgggctgtacgcctacacgctcaccggcctcacgtccaagagccgggactcctacgccaacgccggaatcatagccgagcaggcgattgcccaagtcaggacagtgtattcctatgtgggggagtccaaggccctcaactcgtactcggaggcgattcagaacacattgaagctggggtacaaagcagggatggccaagggtcttggcattggctgcacttacggtatcgcctgcatgtcctgggcgctggtgttctggtacgcaggagtgttcatccggaatggccagaccgatggtggaaaggcattcaccgcgattttctctgcaattgtcggcggcctgagtttgggacaatcgttctcgaatctaggcgctttcagtaaaggaaagattgccggatacaagctgttggaggtgataaggcagaggccgacaattgttcaggacccagcagatggaaggtgcctggatgaagtccatggcaacatagagtttaaggaagtggcctttagttatccgtcccgtccggatgtcatgatattccgtgacttttccctcttctttcctgccggtaaaactgcagctgttgttggaggtagtgggtctggaaagagtacagttgtggctctgattgaaagattttacgatcctaatcagggtcaagttttgctggacaatgtggacatcaagacactacaattgaagtggctgagagatcagattggtttggtgaatcaagaacctgcactctttgctaccaccattcttgaaaatattctttacggcaagcctgatgccacaatggctgaggttgaggctgcggctacatctgccaatgcccatagcttcattgctcttcttcctaatggctataacactcaggtcggggagagaggacttcaactctctggcggtcagaagcaacgtattgccattgctcgtgcaatgctaaagaacccgaagatccttctcttagatgaggcgactagtgcacttgatgctggttcggagaatattgttcaagaagcccttgaccgcctgatggtcggtaggacaactgtcgtggtcgcgcataggctgtcaactatacggtgcgttgacatgattgctgtgatccagcaagggcaggttgttgagaccggtacccatgacgagctccttgcgaaaggaagctcaggagcttatgctgctctcattagattccaggagatggccagaaaccgtgacttccgtggcccatccacccgcaagtcccggtcatcccgcttgagcaattcgctgtccactcggtcattgagccttaggtcggggagcttgaggaacttgagctactcatacagcactggtgcagatggccgtattgaaatggtttccaatgccgacaatgaccggaagtacccagcacctaagggttattttttcaaactccttaagctaaatgcacccgagtggccctataccatactgggagccatcgggtccatcctatctggcttcatcggccctacatttgctattgtgatgagcaacatgattgaagtgttctatttccgggacccgaatgcaatggagaggaagactagggagtatgtgtttatctacattggaactgggttatatgcggttgtcgcgtacctcgttcaacattacttcttcagcatcatgggcgaaaatctgaccaccagggtgcggaggatgatgcttgctgctatcttgaggaatgatgtggggtggtttgatcaagaggagaacaattcaagcctcgtggcggcacgcctttccacagacgcagccgatgtgaagtcggccatagcggaacggatatcagtcatcctgcagaacatgacctcacttctcgtgtccttcgttgtgggcttcatcatcgaatggcgggtggccgtcctcattcttgtcaccttccctctccttgtccttgccaactttgcccagcaactgtccatgaagggcttcgccggcgacacggccaaggcgcacgccaagacgagcatgatcgccggggagggcgtcagcaacatccgcaccgtggctgcgttcaacgcgcaggacaaggtcctgtccctcttctgcaccgagctgcgcgtcccgcagatgcacagcctccgccggagccagatctccggcgcgctcttcggcctgtcgcagctgtcgctgtacgcctccgaggcgctcatcctctggtacggcgcgcacctcgtccgacaccacgtgtccaccttctccaaggtcatcaaggtcttcgtcgtgctcgtcatcacggcgaacaccgtcgccgagaccgtcagcctcgctccggagatcgtgcgtggcggcgagtccatccggtccgtctttgccatcctcaactacaggacgcgcattgacccggatgaaccggaaaccgagcccgtcgagtccgtccgtggcgacatcgacttccggcacgtcgacttcgcctacccgtcgcgccctgacgtcatggtcttcaaggatttcagcctcaggatccgagctgggcagagtcaggcgctcgttggagcgagcgggtcagggaagagcaccgtcatcgctctcatcgagcgtttctacgaccctctcgccgggaaggtcatgatcgacggcaaggacatccggcggctgaacgtgaggtcgctgcgtctcaagatcggcctggtgcagcaggagcccgtgctgttcgccaccagcatctttgagaacatcgcctacggcaaggacggcgcgacggaggaggaggtgatcgaggccgccaaggtggccaacatgcacggcttcgtcagcgcgctcccggagggctacaagacccccgtcggcgagcgcggggtgcagctctcgggcgggcagaagcagcggatcgccatcgcgcgcgccgtgctcaaggaccccgccgtgctcctcctcgacgaggcgacgagcgcgctggacgcggagtccgagtgcgtgctgcaggaggcgctcgagcggatcatgaagggccggaccgcggtgctggtggcgcaccggctgtcgaccatccgcggcgtcgactcgatcgccgtggtgcaggacgggcgcgtcgtcgagcagggcagccacggcgagctcgtgtcgcggcccgacggcgcctactcgcggctgctgcagctgcagctacaccacggctgatcgtatcagttcagggcctaggttccgggtgtacagaagtgggcgaggccagtaatcgtcatggtgctgtgcgggtggtcagatgatgtgcttgggtacaactgttttcttcttcctgtaaccgatcaggattatgccggatgtgttttggcactaatggcggctctggcaattttagatgttcacaagaatcccggtttttttccc

SEQ ID NO: 3063 - DNA, 4328 bp, Oryza sativa
ggcgcacggcgtagcctaggctcacatccggtgacctgatcctctccgtctccaactcctatgcttccctctccccgagaaatgcagtttggttaagcacacccaaccaaaataatccgcagttgcgctgcttgcgttgcgcacactggaatagccgctctctcagtataagacgaggagggagcagccggagcgcgagagggagagaagcggcggcttgggagaggctgcgtttgggtgagctgagagatccaatgccaaggccgtgaggtgatcctgtggctcgggagagggggagaggaagagagagcgagagagagaggtgagcgtgcgtggcggcgatggcggatgagtcagggagctgcggcggcggcggcggtggcggagggggatgcgaggcggtgaagaagagggtggaccagagcgtggcgttccatgagctgttcgggttcgcggacccgctcgactggctgctcatggcggccgggagcgccggggcggtggtgcacggcgccgccatgccggtgttcttcctcctcttcggcgagctcatcaatggcttcggcaagaaccagcacagcctccgccggatgaccgacgaggtgtccaagtactcgctctacttcgtctacctgggcctcgtggtgtgcgcctcgtcttaccttgagatcgcttgctggatgtacaccggggagcgccaggtgggcgcgctgcggcggcgatacctggaggccgtgctgcggcaggacgtggggttcttcgacaccgacgcgcgcaccggcgacgtcgtcttcagcgtctccacggacaccctccttgtccaggacgccatcggcgagaaggtcggcaacttcatccactacctatcgacgttcctggcgggtctcgtcgtcgggttcgtctccgcctggcggctcgcgctgctcagcatcgccgtcatcccgggcatcgccttcgccggcgggctgtacgcctacacgctcaccggcctcacgtccaagagccgggactcctacgccaacgccggaatcatagccgagcaggcgattgcccaagtcaggacagtgtattcctatgtgggggagtccaaggccctcaactcgtactcggaggcgattcagaacacattgaagctggggtacaaagcagggatggccaagggtcttggcattggctgcacttacggtatcgcctgcatgtcctgggcgctggtgttctggtacgcaggagtgttcatccggaatggccagaccgatggtggaaaggcattcaccgcgattttctctgcaattgtcggcggcctgagtttgggacaatcgttctcgaatctaggcgctttcagtaaaggaaagattgccggatacaagctgttggaggtgataaggcagaggccgacaattgttcaggacccagcagatggaaggtgcctggatgaagtccatggcaacatagagtttaaggaagtggcctttagttatccgtcccgtccggatgtcatgatattccgtgacttttccctcttctttcctgccggtaaaactgcagctgttgttggaggtagtgggtctggaaagagtacagttgtggctctgattgaaagattttacgatcctaatcagggtcaagttttgctggacaatgtggacatcaagacactacaattgaagtggctgagagatcagattggtttggtgaatcaagaacctgcactctttgctaccaccattcttgaaaatattctttacggcaagcctgatgccacaatggctgaggttgaggctgcggctacatctgccaatgcccatagcttcattgctcttcttcctaatggctataacactcaggtcggggagagaggacttcaactctctggcggtcagaagcaacgtattgccattgctcgtgcaatgctaaagaacccgaagatccttctcttagatgaggcgactagtgcacttgatgctggttcggagaatattgttcaagaagcccttgaccgcctgatggtcggtaggacaactgtcgtggtcgcgcataggctgtcaactatacggtgcgttgacatgattgctgtgatccagcaagggcaggttgttgagaccggtacccatgacgagctccttgcgaaaggaagctcaggagcttatgctgctctcattagattccaggagatggccagaaaccgtgacttccgtggcccatccacccgcaagtcccggtcatcccgcttgagcaattcgctgtccactcggtcattgagccttaggtcggggagcttgaggaacttgagctactcatacagcactggtgcagatggccgtattgaaatggtttccaatgccgacaatgaccggaagtacccagcacctaagggttattttttcaaactccttaagctaaatgcacccgagtggccctataccatactgggagccatcgggtccatcctatctggcttcatcggccctacatttgctattgtgatgagcaacatgattgaagtgttctatttccgggacccgaatgcaatggagaggaagactagggagtatgtgtttatctacattggaactgggttatatgcggttgtcgcgtacctcgttcaacattacttcttcagcatcatgggcgaaaatctgaccaccagggtgcggaggatgatgcttgctgctatcttgaggaatgatgtggggtggtttgatcaagaggagaacaattcaagcctcgtggcggcacgcctttccacagacgcagccgatgtgaagtcggccatagcggaacggatatcagtcatcctgcagaacatgacctcacttctcgtgtccttcgttgtgggcttcatcatcgaatggcgggtggccgtcctcattcttgtcaccttccctctccttgtccttgccaactttgcccagcaactgtccatgaagggcttcgccggcgacacggccaaggcgcacgccaagacgagcatgatcgccggggagggcgtcagcaacatccgcaccgtggctgcgttcaacgcgcaggacaaggtcctgtccctcttctgcaccgagctgcgcgtcccgcagatgcacagcctccgccggagccagatctccggcgcgctcttcggcctgtcgcagctgtcgctgtacgcctccgaggcgctcatcctctggtacggcgcgcacctcgtccgacaccacgtgtccaccttctccaaggtcatcaaggtcttcgtcgtgctcgtcatcacggcgaacaccgtcgccgagaccgtcagcctcgctccggagatcgtgcgtggcggcgagtccatccggtccgtctttgccatcctcaactacaggacgcgcattgacccggatgaaccggaaaccgagcccgtcgagtccgtccgtggcgacatcgacttccggcacgtcgacttcgcctacccgtcgcgccctgacgtcatggtcttcaaggatttcagcctcaggatccgagctgggcagagtcaggcgctcgtcggagcgagcgggtcagggaagagcaccgtcatcgctctcatcgagcgtttctacgaccctctcgccgggaaggtcatgatcgacggcaaggacatccggcggctgaacgtgaggtcgctgcgtctcaagatcggcctggtgcagcaggagcccgtgctgttcgccaccagcatctttgagaacatcgcctacggcaaggacggcgcgacggaggaggaggtgatcgaggccgccaaggtggccaacatgcacggcttcgtcagcgcgctcccggagggctacaagacccccgtcggcgagcgcggggtgcagctctcgggcgggcagaagcagcggatcgccatcgcgcgcgccgtgctcaaggaccccgccgtgctcctcctcgacgaggcgacgagcgcgctggacgcggagtccgagtgcgtgctgcaggaggcgctcgagcggatcatgaagggccggaccgcggtgctggtggcgcaccggctgtcgaccatccgcggcgtcgactcgatcgccgtggtgcaggacgggcgcgtcgtcgagcagggcagccacggcgagctcgtgtcgcggcccgacggcgcctactcgcggctgctgcagctgcagctacaccacggctgatcgtatcagttcagggcctaggttccgggtgtacagaagtgggcgaggccagtaatcgtcatggtgctgtgcgggtggtcagatgatgtgcttgggtacaactgttttcttcttcctgtaaccgatcaggattatgccggatgtgttttggcactaatggcggctctggcaattttagatgttcacaagaatcccggtttttttccc

SEQ ID NO: 3064 - DNA, 4263 bp, Panicum virgatum
ctgctcgaggaggaagaagaggagcggcttttgagcccctcgagcttacttaccgcgccggccgccgcgggtgttcagatccgatgccaaggcgctgagggcgcgccacctgaccgacctctcgtcgtgtacgtcgtgagggaagagctcggcaagtggcggggaagagggcgtcgcggtcgcggcaatggcggaggacgcggggaaggcggagtccgggagctgcagcggcggcggcggcggcgggtgcgaggcggtgaagaagcggccggagcagagcgtggcgttccacgagctgttcgggttcgcggacccgctggactggctgctcatggcggccgggagcgccggcgccgtggtgcacggcgccgccatgcccgtcttcttcctcctcttcggcgagctcgtcaacggcttcggcaagaaccagcacaacctccgccgcatgacggacgaggtgtccaagtactcgctctacttcatctacctcggcctcgtcgtctgcgcctcctcgtacctggagatcgcgtgctggatgtacacgggtgaacgccaggtgggcgcgctgcggcggcgctacctggaggccgtgctgcggcaggacgtgggcttcttcgacaccgacgcgcgcaccggcgacgtcgtcttcagcgtgtccacggacacgctcctcgtccaggacgccattggcgagaaggtcggcaacttcatccactacctcgcgacgttcctggccgggctggtcgtcgggttcgtctcggcgtggcggctggcgctgctcagcatcgccgtcatcccgggcatcgccttcgccggcgggctgtacgcgtacacgctcaccggcctcacctccaagagccgggactcgtacgccaatgccgggatcatagccgagcaggccatcgcccaggtgaggacggtctactcttatgtgggggagacaaaggccctgaattcgtactcggaggcgattcagaacacactgaagctggggtacaaggccgggatggccaaggggcttggcattggctgcacctacggaattgcttgtatgtcctgggcactggtgttctggtatgccggcgtgttcatccggaatggtcagactgatggagggaaggccttcactgcaattttctcagcaatcgtcggcggcctgagcctggggcaatcattttcaaatcttggagcattcagcaaagggaagattgccggctacaagctgctggaagtgataaggcagaggccaactatagttcaggacacggcagatggaaggtgcctggatgaagttcatggcaacatagaattcaaggaagtggccttcagctatccttcccgcccggatgtcatgattttccgtgacttttctctcttcttccccgctggaaaaactgcagcagttgttgggggcagtggctctggaaagagcactgttgttgctctcatcgagcggttttatgatcctaatcaagggcaagttttgctggacaatgtggacatcaagacgctgcaattgaagtggctcagggatcaaattggtttggtgaatcaagagcctgcactttttgcaactacaattcttgagaatattctttatggcaagcctgatgctacaatggccgaggttgaggctgctgctacttcagctaatgcccatagcttcattgctctgcttcctaatggctacaacactcatgtgggtgagaggggacttcagctctctggtggtcagaagcaacgtattgccattgctcgggcaatgctgaagaatccaaagattctgctcctagatgaggccaccagtgcgcttgatgctggttcagagagtattgttcaagaagcccttgatcgcttgatggtcggcaggactactgttgtggttgcacacaggttatcaaccataaggtgtgttgacatgatcgccgtgatccagcaagggcaggttgtggagaccggtactcatgatgagctccttgccaagggaagctcgggagcttacgctgctcttataaggttccaagagacggccagaaaccgtgcatgcccatcaacccgcaagtcccggtcgtcccgcttgagcaactccctgtccactcggtcattgagcctcaggtcaggaagcttgaggaatctgagctactcatacagcacgggcgccgacggtcgcattgagatggtttccaacgccgacaacgaccggaagtacccagcgccaaggggttacttcttcaaactcctcaagctgaacgcaccggagtggccctacaccatactgggcgccattgggtccatcctgtctgggtttatcggcccgacattcgccatcgtgatgagcaacatgatcgaggtgttctactaccggaaccccagcaagatggagagcaagaccagggagtacgtgttcatctacatcggcaccgggctgtatgccgtcgtcgcctacctcgtccagcactacttcttcagcatcatgggcgagaacctgaccacccgggtgcggaggatgatgctcgccgtgatcttgaggaacgatgtgggatggttcgaccaggaggagaacaactcgaccctcgtggcggcccggctcgccaccgacgccgcggacgtgaagtccgccatcgccgagcggatatcggtgatcctgcagaacatgacctccctcctggtgtccttcgtggtcggcttcatcatcgagtggcgggtcgccctcctcatccttgtcaccttccccctcctcgtcctcgccaacttcgcccagcaactgtcgatgaagggcttcgcgggggacacggccaaggcgcacgccaagacgagcatgatcgccggggagggcgtgagcaacatccgcacggtggcggccttcaacgcgcaggacaaggtcctgtccctcttctgcggcgagctgcgcgtcccgcaggcgcacagcctccgccgcagccaggtctcgggcgcgctcttcggcctctcccagctcgccctctacgcctccgaggcgctcatcctctggttcggcgcgcacctcgtccgcgcccgcgcctccaccttctcccgggtcatcaaggtcttcgtcgtcctcgtcatcaccgccaactccgtcgccgagaccgtcagcctcgcgccggagatcgcgcgcggcggggagtccatccgctccgtcttcgccatcctcaacagccggacgcgcatcgacccggacgacccggacgcggagccggtggaggcagtgcgcggcgacatcgacctccggcacgtcgacttcgcgtacccgacgcgccccgacgtgatggtgttcaaggatttcagcctgcggatccgggccggacagagccaggcgctggtcggcgcgagcgggtccgggaagagcaccgtcatcgccctcatcgagcgcttctacgacccgctcgccggcaaggtgatgctcgacggcaaggacatccggcggctgaacctccggtccctgcgccgccgcatcgggctggtgcagcaggagcccgtgctgttcgccgccagcatcatggagaacatcgcctacggcagggaggacggcgcgacggaggaggaggtcgtggaggccgccaaggccgccaacgtgcacggcttcgtcagcgcgctgcccgacgggtaccgcacccccgtcggggagcgcggcgtgcagctgtccggcgggcagaagcagcgcatcgccatcgcgcgcgcggtgctcaaggaccccgccgtgctgctgctggacgaggccaccagcgcgctggacgccgagtccgagtgcgtgctgcaagaggcgctggagcgcatcatgaagggccgcaccgccgtgctggtggcgcaccggctctccaccatccgcggcgtcgactccatcgccgtcgtgcaggacggccgcgtggtggagcaggggacgcacggggacctcgtgtcccgccccgacggcgcctactcgcggctgctgcagctgcagctgcaccacggctgattgatcactctcgctagtaaacgacggtgtagatactctggaaggcggtgtagcgtggcgggcactggcctagtagccgtggccggaaggcgtaaacacgatcaggatagtatcggcgagtgatgctgcattgtgctttgcggctccggcgattttagatcatcctaattctcattctcagatgaaatgtttttagagttgaactcggatcagatgaaatgttcgaccgaatttgatgcgcaatcgatctgaagttctgaacccaagattcgtctttgctatcctaggag

SEQ ID NO: 3065 - DNA, 4566 bp, Zea mays
gtgctcgcctgttgtataaaagaacaaggcgaacagcgggtgctgctcgaggaggaagaagaggagcggcttttgagctctgaggtctcggtcaccgcccccccaccccaccaccaccaccaccactgggtttttagatccaatgccaaggccgtgaggaagctagctcttgcgtcgtgaggaagagccgaccagagaagctaggagcgcgtggcaatggcggagggcgatgcgggaaaggcggaggcggggagctgcagcgccgccgccgcctccggcgccggcgggtgcgacgcggtcaagaagcggccggagcagagcgtggcgttccacgagctgttcggcttcgcggacccgctggactggctgctcatggctgcggggagcgcgggcgccgtggtgcacggcgccgctatgccggtcttcttcctcctcttcggcgagctcgtcaacggcttcggcaagaaccagcacaacctccgccgcatgacggacgaggtgtccaagtattcgctctacttcgtctacctcggcctcgtcgtctgcgcctcgtcgtacctagagatcgcgtgctggatgtacacgggcgagcggcaggtgggcgcgctgcggaggcggtacctcgaggccgtgctgcggcaggacgtgggcttcttcgacaccgacgcgcgtaccggcgacgtcgtcttcagcgtctctaccgatacgctcctcgtgcaggacgccattggcgagaaggtcggcaacttcatccactacctcgcgacgttcctggccgggctggtcgtcgggttcgtctcggcgtggcggctggcgctgctcagcatcgccgtcatccccggcatcgccttcgccggcgggctgtacgcgtacacgctcactggcctgacctccaagagccgggactcgtacgccaacgccggaatcatagccgagcaggccattgcccaggtgaggactgtctactcctatgtgggtgagaccaaggccctgaattcctactcggaggcgattcagaacaccctgaagctgggttacaaggccgggatggccaaggggcttggcatcggctgcacctatggaatcgcctgtatgtcatgggcgctggtgttctggtacgccggcgtgttcatacggaacggccagacagacggtgggaaggccttcactgcgattttctcagcaatcgtcggtggcctgagcctggggcagtcgttttcgaaccttggagcgttcagcaaagggaagattgccggctacaagctgctggaagtgataaggcagaggccaacgatagttcaggacacggcagacgggaggtgcctcgacgaagtgcatggcaacatagagttcaaggaagtggccttcagctacccttcccgcccggacgtcatgattttccgagacttctccctcttcttccccgctgggaagaccgcggccgtcgtcggaggcagcgggtctgggaagagcacggttgttgctctcattgagcggttctacgatcctaatcaggggcaagttttactcgacaatgtggacatcaagacgctgcaattgaagtggcttagggaccagattggcttggtgaatcaggaacccgcacttttcgcgactacgattcttgagaacattctttatggcaagcctgatgcgacaatggcggaggtcgaggctgcggctacttcagctaatgcccatagcttcattgctctccttcctaatggctacaacactcatgtgggagatagggggcttcagctctccggtggtcagaagcaacgcatcgccatcgcccgcgcgatgctgaagaacccgaagctcctgctactagacgaggccaccagcgcactcgacgctggttcggagagcatcgtccaagaagccctcgaccggttgatggtcggcaggaccaccgtcgtggttgcccacaggctatcgaccataaggtgtgtcgacatgatcgcggtgatccagcaaggccaggtcgtggagactggcactcacgacgaactcctcgccaaaggaagctcgggagcgtacgccgcgctcatcaggttccaggagaccgccaggaaccgcgcgtgcccgtcgacccgcaagtccaggtcgtcccgtctgagcaactccctctccacccggtcgctgagcctcaggtcggggagcctgaggaacctgagctactcgtacagcaccggcgccgacggccgcatcgagatggtttccaacgccgacaacgaccgcaagtacccggcgccgaggggctacttcttcaagctcctgaaactgaacgcgccggagtggccctacaccatactgggcgctgtcgggtccgtcctgtccgggttcatcggccccacgttcgccatcgtgatgagcaacatgatcgaggtgttctactaccggaaccccagcaagatggagagcaagaccagggagtacgtgttcatctacatcggcaccgggctgtacgccgtcgtcgcctacctcgtccagcactacttcttcagcatcatgggcgaaaacctcacaaccagggtgcggaggatgatgctcgccgtgattttgaggaacgatgttgggtggttcgatcaggaggagaacaactcgaaccttgtcgccgctcgcctctccacagacgccgccgatgtgaagtcggccattgccgagcggatatcggtgatcctgcagaacatgacgtccctgctcgtgtccttcgtggtgggcttcatcattgaatggcgggtcgccctcctcatcctcgtcaccttccctctcctcgtgctcgccaactttgcccagcaactgtcgatgaagggcttcgcgggcgacacggccaaggcccacgccaagacgagcatgatcgccggggagggcgtgagcaacatccggacggtggcggcgttcaacgcgcaggacaagatcctgtccctcttctgcagcgagctgcgcgtgccgcagatgcacagcctgcgccgcagccagatctccggcgcgctcttcggcctctcccagctctccctgtacgcgtccgaggcgctcatcctgtggttcggcgcgcacctggtccgcacccacgtgtccaccttctccaaggtcatcaaggtgttcgtggtcctggtgatcacagccaactccgtggccgagaccgtcagcctggcgccggagatcgtgcgcggcggcgagtccatccgctccgtgttctccgtgctcaacagccggacccgcatcgacccggacgacccggacgcggagcaggtggagtcggtgcgcggcgagatcgacttccggcacgtggacttcgcgtacccgacgcggcccgacgtgatggtgttcaaggacctgagcctgaggatccgggccgggcagagccaggcgctggttggggcgagcgggtccggcaagagcaccgtcatcgccctcgtcgagcgcttctacgacccgctcgccgggaaggtgatgatcgacggcaaggacatccggcgcctgaacctcaagtccctgcgcctcaggatcgggctggtgcagcaggagcccgtgctgttcgccaccagcatcctggagaacatcgcctacggcagggacggcgcgacggaggaggaggtcgtggaggcggccaaggtggccaacgtgcacggcttcgtcagcgcgctccccgacgggtacaggacgcccgtgggcgagcgcggggtgcagctgtccggcggccagaagcagcgcatcgccatcgcgcgcgcggtgctcaaggaccccgccgtgctgctgctggacgaggccaccagcgcgctggacgccgagtccgagtgcgtgctgcaggaggcgctggagcgcatcatgaagggccgcaccgccgtgctggtggcgcaccgcctgtccaccatccgcggcgtcgactccatcgccgtggtgcaggacggccgcgtggtggagcagggcagccacggggacctcgtgtcccgccccgacggcgcatactcgcggctgctgcagctgcagctacaccatggctgatcctgcgcctggaatagatactggagggcgcacggccggtgtagatactggagggcggtgttagcgtggcgtggctcaaccgtggccggagaagacgtgttttgatgtgaacgatcaggattgtgccgacaaacaagtgatgccgtattcttcttgcactcctgccggctctgccaatgtttagatcatcccctcctagtaattctcacacctttttttttcttcctttgagaagatcctagtaattctcagatggacccaattgtttgatgtgtaacggtcagaagccagggttcgtctttgctacttgtctaggagttgttgcctctaataattggcttcaaaccttacgaagggatctgcttgaaacagccttgcagttgcagcagccacggagagcgtcactggatctgggtgtccgctgccgccgacatctctagcggagtaacgagaaagcctttggatcgatccataattcgtgcaggctgctttgtaagcacgttatacagcttaaacctctatagtaatatttcgtgcaggtaccttatgttgcta

SEQ ID NO: 3066 - DNA, 3985 bp, Secale cereale
agaagcgggcggaccaggcggtggccttccacgagctcttctcgttcgccgaccggtgggacctggcgctcatgtcgctgggcacgctcggcgcggtggcgcacggcgccgccatgccctgcttcttcctgctcttcggggacctcatcaacggcttcggcaagaaccagaccgacctccgcgccatgaccgacgaggtcgccaagtacgcgctctacttcgtctacctcggactggtggtctgcgtcgcctcctacgcagagatcgcgtgctggatgtacaccggggagcggcaggtgatcgcgctccggaaggcgtacctggacgcggtgctgcggcaggacgtggggttcttcgacacggacgcgcgcacgggggacatcgtcttcggcgtgtccaccgacacgctgctggtgcaggacgccatcggcgagaaggtgggcaacttcatgcactacctggccaccttcttcgcggggctcgtcgtcggcttcgtctcggcgtggcggctcgcgctgctcagcgtcgccgtcatccccgccatcgccttcgccggcggcctctacgcctacacgctcaccgggctcacctccaagagccgcgagtcctacgccaatgccggcgtcgtcgcggagcaggcaattgcgcaagttagaaccgtctactcatttgttggagagagcaaagcgctcaattcgtactctgaagcaatccagaatacactgaagcttggctacaaagctgggatggcaaagggtcttggtatcgggtgcacttacgggatagcgtgcatgtcatgggcgctagtattctggtatgctggtgtcttcatcaggaatgggcagagcgatggtggcaaggcctttactgcgatcttttctgcaatagttggtggcatgagtcttggccaggcattctcgaaccttggagccttcagcaaagggaagattgccggatacaaactgttggaggtcattcgtcagaagccctccatagttcatgatcacaaggatggcaagttgttggcggaggtccatggaaatattgaattcaaggatgttactttcagttacccatcaaggcctgatgctatgatcttccgggatttctctctgttcttccctgctggaaaaactgttgcagttgttggaggcagtgggtctggaaagagcactgtcgtggctctgatagaaaggttctatgatcctaatgaaggccaggttttgctggacaatgttgatatcaagacactccagttgaggtggctgagggatcagattggactagtaaaccaagaacctgccctttttgcaactactatcattgagaatatactgtatggaaagcctgatgccacaattacagaagttgaggctgcagcaactgcatccaatgctcattattttatctctctcctgcccaatggatacaacacaatggttggggagagaggaattcagctatctggtggtcagaaacagcgcattgcaattgctcgtgctatgctgaaggaccccaagatattgctccttgatgaagctacaagtgctttagacgcagactcagagaacattgtgcaagaagctctagaccgcctgatggttgggaggactacagtaattgttgcgcaccgtctgtgcaccatcagaaatgtaaacatgatcgcggtgttacaacaaggccaagttatagagactgggacacatgatgaacttttagcaaaaggtacctccggagcgtatgcatccctgattcgctttcaggaaagtgcacgtaacagagatcttggtgctgcatctacccgtaggtcacgctcgatgcacttgacaagctctctttccaccaaatctctgagcctcaggtcgggaagtttacggaacctgagctatcagtacagtactggagcagatgggcgcatcgagatgatttcaagtgcagataatagcctcaaatacccagcaccacgtggttactttttcaagctcctaaaactgaatggtcctgaatggccgtatgcggtgttgggtgctattggctctgttctatctggattcatcggcccaacatttgcaattgttatgggtgaaatgcttgatgtgttctactacaaggaccccgttgacatggagaagaaaactaagctttatgtgttcatctatattggcacaggcatatacgccgtagttgcttatcttgtgcagcattacttcttcagcataatgggagaaaatcttacaaccagagttagaaggatgatgctgtcagcgatacttaggaacgaagttggttggttcgatgaagaagaaaacaactccagtcttgtggctgctcgtgttgcagtagatgcggctgatgtgaagtcggcgatagccgagaggatatcagtgatactgcagaacacaacatccctgatgacatcattcatcgtcggttttatcattgagtggagagtggcgatccttattctggccactttccctcttcttgtgcttgccaactttgctcagcaactttcgatgaagggctttgctggtgacacagcaaaagcacacgccaagagcagcatggttgccggtgaaggcgtgagcaacatccgtaccgtggcggccttcaacgctcaaaacaaggtcatgtctctgttcagccacgagctgcgcattccagaggagcagatcctgcgccgcagccagaccgcgggcattctgtacggcctctcgcagctctgcctctactgctcggaagcgctcattctctggtacggttctcatctggtccggtcacacgggtcgaccttctccaaggtcatcaaggtcttcgtcgtccttgtcgtgaccgccaactccgtcgccgagactgtcagccttgccccggagatcatccgtggaggcgaatctatccgctccatcttcggcatcctcaacagggcgacgaggatcgagcccgatgacccagaggcagagcgtgtcaccactgtccgtggcgacattgagctgcggcatgtggacttctcgtatccgtctcgccctgacattgagatcttcaaggatttcaacctgaagatccaggccgggcgcagtcaggctctggttggagctagtggttctggtaagagcactgtcattgcgctcatcgagcggttctacgacccgacaggcggcaaggtgatgatcgacggcaaggacatccggcggctgaacctcaagtccctgcggcgcaggatcgggctggtgcagcaggagccggccctgttcgcctccagcatcctggagaacatcgcgtacggcaaggaaggcgcgacggaggaggaggtggtggaggcggccaagacggccaacgtgcacgcgttcgtgagccagctccccgacgggtaccggacggcggtgggcgagcgcggcgtgcagctgtcgggcggcagaagcagcgcatcgccatcgccagggcggtgctcaaggacccggccatcctgctgctggacgaggcgaccagcgcgctggacgccgagtcggagagcgtgctgcaggaggcgctggagcggctgatgaaggggcggaccacggtgctggtggcgcaccggctgtcgaccatccgcggcgtggaccgcatcgccgtggtgcaggacgggcgcgttgttgagcatggtgggcactcggagctcgtcgcgcggcccgagggcgcctactcccggctgctgcagctgcagaaccaccgcaactgatgaggggcatgatcgatgatgccatttgacagccttgtcttggtgggtgggtggatggatggatggaggcttgaattttgtgggtggtggtggtctggtctagtgggtgtagatactagggcaacctgtgttattggtctttttctttgtgcttgaactgcaaaccttgtgatctgatcttgatctgtatcttctccgtgatgaatgctatgatgctacttcttcgtttttctgtagtacgtacgacccgtaaacggtcaaccgacgtac

SEQ ID NO: 3067 - DNA, 5128 bp, Sorghum bicolor
cagagagccgcgccctctcctcccactcccactcccaccgcacagtcacagtcaccacaccagaatgggagaagccggttgatgccgaggcgcgtcggcagcctgctcgagcgcgcgcgagctgaacggctgaacctgacccctcgagctcaacctcaactcctacgctcgccccgaagctttttttaagaacccccaagtgcccggccaaaatataatccgtgcactgcggcgacagtggtgctcgcctgcggtagtaagatcaaaggcgaacagcgggtgccgctcgaggaggaagaagagggagggagcggcttttgagctcgctctgaggtctcagtcacacccccttcccccactgggtttttagatccaatgccaaggccgtgaggccgctagctcttgtgtcgcgaggaagaagagtcgaccagagaagctaggaaaggcgtaggcaatggcggagggcgatgcggggaaggcggaggcggggagctgcagcggcgccggagccggcggcgggtgcgacgcggtcaagaagcggccggagcagagcgtggcgttccacgagctgttcggtttcgcggacccgctggactggctgctcatggcggcgggcagcgcgggcgccgtcgtgcacggcgccgccatgccggtcttcttcctcctcttcggcgagctcgtcaacggcttcggcaagaaccagcacaacctccgccgcatgacggacgaggtgtctaagtattcgctctacttcgtctacctcggcctcgtcgtctgcgcctcgtcctacctagagatcgcgtgctggatgtacacgggcgagcgccaggtgggcgctctccggaggcggtacctcgaggccgtgctgcgccaggacgtgggcttcttcgacaccgacgcgcgtaccggcgacgtcgtcttcagcgtctctaccgacacgctcctcgtgcaggacgccattggcgagaaggtcggcaacttcatccactacctggcgacattcctggccgggctggtcgtcgggttcgtctcggcgtggcggctcgcgttgctcagtatcgccgtcatccccggcatcgccttcgccggcgggctgtacgcgtacacgcttactggcctgacctccaagagccgggactcgtacgccaacgccggaatcatagccgagcaggccattgcccaggtgaggactgtctactcttatgtgggggagaccaaggccctgaattcctactcggaggcgattcagaacaccctgaagctgggttacaaggccgggatggccaaggggcttggcattggctgcacctatggaattgcttgtatgtcatgggcactggtgttctggtatgctggagtgttcatccggaacggccagacagatggtggcaaggccttcactgcaattttctcagcaatcgtcggtggcctgagcttggggcagtcattttcaaaccttggagcattcagcaaagggaagattgctggctacaagttgctggaagtgataaggcagaggccaacgatagttcaggacacggcagacgggaggtgccttgatgaagtacatggcaacatagagttcaaggaagtggccttcagctatccttcccgcccggatgtcatgattttccgtgatttttctctcttcttccctgctgggaagaccgcagcggtggttggaggcagtgggtctggaaagagcacagttgtagctctcattgagcggttttacgatcctaatcaggggcaagttttgctggataatgtagacatcaagacgctgcaattgaagtggcttagggagcagattggtttggtgaatcaggaacctgcactttttgcaactacaattcttgagaatattctttatggcaagcctgatgccacaatggcggaggttgaggctgcggctacttcagccaatgcccatagcttcattgctcttcttcctaatggctacaacactcatgtgggagagaggggacttcagctctctggtggtcagaagcaacgtattgccattgcccgtgcgatgctgaagaatccaaaactcctgctactagatgaggccactagtgcactcgatgctggttcagagaatattgtccaagaagcccttgatcgattgatggtcggcaggacaaccgttgtggttgcccacagattatcaacaataagatgtgtcgacatgatcgcggtgatacagcaaggccaggttgttgagactggtactcacgatgaactcctcgccaaaggaagctctggagcgtatgctgcactcatcagattccaagagacagccagaaaccgtgcatgcccatcaactcgcaagtctaggtcatcccgcttgagcaattccctctccactcggtcactgagcctcaggtcaggaagcttgaggaacctgagctactcatacagcactggtgctgatggccgcatcgagatggtttccaatgccgacaatgaccggaagtacccagcaccaaggggttacttcttcaagctcctaaaactgaatgcaccggagtggccttacaccatactgggtgctattgggtccatcctatctgggtttatcggcccgacatttgccattgtgatgagcaacatgatcgaagtgttctattaccggaaccccaacaagatggagagcaagaccagggagtacgtgttcatttacatcggcactgggctgtatgccgttgtggcatacctcgtccagcattatttcttcagcatcatgggcgaaaacctgaccaccagggtgcggaggatgatgcttgccgtgattttgaggaatgacgtcggatggttcgatcaggaggagaacaattcaaaccttgttaccgctcgcctctccacagacgctgctgatgtgaagtcggccattgctgagcggatatcggtgatcctgcagaacatgacatccctccttgtgtccttcgtggtcggctttatcattgaatggcgggtggctctcctcatcctcgtcaccttccctctcctcgtcctcgccaactttgcccagcaactgtcgatgaagggcttcgcgggcgacacggccaaggcccacgccaagacgagcatgatcgccggggagggcgtcagcaacatccgcacggtggcggcgttcaacgcgcaggacaagatcctgtcgctcttctgcagcgagctccgcgtcccgcagatgcacagcctgcggcgcagccagatctccggcgcgctcttcggcgcctcccagctctccctgtacgcctccgaggcgctcatcctctggttcggcgcgcacctcgtccgcacccacgtgtccactttctccaaggtcatcaaggtgttcgtggtcctggtgatcacggccaactccgtcgccgagaccgtcagcctggcgccggagatcgtccgcggcggcgagtccatccgctccgtgttcgccatcctcaacagccggacccgcatcgaccccgacgacccggacgcggagcaggtggagtcggtgcgcggcgagatcgacttccgccacgtcgacttcgcgtacccgacgcgccccgacgtgatggtgttcaaggacttcagcctgcggatccgtgccgggcagagccaggcgctggtcggcgcgagcgggtccggcaagagcaccgtcatcgccctcatcgagcggttctacgacccgctcgccgggaaggtgatggtggacggcaaggacatccggcgcctgaacctcaagtcgctgcgcctcaggatcgggctggtgcagcaggagcccgtgctgttcgccgccagcatcctggagaacatcgcgtacggcagggacggcgcgacggaggaggaggtggtggaggcggccaaggtggccaacgtgcacggcttcgtgagcgcgctcccggacgggtaccggacgcccgtgggcgagcgcggggtgcagctgtccggcgggcagaagcagcgcatcgcgatcgcgcgcgcggtgctcaaggaccccgccgtgctgctgctggacgaggcgaccagcgcgctggacgccgagtccgagtgcgtgctgcaggaggcgctggagcgcatcatgaagggccgcaccgccgtgctggtggcgcaccggctgtccaccatacgcggcgtggacaacatcgcggtggtgcaggacggccgcgtggtggagcagggcagccacggggacctcgtgtcccgccccgacggcgcctactcgcggctgctgcagctgcagctgcaccacggctgatacgtgcgccccgcttggatcggagtactagctacgtgcagctcccggcgccggcgccggcgcgcggccggtgtagatacgtgctggagggcggtgtagcgtgggcgtggcccaaccgtggccggaagacgtgttttgatgtaaaccaatcaggattgtgccgacgactgatgctgtatttctgcttgcactgctggcggctctggcggtgttagaaggatcatcccctcctagtaactatcagattcagatgaaatgttggacccaaattggatgtgtacgcttcacaacgaccagaagttgagaacccaagattcgtctttgctactacttgtaacttgtactagggtcttcggaccttgctgagaagggcggccgctgctaacagggggccacggagagcgtcactgcccgcggtggccgccggcggcgggacaggttcgccgccgctgtcatccctgtcggagtaacggtcaagccattggatcggtccaacatgtttcttccgggctggcccatccagagcagcagtcactttggaccggacaaatgtttgtggtccggcccacctttgtaatccgaagatagcatgttttgtttcttctttcagcacactcctcttttctcttaatttgcacctgtcacctatgtctgcaagagtagtttttttggtgctagcactagagttcgactgctacaatatctatagtaaggccacaagccagccacattttttagacccttggattatattcaaattatgaacatattgtggaagaaggcatgcatttgtatgcccgtttgcttgtagttggtgccaattcgcaggcatgtcaagtagggggaagtaaaaatggttgagaccattatggagaaagaaggcgt

SEQ ID NO: 3068 - DNA, 4309 bp, Triticum aestivum
tccccctccccgaaaagcgcgattttttttcaagcatacccaagtacccaaccccccagaaattagcacactgcaacagccctgctcgctttgcagtataagagaacggagcgaggaccgccgggagcaggagcaggggctctggtgctaacacttcggtgggtttagatccaatgccagggcggtaaggtgctctcgtggttgcggagctcgcggcggagagagatagaggagtgataatggcggaggagacagggaaggcggaggcgtcggccggggctgcgagctgcggcggcggcgggtgcgaggcggtgaagaagagggcggagcagagcgtggcgttccatgagctgttcagcttcgccgacccgctcgactggctgctcatggcggcggggagcgccggcgccgtcgtgcacggcgccgccatgccggtgttcttcctcctgttcggcgagctggtcaacggcttcggcaagaaccagcaccacctccgccgcatgaccgacgaggtgtccaagtactcgctctatttcgtctacctcggcctcgtcgtctgcgcatcctcgtacctggagatcgcgtgctggatgtacacgggcgagcgccaggtgggcgcgctccggcggcggtacctggaggccgtgctgcggcaggacgtgggcttcttcgacaccgacgcgcgcaccggggacgtcgtattcagcgtctccacggacacgctcctcgtccaggacgccatcggcgagaaggtcggcaacttcatccactacctcgcgacgttcctggcagggctcgtggtcgggttcgtctccgcctggcggctggcgcttctcagcatcgccgtcatcccgggcatcgcgttcgccggcgggctctacgcgtacaccctcaccgggctcacctccaagagccgggactcgtacgccaacgccggaatcatagccgagcaggcgattgcccaagtgaggacggtctactcctacgtgggggagtccaaggccctgaattcctactcggaggcgattcagagcaccctgaagctggggtacaaggccgggatggccaaggggcttggcattgggtgtacctatgggattgcctgcatgtcatgggcgctggtgttctggtacgccggcgtgttcatccggagcggccagacagacggtggaaaggcgttcacggccatcttctccgcaatcgtcggtggcctgagccttggacagtcgttctccaaccttggtgcattcagcaaagggaagattgccggttacaagctgttggaggtgataaggcagaggccgaccatagttcaagactcaaccgacgggaggtgcctggatgaagtccatggcaacattgagttcaaggaagtgtccttcagctatccgtcccgcccggacgtcatggtgttccgtgacttctcgctcttctttcccgccgggaaaacggcagctgtggtcggaggcagcggttctggaaaaagcacggtcgtgtctctgatagaacggttttacgatcctaatcagggacaagttctgctcgataatgcggacatcaagtcgctgcagttgaaatggctgagagatcagattggtttggtgaatcaagaacccgcactcttcgcgaccaccatcattgacaatattctttatggcaagcctgacgccacaatggctgaggttgaggccgcggcttcggctgccaatgcccatagcttcattgctcttcttccaaatgggtacaacactcaggtgggagaacgaggacttcagctgtccggtggccaaaagcaacgaattgccattgcccgtgcaatgttgaagaacccaaagatccttctccttgatgaggcaactagtgctcttgatgctggttctgagagtattgttcaagaggcacttgaccgcataatgatcggtaggacaactgtggtggttgcgcacaggctctcaaccatacggagtgttgacatgatcgccgtgatccagcaagggcaggttgttgagaccggtactcatgatgagctcctcgccaaaggaagctctggtgcttacgcagctctcatcagattccaggagatggcaagaaaccgcgacttccgtggggcatccacccgcaagaaccggtcatctcgcttgagcaattcgctgtccactcggtcactgagcctcaggtcgggaagcttgaggaacctgagctactcatacagcaccggcgcagatggccgcattgagatggtctcgaacgccgacaatgaccggaagtacccggcgccaaaaggatactttttcaagctcctcaagctaaatgctccggaatggccctatacggtgctgggggcgatcggatccatcatgtctggcttcattggcccgacatttgccatcgtgatgagcaacatgattgaagtgttctatttccgggaccccaacgcgatggagcgcaagactagggagtatgtgttcatctacatcggaaccgggttctacgcggttgtcgcgtacctgatccagcattacttcttcagcatcatgggcgaaaacctgaccaccagggtgcggaggatgatgcttgcagttatcttgaggaacgacgtggggtggttcgacgaggaggagaacaactcgagcctggtggcggcgcggctcaacacggaggccgcggacgtgaagtcggcgatagcggagcggatatcggtcatcttgcagaacatgacatcgctcctggtgtccttcatcgtcggcttcatcatcgaatggcgggtcgccatcctcatcctcgtcaccttccctctccttgtcctggccaactttgctcagcaactgtccatgaaggggttcgccggcgacacggccaaggcgcacgccaagacgagcatgatcgccggggagggcgtcagcaacatccgcaccgtggcggccttcaacgcgcaggacaagatcctgtccctcttctgcagcgagctgcgcgcgccccagatgcacagcctgcgccggagccagatcgccggcgtgctctacggcctctcgcagctctccctctacgcctccgaggcgctcatcctctggtacggcgcccacctcgtccgccaccacgtctccaccttctccagggtcatcaaggtcttcgtcgtcctcgtcatcaccgccaactccgtcgccgagaccgtcagcctcgcgcccgagatcgtccgcggcggcgagtccgtccgctccgtcttcgccgtcctcaacagcaggacgcgcatcgacccggacgagccggaggccgagcaggtggagaaggtccgcggcgagatcgagctccgccacgtcgacttcgcctacccgtcgcgcccggacgtgatggtcttcaaggagttcagcctgaggatccgagctggccagagccaggcgctcgtgggagcgagcgggtcagggaagagcaccgtcatcgctctcatcgagcgtttctatgatcccatggccgggaaggtcatgatcgacggcaaggacatccgtcggctcaacttgaagtctctccgtctcaagatcggcctggtgcagcaggagcccgtcctgttcgccaccagcatcctggagaacatcgcctacggcaaggacggcgtgacggaggaggaagtcgtcgaggcggccaaggtggccaacgtgcacggcttcgtcggcgcgctccccgacggttacaggacgcccgtgggcgagcgcggcgtgcagctctccggcggccagaagcagcgcatcgccatcgcccgcgcggtgctcaaggacccggccatcctcctgctggacgaggcgacgagcgccctggacgcggagtccgagtgcgtgctccaggaggcgctggggcgcatcatgaagggccggacgaccgtgctggtcgcgcaccggctgtcgaccatccgctgcgtggactccatcgccgtggtgcaggacgggcgcgtcgtggagcagggcagccacggcgatctcgtgtcgcggccggacggcgcctactcgaggctgctgcagctgcagctgcaccacgggtgacgatggatggattggcgtcctgctccggcatggcggctgtagatacagtgtagaccgaggcgagctttgatcgacactccgatgagcaacagagatttgctgtagtgcggcggcggcccaaatggtgataggtgttagccggaactagtgttctcttttctctgtaaccgatcaggattatgatgaaggccatgttacattttgttccaacttgcaggtatgtccagcttcggcagaatttcttttccccagcagaattgtcgttctcctcgttgtct

SEQ ID NO: 3069 - DNA, 4132 bp, Secale cereale
ggtgctaacatttcggtaggtttagatccaatgccacggcggtagggtgttcttctggttgcggagctcgcgacggagagagatagaggagtgataatggcggaggagacagggaaggcggaggcgtcggccggggccgggagctgcggtggcggcggcggcgggtgcgaggcggtgaaaaagagggcggagcagagcgtggcgttccatgagctgttcagcttcgccgacccgctcgactggctgctcatggcagcggggagcgccggcgccgtagtgcacggcgccgccatgccggtgttcttcctcctattcggcgagctggtcaacggcttcggcaagaaccagcaccacctccgccgcatgaccgacgaggtgtcaaagtactcgctgtacttcgtctacctcggcctcgtcgtctgcgcatcctcatacctggagatcgcgtgctggatgtacacgggcgagcgccaggtgggcgcgctccggcggcggtacctggaggccgtgctgcggcaggacgtgggcttcttcgacaccgacgcgcgcaccggcgacgtcgtcttcagcgtctccacggacacgctcctcgtccaggacgccataggcgagaaggtcggcaacttcatccactacctggcgacgttcctggcggggctcgtcgtcgggttcgtctccgcctggcggctggcgctgctcagcatcgccgtcatcccgggcatcgcgttcgccggcgggctgtacgcgtacacgctcaccgggctcacctccaagagccgggactcgtacgccaacgccggaatcatagccgagcaggcgattgctcaagtgaggacggtctactcctacgtgggggagtccaaggccctgaattcctactcggaggcgattcagagcaccctgaagctggggtacaaggccgggatggccaaggggcttggcattgggtgcacatatgggattgcctgcatgtcatgggcgctggtgttctggtacgccggcgtgttcatccggagtggccagacagacggtggaaaggcgttcacggccatcttctccgccatcgtcggaggcctgagccttggacagtcgttctccaaccttggtgcattcagcaaagggaagattgccggttacaagctgttggaggtgataaggcagaggccgacaatagtccaagactcaactgatgggaggtgcctggatgaagtccatggcaacattgagttcaaggaagtgtccttcagctatccgtcccgcccggacgtcatggtgttccgtgacttctcgctcttctttcccgcagggaaaaccgcagccgtggtcggaggcagcggttctgggaagagcacggtcgtgtctctgatagaacggttttacgatcctaatcagggacaagttttgctcgataatgcggacatcaagtcgctgcagttgaaatggctgagagatcagattggtttggtgaatcaagaacccgccctcttcgcgaccaccatcattgataatattctttatggcaagcctgacgccacaatggctgaggttgaggccgcggcttcggctgccaatgcacatagcttcattgctcttcttcctaatggatacaacactcaggtgggagaaaggggacttcagctgtctggtggccagaagcaacgaattgccattgcacgtgcaatgctgaagaacccaaagatccttctccttgacgaggcaactagtgctcttgatgctggttctgagagtatagttcaagaagcacttgaccgcataatgatcggtaggacaactgtggtggttgcgcacaggctctcaaccatacggagtgttgacatgatcgccgtgatccagcaagggcaggttgttgagaccggtactcatgacgagctccttgccaaaggcagctctggtgcttatgcagctctcatcagattccaggagatggcaagaaaccgcgacttccgtggggcgtccacccgcaagaaccggtcgtctcgcctgagtaattccctgtccactcggtcactgagcctcaggtcgggaagcttgaggaacctgagctactcatacagcaccggtgcggatggccgcattgagatggtctcaaacgccgacaatgaccggaagtacccagcgccaaagggatactttttcaagctcctcaagttaaatgctccggaatggccctatacggtgctgggggcgatcggatccatcatgtctggcttcatcggcccgacatttgctatcgtgatgagcaacatgattgaagtgttctatttccgggaccccaacgcgatggagcgcaagactagggagtatgtgttcatctacatcggaaccgggttctacgcggttgtcgcgtacctgatccagcattacttcttcagcatcatgggcgaaaacctgaccaccagggtgcggaggatgatgcttgcagttatcttgaggaacgatgtggggtggttcgacgaggaggagaacaactcgagcctggtggcggcacggctcaacacggaggccgcggacgtgaagtcggcgatagcggagcggatatcggtcatcttgcagaacatgacatcgctcctggtgtccttcatcgtcggcttcatcatcgaatggcgggtcgccatcctcatcctcgtcaccttccctctccttgtcctagccaactttgctcagcaactgtccatgaaggggttcgccggcgacacggccaaggcgcacgccaagacgagcatgatcgccgggagggcgtcagcaacatccgcaccgtggcggccttcaacgcgcaggacaagatcctgtccctcttctgcagcgagctgcgcgtgccccagatgcacagcctgcgccggagccagatctccggcgtgctctacggcctctcgcagctctccctctacgcctccgaggcgctcatcctctggtacggcgcccacctcgtccgccaccacgtctccaccttctccagggtcatcaaggtcttcgtcgtcctcgtcatcaccgccaactccgtcgccgagaccgtcagcctggcgcccgagatcatccggggcggcgagtccgtccgctccgtcttcgccgtgctcaacagcaggacccgcatcgaccccgatgagccggaggccgagcaggtggagaaggttcgcggagagatagagctccgccacgtcgacttcgcctacccgtcgcgcccggacgtgatggtcttcaaggagttcagcctgaggatccgagctggacagagccaggcgctcgtgggagcgagcgggtcggggaagagcaccgtcatcgctctcatcgagcgtttctatgaccccatggccgggaaggtcatgatcgacggcaaggacatccgtcggctcaacctgaagtctctgcgtctcaggatcggcctggtgcagcaggagcccgtcctgttcgccaccagcatcctggagaacatcgcctacggcaaggacggcgtgacggaggaggaggtcgtggaggcggccaaggtggccaacgtgcacggcttcgtcagcgcgctccccgacggctacaggacgcccgtgggcgagcgcggcgtgcagctctccggcggccagaagcagcgcatcgccatcgcgcgcgcggtgctcaaggacccggccatcctcctgctggacgaggcgacgagcgccctggacgcggagtccgagtgcgtggtccaggaggcgctggggcgcatcatgaagggccggacgaccgtgctggtggcgcaccggctgtcgaccatccgctgcgtggactccatcgccgtggtgcaggacgggcgcgtggtggagcagggcagccacggcgatctcgtgtcgcggccggacggcgcctattcgaggctgctgcagctgcagctgcaccacgggtgatgatgggtggattggcgtcctgctccggcatggcggctgtagatacagagtagaccgaggcgagctttgatcgacactccgatgagcaacagagatttgctttagtgcggcggcggcggcccaaatggtaataggtgttagccggaactagtgttctcttttctctgtaaccgatcaggattatgatgaaggccatgttacattttgttccaacttgcacttatgtccggcttcagcag

SEQ ID NO: 3070 - DNA, 4352 bp, Hordeum vulgare
ttccccctcccccgaaaagcgcgatttttttcaagcataccccagcacccaacccaagcccccaaaaattagcacactgcaacagccctgctcgctttgcagtataagagaacagagtgaggaccgccgggagcaagagcaggagcaggggggaggggctctagtgctaaacatttcggcgtgtttagatccaatgccagagcggtgaggcgctcttctggttgcggagctcgcggcggagagagacagaagagtgacaatggcggaggagacagggaaggcggagtcgtcggccggggccgggagctgcggcggcggcggcggtggcgggtgcgaggcggtgaagaagagggcggagcagagtgtggcgttccatgagctgttcagcttcgccgacccgctcgactggctgctcatggcggctgggagcgccggcgccgtcgtgcacggcgccgccatgccggtgttcttcctcctgttcggcgagctggtcaacggcttcggcaagaaccagcaccacctccgccgcatgaccgacgaggtgtccaagtactcgctctacttcgtctacctcggcctcgtcgtctgcgcatcctcatacctggagatcgcgtgctggatgtacacgggcgagcgccaggtgggtgcgctccggcggcggtacctggaggccgtgctgcggcaggacgtgggcttcttcgacaccgacgcgcgcaccggcgacgtcgtcttcagtgtctccacggacacgctcctcgtccaggacgccatcggagagaaggtcggcaacttcatccactacctggcgacgttcctggcagggctcgtcgtcgggttcgtctcggcctggcggctggcgctgctcagcatcgccgtcatcccgggcatcgcgttcgccggcgggctctacgcgtacaccctcaccgggctcacctccaagagccgggagtcgtacgccaacgccggaatcatagccgagcaggcgattgcccaggtgaggacggtctactcctacgtgggggagacaaaggccctgaattcctactcggaggcgattcagagcaccctgaagctggggtacaaggccgggatggccaaggggctcggcattgggtgcacctatgggattgcctgcatgtcatgggcgctggtgttctggtacgccggcgtgttcatccggagcggccagacggacggtggaaaggcgttcacggccatcttctctgcaatcgtcggcggcctgagccttggacagtccttctcgaaccttggtgcgttcagcaaagggaagattgccggttacaagctgttggaggtgataaggcagaggccgacaatagtccaagactcaactgatgggaggtgcctggatgaagtccatggcaacattgagttcaaggaggtgtccttcagctatccgtcccgcccggacgtcatggtgtttcgtgacttctcgctcttctttcccgccgggaaaatggcagctgtggtcggaggcagcggttctgggaagagcaccgttgtgtctctgatagaacggttttacgatcctaatcagggacaagttttgcttgataatgcggacatcaagtcgcttcaattgaaatggctgagagatcagattggtttggtgaatcaagaaccagccctcttcgccaccaccatcattgacaatattctttatggcaagcctgacgccacaatggctgaggttgaggccgcggcttcggctgccaatgcacatagcttcattgctcttcttcctaatgggtacaacactcaggtgggagaacggggacttcagctgtctggtggccagaagcaacgaattgccattgcccgtgcaatgctgaagaacccaaagatccttctccttgacgaggcaactagtgctcttgatgctggttcagagagtatcgttcaagaagcactcgaccgcataatgatcggtaggacaactgtggtggttgcacacaggctctcaaccatacggagtgttgacatgatcgcggtgatccagcaagggcaggttgttgagaccggtactcatgacgagctccttgccaaaggcagttctggtgcttatgcagctctcatcagattccaggagatggccaaaaaccgcgacttccgtggggcatctacccgcaagaaccggtcatctcgcctgagtaattccctgtcaactcggtcactgagcctcaggtcgggaagcttgaggaacttgagctactcatatagcaccggtgcggatggccgcattgagatggtctcaaacgccgacaatgaccgtaagtacccggcgccaaaaggatactttttcaagcttctcaagctaaatgctccggaatggccttatacggtgctgggggcgatcggatccatcatgtctggcttcattggcccgacatttgccatcgtgatgagcaacatgattgaagtgttctatttccgggaccccaacgcgatggagcgcaagactagggagtatgtgttcatctacatcggaaccgggttctacgcggttgtcgcctacctgatccagcactacttcttcagcatcatgggcgaaaacctgaccaccagggtgcggaggatgatgcttgcagttatcttgaggaacgacgtggggtggttcgacgaggaggagaacaactcgagcctggtggcggcacggctcaacacggaggccgcggacgtgaagtcggcgatagcggagcggatatcggtcatcctgcagaacatgacatcgctcctggtgtccttcatcgtcggcttcatcatcgaatggcgcgtcgccatcctgatcctcgtcaccttccctctccttgtcctcgccaactttgcccagcaactgtccatgaaggggttcgccggggacacggccaaggcgcacgccaagacgagcatgatcgccggggagggcgtcagcaacatccgcacggtggcggccttcaacgcgcaggacaagatcctctcgctcttctgcagcgagctgcgcgtgccccagatgcacagcctgcgccggagccaggtctccggcgtgctctacggcctctcgcagctctccctctacgcctccgaggcgctcatcctctggtacggcgcccacctcgtccgccaccacgtctccaccttctccagggtcatcaaggtcttcgtcgtgctcgtcatcaccgccaactccgtggccgagaccgtcagcctcgcgcccgagatcatccgcggcggcgagtccgtccgctccgtcttcgccgtcctcaacagcaggacgcgcatcgacccggacgagccggagggcgagccggtggaaaaggttcgcggcgagatcgagctccgccacgtcgacttcgcctacccgtcgcgcccggacgtgatggtcttcaaggagttcagcctgaggatccgagccggccagagccaggcgctcgtgggggcgagcgggtcggggaagagcactgtcatcgctctcatcgagcgtttctatgatcccatggccggcaaggtcatgatcgacggcaaggacatccgtcggctcaacttgaagtcgctgcgtctcaagatcggcctggtgcagcaggagcccgtcctgttcgccaccagcatcctcgagaacatcggctacggcaaggacggcgtgacggaggaggaggtcgtcgaggcggccaaggtggccaacgtgcacggcttcgtcagcgcgctcccagacgggtacaggacgcccgtgggcgagcgcggcgtgcagctctccggcggccagaagcagcgcatcgccatcgcgcgcgcggtgctcaaggacccggccatcctcctgctggacgaggcgacgagcgccctggacgccgagtcagagtgcgtggtccaggaggcgctggggcgcatcatgaagggccggacgaccgtgctggtcgcgcaccggctgtcgaccatccggtgcgtggactccatcgccgtggtgcaggacgggcgcgtcgtggagcagggcagccacggcgacctcgtgtcgcggccggacggcgcctactcgaggctgctgcagctgcagctgcaccatgggtgatgatggatggatggatgggatggattggcgtcctgctccggcatggcggctgtagatacagagtagaccgaggcgagctttgatcgacactccgatgagcaacagagatttgctgcccagatggtgataggtgttaggccggaactagtgttttattttctctgtaaccgatcaggattatgctgaaggccatgttacattttgttccaacttgtactgatgtccggcttcggcacaatttcttttccccgacggaatttgtccttctcctcgttatctgtttcaaatagat

SEQ ID NO: 3071 - DNA, 4294 bp, Hordeum vulgare
caagcccccaaaaattagcacactgcaacagccctgctcgctttgcagtataagagaacagagtgaggaccgccgggagcaagagcaggagcaggggggaggggctctagtgctaaacatttcggcgtgtttagatccaatgccagagcggtgaggcgctcttctggttgcggagctcgcggcggagagagacagaagagtgacaatggcggaggagacagggaaggcggagtcgtcggccggggccgggagctgctgcggcggcggcggcggcgggtgcgaggcggtgaagaagagggcggagcagagtgtggcgttccatgagctgttcagcttcgccgacccgctcgactggctgctcatggcggctgggagcgccggcgccgtcgtgcacggcgccgccatgccggtgttcttcctcctgttcggcgagctggtcaacggcttcggcaagaaccagcaccacctccgccgcatgaccgacgaggtgtccaagtactcgctctacttcgtctacctcggcctcgtcgtctgcgcatcctcatacctggagatcgcgtgctggatgtacacgggcgagcgccaggtgggtgcgctccggcggcggtacctggaggccgtgttgcggcaggacgtgggcttcttcgacaccgacgcgcgcaccggcgacgtcgtcttcagtgtctccacggacacgctcctcgtccaggacgccatcggagagaaggtcggcaacttcatccactacctggcgacgttcctggcagggctcgtcgtcgggttcgtctcggcctggcggctggcgctgctcagcatcgccgtcatcccgggcatcgcgttcgccggcgggctctacgcgtacaccctcaccgggctcacctccaagagccgggagtcgtacgccaacgccggaatcatagccgagcaggcgattgcccaggtgaggacggtctactcctacgtgggggagacaaaggccctgaattcctactcggaggcgattcagagcaccctgaagctggggtacaaggccgggatggccaaggggctcggcattgggtgcacctatgggattgcctgcatgtcatgggcgctggtgttctggtacgccggcgtgttcatccggagcggccagacggacggtggaaaggcgttcacggccatcttctctgcaatcgtcggcggcctgagccttggacagtccttctcgaaccttggtgcgttcagcaaagggaagattgccggttacaagctgttggaggtgataaggcagaggccgacaatagtccaagactcaactgatgggaggtgcctggatgaagtccatggcaacattgagttcaaggaggtgtccttcagctatccgtcccgcccggacgtcatggtgtttcgtgacttctcgctcttctttcccgccgggaaaacggcagctgtggtcggaggcagcggttctgggaagagcaccgttgtgtctctgatagaacggttttacgatcctaatcagggacaagttttgcttgataatgcggacatcaagtcgcttcaattgaaatggctgagagatcagattggtttggtgaatcaagaaccagccctcttcgccaccaccatcattgacaatattctttatggcaagcctgacgccacaatggctgaggttgaggccgcggcttcggctgccaatgcacatagcttcattgctcttcttcctaatgggtacaacactcaggtgggagaacggggacttcagctgtctggtggccagaagcaacgaattgccattgcccgtgcaatgctgaagaacccaaagatccttctccttgacgaggcaactagtgctcttgatgctggttcagagagtatcgttcaagaagcactcgaccgcataatgatcggtaggacaactgtggtggttgcacacaggctctcaaccatacggagtgttgacatgatcgcggtgatccagcaagggcaggttgttgagaccggtactcatgacgagctccttgccaaaggcagttctggtgcttatgcagctctcatcagattccaggagatggccaaaaaccgtgacttccgtggggcatctacccgcaagaaccggtcatctcgcctgagtaattccctgtcaactcggtcactgagcctcaggtcgggaagcttgaggaacttgagctactcatatagcaccggtgcggatggccgcattgagatggtctcaaacgccgacaatgaccgtaagtacccggcgccaaaaggatactttttcaagcttctcaagctaaatgctccggaatggccttatacagtgctgggggcgatcggatccatcatgtctggcttcattggcccgacatttgccatcgtgatgagcaacatgattgaagtgttctatttccgggaccccaacgcgatggagcgcaagactagggagtatgtgttcatctacatcggaaccgggttctacgcggttgtcgcctacctgatccagcactacttcttcagcatcatgggcgaaaacctgaccaccagggtgcggaggatgatgcttgcagttatcttgaggaacgacgtggggtggttcgacgaggaggagaacaactcgagcctggtggcggcacggctcaacacggaggccgcggacgtgaagtcggcgatagcggagcggatatcggtcatcctgcagaacatgacatcgctcctggtgtccttcatcgtcggcttcatcatcgaatggcgcgtcgccatcctgatcctcgtcaccttccctctccttgtcctcgccaactttgcccagcaactgtccatgaaggggttcgccggggacacggccaaggcgcacgccaagacgagcatgatcgccggggagggcgtcagcaacatccgcacggtggcggccttcaacgcgcaggacaagatcctctcgctcttctgcagcgagctgcgcgtgccccagatgcacagcctgcgccggagccaggtctccggcgtgctctacggcctctcgcagctctccctctacgcctccgaggcgctcatcctctggtacggcgcccacctcgtccgccaccacgtctccaccttctccagggtcatcaaggtcttcgtcgtgctcgtcatcaccgccaactccgtggccgagaccgtcagcctcgcgcccgagatcatccgcggcggcgagtccgtccgctccgtcttcgccgtcctcaacagcaggacgcgcatcgacccggacgagccggagggcgagccggtggaaaaggttcgcggcgagatcgagctccgccacgtcgacttcgcctacccgtcgcgcccggacgtgatggtcttcaaggagttcagcctgaggatccgagccggccagagccaggcgctcgtgggggcgagcgggtcggggaagagcactgtcatcgctctcatcgagcgtttctatgatcccatggccggcaaggtcatgatcgacggcaaggacatccgtcggctcaacttgaagtcgctgcgtctcaagatcggcctggtgcagcaggagcccgtcctgttcgccaccagcatcctggagaacatcggctacggcaaggacggcgtgacggaggaggaggtcgtcgaggcggccaaggtggccaacgtgcacggcttcgtcagcgcgctcccagacgggtaccggacgcccgtgggcgagcacggcgtgcagctctccggcggccagaagcagcgcattgccatcgcgcgcgcggtgctcaaggacccggccatcctcctgctggacgaggcgacgagcgccctggacgccgagtcagagtgcgtggtccaggaggcgctggggcgcatcatgaagggccggacgaccgtgctggtcgcgcaccggctgtcgaccatccggtgcgtggactccatcgccgtggtgcaggacgggcgcgtcgtggagcagggcagccacggcgacctcgtgtcgcggccggacggcgcctactcgaggctgctgcagctgcagctgcaccatgggtgatgatggatggatggatgggatggattggcgtcctgctccggcatggcggctgtagatacagagtagaccgaggcgagctttgatcgacactccgatgagcaacagagatttgctgcccagatggtgataggtgttaggccggaactagtgttttattttctctgtaaccgatcaggattatgctgaaggccatgttacattttgttccaacttgtactgatgtccggcttcggcacaatttcttttccccgacggaatttgtccttctcctcgttatctgtttcaaat

SEQ ID NO: 3072 - DNA, 4373 bp, Gossypium raimondii
gctctttttatgctgctttgccctttacttttcctcattttttccccttctcttcaccttagttctcgaactcataaactcacaaacgacattgtcaggttttcgagaccttgaaaaagggaagaaagataaagaagcaaaaaaagggtctttactctttagatctctcgttcttctttcacccttaagagatcttctttctttctttctttctttctttcaatggctattcttcaactcagttgcttttgaatcaaactcaactcacctcaactcaattcatccaacctcttcctttcttcttctttagctttggttttttgagtttacaaaaaaatggctgaaccaactgaaacaaaagcagtccctgaagcagaaaagaagaaagaacaaagcttgccattttaccaacttttcacttttgctgacaaatatgattatttgttgatgatcactggtagcttaggagctatcatccatggttcttcaatgcctgttttcttcttattatttggtgaaatggttaatggctttggcaaaaaccaatctgatttgcccaaaatgactcatgaagttgccaagtatgcactctattttgtgtatcttggtcttattgtctgcctatcatcatatgcagagattgcatgttggatgtacactggggaaagacaagtaagcacattgagaaagaagtatttggaagctgttttgaaacaagatgttgggttctttgacaccgatgcaagaactggggatattgtttttagtgtttccactgatactctacttgttcaagatgccatcagtgagaaggtagggaactttatacattatctgtcaacattcttggctggtttagtagttggttttgtgtcagcatggaggttagccttactgagtgtggcagtgatccctggaattgcctttgccggcggcttatacgcgtatacgttgaccggcctcacttcgaagagccgggaatcctatgcgaatgccggcataattgccgagcaggccatcgcacaagttcgtaccgtgtactcatatgttggcgagagtaaggcccttaattcttattcagatgcaatacagaacacacttaaactcggatacaaggctggaatggctaagggtttagggctcgggtgcacttatggcattgcttgtatgtcttgggcgcttgttttctggtacgctggtgttttcatccggaatggacagagcgatggcggcaaggcatttacagctattttctcagccattgttggtggcatgagtttgggtcagtcattttcaaatctcggggcatttagtaaaggaaaagcagctggttacaaactgatggagattatcaaccaaaaaccctccataattcaagaccatttggacgggaaagtactggaggaagttaatggcaatatagaattcaaggaagtgactttcagctacccatcgagaccggatgttatcatctttagcaatttctcgattttctttccagcaggaaagacaattgcagttgttggtggtagcggctctgggaagagtactgtcgtctctctgatagagaggttctatgatcctaaccaggggcaggttttgttggataatgttgacataaagacactgcaacttaaatggttacgtgatcagattggactggtaaatcaagaacctgctctctttgcgactaccatccttgagaacatactatatggaaaacccgaggcaacaatggatgaagtggaagctgctgcttgtgctgcaaatgctcacagctttattaccctactccctaatggatataacactcaggtgggagaacgaggagtccaactctctggtggccaaaaacaaagaattgcgattgctagagccatgttgaagaatccaaagatcttgctccttgatgaagcaacaagcgcactcgatgcaggctccgagagtattgttcaggaagctcttgaccggctaatggtcgggagaacaactgtagttgttgctcatcgactctccaccataaggaatgttgattcgatagctgttatacaacaagggcaagttgttgagactggaacacatgaagagttgattgcaaaggcaggggcgtatgcttcgttaatcagattccaagaaatggtgggaaatagagactttgctaatccatcaactcgccgatcacgttcaacacgtctaagtcattcactgtcaactaagtccttaagcctccggtctggcagtttgcgaaacttgagctattcttacagtaccggtgctgatggccggatagagatgatatcaaatgctgaaacggaacgtaaaaacccagcaccggatggctatttctgccggcttctcaagctaaatgctcccgaatggccctattcaatcatgggagccgttggttccgtgctttctggttttataggaccaacttttgccattgtgatgagcaatatgatcgaagtcttttactatacaaaccctacctctatggaaagaaagacaaaagaatacgttttcatctacatcggagctggtctatatgctgtcgttgcgtatttgattcaacattatttcttcagtattatgggagaaaacctcacaacacgagtgaggcggatgatgcttggagcaattctaaggaatgaagtcggatggtttgacgaggaagagcacaattcaagccttcttgcagccaaattggcaaccgatgcagccgacgtaaaatccgcgatagctgaaaggatctctgtgatactacaaaacatgacttcacttctcacttcattcattgttgccttcatagtcgaatggagggtctctcttctcatcctcggtaccttccctcttctagtcctcgcaaacttcgctcagcaactttcactcaaagggtttgctggtgacacggcgaaggcgcatgcaaagacaagcatgattgcaggtgaaggtgtaagcaatattcgaacggttgcagcattcaatgcacagaacaagatcctttcactgttttgctacgaactccgagttccgcagatgcaaagccttcgtcgcagccaaacatcgggtctcctttttggcttgtctcagctcgcactttatgcttcggaagctctcatactctggtatggagctcaccttgttagcgaaggtgtttcaaccttctctaaggtgattaaggtttttgtggtattggtggttactgcaaattctgtggcggaaactgttagtctcgctcctgagatcgttaggggtggtgaagctgttggttcagtgttctcaattctagatcgttcaactaggattgacccagatgatccagaggcagaaccggttgaaacaattcgtggagaaattgaactccgtcatgttgattttgcatatccttcgcgacctgatgttagtgtgtttaaagaccttaaccttcgaatccgtgctggccaaagccaagcacttgttggagctagtggctctggcaagagttcagtcattgcattgattgaacgattctacgatccaacagccggaaaggttatgatcaatggaaaagatatccggagattgaacttgaagtctcttaggcttaaaatcggattggtacaacaagaaccagccctctttgctgccagcattttcgataatatcgcttatggaaaagaaggagcaaccgaagctgaagtaatcgaagcagctcgagcagctaacgtgcacggtttcgttagtgcgttgcctgatggttacaaaacacccgttggtgagagaggcgttcaactctccggaggtcaaaaacaaagaatcgccatcgcaagggctgtacttaaggacccaacaatattactactcgatgaagccaccagtgcactcgacgcagaatcagaatgcgtgctacaagaagcactcgaaaggctcatgaggggccgcacgacggtacttgtggctcaccgtctctcgacaataagaaacgtcgacagtattggagtagtacaagacgggcgaatcgtagaacaaggcagccattccgaattgattagccgaccggaaggagcttattctaggctcttgcaactgcaacaccatcacatatgaaagtttttattttttattttaattgaatcaacttgttgggtggtataattatgtttgggaccctttaacctcttatgtttttcatattttccttttttgaatgatgatagttgtagatattgttaaagtggagactgtatctttgggttctactgccccatttccaatggggtttccaatgttaaattattgatatctatggtgcataacataagtccctttttttttttcttgtaattggtttttatataatattataaagcgcaaactctagacaccactttttt

SEQ ID NO: 3073 - DNA, 3990 bp, Nicotiana benthamiana
tcaatggcggagactacagaaggaaaaccaatgccagaggcagagaagaagaaagagcaaagtcttccattttatcagttattttcttttgctgataagtatgattatcttctaatgatttctggaagtattggagctattattcatggctcttctatgcctgttttctttctcctttttggtgaaatggttaatggttttggcaaaaatcaaatggatttgcacaaaatggttcatgaagtatcaaagtatgctctgtatttcgtgtatcttgggttgatagtttgtgcatcatcctacgcagagattggttgttggatgtatactggagaaagacaagtaagtgcactaaggaagaaatatttagaggcagtgttgaaacaggacgttgggttttttgatacagatgctagaactggagatattgttttcagcgtctcaacggatactctactggtccaagatgccattagtgagaaggtgggcaattttatccactacctttcgacgttcttggctgggttggtggttggtttcgtgtcagcgtggaggttggctctcctcagtgttgcagtaattcctggaattgcttttgctgggggactttatgcttatactctcactggtctcacctccaaaagcagagaatcctatgccaatgctggtatcattgccgagcaggcaattgcacaagtcagaacagtttactcatacgtgggcgagagcaaagccctcaattcatattcagatgcaattcagaacacattaaagctcggatacaaggctggcatggccaaaggcttgggtttgggatgtacctatggaatagcatgcatgtcgtgggcccttgttttctggtacgccggggttttcatcaggaatggacaatctgatggaggaaaggcatttactgctattttctcagccattgttggtggcatgagtttgggtcagtcattttccaatcttggtgcctttagtaaaggaaaagcggctggatacaagttaatggagatcatcaagcagaaacctactattgttcaagatcttgcagatggaaagtgcctgtctgaggtcaatggaaacattgaattcaaaaatgtgaccttcagctatccttcaagaccggatgtgattatcttcagagatttctgcattttcttccctgctggaaagacagttgcagtcgttggtggcagtggctcagggaaaagcactgttgtttcgctcatagaaagattttatgatcctaacgagggtcaagttttgctggacaatgtggacataaagacattacaacttagatggttgagagatcagattggccttgtgaatcaagaacctgcattatttgctactaccatacttgagaacatactgtatggaaagcctgatgcaactatggctgaagttgaggctgctacctctgctgccaatgcacatagttttattaccttgctgcctaatggatacaacacccaggtgggagagcgtggtgtccaactatctggtggacagaaacagagaattgcaattgcaagggctatgttaaagaacccaaagatcctcctgcttgatgaggccactagtgctcttgatgctggttcagagagcattgtccaggaagctctggaccgcctcatggttggccggacgactgtagttgttgctcatcgtctctccacaattagaaatgttgattccattgcagttatacaacaagggcaggtagttgagactggaacacatgaagagctgattgccaaaggtggggcttattcttctttaatcagattccaagaaatggttgggaaccgagacttctcaaatccatctactcgtcgtacacgttcatctcgtttaagcagttcactatcaacaaagtctctaagccttcgctctggcagtttaaggaatttgagctattcatacagcaccggtgcagatggacgtattgaaatgatttctaatgctgaaacagagaggaaaaatcctgcaccacagggctatttctgccgccttctcaaactaaatgctcccgagtggccttattcaatcatgggagctgtagggtctgttctctctggttttattggtccaacttttgctattgtgatgagtaacatgattgaggtgttctactatagaaatcccgcaagcatggaaagaaagacaaaggaatatgtcttcatttacattggggcaggcctgtatgctgttgtagcatatttaatacagcattacttctttagtattatgggagaaaacctcactaccagggtgcggaggatgatgttggcagcaattttgaggaatgaagttggatggttcgatgaggaggagaacaattcaagtttacttgcagctcgcttagctacagatgctgcagatgttaagtcagccatagcggagaggatctcggttatactacagaatatgacatctcttctcacttcatttatagttgcatttatagtcgaatggcgagtctcacttctcatccttgccacatttccgcttctagtcttggccaattttgctcagcaactctcactgaaaggatttgctggagacacagccaaagcgcatgcaaagacaagcatgattgctggagaaggagtaagcaatattagaactgtagcagctttcaatgctcaagaaaagatcatctctttgttctcccaagagcttagagttccacaaatgcaaagtcttcgtcgcagccaaatgtcaggactcttatttggtatatcacaacttgctctttatgcctctgaggctctgattctttggtatggcgcgcaccttgttagcaaaggggtctcgactttctctaaggtgattaaggtctttgtagtccttgtgatcacggccaattcagttgctgaaaccgtcagtttagcacccgagattgttaggggtggtgaagctgttggttctgtattttccattcttgatcgctcaaccagggtcgatcctgatgacactgaagctgatccagttgaatcaattagaggggatattgaattgcgccatgttgattttgcatatccttcacgacctgatgtttcagtgttcaaggacttcaatcttaggattcgtgctggccaaagccaagctcttgtgggggcaagtggctcaggaaagagctccgttatagccttaattgaaaggttctatgatccaacaggtggaaaagttatgattgatgggaaagacataaggagattaaacttgaaatccctaaggcttaaaattgggttggtgcaacaagagccagctctgtttgcagctagtatttttgataatattgcctatggtaaagagggtgcaacagaagcagaagtggttgaagcggctcgagctgcaaatgtacacacttttgtaagtggtttgcctgaaggttacaagacccctgttggtgagagaggtgttcaactatcgggaggacagaaacaacggattgcaattgctagggccgttcttaaagatccatcaattctcctacttgacgaggctacaagtgcacttgatgctgaatccgaatgtgttttacaagaagcactcgaaaggttgatgagaggtcgaaccactgtacttgtggctcaccgattatcaacaattcgtcatgtggacagcatcggggtggtgcaagatggtcgcattgttgaacaaggaagccactctgagttaatcagcaggccagaaggtgcatattctagactattgcaactacaacaccaccggatatgataacttgaagaatttaattttttttttcttttttatttttatggaagcaagtaacatggcctagtgttttggggtagtgacaatgttggggtcctagtaaccgttgctttcatttgcttttattgattatgatgatgatgctgatagttgtagatatgggaatgtcacggtcaatattatatcatcggaaaagtctcaaactctattccctatggagaatattatattttaaaatat

SEQ ID NO: 3074 - DNA, 4502 bp, Brachypodium distachyon
tcgaagttcagaggttatatgggcttaactcccagacaaaattttaatgtgagcgtcgtatctagcacaaacgcgagctccttttttaagcacactgcacaccgaacagaaaaaagatcgcacactgcacacggaacagctctgctcgcttgcagtataagagaacagaacggggagccccgggagtaggagcaggaggagtggcgctggagctaaaatttcggtgggtttagatccaatgccgaggtcgtgaggtgcgcttgtagctgaggatttcgtgagggagagagaggggaagaggacagacaatggcggaggagacagggaaggcgggggccgggagctgcagcggcggcggcggcggcggcgggtgcgaggcggtgaagaagagggcggagcagagcgtggcgttccatgagctgttcatcttcgcggacccgctggactggctgctcatggcggcggggaccgccggcgccgtcgtgcacggcgccgccatgccggtgttcttcctcctgttcggcgagctggtcaacggcttcggcaagaaccagcaccacctacgccgcatgaccgacgaggtgtccaagtattcgctctacttcgtctacctcggcctcgtcgtctgcgcgtcctcgtacttggaaatcgcgtgctggatgtacacgggcgagcggcaggtcggcgcgctccggcggcggtacctggaggccgtgctgcggcaggacgtgggcttcttcgacaccgacgcgcgcaccggcgacgttgtcttcagcgtctccaccgacacgctcctcgtccaggacgccatcggcgagaaggtcggtaacttcatccactacctcgcgacgttccttgcggggctggtcgtcggcttcgtctccgcctggcggctcgcgctgctaagtatcgccgtcatccccggcatcgcattcgccggcgggctgtacgcgtacacgctcaccgggctcacatccaagagccgggactcgtacgccaacgccggtatcattgccgagcaggcgattgcccaggtgaggacggtgtactcctatgttggggagtccaaggctttgaattcctattcggaggcgattcagagcaccctgaagctggggtacaaggcagggatggcaaaggggcttggcattgggtgtacttatggaatcgcctgcatgtcatgggcactagttttctggtatgccggtgtgttcatccgaagtggccagacagatggtggaaaggcgttcaccgcgattttctcagcaatcgtcggaggcctgagcctgggacaatcattttcgaacctcggagcattcagcaaagggaagatcgctggatacaagctgttggaggtgataaggcagaggccaacgattgttcaggactcggctgatggcaggtgcctggatgaagtccatggcaacattgagttcaaggaagtgtccttcagttatccatcccgcccggacgtcatgatattccgtgacttttctctcttcttccccgcggggaaaactgcagctgtagttggaggcagtgggtctgggaagagcactgttgtatctctcattgaacggttttatgatcctaatcaggggcaagttttgctggataatgtcgacatcaagacgctgcaattgaaatggctgagagaccaaattggtttggtgaatcaagaacctgccctctttgcaaccaccatcatcgagaatattctttatggcaagcctgatgccacaatggcagaggttgaggccgcggcttcggctgccaatgcccatagcttcattgctcttcttcctaatggctacaacactcaggtgggagaaagagggcttcagctctctggtggccagaagcaacgaattgccatcgcccgtgcaatgcttaagaatccaaagatccttctccttgatgaggcaaccagtgcactagatgctggttctgagagtattgttcaagaagcactggaccgcataatgatcggtaggacaactgttgtggttgcacacaggctctctaccatacgatgtgttgacatgatcgccgttatccagcaaggccaggtcgttgagaccggcactcatgatgagctcctcgccaaaggaagttctggcgcttacgctgctctcatcagattccaggagatggccagaaaccgtgacttccgtggatcatctacccggaagaaccggtcatcccgcttgagtaattccctgtccactcggtcactgagcctgaggtcaggaagcttgaggaacttgagctactcatacagcactggtgcagatggacgcattgagatggtttctaacgccgacaatgacaggaagtaccctgcaccgaaagggtactttttcaaactccttaagctaaatgcgccggaatggccctataccgtgttaggggcgattgggtccatcatgtctggctttattggcccgacatttgctattgtgatgagcaacatgattgaagtgttctattaccgggaccccaacgcaatggagcgcaagactcgggagtacgtgttcatttacatcggcactggattatatgcggttgtcgcatatcttgttcagcattatttcttcagcatcatgggcgaaaatctgaccaccagggtgcggaggatgatgcttgcagtgatcttgaggaacgatgtcgggtggtttgatgaagaggagaacaattcaagccttgtggcggcacgccttgccaccgaggctgcagacgtgaagtccgcaatagccgaacggatatcggtcatcttgcagaacatgacctcgctcatggtgtccttcgtggtgggtttcatcatcgaatggcgggtcgccattctcattcttgtcactttccctctgcttgtccttgccaactttgctcagcaactgtcgatgaaggggttcgcgggggacacggccaaggcgcacgccaagacgagcatgatcgccggggagggcgtgagcaacatccgcaccgtggcggccttcaacgcccaggacaagatcctgtccctcttctgcagcgagctgcgcgtccctcagagccacagcctgcgccggagccagatctccggcgcgctctacggcctctcccagctctccctctacgcatccgaggcgctcatcctctggttcggcgcccacctcgtccgccaccacatctccaccttctccaaggttatcaaggtctttgtcgtgctcgtcatcaccgccaactccgtcgctgagactgtcagcctcgccccggagatcatccgtggcggcgagtccatccggtccgtcttcgccgtgctcaacagcaggacgcggatagacccggatgagccggagaccgagcaggtggagtcggtccgcggtgagatcgagcttcgccacgtcgatttcgcctacccgtcgcgccctgacgtgatgatcttcaaggatttcagcttgaggatcagagccgggcagagccaagccctggtgggggcgagtggatcagggaaaagcaccgtcatagctctcatcgagcggttctacgaccccatggctgggaaggtgatgatcgacggcaaggacatccgtcggctcaatctcaagtctctgcgcctcaagatcggccttgtgcagcaggagcccgtcctgttcgccaccagcatcctggagaacatcgcgtacggcaaggacggcgcgacggaggaggaagtcatcgaggcggccaaggtggccaacgtgcacggctttgtcagcgcgctccccgatggctacaggacacccgtgggcgagcgcggcgtgcagctctccggcgggcagaagcagcgcatcgccatcgcccgtgcggtgctcaaggaccccgccgtgctgctgctggacgaggcgacaagcgccctggacgccgagtccgagtgcgtgctccaggaggcgctggggcgcatcatgaagggccggacggccgtgctggtcgcgcaccggctgtcgaccatccgctgcgtggactccatcgccgtggtgcaagacgggcgcgtcgtcgagcagggcagccacggcgacctcgtgtcgcggcctgatggcgcctactcgcgtctgctgcagctgcagctgcaccacgggtgatctgatgagatgcccggggcgtctgctccgccttggcgttggcgggtgtagatacagagtaggacgaggcgagcttccttggtgacgacgacactccgacgagcaaaggaaattgtgctgtagtactagtgccgcgatggcggcccaaaccgtaggttaggacttggaactagtagtgttcttttcttctgtaacagatcaggattatgcctaaagcgatgttatattttctgcgaacttaacactgatggtggctttggcggaattgttgttctcctcgctatgtgctccaaatcccagatcagttgaacaaatttcaactagcgcccagcgacgagatgattgaagaacacgtacattcagattcaagaatggtagtcttcacctcagatatgtagagta

SEQ ID NO: 3075 - DNA, 4221 bp, Ricinus communis
cttctttgaccacaaatatactctcactttacacactcactcttatatgcatctttttatgctcttagctcagatctctccttcaatggcaatatacccacctcctactttcgctcaatcctcactttactgtctttcttgattcagtttatcatcaaagcttcagtcttttcttttttttctaatatatattacttttgggttcttgaactagaaaagaatggcagcagaaacagcagttgaatctaatactactagtactactaaagcaccattgccaccagaggcagagaaaaagaaagaacaaagcttgccgttttatcagctattctcatttgctgataactatgattggttacttatgatctctggtagtacaggagctattattcatggctcttcaatgcctgttttcttcttgttatttggcgaaatggttaatgggtttggtaaaaaccaatctgatttgacaaaaatgactcacgaagtctctaagtatgctttatattttgtgtatcttggccttgttgtatgcctatcgtcctatgcagagattgcgtgctggatgtatactggagaaaggcaagtaagcacactgaggaagaagtatttagaggcagtgttgaaacaagatgttgggttctttgatacagatgcaagaactggtgatattgtctttagtgtctcaacagacacccttctcgttcaagatgccattagtgagaaggttggtaactttatacattatctgtcaacatttctagctgggctagtggttggttttgtatcagcatggaggctagcgttgctaagtgtggcagtcataccaggaatagcatttgccggtggcttatatgcatacactctaaccggcctgacatccaaaagccgtgaatcctatgcacaagccggcataattgctgaacaggctattgcgcaagttcgaaccgtctactcatatgttggagagagcaaagccctaaattcatactctgatgcaatacagaacactttaaagcttggatacaaggctggtatggccaaaggtttgggactgggatgtacctatggaattgcatgcatgtcatgggcccttgtattttggtatgctggagtttttatcaggaatggacaaaccgatggagggaaggcattcaccgcgattttctctgccattgttggtggaatgagtttgggccagtcattttcaaatcttggtgcttttagcaaaggcaaagcagctggatacaagttgatggaaattataaagcaaaagcctactataattcaagacccctcagatggcaagtgcttgcctgaaattaatggaaacatagaattcaaggatgtgactttcagctacccatcaaggccagatgttatcatattccgtgatttctcaatcttctttcctgctggaaagactgttgctgttgttgggggtagcgggtcagggaaaagtactgttgtctctcttattgagaggttttatgatcctaatcagggccaagttttgctggataatgtggacataaagaccctgcaactgaggtggttacgcgatcaaattggattggtgaatcaagagcctgctctctttgcaaccaccatactcgagaacatactctatggaaagcctgatgcaacaatggatgaagtggaagctgctgcttctgctgcaaatgctcacagtttcatcaccttgcttcccaatgggtataacactcaggtgggagaaagaggagtgcaactctcaggtggtcaaaaacagagaatagcaattgctagagctatgttaaagaacccaaagatcctccttcttgatgaagcaaccagtgcccttgatgcaggttctgaaagcattgttcaagaagcattagaccgtctcatggttggaagaacaactgtagttgttgcacatcgactctccacaattagaaatgtcgatacaattgcagttattcaacaagggcaagttgttgagacagggacccatgaggaactgatttcaaaaggagcagcatatgcttcattaattagattccaagaaatggtgagaaatagagacttcgctaacccatcaactcgacgatcacgctcaacacgtttaagtcattcactttcaacaaagtctctaagcctccgctctggcagtttacggaacctaagctattcatacagtacaggggctgatggccgcattgaaatgatatcaaatgctgaaactgaacgtaagaatccagcacctgatggctacttctgcagactgcttaagctaaatgctcctgaatggccatattctataatgggtgctataggatctgtactttctggttttattggtccaacctttgccatagtgatgagcaacatgattgaggttttctattatagaaatcctgcttccatggaaaggaagacaaaggagtatgttttcatttacattggtgctgggctttatgctgttgttgcatatttgattcagcattacttcttcagtattatgggagagaatcttactacaagagtaagaagaatgatgcttgcagcaattctgaggaatgaagtcggatggttcgatgaagaagagcataactcaagccttgttgcggcccggttagctaccgatgcagctgatgtaaaatctgcaatagcggagagaatttctgttatactacaaaacatgacctctctcctcacttcgttcatagttgctttcatagtggaatggagggtatcccttctcattttagctaccttccctcttcttgtccttgctaactttgcccagcaactctcactcaaagggtttgctggagacactgccaaggcccatgccaagactagcatgattgctggtgagggagtgagcaatatccgaacggttgcagcttttaatgcccaagataaaatcctgtccttgttctgccatgaactcagtgttccacaacttcgtagcctacgtcgaagccagacatctggcctcctttttggcctctctcagcttgctctttatgcctctgaagcgctcatcctttggtatggtgctcatcttgttagcaaaggggtctccacattctcaaaggttattaaggttttcgtagtccttgtcatcacagctaattcagttgcagaaactgttagtcttgcgccagagattataaggggcggtgaagctgtaggttcagtattttcaattttggaccgttccactaggattgatccagatgatcctgaggctgagcctgttgagtcaattcgcggggaaattgaacttagacatgttgatttttcatacccctcaagacctgatgttccagttttcaaagaccttaaccttagaatccgagctggccaaagccaagcccttgttggagctagtgggtgtggaaagagttctgtgattgctttgattgagcgattttatgatccaactgctggaaaggttatgattgatgggaaggacattcggcgattaaatttgaagtccttgaggcttaaagttggattggtgcaacaagagccagcactctttgcagcaagcatttttgacaacatagcctatggaaaggagggtgcaactgaagctgaagtaattgaagcagcacgcgcagccaatgtgcatggattcgttagcgcattgcctgatggatacaaaacaccagtaggcgagagaggagttcagctctcaggaggacaaaaacaaagaattgcaatagcaagggcagttcttaaagacccagcaatccttttactagatgaagctacaagtgcacttgatgctgaatcagaatgtgtgctgcaagaagcacttgaaaggttaatgagaggtcgaaccacagtgcttgtagctcacaggttatcaacgattagaggggttgacagtattggagtcgtacaagacggacggatagttgagcaaggcagccatgccgaattagttagccgaggcgacggagcatattctagactgttacagctacaacaccatcacatatgatgggaaggaacatggccttgttgattgttaattatgttttggggtcccattaaccttatgttttcattttacttcttttctcctttttttggaatgattatgatgatgacagttgtagatatgggaatgtggaggactatatcttgagaagaactatcaatccccattttccaatggggtagcaagtgttatattattaaatatctaatggttcataaacc

SEQ ID NO: 3076 - DNA, 4535 bp, Prunus mume
cctggatcaccatcaaatacagtaatttcaaaaccgcagttaaatcccacatattctaatactatataacagaaccacccatacacctctctttcttcaaactcattttctccaccttcctttgaccattggtccaaccaacctacacacacacacacacacacactctctctccctctctctctcgcactgcttttcattttctttccggcaaacgaagctctgtggatagtctcgggctgatcgaccagaacgaaacgacattgacagttcttgaagacgaaaaagagagaaaacaaaaaaaggttctttagatctctcatcttaaatgtctagttgacacttcataagctctgctcatatcttttctgtaattaaaggcaatgaaccaccactcactttaaaagctcggttctttgagtcactctgctctgccttttatcctatcccattggaaacgaggctgagctacaatggcggagaccacggaggcaaagacattgcccgaggcagataagaagaaggagcaaagccttcccttttaccagctcttctctttcgctgacaagtatgattggcttctcatgatctccgggagcataggagcaatcattcatggctcatccatgcctgtcttcttcctcttgttcggtgaaatggttaatgggtttggcaaaaaccaaatggatttgaagaaaatgaccgcagaagtagcaaagtatgctctgtacttcgtttaccttggtctcatagtatgcttctcatcctatgcagagattgcatgctggatgtacactggggaaaggcaagtgagcacactgaggaagaagtatttggaggcagtgctgaaacaagacgtgggtttctttgatacagatgcaagaactggagacatagtcttcagtgtctcaacggacacccttttggtccaagatgccattagcgagaaggtgggcaatttcatacactatctttcaacatttctggcggggctggtggttggttttgtatcagcatggaggctggcgctgctgagtgtggctgtgattccagggattgcttttgccgggggcttatatgcctatacactcaccggcctcacctccaagagccgcgagtcatatgcaaatgcagggattatggctgagcaggccattgcacaagttaggacagtttattcatatgttggtgaaagcaaggccctcaattcctattcggatgccatacagaacaccctgcagcttggttacaaggctggaatggccaaaggtctgggcctagggtgtacctatggcatagcttgcatgtcatgggcacttgttttctggtatgccggtgtgtttatccgaaatgggcagactgatggtgggaaagcattcacagccattttttcagccattgttggtggcatgagcttgggtcagtcattttcaaatcttggggcctttagcaaaggtaaatcagctggatacaaattgatggagattattaagcaaaagcccaccataattcaagatcccttggatggaaagtgcttgtctgatgttaatggcaatatagaattcaaggaagtaacctttagctacccttcaagaccagacgttatcatctttcggaatttctcaatcttcttcccagctggaaagactgttgctgttgttggtggtagtggttctgggaaaagcactgttgtctctctgatagaaaggttctatgatcctaaccaggggcaggtgttgattgatagtgtggacataagaacactgcaactgaaatggttacgtgatcagattggccttgttaaccaggagcctgcactttttgcaactactatacttgagaacattctctatggaaagcctgatgcaacaatggctgatgtagaagctgcagcctctgcagccaatgctcatagtttcatcaccttgcttcccaatgggtacaacactcaggtaggagagcgaggagttcaactatctggtgggcaaaagcagaggattgcaattgccagagctatgttgaaaaacccaaagatcctccttctggatgaggcaaccagcgcacttgacgcaagctcagagagcattgttcaagaagctctagaccgtctcatggttggaagaacaactgtagttgtggcacatcgcctttccaccataagaaatgttgatagcattgcagtcatacaacaagggcaagttgttgagacaggaacacatgaagaactgattgccaaagcaggtgcctatgcctcattaattcggtttcaagaaatggtcggtaacagagacttcaggaatccatctacacgttgttcacgttcgtcacggctgagccactcattgtcaacaaagtctttgagccttcggtctggcagcttaaggaacctaagctaccagtacagtaccggtgctgatgggcggatagagatgatttcaaatgctgaaacagacaggaaaactcgagctcctgatggctatttcttccggcttctcaagttaaacgctcctgaatggccctattcaattatgggagctataggatcagtactgtccgggtttattggtccaacatttgctattgtaatgagcaatatgattgaggttttctactatagaaatcctgcctctatggaaaggaagacaaaggagtatgttttcatttacattggagctggcctctatgctgtggctgcatatttgatacaacattacttcttcagtatcatgggagagaacctcactaccagagtgagaaggatgatgcttgcagcaatcttgagaaatgaagttggatggtttgatgaagaggagcacaactctagccttctagcagcccgattggccacagatgcttctgatgtgaagtcagcaattgctgagaggatatctgtaatattgcagaacatgacttcactcctcacttcattcatagttgctttcatagtggaatggagggtctctctgctcattttagcaacctttcctcttctagtgctagccaactttgctcagcaactttctttgaaagggtttgctggagacactgccaaggctcatgcaaagacaagcatgattgcaggggagggagtgagcaatatcagaacagttgctgccttcaatgcccaaaacaagattctctctctcttctgccacgagctccgtatccctcagcttggaagccttcgccggagccaaactgccggccttctatttggcctctctcagcttgcattgtatgcctctgaggctctcattttatggtatggtgcccaccttgtcagcaaaggtgtctcaaccttctccaaagtaatcaaggtttttgtggtcctggttgtaacagctaattcagttgctgaaactgttagccttgcccctgagattattaggggtggtgaagctgttggttcagtcttttcaatccttgatcgtcaaacgaggatcgacccggatgatcccgaggcggagattgttgaaacaattcgcggtgaaattgaacttagacatgttgattttgcctatccatcacgacctgatatcatggtctttaaagattttaatctgagaatccgcactggccaaagccaagcacttgttggagctagtggttcaggaaagagttctgtgattgcattgattgagaggttttatgatcccatagttggtaaagtaatgattgatggcaaagacattcgacgtctgaacttgaagtctctccggctaaaaattggtttggtacaacaagagccagccttgtttgcagccagcattttcgaaaacattgcctatggcaaagaaggggcaactgaagcagaagtaattgaagcagctcgtactgccaatgtgcatggttttgttagtggattgcctgatggctacaaaaccccggttggggagagaggggttcagctctcagggggacagaaacaaagaattgcaatagcaagggctgtgctcaaggacccaacaatacttttgcttgatgaggccacaagtgcacttgatgctgaatcagaatgtgtactacaagaagcactcgagaggcttatgaggggccgcaccaccgtgctggttgcccaccgtttatcgacgatcagaggggtggacagcattggtgtggtgcaagatgggcgcattgtggaacacggtagccactcggaactggtgagccgccctgatggggcttattctagactgctgcagctacagcatcatcatatatgagaggagtttttttggtcaaaagcagcggcatgcatggccttgttgggttgttaaattatgtttgtcccgttaatcttttccatccaccattgttcttttagttgtagatatggcatatcaatcttctgaacaatttctctgatctctaatggagtagcaagtattatattatcaatatctttcctgcatgttatcaatgtcggttgttgggatttagctttcctttctcttagcactcttctcttagctttatgatatcacacccaaaagcaaccctccaaaagaaaatcattagatccctttgggagaaac

SEQ ID NO: 3077 - DNA, 4300 bp, Solanum phureja
gtctcactctcacttgcacacacttttacgtttatttttctctcattcctttgactactggtcttattacttcccccacctttctctcttctctttctccattttctcttaagctcaatcaaaaaaatacactgttttcttcaacagatctctctgatcccatcattcaatgatgtttcttgtttctttcaagaaatgaactttcttgaccccaattaatattcttgaactgggttgtcaacaaaatttgttttttctttttgtttcttgggggttcttgaagttcaatggcggagactactgaagggaaatcaatgccagaggcagagaaaaagaaagaacaaagtcttcctttttatcagcttttctcttttgctgataagtatgattatcttcttatgacttgtggaagtattggagctattttacatggctcttctatgcctgttttctttctactttttggtgaaatggtaaatggtttcggaaaaaatcaaatggatttacacaaaatgacccatgaagtatcaaagtatgctctgtatttcgtgtaccttgggttgatagtttgtgcatcatcctatgcagagattggttgttggatgtatactggagaaaggcaagtaagtacactaaggaagaaatatttagaggcagtgttgaaacaggacgttgggttttttgatacagatgcaagaacaggggatattgttttcagtgtttcaacggatactctactggtccaagacgccataagtgagaaggtgggcaatttcattcactacctttcgacgttcttggcgggtttggtggttggtttcgtgtcagcgtggcggttagctctcctaagtgtggcggttattcctggaattgcttttgctgggggtctttatgcttatactctcaccggtctcacctcaaaaagcagagaatcctatgccaatgctggaattattgctgagcaggcaattgcacaagtcagaacagtttactcatatgtgggcgagactaaagcccttaattcatattccgatgcaattcagaacacattgaagctcggatacaaggctggcatggctaaaggattgggtttgggatgtacctacggaatagcatgcatgtcatgggcccttgttttttggtatgctggggttttcattaggaatggacagagtgatggtggaaaggcatttactgctattttctcagccattgttggtggcatgagtttaggtcagtcattttccaatcttggggcattcagcaaaggaaaagcagctggatacaagttaatggaaattattaggcagaaaccgaccattgtgcaagatactctagatgggaaatgcctgtctgaggtcagcgggaacattgaattcaaaaatgtgaccttcagctatccgtcaagacctgatgtgattatcttcagagatttcaacattttcttccctgctggaaaaacagttgccgtggttggtggcagtggctcaggaaaaagcacagtcgtctcattgatagaaagattttatgatcctaatgatggtcaagttttgcttgacaatgtggacataaagacgttacaacttagatggttgcgtgatcagattggccttgtaaatcaagagcctgcgttatttgctactaccatactcgagaacattctgtacggaaagcctgatgcaaccatggctgaagttgaggcggctacctgcgcttccaatgcacatagctttattaccttgcttcctaacggatacaacacccaggtgggagagcgtggtgtacaactctctggtggacagaaacagagaattgcaattgcaagagctatgttaaagaacccgaagatcctcctgcttgatgaggccaccagtgctcttgatgctggttccgaaagcattgtccaggaagctctagaccgtctcatggttggccgtactactgtggttgtagctcaccgtctctccacaattagaaatgtcgattcaattgcagttatacagcaagggcaggtggttgagactggaacacatgaagaactgatttccaaagctggggcttatgcttctttaatcagattccaggaaatggttgggaacagagacttttcaaatccatctactcgccgtactcgttcaactcggttaagtcattcattatcaacaaagtctctaagccttcgctctggaagtttaaggaatttgagctattcatacagtaccggtgcagatgggcgtatagaaatgatctctaatgctgaaacagataggaaaaatcctgctccacagaattatttctgccggcttctcaaactgaatgcgcctgagtggccttattcaatcatgggggccgtagggtctgtcctctccggtttcattggtccaacttttgctattgtgatgagcaacatgattgaggtattctactatacaaatcccgcaaccatggaaagaaagacgaaggaatatgtcttcatctacattggagcgggtctttatgccgttgtagcatatttaatacagcattacttcttcagtattatgggagaaaacctcactaccagggttcggaggatgatgttgtcagcaattttaaggaatgaagtcggttggttcgacgaggaggagaacaattcaagtctactagcagctcgtttagctacagatgctgcagatgttaaatctgctatagcggagaggatctccgttatactgcagaatatgacatctcttctcacttcattcatagttgcatttatagtcgaatggcgggtctcactgctcatcctcgccacatttccgcttctcgtcttggccaatttcgctcagcaactctcactgaaaggatttgctggagacacggccaaggcgcatgcgaagactagcatgattgctggagaaggagtaagcaatattagaactgtagcagccttcaatgcccaagagaagattatctctttgttctcccaagagcttcgagttccacaaatgcagagtcttcgacgaagccaaatgtcaggactcttatttggtatatcacagcttgctctttatggttctgaagctttgattctttggtatggtgcacaccttgttaacaacggggtctcgactttctctaaggtgattaaggtctttgtagtccttgtgatcacagctaattcagtcgctgaaaccgtcagcctagcacccgagattattaggggtggtgaagctgttggttcagtattttctattcttgatcgctctaccagggtcgatcctgatgaccctgaagccgatccagttgaatcaattagaggggatattgaactccgtcatgttgattttgcatacccttcacgaccggatgtctctgtgttcaaggacctcaatctaaggattcgcgctggccaaagccaagctcttgttggggcaagtgggtcgggaaagagctccgttatagccttaatcgaaaggttctatgacccaaccggtggaaaagttatgatcgatgggaaagacataaggagattaaacttgaagtctctaaggcttaaaattggtttggtgcaacaagagccagctctgtttgcagctagcatttttgaaaatattgcctatggtaaagagggtgcaacagaagccgaagtcattgaagcagctcgcgcagcaaatgtacacactttcgtaagtggtttgcctgaaggttacaaaacccctgttggtgagagaggtgttcaactctctggaggacaaaaacaaaggattgcaatagcaagggccgttcttaaagatccatcgattctactacttgatgaggctacaagtgcactggatgctgaatccgaatgtgtgttacaagaagcactcgagaggttgatgagaggtcgaaccaccgttttggtggctcaccgattatcaacaattcgaaatgtggatactattggagttgtgcaagacggacgaatcgttgaacaaggaagccattctgagttaatcagcaggccagaaggtgcatattctagactactgcaactacaacaccaccgcatatgatgaaaattacaagaatctttttttactttttaacttttaatttttatggaagtaagcaacatggcctagtgtttttggcctttgggatggttgggggggagtaacaatgtttgggtcctagtaactgttgctttcatatgctttattgattatgatgctgatagttgtagatatgggattgattgtcacgatcaaatattatatcattgggaaagtttacaactctattccctatggagaagaagaagtatatgttaaaatat

SEQ ID NO: 3078 - DNA, 4131 bp, Allium cepa
ctacagtcaccgcgcgcgtgaccagactccacttcttctccctctccattatatttacacaggaactcatctctttccactctatttactttcagccgatcactaacaatggcggacccactcgaccagaaacccgagcccgagaagaaaactcaacaaacccaaaccgtcccattctttactctcttctcattcgccgatcgcaaggattacctcctaatgctcgctggaaccattggagccgttgttcatggctctgccatgcccgttttcttcctcctttttggccagttgatgaacggcttcggaaaaaaccagactaatctcgccgtcatgactgatgaagtgtctaaatatgcactgtattttgtctacttggggctggtggtttgtgcttcgtcctacgctgagattgcatgctggatgtatacaggagagaggcaggtgagcgctcttaggaggaggtatttggaatcagtgctaaagcaagatgttggcttttttgatacagatgcacgtacgggtgatattgtatttagtgtatcaaccgatactcttcttgttcaagatgctattagcgagaaggttggtaattttattcattacttgtcgacatttttggctgggttagtagtaggattcatatccgcatggaaattggcacttcttagtgtagcggttattccaggaattgcatttgctggtgggctttacgcctatactttgactgggctcacttctaaaagcagggagtcttatgcaaatgctggcattgtagctgaacaggcgatagcccaagttcgtacagtgtattcatatgttggagagaccaaagcactcaactcctactctgaagcaattcaaaatacattaaaactcggatacaaggcaggcatggccaagggccttggtattggatgtacttatggtattgcatgcatgtcgtgggcattagtattttggtatgctggcgttttcatacgaaatggtcaaacggatggtggaaaagcttttactgctattttttctgcaattgttggtggcatgagtctagggcaatcattttcgaatcttggagcttttagcaaaggcaaggcagctggatttaaattgatggaaataatacgccagaaaccttctatcgctcaagacgctaatgatggaaaatgtttggatgaagtgcatgggaacatagaacttaaagatgttacattcagctacccatcgagacctgatgttcttatattcaaagatttctctcttttcttcccagctggaaagactgttgcaattgtaggaggcagcggatctggaaagagtactgtagtctcgttgatagaaagattttacgatccaaatagtggtcaagttttgctggataatgtggatattaggacactccaattgagatggctaagggatcaaattgggttggtgaatcaagagccagcactttttgcaactagcatacttgaaaacatactctatggaaaacctgatgccacaattgctgaagttgaagctgcggctacttctgcaaatgctcatagtttcattgcacttcttcccaatgggtacgacactcaggctggagaaagaggggttcagctatctggtggtcaaaagcagagaattgcaattgcacgtgccatgcttaaaaacccaaaaattctacttcttgatgaagccaccagtgctttagatgcaggttcagagagtatagttcaagaagccttggaccgactcatgataggaagaactactgtagttgttgcgcacagacttaccactataagaaatgtggataccatagccgtgattcaacaaggtcaagtcgttgaaacaggaactcatgatgaacttattgcaaaaggtagctccggtgcatatgcaactcttataagatttcaagaaatggcaagaaccagagattttaatattggttcgacccgaagatctaggtcatcccgccttagctgttctctatcaactaaatctctaagtcttaggtcgggaagcttacgtaatttaagctatcagtatagtacaggagcagatggtcgattagagatggtgtctaatgcagataatgatcgaaaatatcctgcccctgatggttacttctttagacttttgaaactgaatgcaccagaatggccttatgctgtattaggtgctgttgggtcaattctttctggatttattggtcccacgtttgcaattgtgatgagcaatatgatcgaggtgttttattacaaggatcccaatgcaatggagagcaaaacaagggagtttgtatttatttatatcggtgctggcctttatgctgtcgtagcatatcttgtacagcattattttttcagtatcatgggcgaaaaccttacaacccgagttagaagaatgatgctagctgcgattttaaggaatgaagtgggctggtttgacgaagaggagaacaattcaagtctcgtggctgctcggttatccacggatgcagctgatgtgaagtctgcaatcgctgaaagaatatctgttatactgcagaacatgacttcattgctcacatctttcatagttggattcatcgtggagtggagggttgcattactcatattgggcactttccctcttttagttctagccaattttgcacagcaactgtcactgaagggtttcgccggagacaccgcaaaagcgcatgcgaaaaccagcatgatagcaggagaaggcgtaagcaacattcgaaccgtggcagccttcaacgcacaggacaaaataatctccctcttttgcaacgagctccgcatccctcgaaagcgcagcctgcgcaaaagtcaaacctcaggtctcctcttcggggtctcccagctctccctatacgcatccgaagccctgatcctatggtacggcgcccacctcgtccacagcggcctgtccaccttctccaaagtgatcaaagtctttgtggtcctggtcatcaccgccaactccgtggccgaaactgtgagcctggcccccgagatcgtgcgcggcggcgagtccatccgctccgtcttctccatcctcaaccgctccactcggatcgagcccgacgacccagaatctgaacccgtggaatctgtacgtggcgagatcgagctccgccacgtcgatttctcgtacccatcccgccccgacgtgcccatcttcaaggacttcaacctgaggatccgagccgggcacagccaggccctggtcggggcgagcgggtcgggcaagagctccatcatcgccctcatcgagcggttctacgacccgtcctccgggaaagtaatgatcgacagcaaagacatccggcggctgaacctgaagtccctgcgtaggaagattgggctcgtgcagcaggagcctgcgctgtttgccaccacaatattcgagaacattgcgtacgggaaggaggggccgaaggaggaggaggtggtggaggcggcgaaggctgcgaacgtgcacgcgttcgtttcagggttgccagaggggtacaagacgatggtaggggagagaggggtgcagctgtcgggagggcagaagcagaggatagcgatagcgagggcggttttgaaggatccggcggtgctgttgctggatgaggcgacaagcgcactggatgcggagtcggagtgcgtgttgcaggaggcgctggagaggttgatgaggggacgaacaacagtgatcgtggcgcacaggctgtctacgataaggaatgtggataatatagcagtggtgaaggatgggaggatcgtggagcaggggtgccattccgatctagttggtagggttgatggtgcttattatggacttctgcagttgcaaggccaccgtggttgagtagaaaaaggatgatgtgggggtttgagggagagagatgatcgttttgacattgggaccgggtttgtatagagtatgtggcgttggggtcgttgtaatttgtactgctgatcttgtttttattcttgagttttaatttaatcctaccgtctcatgtggttagagcgacgatccagtgtattattattaggatgaagtgttgtaatgagatgttctgaattctaattaattgtaatcttatttttcaacgaagacggttaagttttt

SEQ ID NO: 3079 - DNA, 3920 bp, Prunus persica
atggcggagaccacggaggcaaagacattgcccgaggcagataagaagaaggagcaaagccttcccttttaccagctcttctctttcgctgacaagtatgattggcttctcatgatctccgggagcataggagcaatcattcatggctcatccatgcctgtcttcttcctcttgttcggtgaaatggttaatgggtttggcaaaaaccaaatggatttgaagaaaatgaccgcagaagtagcaaagtatgctctgtacttcgtttaccttggtctcatagtatgcttctcatcctacgcagagattgcatgctggatgtacactggggaaaggcaagtgagcacactgaggaagaagtatttggaggcagtgctgaaacaagacgtgggtttctttgatacagatgcaagaactggagacatagtcttcagtgtctcaacggacacccttttggtccaagatgccattagcgagaaggtgggcaatttcatacactatctttcaacatttctggcggggctggtggttggttttgtatcagcatggaggctggcgctgctgagtgtggctgtgattccagggattgcttttgccgggggcttatatgcctatacactcaccggcctcacctccaagagccgcgagtcatatgcaaatgcagggattatggctgagcaggccattgcacaagttaggacagtttattcatatgttggtgaaagcaaggccctcaattcctattcggatgccatacagaacaccctgcagcttggttacaaggctggaatggccaaaggtctgggcctagggtgtacctatggcatagcttgcatgtcatgggcacttgttttctggtatgccggcgtgtttatccgaaatgggcagactgatggtgggaaagcattcacagccattttttcagccattgttggtggcatgagcttgggtcagtcattttcaaatcttggggcctttagcaaaggtaaatcagctggatacaaattgatggagattattaagcaaaagcccaccataattcaagaccccttggatggaaagtgcctgtctgatgttaatggcaatatagaattcaaggaagtaacctttagctacccttcaagaccagatgttatcatctttcggaatttctcaatcttcttcccagctggaaagactgttgctgttgttggtggtagtggttctgggaaaagcactgttgtctctctgatagaaaggttctatgatcctaaccaggggcaggtgttgattgatagtgtggacataagaacactacaactgaaatggttacgtgatcagattggccttgttaaccaggagcctgcactttttgcaactactatacttgagaacattctctatggaaagcctgatgcaacaatggctgatgtagaagctgcagcctctgcagccaatgctcatagtttcatcaccttgcttcccaatgggtacaacactcaggtaggagagcgaggagttcaactatctggtgggcaaaagcagaggattgcaattgccagagctatgttgaaaaacccaaagatcctccttctggatgaggcaaccagcgcacttgacgcaagctcagagagcattgttcaagaagctctagaccgtctcatggttggaagaacaactgtagttgtggcacatcgcctttccaccataagaaatgttgatagcattgcagtcatacaacaagggcaagttgttgagacaggaacacatgaagaactgattgccaaagcaggcgcctatgcctcattaattcggtttcaagaaatggtcggtaacagagacttcaggaatccatctacacgttgttcacgttcgtcacggctgagccactcattgtcaacaaagtctttgagccttcggtctggcagcttaaggaacctaagctaccagtacagtaccggtgctgatgggcggatagagatgatttcaaatgctgaaacagacaggaaaactcgagctcctgatggctatttcttccggcttctcaagttaaacgctcctgaatggccctattcaattatgggagctataggatcagtactgtccgggtttattggtccaacatttgctattgtaatgagcaatatgattgaggttttctactatagcaatcctgcctccatggaaaggaagacaaaggagtatgttttcatttacattggagctggcctctatgctgtggctgcatatttgatacaacattacttcttcagtatcatgggagagaacctcactaccagagtgagaaggatgatgcttgcagcaatcttgagaaatgaagttggatggtttgatgaagaggagcacaactctagccttctagcagcccgattggccacagatgcttctgatgtgaagtcagcaattgctgagaggatatctgtaatattgcagaacatgacttcactcctcacttcattcatagttgctttcatagtggaatggagggtctctctgctcattttagcaacctttcctcttctagtgctagccaactttgctcagcaactttctttgaaagggtttgctggagacactgccaaggctcatgcaaagacaagcatgattgcaggggagggagtgagcaacatccgaacagttgctgccttcaatgcccaaaacaagatcctctctctcttctgccacgagctccgtatccctcagcttggaagccttcgccggagccaaactgccggccttctatttggcctctctcagcttgcactgtatgcctctgaggctctcattttatggtatggtgcccaccttgtcagcaaaggtgtctcaaccttctccaaagttatcaaggtttttgtggtcctggttgtaacagctaattcagttgctgaaactgttagccttgcccctgagattattaggggtggtgaagctgttggttcagtcttttcaatccttgatagtcaaaccaggatcgacccggatgatcccgaggcggagattgttgaaacaattcgcggtgaaattgaacttagacatgttgattttgcctatccatcacgacctgatatcatggtctttaaagattttaatctgagaatccgcactggccaaagccaagcacttgttggagctagtggttcaggaaagagttctgtgattgcattgattgagaggttttatgatcccatagttgggaaagtaatgattgatggcaaagacattcgacgtttgaacttgaagtctctccggctaaaaattggtttggtacaacaagagccagccttgtttgcagccagcattttcgaaaacattgcctatggcaaagaaggggcaactgaagcagaagtaatcgaagcagctcgtactgccaatgtgcatggttttgttagtggattgcctgatggctacaaaaccccggttggggagagaggggttcagctctcagggggacagaaacaaagaattgcaatagcaagggctgtgctcaaggacccaacaatacttttgcttgatgaggccacaagtgcacttgatgctgaatcagaatgtgtactacaagaagcactcgagaggcttatgaggggccgcaccaccgtgctggttgcccaccgtttatcgacgatcagaggggtggacagcattggtgtggtgcaagatgggcgcattgtggaacatggtagccactcggaactggtgagccgccctgatggggcttattctagactgctgcagctacagcatcatcatatatgagagaagagttttttttgtcaaaagcagcggcatgcatggctttgttgggttgttaaattatatttgtcccgttaatcttatccatccaccattgttcttttagttgtagatatggcatatcaatcttctgaacaatttctctaatctctaatggagtagcaagtattata

SEQ ID NO: 3080 - DNA, 4374 bp, Solanum lycopersicum
acgatgtctcactctcacttgcacacacttttacgtttatttttctctcattcctttgactactggtcttattatttcccccacctgtctctcttctctttctccattttctcttaagctcaatcaacaaagtactctgttttcttcaaacagatctctctgacccatcattcaatggtgtttcttttttcttccaagaaatgaactttcttgaccccaattaatattcttgaactggattgtcaacaaaatttgtcttctctttttatttattgaagttcaatggcggagactactgaagggaaatcaatgccagaggctgagaaaaagaaagaacagagtcttcctttttatcagcttttctcttttgctgataaatatgattatcttcttatgacttgtggaagtattggagctattttacatggctcttctatgcctgttttctttctcctttttggtgaaatggtaaatggttttggaaaaaatcaaatggatttacacaaaatgacccatgaagtatcaaagtatgctctgtatttcgtgtaccttgggttgatagtttgtgcatcatcctatgcagagattggttgttggatgtatactggagaaaggcaagtgagtgcactaagaaagaaatatttagaggcagtgttgaaacaggacgttgggttttttgatacagatgcaagaacaggggatattgttttcagtgtttcaacggatactctactggtccaagatgccataagtgagaaggtgggcaatttcattcactacctttcgactttcttggcgggtttggtggttggttttgtgtcagcgtggcggttagctctcctaagtgtggcggttattcctggaattgcttttgctgggggtctttatgcgtatactctcaccggtctcacgtcaaaaagcagagaatcctatgcaaatgctggaattattgctgagcaggcaattgcacaagtcagaacagtttactcatatgtgggcgagaccaaagcccttaattcatattccgatgcaattcagaacacattgaagctcggatacaaggctggcatggctaaaggtttgggtttgggatgtacctatggaatagcatgcatgtcatgggcacttgtattttggtatgctggggttttcattcggaatggacagagtgatggtggaaaagcatttactgctattttctcagccattgttggtggcatgagtttaggtcagtcattttccaatctcggggcattcagcaaaggaaaagcagctggatacaagttaatggaaattattaagcagaaaccgaccattgtacaagatactctagatgggaaatgcctgtctgaggtcagcgggaacattgaattcaaaaatgtgaccttcagctatccgtcaagacctgatgtgattatcttcagagatttctgcattttcttccctgctggaaagacagttgccgtagttggtggcagtggctcaggaaaaagcacagtcgtctcattgatagaaagattttatgatcctaatgatggtcaagttttgctcgacaatgtggacataaagacgttacaacttagatggttgcgcgatcagattggccttgttaatcaagagcctgcgttatttgctactaccatactcgagaacattctgtacggaaagcctgatgcaaccatggctgaagttgaggcggctacctgcgcttccaatgcacataactttattaccttgcttcctaacggatacaacacccaggtgggagagcgtggtgtacaactctctggtggacagaagcagagaattgcaattgcaagagctatgttaaagaacccaaagatcctcctgcttgacgaggccaccagtgctcttgatgctggttccgagagcattgtccaggaagctctagaccgtctcatggttgggcgtactactgtggttgtagctcaccgtctctccacaatcagaaatgttgattcaattgcagttatacagcaagggcaggtggttgagactggaacacatgaagaactgatttccaaagctggggcttatgcttctttaatcagattccaggaaatggttgggaacagagacttttcaaatccatctactcggcgtacacgttccactcggttaagtcattcattatcaacaaagtctctaagccttcgctctggaagtttaaggaatttgagctattcatacagcaccggtgcagatgggcgtatagaaatgatttctaatgctgaaacagataggaaaaatcctgctccacagaattatttctgccggcttctcaaactgaatgctcctgagtggccttattcaatcatgggagccgtagggtctgtcctctccggtttcattggtccaacttttgctattgtgatgagcaacatgattgaggtattctactatacaaatcccgcaaccatggaaaggaagacaaaggaatatgtcttcatctacattggagccggtctttatgccgttgtagcatatttaatacagcattacttcttcagtattatgggagaaaacctcactaccagggttcggaggatgatgttggcagcaattttaaggaatgaagttggttggttcgatgaggaggagaacaattcaagtctactagcagctcgtttagctacagatgcggcagatgttaaatctgctatagcggagaggatctccgttatactgcagaatatgacatctcttctcacttcattcatagttgcatttatagtcgaatggcgtgtctcactgctcatccttgccacatttccgcttctcgtcttggccaatttcgcccagcaactctcactgaaaggatttgccggagacacggccaaggcgcatgcaaagactagcatgattgctggagaaggagtaagcaatattagaactgtagcagccttcaatgcccaagagaagattatctctttgttctcccaagagcttagagttccacaaatgcagagtcttcgacgaagccaaatgtcaggactcttatttggtatatcacagcttgctctttatggttctgaagctctgattctttggtacggtgcacaccttgttaacaacggggtctcgactttctctaaggtaattaaggtctttgtagtccttgtgatcacagctaattcagttgctgaaacggtcagcctagcacccgagattattaggggtggtgaagctgttggttctgtattttccattcttgatcgctctaccagggtcgatcctgatgaccctgaaggcgatccagttgaatcaattagaggggatattgaactccgtcatgttgattttgcatacccttcacgaccggatgtctctgtgttcaaggacctcaatctaaggattcgcgctggccaaagccaagctcttgttggggcaagtggatcgggaaagagctctgttatagccttaatcgaaaggttctatgatccaacgggtggaaaagttatgattgatgggaaagacataaggagattaaacttgaagtctctaaggcttaagattggtttggtgcaacaagagccagctctttttgcagctagcatttttgaaaatatcgcgtatggtaaagagggtgcaacagaagccgaagtcattgaagcagctcgggcagcaaatgtacacacattcgtaagtggtttgcctgaaggttacaaaacccctgttggtgagagaggtgttcaactctcaggaggacaaaaacaaaggattgcaattgcaagggccgttcttaaagatccatcgattctactacttgatgaggctacaagtgcactggatgctgaatccgaatgtgtgttacaagaagcacttgaaaggttgatgagaggtcgaaccaccgttttggtggctcaccgattatcaacaattcgaaatgtggatactattggagttgtgcaagacggaagaatcgttgaacaaggaagccattctgagttaatcagcaggccagaaggtgcatattctagactattgcaactacaacaccaccgcatatgatgaaaattacaagaatctcttattccttttctttttttaacttttcaacttttaatttttatggaagcaatcaacatggcctagtgtttttggcctctgggatggtttgtggggggagtaacaatgtttgggtcctagtgactgttgctttcatatgctttattgattatgatgatgtgatgatgctgatagttgtagatatgggattgtcacgatcaaatattatatcattgggaaagtttacaactctattccctatggagaagaagtatatgttaaaatatggagcattcaacttttctgtatatgctttggattatttcattatacaccttggtttcc

SEQ ID NO: 3081 - DNA, 3945 bp, Fragaria vesca
ttgaaccaactgcaatggctgagagcacagagccaaccaagacactgccggaggcagagaagaagaaagagcagagcctaccgttctaccagctcttctcttttgctgacaagtatgattgccttctcatggtctccggcagcataggagccatcattcacggctcttccatgcccgtgttcttcttattgttcggtgaaatggttaatgggttcggaaaaaaccagatggacttgcacaaaatgacggccgaagttgccaagtatgctctgtatttcgtctacctcggcctcatcgtgtgcgtgtcatcctacgccgagattgcatgctggatgtacaccggagaaagacaagtgagcactctgaggaagaagtatctggaagcggtgctgaaacaagacgtggggtttttcgacacagatgcaagaacaggtgacatagtcttcagcgtctcgacggacacccttctggtccaagatgccattagtgagaaggtggggaacttcatacactatctttcaacgtttctggcgggactggtggttgggtttgtgtcagcatggaggctggctctgctgagtgtggcagtcatcccggggattgcttttgccggcgggttgtatgcctatacgcttacagggctcacatccaagagccgagaatcgtatgcaaatgctggcattatggctgagcaagccatcgcacaagttcgaacagttaaatcatatgtgggtgaaagcaaggccttgaattcctattcagatgccatacagaacaccttgcagcttggttacaaggctggaatggccaaaggtctggggttagggtgtacctatggcatagcttgtatgtcgtgggctcttgttttctggtatgctggtgtgtttattcgaaatgggcagactgatggagggaaagcattcacagccattttttcggctattgttggtggcatgagcttgggtcagtcattttccaatctcggggcctttagcaaagggaaatcagctggatacaagttgatggagatcatcaagcaaaagcccaccataattcaggaccaattggatggaaagtgcttgtccgaggttaatggaaacatagaactcaaggaggtgacattcagctatccgtcgaggccagatgttatcattttccgtaatttctcaatcttcttcccagctggaaagactattgccgtagttggcggcagtggttctgggaaaagcactgttgtctctctgattgaaaggttttatgatcctaaccatgggcaggttttgctggatggtgtggacataagaacactgcaactgaaatggttacgtgatcagatgggcctggtaaaccaggagcctgcactttttgctaccaccattcttgagaacatactctatggaaaggctgatgcaacaatggatgaagtagaagcagcagcctctgcagctaatgctcatagtttcatcacgttgcttcctaatgggtataacactcaggtaggagagcgaggagtccaactctcaggaggccaaaaacagagaatcgcaattgctagagctatgttgaaagacccaaagatcctactcctagatgaagcaaccagtgcccttgatgcaagctctgaaagcattgttcaagaagctctagaccgtctcatggtagggaggacaactgtagttgtggcacatcgcctttccaccataagaaatgttgacagcattgcagttatacaacaagggcaagttgtagagacaggaactcatgaagaactgattgccaaagcaggtgcatattcttcgttaattcggttccaagaaatggttggaaacagagacttcaggaatccatctactcgttgttcacgatcatcacggctaagccactcattgtcgaccaagtctttgagcctccggtctggcagcttaaggaacctgagctacagttacagtactggtgctgatgggaggatagagatgatttcaaatgctgagacagacaggaaaactcgagctccaaggggatacttctttcggcttctcaagctaaatgcacctgaatggccctattcaatcatgggtgccataggatcagtactatccgggtttatcggtccaacctttgccattgttatgagcaacatgattgaggtgttctactacagaaatcctgcttccatggagagaaagacaaaggagtatgtcttcgtttacataggagctgggctatatgctgtcgttgcatacttgatacaacattacttcttcagcatcatgggagagaacctcactactagagtaaggaggatgatgcttgcagcgattttaaggaacgaagttggatggtatgatgaagaggagaacaactcaagtcttctagcttccaaactggccacagatgctgctgatgtgaaatccgcaattgctgagaggatttctgtaattctgcagaacatgacttcactgctcacttcattcatagttgctttcattgtggaatggagggtttccctgcttatcctagcaactttcccgcttttagttcttgccaactttgctcagcaactttcgcttaaaggctttgctggagacactgccaaggctcatgcaaagacgagcatgattgcaggggaaggagtgagcaacattcgaacagttgcagccttcaatgcacaagataagatcctatctctcttctgccatgagctacgcatcccacaactaggaagccttcgtcggagccaaactgctggtctcctatttggcctctcacagcttgccttatatgcctctgaagctctcattctgtggtatggcgcccaccttgtgagcaaaggtgtctcgaccttctccaaagtcattaaggttttcgtggtcctggttgtaacagccaattcagtagcagaaacagttagtcttgcccctgagattattaggggtggtgaagctgttggctctgtgttttcaattcttgatcgccaaaccaggattgaccctgatgaccctgaggccgaggtggttgaaaccattcgtggggagattgaacttaggcatgttgattttgcatacccttcacgaccggatattatgatctttaaagattttaatctcagaatccgtactggccaaagccaagcacttgttggagctagtggttcaggaaagagtactgtgattgcgttgatcgagaggttctatgatccaatagttgggaaggtaatgattgatggcaaagacattcgacgtttgaacttgaagtctcttaggctgaaaattggtttggtgcaacaagaacctgctctctttgcagcaagcatttttgataacattgcctatggaaaagaaggtgcaaccgaagcagaagtgatcgaagctgcacgtacagccaatgtgcatggattcgttagtggactgcctgatgggtacaaaactccagttggggagagaggggttcagctctcaggaggacagaaacaaagaattgccatagcaagagctgtgctcaaggacccaacaattcttctgctagatgaggccacaagtgcattggatgcagaatcagaatgtgtgctacaagaagcactggagaggctcatgagaggccgaaccacagtgttggttgcccaccgtttatcaacaattagaggggtggacagcatcggtgtggtgcaagatggccgcattgtggaacatggaagccactcagaacttgtgagccgcccagatggggcgtattcgagactgttgcagctgcaaaatcatcgtatatgagaagatattcagttttggtcaatcaaatgcagcatgcatggccttgttgggtggtgttgattatgtatgtcccattaactttatgtatcctcttatttttcatctagttgtagatatggctcgtgttcatcagtacaatttctctaatctcaatgaagtagcagtattatattatcag

SEQ ID NO: 3082 - DNA, 5692 bp, Theobroma cacao
aaggtaagtttaacctcgaactttaggacagaaaaatctataccaatttacctgcccaaaaagagttattatttgaaaaaaagaaaaaaaaatgttactctgtttcatcgaaatattaatttttgagccagaaaaactcttttggtttgaccaatggtcttacacatgcattctcttccttgtataactttacaatttctctctctatatatgcactcactcactcaaacactctctttgtgctttgccctttccttttttttttcttctcttctgcttagttctcgaactgataaactcaaaaacgacattgtcagattttcgagaccttaaaaaagaggaagagagagagagagaagaagaaagggcctttagatctctcatttctttcactccccagatcctcctccctgtctctctctctctctctcgctctctctttcttccttatggctgttctcaatcaaaaattttaactcaatttccctgagtcaacccaactcaactcattttagctcttgcttcctttctatcttggttttttttgtttttccattcaaaaagttggtttagctttgattttgagtttacaatggctgaaacaacagaaacaaaggcagtcccggaagcagaaaaaaagaaagaacaaagcttgccattttaccaacttttctcttttgcagacaaatatgattatttcttgatgatctctggtagcttgggagctattatccatggttcctcaatgcctgttttcttcttattatttggtgaaatggttaatggctttggaaaaaaccaatctgatttgtccaaaatgactcatgaagttgccaagtatgcactctattttgtgtatcttggtcttattgtctgcctatcatcttatgcagagattgcatgttggatgtacactggggaaaggcaagtaagtacattgagaaagaagtatttagaagcagtgttgaagcaagatgttggattctttgacactgatgcaagaactggggatattgtctttagtgtttcaactgatactctacttgtccaagatgccatcagtgagaaggttgggaacttcatacattatttgtcaactttcctggctggtttggtggttggttttgtatcagcctggaggttagcactgctaagtgtggcagtgatccctggaattgcttttgctggtggcttatatgcctatactctgaccggcctcacttccaagagccgggaatcctatgcaaatgctggcataattgccgagcaggccattgcacaagttcgtactgtatattcgtatgttggtgagagcaaggcccttaattcctactcagatgcaatacagaacacgctaaaacttggatataaggctggcatggccaagggtttggggctagggtgtacatatggcatagcttgcatgtcttgggcccttgtgttctggtatgctggtgtttttatcaggaatggacagacagacggggggaaggcattcacagcaattttctctgccattgttggtggcatgagtttgggacagtcattttccaatcttggggcatttagtaaaggcaaaacagctggttacaagttgatggagattatcaagcaaaagccctccataatccaagaccattctgatggaaaagtactgcctgaggttaatggcaatatagaattcaaggatgtaactttcagctatccatcaagaccagatgtgatcatctttcgcaatttttcaatcttctttcctgcaggaaagactgttgcagttgttggtggtagtggttcagggaagagtactgttgtctctctgatagagaggttctatgatcctaaccagggacaggtattgttggataatatggatataaaaacactgcaactaaaatggttacgtgatcagattggacttgtgaatcaggaacctgctctctttgcaactaccatcctcgaaaacatactctatggaaaacctgatgcaacaatggatgaagttgaagctgctacttctgctgcaaatgctcacagctttattaccctacttcctaatgggtacaacactcaggtgggagagcgaggagtccaactttctggtggccaaaaacagagaattgcaattgctagagccatgttgaagaatcctaagatcttgctccttgatgaagcaacaagtgctctggatgcaagctctgagagtattgttcaggaagctcttgaccgtctcatggtagggagaacaactgtagttgttgcacatcgcctctccaccataaggaatgttgattcaatagctgttatacagcaaggacaagttgttgagacaggaactcatgaagaattgattgctaaggcaggggcatatgcttcattaatccgattccaagaaatggtgggaaatagagattttgctaacccatcaactcgccgttcacgttcatcacgtctaagtcattcactatcaactaagtccttaagcctccggtcaggcagcttgcggaacttgagctattcttacagtactggtgctgatggccgaatagagatgatctcaaatgccgagacagaccgtaaaaatcctgctccagatggctatttctgccggcttctcaagctaaatgctcctgaatggccctattcaatcatgggagcggttggttctgtgctttctggttttattggaccaacttttgccattgtgatgagcaatatgattgaggtcttctactatacaaatcctacgtctatggaaagaaagacaaaagaatatgttttcatttacattggagctggtctatatgctgtcattgcatatttgattcagcattatttcttcagtattatgggagaaaacctcacaacaagagtgaggaggatgatgcttggagcaattctaaggaatgaagtcggatggttcgatgaggaagagcataattcaagccttcttgcagccagattggcaactgatgctgctgatgtgaaatctgcgatagctgagaggatctcggtgatactgcaaaacatgacttcactcctcacctcattcatcgttgccttcatagtagaatggagggtctcacttctcatccttggtaccttccctcttctagtccttgcaaactttgctcagcaactctctctcaaagggtttgctggtgacaccgccaaggcacatgccaagactagcatgattgctggtgaaggtgtaagcaatatcagaacagttgcagccttcaatgcacaaaacaagatcctctcattattttgctatgagctccgagttccacagaagcgaagccttggccgcagccaaacttctggcctcctttttggcttatctcaactggctctttatgcctctgaagctctcatactttggtatggcgcccaccttgttagcaaaggtgtctccacgttctctaaggtgattaaggtttttgtggtattagtggtcacagcaaattctgtggcagaaactgttagtcttgctcctgagatcattaggggtggtgaagctgtcggttcagtgttctccattttagatcgttcaaccaagattgacccagatgatcctgagggagagccagttgaatcaattcgtggagaaattgaacttaggcatgttgattttgcatatccttcacgacctgatgtcagtgtgtttaaagaccttaaccttcgaatccgtgctggccaaaaccaagcacttgtcggggctagtggctctggcaagagttcagtcattgcattgattgagcggttctatgatcctattgctggaaaggttatgatcgatggaaaagatatacggagattgaacttgaagtctcttaggcttaaaattggattggtgcaacaagagccagccctctttgcagccagcatttttgataacattgcctatggaaaagaaggggcaactgaagcggaagtaattgaagcagcccgtgcagctaatgtgcatggatttgttagtgcattgcctgatgggtacaaaacaccagtaggtgagagaggggttcagctctctggaggtcagaaacaaagaattgcaattgcgagggctgtgcttaaggacccaaccatactattacttgatgaggccactagtgcacttgatgcagaatcagagtgtgtactacaagaagcacttgaaaggctaatgaggggccgcaccacggtgcttgtggctcaccgtctctcgacaataagaaatgttgacagtattggagtggtgcaagatgggcgcattgtagaacaaggcagccacgccgaattgattagccgagccgaaggagcgtattctaggctcttgcaactacaacaccatcacgtataagagttttggttgaagcaacatggccttgttgggtggtaattatgttgggacccattaaccttatgtttctatctttcttttttttttttgaatgatgatagctgtagatattggaatgtggagagtgtatcttgagagccactgccccatttccaatggggtagcaaatgttaaattattgatatctatggtgcacaagccccgtgtctatccagttggtcaggtgattgattggctttacttgccctttttgtaattgaaattttataatactataaagtgcaaaccctagacaccacctttccagcccttgtgaaagcctttttcttgatctagcttttccttgcatgtgtttgctgaagggttcttttctggttgtagataaagggcatttctttttttatggcttccaggcccacatgaagtacaagatggtttagcactaacaagataactactcatctctttctaacaaaatgcacagacagacatattcattcctagcagatggtaacgatattattgtaaaagcaaagatgttagttgtaaagcttacgtctatgctgcaagaatggttgtcaagacccactatccatatatctaaaaagggccccaacttggatcattttttttttaatcttgcctgcacctgtaacaccttttctttacacttgaattcagtgtatttttccatcaagtaaatgaaaatgaagtatggggcaagcttcttttattataattatcagaatgattatagagctcagtaaaagtttgcatttctgtacttgttctgtcacaaaggtgaaaaaactaagactcccaagggagttggccctatgcaacttttacagttcactgatatttttgccattgagatttgagattgtgggggtgaaacaaagatggtgaagcaaagcaaaggcatggcagaggacagatagaggaatcggggttctcacttctcagcagcatggtgggtcatagattgatgctgatgttaagacacctggtagcgatgatgcatcacatcaactttcgtatggttccattgcattatacgagcctgcaatttttctgcatgctaggatactgctatttgcctgacaacaagatttattgattatgaagccataataaatttgttttcaggaccccccaaacattacttaatgcatctcaagtatcttttatatattgaaaaacttcccactccactaagcaatatttttgtatacaaaagtaagaaagcatctgataataataatggtgtaaatgtcagtggtgaagtaaattctccatgaagtgatatcttgacatagatttccaccacagtaaaagtttcaatacatt

SEQ ID NO: 3083 - DNA, 4500 bp, Cicer arietinum
tccacaccctcacccatctctctcttctcaaattcatgttctcttctctccacttccaaacctttgaccactttccaacatcacaacacacacacacacacacacacactttcttctaccaaaaacagacattgacacttccttcactacaaaaagagagtttgcatcagatctccttaaaatgctcacaacaatttacattacattaacttcacttcttgactacccttttaactcaagatctcttttttcattctattgaaccattttccactataaaaatccaatttttttttttttaaattttatcagttacccttttataaaaatccaatttttcttacttataaccaacctttattaaaaagacagtatttttaattgttgggttggttcaaattttccaatggctgaagtttctgaagtgaaagcatcattgcctgaagcagagaagaagaaagaacagagtttaccattttatcagcttttttcatttgctgataaatatgattggattctcatgatctcaggaagtattggagctatcattcatggttcatcaatgcctgttttttttcttctctttggtcaaatggttaatggttttggtaaaaaccaaatggatttgaagaaaatgactgatgaagtttctaagtatgcactttactttgtgtaccttggacttgttgtttgcatttcatcttatgcagagattgcatgctggatgtatactggggagagacaagttagcaccttgaggaagaagtatttggaggcagttcttaaacaagatgttggtttctttgatacagatgctagaacaggagatatagtttttagtgtctctactgatacacttttagtccaagatgctattagtgagaaggttggaaatttcatacattatctatcaacttttctagctggacttgtggttggttttgtgtcagcatggagattagcacttcttagtgttgcagtgattcctggcattgcttttgctggtggattgtatgcttatacactcaccggacttacctcgaaaagtcgcgaatcgtatgcaaatgccggtataattgctgaacaggcgattgctcaagttcggacggtttactcttacgtcggcgagagtaaggcattgaattcttattcagatgcaatacaaaacacattgaagcttggatacaaggcaggaatggctaaaggtttaggcctaggatgcacgtacggtatagcttgcatgtcgtgggcgctagttttctggtatgccggagtttttatcaggaatggacaaaccgatggtggcaaggcattcacggctattttctccgcgattgttggtggaatgagtttaggtcagtcgttttcgaacttaggcgctttcagcaaaggcaaagcggctggatacaaattgatggaaatcatcagacaaaaaccaaccatagtagaagatcttttggacggaaaaaccttagccgaggttaatggaaacattgaatttaaagatgtgactttcagctatccatcaaggccggacgtgattattttccggaaattttcgatctttttcccggctggtaaaaccgttgcggttgttggtggtagtggatctggaaagagtactgttgtttccttgattgaaaggttctatgatcctaatgaaggtcaggttctgctcgataatgtggacattaagacactacaattgaaatggttacgcgatcaaatcggattggtgaatcaagaacctgctttatttgcaacaaccattcttgagaacattctctatggaaaacctgatgcaacaatagatgaagtggaagctgcaacttctgctgcaaatgctcatagctttattactttgcttcctaatggatacaacactcaggtaggagagcgaggagttcaattatcgggtggacaaaagcaaaggattgcaattgcaagagcgatgttgaaaaatccgaagattcttctcttagatgaagcaactagtgctcttgatgcaggatccgaaagcattgttcaagaggcgctagaccgtctcatgatcggtagaactaccgtagttgttgctcatcgtttatcaaccattagaaacgttgacactattgctgttattcaacaagggctagttgtcgagaccggaacacacgaagaactttttgctaagggaggaacctatgcttctctaattaggttccaagaaatggttggaaatagagacttttccaacccttcaactcgccggacgcgctcatcgcgattaagccattcgctttcgacaaagtctttaagcttaaggtcaggaagcttaaggaacttgagttatcagtacagcacgggagccgatggtcgtatcgagatgatctcgaatgctgaaacggacaagaaaaatccagctccagacggatatttcttcaggttactcaaaatgaacgcgcccgagtggccttactcaatcatgggagccgttggatccattctttccggattcatcggaccgacttttgctattgttatgagcaacatgattgaagttttctactatagaaattatgcatccatggagagaaaaactaaggaatatgtattcatatacattggtgctggtatttatgctgttggtgcctacttgattcaacattacttttttagtataatgggagagaatctcaccacaagggtcagaagaatgatgcttgcagctattttgaggaatgaagttggatggttcgatgaggaggagcacaactcgagccttgttgccgctcgcctcgccacggatgcggccgatgtgaagtcggctattgccgagaggatatcagtaatattgcagaacatgacatctctactcacttctttcattgttgctttcattgttgaatggagagtttccttactcatccttgcaaccttccctcttctagttcttgcaaattttgctcagcaactatctctgaaagggttcgccggagacacggcgaaggctcatgcaaagacaagcatgattgcaggagaaggagtaagcaacatcagaactgttgcagcattcaatgctcaaaacaagatgttgtcgatattttgccacgagcttcgcgtcccgcagagcctaagcctgcgccgaagtttgacatccggcctcttattcggcctctctcaactcgccctatatgcgtccgaagctctcattctatggtatggtgcacatttagttagcaaaggtgtttccacattttcaaaagtcatcaaggtgtttgttgtcttagtgatcacggcaaattccgtggcagaaactgttagtcttgctcctgagataatccgcggtggagaagctgttggttcggttttctcaattctcgaccgctcaactcggattgatcctgatgatcccgatgcagaacaagttgaatcggttcgcggggagattgaacttagacatgttgattttgcatacccttctagaccggatgtgatggtgttcaaagatttcagtctaagaattcgggcaggccagagccaagcccttgtcggggcgagtggttcggggaagagttctgttattgcattgatagagcgattctacgatccgatcgtcggtaaggtaatgatcgatggaaaggacattaggaagttgaatttaaagtcattaaggcttaagattggtttagtccaacaagaaccagcattgtttgcagctagcattttagagaacattgcatatggtaaagaaggagcaaccgaagccgaggtgatcgaagccgctcgctcggccaatgtgcatgcatttgttagtggtttgccggaaggttacaaaacaccggtcggcgaaagaggcgtgcaactatccggcggtcaaaagcaaaggattgctattgcaagagctgttcttaaggatcctacaatacttttactcgatgaagcaacaagtgcacttgacgccgaatccgaatgtgtcttacaagaagccttagagaggctaatgaggggtcgaaccaccgtgctcgtggctcatcgtttgtcgaccattcgaggagtcgattgtatcggcgttgtgcaagacggtcggattgtcgagcaaggaagtcattctgaactcataagcaggccagaaggagcttattctagactcttgcagctacaacatcatcacatatgaaaaagaagagaattttatttgatacattatgataatgaccttatggtttgatgataattatgtttggtcccattaacctcatgctttgattttttcttttttagatgtagatatgtgtttttttttatgaggtttgtaccttaaggacaaaagtgctctatttttaatagagaatcacttattatataatattaattattaatcacatatcataggtgcatatgcataagcatgttatctatctgtttctttagcttttcttctaacttactaataataaaatgcaattccaacaattgcatgttttgttgctctttgctttcttttcatgcatgtgtgtt

SEQ ID NO: 3084 - DNA, 4805 bp, Vitis vinifera
ctaaattaaatttgaagaaattacattcataatttagaaaaatatttggtatgtgacaaatatttattttaaagtagaaaataatatatatatatatataggaagagagagaagaaagcaaggagagtaacaattgagattccagttaactagggaccaaactgtattatttgcaaacctcagttaggtgaagtcctctccagtctccacctatataaccagcctcactccactccatttccctctacgctttgcctctcgtctccctgcttttctcttttcttctccggccactggcctcaaaacactgcgtttaggactcataaatcaacccaggcccacattctcagtggttgatttctggttcagcttcactgcttcattgagtgagggaggatctgtgaatggttggcggtgggcgtgcttgatttggtttgtggtgtggttttttgggggctcgtttgtggggaggcaagtggggttggggtggaatggcggagggtggtgcggaggcgaaggcgttgccggaggcggagaagaagaaggagcagagtctgccgttttaccagctgttctcgtttgcggacaagtatgattggattctgatggtgtccggcagcgtcggtgcggtgattcatggctcgtccatgccggtgttctttcttttgtttggagagatggtgaatggattcgggaagaaccagactgatttgagcaagatgactgaagaagtcgccaagtacgctctctatttcgtctacctcggagtggtggtctgcatatcatcctacgcagaaattgcatgttggatgtacaccggagagaggcaagtgagcaccctgaggaagaagtatttggaggcagtgttgaagcaggacgtgggcttctttgatacagatgctagaacaggggatattgtttttagcgtttccactgatacactgcttgttcaagatgccattagcgagaaggttgggaatttcatacattacctgtccacttttctggcgggactggtggttggttttgtatcggcatggaggctggcattacttagtgtggcagtgatcccgggaattgcctttgctgggggcttatatgcatatacgctaacaggactaacgtccaagagccgggaatcgtatgcaaatgctggcatcattgctgagcaggccattgcacaagttcggactgtttactcatatgttggtgagagcaaggcactcaattcttattcagatgcaatacaaaacacattgaagcttggatacaaggctgggatggccaaaggcctgggactaggatgtacttatggaatagcttgcatgtcctgggccctggttttctggtatgctggtgtttttatcaggaatggacagacagatggagggaaggcattcaccgcaattttctcagccatcgttggtggcatgagtttgggccagtcattctcaaaccttggggcatttagcaaaggcaaagctgcggggtacaagttaatggagattattaggcaaaagccctccatagttcaggacccttctgatgggaagtgcttggctgaggttaacgggaatatcgaattcaaagacgtgaccttcagctacccatcccggccagatgttatcatctttcgagatttctcaattttctttcctgcaggaaagacagttgcagttgttggtggtagtgggtcagggaaaagcactgttgtctctttgatagagaggttctacgatcctaatcaggggcaagttttgctggataatgtggacataaagacactgcagctgagatggttacgtgatcagatcggtctggtgaaccaagaacctgcgctctttgcaaccaccatacttgagaacatactctatggaaagcctgatgctacagctgctgaagtggaagctgcggcttctgcagcaaatgctcacagtttcattactttgcttcccaatgggtataacacacaggttggagagcgaggaacccaactctctggtggccagaaacaaagaattgcaatcgctagagctatgttgaaaaatccaaagatccttctccttgatgaggcaaccagtgcccttgatgccggctctgagagcattgtccaggaagctcttgatcgcctcatggttggcaggacgactgtagttgtggctcatcgcctctccaccataagaaatgttgatacaattgcagttatacagcaagggcaagttgtcgagacaggaacccatgaagaactaagtgccaaagctggagcatatgcatcattaattcggttccaagaaatggtaagaaacagggattttgcaaatccttcaacccgcaggtcgcgatcatcacgactaagccattcactgtcaacaaagtctcttagtctccggtctggcagtctgcggaacctaagctatcagtatagcactggtgctgatggtcggatagagatggtctcaaatgctgaaacggacaagaaaaatccagcaccagatgggtatttttaccggcttctaaatctcaatgctccagaatggccctattcaataatgggtgctgtaggatcagtactctctggttttataggtccaacctttgccatcgtcatgagcaatatgattgaagtgttctactatagaaatcctgcatccatggagaggaagacgaaggagtatgttttcatttacattggagcaggcctgtatgctgtcattgcatatttgatacaacactacttcttcagtatcatgggagagaacctcaccacaagagtgaggaggatgatgcttgcagcaatccttaggaatgaagttgggtggttcgatgaggaggaaaacaactccagccttcttgcagctcgtctggctacagatgcagctgatgtgaagtcggcaatagcagaaagaatttctgttatactacagaacatgacgtctctcctcacttcattcattgttgctttcatagtggaatggagggtctcccttctcatcctagccaccttccccctcctcgtccttgccaattttgctcagcaactttctcttaaaggatttgccggagacacagccaaggcgcatgcaaaaactagcatgattgcaggggagggagtgagcaacatcagaactgttgctgccttcaatgcccaagagaagatactctccctcttttgctatgagcttcgcgtgcctcagatgcaaagccttcgtcgtagtcaaacttctgggctcctctttggcctctctcagcttgctctttatgcctctgaagcactcattctctggtatggatcccaccttgtcagcaaaggggcctccaccttttctaaggttattaaggtttttgtggtgctggtcatcacagccaattcagttgcagaaacagttagtcttgctcctgagatcattaggggtggcgaggctgttggatcagtcttttctattcttgatcgttcaaccaagattgaccctgatgattcagatgctgaaccagttgaatcaatccgtggggaaattgaactacgccacgttgatttttcatacccttcacggtctgatatcacagtgtttaaagaccttaacctaagaattcgagctggccagagccaagcccttgttggagctagtgggtctggtaagagttctgtcattgcactgatcgagcgattctatgacccaactgctggaaaagttatgattgatggcaaagatgtccggcgtttgaacctgaagtctttgaggctcaaaatcgggttggtacagcaagagccagctctctttgcagctagcattttggacaacattgcctatggcaaagatggagcaacagaagcagaagtaattgaagcagctcgagctgccaatgtccacggctttgtcagcgggttgcctgatggatataaaactccagttggggagagaggagtccaactctcaggagggcagaagcaaagaattgccatagccagggccgtcctcaaggacccaacaatcctcctactagatgaagccacaagtgcactagacgcagagtcagaatgtgtgctacaagaagccctggagaggctgatgagggggcgcaccacagtgcttgttgcccacaggttatcaaccattagaggggtggacagcattggagtagtccaagatggccgcattgtagagcaaggtagccactccgagctcatcagccgacccgagggggcctactcaagactcttgcaactacagcaccatcacatatgagaagagattttgataattgtagcaacatggcctctgttgggtgttgattatgtttgggtcccattaaccttttgctttcatattttccatttcatgatgatagttgtagatatatggggatgtgaagaagaaaacaagaagaagaatatcaagagtacccactgctccattcccaatggagaaggaaatattatattatcaatatctatggtgcataaacccttgtgttatctgtctgcttagttgggtgattcattaccctttgccttcttttctaagttctgttgtacgataatacccaaaaggcaaaaccaacccccacacaatcccacctttccagcccctaaagagagacctttcccttgccccatttcaccttttccattgcatgtggttgctaatgtgtgctctttttcattatagataaggccttaaggacatctctctatctgttaaaagcaacacccaacagaagggatttatttttcttaaatgtaaagcttgagatgtgttgataaatgtcccacttgggacacattaggaccctaccctaaagtcttg

SEQ ID NO: 3085 - DNA, 3967 bp, Nicotiana benthamiana
tcaatggcggagactacagaaggaaaaccaatgacagaggcagagaagaagaaagagcaaagtcttccattttaccagttattttcctttgctgataagtatgattatcttctaatgattactggaagtattggagctattgttcatggctcttctatgcctgttttctttctcctttttggtgaaatggttaatggttttggcaaaaatcaaatggatttgcacaaaatggttcatgaagtatcaaagtatgctctgtatttcgtgtatcttgggttgatagtttgtgcatcatcctacgcagagattggttgttggatgtataccggagaaagacaagtaagtgcactaaggaagaaatatttagaagcagtgttgaaacaggacgttgggttttttgacacagatgctagaacaggagatattgttttcagcgtctcaacggatactttactggtccaagatgccattagtgagaaggtgggtaatttcatccactacctttcgacgttcttggccgggttggtggttggtttcgtgtcagcatggaggttggctctcctcagtgtggcagtaattcctggaattgcttttgctgggggtctttatgcttatacgctcactggtctcacctccaaaagtagagaatcctatgccaatgctggtatcattgccgagcaggcaattgcacaagtcagaacagtttactcatacgtgggcgagaacaaagccctcaattcttattcagatgcaattcagaacacattaaagcttggatacaaggctggcatggccaaaggcttgggtttgggatgtacctatggaatagcatgcatgtcgtgggcccttgttttctggtacgccggggttttcatcaggaatggacaatctgatggaggaaaggcatttactgctattttctcagccattgttggtggcatgagtttgggtcagtcattttctaatcttggtgcgtttagtaaaggaaaagcagccggatacaagttaatggagatcatcaagcagaaacctaccattgttcaggatcttgcagatggaaagtgcctgtctgaggtcaatgggaatattgaattcaagaatgtgaccttcagctatccttcaagaccggatgtaattatcttcagagatttctgcattttcttccctgctggaaagacagtagcagtcgttggtggcagtggctcaggaaaaaccactgttgtttcgctcatagaaagattttatgatcctaatgagggccaagttttgctggacaatgtggacataaagacattacagctcagatggttgcgagatcagattggccttgtgaatcaagaacctgcattatttgctactaccatacttgagaacatactgtatggaaagcctgatgcaactacggctgaagttgaggctgctacctctgctgccaacgcacatagctttattaccttgcttcctaatggatacaacacccaggtgggagaacgtggtgtccaactatctggcggacagaaacagagaattgcaattgcaagagctatgttaaagaacccaaagatcctcctgtttgacgaggccactagtgctcttgatgctggttcagagagcattgtccaggaagctctggaccgtctcatggttggccggactactgtagttgttgctcaccgtctctccacaattagaaacgtcgattcaattgcagttatacagcaagggcaggtagttgagactggaacacatgaagagctgattgccaaagctggggcttattcttctttaatcagattccaagtaatggttgggaaccgagacttctcaaatccatctacccgtcgtacacgttcatctcgtttaagcagttcactatcaacaaagtctctaagccttcgctctggtagtttaaggaatttgagctattcatacagcaccggtgcagatggacgtattgaaatgatttctaatgctgaaacagagaggaaaaatcctgcaccacagggctatttctgccgccttctcaaactaaatgctcccgaatggccttattcaatcatgggagccatagggtctgttctctctggttttattggtccaacctttgctattgtgatgagcaacatgattgaagtattctactacagaaatccagcaagcatggaaagaaagacaaaggaatatgtcttcatttacattggggcaggcctttatgctgttgtagcatatttaattcagcattacttctttagtattatgggagaaaacctcaccaccagggtgcgaaggatgatgttggcagcaattttaaggaatgaagtgggttggttcgatgaggaggagaacaattcaagtttacttgcagcgcgcttagcaacagatgctgcagatgttaaatcagccatagcggagaggatctccgttatactacagaatatgacatctcttctcacttcatttatagttgcatttatagtcgaatggcgagtctcacttctcatccttgctacatttccgcttctagtcttggccaattttgctcagcaactctcactgaaaggatttgctggagatacagccaaagcgcatgcaaagactagcatgattgctggagaaggagtaagcaatattagaactgtagcagctttcaatgctcaagaaaagatcatctctatgttctcccaagagcttagagtcccgcaaatgcaaagtcttcgacgcagccaaatctcaggactcttatttggtatatcacaacttgctctttatgcttctgaggctctgattctttggtatggcgcgcaccttgttagcaaaggggtctcgactttctctaaggtgattaaggtctttgtagtccttgtgatcacggccaattcagttgctgaaaccgtcagtttagcacccgagattgttaggggtggtgaagctgttggttctgtattttccattcttgatcgctcaaccagggtcgatcctgatgacactgaagctgatccagttgaatcaattagaggggatattgaattgcgccatgttgattttgcatatccttcacgacctgatgatgtttcagttttcaaggacttcaatcttaggattcgtgctggtcaaagccaagctcttgtcggggcaagtggctcgggaaagagctccgttatagccttaattgaaaggttctatgatccaacaggtggaaaagttatgattgatggaaaagatataaggagattaaacttgaaatcccttaggcttaaaattgggttggtgcaacaagagccagctctgtttgcagctagtatttttgagaatattgcctacggtaaagagggtgcaacagaagctgaagttgttgaagcggctcgagctgcaaatgtacacactttcgttagtggtttgcctgaaggttacaagacaccagttggtgagagaggtgttcaactctcgggaggacagaaacaacggattgcaattgcaagggctgttcttaaagatccatcaattctcctactcgacgaggctacaagtgcacttgatgcggattccgaatgtgtgttacaagaagcactcgaaaggttgatgagaggtcgaaccactgttcttgtggctcaccgattatcaaccattcgtcatgtggacagcatcggggtggtgcaagatggtcgcattgttgagcaaggaagccattctgagttaatcagcaggccagaaggggcatattctagactattgcaattacaacaccaccggatatgaaaattggaagaattttagtttttttttccttttatatttttatttttatggaagcaagtaacctggcctagtgttttgggggagtgacaatgtttgggtcctagtaactgttgctttcatttgcttttattgattatgatgatgatgctgatagttgtagatatgggaatgtcacggtcaatattatatcatctgaaaagtctccaactct

SEQ ID NO: 3086 - DNA, 4533 bp, Populus trichocarpa
gtatatattccttcaaaaactcctcacactctcctgtcccccccagccctgtgaccactagtccaacatactctcactttactcaaaacacactctccctgtctctccctctctatgtttactctgctctcctttcccttctacacatgcaccttttcttatagttcttcagagatctctcatcaccttcaatggcaataagcccagtggttactatctctctatattaactttataagaatccttttctttttactactcttgagagtcaactcattggcttacaaaactttttccatattttgtttttctgaggagagcttggttctggggccataatggcagaaaccacagaagctaatagaccatcattgccagaagcagagaagaagaaagagcaaagcttgccattctatcagcttttctcatttgctgacaaatatgattggttacttatgatctctggtagcataggagccattattcatggctcttcaatgcctgtttttttcctcttgtttggtgaaatggttaatgggtttggcaagaaccaatctgatttgtataaaatgactcatgaagtctccaagtacgctctctattttgtgtatcttggtattgttgtgtgcctatcatcctatgcagagattgcatgctggatgtacactggagaaaggcaagtgagtacattgagaaagaagtatttagaagcagttttgaaacaagatgttggattctttgacacagatgctagaactggggatattgtctttagtgtctcaactgacacccttcttgtccaagatgccattagtgagaaggtggggaattttatacattatttatctacatttttagccgggctagtggttggttttgtgtccgcgtggaggctggcattgctaagtgtagcagtgataccaggaatagcttttgctgggggtttgtatgcttatactctcactggactcacgtccaagagccgtgaatcttatgcgcaggccggtataattgctgagcaggctattgcgcaagttcggacagtttactcttttgttggtgagagcaaagccctgagttcttatacagatgcaatacaaaacacgttgaagcttggatacaaggctggaatggccaaaggtttggggctgggatgtacctatggaatagcatgcatgtcatgggcccttgtattctggtatgctggtgtttttatcaggaatggacagaccgatggagggaaagcattcacggccattttctctgcaattgttggtggcatgagtctgggccagtcgttttctaatcttggtgcatttagcaaaggtaaagcagctggatacaaattgatggagattatcaagcaaaggccttccataactcaagatgccgtagatgggaaatgcctggctgaggttaacggaaatatagaattcaagagtgtaacattcagttacccatccaggccagatgttattatattccgtgatttctcaatcttctttcctgctggaaagaccgttgctgttgttggtggcagtggatcaggaaaaagcactgttgtctctctaatagagagattttatgatcctaatcaggggcaagttttgctggataacgtggacataaaaaccttgcaattaagatggctacgtgatcagattgggttggtgaaccaagaacctgcactgtttgcaactactatactcgagaacatacgatatggaaagcctgatgcaacaatggacgaagtggaagctgccacttctgctgcaaatgctcatagcttcattactttgcttcctaatggatacaacactcaggtgggagagcgaggagtccaactctcaggtggccagaaacagaggattgcaattgctagagctatgttgaagaacccgaagatcctgcttcttgatgaagcaaccagtgctcttgatgcaagttctgagagcattgttcaagaagcattagaccgcctcatgattggaagaacaactgtagttgttgcgcatcgactctccaccattagaaatgttgatacgattgcagttattcagcaagggctagttgttgagacaggaacccatgaagaactcattgccaaagcaggagcatatgcttctctaatccgattccaagaaatggtgagaaatagagactttgctaacccatccactcgccggtcacgctcatcacgactaagccattcactttcaacaaagtctctaagcttgcggtctggcagtttacgaaacttgagctattcatacagcactggtgctgatggccgtattgagatgatctcaaatgctgaaactgaccgtaaaaaccccgcacctgatggctatttctgcaggttgctaaagctgaatgctcctgaatggccttattcgataatgggtgctgtaggatccgtgctttctgggtttataggtccaacctttgctattgtgatgagcaatatgattgaagttttctactatagaaacccggcctccatggaaaggaagacaaaagaatatgtttttatatacattggtgctggtctttatgctgtcgttgcatacttgattcagcattacttcttcagcattatgggagagaacctcactacaagagtgaggaggatgatgcttgcggcaattttgaggaatgaagttggatggttcgatgaagaagagcataactcaagcctagttgcagctcgattagctaccgatgctgcagacgtaaaatctgcaatagctgagaggatatccgtcatactacaaaacatgacttctctcctcacttcattcatagttgctttcatagtagaatggagggtctcccttctcattttagccaccttccctcttctcgtcctcgccaactttgcccagcaactctctctcaaaggatttgctggagacacagccaaggcccatgcaaagactagcatgattgctggtgagggggtgagcaatatccgaactgttgcagccttcaatgcccaaggcaaggtcctctctctgttctgccatgagcttcgtgttccgcagcttcatagcctacgtcgaagtcaaacttctggcctcctctttggcctctctcagcttgctctttatggttctgaagctcttattctgtggtacggtgctcaccttgttagcaaaggggtttccacattctcaaaggtcattaaggttttcgtggtactggtcatcacagctaattcagttgcagaaactgttagtcttgcccctgagattattaggggtggcgaagctgttggttctgttttttcaattttggaacgttctactaagattgaccctgatgattctgaggctgagcctgttgaatcacttcgtggggaaattgaacttagacatgttgatttcgcatacccttctcgacctgatgtgcctgtgttcaaggacttgaaccttagaatccgagctggccaaagccaggcccttgttggtgctagtgggtgtggaaaaagttcagtgatctcgttgattgaacgattctatgatcctatggcggggaaggttatgattgatgggaaggatattcgacgattgaatttgaagtctcttaggcttaaaattggattggtgcaacaagagccagcgctatttgcagcaagcattttcgataacattgcctatggaaaagacggtgcaactgaagctgaagtaattgaagccgctcgagctgccaatgtgcacgggtttgttagtgcattgcctgatggatataaaacgccagttggtgagagaggagttcagctgtctgggggtcaaaaacaaagaatcgcaatagctagggctgttcttaaggacccagcaatcctactactggatgaggctacaagtgcacttgatgccgaatcagaatgtgtgctacaagaagcactcgagaggctaatgaggggccgaaccacagtgcttgtggctcatcgtttatccaccattagaggggtggatagcattggagttgtgcaggatgggcggattgtggagcaaggcagccattccgaactggttagccggcccgacggggcttactttagacttttgcagctacagcaccatcacatatgagagagcattttgattgaagcagcatggccttgttgattgttaattatgtttggggttccattaaccttgtgtttctatttttccttcttttttttttggacgatgatgacagttgtagatatggtaatgtggagactacatcttgaagaaaactatcccatctccagatggggtagcatatgtttaaatataaatatctaagggtgcatatccatgttgtctatctggttattgccaccaaccgattagcttttcctcctctcaagtgttgctttatagcagtgaaacagcaacccccagtaatcatgcttctagctcccattggaaaccttttctagctgttgctttccccgtattgcatgtgattgttagtgttcttttcgatttggggtaagagacactattttttttatccctcctgtgagttgaaggcccacat

SEQ ID NO: 3087 - DNA, 4270 bp, Citrus clementina
gtccactctttctctcttcctttttccgttttgctttgttttgctctttgataatttctaacaaaccaggcttcacccgaacactttaactgtgttgttagttcaaaagggtgctttgatctttcattttctcaatgctttaatcggcttagatctctcttcattgagacttgaatacgttggttttttcttgctttggtgtattagataatggctgagccaactactgaagcagcaaagactctgccaccagaggcagagaagaagaaagaacaaagcttgccattttttcaactcttttcatttgctgacaaatatgattggtgtcttatgatctttggtagcttaggagccgttattcatggctcttcgatgcctgtttttttccttctctttggtgaaatggttaatggctttggcaaaaaccaaactgatattcacaaaatgactcatgaagtttgcaagtatgcactttactttgtgtatcttggactcattgtctgcttttcttcttatgctgagattgcatgttggatgtacactggggagaggcaagtaagcactttgaggaagaagtatttggaagcagtattgaaacaagatgttggcttctttgacactgatgcaagaactggtgatattgtcttcagtgtttcaacggatactcttctcgttcaagatgccattagtgagaaggtggggaattttattcattatttgtcaacatttttggctgggctagtggttggttttgtatcagcatggaggttggcattgctaagtatagcagtgattcctggtattgctttcgctggaggcttatatgcatatactctcactggcctcacgtccaagagccgtgaatcatatgcaaatgccggcataattgctgagcaggccattgcacaagtccggacagtttactcgtatgtgggtgagagtaaggccctcaattcctattcagatgctatacaaaacacactgaaactaggatacaaggctggtatggccaaaggtcttgggcttggatgtacttatggaattgcttgcatgtcatgggcccttgttttctggtatgccggtgtttttatcaggaatggagtaactgatggaggaaaggcattcactgcaattttctctgccatagttggtggcatgagtttgggtcagtctttttcaaaccttggagcattcagcaaaggtaaagcagctggttataagctgatggagatcatcaaacaaaagccttccataattcaagacccaacaaatggaagatgcttggatgaggttaatggcaatatagaattcaagaatgtaacttttagctacccatcaaggcctgatgtgattatcttccgggatttctctatttactttcctgctggaaagactgttgcggttgttggtggcagcggatctgggaaaagcactgttgtctctctaattgaaagattctatgatcctaatgcagggcaagttctgctggataatgtggacattaaaacactgcaattgagatggttacgcgaccagatagggcttgtgaaccaagaacctgcactttttgctaccaccatacttgagaacatactctatggcaaacctgaggcaacaatggctgaagtggaagctgctgcttctgctgccaatgctcacagttttattacattgcttcctaatggttacagtactcaggtgggagagcgtggagtgcagctctctggtggacagaaacagagaattgcaattgccagggctatgttgaagaaccccaagatccttcttcttgatgaagcaactagtgcacttgatgcagggtcagagagcattgttcaagaagctttggaccgtctcatggttgggagaacaactgtagttgttgcccatcgcctctccaccattagaaatgtagacacagttgcagttatccagcaagggcaggttgttgagacaggaacgcatgaggaactgattgctaaggctggggcctatgcttcattaatccgattccaagaaatggtgaggaatagagactttgcaaacccatcaactcgccgctcacgttcaacacgtttaagccattcattgtcaacaaagtccctaagcctccgctctggcagcttaaggaatttgagctactcttacagtactggggctgatggccggatagagatggtttcaaatgctgaaactgaccgcaaaaatccagctcctgatggttacttcttgcggcttctcaagctaaatgctcctgaatggccatattcaataatgggtgctatagggtctgtgctttctggttttatcggtccgacctttgccatcgtgatggcctgtatgattgaggttttctactatagaaatcctgcatccatggaaaggaagactaaagaatttgtcttcatttacattggtgcgggtctttatgcagttgttgcatatttgattcagcattacttctttagcattatgggagagaacctcaccacaagagtgaggaggatgatgcttgcagcaatcttaaggaatgaagtcggatggttcgatgaagaagagcacaactcaagcctagttgcggctcgattggcaactgatgctgccgatgtgaaatcagcaattgctgatagaatttctgtgattctacaaaacatgacctcactgctcacatccttcatagttgcattcatagtggaatggagagtctctcttctcattctaggcacataccctctgcttgtccttgctaactttgctcagcaactgtctctcaaagggtttgctggagacaccgccaaggcccatgcaaagacaagcatgatagctggtgagggagtgagcaatatccgaactgttgcagcctttaatgctcaaaacaagatcctctccctgttctgccatgagcttcgtgtgccccaaagccaaacccttcgtcgtagtctaactgctggcattcttttcggcatctctcagtttgctttacatgcctctgaagctctcattctatggtacggtgttcaccttgttggcaaaggggtatcgacattttctaaggttatcaaggtttttgttgtcctggtcgtgaccgccaattcagtggcggaaactgtcagtcttgctccagagatcattagaggtggcgaatctgttggctcagtgttttccattttggaccgctctactagaattgacccagatgatccagatgctgagcccgtagaaacaattcgcggagaaattgaacttaggcatgttgattttgcctacccatcaagaccagatgtagttgtttttaaggactttaaccttagaatccgtgctggccagagccaagctcttgtaggtgctagtgggtctggcaagagttctgtgattgcattgattgagagattttacgatcctacagctgggaaagttatgattgatggcaaggatattcgtcgattgaacttgaagtcccttaggcttaaaattggtttggtgcaacaagagccagccctgtttgcggcgagcatttttgataacattgcatatggaaaagaaggtgcaactgaagcagaagtcgttgaggccgcccgtgctgctaatgtgcatgggtttgttagtgcattgcccaatgcgtacaaaacaccagttggtgagagaggggttcaactctctggtggacagaagcaaaggatagcaattgctagggctgttctcaagaacccagcaatacttctgcttgatgaggccacaagtgcccttgatgctgaatctgagtgtgtgctacaagaagctcttgagaggctaatgaggggccgaaccacggttcttgtggctcaccgattatcaacaataagaggtgtagactgcattggagttgtgcaagatggccgcattgtagaacagggtagccactccgaattggttagccgtccagatggggcatattctagacttttgcaattacagcatcatcatatttgagtgtgcttttggccttgattgtggtaattatgtttgggtccccattaacctcatgtttccatttttctttttgaatgatgatatgatagttgtagatatggaaatgtggagattatatcttaagaactgctgccccattttccaatggggtatcatgtgttatattattaatatctttggtgtataagcctgttgatctatctgtggttgattaggtgattggttggcttttcatctccagttgtaattgcaattttataatatttgaaaagcaaatcaagatgcaacctttccagccctc

SEQ ID NO: 3088 - DNA, 4385 bp, Capsicum annuum
agcatagtttagtgaagttgggatgtatcacactcactttgcacacacttttacgtttatttttctccaattcctttgactactgctcctcctcttcttacctttttcccttctctttctccattttctcttagctcaaaacactcactcatttaactcactcttccaacttcagcttaattcaagaaaatactctgttatatatttagcacagatagatctcaatgtttttttgcaagaaagtaaaattcctatagtgggatgtcaatataatttgttgttgtttgtgagttttttttttttttgtaagggtgatatatagagtttgttgaagttcaatggcggagcatactgaagggaaaacaatgccagaagcagagaagaaaaaagaacaaagtcttcctttttatcagctcttttcttttgctgataaatttgattattttcttatgattactggaagtattggagctattttacatggctcttccatgcctgttttctttctcctttttggtgaaatggttaatggttttggcaaaaatcaaatggatttgcacaaaatgacccatgaagtatcaaagtatgctttgtatttcgtgtaccttgggttgatagtttgtgcatcatcctatgcagagattggttgttggatgtacactggagaaaggcaagcgagtgcactgaggaagaaatatttagaagcagtgttgaaacaggacgttggattctttgatacagatgcaagaactggagatattgttttcagtgtttcaacggatactctgctggtccaagatgctattagtgagaaggtgggcaatttcattcactacctttcgacgttcttggcgggtttggtggttggtttcgtgtcggcatggaggttagctctcctcagtgtggcggttattcctggaattgcttttgctgggggtctttatgcttatactctcactggtctcacctcaaaaagcagagaatcctatgccaatgctggtattattgctgagcaggcaattgcacaagtcagaacagtttactcatatgtgggcgagagcaaagcccttaattcatattcggatgcaattcaaaacacattgaagctcggatacaaggctggcatagctaaaggcttgggtttgggatgtacctacggaatagcatgcatgtcatgggcccttgtattctggtatgctggtgttttcatccggaatggacaaagtgatggtggaaaggcatttacagctgttttctcagccattgttggtggcatgagtttgggtcaatcattttccaatcttggggcattcagtaaaggaaaagcagctggatacaagttgatggagatcatcaatcagaaaccgaccattgttcaagatcctttagacgggaagtgcctgtctgaagtcagtgggaacattgagttcaaaaatgtgaccttcagctatccttcaagacctgatgtgattatcttcagagatttctgcattttcttccctgctggaaagacagttgccgtggttggtggcagcggctcaggaaaaagcactgttgtctccctgatagaaagattttatgatcctaatgagggtcaagtttttctggacaatgtggacataaagacgttacaacttagatggctgcgtgatcagattggtcttgtgaatcaagaacctgcattatttgctactaccatacttgagaacatactctatggaaagactgatgcaactatggccgaagttgaggctgctacctgcgcttccaatgcacatggctttattaccttgcttcccaacggatataacacccaggtgggagagcgtggtgtccaactctctggtggacagaaacagagaattgcaattgcaagggctatgttaaagaacccgaagatcctcctgcttgatgaggccaccagtgctcttgatgctagttcggagagcattgtccaggaagctctggaccgtctcatggttggccggactactgtagttgtagctcaccgtctctccactattagaaatgtcgattcaattgcggttatacagcaagggcaggtagttgagactggaacacatgaagagctgattgccaaagccggggcttattcttctttaatcagattccaggaaatggttgggaacagagacttttcaaatccatctactcgtcgtactcgttcaactcggttaagtcattcattatcaacaaagtctctaagccttcgctctggcagtttaaggaatttgagctattcgtacagcactggtgcagatgggcgtatagaaatgatttctaatgctgaaacagataggaaaaatcctgcaccacagaattatttctgccggcttctcaaactgaatgcgcccgagtggccttattcaatcatgggagccatagggtctgtcctctctggtttcattggtccaacttttgctattgtgatgagctgcatgatcgaggtattctactatacaaatcctgcaatcatggaaagaaagacaaaggaatacgtcttcatctacattggagcaggtctttatgctgttgtagtatatttaatacaacattacttcttcagtattatgggagaaaacctcactaccagggttagaaggatgatgttggcagcaattttgaggaatgaagttggatggttcgacgacgaggagaacaattcaagtctactagcagctcgcttagctacagatgctgcagatgttaaatctgccatagcggagaggatctccgttatacttcagaatatgacctctctcctcacttcattcatagttgcatttataatcgaatggcgagtctccctgctcatcctcgccacatttccgcttctcgtcttagccaattttgctcagcaactctcattgaaaggatttgccggagacacggccaaggcgcatgcaaagactagcatgattgctggagaaggagtaagcaatataagaactgtagcagccttcaatgcccaagaaaagattatctcgttgttctcccacgagcttcgagttccacaaatgcagagtcttcgatgcagccaaatgtcaggaatcttatttggaatatcacagcttgctctttatggttctgaagcactgattctttggtatggtgcacaccttgttaacaatggggtctcgactttctctaaggtgattaaggtctttgtagtccttgtggtcacagctaattcagttgctgaaactgtcagcctagcacccgagattattaggggtggtgaagctgttggttctgtattttccattcttgatcgctctactaggatcgatcctgatgaccctgaaggtgatccagtcgaatcaattagaggggatattgaactccgtcatgttgatttttcgtacccttcacgaccggatgtctctgtgttcaaggacctcaatctaaggattcgtgctggccaaagccaagctcttgtgggggcaagtggctcgggaaagagttccgttataggcttaatcgaaaggttctacgatccaacaggcggaaaagttatgatcgatgggaaagacataaggagattaaacttgaagtctctaaggcttaaaattggtttggtgcaacaagagccagctctgtttgcagctagcatttttgataatattgcctatggtaaagagggtgcaacagaagccgaagtcattgaagcagctcgtgctgcaaatgtacacactttcgtaagtggtttgcctgaaggttacaagactccagttggtgagagaggcgttcaactctcaggaggacagaaacaaaggattgcaattgcaagggccgttcttaaagatccgtcaattctcctacttgacgaagctacaagtgcactcgatgctgaatctgagtgcgtgttacaagaagcactcgaaaggttgatgagaggtcgaaccaccgttctagtggctcaccgattgtcaacaattcgtaatgtggatagcatcggggttgtgcaagacggtcgcattgttgaacaaggaagccattctgagttaataagcaggcccgaaggtgcatattctagattattgcaactacaacaccaccgcatatgataataacaagaatgatctcttttttcaattttcattttaacttttaatttttatggaagcaaacagcatggcctagtgtttggcctttggggtggggagtaacaatgtttgggtcctagtaactgttgctttcatttgctttattgattatgaatatgatgtcgatgatgctgatagttgtagatatgggaatgtcacggtcaatattaatatcacggggaaagtttacaactctattccctatggagaagaagtatatgttaaaatattaatattatcaatggagcattgaacttt

SEQ ID NO: 3089 - DNA, 4021 bp, Vinca minor
agagtagctccctgtctgtccgggctaaccaaatcttttgctctcgagatttctcgaacttataactactagccgacaccattttcaagttttcaataccttgttattgaaatcagaatccgaaaaaatacataaaaaaacaaacaaatgacaaatcactccttcttcttcttcagatctcttttttcctcattcaaaatcatccatgtttaaagttttctggttgtagtgttaattagtgttgttgattttgaattgaaaatggcggagacgactgaaggagggaaagcaatgccggcggaagcggagaagaagaagaaggagcaaagtctacctttctatcagctattttcctttgctgataaatatgattatgttttaatgatctctggaagcattggagctataattcatggttcatctatgcctgttttcttcctattgttcggccaaatggttaatggcttcggtaaaaaccaatctgatttgcataaaatgactcacgaagtcgccaagtatgctctttactttgtctacctcggactagtagtctgtttttcatcctacgccgagatagcatgttggatgtacaccggagagagacaagccggagcattgaggaagaagtatttggaggcagtgttgaaacaagacgtaggattcttcgacacagatgctcggacaggagatattgttttcagtgtctcaacggatacacttcttgtccaagatgccatcagtgagaaggtgggaaattttatccattatctttcgacgtttttggccggtttagtggttggttttgtatcagcatggaaactggctctgcttagtgtggctgtgattccgggaattgcctttgctgggggcttgtatgcatacaccctcacaggtctcacgtcaaagagtcgggaatcttatgccaatgctggcataattgccgagcaggctattgcacaagttaggacagtatactcgtacgttggcgagagcaaggcgctgaatgcctattcagatgcaatacagaatactttgaagcttggatacaaggctgggatggctaaaggcctcggactcggatgcacctatggaatagcatgcatgtcatgggcacttgttttctggtatgctggtgtctttatcaggaacggacagactgatggtggaaaagcatttaccgctattttctcagccattgttggtggcatgagtttaggccagtcattttctaaccttggggcattcagcaaaggcaaagcagcaggatacaagttaatggaaattatcaaacaaaagccaacaatagttcaagatcacgcagatggaaagtgcttggatgaggtcaatgggaatattgagttcaagaatgtgacttttagctatccctccaggcctgatgttattatcttcagggatttctctattttctttcctgctggaaagaccattgctgttgttggtggtagtggttcaggaaaaagcacggttgtctccttgatcgaaaggttctacgatcctaatcagggggaaattctcctggacaatgtggatataaaaactctacaactgcgatggttgagggatcagataggtttggtaaatcaagaaccggcactctttgccaccaccattcttgaaaacatactctatggaaagcctgatgcaagcacggctgaagtggaggcggctgcctctgctgcaaatgctcatagttttattactttgcttcctaatgggtacaacactcaggcaggagagcgtggggttcaactttctggtggtcaaaagcagagaatagcgattgctcgagctatgttgaaaaacccgaaaatcctcctgctggatgaagcaactagtgccctcgatgcaggttcagagagcattgttcaagaagctctagaccgtctcatggttggaaggacaacagtggttgtggcacatcgcctttctaccattagaaatgtcgactctattgcagttatacagcaagggcaagttgtcgaaactggaacacacgtagaactggttgccaaagccggggcttacgcttccctaattcgattccaagaaatggtgggaaatagagacttttcaaatccttcaactcgccgtacacgttctacccgtctaagccactcactatcgactaaatccttaagccttcgctctgggagtttaagaaatttaagctattcctacagcaccggtgctgatggtcgtattgagatggtttcaaatgctgaaacagacgggaaacatccagctccacatgggtatttctgcaggcttctaaaactaaatgctcctgaatggccttattcaatcatgggtgcagttggatcggttctttctggattcattggtccaacatttgcaattgtgatgagcaatatgattgaagtgttctattacagaaatccggctagcatggagaggaagacaaaggaatatgtttttatttacatcggagcaggtctttatgctgttgttgcatatttgatacaacattatttcttcagcattatgggagagaaccttaccaccagagtaaggagaatgatgcttgcagcaattttaaggaatgaagtcggatggttcgatgaggaggaacacaattcaacattattagcagctcgcttagcaactgatgctgcggatgtaaaatcggcaattgccgagaggatatccgtgatcctgcagaatatgacctctctgctaacttcatttatagtagccttcataattgaatggaaggtctcactacttatcctggccaccttcccgcttcttgtccttgccaactttgctcagcaactttcactcaaaggatttgccggtgacacagcaaagtcccatgcaaagacgagcatgatcgcaggggaaggagtaagcaacattagaacagttgcagcattcaatgcccaagaaaaggttctgtccttattttcccaggaacttcacgtcccacagctccacagtctccgtcgaagccaaacttcaggccttctgtttggtctttcccagcttgctctttattcttcagaagctttaatcctatggtatggctcacatctcgttagcaagggcgcttctaccttctcaaaggttattaaggtttttgtggtcttagtcataacagccaattcagttgctgaaaccgttagccttgcccccgaaattataaggggtggtgaagctgttggttccgtattttctgttcttgatcgttcaacaaggatagattctgatgatcctgaagctgagccagttgaatcaatgcgcggtgacattgaattccgacatgttgattttgcatatccatcacggccagatgttattatattcaaggactttaacctcagaattcgggctggccagagccaagcacttgtcggggcaagtggttcggggaagagttctgttattgccctgatagagcgtttctatgatccaatatcagggaaagtaatgatcgatgggaaagacattagaagattgaatttgaagtctctaagactcaaaattggacttgtacagcaagagccagcgctttttgcagcaagcatatttgataatatcgcgtatggtaaagatagtgcaacagaagccgaagtaatagaagctgctcgtgctgcaaatatgcatgcatttgttagtagcttaccggaagggtacaaaaccccggttggcgaaagaggagtacaactctccggtggacaaaaacaacgaattgcaatcgcaagagccgttctgaaggacccaacaatacttctgctcgatgaagctacgagtgctcttgatgcagaatcagaatgtgtgttacaagaagcactcgaaagactaatgaggggtcgaaccactgtccttgtggctcacagattatcgaccataagaggagtcgattgcattggagtcgtgcaagatggaagaattgtagagcagggcagccatggagaactaatcagccggcctgatggtgcttattctaggcttttgcaactacagcacaatcacatatgag

SEQ ID NO: 3090 - DNA, 4422 bp, Glycine max
gtggctttatcaacctaaccgtgatccatcatcatactagtatgctctaattcacaaccacagtaaaaccaaaccactaacactataaaaccacacttcacacctctctctcttcccaaactcttgttcttctccccaatttcctttgaccactgttcaccaagacacacacacacactctcactctctttgctctctctaccaaaccaaaaaacgatattgacactgcaaaaaagagtgatatagcaaaaggggttgttgtttcagatctccttcattcaatgtcaagaaagaagtcacaacattacacaccccactaggcctagatctccttgttcatggcattgagccacgagtcactctaaaaatcccattttctacccttttgttcttatcacatcagaacctctgtttcatagctgggggtgtttgtgttgtgacttgttctaatggctgaagcttctgagcctaaagcattgcctgaggcagagaagaagaaggagcagactctgcccttttacaagctcttctcatttgcagacaagtgtgattggatgctcatgatctctggcagcataggagccattgttcatggctcatccatgccagttttcttccttctctttggtgaaatggttaatggctttggcaaaaaccaaatggacttgaagaaaatgacagaagaagtatcaaagtatgctctctatttcgtgtaccttggtcttgtcgtttgcatatcatcctatgcagaaattgcatgttggatgtacactggggagaggcaagtgagtacactgagaaagaagtacttggaggcagtgcttaaacaagacgttggtttctttgacacggatgcaagaacaggagatatagtttttagtgtctccacagatacacttctagttcaagatgctataagcgagaaggtggggaacttcatccactatctatcaacgtttctggcgggtctagtggttggctttgtttcagcatggaggcttgcacttctgagtgttgcagtgattcctgggattgcttttgctggtggattgtatgcttacacactcactggcctcacatcaaagagtcgtgaatcttatgcaaatgcgggcatcatcgccgagcaggccattgctcaagttagaactgtttactcttatgttggtgagagcaaggcattgaattcttattctgatgcgatacaaaacacattgaagcttggatacaaggcagggatggccaaaggattaggtctaggatgcacatatggaatagcttgcatgtcttgggcactagttttctggtatgctggagttttcatcaggaatggacaaacagatggtggcaaggcattcaccgctattttctcggccattgttggtggcatgagtttgggacagtcattttcaaacttaggcgctttcagcaaaggcaaagcagctggatacaaattgatggaaatcatcaatcagaaacccaccatagtggaagatccatcggaaggaaagtgcttagccgaggttaatggcaacattgaatttaaggatgtcactttcagctacccttcgaggccggacatgtttatctttcgcaatttctcaatctttttccctgctggtaaaactgttgccgttgttggtggtagtggatctggaaagagcacagttgtttccttgatagaaaggttctatgatccaaatgaaggtcaggttctgctggataatgtggacattaagacactgcaactaaaatggttgcgcgatcaaattgggttggtgaatcaagaacctgcactctttgcaactactattcttgagaatatactctatggaaaacctgatgcaacaatggctgaagtggaagctgctacttctgctgcaaatgctcatagctttattaccttgcttcctaatggctataacactcaggtaggagagcgaggagttcaattatctgggggccaaaagcagagaattgctattgccagagctatgttgaagaatccaaagattcttctgctagatgaagcaactagtgctcttgatgcaggatctgaaagcattgttcaagaggcactagataggctcatggttggaagaacaaccgtggtagttgcgcatcgtctatcaaccataaggaatgttgataccattgcagttatacaacaaggacaagttgttgagacaggtacacatgaagaactcattgccaaggcaggcacctatgcctcactcattcggttccaagaaatggttggaaatagagacttctccaacccatcaactcgccggactcggtcatcacgcctgagccattcgctgtcaacaaagtccttgagcctccggtccggaagcttgaggaacttgagctaccagtacagcaccggagctgatggccgcattgagatgatatcaaatgctgaaacagacaagaaaaatcctgccccagatggatatttcttcaggttgctgaagatgaatgctcctgagtggccttactcaatcatgggagctgtgggttctgtcctttctggattcattggccctacttttgccattgttatgagcaacatgattgaggtcttttacttcagaaattatgcatccatggagaggaagactaaggagtatgtcttcatctacattggtgctggtctctatgcagttggtgcatacttgatacaacattacttctttagtatcatgggagaaaacctcaccacaagggtcagaagaatgatgcttgccgctattttgaggaatgaagttggatggttcgatgaggaggagcacaactcaagccttgttgcagctcgccttgccacagatgcagctgatgtcaagtctgccattgctgagagaatatcagtgattctacagaacatgacatctctccttacttctttcatagttgctttcatagtggaatggagggtttccttgctcatcttggcaaccttccctctccttgttctagccaattttgctcagcaactatcactaaaagggtttgctggagacacagccaaggctcatgcaaagacaagtatgatagcaggagagggagtgagcaacatcagaacagttgcagcattcaatgctcagaacaagatgttatcagtgttctgccacgagcttcgtgtgcctcagagccagagcctgcgccggagccagacatccggcttcttgtttggcctctctcagcttgccctctatgcttccgaggctctcattctatggtatggtgcacatttggtcagcaaaggtgtttcaaccttctccaaagtcatcaaggtgtttgtggtcttagtgatcacagcaaattcggtggccgaaaccgtgagccttgcaccggagattatccgtggtggcgaagctgttggttcagtgttctcaatccttgatcgctcaaccagaattgaccctgatgatcctgatgctgatccagttgaatcgcttcgcggggagattgagctcagacatgttgattttgcgtacccttctaggcctgatgtgatggtgttcaaggatttgaaccttaggatccgtgcaggccagagtcaagcccttgtgggggcaagtggttcggggaagagttctgttattgcattgattgagagattctatgaccctattgctggaaaagtgatggttgatggaaaggacattaggaagttgaacttgaagtctttgaggctcaagatcgggttggtgcagcaagagccagcactttttgcagcaagcatttttgagaacattgcatatgggaaagaaggtgcaactgaggctgaggtgattgaggccgcacgtgctgccaacgtgcacgggtttgtgagtggtttgcccgagggttacaagacaccggttggcgagagaggtgtacaactctctggagggcaaaagcaaaggattgctattgcaagagctgtgcttaaggaccccacaattcttctactagatgaggccacaagtgcactagatgctgagtctgagtgtgtgctacaagaggccttggagaggctaatgaggggtcgcaccacggtgctcgtggctcatcgtttgtcaacaattagaggggttgattgcattggagtggttcaagatgggcgcattgtagagcaaggtagccattctgaacttgtcagcaggcctgagggggcatattctagactcttgcagctacaacatcatcacatatgagagggattattgttttttttttatttatttatttgatgaatatgaccttgtgggggtgataaattatgtttgggtcctattaacctcatgctttggtttagatgtagatatgtgggatatgaggtttgtatcttgaggacaaagtgatctatttccaatggggtatcaattattatatttaatcacaagccaatgggtgcataagtctgtcatctatctggtg

SEQ ID NO: 3091 - DNA, 4489 bp, Medicago truncatula
catctctctcttctcaaatccatgtaatcttctctccactttgaccattgtccaacaacacaacacaaacacacttcacttaccaactcatcactctctatagtttctagtacttcaacttttccttccaaaacaactgtttttttccttcttctttcaaatgttgttaaaaccaaaaaacagacattgacacttccttcactacaaaaagacactaaaagtgtttgcaacagatctccttaatatgctcagaaaatattcacattacatttacttcacttcttgactagccctttattccaagatctcttttttcattgcattcaaccattactcatcataaaaatccaatttttatttaaactatcacctaccctttaatcaaaatccaattttttcatcaaaaaactaagtttttcataaaaaaaattgtgtttttcattgttgggctggttcaaaattgccaatggctgaagcttctgatgtgaaagcttcattgcctgaagcagagaagaagaaagaacaaagtttaccattttttcagcttttctcatttgctgataaatatgattggattcttatgatctctggaagtattggtgccattattcatggttcatctatgcctgtttttttccttctctttggtcaaatggttaatggttttggtaaaaaccaaatggatttgaagaaaatgactgatgaagtttccaagtatgcactttactttgtgtaccttggccttgttgtttgtatatcatcttatgcagagattgcatgctggatgtatactggagagagacaagtaagcaccttgagaaagaagtatttggaggcagtgcttaaacaagatgttggattctttgatacagatgctaggacaggagatatagttttcagtgtatcaactgatacactattagtccaagatgctattagtgagaaggttgggaatttcatacattatctatcaacttttctggctggacttgtggttggttttgtgtcagcatggagattagcccttctcagtgttgcagtgattcctggaattgcttttgctggtggattgtatgcttatacactcaccggccttacatcgaagagtcgcgaatcatatgcaaatgctggcataattgccgaacaggccattgctcaagttcgaacggtttactcttatgtcggtgagagtaaggcgctgaattcttattctgatgcaatacaaaacacattgaagcttggatacaaggctggaatggctaaaggtttaggcctaggatgcacatacggcatagcttgcatgtcatgggcactagttttctggtatgccggagtttttatcaggaatggacagaccgatggaggcaaggcattcaccgctattttctctgccattgttggtggaatgagtttaggtcagtcgttttcaaacttaggtgcatttagcaaaggcaaagcagccggatacaaattgatggaaatcatcaagcagaaaccaaccatagttgaagatctgtcggatggaaaatgcttagccgaggttaacggcaacattgaatttaaggatgttagtttcagctatccatcaaggccggatgtgatgatttttcagaatttctcaatctttttcccagccggcaaaaccgttgcggttgttggtggtagtggatctggaaagagtaccgttgtttccttgatcgaaaggttctatgatcctaatgacggtcaggttttgcttgataatgtggacattaagacgctacagctaaaatggttacgcgatcaaattggattggtgaatcaagagcctgctctatttgcaactaccattcttgaaaacatactctacggaaaacctgatgcaacaatggatgaagtcgaatccgcaacttctgctgcaaatgctcatagctttattacattgcttcctaatggctacaacactcaggttggtgagcgaggagttcaattatctggtggacaaaagcaaaggattgcaattgcaagagctatgttgaaaaatccaaagatccttctcttagacgaagcaactagtgctctcgatgcaggatccgaaagcattgttcaagaggcgctagaccgtctcatggttggtagaacaaccgttgttgttgctcatcgtttatcaaccattagaaatgtcgacagtattgctgttattcaacaaagagtagttgtcgagacaggaacacatgaagaacttttcgccaagggaggaacctacgcttccctaattagattccaagaagtggttggaaaccgagacttctcgaacccttcaactcgccggaatcgctcgtcaaggttgagtcattccctttcaactaagtccttaagccttaggtcaggaagcttgaggaatttgagctaccaatacagcaccggagccgatggtcgaatcgagatgatctcaaatgccgaaaccgataagaaaaatccggctccggatggatatttcttccgattactcaaaatgaatgcgcccgagtggccttactcgataatgggagccgttggatctgttctttctggattcattggtccaacttttgctattgttatgagcaatatgattgaggtgttttactatagaaactatgcatccatggagaagaaaactaaagagtatgttttcatatacattggtgctggaatttatgccgttggtgcgtacttgatacaacattacttttttagtatcatgggagaaaatctcaccacaagggttagaagaatgatgcttgcagctattttgaggaatgaagttggatggttcgatgaggaggagcacaactcaagtcttgttgccgctcgccttgccactgatgcagctgatgtaaagtcagccattgctgagaggatatcagtaattttgcaaaacatgacatctcttctcacttctttcattgttgctttcattgttgaatggagggtttctttactcatccttggaactttccctcttcttgttctagcaaattttgctcagcaactatctctcaaagggttcgccggcgatactgcgaaggctcatgcaaagacaagcatgattgcaggagagggagtaagcaacatcagaacagttgcagcattcaatgcacagaacaagatgttgtccatcttttgtcacgagctacgtgtccctcagagccaaagccttcgtcgtagtttgacatcgggactcttatttggcctctctcagcttgccctttatgcatctgaagctctcattctatggtacggtgcacatttagtaagcaaaggcctttccaccttctcgaaagtcatcaaggtgtttgttgtcttggtcatcacagctaattctgtggcagaaactgttagcctagctccggagattattcgtggtggtgaagctgttggttcagttttctcaattctcgaccgatcaactcgaattgaccctgatgatcctgatgctgaaatggttgaatcagttcgtggagagattgaacttagacatgttgatttcgcatatccttctagacccgatatgatggtgttcaaagatttcagccttagaattcgcgcaggtcagagccaagcacttgtcggggcaagtggttccggaaagagttctgttattgcattgatagaacgtttctatgatccacttgtcggtaaagtaatgatcgacgggaaagacattaggaggttgaatttaaagtctttaaggcttaagattggtttagtgcaacaagaaccggctttgtttgcatccagcattttcgacaacattgcatacggcaaagaaggcgcaacagaagccgaggtaatcgaagcggctcgtgcggccaatgtccatggatttgtgagtggtttacccgaaggttacaagacgccagtcggcgaaagaggtgtgcaactctctggcggtcaaaagcaaaggatcgctattgcaagagctgttcttaaggaccctgcaatacttttacttgatgaagcgacaagtgcacttgacgctgaatccgaatgtgtactccaagaagccttagagaggctaatgaggggtcgaaccactgttctcgtggctcatcgtttgtcaacaattcgaggagttgattgcattggtgtcgtgcaagacggtcgcattgtcgaacaaggaagccattctgaactcattagcaggccagaaggagcttattctagactcttgcagctacaacatcatcacatttgagatttttatttgataaaatatgatcatgataatgactttgtgagttgatgataattatgtttggtcccattaacctcatgctttgatttttcttttttagatgtagatatgtgttctttatgaggtttgtaccttaaggacaaaagtgctctattttcaatagagtatcaagtattatatattattaatcatatttcaaaggtgcacaagcatgttatctatctgtttttgttttagcttttcttgtactttactattaatataattcag

SEQ ID NO: 3092 - DNA, 4270 bp, Citrus sinensis
gtccactctttctctctttctttttccgttttgctttgttttgctctttgataatttctaacaaaccaggcttcacccgaacactttaactgtgttgttagttcaaaagggtgctttgatctttcattttttcaatgctttaatcggcttagatctctcttcattgagacttgaatacgttggttttttcttgctttggtgtattagataatggctgagccaactactgaagcagcaaagacgctgccaccagaggcagagaagaagaaagaacaaagcttgccattttttcaactcttttcatttgctgacaaatatgattggtgtcttatgatctttggtagcttaggagccgttattcatggctcttcgatgcctgtttttttccttctctttggtgaaatggttaatggctttggcaaaaaccaaactgatattcacaaaatgactcatgaagtttgcaagtatgcactttactttgtgtatcttggactcattgtctgcttttcttcttatgctgagattgcatgttggatgtacactggggagaggcaagtaagcactttgaggaagaagtatttggaagcagtattgaaacaagatgttggcttctttgacactgatgcaagaactggtgatattgtcttcagtgtttcaacggatactcttctcgttcaagatgccattagtgagaaggtggggaattttattcattatttgtcaacatttttggctgggctagtggttggttttgtatcagcatggaggttggcattgctaagtatagcagtgattcctggtattgctttcgctggaggcttatatgcatatactctcactggcctcacgtccaagagccgtgaatcatatgcaaatgccggcataattgctgagcaggccattgcacaagtccggacagtttactcgtatgtgggtgagagtaaggccctcaattcctattcagatgctatacaaaacacactgaaactaggatacaaggctggtatggccaaaggtcttgggcttggatgtacttatggaattgcttgcatgtcatgggcccttgttttctggtatgccggtgtttttatcaggaatggagtaactgatggaggaaaggcattcactgcaattttctctgccatagttggtggcatgagtttgggtcagtctttttcaaaccttggagcattcagcaaaggtaaagcagccggttataagctgatggagatcatcaaacaaaagccttccataattcaagacccaacaaatggaagatgcttggatgaggttaatggcaatatagaattcaagaatgtaacttttagctacccatcaaggcctgatgtgattatcttccgggatttctctattttctttcctgctggaaagactgttgcggttgttggtggcagcggatctgggaaaagcactgttgtctctctaattgaaagattctatgatcctaatgcagggcatgttctgctggataatgtggacattaaaacactgcaattgagatggttacgcgaccagatagggcttgtgaaccaagaacctgcactttttgctaccaccatacttgagaacatactctatggcaaacctgaggcaacaatggctgaagtggaagctgctgcttctgctgccaatgctcacagttttattacattgcttcctaatggttacagtactcaggtgggagagcgtggagtgcagctctctggtggacagaaacagagaattgcaattgccagggctatgttgaagaaccccaagatccttcttcttgatgaagcaactagtgcacttgatgcagggtcagagagcattgttcaagaagctttggaccgtctcatggttgggagaacaactgtagttgttgcccatcgcctctccaccattagaaatgtagacacagttgcagttatccagcaagggcaggttgttgagacaggaacgcatgaggaactgattgctaaggctggggcctatgcttcattaatccgattccaagaaatggtgaggaatagagactttgcaaacccatcaactcgccgctcacgttcaacacgtttaagccattcattgtcaacaaagtccctaagcctccgctctggcagcttaaggaatttgagctactcttacagtactggggctgatggccggatagagatggtttcaaatgctgaaactgaccgcaaaaatccagctcctgatggttacttcttgcggcttctcaagctaaatgctcctgaatggccatattcaataatgggtgctatagggtctgtgctttctggttttatcggtccgacctttgccatcgtgatggcctgtatgattgaggttttctactatagaaatcctgcatccatggaaaggaagactaaagaatttgtcttcatttacattggtgcgggtctttatgcagttgttgcatatttgattcagcattacttctttagcattatgggagagaacctcaccacaagagtgaggaggatgatgcttgcagcaatcttaaggaatgaagtcggatggttcgatgaagaagagcacaactcaagcctagttgcggctcgattggcaactgatgctgccgatgtgaaatcagcaattgctgatagaatttctgtgattctacaaaacatgacctcactgctcacatccttcatagttgcattcatagtggaatggagagtctcacttctcattctaggcacataccctctgcttgtccttgctaactttgctcagcaactgtctctcaaagggtttgctggagacaccgccaaggcccatgcaaagacaagcatgatagctggtgagggagtgagcaatatccgaactgttgcagcctttaatgctcaaaacaagatcctctccctgttctgccatgagcttcgtgtgccccaaagccaaacccttcgtcgtagtctaactgctggcattcttttcggcatctctcagtttgctttacatgcctctgaagctctcattctatggtacggtgttcaccttgttggcaaaggggtatcgacattttctaaggttatcaaggtttttgttgtcctggtcgtgaccgccaattcagtggcggaaactgtcagtcttgctccagagatcattagaggtggcgaatctgttggttcagtgttttccactttggaccgctctactagaattgacccagacgatccagatgctgagcccgtagaaacaattcgcggagaaattgaacttaggcatgttgattttgcctacccatcaagaccagatgtagttgtttttaaggactttaaccttagaatccgtgctggccagagccaagctcttgtaggtgctagtgggtctggcaagagttctgtgattgcattgattgagagattttacgatcctacagctgggaaagttatgattgatggcaaggatattcgtcgattgaacttgaagtcccttaggcttaaaattggtttggtgcaacaagagccagccctgtttgcggcgagcatttttgataacattgcatatggaaaagaaggtgcaactgaagcagaagtcgttgaggccgcccgtgctgctaatgtgcatgggtttgttagtgcattgcccaatgcgtacaaaacaccagttggtgagagaggggttcaactctctggtggacagaagcaaaggatagcaattgctagggctgttctcaagaacccagcaatacttctgcttgatgaggccacaagtgcccttgatgctgaatctgagtgtgtgctacaagaagctcttgagaggctaatgaggggccgaaccacggttcttgtggctcaccgattatcaacaataagaggtgtagactgcattggagttgtgcaagatggccgcattgtagaacagggtagccactccgaattggttagccgtccagatggggcatattctagacttttgcaattacagcatcatcatatttgagtgtgcttttggccttgattgtggtaattatgtttgggtccccattaacctcatgtttccatttttctttttgaatgatgatatgatagttgtagatatggaaatgtggagattatatcttaagaactactgccccattttccaatggggtatcatgtgttatattattaatatctttggtgtataagcctgttgatctatctgtggttgattaggtgattggttggcttttcatctccagttgtaattgcaattttataatatttgaaaagcaaatcaagacgcaacctttccagccctc

SEQ ID NO: 3093 - DNA, 4463 bp, Glycine max
cataacactattcacttgactcctttatctctgtggctttatcaacctaaccgtgatccatcatcatactagtatgctctaattcacaaccacagtaaaaccaaaccactaacactataaaaccacacttcacacctctctctcttcccaaactcttgttcttctccccaatttcctttgaccactgttcaccaagacacacacacacactctcactctctttgctctctctaccaaaccaaaaaacgatattgacactgcaaaaaagagtgatatagcaaaaggggttgttgtttcagatctccttcattcaatgtcaagaaagaagtcacaacattacacaccccactaggcctagatctccttgttcatggcattgagccacgagtcactctaaaaatcccattttctacccttttgttcttatcacatcagaacctctgtttcatagctgggggtgtttgtgttgtgacttgttctaatggctgaagcttctgagcctaaagcattgcctgaggcagagaagaagaaggagcagactctgcccttttacaagctcttctcatttgcagacaagtgtgattggatgctcatgatctctggcagcataggagccattgttcatggctcatccatgccagttttcttccttctctttggtgaaatggttaatggctttggcaaaaaccaaatggacttgaagaaaatgacagaagaagtatcaaagtatgctctctatttcgtgtaccttggtcttgtcgtttgcatatcatcctatgcagaaattgcatgttggatgtacactggggagaggcaagtgagtacactgagaaagaagtacttggaggcagtgcttaaacaagacgttggtttctttgacacggatgcaagaacaggagatatagtttttagtgtctccacagatacacttctagttcaagatgctataagcgagaaggtggggaacttcatccactatctatcaacgtttctggcgggtctagtggttggctttgtttcagcatggaggcttgcacttctgagtgttgcagtgattcctgggattgcttttgctggtggattgtatgcttacacactcactggcctcacatcaaagagtcgtgaatcttatgcaaatgcgggcatcatcgccgagcaggccattgctcaagttagaactgtttactcttatgttggtgagagcaaggcattgaattcttattctgatgcgatacaaaacacattgaagcttggatacaaggcagggatggccaaaggattaggtctaggatgcacatatggaatagcttgcatgtcttgggcactagttttctggtatgctggagttttcatcaggaatggacaaacagatggtggcaaggcattcaccgctattttctcggccattgttggtggcatgagtttgggacagtcattttcaaacttaggcgctttcagcaaaggcaaagcagctggatacaaattgatggaaatcatcaatcagaaacccaccatagtggaagatccatcggaaggaaagtgcttagccgaggttaatggcaacattgaatttaaggatgtcactttcagctacccttcgaggccggacatgtttatctttcgcaatttctcaatctttttccctgctggtaaaactgttgccgttgttggtggtagtggatctggaaagagcacagttgtttccttgatagaaaggttctatgatccaaatgaaggtcaggttctgctggataatgtggacattaagacactgcaactaaaatggttgcgcgatcaaattgggttggtgaatcaagaacctgcactctttgcaactactattcttgagaatatactctatggaaaacctgatgcaacaatggctgaagtggaagctgctacttctgctgcaaatgctcatagctttattaccttgcttcctaatggctataacactcaggtaggagagcgaggagttcaattatctgggggccaaaagcagagaattgctattgccagagctatgttgaagaatccaaagattcttctgctagatgaagcaactagtgctcttgatgcaggatctgaaagcattgttcaagaggcactagataggctcatggttggaagaacaaccgtggtagttgcgcatcgtctatcaaccataaggaatgttgataccattgcagttatacaacaaggacaagttgttgagacaggtacacatgaagaactcattgccaaggcaggcacctatgcctcactcattcggttccaagaaatggttggaaatagagacttctccaacccatcaactcgccggactcggtcatcacgcctgagccattcgctgtcaacaaagtccttgagcctccggtccggaagcttgaggaacttgagctaccagtacagcaccggagctgatggccgcattgagatgatatcaaatgctgaaacagacaagaaaaatcctgccccagatggatatttcttcaggttgctgaagatgaatgctcctgagtggccttactcaatcatgggagctgtgggttctgtcctttctggattcattggccctacttttgccattgttatgagcaacatgattgaggtcttttacttcagaaattatgcatccatggagaggaagactaaggagtatgtcttcatctacattggtgctggtctctatgcagttggtgcatacttgatacaacattacttctttagtatcatgggagaaaacctcaccacaagggtcagaagaatgatgcttgccgctattttgaggaatgaagttggatggttcgatgaggaggagcacaactcaagccttgttgcagctcgccttgccacagatgcagctgatgtcaagtctgccattgctgagagaatatcagtgattctacagaacatgacatctctccttacttctttcatagttgctttcatagtggaatggagggtttccttgctcatcttggcaaccttccctctccttgttctagccaattttgctcagcaactatcactaaaagggtttgctggagacacagccaaggctcatgcaaagacaagtatgatagcaggagagggagtgagcaacatcagaacagttgcagcattcaatgctcagaacaagatgttatcagtgttctgccacgagcttcgtgtgcctcagagccagagcctgcgccggagccagacatccggcttcttgtttggcctctctcagcttgccctctatgcttccgaggctctcattctatggtatggtgcacatttggtcagcaaaggtgtttcaaccttctccaaagtcatcaaggtgtttgtggtcttagtgatcacagcaaattcggtggccgaaaccgtgagccttgcaccggagattatccgtggtggcgaagctgttggttcagtgttctcaatccttgatcgctcaaccagaattgaccctgatgatcctgatgctgatccagttgaatcgcttcgcggggagattgagctcagacatgttgattttgcgtacccttctaggcctgatgtgatggtgttcaaggatttgaaccttaggatccgtgcaggccagagtcaagcccttgtgggggcaagtggttcggggaagagttctgttattgcattgattgagagattctatgaccctattgctggaaaagtgatggttgatggaaaggacattaggaagttgaacttgaagtctttgaggctcaagatcgggttggtgcagcaagagccagcactttttgcagcaagcatttttgagaacattgcatatgggaaagaaggtgcaactgaggctgaggtgattgaggccgcacgtgctgccaacgtgcacgggtttgtgagtggtttgcccgagggttacaagacaccggttggcgagagaggtgtacaactctctggagggcaaaagcaaaggattgctattgcaagagctgtgcttaaggaccccacaattcttctactagatgaggccacaagtgcactagatgctgagtctgagtgtgtgctacaagaggccttggagaggctaatgaggggtcgcaccacggtgctcgtggctcatcgtttgtcaacaattagaggggttgattgcattggagtggttcaagatgggcgcattgtagagcaaggtagccattctgaacttgtcagcaggcctgagggggcatattctagactcttgcagctacaacatcatcacatatgagagggattattgttttttttttatttatttatttgatgaatatgaccttgtgggggtgataaattatgtttgggtcctattaacctcatgctttggtttagatgtagatatgtgggatatgaggtttgtatcttgaggacaaagtgatctatttccaatggggtatcaattattatatttaatcacaagccaatgggtgcataagtctgtcatctatctggtgttttgagcc

SEQ ID NO: 3094 - DNA, 4442 bp, Phaseolus vulgaris
tgcacagaaccccataacactgttcactcgattcctttatctttgtggctttatcaaccaaacagtgaatttacaaccacagttaaaccaaaccactaactctataaaaccacacttcacacatctctctcttcccaaactcttgttctcttcaacttcctttgaccactgtccaacaacacacacacactcttctctctctctctctctcaacttctctgctatctctaccaaaccaaaaacgatattgacactgcaaaaaaagagtatattgaaaaaggggttgttgtttcagatctccttcattcaatgtccagaaaaaagtcatatggcacacaccactagggctagatctccttgttcatggcattgagccacgagtcagtctaaaaatcctattttgtttccacccttttgttctccccgccccagaagctgtgtttctgtgatttgctctcatggctgatgctgctgagcctaaagcattgcctgaggcagagaagaagaaggagcagactttgcccttttacaagctcttctcatttgctgacaagtgtgattggatgctcatgatctctggcagcttaggagccattgttcatggctcatcaatgccggttttcttcctgctctttggtgaaatggttaatggctttggcaagaaccaaatggacttgaagaaaatgacagaagaagtatcgaagtatgctctctatttcgtgtaccttgggcttgtcgtttgcttatcatcctatgcagaaattgcatgctggatgtacaccggggagaggcaagtgagcacactgagaaagaagtacctggaagcagtgcttaaacaggacgttggtttctttgacacggatgcaagaacaggggatattgttttcagtgtctccacagacacactactggttcaagatgctataagcgagaaggtggggaacttcatacactatctatcaacgtttctggctggtctggtggttggttttgtgtcagcatggaggctcgcacttctgagtgttgcagtgattcctgggattgcttttgctggtggattgtatgcttacacactcactggcctcacatcaaagagtcgtgaatcttatgcaaatgcaggaataatagctgagcaggccattgctcaagctagaactgtttactcttatgttggggagagcaaggcactgaattcttattctgatgcaatacaaaacactctaaaacttggatacaaggcaggaatggccaaagggttaggcctaggatgcacatatggaatagcatgcatgtcttgggcactggttttctggtatgctggagttttcatcaggaatggacaaacagatggaggcaaggcattcacggctattttctcagccattgttggtggcatgagtttgggacagtccttttccaacttaggtgctttcagcaaaggcaaagcagcgggatacaaattgatggagatcatcaatcagaaacccaccatagtggaagattcatcagaagggaagtgcctagctgatgttaatggcaacattgaatttaaagatgttactttcagctacccttcgagaccggatgtgtttatctttcgcagtttctcaatctttttccctgctggaaaaactgttgcggttgttggtggcagtggatctggaaagagcacagttgtttccttgatagaaaggttctatgatccaaatgaaggtcaggttctgctggataatgtggacatcaagagtctacaactaaaatggttacgtgatcaaattgggttggtgaatcaagaacctgcactctttgctactaccattcttgagaatatactctatggaaaagctgatgcaactatggctgaagtggaagctgctacttctgctgcaaatgctcatagttttatcaccttgcttcctaatggttacaacactcaggtaggagagcgaggagttcaattatctgggggccaaaagcagagaattgcaattgccagagccatgttgaagaacccaaagatccttctactagatgaagcaactagtgctcttgatgcagggtctgaaagcatagttcaagaggcactagacaggctcatggttggaagaacaactgtggttgtggcacatcgtctatcaaccataaggaatgttgataccattgcagttatacaacaaggacaagtagttgagacaggcacacatgaagaactcattgccaagacaggcacatatgcttcactcattcggttccaagaaatggttggaaatagagacttctccaacccatcaacccgcaggactcggtcatcgcgattgagccattcattgtcaacaaagtccttaagtctcaggtctggaagcctgaggaacttgagctaccagtatagcactggtgccgatggccgtattgagatgatatcaaatgctgaaacagacaagaaaaatcctgccccagatggatatttcttcaggttgctcaagctgaatgctcctgagtggccttattcaatcatgggagctgttggttctgttctttctggattcattggccctacttttgctattgttatgagcaacatgattgaggtcttttacttcagaaattatgcttccatggagaggaagactaaggagtatgtcttcatttacattggtgccggtctctatgcagttggtgcatacttgatacaacattacttctttagtatcatgggagaaaacctcaccacaagggtcagaagaatgatgcttgccgctattttgaggaatgaagttggatggttcgatgaggaggagcacaactcaagccttgttgcagctcgccttgccactgatgcagctgatgtcaagtctgcaattgctgagaggatatcagtgattctgcagaacatgacatctctccttacttcttttatagttgctttcatagtggaatggagggtttccttgctcatcttggcaaccttccctctacttgtgctagccaactttgctcagcaattatctctaaaagggtttgctggagacactgcaaaggctcatgcaaagacaagtatgatagcaggggagggagtgagcaacatcagaacagttgcagcattcaatgctcaaaccaagatgttatctgtgttctgcaatgagcttcgagtgcctcagcgccagagtctgcggcggagcctcacatccggcttcttgttcggtctctctcagcttgccctctacgcctcagaggctctcattctatggtacggtgcacatttggtgagcagaggtgcttcaaccttctcaaaggtcatcaaggtgtttgtggtgctcgtgatcacggcaaattcggtggcggaaaccgtcagcctggcgccggagataatccgcggcggggaggccgttgggtcggtgttctcaatccttgaccggtcgacaaggattgacccggatgatcccgatgctgacccggtggagactctgcgcggggagatcgagctgaggcatgtcgattttgcatacccttcaaggcctgatgtgatggtgttcaaggatttgagcctgaggatccgtgcagggcagagccaggctcttgtgggggcaagtggatcagggaagagctctgtgattgctctgatagagagattctacgaccctattgcagggaaagtgatggtggatgggaaggacataaggaagttgaacctgaagtctctgaggctgaagatagggttggtgcagcaagagccagcactttttgcagcaagcattttcgagaacattgcatatggaaaagatggtgcgagcgagggtgaggtgatagaggctgcacgtgcagccaatgtgcatggatttgtgagtggcttgccagagggttacaagaccccggttggtgagagaggagtgcagctttctggagggcagaagcagaggattgccattgctagggcagtgctcaaggaccctgcaattctccttctggacgaggccacaagtgccctagacgctgagtcggagtgtgtgctacaagaagccttggagaggctaatgaggggtcgcaccacagtgcttgtggctcatcgtttgtccaccattagaggggtggattgcatcggagtggttcaagatgggcgcattgtggagcagggtagccatgcagaacttgtgagcaggccagagggggcatattctagactcttgcagctgcaacatcatcacatatgatgaatgagagagagacagagaagagacagagagaaacagagagagagattattgttttttatttgataaatatgaccttgtggggtgataattatgttatctcatgtgtttttaggtgtagatatgtgggatatgatgatgaggtttgtaccttgaggacaaagtgatctattatggcttatcaattattatattaatcacatgccaatgtgcatatatgcatgcaatctaaca

SEQ ID NO: 3095 - DNA, 4337 bp, Eucalyptus grandis
cttggcgtcaagactctcggcaaactctcactgtcgctctcattctctctctactcatggtctcggccttttttctctccagcgaaggcgagctgatgaacgaaactgctgcactgtcagtgcccctgtagagagagagaggaggagcggggagagagagagagagagagagagcacggacaagagaggaaagggtggtcatcagatctttccttcaatggcgaaaatccagcgacaccatcctcgttcttgagctctcctgaagtgtttcgtcatcccgatttgaccgaccagctgatcccttgtcaatctctcctgctaatctcgagacaagcgagcgagcgagagagacagagaggcagagaaagacgcaaaaaagatggcagagagtggagatggaaaagcattgcccgatgcagagaagaagaaggaccagagcttgcccttttaccagctcttctcgttcgccgacaagtacgattggcttctcatgatctctggcagcttgggagctataatccacggatcttcaatgcccgtcttcttcctcctgtttggcgaaatggttaacgggttcggcaagaaccagtccgatttgaagaagatgacccaagaagtgtccaagtacgcactttacttcgtgtatcttgggctggtcgtttgcttgtcttcctacgcagagattgcttgttggatgtacaccggagaaaggcaagcgagcaccttgcggaagaagtacttggaggccgtgttgaggcaagacgtggggttcttcgacaccgatgctcgaactggagatatcgtcttcagcgtctccacggatactctgcttgtccaagatgccattagcgagaaggttggcaacttcatacactacctgtcgacgtttctggctgggctggtggttggtttcgtggccgcatggaggcttgcgctgctgagtgtggctgtgattcctggaatcgcttttgccggaggcttgtatgcttatacgctcaccggtctcacgtctaagagtcgcgaatcttatgcgaatgctggcataatcgccgagcaggcgattgcgcaagtccggaccgtctactcttacgttggcgagtgcaaggccctgaattcctactcagacgcgatacagaacacgctgaagcttgggtacaaggccggtatggccaagggcttggggttgggatgcacatacgggatcgcatgcatgtcatgggcgctcgtcttctggtatgccggtgttttcatcaggaatggacagacagatggagggaaggcgttcacagctattttctctgccattgttggtggcatgagcttgggccaatcattttcgaacctcggagcattcagcaaaggcaaagcagcgggatacaagctgatggaagtgatcaggcaaaagccttccataggtcacgatccttccaatgggaaaaccttgcctgagatcaatgggaacattgagttcaaggatgtgacgttcagctacccgtcaaggccggacgtcatcatcttccgcaatttctccattttcttcccggcgggaaaaacagttgctgttgttggcgggagtggctctgggaagagcactgttgtgtccttgatcgagagattctacgatcctaatcaagggcaagttttgctggacaatgtcgacctgaaggcactgcagctgaaatggctaagggatcagattggccttgtcaatcaagagcctgctctctttgccaccaccatactcgagaacataatttacggtaagccagatgccacaatggccgaagtggaagcagctgctactgcggcgaatgctcatagcttcatcaccttgcttcctaagggttacagtactcaggtaggagagcgaggagtccagttatcgggaggtcagaaacaaaggattgcgattgcgcgggccatgttgaagaaccctaaagtcctcctactcgatgaggccaccagtgcgcttgatgccggctcggagagcatagtccaggaggcacttgaccgcctcatggtaggccggacgactgtggtcgtcgcgcaccgtctctccaccatcaggaacgtcgacagcattgcggtgatacagcaggggctggtcgttgagaccgggacccacgaggagctgattgccaaggctggggcctacgcctctctgatcaggttccaggagatggttgggaacagagacttctcaaacccgtcaacccgcaggtgtcgctcgtcgcggctaagccactcactttcgaccaagtccctgagtctccggtctggcagtctgaggaatctcagctactcatacagcactggtgccgacggccgcatcgagatggtgtcaaatgccgagaccgagaggaggaaccccgcgcctgatggctacttctgcaggctcctcaagctgaatgctcccgagtggccctactccataatgggcgccgcagggtctgtgctctcagggttcatcgggccaacctttgcgatcgtcatgagcaacatgattgaggtgttctactacaggaacccggcctccatggagaggaagacgaaggagtatgtgtttatctacataggggccggcctctatgccgttgttgcgtacctgatccaacattacttcttcagcatcatgggagagaacctcaccaccagagtgaggaggatgatgcttgcagcaattctgaggaatgaagtcggatggttcgatgaggaggagcacaactcgagcctggtggcggctcggttggcgaccgacgctgcagatgtgaagtcagcgatcgctgagaggatctcggtgatattgcagaacatgacctcgctgctcacttccttcatcgtggctttcattattgagtggagggtgtctctcctgatcctggccaccttccctcttctggtccttgccaacttcgctcagcaactctctctcaaaggctttgctggagacacagccaaggcacatgccaagactagcatgattgcgggagagggagtgagcaacatcagaactgtcgcggcattcaatgcccaaaacaggatcctctccttgttctgccacgagctccgtctcccacagatgaggagccttggccgaagccaaaccgctggcctcctctttggtgtctctcaacttgctctctatgcttctgaggccctgattctatggtacggtgcccaccttgtgagcaggggcatgtccaccttctccaaggtgatcaaagtttttgttgtccttgtgatcactgccaattccgtcgcagagaccgtgagccttgccccagagatcatcaggggtggtgaggcggtgggatctgtcttttccattttggaccgtcagacgaggattgaccctgacgatcctgaggctgagcaggttggctcgttacgtggggagatcgaactcaggcatgttgactttgcttatccatcacgacctgatgttgttgtattcaaagacctcaaccttaggatccgtgctggccatagccaagctcttgttggagccagcgggtcgggcaagagctcggtcattgcacttattgagcgcttctatgacccgatcgctgggaaagtcatgattgatggcaaggatataaggaggctcaacttgaagtctcttaggctcaagattggactggtccaacaagagccggccctctttgctgcaaacattttggacaacattgcatatggtaaagagggtgcgactgaagctgaagtgattgaagctgctcgcacagccaatgtgcatggatttgtgagcgcattgcccgacggttacaaaacccccgtcggggagagaggggtccaactctctggagggcaaaagcaaaggattgcaatagccagggctgtcctcaaggatcctgcgatcctcctgttggacgaggcgacgagtgcacttgatcctgaatcagagtgcgtgctgcaagaagcccttgagcggctgatgcggggccgcacgaccgtgctggtggctcaccggctctcgaccataagaggggtggacagcattggcgtggtccaggatgggcggatcgtggagcaaggaagccacgccgagcttgtgagccgaccagaaggggcctactcgagactcttgcagctacagcttcatcacatatgaaaaagcggttcccttttttcctagaattgtagggaactttattgcacttgtgggatggtgactatgctggggtccaatcgatcttgtactcaattcctgataaaagttgtagatatgggcatgtgaaggttgatattttctgaaactacagatctactattatttcctatctatgattaatgagatatattttatcgactaaacgaaa

SEQ ID NO: 3096 - DNA, 4227 bp, Tabernaemontana elegans
tactggcccaattcgatcatttgctttgactactggtcataacgcccactgccccggctttctgtttccggcaaaccaagccctccttctctgctaaggtactgctaaggaagagagagtagcttctcactcccatctctctttctttatgatttcttgaacccataatactagccgacacattgtcagttcttcaagactgtgatatagaaattaagaatcccagatacgaatacgtacaaacaaatcgctcgctcttcagatctctctctctctctcaagcatccagtgcccacgccgtgtgctcagcagcggcattatgataataacatggtgaagcgcccgatgcgccgagatcatcagctggcaaccgggcactgataacacagcaagggtgttttattgtagtgttgcaagttttttcttctggggtagttgagaaggctggacttctgaaatggctgagactactgaagggaaagtaatgccggaagcggagaagaagaaggagcaaagtctcccattctatcagctgttttcatttgctgataaatatgattatcttttgatgatctctggaagccttggagctatagttcatggttcctctatgcctgttttcttcctcttgtttggcgagatggtgaatggcttcggcaaaaaccaaactgatttgcataaaatgacccacgaagtctcaaagtatgctctgtactttgtctaccttggattggtagtgtgtttttcatcctacgctgagattgcttgttggatgtacaccggggagaggcaagcgggagctctgagaaggaagtatttggaggcggtgttgaaacaggacgtgggattctttgatacagatgctcggacaggggacattgttttcagtgtctcaacggacactcttcttgtccaagatgccatcagtgagaaggtgggaaatttcatccattatctttctacgtttttggctggtttggtggttggttttgtgtcagcatggaggctagctttgcttagtgtggcagtgattccgggaattgcttttgccgggggtttgtatgcatacacactcacaggtctcacatccaagagtcgtgaatcttatgccaatgctggcataattgcggagcagaccattgcacaagttaggacggtttactcttacgttggtgagagtaaggctctcaaggcctactcagatgcaatacagaatactttgaagcttggatacaaggctggaatggccaaaggcctgggactgggatgcacctatggaatagcatgcatgtcatgggcccttgttttctggtatgctggtgtgtttatcaggaacgggcaaactgatggtggaaaagcatttactgctattttctctgccattgttggtggcatgagtttgggccagtcattttcgaacctcggagcattcagcaaaggcaaggctgcgggatacaagttagtggaaattatcaaacaaaagccaacaatagtccaagaccatacagatggaaagtgcttgactgaggttaatgggaacattgaattcaaaaatgtgacttttagctatccctccagacccgatgtcattatcttcagagatttctctattttcttccctgccggaaagacagttgctgttgttggtggtagtggttcaggaaaaagcacggtggtctccctgattgaaaggttctatgatccgaatcagggtgaaattcttctagacaatgtggacataaaaacactacaattgcgatggttgagggatcagattggtctggttaaccaagaacctgcactatttgccacgaccatacttgaaaacatactctatgggaagcctgatgcaaccatggctgaagtggaggctgctgcctctgctgcaaatgctcatggctttgttactttgcttcctaatgggtacaacactcaggtaggagagcgtggggttcaactttctggtggtcaaaaacagagaatagcaattgctagagctatgttgaaaaaccccaggatcctcctgcttgatgaagccactagcgcccttgatgcaggctcggaaagcattgttcaagaagctctagaccgtctcatggttggaaggacaacagtggttgttgctcatcgcctttcgaccataagaaatgttgacggcattgcagttatacagcaagggcaagttgttgaaactggaacacatgaagaactggttgccaaagcaggggcttatgcttccctaattagattccaggaaatggtggggaatagagacttttcaaatccttcaactcgtcgttcacgctcttcccggctaagccactcactgtcaactaaatcactaagccttcgctctggcagtttaagaaatttaagctattcatacagcacaggtgctgatggtcgtattgagatggtgtcaaatgctgaaacagaccggaaaaatccagctccagatgggtacttctgtaggcttctcaaactaaatgctcccgagtggccttattcaatcatgggtgctgttgggtcggttctctctggattcattggtccaacttttgcaattgtgatgagcaatatgattgaagtgttctattacaaaaatcctgccagcatggaaaggaagacaaaggagtatgttttcatttacattggagctggtctctatgctgttgttgcatatttgattcaacattacttcttcagcattatgggagagaacctcactaccagagtaaggaggatgatgcttgcagcaattttaaggaatgaagttggatggtttgacgaggaggagcacaattcaaacctcttggctgctcggttagccacggatgctgccgatgtaaaatcagccattgccgagagaatatctgtgatcctgcagaatatgacctctctcctaacttcatttatagtagccttcataattgaatggaaggtctcactgcttatcctagctaccttcccacttctagtcctggccaactttgctcagcaactgtcagtaaaaggatttgctggcgacacagccaaggcccatgctaagaccagcatgatcgcaggggaaggagtaagcaacatcagaaccgttgcagcattcaatgcccaagaaaagattctttccttgttctgccaggaacttcgcgtcccacagctccgcagtctccgtcgaagccaaacctcagggcttctctttggtcttgcgcagcttgctctttattcttcagaagctttaatcctttggtatggtgcacacctcgttagcaagggtgcttctaccttctcaaaggttattaaggtttttgtggtcttagtcattacagccaattcagttgctgaaactgttagccttgccccagaaataattaggggtggtgaagctgttggttccgtattttccattcttgatcgcccaacaaggatagatgcagatgatcctgaggctgagcctgttgaatcaatacggggtgacattgaattacgacatgttgatttcacgtatccttcacgacctgatgtctctgtattcaaagacctcaaccttagaatccgtgctggccagagccaagctctagtgggggccagtggatcggggaagagttctgttattgcactgatagaacgtttctatgatccaatagcgggtaaagtcatgatcgacgggaaagacattagaaggttgaacttgaagtctctgcgactcaaaattgggctggttcagcaagagccagctctctttgcagcaagcatctttgacaatattgcctatggtaaagatggtgcaaccgaagcagaagtaatagaagcagctcgtgctgcaaatatgcacacatttgttagtggcttgcccgaaggctacaaaaccccggtaggagaaagaggagttcaactctccgggggacaaaaacaacgaattgcaattgcacgcgccgttctgaaggacccaactatacttctcctagacgaagctacaagtgctcttgatgccgagtcagaatgtgtgctgcaagaagccctggaaaggctcatgagaggtcgaactactgttcttgtggcgcacaggttatcaaccataagaggagtggatagcattggagttgtgcaagatggacgaattgtagagcagggcagccatggtgaactgatcagccggcctgatggagcatattctaggcttttgcaactacagcacaatcacatatgagaaatgaattttttttttct

SEQ ID NO: 3097 - DNA, 4314 bp, Gossypium raimondii
ggctgctttgccctttactttttcccttctcttcagctgagttctcgaacttgataaactcaaaaacggcattgtcagattttcgagaccttaaaaaaagaaagtgtgagagagaaagagagagagttatgtagaaaaagagtctcttttagatctcatcttcttctttcatcttcagatcttcccccactccactcgtctttttctatctttcaatggctattcttctcacactttaacttaatttccaccgagtcatcccaacccattggacctctttctccctttctacctctttttttcttgattctgaaacttgggttagctttgtttctttttttgagttttaaaaatggctgaaacaacagaaacaaaaacagttcctgaagcagagaagaagaaagaacaaagcttaccgttttaccaacttttcacttttgctgacagatatgattacatgttaatgatctctggtagcttaggagctattatccatggttcctcaatgcctgttttcttcttattatttggtgaaatggttaatggctttggcaaaaaccaatctgatttgcccaaaatgactcatgaagttgccaagtatgcactctattttgtctatcttggtcttattgtctgcttatcatcttatgcagagattgcatgttggatgtacactggggaaagacaagtgagtacattaaggaagaagtatttagaagcagttttgaaacaagatgtaggattctttgacactgatgcaagaactggagatattgtttttagtgtttcaactgatactttgcttgtccaagatgccatcagtgagaaggttggaaactttatccattacttgtcaactttcttggctggtttggtagttggttttgtatcagcatggaggttagccttattaagtgtagcagtgatccctggaattgcatttgctggaggtttatatgcatatactttaaccggcctcacttcaaaaagccgggaatcctatgcaaatgccggcataattgccgagcaggcgattgcacaagtccgtaccgtttactcatatgttggtgagagcaaggcccttaattcttactcagatgcaatacagaacacactaaaactaggatacaaggctggtatggccaagggtttggggctcgggtgtacgtatggcatagcttgcatgtcttgggcgcttgttttctggtacgctggtgtttttatccggaatggacagactgatggaggcaaggcgttcactgcaattttctcggccattgttggtggcatgagtttgggtcagtcattctccaatctcggagcctttagtaaaggaaaaacagctggttacaagttgatggagattatcaagcaaaaaccctccataactgaagatcatttggatggaaaagtacttcccgaggtcaatggcaacatagaattcaaggatgtcacgttcagttacccttcaagacctgatgttatcatctttcgcaacttctcaatcttctttccggcaggaaagaccatggcagttgttggtggtagtggttctgggaaaagtacagttgtgtctatggtagagaggttctatgatcccaacgagggacaggttttgttggataatgtggacataaagatactgcaactaaaatggttacgcagtcagattggattggtgaatcaagaacctgcactctttgcaactacaatcctcgagaacatactctatggaaagcctgatgcaacaatggatgaagtggaagctgccgcttctgctgcaaacgctcatagttttattaccctacttcctaatgggtatagcactcaggtgggagagcgaggagtccaattgtcgggtggccaaaaacagagaattgctattgctcgagccatgttgaagaacccgaagatcttgctccttgatgaagcaacaagtgcacttgatgcgagctccgagagtattgttcaggaagctcttgatcgtcttatggttgggagaacaactgtagttgttgcacatcggctctcaaccataaggaatgttgattctatagctgttatacagcaaggacaagttgttgagattggaactcatgaggaattgatttctaaggcaggagcatatgcttcattaatcagattccaagaaatggtgggaaatagagacttcgctaacccatcaacgcaccgttctcgttcatcacgtctaagtcattcactgtcaaccaagtccttaagcctccggtctggcagcttacggaacttgagctattcttacagtactggtgctgatggccgaatagagatgatctcgaatgctgagacggagcgtaaaaatccagctccacatggctatttctgccggcttctcaatctaaatgctcctgagtggccctattcaattatgggagctgttggttctgtgctctccggtttcatcggaccaacttttgccatagtaatgagcaatatgattgaggtgttctactatacaaatccgacctcgatggaaagaaagacaaaagaatatgttttcatctacattggggctggtctctatgctgtcgtcgcatatttgattcagcattatttcttcagtatcatgggagaaaacctcacaacaagagtgaggagaatgatgcttggagcaattcttaggaacgaagtcggatggttcgatgaagaagagcacaattcaagtcttcttgcagccaaattggcagctgatgcagctgacgtaaaatctgcaatagctgagcggatctcagtcatactccaaaacatgacttcacttctcacctccttcatcgtcgccttcattgtagaatggagggtctctcttctcatcctcggtaccttccctcttctagtccttgcaaactttgctcagcaactctctctcaaagggtttgctggtgacactgcgaaagcacatgcgaagactagcatgattgccggcgaaggtgtaagtaatatcagaacagttgcagccttcaatgcacaaaacaagatcctttcgctattttgtcatgagctccgagttccacagatgcaaagccttcgtcgcagccaagtttctggcctcctttttggtctatctcaacttgctctttacgcttcggaagctctcatactttggtatggtgcgcaccttgtaaacaaaggtgcctccacattctcgaaggtgatcaaggtttttgtggtcttggtggtcacggcaaattcagtggcggaaactgttagtcttgcccctgaaatcattaggggtggtgaagctgttggttcagtgttctccattttagatcgttcaaccaggattgatccggatgatcctgaagcagaaccagttgaatcaattcgtggagaaatcgagcttaggcatgttgattttgcatacccttcacgacctgatgtcatcgtgtttaaagaccttaaccttcgaatccgtgctggtcaaagccaagcacttgttggagctagtggctctggcaagagttcagtcattgcattgatcgaacgcttctatgatcctacagctggaaaggttatgatcgacggaaaagatatccggagattgaacttaaagtctcttaggcttaaaatcggattggtacaacaagagccagccctctttgctgctagcattttcgataatattgcttacgggaaagaaggagcaactgaagctgaagtaattgaggcagcccgagcagctaacgtgcatggttttgtcagtgcattgcctgatgggtacaaaacacctgttggtgaaagaggggttcagctctctgggggtcaaaaacaaagaatcgcaattgcacgagccgtgctaaaggacccaacaatactattactcgacgaggccaccagcgcacttgatgctgaatccgagtgtgtactacaagaagcactggaacggctaatgaggggtcgcaccacagtacttgtggctcaccgtctctcaacgataagaaatgtagacagcatcggagtagtgcaagacggtcgaattgtggaacaaggcagccactcggaattgatagcccaacccgaaggagcctattcaaggctgttgcaactacaacaccatcacatatgatataatatagctgtagatatgggaatgctgtagactggctgtatcaatggcccccatttccaatgagatgaaaaaaatgttaaattattgagatatatatgaatggtggataagccccaatatgtgttgattggcttttactttctgtaattgaaatttttataatactataaagtggaaaccctagacatcacctttccagcctttatcaa

SEQ ID NO: 3098 - DNA, 4092 bp, Cajanus cajan
tgtttagtcgttggggtgttgtgacttgttaattctcatggctgaagttgctgaacctagagcattgcctgaggcagagaagaagaaggagcaaagtttacccttttacaagcttttctcatttgcagacaagtatgattggatgctcatggcctcaggcaccataggagccattgttcatggctcatccatgccctttttcttcctcctctttggtcaaatggttaatggctttggcaaaaaccaaatggacttgaagaaaatgacagatgaagtatcaaagtattctctctacttcgtgtaccttggccttgtcgtttgcatatcatcctatgcagaaattgcatgctggatgtacactggggagaggcaagtgagcacgctgagaaagaagtacttggaagcagtgcttaaacaagacgttggattctatgacacggatgcaagaacaggagatattgtttttagtgtctccacggatacactactagtccaggatgctataagcgagaaggtggggaacttcattcattatctatcaacgtttctggcgggtctagtggttggttttgtgtcagcatggaggctagcacttctgagtgtggcagtgattcctgggattgcttttgctggtggattgtatgcttacacactcactggcctcacatcaaagagtcgtgaatcttatgcaaatgctggaacaatagcagagcaggccattgctcaagttagaactgtttactcttatgttggtgagagcaaggcactgaattcttattctgatgcaatacaaaacacacttaagcttggatacaaggcaggaatggccaaaggtttaggcctaggatgcacatatggaattgcatgcatgtcttgggctctagttttctggtatgctggagttttcatcaggaatggacaaacagatggaggcaaggcgttcacagcaattttctcggccattgttggtggcatgagtttgggacagtcgttttcgaatttaggcgctttcagcaaaggcaaggcagctggatacaagttgatggaaatcatcaaacagaaacctaccatagtggaagatccattgcaaggaaagtgcttagctgaggttaatggcaacattgaatttaaggatgttgcattcagctacccttcgaggccagatgtttttatctttcgcagtttttcaatctttttccctgctggaaaaactgttgcggttgttggtggtagtggatctggaaagagcactgttgtttctttgatagaaaggttctatgatccaattgaaggtcaggttctactggataatgtggacattaagacactacaactaaaatggttacgtgatcaaattggattggtgaatcaagaacctgcactctttgcaactaccattcttgaaaatatactctatggaaaacctgatgcaacaatagctgaagtggaagctgctacttctgctgcaaatgctcatagctttatcaccttgcttcctaatggctataacactcaggtaggagagcgaggagttcagttatctgggggccaaaaacagagaattgcaattgccagagctatgttgaagaatccaaagatccttctcttagacgaagcaaccagtgctcttgatgcagggtctgaaagcattgttcaagaggcactagacaggctcatggttggaagaacaaccgtggttgttgcacatcgtctatcaaccataaggaatgttgataccattgcagttatacaacaaggacaagttgttgagacaggtacacatgaagaactcatagccaaggcaggtacctatgcttcactcattcggttccaagaaatggttggaaatagagacttgtccaacccatcaactcgccggacacggtcgtcacggttgagccattcgttgtcaacaaagtcattaagcctccggtccggcagcttgaggaacttgagctaccagtacagcactggagccgatggccgcattgagatgatatcaaatgctgaaacagacaagagaaatcctgccccggatggatacttcctcaggttgctcaagttgaatgctcctgagtggccttactcaatcatgggagccgttggttctattctttctggattcattggcccaacttttgctattgttatgagcaacatgattgaggtcttttacttcagaaattatgcgtccatggagaggaagactaaggagtatgtcttcatttacattggtgctggtatctatgcagttggtgcttacttgatacagcattacttttttagtatcatgggagaaaacctcaccacaagggtcagaagaatgatgcttgccgctattttgaggaatgaagttggatggttcgatgaggaggagcacaactcaagccttgttgcagctcgccttgccactgatgcagctgatgtcaagtctgccattgctgagaggatatcagtgatattgcagaacatgacatctctccttacttcttttatagttgccttcattgtggaatggagggtttccttgctcatcttgggaaccttccctctccttgttctagccaatttcgctcagcaactatctctaaaagggtttgctggagacacagccaaggctcatgcaaagacaagcatgatagcaggagagggagtgagcaacatcagaacagttgcagcattcaatgctcaaaacaagatgttatcagtgttctgccacgagctccgagtgcctcaaagccagagcttgcgccggagccaaatttccggcctcttgttcggcctctctcagctagctctctacggctctgaggctctcatcttgtggtacggttcacatttggtgagcaaaggtgcttcaaccttctcaaaggtcatcaaggtatttgttgtcctagtgatcacagcaaactcagtggcggaaaccgtcagcctggctccggagatcattcgtggcggcgaggccgttggttcggtgtttgcaatccttgatcgctcgacaaggattgaccccgatgatccggatgctgagccagtcgaatcacttcgtggggagattgagctgagacatgttgattttgcatacccttctaggccagatgtgatggtgttcaaggatttcaaccttaggatccgtgcaggccagagccaggctcttgtgggggcgagtggctcagggaagagttctgtcattgcattgattgagcgtttctatgaccctattgctggaaaagtgatggtggatggaaaggacataaggaagttgaacttgaagtctttgaggcgcaagattgggttggtgcagcaagagccagcactttttgctgcaagcatttttgagaacattgcatatggtaaagagggtgcaactgaggctgaggtgatggaggccgcacgtgccgccaatgcgcatgcatttgtgagtagtttgcctgagggttacaagacatctgttggtgagagaggtgtgcaactctctggagggcagaagcaaaggattgctattgcaagggctgtgctcaaggaccctacaattcttttgctagatgaggccacaagtgcactagatgctgagtctgagtgtgtgctacaagaggccttggagaggctaatgaggggtcgcaccacagtgcttgtggctcatcgtttgtcaacaattagaggggttgattgcattggagtggttcaagatgggcgcattgtggagcaaggtagccatgctgagcttttcagcaggcctgagggggcatattctagactcttgcagctacaaaatcatcacatatgattattgatttttatttgataaatatgaccttgtggggtgataattatgtttggtcccattaacctcatgctttggttttctttttttagatgtagatatgtgggaatatgaggtttgttgtaccttgaggacaatgatctatttccaatggggttatcaattattatattaatcacatgtcaatggttattcataagcatgtcatctatctgtattttggagccttttcttctaccttcccattaccataatgtcttgttgctgcctttgctttttctgtatgcatgtgtttatattgataaatc

SEQ ID NO: 3099 - DNA, 4030 bp, Citrullus lanatus
ttttttcttggtgcctccaatggcggaaccagcagcagagcctaaggcattacccgaacccgaaaagaagaaggaacagagccttcctttttaccaactcttctcttttgcagacaaatatgactggtttctcatgatcctcggtagtttcggcgccattgtccacggctcttccatgcctgtttttttccttcttttcggcgaaatggttaacggcttcggcaaaaaccaatccaattttcacaaaatgacagcagaagtctctaagtatgctctgtattttgtctacttgggtctcattgtctgtttctcatcctacgccgagatcgcatgttggatgtacacaggggagaggcaagtgagtacattgagaaagaagtatttagaagctgttttgaaacaagatgttggattcttcgacactgacgccagaacaggggatgttgttttcagtgtttcaacagacactcttcttgtacaagatgcaatcagcgagaaggtggggaacttcattcactatctttcgacgtttctagctggattggttgtgggttttgtgtcagcatggagactagctcttctgagtatagcagtaattccaggaatcgcttttgctggtggtttatatgcttatactctcactggacttacttcaaagagtcgagaatcctatgccaatgctggcataattgccgaacaggcgattgctcaagttcgaactgtttactcttacgttggagaaagcaaagccctgaattcctattcagattcaattcaaaacacattgaaaattggttacaaggcaggaatggctaaggggttgggtctaggttgtacctatggcattgcttgtatgtcttgggcacttgtcttctggtatgctggagtcttcatccggaacggccagtccgatggcggcaaagccttcactgctatattctccgccatcgtcggtggcatgagcttggggcagtcattttccaatttgggagcattcagcaaagggaaagcagcagggtacaaattgatggagattatcaaacagaggcctacaattattcaagacccattagatgggaaatgtttgggtgaagttaatggcaacattgagttcaaagatgtcacctttagctatccatccaggccggacgtgatgatctttagggatttctccatttttttccctgccgggaagacggtggctgtcgttggtggtagcggttccgggaaaagcactgttgtctctctcattgaaagattctacgatcccaatcaagggcaggttttactagacaatgtagacatcaagacactgcaattgaaatggctaagagatcaaattggtctagtgaatcaggaaccggctctgtttgcaaccaccatatacgaaaacattctctacggaaaacccgatgcgacgatggcggaggtggaagctgctgcggctgcagccaacgctcatagcttcatcacattgctccccaatggctacgacacccaagtgggcgaaagaggattacaactctccggtggacaaaaacagaggattgccatagccagagcaatgttgaagaaccccaaaatccttctcctcgatgaagccaccagcgcactcgatgcaggctctgagagcatagttcaagaagctttagaccgtttaatggtcggaagaacaacagtggtggttgcacatcgattatcaacaataagaaatgtcgattcaattgcagttatacaacaggggcaggtagtcgaaacaggaactcacgaagaactaatcgctaaatccggtgcttattcctcgttaattcgattccaagaaatggttcgaaatagagaattctcaaacccatcgacccgtcgaacacgatcttcacgactgagtcattcgttatcgacaaaatcgttaagcctccgctccggcagcctcaggaatttgagttattcgtatagcaccggcgccgatgggagaatcgaaatggtctcaaacgccgaaactgacaggaaaaacccagcccccgatggctatttcattcgtcttcttaaactgaacggccccgaatggccgtattcgataatgggcgctgttgggtctgttctctctggtttcatcagtccaacatttgccattgttatgagtaacatgatcgaggtcttctattacagaaattcatccgccatggaaaggaaaatcaaggaattcgtattcatctacattggaattggggtttacgcagtggtagcttatctaattcagcattatttctttacaatcatgggtgagaatctcactaccagggtcagaagaatgatgctcgcagcgattttgaggaatgaagtgggatggttcgatgaagaagaacacaactcaagtttagtagcagcaagattggctactgatgcagctgatgtaaaatccgccattgctgaaagaatatcagtgatactacaaaatatgacttcactcttcacttcttttatagttgcatttattgttgaatggagagtttctcttctcatccttgcagccttccctctactggttcttgccaacatggctcagcaactttctttaaaaggatttgctggggatactgctaaggcccacgcaaagacaagtatgattgcaggggaaggtgtgagtaatatcagaacagtggctgccttcaatgctcaagacaagatcctttctctgttccgccacgagcttcgtgtcccacaacgacagagtctccgccggagccaaacggcaggtgtccttttcggtatctcacagctagctttatatgcctctgaagctttagttctatggtatggtgtccatttggtcagcaatggtggatcaacattctccaaagtgatcaaagtctttgttgtcttggttgttactgccaattctgtggcggagactgttagtcttgctcctgagatcattagaggtggtgaatcaattggttctgttttctcaattctcgatcgcccgacgaggatcgaccctgatgatcctgaggcagagactgttgagacgcttcgtggggaaattgaactccgacatgttgacttcgcatacccgtctcgacctgatgtcatggtgtttaaggatctcaatttgaggatcagggctggtcagagccaggcattggttggagccagtggatcagggaagagttcagtgattgctttgattgagagattctacgatccgcttgccgggaaagttatgatcgacgggaaggacattcgacgcctgaacttgcaatccttgaggctgaaaattggtttggtacagcaagagccagccttatttgcagccagcatttttgacaatattgcatatggaaaagatggagcaacagaggcagaagtaatagaggcagcaagagcagccaatgtgcatggctttgtaagtggacttcctgatggctacaagacaccagttggggaaagaggcgttcaactctctggtggccaaaaacaacgcatagctattgccagagctgttctcaaggaccccacaatcctcctcctcgacgaagctaccagtgctctcgacgccgagtccgagtgtgtgctgcaagaagctctcgaaaggctcatgaggggccggaccacggtggtcgtggcacatcgcctgtccacaatcaggggtgtggactgcattggcgtggtccaagacggtcgcattgtcgagcaaggcagccataatgagctgctaagccgagctgagggggcttactcaaggctcttgcagctgcaacaccaacacatatgaaagggggaagggtcaaaattttccaatggagcaacatggggttgttggttgttaaaccaaatttggggtcccattttagatgatgtttttttctttcttctttttcatctttcttttttaatttttctagttgtagatatcaatctggaatgtgcaatctattctatatcttgttgactgctccatttccaatgggaaaaaggcaagtatcttattataattgaaaattatggtgcactgcatgaacccctttaccta

SEQ ID NO: 3100 - DNA, 3775 bp, Cucumis sativus
tttttttctacgaccctccaatggcggaaccggttacagagcctaaggcattacccgagcccgaaaagaagaaagaacagagccttccctttcaccaactcttctcttttgcagacaaatacgactggtttctcatgatccttggtagttttggtgccattatccacggctcttccatgcccgttttcttcctccttttcggcgaaatggttaacggattcggcaaaaaccaatccaattttcacaaaatgacagctgaagtctctaagtatgctctgtattttgtgtacttgggtctcattgtctgtttctcatcctatgccgagatcgcatgttggatgtacacaggggaaagacaagtgagcacattgagaaaaaagtatttagaagctgttttgaaacaagatgttggattcttcgacactgatgcaagaacaggggatgttgtttttagtgtttcaacagacactcttcttgtacaagatgcaatcagtgagaaggtggggaacttcattcactatctttcgactttcttggctggattggttgtgggttttttgtcagcatggagattagctcttttgagtatagcagtaattcctggaatagcttttgctggtggtttatatgcttatactctcactggccttacttcaaagagtcgagaatcctatgcaaatgctggcatcattgccgaacaggcgattgctcaagttcgaactgtttactcttatgttggggaaagcaaagctttgaattcctattcagattcaattcaaaacactttgaaaatcggatacaaagcaggaatggctaaagggttgggtcttggttgcacttatggcattgcttgtatgtcttgggcacttgttttctggtatgctggcgttttcatccgaaacggacaaacagacggtggtaaagccttcactgctatattctccgccatcgtcggtggcatgagtttggggcagtcattttccaatttgggagcatttagtaaagggaaagcagcagggtataaattgatggagattatcaaacaaaagcctacaataattcaagacccattagatgggaaatgtttgggtgaagttaatggcaacattgagttcaaagatgtaacctttagctacccatctagaccggatgtgatgatctttagagatttctccattttcttcccggccggtaaaacggtggctgttgttggcggtagcggttccgggaaaagcactgttgtttctctcattgaaagattctatgatcccaatcaagggcaggttttattagataatgtagacatcaagacactgcaattgaaatggctacgtgatcaaattggtttagtgaatcaagaaccggctttgtttgcaaccaccatatacgaaaacattctctacggcaagcccgacgccaccacggcggaggttgaagctgccgcggctgcagccaatgcacatagctttatcacattgctccccaatggctacgatacccaagtgggggaaagaggattacaactctccggtggccaaaaacagagaatcgccatagccagagcaatgttgaagaaccccaaaatccttcttctcgatgaagccactagtgctctcgatgcaggctctgagagcatagttcaagaagctttagatcgtttaatggttggaagaactacggtggtagtcgcacatcgattatcaaccataagaaatgtcgattcaattgcagttatacaacaggggcaagtcgtcgaaacaggaactcacgacgaactaatcactaaatccggtgcttattcttcgttaatccgattccaagaaatggttcgaaacagagaattctccaatccatcgacacgtcgaacacgatcgtcacggcttagccactcattatcaacaaaatcattaagcctccgctccggtagtctcaggaatttgagctattcgtatagcaccggtgctgatggccgaatcgaaatggtctcgaacgccgaaaccgatcggaaaaaccctgccccagatggctatttccttcgtcttcttaaactcaacggccctgaatggccgtattcaataatgggagctgttgggtctgttctctccggtttcatcagtccaacattcgccattgttatgagcaacatgattgaggttttctattacagaaattcatccgccatggaaaggaaaatcaaggaattcgttttcatctacatcgggattggggtttacgcagttgtagcttatctaattcagcattatttctttacaatcatgggcgaaaatctcacaaccagagtcagaagaatgatgctcgcagctatattgaggaatgaagtcggatggttcgatgaagaagaacacaactcaagtttagtagcagcaagattagcgactgatgcagctgatgtaaaatccgcgatagctgaaagaatatcagtgatattacaaaacatgacttcacttttcacatctttcatagttgcattcattgttgaatggagagtttctcttctcatccttgcagctttccctctacttgttcttgccaacatggctcagcaactttcattaaaaggatttgctggggatactgcaaaggcccacgcgaagacaagtatgattgcaggggaaggtgtgagcaatatcagaacagtagctgccttcaatgctcaagacaagatcctttctttgttttgccatgagcttcgtatcccacagcgacagagtctccgtcgaagccaaacggcagggattctttttggtatatcgcagctagctctttatgcttctgaagctttagtgttgtggtatggtgtccatttggtcagcaatggtggatcaacattttctaaggtgatcaaagtcttcgttgtcttggttgttactgccaattctgtggcggaaactgttagtcttgctcccgagattgttagaggtggtgaatcgatcggttctgttttctcgattctcgatcgcccaacgaggattgaccctgatgatcctgaggcagagactgttgagacgcttcgtggagaaattgaactacggcatgttgacttcgcatacccgtctcgacctgatgtcatggtgtttaaggatctcaatttgagaatcagagctggtcagagccaggcattggttggagctagtggatcagggaagagttcagtgattgctttgattgagagattctacgatccgcttaccgggaaagttatgattgacgggaaggacattcgacgcctaaacttacaatccttgaggctgaaaattggattagtacaacaagagccagccttatttgctgccagcatttttgataacattgcatatggaaaagatggagcaacagaatcagaagtaatagaggcagcaagagcagccaatgttcatggctttgtaagtggactacctgatggctacaacacaccagttggagaaaggggagttcagctatctggtggccaaaaacaacgcatagctattgctagggctgttctcaaggaccccacaatcctcctcctcgacgaggccaccagcgccctcgacgccgagtccgagtgtgtgctgcaagaggctctcgaaaggctcatgaggggccgaaccacggtggttgtagcacatcgcttatccacaatcaggagtgtggacagcattggtgtggtccaagatgggcgcattgttgaacaaggtagccataacgagctgctaagccgagccgagggggcttactcaaggcttttgcagctgcaacatcaacatatatgaaa

SEQ ID NO: 3101 - DNA, 4322 bp, Glycine max
gttcttctcccaaacttcctttgaccactgtccaccaacacacacactctctctcaactctctttgctttctctaccaaaccaaaaaacgatattgacactgcaaaaagatagcatatatcaaaaggggttgttgtttcagatctccttcattcaatgtaaagaaaaaagtcacaacatgaaacacctcacaaggcctagatctccttgttcatggcattgagactctggttactctaaaaatcccattttgattccacccttttgttttttctcacttcagaacctgtgtttcatagtttggcggtgtttgtttgtttgtgacttgttctaatggctgaagctgctgagcctaataaagcattgcctgaggcagagaagaagaaggagcagacactacccttttacaagctcttctcatttgcagacaagtgtgattggatgctcatgatctctggcagcataggagctattattcatggctcatccatgccggttttcttcctcctctttggtgaaatggttaatggctttggcaaaaaccaaatgaacttgaagaaaatgacagaagaagtatcaaagtatgctctctatttcgtgtaccttggccttgtcgtttgcatatcatcctatgcagaaattgcatgctggatgtacactggggagaggcaagtgagcacactgagaaagaagtacttggaggcagtgcttaaacaagacgttggtttctttgacacggatgcaagaacaggagatattgttttcagtgtttccacagatactcttctagttcaagacgctataagcgagaaggtggggaacttcatacactatctatcaacgtttctggctggtctagtggttggttttgtttcagcatggaggcttgcacttctgagtgttgcagtgattcctgggattgcctttgctggtggattgtatgcttacacactcactggcctcacatcgaagagtcgagaatcttatgcgaatgctggcatcatcgccgagcaggcaattgctcaagttagaacagtttactcttatgttggtgagagcaaggcattgaattcttattccgatgcaatacaaaacacattgaagcttggatacaaggcagggatggccaaaggtttaggcctgggatgcacatatggaatagcttgcatgtcttgggcactagttttctggtatgctggagttttcatcagaaatggacaaacagatggtggcaaggcgttcaccgctattttctcggccattgttggtggcatgagtttgggacagtcattttcgaacttaggcgctttcagcaaaggcaaagctgctggatacaaattgatggaaatcatcaatcagaaaccaaccatagtggaagatccatcggaaggaaagtgcttagctgaggttaatggcaacattgaatttaaggatgtcactttcagctacccttcgaggccggatatgtttatctttcgcaatttctcaatctttttccctgctggtaaaactgttgcagttgttggtggtagtggatctggaaaaagcacagttgtttccttgatagaaaggttctacgatccaaatgaaggtcaggttctgctggataatgtggacattaagacactacaactaaaatggttacgtgatcaaattgggttggtgaatcaagaacctgcactctttgcaactaccattcttgagaatatactctatggaaaacctgatgcaacaatggctgaagtggaggctgctacttctgctgcaaatgctcatagctttattaccttacttcctaatggctataacactcaggtaggagagcgaggagttcaattatctgggggccaaaagcagagaattgctattgctagagctatgttgaaaaatccaaaaatccttctattagatgaagctactagtgctcttgatgcagggtctgaaaacattgttcaagaggcactagacaggctcatggttggaagaacaaccgtggttgttgcacatcgtctatcaaccataaggaatgttgataccattgcagttatacaacaaggccaagttgttgagacaggcgcacatgaagaactcattgccaaggcaggcacctatgcctcactcattcggttccaagaaatggttggaaatagggacttctccaacccatcaactcgccggacacggtcatctcgcttgagccattcattgtcaaccaagtccttaagcctccggtctggaagcttgaggaacttgagctaccagtatagcaccggagccgatggccgcattgagatgatatcaaatgctgaaacagacaagaaaaatcctgccccagatggatatttcttcaggttgctcaagatgaatgctcctgaatggccttactcaatcatgggagctgttggttctgttctttctggattcattggcccaacttttgctattgttatgagcaacatgattgaggtcttttacttcagtaattatgcatccatggagaggaagactaaggagtatgtcttcatttacattggtgctggtctctatgctgttggtgcatacttgatacaacattacttctttagtatcatgggagaaaacctcaccacaagggtcagaagaatgatgcttgccgctattttgaggaatgaagttggatggttcgatgaggaggagcacaactcaagccttgttgcagctcgccttgccacagatgcagctgatgtcaagtctgccattgctgagaggatatcagtgattctacagaacatgacatctctccttacttctttcatagttgctttcatagttgaatggagggtttccttgctcatcttggcaactttccctctccttgttctagccaattttgctcagcaactatctctaaaagggtttgctggagacacagccaaggctcatgcaaagacaagtatgatagcaggagagggagtgagcaacatcagaacagttgcagcattcaatgctcagaacaagatgttatcggtgttctgccacgagctccgagtgcctcagagccagagcctgcgccggagcctgacatccggcttcttgttcggtctctctcagcttgccctctatgcctccgaggctctcattctatggtatggtgcacatttggtcagcaaaggtgtttcaaccttctcaaaggtcatcaaggtgtttgtggtcctagtgatcactgcgaattcggtggctgaaaccgtgagccttgcaccggagattattcgcggtggcgaagctgttggttcagtgttctcaatcctcgatcgatcaacaagaattgaccctgatgatcctgatgctgatccggttgaatcgcttcgcggggaaattgagctcagacatgttgattttgcatacccttctaggcctgatgtgatggtgttcaaggattttaaccttaggatccgtgcaggccagagtcaggctcttgtgggggcaagtggttcggggaagagttctgttattgcattgattgagagattctatgaccctattgctggaaaagtgatggtggatggaaaggacattaggaagttgaacttgaagtctttgaggcttaaaattgggttggtgcagcaagagccagcactttttgcagcaagcattttcgagaacattgcatatgggaaagaaggtgcaaccgaggctgaggtgattgaggccgcgcgtgctgcgaacgtgcacggatttgtgagtggtttgcctgaaggttacaagacaccggttggcgagagaggcgtgcaactctctggagggcaaaagcaaaggattgccattgcaagagccgtgcttaaggaccccacaattcttctactagatgaggccacaagtgcacttgatgctgagtccgagtgtgtgctacaagaggccttggagaggctaatgaggggtcgcaccacggtgctcgtggctcatcgtttgtcaaccattagaggggttgattgcattggtgtggttcaagatgggcgcattgtggagcaaggtagccattctgaacttgtcagcaggcatgagggggcatattctagactcttgcagctacaacatcatcacatatgagaatatgagagaaagagattattgttttttttgtatttgataaatatgaccttgtgggggtgataattatgtttgggtcccattaacctcatgctttggtttttctttttttctttcttttagatgtagatatgtgggatatgaggtttgtagcttgagttcaaagtgatctatttccaatggggtatcaattattatatttaatcacatgccaatggtgcataagcctgtcatcta

SEQ ID NO: 3102 - DNA, 3964 bp, Manihot esculenta
atggcagcagagagtgtagatactacaaataatactaatactaaaggatcattgccagaggcagagaagaagaaagaacagagcttgccattttaccagcttttctcatttgctgataagtatgattggctgctaatgatctctggtagcataggagccattattcatggctcatcaatgccagtatttttcttgttatttggtgaaatggttaatgggtttggcaagaatcaatctgatttggaaaaaatgacccatgaagtctccaagtatgcgctatattttgtctatcttggccttgttgtgtgtctatcatcatatgcagagatttcttgctggatgtacaccggagagagacaagtcggcacactgaggaagaagtatctagaggcagtgttgaaacaagatgttggattctttgacacagatgcaagaactggagatattgtttttagtgtcgtgggaaactttatacactatctatcaacatttctagctgggctagtggttggttttgtatcagcatggaggctagcattgctaagtgtagcagtgataccaggaatagcttttgctggtggcttgtatgcatatacactcactggcctcacatccaagagccgcgaatcctatgcacaagccggcataattgccgagcaggctattgcgcaagttcggacagtttattcttatgttggggagagcaaagccttaaattcgtattcagatgcaatacaaaatactttaaagcttggatacaaggctgggatggccaaaggtttgggtttagggtgtacttatggaatagcatgcatgtcatgggcccttgttttctggtatgctggtgtttttatcagaaacggacagactgatggaggaaaggcattcacggcgattttctccgccattgttggtggcatgagtttgggccagtcattttcaaatcttggggcatttagcaaaggtaaagctgctggatacaagttgatggaaattattaggcaaaagcctaccattattcaagacccctcggatgggaagtgcttaccagaggttaatgggaacattgaattcaaggatgtaactttcagttacccatcaaggccagacgttataatattccgcgatttctcaatcttctttcctgctggaaagactgttgctgttgttggtggtagtggatcagggaaaagtactgttgtctctctgatagagaggttttacgatcctaatcagggacaagttttgcttgataatgtggacataaagaccctgcaactgaggtggttacgcgatcagattgggttggtgaatcaagaacctgcgctctttgcgaccaccatacttgagaacatactatatggaaagcctgatgccacaatggatgaagtggaagctgctgcttctgctgcaaatgctcatagcttcattactttgcttcctaatggctacaatactcaggttggagagcgaggagtccaactctctggcggccaaaaacagagaattgcaattgctagagctatgctgaagaatccaaagatccttcttttggatgaagctaccagtgcccttgatgcaggctctgaaagcatagttcaagaagcattagaccgtctcatggttggaagaacaactgtagtggttgcgcatcgactctccactattagaaatgttgatacaattgcagttatccaacaagggcaagttgttgagacaggaacccatgaagaactgatttccaaagggggagcatatgcttcattaatcagattccaagaaatggtgagaacgagagatttcgcaaacccatcaactcgacgatcacgctcaacacgtctaagtcattcactttcaacaaaatctttaagcctccggtctggaagtttacggaacttgagctattcatatagtacaggtgctgatggtcgtattgagatgatctccaatgctgaaactgaccgtaaaaatccagcaccagatggctatttctgcagactactcaaactaaatgctcctgaatggccatattctataatgggtgctataggatctgtgctttccgggtttattggtccaacctttgccatagtaatgagcaacatgattgaggttttctattacagaaatcctgcctccatggaaagaaagacaaaggagtatgttttcatttacattggtgctggtctttatgctgttgttgcatatttgattcagcattacttcttcagtataatgggagagaatcttactacaagagtaagaagaatgatgcttgcagcaattctgaggaatgaagttggatggtttgatgaagaagagcacaactcgagccttgtcgcagcacgattagctactgatgctgctgatgttaaatctgcaatagccgagagaatatcagtgatactacaaaacatgacctctctcctcacgtcattcatagttgctttcatagtggaatggagagtctcccttctcattttagctacctttcctcttcttgtccttgccaactttgcacagcaactttctctcaaagggtttgctggagacaccgccaaggcccatgcaaagactagcatgattgctggtgagggagtgagcaacatcagaacagttgctgcttttaatgctcaagataaaatctcctctctgtttagctacgagcttcgtgttccacagcttcgcagcctacgtaggagccaaacatcaggcctcctatttggcctctctcagcttgctctctatgcctctgaagctctcatcctttggtatggtgctcatcttgtcagcaaagggtcctccacattctctaaggttattaaggtttttgtagtcctggtgatcacagctaattcagttgcagaaactgttagccttgctccagagattataaggggtggtgaagctgttgggtctgtgttttcaatcttggaccgttccacaaggattgatgcagatgatcctgaggctgattctgttgaatcaatccatggggaaattgaacttaggcatgttgattttgcatacccctcacgacctgatgttccagtgttcaaagaccttaaccttagaatccgtgctggccaaagccaggcccttgtgggagctagtggatgtggaaagagttctgtgattgcattgatcgagcgattttatgatcctactgctggaaaagttatgattgatgggaaggatattcgacgattgaatttgaagtcactgaggcttaagattgggttggtgcaacaagagccagctctctttgcagcaagcattttcgataacattgcctatggaaaagaaggcgcaaccgaggctgaagttattgaagcagctcgtgcagccaatgtgcatggtttcgttagtgcattgcctgatgggtacaaaacaccagttggtgaaaggggagttcagctctccggaggacaaaaacaaagaatcgcaatagcaagagctgttcttaaggaccctgcaatacttttactagacgaggctacgagtgcacttgatgctgaatccgaatgtgtgctacaagaagcacttgaaaggttgatgagaggtcgaaccacggttcttgtagcgcaccgtttatcaaccatcagaggtgtggatagtatcggagtcgtgcaagacgggaggattgtggagcaaggcagccactcggaactggttagccgccctgacggggcctattctagactcttgcagctacagcaccatcacatatgatgggaaggaacatggccttgttgattgttaattatgttttggggtcccattaaccttatgttttcattttacttcttttctcctttttttggaatgattatgatgatgacagttgtagatatgggaatgtggaggactatatcttgagaagaactatcaatccccattttccaatggggtagcaagtgttatattattaaatatctaatggttcataaacccttgttgtcta

SEQ ID NO: 3103 - DNA, 4694 bp, Glycine max
tgaacatctaaaaatatagaaaggatagaataacaattaataacaactttgaccactctaaaactaaaaacaaaaactttgacattgtatttaattctcattttttcacctattaaagaaaagtaagaaaaaaaaaaaaaaaaaaccagacacagcacagagccccataacactattcacttgattccttttatctctgtggctttaccaacctaaccgtgattattcatcatcatcatactactaccatgctctaattcacaacctcagttaaaaccaaaccactcacactataaaaccacacttcacacctctctctcttcccaaactcttgttcttctcccaaacttcctttgaccactgtccaccaacacacacactctctctcaactctctttgctttctctaccaaaccaaaaaacgatattgacactgcaaaaagatagcatatatcaaaaggggttgttgtttcagatctccttcattcaatgtaaagaaaaaagtcacaacatgaaacacctcacaaggcctagatctccttgttcatggcattgagactctggttactctaaaaatcccattttgattccacccttttgttttttctcacttcagaacctgtgtttcatagtttggcggtgtttgtttgtttgtgacttgttctaatggctgaagctgctgagcctaataaagcattgcctgaggcagagaagaagaaggagcagacactacccttttacaagctcttctcatttgcagacaagtgtgattggatgctcatgatctctggcagcataggagctattattcatggctcatccatgccggttttcttcctcctctttggtgaaatggttaatggctttggcaaaaaccaaatgaacttgaagaaaatgacagaagaagtatcaaagtatgctctctatttcgtgtaccttggccttgtcgtttgcatatcatcctatgcagaaattgcatgctggatgtacactggggagaggcaagtgagcacactgagaaagaagtacttggaggcagtgcttaaacaagacgttggtttctttgacacggatgcaagaacaggagatattgttttcagtgtttccacagatactcttctagttcaagacgctataagcgagaaggtggggaacttcatacactatctatcaacgtttctggctggtctagtggttggttttgtttcagcatggaggcttgcacttctgagtgttgcagtgattcctgggattgcctttgctggtggattgtatgcttacacactcactggcctcacatcgaagagtcgagaatcttatgcgaatgctggcatcatcgccgagcaggcaattgctcaagttagaacagtttactcttatgttggtgagagcaaggcattgaattcttattccgatgcaatacaaaacacattgaagcttggatacaaggcagggatggccaaaggtttaggcctgggatgcacatatggaatagcttgcatgtcttgggcactagttttctggtatgctggagttttcatcagaaatggacaaacagatggtggcaaggcgttcaccgctattttctcggccattgttggtggcatgagtttgggacagtcattttcgaacttaggcgctttcagcaaaggcaaagctgctggatacaaattgatggaaatcatcaatcagaaaccaaccatagtggaagatccatcggaaggaaagtgcttagctgaggttaatggcaacattgaatttaaggatgtcactttcagctacccttcgaggccggatatgtttatctttcgcaatttctcaatctttttccctgctggtaaaactgttgcagttgttggtggtagtggatctggaaaaagcacagttgtttccttgatagaaaggttctacgatccaaatgaaggtcaggttctgctggataatgtggacattaagacactacaactaaaatggttacgtgatcaaattgggttggtgaatcaagaacctgcactctttgcaactaccattcttgagaatatactctatggaaaacctgatgcaacaatggctgaagtggaggctgctacttctgctgcaaatgctcatagctttattaccttacttcctaatggctataacactcaggtaggagagcgaggagttcaattatctgggggccaaaagcagagaattgctattgctagagctatgttgaaaaatccaaaaatccttctattagatgaagctactagtgctcttgatgcagggtctgaaaacattgttcaagaggcactagacaggctcatggttggaagaacaaccgtggttgttgcacatcgtctatcaaccataaggaatgttgataccattgcagttatacaacaaggccaagttgttgagacaggcgcacatgaagaactcattgccaaggcaggcacctatgcctcactcattcggttccaagaaatggttggaaatagggacttctccaacccatcaactcgccggacacggtcatctcgcttgagccattcattgtcaaccaagtccttaagcctccggtctggaagcttgaggaacttgagctaccagtatagcaccggagccgatggccgcattgagatgatatcaaatgctgaaacagacaagaaaaatcctgccccagatggatatttcttcaggttgctcaagatgaatgctcctgaatggccttactcaatcatgggagctgttggttctgttctttctggattcattggcccaacttttgctattgttatgagcaacatgattgaggtcttttacttcagtaattatgcatccatggagaggaagactaaggagtatgtcttcatttacattggtgctggtctctatgctgttggtgcatacttgatacaacattacttctttagtatcatgggagaaaacctcaccacaagggtcagaagaatgatgcttgccgctattttgaggaatgaagttggatggttcgatgaggaggagcacaactcaagccttgttgcagctcgccttgccacagatgcagctgatgtcaagtctgccattgctgagaggatatcagtgattctacagaacatgacatctctccttacttctttcatagttgctttcatagttgaatggagggtttccttgctcatcttggcaactttccctctccttgttctagccaattttgctcagcaactatctctaaaagggtttgctggagacacagccaaggctcatgcaaagacaagtatgatagcaggagagggagtgagcaacatcagaacagttgcagcattcaatgctcagaacaagatgttatcggtgttctgccacgagctccgagtgcctcagagccagagcctgcgccggagcctgacatccggcttcttgttcggtctctctcagcttgccctctatgcctccgaggctctcattctatggtatggtgcacatttggtcagcaaaggtgtttcaaccttctcaaaggtcatcaaggtgtttgtggtcctagtgatcactgcgaattcggtggctgaaaccgtgagccttgcaccggagattattcgcggtggcgaagctgttggttcagtgttctcaatcctcgatcgatcaacaagaattgaccctgatgatcctgatgctgatccggttgaatcgcttcgcggggaaattgagctcagacatgttgattttgcatacccttctaggcctgatgtgatggtgttcaaggattttaaccttaggatccgtgcaggccagagtcaggctcttgtgggggcaagtggttcggggaagagttctgttattgcattgattgagagattctatgaccctattgctggaaaagtgatggtggatggaaaggacattaggaagttgaacttgaagtctttgaggcttaaaattgggttggtgcagcaagagccagcactttttgcagcaagcattttcgagaacattgcatatgggaaagaaggtgcaaccgaggctgaggtgattgaggccgcgcgtgctgcgaacgtgcacggatttgtgagtggtttgcctgaaggttacaagacaccggttggcgagagaggcgtgcaactctctggagggcaaaagcaaaggattgccattgcaagagccgtgcttaaggaccccacaattcttctactagatgaggccacaagtgcacttgatgctgagtccgagtgtgtgctacaagaggccttggagaggctaatgaggggtcgcaccacggtgctcgtggctcatcgtttgtcaaccattagaggggttgattgcattggtgtggttcaagatgggcgcattgtggagcaaggtagccattctgaacttgtcagcaggcatgagggggcatattctagactcttgcagctacaacatcatcacatatgagaatatgagagaaagagattattgttttttttgtatttgataaatatgaccttgtgggggtgataattatgtttgggtcccattaacctcatgctttggtttttctttttttctttcttttagatgtagatatgtgggatatgaggtttgtagcttgagttcaaagtgatctatttccaatggggtatcaattattatatttaatcacatgccaatggtgcataagcctgtcatctatcttcttttttttagccttttcttctaccttcctattag

SEQ ID NO: 3104 - DNA, 4164 bp, Rosmarinus officinalis
cacaactttggcgcaactcccattctttttggatcgtctgtattttatttttcaagattcccataatccctgcgtgatatgccgtaaagggaaaggcccaacaggagcatcgtcatgcatcgcccttaatcgagctgggttcgtcgtctccattgttaaagattcgattttcttttcaagattttgaaaaatggcggagggtggcgacgggaaggcaatgccagaggcggagaagaagaaggagcagagcctgccgttctaccagctgttctcgttcgcggacaagtacgacgtcgtgctgatgatcgccggcagcctcggcgccatcgtgcacggctcctccatgcccgtcttcttcctcctcttcggcgagatggtcaatggcttcggcaagaaccagatggatttgcacaagatgacccatgaagtttccaagtatgctctgtatttcgtgtatcttggactcgtggtctgcttctcctcctacgcagaaattgcatgttggatgtacactggtgagaggcaagcaggcacattgaggaagaagtatttggaggccgtgttgaagcaggatgtcggattcttcgacaccgatgctcgaaccggagatattgttttcagtgtttcaactgatactctgcttgttcaagatgccattagtgagaaggttggcaacttcattcattatctttcgacgttcttggcggggctggtggttggatttgtatcggcatggaagctagctcttctcagcgtggctgtgattccgggcattgcctttgccggtggtttgtacgcatacactctcaccgggctcacctccaagagccgcgaatcctatgcaaacgctggtataattgctgagcagtccattgcacaagttaggacggtttactcctatgtcggtgagacaaaagccctcggtgcatattcggacttgatccaaaacacattaaaactagggtacaaggccggtatggctaaagggctcggattaggatgcacctacggcatagcatgcatgtcttgggctctagttttctggtatgccggcgttttcatcagaaacggacagacagatggtggcaaagcgttcactgcaatcttctctgctatagttggtggcatgagcttgggccagtcgttttcgaatctcggggcattcagcaaaggtaaagctgctggatacaagttgatggaaataatcaagcagaaaccgaccatagtagacgacacatgtaacgggaactgcttgactgatatcagaggaaacattgagttcaagagtgtgacgtttagttatccatctagacctgatgtgatcatcttccgagacttctccatcttctttcccgctgggaaaacggttgctgtagtcggtggtagtggttcggggaagagcaccgtcgtctccttgattgaaagattctatgatcctaatcagggtgaaattttgttggacaatgttgacatcaagacactgcagctgagatggctgcggaatcaaattggcttggtgaaccaagaaccggcgctttttgcaaccacgatactcgagaacattttctacgggaagcccgacgcgaccatggcggaagtcgaagctgctgcctctgctgctaatgcccacagcttcatcaccttgcttcccaatggatacaacactcaggtcggggagcgtggcgtccagctctccggggggcagaagcagaggatagcgattgcaagggcaatgctgaaggacccgaagatacttcttctcgacgaagccaccagcgcactggatgcaagctccgagagcatcgtgcaggaggctctcgatcgtctgatggtagggaggaccacggtggttgtagcgcaccggctatcgacaataagaaatgttgattcgatcgtggttattcagcaagggcaagtcgtcgaaaccggaacacatgaagagctgatttccaaagctgctgcctatgcatcattgatcagattccaagaaatggtggggaaccgagatttatcaaacccttcaacgcgtaggacacgctcgacacgcctgagccactcgttgtcgacaaagtcgctcagcctccgatcagggagcttgagaaacttgagctattcgtacagcacgggcgccgatggtcggatcgagatggtgtcgaacgccgaaaccgatcggaagaatcccgccccggccggttacttctgtaggctgctaacgctcaatgctcccgagtggccgtattcaatcatgggagccatcgggtcggttctttccggcttcattggcccgactttcgctatcgtgatgagcaacatgatcgaggtgttctactaccggaaccccgccgccatggagaggaagacgaaggagtacgtcttcatctacattggggccggtctctacgccgtcgtcgcgtacctcattcagcactacttcttcagcatcatgggtgagaacctcaccacaagagtgagaagaatgatgcttgcagccattttgaggaacgaggtcgcgtggtttgacgaggaggagaacaactcaagcctcctctcggcccggcttgccacggacgccgcggacgtgaaatcggccattgccgagaggatttcggtgatgctgcagaacatgacgtcgctcctcacttctttcatcgtcgcgttcatcgttgaatggagggtctcgctgctcatcctcggcacattccctcttctagtcctagcaaactttgctcagcaactctctctcaaagggttcgcaggagacacggcgaaagcgcacgcaaaaacgagcatgatcgcaggtgaaggagtgagcaacattcgaaccgtagccgcgttcaacgcccaagaaaagatcctctctttgttctgtcacgagctccgcctcccccaacgtcggagcctcgcgcgcagccagtcttctggtttcctgttcggtctctcgcagctcgctctttacggatccgaagctctcattctctggtacggcgcccacctcgttagcaagggcgtctctaccttctcgaaggtgatcaaggtttttgtggtcttggtcatcacagctaattcggttgcggagacggtgagcctcgcaccggagatcatccggggaggggaagctgttggttcggtcttctcggtcctcgaccggtccacgaggattgatccggacgatccggaggcggagccagtcgagtcgatccgtggcgacattgagctccgccacgtcgactttgcttacccttcgcgcccggacgtgatggtgttcaaagacctgagcctacggatccgggccgggcagagccaggcactcgtcggggcgagcgggtcggggaagagctcagtgattgcgttgatagagaggttctacgatcctctctccggtaaagtcatgatcgatgggagagatattaggagattgaacttgaaatctctccggctcaagattggcctcgtgcagcaagagccagcgctcttcgccgccagcattctcgacaacattgcctacgggaaggacggtgcgaccgagggcgaggtgatcgaagccgcacgcgccgcaaacgtgcacactttcgtgagcaggctgcccgagggttacaaaacccctgtcggagagcggggcgtccagctctccggcgggcagaagcaacggatcgcaatagcacgagccgtgctcaaggatccgtcgatcctactcctcgatgaggccacaagcgctctcgacgcggagtcggagtgcgtcttgcaagaggctctcgagaggctgatgagagggcgcaccaccgtgcttgtcgcccaccggctctccaccatacgtggggtggacagcatcggggtggtgcaagacggccgcatcgtcgagcagggcagccacggcgagcttatcagccggccagagggcgcatattcaaggctactccaactgcaacatcatcgcatatgataaaataaaataataattaaccccccccccccccccccccccccccccccccccccccccccccccccccccccccccccccccaaccctttcttctttttgtttccacttccttttttcaaaatttattttgttatggtgatagatgtagatattgtaatgtgtgaggactgtattttcaagaatgaccactccatttccagcgtgctaaaaagaatataacc

SEQ ID NO: 3105 - DNA, 4111 bp, Echinacea purpurea
acccccacgcacccctctcactttgaccacaacctgactcattgccactgtcacaccatccctcactcaaaacacccacctccaccattgttaacactttcagatctcactctagcttccttcatggccattaaactgatttctgctttctgttttctcattctttaatctgtaaaaaagctccatacaatcttccagagtttcaaaaatggcggacgcaacggaaccaaccaaggcaatgccggcacaagcggagaagaaaaaggaacagactctaccgttttatcaactgttcttgtttgccgataagctcgattacgctctcatgattctcggtagcatcggtgccgttgttcatggatcttctatgccgttcttcttcttattgtttggtcaaatggtcaacggattcggaaaaaaccaatccgatttgaacaccatgactcacgaagtctctaagtatgctttgtacttcgtctatctcggattggtggtgtgtgtctcgtcttacgcagagatcggatgctggatgtataccggagaacgacaagtgagcgcgttgaggaagaggtacttagaagcagtgttgaaacaggacgtagggttttacgatactgatgcaagaacaggtgatatcgtttttagtgtctcaacggacacactgcttgttcaggacgccattagtgagaaggtgggaaactttattcattatctgtctacatttttggctggattggtggttggttttgtgtcagcatggaagctagctcttctgagtgttgcagtgataccggggattgcgtttgcgggtggtttatatgcgtatacgcttactggtctcacttcgaagagccgtgaatcgtatgccaatgctggcattattgctgaacaggctattgcacaagtaagaacggtttattcgtatgtgggcgagaccaaggcgttggactcgtattcggatgcgatacagcacacccttaagctcgggtataaggcgggaatggcaaagggtttaggattgggatgtacatatggaattgcatgcatgtcatgggcacttgtgttctggtatgctggtgtgtttattaggaatgggcaaacagatggtgggaaagcattcactgctattttctctgccattgttggtggcatgagtttgggtcagtctttttcaaatcttggagcattcagcaaaggtaaagctgctggatacaagttattggaaatcattaagcaaaacccgactatagttcaagactctaaagacgggatgtgcttagcggaggtcaatggcaatattgagttcaaggaaatatctttcagttatccttcaaggccagatgtcttcatcttcagaaacttttctattctcttccctgcgggtaaaacagttgctgttgttggtggtagcgggtctggtaaaagcactgttgtttcactgattgaaaggttctacgaccctaatcaagggcaaatattgctagacaatgtggatataaagacactgcaactgaaatggttgcgcgatcaaattggtctagtgaaccaagagcctgcactcttcgccaccacaatccttgaaaacatactttatggaaaacctgatgcaactacagatgaagtggaagcagcagcctctgcagccaatgctcacagcttcattacctcgcttccaaacggctacaacacccaggtgggtgagcgtgggatccagttatctggaggtcaaaaacaaagaatcacaatcgctagagcaatgttaaaaaacccaaaaatactcctccttgatgaagcaacaagtgccctcgattcaggatccgagagtatcgttcaggaagcccttgaccggttaatggttggaagaacaaccgtcgtggttgcacatcgtttatccaccataagaaatgtcaactcaatagcagttatccaacaaggacagattgtggaaacaggaacacacgaagaactaatttccaaagctggcgcttacgcctcgttaatcaggttccaagaaatggcaggcacccgagacttttcaaacccttcaactcgccgcacgcgctcaacacgattaagccattcattgtcaacaaaatctcttagcctcaggtctggaagcttgagaaacttaagctattcatacagtactggtgcagatggccgtatagaaatgatatccaatgctgaaacagataaaaagaatccagctccacgcggctacttcttccgtcttttgaagatgaatgctcctgaatggccttactcgataatgggtgctgtagggtccgttttatccggattcatcggtccaacttttgccattgtgatgagcaatatgattgaagttttctactttaacaaccctgctcaaatggagaggaaaacaaaagaatatgtttttatttatgttggagcaggtttatatgctgttgttgcatatttgatccagcattacttctttagtattatgggagagaaccttactacaagagtaaggagaatgatgctttcagccattctgaggaatgaagtgggatggttcgatgaagaggaacataactcaagtcttgttgcagccaaattagccacagatgctgctgatgtaaaatcagccatagccgagaggatatctgttatattacagaacatgacctctctgctgacgtcatttgtggttgcatttattgtggaatggagggtttcacttctcattcttgccactttcccccttcttgttctggcccattttgctcagcaactttctctcaaaggttttgctggagacactgcaaaagctcatgcgaaaacaagcatgatcgccggtgaaggagtgagcaacattcgaaccgtcgcagccttcaacgcccaagataagatcctctccttattctccgctgaacttcgtgtcccgcaaaaacaaagccttcgtcgtagtcagttttcgggcatgatcttcggtatctcacaactggctctatatgcatccgaagctctaatcctatggtatggcgcgcatctcgttaccaaaggcctttcaaccttttcaaaagtaatcaaagtgttcattgtcctagtcatcaccgccaactcagtagctgaaactgttagtcttgctcccgagatcatcagaggcggtgaagccatcggttcagtattctcgattcttgatagatcaacacgaattgacccggatgatccagatgccgaccaggttgaaacgattcggggcgagattgagctgcgtcatgtcgacttctcatacccttcaagacccgatgtaatcgtttttaaggactttagtcttagaatacgggccggtcagagccaggctctagtgggagctagtgggtccgggaaaagctcggtgatcgcgttaatcgagcggttctacgacccaaccgcgggaaaagttatgatagacggtaaagacattagacggttaaatctgaagtctcttcggttgaaaatcggtctagtccaacaagaaccagctctatttgctacaaccataatggaaaacatcgtgtatgggaaagacggggctacagaagctgaagtcattgcagccgcaaccgcagcaaatgtgcacacattcattagtggtttgccagaaggatataaaactccggttggggagagaggagttcagctttcgggtggacaaaagcaaaggatcgcgatagcccgagctattttaaaggacccgaggattctgttactagatgaagcaactagtgcactagatgcggaatcagagtgtgcgcttcaagaagcacttgaaaggctaatgaggggtcgaacgacggtgttggtggcccaccggttatcaacgatccgaggggttgatagtattggtgtggttcaagatggtcgaattgtggaacagggtagccatggtgagcttataagtcgaccagaaggtgcttactctaggctcttgcaactacaacaacatcgtatatgatgatgctgatgataaacatgtttgttttacatagtatattcgtctccaatcgttagctatgatatgttttgtcgattggttccatcataactgccatccccgacatcttgtaactgaatgtttgtaatgttgttatatataaaaatt

SEQ ID NO: 3106 - DNA, 4467 bp, Mimulus guttatus
tctacacacacacccccctctcttctctctccacctcgtttgaccaccagtctcaccgatacattttctctttccggcaaactcaaaaacaatttaaagtctatctaatttctctctccctctctctctctctctctctctctctctctctcacacacacacacacacacattaatgagcacagttcagtgtcaactcactgaccgttgatatatctacagctatgagctcatcagaatataatactcttatttcttagatctcatgttcttcaagattcttcctaccatttcgtgaaaaaaccgaaaaccccacttcaaaatacgatcatgcaccactagtttctaatcactacttcgcatttcaccctctaatttgaagtgggttcttcgattgtgattgattcctagctagcaattagctgctactctgttttttttttttgaaagactccattttttttggtcggaagaaatggcggaggcggccgacgggaaagcaatgccggagtcgccggagaagaagaaagaacagagcctaccattctatcagctgttttcatttgctgataaatatgatttaatattgatgacaaccggcagcctcggcgccattattcacggctcttcaatgccggttttctttctgctctttggtgaaatggtcaatggctttggtaaaaaccaaatggatttgcacaagatgacaaatgaagttgccaagtatgctctgtatttcgtctaccttggactggtcgtatgcttttcatcttacgcagagattgcatgttggatgtacaccggagagagacaagttggtacgttgaggaagaaatatttggaggccgtattgaaacaagacgttggtttctttgacacagatgcaagaactggggatattgttttcagcgtctccactgatactctccttgttcaagatgccatcagtgagaaggttggtaatttcattcattatctatcgactttcttggccggattggtggtcggttttgtgtcggcatggaggctagccctcctgagtgtggctgtgattcctgggatcgcctttgccggtggtttatacgcttataccctcaccggactcacttcaaagagccgtgaatcgtacgctaatgccggtataattgccgagcagtcgattgcacaagttaggacagtatactcgtatgtcggagaaacaaaaaccctcggtgcgtattcggatttaatacagaacacactaaagctaggatacaaggctggaatggctaaaggtcttggtttaggatgtacttacggcatagcatgcatgtcgtgggccctcgttttctggtatgcgggtgttttcatcagaaacggacagacagatggcggcaaggcattcaccgccattttctccgccattgttggtggcatgagtttgggccagtcattttcgaatctcggtgcgttcagcaaaggcaaagcagctggattcaaattaatggaaataattaagcaaaaaccaacgatagtccaagatgatttagactccaagtgtttgaccgaagtcaacgggaatatcgagttcaagaacgtaactttcagctacccatcgaggcctgatgtcatcatcttcagagacttctccattttcttccccgccggaaaaactgtggcggtagtcggcggcagcggttccggcaaaagcaccgttgtctccttgatagaaagattttacgatcctaatcagggggagattttgctcgacaatgtggacatcaaaacgctccagctgaggtggctgcgcagtcaaatgggattggtaaatcaagaacccgccctcttcgccacaacgattctcgagaatattctttacggaaaaccggacgcaaccatgtccgaagtcgaagctgcctcctctgctgctaatgctcacagcttcatcaccttgcttcctaatggatacaacacccaagtcggagaacgtggggtacagttatctggcggccaaaagcaaagaatagctatcgcgagggcaatgctaaaagacccgaaaattcttcttctcgacgaagcaactagtgcattagatgcaggctcggagagcattgtgcaagaggctttggaccgtttgatgattgggagaactacagtagtggtggcccaccgattatcaacaataagaaacgtcgactcgattgcggttatacaacaagggcaggttgtcgaaaccgggacccacgaagaattaatcgccaaagccgctgcttatgctaatctaatcagatttcaagaaatggtggggaacagagatttctcgaacccttcgactcgaagaacaagatcttcgaggctgagtcattctctatccacgaaatcactcagcctccgttctgggagtttaaggaacctgagctattcttacagcacgggtgcagacggtaggatagagatggtgtccaatgccgaaacggagcggaaaaatccagcaccgtccggatacttctgcaggcttcttacactgaatgcgcccgagtggccttattcgattatgggagctgtggggtccgttctttccggattcatcggccccacatttgctattgtgatgagtaatatgattgaggttttctattaccagaaccctgctgacatggaaaggaaaacgaaggaatacgtcttcatatatatcggagcgggtatttatgccgttatcgcgtatcttattcagcactacttcttcagtataatgggagagaatctcactacaagagttaggagaatgatgcttgcagcgattttgaggaatgaagtggggtggttcgacgaggaggagaacaattcgagcctactcgcaaaccgtttagctaccgatgcagcggacgtaaaatcggctatcgcagagaggatttcggtgatattacagaacatgacttctctactcacttcgttcatagttgcattcatcgttgaatggagggtttcactgctcatacttgctacatttcctcttcttgtcctagcaaactttgctcagcaactatctctcaaagggttcgcaggagacaccgccaaagcccacgcaaaaacgagcatgatcgccggagaaggagtgagcaacatccgaactgtggcggcattcagcgcgcaagaaaagattctatctttattctccaacgagctccgtttgccgcagaagcaaagcctccgccgcagccaatgctccggcctactcttcggcctctcgcagctcgctctctacgcctccgaagcactaatcctctggtacgggtcccacctcgttagcaaaggggtctccaccttctccaaggtcatcaaggtctttgtcgtcctagtcatcaccgccaactccgtcgcggaaaccgtcagcctcgccccggagatcatccggggcggcgaagcggtcgggtcggttttctcgatcctggataggcccacacggatcgacccggacgacaccgaggcggagaccgtcgagtcgatccgcggcgagatcgagctacgccacgtggactttgcgtacccgtctcgtcctgacgtgatggtgttcaaggacttcagtctgagaatccgggcgggccatagccaagccctagtcggggcaagcgggtcgggtaagagctctgtaattgcattaatagaaagattctacgacccgttatccgggaaagttatggtggacgggaaagatatccggaggctaaacctaaaatcgctccgccggaggatcggattggtccaacaggagccggcgctctttgccgccagtatcttcgagaatattgcatacgggaaagacggtgccgccaccgaggcggaggtgatcgaggcagcgcgggcagcgaacgtgcacaccttcgtgagcggcttgccagaggggtacaaaacccccgtaggagagagaggggtgcagctctccggcgggcagaagcagaggatcgcgatcgcacgggcagtactaaaggacccgtccattctcttgctggacgaggccacgagcgcgctcgatgcagagtcggagtgcgttctgcaggaggcgctcgagcgcctcatgagagggcggaccacggtgctcgtggcccaccgcctgtcgaccatacgtggggtccacagcatcggcgtggttcaagatgggcggattgtcgaacaaggcagtcataatgagctgattggccggccggaaagtgcttattcgaagctgttgcaactacagcaccaccgcatatgaaaaaaagtggttattaacctttttttcttttttcttttttttggtttgttttttttaatggtatgatgatgatgatggtgatagttgtagatatttggtatgtgaaaagacaactttatccctagtgacgattttctgcactaaaattaatgttgtaataattaactttgatgcatgatcttctgtttctcttttttgttgctgaattatgaattatccattgattttcacatcaca

SEQ ID NO: 3107 - DNA, 4403 bp, Chenopodium quinoa
aaaaataaatgtgtttaaaagaaagattcctcttcatttagttctacttctacttgtccttcattccagatctcattaatggcgcttaactaagcgcaacggtcacataacattaatcagccagtatatttcttattgatcaaaccaaataaatcaataagtgaagtattgtttcatcaatggcgcagtctacggccgatggaaaagccatggccgaggccgagaagaagaaggatcaaacactaccattctatcagctgtttacatttgctgataaatatgattatcttttaatgagtattgggagtttaggtgctgttattcatggctcttctatgcctgtttttttcttactctttggtgagatggttaatgggtttggtaaaaatcagcttaatcttcaaactatgactcatgaagtctccaagtatgctttgtatttcgtctaccttggcctcattgtatgcgcctcgtcttacgcagaaattgcttgttggatgtactctggagaaaggcaagctggaacattgagaaagaaatatttagaggctgttttaaaacaggatgtggggttctttgacactgatgctagaactggtgatattgtcttcagtgtttctactgatacacttcttgttcaagatgccattagcgagaaggtgggaaatttcatacattatctatcaacgtttttggcgggattggtggttgggtttgtatcagcatggaagctagcattgctgagtgttgcagttattcctggaatcgcatttgcaggaggtctttatgcttacactcttactggactcacgtctaagagtcgtcaatcatatgccaatgctggtattattgctgaacaggccattgcacaagttcgaactgtgtattcatatgttggggagactaaggcgcttgattcatattccgatgccattcaaaatactcttaaacttgtttacaaggctgggatggcaaagggtttgggtcttggatgtacgtatggtattgcttgcatgtcatgggcccttgttttttggtatgctggtgttttcatcaggaatggacagactgatggaggaaaggctttcacggccattttctctgccattgttggtggcatgagcttaggtcagtcattctcaaaccttggggcctttagcaaagggaaagcagcaggatacaagttgatggagataatcaaacaaaagccgaccattgtccaagatcaggccgatggaaagtgtttagaagaagttagtggaaacatagaattcaaaaatgtgtcattcagctatccttctcgtcctgatgtgatgatctttcgagatttttcaattttctttcctgcgggaaagactgttgctgtggttggtggtagtggttcagggaagagtacagttgtttccttgattgagaggttctatgatcctaacggcggtcaggttttgctggacaacaatgacattaggacactgcaattaacatggttgcgcggtcaaattggtctggtgaaccaagagccggcgctctttgctactaccatccttgagaatattctctatggaaaacctgatgctacaatggccgaggttgaagctgctaccaattctgccaatgctcatagcttcatcaccttgcttccaaatggctacaacacccatgtgggtgaaaggggtgttcagctttcaggcggtcagaaacagagaatagcaattgctagagcaatgttgaagaacccgaaaattctcctcctagatgaagccacaagtgcacttgatgctagctctgagagcatagtccaagaagcacttgacagattgatggtgggaagaacaacagtagttgtggcccatcgactttccaccatcagaaatgttgacacaattgctgtaattcagcaaggacaagttgtcgagacaggaactcacgaggaactgatagctaaagcaggggcctatgcatcattgatccggttccaagaaatggttggaaatagggatttttcaaacccctctacacgtcgtactcgctcatcaagattgagctgttctctttccacaaaatccttgagccttcgttcaggaagtttgagaaacttaagctactcatacagtacaggtcttgatggccggattgagatggtttctaatgccgagtcagagaggaagaatcctgcaccacgaaactatttctttaggcttcttaaacttaatgcccccgaatggccttactcaatcatgggtgctgtaggatcaatattgtccggttttattggtccaacttttgctatcgtgatgagtaatatgatcgaggttttctactactcgaattatgcttctatggagaagaagactaaggaatatgtcttcatctacattggggcaggactttatgctgtcgttgcatacttaatccagcattacttctttagcatcatgggtgaaaatctcacaactagagttcgtaggatgatgcttgcagcaatcttgaggaatgaagtcggatggttcgatgaggaagagcataactctagcctcctagcagctcgcttagcaactgatgcagctgatgtaaaatccgctattgctgagaggatttctgttatactgcagaacatgacctcacttctcacatcgttcatcgttgctttcattgtggaatggagggtttcacttctcatattgggaacattcccacttctagtccttgctaactttgctcagcaactatcactgaaaggattcgcgggagacacagctaaagcacatgcaaaaacgagcatgattgctggtgaaggggtgagcaacattagaacagtagctgcattcaatgctcaggagaagatcctatcccttttctgccatgagcttcgagtgccacaaaaacgtagcttccgtcgtagtcaaacttctggtggtctctttggtatttctcagctagctttgtatggttcagaagccctcattttatggtatggtgctcatcttgtaagcaaaggtctttcgactttctccaaagtcatcaaggtctttgtagtcttagtcatcacagccaactcagttgctgaaactgtgagccttgctcctgagatcataaggggcggagaggccgtggggtctgttttctcaatcttagaccgatgcacaaggattgacccagacgattcagaagcagaacctgttgaatccatacgtggggagattgaattccgtcatgttgattttgcataccctactcgccctgatatccttgtgtttaaggatttcaaccttagaattcgagcaggccaaagccaagccctagtcggagcaagtgggtctgggaagagctcagtcattgcattgattgagcggttctatgacccatgtggtggtaaagttatgatcgatggcaaggacatccggagattgaacctcaaagcgcttagacttaagattggtttagtgcaacaagaaccagccctttttgctgctagcatctttgataatatcgtgtatgggaaagaaggagcaacagaagcagaagttattgaagctgctcgagcagctaacgtgcatggttttgtcagtgcattacccgagggctacaaaacaaccgttggagaacgaggagttcagctttctggaggtcagaagcagaggattgccatcgccagggcagtactcaaggaccctgccatccttcttttagacgaggctactagtgccctggatgcagagtcagagtgtgtgctccaagaggctcttgagagattaatgagaggccgaacctctgtgcttgttgcacatcgtttgtccacaataaggggagttagtagtataggagtggtccaagatgggcgcattgtagagcaaggtagccactccgagttaatcagtaggcctgagggggcttactctcgcctttcacaacttcaactccatcacgtgtgagtgagcaagcaagcaagcacagtccaatcatagccgtagggatgatattgtgtagcattcgagttgctactattagtaacatttgtgttatctgcgacgttaactacccgtcggttttagctaattctttgtcaatgatggtggtgggtgatggtgattgctgtagatatggggcatagtaaggctatttctaggtttttctttcttttttcttatttaatccaacatttgatttctgtatggaaaagaaatcattgtattatgaatggagggttctgaaaaaaaaaaggactgtttgcatgtgagctgagtttggttagagttttcttgtaggctttttcatttacttactggaaaaagatctgctgaagacctttccagcataactaaaaaagctcccttttttctattttttatgtatggtaacatgaaatgcatattttggagctattttgcttctctttctctgac

SEQ ID NO: 3108 - DNA, 3906 bp, Plantago ovata
ggacacaaccgacgcaaaaacaatgccgccagtggtggttgagccagagaagaagaaggagcagagcttgccgttctaccagctcttctctttcgcggataaatacgactacgttttgatgaccgctggcagtattggagcagtcattcacgggtcatccatgcctgtgttcttcttgctgttcggtcaaatggtcaatgggttcggcaagaaccagatggatcttcacaagatgactgatgaagttgctaagtatgctctgtattttgtgtatcttggcttgattgtgtgcttctcatcatacgcagagatagcatgttggatgtacactggtgagaggcaagttggtacattgaggaagaagtatttggagtcggtgcttaagcaggacgtcggtttcttcgataccgatgctagaaccggtgatatcgtgttcagtgtctcgaccgatactcttcttgttcaagatgccattagtgagaaggtgggtaatttcatccattatctttcaacatttttggcgggattggtggttggtttcgtgtcagcatggaagctggctctactcagtgtggctgtgattcctggaatcgcctttgccggtggtttgtatgcgtacactctcacgggccttacatccaagagtcgagaatcatatgcaaatgccggtataattgctgagcagtcgattgcacaagttaggacagtgtactcatatgttggcgagacgaaagtcctgggtgcatattcggatttgatacagaacacacttaagttgggatacaaggctggaatggccaaaggtcttggattaggatgcacttatggtatagcatgcatgtcatgggctcttgtattttggtacgctggagtatttatccgaaacggacagacagatggaggaaaggcattcactgctattttttcagccattgttggcggcatgagcttgggccaatcgtttctaaccttggggcattcagcaaaggtaaagcagcaggatttaagttgatggagatcatcaaacagaaaccaaaaattgttcaagacgaattggacggaaagtgccttactgaagtgagtgggaacatcgagtttaagaatgtgacgtttagctatccatcacgacctgatgtcattatctttagagacttttccattttcttccctgcgggaaagacagttgcggttgttggtggaagtggctccgggaaaagtaccgtggtctcgttgatagaaagattttatgatcctaaccagggagaaattttactagacaatgctgacatcaagacattgcaactgagatggttgcgaaatcaaattggtttggtgaaccaagaacctgctctttttgccactacgatactcgacaacattatgtatggtaagcctgatgcaaccatgatggaagttgaggccgctgcttgtgccgctaatgctcatagctttataaccctgcttcctaatggttacaagactcaggtgggagaacgcggtgtccaattatccggtggccaaaagcaaagaatagcaatcgcaagggctatgctaaaggatccaaagatacttctacttgatgaagcgactagcgcgcttgatgcaggttcagaaagcattgttcaagaagctttagaccgtctcatggttggaagaactacagtagtggtagctcatcgcctctcgacaatcagaaatgttgactctattgcggtcttgcaacaagggcaagttgttgaaactggaacccatgaagaacttatttccaaagctggggcatatgcttctttgattagattccaagaaatgatagggaccagagatttttcaatccttcaactcgaaggaaccgctcttcacggctaagctactcactatcgacaaagtctcttagcctccgttctgggagtctgagaaacctgagctattcttacagcacaggtgcagatggtcggatagagatgatatccaacgccgaaaatgataagaagaatccagcaccagctggatacttctgccgtttgcttaagttaaatgccccagaatggccttattcaattatgggagctgtaggctctgtcttgtctgggttcattggcccaactttcgctattgtgatgagtaacatgatagaggtgttttactatacaaatcctgcggccatggaacgaaaaacaaaagaatacgttttcatatacattggagcaggtatttacgctgttgtcgcgtacctaattcagcactacttcttcagtatcatgggagagaatcttacaacaagagttaggagaatgatgcttgcagccattttaaggaatgaagtcggatggttcgatgaggaggagaacaactcgagcctccttgcagctcgcctagcgactgatgccgccgacgtaaaatcagccatagctgagaggatatctgttatactgcagaacatgacctctcttctcacttctttcatagttgccttcatagttgaatggagagtttcactgctcatacttggcacattccctcttcttgtccttgcaaactttgctcagcaactatctctgaaaggattcgctggagataccgcaaaagctcatgcaaaaactagcatgattgcaggggaaggagtaagcaacattagaacagttgctgcattcaacgcccaagataagatcctctctttgttccgtaatgaactcaacgtacctcaacgtcaaagtcttcgccgcagccaatgttcagggtttctgtttggtctctcacagctcgctctttacgcgtctgaagctcttatcctttggtatggtgcccatctggtgaacaacggggtttccacgttctcaaaggttataaaggtcttcgtagtgttggttatcacggccaattctgtggctgaaactgtaagccttgctccagaaatcatccgaggtggagaagcagtcggatcggtattctcggtcctggatcgccctactcggatagatccagatgactgtgaagctgagcctgtcgagtctattcgtggtgagattgagcttcgccatgttgactttgcttacccatccagatcagatgttatcgtgtttaaggatttcagcctgagaatccgagcagggcagagccaagctctagtaggggccagtggatcggggaagagttccgttatcgcccttatcgagagattttatgatcctctatcagggaaagttatgattgatggaaaagacattcgaagattgaacttgaaatcgctcagacagaaaatcggacttgtccaacaagagcctgcattgtttgctgcaagtatattcgacaacattgcgtacgggaaagagggtgcaaccgaagcagaggtgatcgaggcagccagagccgctaacgttcacacatttgtgagcggtttacccgaaggctacaagacccctgttggagagcgcggagttcagctctcaggaggccaaaagcaacgaattgcaattgcacgagcagttcttaagaacccatctatcctactactcgacgaggccactagtgctcttgacgcagagtcagaatgcgtgttacaagaggcactagaaagacttatgagaggacgaactactgttcttgtcgctcaccggttatccacgatacgtggagtggacagtatcgcggtggttcaagatgggcgaattgttgaacaaggtagccatggagagctaatcagccggcccgaaggagcatattcgagactcttgcaactacaactccatcgcgtatgaaaaccttagaaccttaccaagttttcgatatggttcgggtcgattaaccacgtttgtttttttctttttttttctttagcctgaactaccgtctcctgatcatcagcaactggtaaatttttgtattgttgctcgcgccttcccccggccg

SEQ ID NO: 3109 - DNA, 3963 bp, Aquilegia formosa
ttgttgttgtttttctttctgtactaatggctgaaacaacagaagtgaaagcaattcatgaagcagagaagaaaaaagatcaaagtttaccattctatcaactctttacatttgcagacaagtatgattggtttattatgagtataggtagtattggagctatcattcatggctctgctatgccagttttctttcttttatttggtaaaatggttaatggatttggacaaaatcaatctgatcttcattctatggttcatcaagtctccaagtattctctgtatttcgtctaccttggactcattgtttgtctctcttcttatgctgagattgcttgttggatgtatactggagaaagacaagtgagtacattgaggaagaaatatttagaagcagtgttaaagcaagatgtgggttttttcgacacagatgcaagaactggtgatattgtgtttagtgtttctacagacacattacttgttcaagatgcaattagtgagaaggttgggaacttcatacattatctttcaacatttcttgctggattagtggttggttttgtatcggcatggaaactggcacttttgagtgtagctgtgataccggggattgcttttgccggtggtttatatgcctatactcttaccggtcttacttccaaaagccgagagtcttatgcaaatgctggcattattgcagaacaggccattgcgcaagtacggacagtttactcgtatgtgggggagacgaaggcccttaattcgtattctgatgccatacaaaatacattgaagcttggatataaagctggtatagcgaaaggtctgggaattggttgtacatatggaattgcatgtatgtcatgggccctggttttctggtatgctggggttttcatcagaaatgggcaaactgatggcgggaaggctttcacggcaattttctctgctattgttggtggcatgagcttggggcagtcattctcaaaccttggggcattcagcaaaggtaaaatggctggatataagctcatggagattatcaagcaaaagccctctattgttcaggactccttagatgggaaatgtttgcaggaagttaatggaaatatagaattcaaagacatagcatttagctatccatcaaggccggatgtcatcatcttccgtaacttttctatttcctttcctgctggcaagacggttgctgttgttggtggtagtgggtctggaaagagcaccattgtgtcacttattgaaaggttctatgatcctagccagggtcaggttttgctggacaatgtggatataaagaccctgcaactaaagtggctacgagatcaaattggtttggtgaaccaagagccagcactttttgccaccaccatcctggggaatatactttatggaaagcctgatgcaacaatggctgaagttgaagctgctgcttctgctgcaaacgcacatagctttattacactgctgcctaatggttacaatacacaggtgggagagcgtggagtgcaactctctggtggacagaaacagagaattgccattgcgagagctatgttgaaggacccaaaaattcttctccttgacgaggccactagtgctcttgatgcaggttccgagtgctttgtccaagaagctctagaccgcctcatggttgggagaaccacaatagttgtagctcatcgcctctccaccataagaaatgttgatagcattgctgttcttcagcaaggccaagttgttgaaaccggtactcatgaagaattgattgcaaaagctggggcatatgcctctttgatccggttccaggagatggcaaggaacagagactttagtgtccctttggctcaccaatctcgttcatctcgtttaagtcattcactttcaactaagtccttaagtctccgatctggcagtttaaggaacttgagctaccaatacagcactggtgcagatggtcggttagaaatgatctcgaaagctgacactgaacggaagaaccctgcaccaaatgggtacttcttgagacttcttaagcttaatgcaccagaatggccttatgtaattatgggggctgtcggatcaatactatcagggtttattggtcctacgtttgcaattgtgatgagcaatatgattgaagtgttctattatagagatctatctgcaatggagagaaagacaaaggagtttgtattcatatacattggtgctgggctgtatgctgtagtggcatatcttacacaacattacttcttcagtatcatgggggagaacctcacaactagagtcaggaggatgatgctctcagttatcctaaggaatgaagttgggtggtttgatgaggatgagaacaactcaagccttattgcagctcgcttagccacagatgctgctgatgtgaagtctgccatagccgagagaatttcagtgatactacagaacatgacatcacttctcatatcattcatagtcgcttttatagttgaatggagagtctcactacttattcttgggacgtttcctttgcttgtccttgctaattttgcccagcaattgtccatgaaaggattcgctggagacacagccaaggcacatgcaaaaactagcatgattgccggtgagggtgtcagtaacatccgtactgttgcagccttcaacgctcaggacaagatcctgtcgctcttcagccatgaacttcgcattccacaacttcgaaatcttcgtcgtagccaatctgctggccttctttttgggctttcccagcttgctctatatgcatctgaagctcttattctctggtatggagttcaccttgtgagcagaggtctctccacattctccaaggttatcaaggtctttattgtccttgtcattactgctaattctgttgccgagacagtaagccttgcccctgagatcatccggggtggtgaggctgtcagttctgtattttccatccttgatcgttcaaccaggattgatccagatgacccggaagctcaacaagttgaaacaatccgtggagagattgagttacatcatgttgacttttcttacccagcccgacctgacctaattgtgtttaaagactttaatctgcgaatccgagctgggaaaagccaggcgctggtgggtgccagtgggtctggtaagagctctgtgattgcattgattgagcggttctatgatccaactggcgggaaggttttgattgatggaaaagatattcgacggcttaacctgaaatctcttcgccttaagatagggctggttcaacaagaaccagctctttttgcaacaagcattttcgagaacattgcatatgggaaggatggagcaacagaggcagaagtcattgaggcagctcgtgctgctaatgtgcatgtttttgtgagtagtttacccgaagggtacaagacaccagttggggaaagaggggtccagctctcaggtggtcagaaacaacgaatagctatcgcaagggctgtgctaaaggatccagcagtacttctgctagacgaggctacaagtgcacttgatgcagagtcggagtgtgtgttacaagaagcccttgagaggttgatgagaggacggaccacagtgcttgtggctcataggttatccaccattagaggtgttgacaacattggtgtcgtacaagatggacatatcatagaacaaggaagtcactctgagcttctcaatcgacctgatggtgcatactgcaagctgttgcagctacaacatcattccatttaattctgctgtgtgactagtcggtactaataaccacaaagctttgggattactttttccatcattttttttgttgtaggataatggtgggtgtagatatcaggggatgagttagtaactcgtgtaatgatgttgtaaactatctaatcatggctgcatttcaaaggcagaagaaaatataatttcaaga

SEQ ID NO: 3110 - DNA, 3677 bp, Vinca minor
gctattttcctttgctgataaatatgattatgttttaatgatctctggaagcattggagctataattcatggttcatctatgcctgttttcttcctattgttcggccaaatggttaatggcttcggtaaaaaccaatctgatttgcataaaatgactcacgaagtcgcaaagtatgctctgtacttcgtctaccttggactcgtagtttgtttttcatcctacgccgagattgcttgttggatgcacaccggagaacggcaagccggagcattgaggaggaagtatttggaggcagtgttgaaacaagacgtcggattcttcgacacagatgctcggacaggagacattgttttcagtgtctcaacggatacacttcttgtccaagatgccattagtgagaaggtgggaaattttatccattatctttcgacgtttttggctggtttggtggttggttttgtttcagcatggaagttggctctgcttagtgtggcagtcattccgggaatcgcctttgccgggggcttgtacgcatacaccctcacgggcctcacatccaagagccgtgaatcttatgccaacgctggaataattgctgagcaggccattgcacaagttaggacagtttactcgtatgttggagagagtaaagctctgaattcctattcagatgcaatacagaatactttgaagctgggatacaaggctgggatggctaaaggcctcggactcggatgcacctatggaatagcatgcatgtcatgggcccttgttttctggtatgccggcgtcttcatcaggaatgggcagaccgatggtggaaaagcatttacagctattttctctgccattgttggtggcatgagtttgggtcagtcattttcgaatctcggggctttcagcaaaggtaaagctgcgggatacaagttaatggaaattatcaaacaaaagccaacaatagttcaagaccatgaggatggaaaatgcttagatgaggtcaatgggaatattgagttcaagagtgtgacgtttagctatccctccagacctgatgttattatcttcagggatttcactattttctttcctgctggaaagacggttgctgttgttggtggtagtggttcaggaaaaagcaccgttgtttctttgatcgaaaggttctacgatcctaatcagggtgaaattcttctcgacaatgtggacataaaaacgctacaactgcgatggttgagggatcagattggtttggttaatcaagaacctgcactctttgcgaccaccattcttgaaaacatactctacggaaagcctgatgcaaccatggccgaagtggaggctgctacctcggctgcaaatgctcatagctttatcactttgcttcctaatggatacaaaactcaggtaggagagcgtggcgttcaactttctggtggtcaaaagcagagagtagcgattgctcgagctatgttgaaaaatcctaagatcctgctgctcgatgaagctactagcgccctcgatgcaggttcagagagcattgtccaagaagctctagaccgtctcatggttggaaggacaacagtagttgttgcccatcgcctttctaccataagaaatgtcgactctgttgctgttatccagcaagggcaagttgtcgaaactggaacacacgaagaactggttgccaaagccggggcttatgcttcactaatccgattccaagaaatggtgggaaatagagacttttcaaatccttcaactcgccgtacacgctcttcccgtctaagccactctctgtcaactaaatcgctaagccttcgctctgggagtttaaggaatttaagctattcctacagcactggtgctgatggtcgtattgagatggtatcgaatgctgaaacagagaggaaaaatccagctccacatggatacttctgcaggcttttaaaactaaatgctcctgaatggccttattcaatcatgggtgccattggatcggttctttctggattcattggtccaacttttgcaattgtgatgagcaatatgattgaagtgttttattaccgaaatcccgccagcatggagaggaagacaaaggaatatgttttcatttacataggagccggtctttacgctgttgttgcatatttgattcaacattatttcttcagcattatgggagagaaccttactaccagagttaggagaatgatgcttgcagcaattttgaggaatgaagtcggatggttcgatgaggaggaacataattcaacattattagcagctcgtttagcaactgatgcggcggatgtaaaatcagcgattgctgagaggatatctgtgatcctgcagaatatgacctctctgcttacttcatttattgtagccttcatagttgaatggaaggtctcactacttatcctggccaccttcccacttcttgtccttgccaactttgctcagcaactctcactcaaaggatttgccggggacacggctaaggcccatgctaagaccagcatgatcgcaggtgaaggagtaagcaacattagaacagtggctgcattcaacgcccaagaaaagattctttccttgttttcccaggaacttcacgtcccacagctccggagtctccgacgaagccaaacttcaggccttctgtttggtctttcccagcttgccctttattcttcagaagctttaatcctatggtatggctcacatctcgttagtaagggcgcctctacgttctcaaaggttattaaggttttcgtggtcttagtcataacagccaattcggttgctgaaaccgttagccttgcacccgaaattataaggggtggtgaagcagttggctctgtattttctgtccttgatcgttcaacgaggatagattcagatgatcctgaagctgagacagttgaatcaatgcgcggtgacattgaatttcggcatgtagatttcgcatatccatcacggccagatgtcacagtgttcaaggaccttaaccttagaattcgggcaggtcagagccaagcactagtcggggctagtggttcggggaagagttctgttattgccctgattgagcgtttctatgatccgatagcggggaaagtcatgatcgatgggaaagacattagaagattgaatttgaagtctctaagactgaaaattgggctggtacaacaagagccagcgctctttgcagcaagcatatatgacaatatcgcgtatggtaaagaaggcgctactgaagctgaagtaatagaagctgctcgtgctgcaaatatgcatgcatttgttagtagcttgccggaagggtacaaaaccccggttggggaaagaggagttcaactctccggtggacaaaaacaacgaatagcaattgcaagagctgttcttaaggacccaacaatacttctgctagacgaagctacgagtgctcttgatgctgaatcagaatgtgttcttcaagaagcacttgaaagactaatgaggggtcgaaccactgttctcgtggctcatagattatcgactataagaggagtggattgcattggagttgtgcaagatggaagaattatagagcagggcagccatggagaactaatcagccggcctgacggtgcttattctaggcttttgcaactacagcacaatcacatatgag

SEQ ID NO: 3111 - DNA, 3898 bp, Malus domestica
atggcggagacagcggcggaggcgaagacattgccggaggcggagaagaagaaggagcagagcctgccgtttttccagctcttctcctttgcagacaagtacgattggatgctcatgatcttcggaagcttgggcgccgtcgtgcacggctcctccatgccgctgttcttcctcatgttcggcgaaatggttaacgggttcggagaaaaccaaatgaatttgcagaaaatgaccgccgaagtagcaaagtacgctttgtactttgtgtatctcggtctcatagtatgcgtaacatcctacgcagaaattgcatgctggatgtacaccggcgagaggcaggtgagcacgctgaggaagaagtatctggaggcggtgctgaaacaggacgtcggcttcttcgacacggacgccagaactggggacattgtcttcagtatctcgacggacactcttctggtccaagatgccatcagcgagaaggtggggaacttcatacactatctatctacatttctggcaggcctggtggtagggtttgtatcagcatggaggctggcgctgctgagtattgccgtgattcccggaatagtttttgccggcggcttatatgcctatacactcaccggcctcacgtccaagagtcgccagtcgtatgcaaatgcagggatagtggctgatcaggccattgcgcaagttcggacagtttattcctatgttggtgaaagcaaggccctcaattcgtattcggatgccatacagaacactttgcagcttggttacaaggccggaatggccaaaggtcttggcctagggtgcacctacggcattgcttgtatgtcatgggcacttgtttactggtacgctggtgtgtttatccgaaatgggcagactgatggagggaaagcgttcactgccattttctcagccattgttggtggcataagcttgggtcagtcattttcgaaccttggggcctttagcaaaggtaaatcagctggatacaagttgatggagataattaagcaaaagccaaccatagttcaagaccccttggaaggaaagtgcttatcggatgttagtggtaatatagaattcaaggaagtaaccttcagctacccttcgaggccagatgttattatcttccgaaatttttcaatcttctttccagccgggaagactgtcgctgttgttggtggtagtggttcagggaagagcactgttgtctctctaatcgaaaggttctacgatcctaaccaggggcaggttttgatcgatagcgtggacataaaaacgctgcaattgaaatggttgcgcgatcagattgggctggtaaaccaggaaccggcactctttgcaactacgatactcgagaacattctctatggaaagcccgacgcaacaatggaagacgttgaagttgcggcctcctcagcgaatgctcacagtttcatcaccttgcttccaaagggatataacactcaggtaggagagcgaggagttcaactctctggtggtcaaaagcagaggattgcaattgccagagctatgttgaaaaatccaaagatcctcctccttgacgaagctaccagcgccctggatgcaagctcagagagcattgttcaagaagctctggatcgtctcatggtcggaaggacaactgttattgtggcacatcgcctttccactattagaaatgttgatagcattgcagttatacaacaaggccaagttgtcgagacaggtacacatgaagaactgattgctaaagcaggggcatatgcttctctaattcgattccaagagatggttgggaacagagacttcaggaacccatcgactcgctgctctcgttcatcacgtctaagccactcattgtcaacgaagtctttaagcctccggtctggcagcttaaggaacctgagctattcgtacagtacgggtgctgatgggcggatagagatgatttcaaatgctgaaacagacaggaaaactcgagctcctaagaactatttcttccggcttctgaagctaaacgctcccgaatggccctattcaataatggccgctataggatcactactctccgggtttatcggtccaacatttgctattctaatgggcaacatgattgaggttttctactatagaaatcctgcctcaatggaaaggaagacaaaggaatatgttttcatgtacgttggagtgggactatacgcagtggttgcgtatttgatacagcattacttctgcagcatcatgggagagaacctcactactagagtgagaaggatgatgcttgcagcaatcttgaggaatgaagttggatggtttgatgaggaggagcacaactctaaccttctaacagctaaattggcgacggatgctgctgatgtgaaatcagctgtttctgagaggatatctgtgatattgcagaacatgacctcactcctcacttcattcattgttgccttcatagtggaatggagagtctccctgctcattttagcaaccttccctcttctggtgctagccaactttgctcagcaactttctttgaagggctttgctggagacacagccaaggctcatgcaaagacgagcatgattgctgggggagggagtgagcaacattcggacagtcgccgccttcaattcccaaaacaagatcctatctctgttctgccacgagctccgtctcccactgctgggaagcctccgccgcagccaaactgctggcgtcctatttggcctctctcagtttgctctccatgcctctgaagctctcattttgtggtatggtgcccacctcgttagcaaaggtgtctccaccttctcgaaagttattaaggttttcattgtccttgttgtaacggcgaattcagttgctgaaactgtcagccttgccccggagattatcaggggcggtgaagcagttggttcggtattttcaatccttgatcgtcaaacaaggattgacccagatgatcctgaggctgaggtggttgaatcagttcgcggagaaattgaacttaggcatgttgattttgcatatccatcgcgacctgatatcatggtgttcaaagattttagtctcagaatccgtactggccacagccaagcgcttgtcggagttagtggttcgggaaagagttctgtgattgcattgatcgagcgattttatgatccattagttgggaaagtaatgatcgatggcaaggacatccgccggttgaacttgaagtctcttcggttgaaaattggactggtgcaacaagaaccagccctgtttgcagcaagcatctttgaaaacattgcctacggcaaagaaggcgcaaccgaagcagaagtaatcgaagctgcacgtactgctaacgtgcatggtttcgttagcggattgcctgatggatacaaaaccccggttggggagcgaggagttcagctctctggcggacagaaacaaagaattgcaatagcaagggcggtgctcaaggaccctagaatactcttgctagatgaggccacaagtgcacttgatgctgaatcagaatgtgtgttgcaagaagcacttgagaggctaatgaagggccgcaccaccgtgctagttgcccaccgtttatcgacaattagaggggtggacagcattggcgtggtgcaagacgggcgcattgtggaacacggcagccattcggaactagtgagccgccccgacggagcttactcaaggctgttgcagctgcaaaatcatcacgtatgagaagagttttggtcaaaagcaagcatgcatgcatggatggccttgttgggtgttaattatgtgtgtcccctatttttcttagtttgtagatattggcaaatgtgtctgaacaatttctctctaatctctaaagcaagtattata

SEQ ID NO: 3112 - DNA, 4042 bp, Aquilegia formosa
cttggaatctctaaaaagcttcaatccttcgttttttacttcaatgtgaagaaaacaaaaaaccattaataatcttagtagtagtttagtttgaatagtttttatgctttagagtcttaacaataatggcagaaactgtagaaccaaaagttgtacttgaagcagagaagaagaaagaacagagtttacccttttatcagttattcacatttgctgataagtatgattacttattaatgattggaggaagtttaggagcttttatacatggttcagctatgccagttttctttcttttgtttggtgaaatggttaatggatttggtaaaaatcaatctgatttaaagaaattaactgaagaagtttcaaagtatgctctgtatttcgtctatcttggtctcgttgtttgcttatcttcttatgcagagattgcgtgttggatgtatacgggagagagacaagtgagtacattaaggaaaaagtatttagaagcagtattgaagcaagatgttggattctttgatacagatgctagaacaggagatattgtgttcagtgtttctacagatacactacttgttcaagatgctataagtgagaaggtgggtaatttcattcactatctttcaacttttctggctggattagttgtgggtttcatttcggcatggaggttggcactactaagcatagcagtgattccgggtattgcttttgctggtggcttatacgcatatactcttactggtcttacatccaagagccaagagtcttatgccaatgcagggataattgctgagcaggcagttgctcaagttcgaacagtttactcatatgtaggagagagcaaaacgctcaattcatactctgatgcaatatcagatacattgaagcttggatacaaggcaggaattgccaaaggccttggaattggttgtacatatggcattgcatgcatgtcgtgggccttagttttctggtatgctggggtttttatcaggaatggacagacagatggagggaaggcatttacagcgattttctcagccattgttgggggcataagcctgggacaatcattttcgaatctcggggcatttagtaaaggaaaagctgctggatacaagctaatggagattatcaagcagaaaccatctatagttcaagacgtatcaggagggaagtgtttgacggaagtcatgggaaacatcgaattcaaagatgtgacttttagctacccatcccgaccggatgtaattatcttgcgtgacttctcgattttctttcccgcgggaaagactgttgccgtagtcggaggtagtgggtcgggaaagagcactgttgtgtctttgattgaaagattctatgatcctaatcaggggcaggttcttttggacaatgcagatataaagacactgcaactaaagtggttacgcaatcagactggtttggtgaatcaagaaccagcactctttgcgaccactatactagaaaatatactctacgggaaacctgatgctactatttctgaagtagaagctgccgctactgctgctaatgcacatagcttcattactctgcttcccaatggttacaacacgcaggtgggagaacgaggagttcagctctctggcggccagaaacaaaggattgccattgccagggctatgttaaaaaaccccaagattctactccttgacgaggctactagtgctcttgatgcaggatctgagagtattgtccaagaggccctagaccgcctcatggttgggagaacaacaatagtcgttgctcatcgcctctccaccataagaaatgttgacacaatagcagttatccaacaagggcaagttgttgagactggtacccatgaagaactgatttccaaagctggggcttatgcttccttaataagatttcaagagatggtcaggaacagagacaatagcactccttcgacgcaccattcacgatcaacacgtctaagtcattctctttcgaccaagtcccttagcctccggtctggtagtttaaggaacttaagctatcagtatagcactggggctgatggtcgattagagatgatatctaatgctgatattggacgtaagattccagcaccgaaggggtacttcatcaggcttcttagaatgaattctccagaatggccttattcgctcatgggggctgttggatcaatactttcaggatttattggtccaacctttgcaattgtgatgagcaatatgattgaggttttctattataaagatccttctgcaatggagaggaaaacaaagcagttcgtgttcatatatatcggtgcaggcctttatgctgtaggcgcatatctcacacagcattattttttcagtattatgggggaaaatctgacgactagagtaaggagaatgatgctcgcagcaatcctaaggaatgaagttggatggtttgacgaggaagagaacaattcaagccttgtagctgctcgtctggctacagatgctgctgatgtgaaatcggccattgccgaaaggatctctgtgatacttcaaaatatgacatcattactgacatcatttatagttgcattcataatcgaatggagggtctctcttctcattttaggcaccttccctcttctagtccttgccaattttgctcagcaactttcgatgaaagggtttgctggggacacggcaaaggcacatgcaaagaccagcatgattgctggggagggagtgagtaacattcgcactgtagctgctttcaatgctcaggacaagatcctctcactcttcagtcacgagcttcgcattccacagcttaggagtcttcgtcgcagccagtctgctggcttactctttggtctctcccaacttgcactctacacatcagaggctctcattctatggtatggtgctcaccttgtgagtaaaggtgtctcgactttctcaaaggtcatcaaggtctttgtcgtgcttgtcatcactgccaactctgttgcggagactgttagtctagctcctgagattattcgaggtggtgaatctgtcagttctgtcttttcaatccttgatcggtccacaaaaattgatcctgatgacccggatgctgaggtagttgaatcagtacgtggggacattgaattgcgacacgttgactttgcttacccacttcgccctgaggtttctgtgtttagagattttaacctcagaatccgtgctggacagagccaagcccttgttggtgccagtggatctggaaagagctctgtgattgcgttgattgaaagattttatgatccagtggttgggaagattttaattgatggaaaggacattcgacgtctgaacttaaaatctctacgtctaaagataggattagttcaacaagaaccagccctatttgcttccagcatttttgagaacattgcttatgggaaagatggagcaacagaggcagaagtgattgaggcagctcgtgccgctaatgtacatgggtttgtaagtgggttaccaaatggatacaagactccagttggagaaagaggagtccagctctccggtggacaaaagcagcggattgcaattgcgagagcagtacttaagagcccagcaatacttctgcttgacgaggcaactagtgcactcgatgctgaatcagagtgcatgctacaagaagcacttgagagactgatgaaggggcggacaacaattcttgttgctcaccgattatcaaccattagaggggtggacaacattggtgtggttgaagatggacacattgttgaacaaggcagccatgctgaattggtcagccgagccgatagtgcgtactatcggcttttgcagctacaacaccatcacatctgattgacccgctgtcatcaaaatcatttctatggtatgatatatgggtcccatcaaatcctttttccttctttttttcctgaaaaaattatgatggttgtagatattagaatgagtttgttctgttgtaatgtatttcaggatggattcattcccagtcaagaagctaa

SEQ ID NO: 3113 - DNA, 4076 bp, Lactuca sativa
cctcgtttgaccacaagtccagtctcattcagactcagcacacccaactctgaaccactctttcatggcgtttgatctgctctcaatattctcgttgtctcatttttgaagaagtccagtacacaaccggagactgagcgtgctgccgtggaggtttagtaaaatggcggagacggtgaaggcaatgccggcacaggcggaaaagaagaaagagcagagtcttccgttctaccaacttttttcatttgcagataagttagattacgttctcatgatcttcggtagcatcggtgccattgttcacggatcttccatgcctgtatttttcctcttgttcggtcaaatggttaatggattcggcaaaaaccaaactgatttgagcaccatgactcatgaagtatctaagtatgctttgtatttcgtttatctcggactagtcgtctgcgtatcatcatatgcagagattggatgttggatgtatactggagaaaggcaagtgagtgcgttgaggaagaggtacttggaagccgttctgaaacaggacgtaggattttacgatacagatgcaagaacaggcgatatcgtttttggtgtttcaacagacactctccttgtccaagatgccattagcgagaaggttggaaacttcatccattacctttcgacatttttggctggattggtggtcggttttgtgtctgcttggaagctagctttactcagcattgcagtgataccgggaattgcatttgccggtggcttatacgcatatactctcaccggtctcacctccaagagccgtgaatcctacgccaatgccggcatcatcgctgaggaggcaattgcgcaagttagaactgtgtactcatatgttggggagacgaaggcccttaattcctattccgatgcaatacaacacacattgaagctgggttacaaggctggaatggcaaaaggattagggctcggatgtacatatggaatagcttgcatgtcttgggcacttgttttctggtatgcaggtgtctttataagaaacggacaaaccgacggtggaaaagcattcacagccattttctctgccattgttggtggaatgagtctagggcagtcattttcgaatcttggagcatttagcaaagggaaagcagctggatacaagttgtttgaaattattaagcaaaaacccactatacatcacaacactgtaaatgggaagtgtttgactgaagtcaacgggaatatcgagttcaaagaagtaacttttagttacccttcacgtccagatgtcattatctttagaagcttctccatattcttcccggccggaaagacagttgcggtggttggcggtagtgggtccggcaaaagcaccgttgtttccttaattgaaaggttttacgatcctaatcaaggccaaatactgctagacaatgtggacataaagacactccaacttgaatggctacgtgatcagattggtttagtaaaccaagaacccgcactcttcgccactaccatacttgaaaacatactttacggaaaacgagatgccacaatggctgacgtggaatccgccacgtcagcagcgaatgcgcacagtttcatcacccttcttcctaatggctacaacactcaagtcggcgaaagaggaatccaactatctggtggtcaaaaacaaagaattgcaattgccagagccatgttaaaaaaccctaaaatcctacttctagacgaagcgacaagcgcgctggattccggttccgagagcatcgtacaggaagctctcgaccggttaatgatcgggcggacaaccgttgtggtcgcacatcggttgtccaccataagaaatgttgactcggtagctgtcatccaacaaggacatgttgttgaaaccggaacacacgaagaactgatttcaaaaccaggggcgtatgcgtctttaatcaggtttcaagaaatggcgggaaatcgggatttttcgaatccttctacacgtaggacacggtcaacacgacttagccattcattgtcgacaaagtctttaagtcttagatctggaagtttaaggaatttgagttatcagtatagtactggtgcggatggtcgtattgagatgatatcaaatgctgaaacagatagaaaaaacccggctccgagtgggtatttcttcagactattgaagatgaatgctcccgaatggccttattctataatgggcgctgtggggtccgtgctttcgggatttatcggtcccacattcgcgattgttatgagtaatatgattgaggttttttactatgataaccctgataaaatggagagtaaaaccaaagaatgtgttttcatctacgtaggagctggtttatatgcggttgtagcgtatctaatccaacattacttctttagtatcatgggcgagaatctcactacacgagtaagacgaatgatgctagcagcgataatgaggaatgaagttggatggttcgatgaagaagagcataactcgagtttagttgcagcccgattagcgacagacgccgcagatgtgaagtcagccattgctgaaaggatctcggttatattgcagaacatgacttcactcctgacgtcatttgtggttgcgtttatagtggaatggagggtttcgcttcttattcttggcaccttccctcttcttgttctggctcattttgctcagcaactttcactaaaaggcttcgccggagacacggccaaagcacatgcgaaaaccagcatgatcgccggagaaggagtgagcaacattcgaaccatcgcagcctttaacgcccaagacaaaatcctgtccttattctccgacgaacttcgtgtcccacagaagcaaagccttcgacggagtcaaatctccggtatcctgtttggcgtctcccaactcgctcttttcgcctccgaagccctaatcctctggtacggcgcacatctcgttaaaaacggtgtctccactttctcaaaagtcatcaaagtgtttgtcgttttagtcatcaccgctaattcggtagcggaaacggttagcctcgctccggagattatcagaggcggtgaagccatcggctctgtgttttccgttctcgataggtcaaccaggatcgaccccgacgatccagattccgagcctgtggaaacgattagaggcgaaatcgagttacgtcatgttgacttttcgtatccttcgagacctgacgtcattatattcaaggatctgagtcttagaatccgatcaggccagagccaagcgttagtcggagccagtggttgcgggaaaagttcaataatcgcactcatcgaacgattctacgatccatccgccggaaaagttatgatcgacggaaaagacatcagaaggttaaacctccggtcgcttcgtgcgaaaatcggattagtccaacaagagccggccttattcgcggctagcataatggagaacatcgcgtacgggaaagagggagcaacggaggcggaagtgattgaagcggcgcgtgcagcaaacgttcatgtattcgttagcggtttgcctcaagggtataaaactccggtaggtgagagaggggttcagttatccggagggcaaaaacagaggattgcaatagcgagggctgttttgaaagatccgacgattctgttactagatgaggcgacgagtgccctagatgctgaatcggagtgtgtgcttcaggaagcacttgaacggctgatgagagggcggacgacggtgctagtggcccaccggttatcgacgatacgaggcgtggataatattggagtggttcaagacggtcggattgtggaacaaggcagccatggggaattgttgagccgtggcgctgatggggcctactcacgcttgttgcagctacaacaccatcggatatgattatatgaaaatttgggggttgtttttttattaatatagaatcaaagagatgaatgatatgcatgatggtatgtatggaatgaacggatctagtaattaaattgtgtttatgtcttttaatttaatcattggtttttatatcatgtctcatacatgagctcta

SEQ ID NO: 3114 - DNA, 3951 bp, Triphysaria pusilla
aaaacccaccagaaaaatccgaccatgcatatcgcatttataatcaacatttattactgaactgggttggtttatcgagagtgatttaaaagctaaactttttatttttcttcataaagactccattttttttgaaaaaatggcggaggcggctgacgtcggcaaaccaatgccattgccggcggagtccgagaaaaagaaagcacaaagcttgccgttttatcagctgtttacctttgctgataaatatgacttagttctgatgataactggcagccttggcgcaatcattcacgggtcctctatgcctgttttctttttgctttttggccaaatggtcaatgggtttggtaaaaaccaaatggatttgcaaaaaatgacccacgaagttgcaaagtatgctctatatttcgtctatcttggattgatagtctgcttttcttcctacgccgagatatcatgttggatgtacactggggagcgccaagttggagcaatgaggaagaaatatttagaagctgtattgaaacaagatgtgggctttttcgatacagacgcaagaacaggggatattgttttcagtgtctctactgatactcttcttgttcaagatgccattagtgaaaaggttggtaatttcattcattatctttcgacgtttttggctggattggtggttggttttgtgtcggcatggagattagctttgctgagtgtagctgtgatacccggaatcgcgtttgccggtggtttatacgcttatacgctaaccggacttacgtcgaagagccgggaatcgtatgctagtgctggtataattgctgagcagtcgattgcacaagttaggacagtttattcgtatgccggtgaaacgaaagccttaaatgcatattcggatttaatacaaaacacgttaaagctaggatacaaggcgggtatggctaaagggcttggattaggatgtacttacggtatagcatgtatgtcgtgggctcttgttttctggtacgccggagtttttatcagaaacgggcagactgacggcggcaaagccttcaccgctattttctcggctattgttggtggcatgagcttgggacagtcgttttccaatcttggcgcgtttagcaaaggaaaggccgctgggtacaaattaatggagataataaaacaaaaaccgaccatagttcaagacggggagggctcgaagtgtttgagtaaagtaaacgggaatatcgagttcaagaatgtgacttttagctacccgtctagacccgatgttatcatcttccgagacttttcgattttcttcccagccggaaaaactattgcggtggttggtggtagcggttcgggaaaaagcaccgtcgtttcgttgatagaacgattttacgatccgaatcagggtgagattttgcttgatgaagtcgatataaagacattgcagctaagatggttaaggaatcaaataggtttggttaatcaagaaccggctttatttgccacgacaatactcgagaatattctatacgggaagcccgatgcaaccatggctgaagtcgaagctgctgcatcggctgctaatgctcatagctttgtcacattacttcctaatggttacaacacacaggtcggagaacgtggggtccagctatccggaggccagaagcaaagaatcgcgatagcaagagcaatgctaaaagacccaaaaatcctcctcctcgacgaggccacaagtgccctcgatgccggctccgagagcattgtccaagaagcgttagaccgtctgatggtaggacgaacaaccgtaattgtagctcaccgtctctccacaatccgaaacgtcgactctatctccgtcatacaacaaggccaagtcgtcgaaaccgggacccacgaggaactaatctccaaagccggcgcttacgcgtccctaataagattccaagaaatgatcggaaacagagaaatcacaacaaacccttccaccattcggaaccgctcgtctcgtttaagtcactccttgtcgactaagtcactcagtctccgttcggggagtttacgaaacttgagctattcttacagcacgggagccgatggccggatagagatggtgtccaatgccgagacggatcgaaaaaatccggccccggctggttatttttgccgtctgcttaaattaaacgctccggaatgggcttactcgattatgggaggtgtagggtctatactttccggtttcatcggcccgacttttgcgatcgtgatgagtaatatgattgaggttttttactaccaaaactcggccgatatggaaagaaaaacaaaggagtacgtttttatctacatcggagctggtatttatgccgttggtgcgtatcttattcagcattatttctttagcatcatgggcgaaaatttaactacgcgagttaggagaatgatgcttgcagcgatcttgaggaatgaagtcggatggttcgatgaggaggagaacaattcgggcttactagcggcccggttatcagccgatgctgcggatgtgaaatcggcaatagccgagaggatatcggttatattacaaaacatgacatcacttctcacttctttcatagttgccttcattgttgaatggagagtctcattgctcattcttgctacattcccacttcttgtcctagcaaattttgctcagcaactctcactaaaagggttcgccggcgacacggccaaagcccacgcgaaaacgagcatgattgccggagaaggtgtcagcaacattcgtacagttgccgcatttaacgcccaagaaaagatcctatctttattctcacacgagctccgattaccccaaaaccggagcctccgccggagccaatcctccggcttcctattcggcctctcccagctcgctctctacgcctccgaagctctcatcctctggtacggggcccacctcgttagtaaaggcctctccactttctcgaaggtcataaaagtctttgtcgtcctagtcatcaccgccaactcggtagctgagaccgttagcctcgctccggaaatcatacgtggcggcgaggcggtcgggtcggttttctcgattcttgatcggtccacgaggatcgacccggacgacaccgaagcggaccccgtcgagactatccgcggcgagattgaactacgtcatgttgactttgcttacccgtctcgacccgacgtgttggtttttaaggactttaacttaaggatccgtgcgggccagagccaggctctggtcggcgcaagcgggtcgggtaaaagctccgtcatagccctaatcgaacgattttacgacccgatcggcgggaaagtcatgatcgacgggaaagatattcggagactaaatttgaaatctcttcgtttaaaaattgggttggttcaacaagagcccgttttattcgcgacaagcattttcgacaacattgcgtacgggaaaaacggggcgaccgagacggaggtgatcgaggcggcaagggcggcgaatgtgcacacgtttgtgagtggtttgccggagggttataaaactccggtgggcgagagaggggtacaattgtccggtgggcaaaagcaacggattgcgattgcgcgggccgtacttaaggacccgtcgatacttttgctcgacgaggcgacgagtgctctcgatgcggagtcggagtgtgttttgcaagaggcgctcgagaggctcatgaggggtcgaaccacggttctagtggctcatcggttgtcgactatacgaggcgtggatagtatcggggtggttcaggatgggcggatagtcgagcagggtagccatggggagttggttagtcggcacgatggggcgtattcgaggttgttgcaactgcaacaccatcgaatttgatgatgagttggataaaaaaagcagttggggctttgttaacttttttt

SEQ ID NO: 3115 - DNA, 4031 bp, Helianthus annuus
gaagaaagagcaaactcttccatcctcactcacactcactctcaagctcattttcattttcatggcgtttgatctctctcatttctgaacaaacaatttctcacattcaaccataatatggcggaaacggcgaaaacaatgccggagaagaagaaagagcaaactcttccattctataaactcttttcattcgcggataaatacgattacattctcatgatctccggcagcatcggtgccatcattcacggttcctccatgccgttcttcttcctcttgttcggtcaaatggttaacggtttcggtaaaaaccagtcagatttatccaccatgactcatgaagtctccaagtatgctttgtattttgtttaccttgggcttgttgtctgcgtatcttcctatgcagagattggatgctggatgtacaccggagaacggcaagtgagtgcgttaaggaagaggtacttagaagcagtactgaaacaagacgtcggattttacgatacagatgcgagaacaggagatattgtttttggtatttcaacggatactcttcttgttcaagatgccattagcgagaaggtggggaactttatccattatctttccacatttttggctggattagtggttggttttgtgtcagcgtggaagcttgctctactgagtattgctgttattccgggtattgcatttgcgggcggcttatacgcgtatacactcaccggtctcacttcgaaaagccgtgaatcctatgccaatgctggcattatcgccgaggaggctattgcacaagttagaactgtatactcatatgttggggaaacgaaggcgctcaactcgtactcagatgcgatacagcatacgctcaagctcgggtataaggcgggaatggcaaaggggttgggtttaggatgtacttatggaatcgcttgcatgtcttgggcacttgtgttctggtatgcaggcgtgtttattagaaacggacagaccgatggcggaaaggcgtttactgccattttctccgccattgttggtggcatgagtttaggtcagtcgttttcgaatataggagcttttagcaaaggcaaagcagctggatacaaattgctggaaatcatccagcaaaaacccactatagctcacaactctacagatgggaaatgtctagcagaagtcaacggaaacattgagttcaaagaagtaacctttagttacccgtcacgtccggatgtcataatctttagaaatttctcaattttcttcccagctggaaagacggttgctgtggtcggtggcagcgggtccgggaagagcaccgttgtttcgttaatagaacggttttacgaccctaatcaaggccagatactgatagacaatgtggacataaagacgctgcaacttcgatggttgcgcgatcagattggccttgtgaaccaagaacccgcacttttcgctaccactatacttgaaaacatactttacggaaaaccggatgcaactatggctgaagttgaagcagctgcgtctgcagccaatgctcacagcttcatcaccctgcttcctaatggttataacactcaggttggggagagaggagttcagttatccggtggtcagaaacaaagaatcgcaatagctagagcaatgttaaagaacccgaagattttacttcttgatgaagcaaccagtgccctcgattccggttcggaaagcatcgtgcaagaagctcttgaccgtttgatgttaggaagaacaactgtggtggttgcgcatcgtctttcaaccataagaaacgttgattcaatagcagttatccaacaaggacaagttgtcgaaaccgggacccacgaagaactcatttcaaaaccaggaccctacgcttcgttaattcggtttcaagagatggcgggaaaccgggatttctcaaacccttcaacgcatcgtacacggtcaacacggttaagtcactcgttgtcgacaaagtctctcagcctcagatcgggaagcttaagaaacttaagctactcgtacagtaccggtgcagatggtcgtattgaaatgatctcaaacgctgaaacagaaagaaaaaatccagcacctagtggttactttttccgtcttttgaaactgaacgcacccgaatggccttattcaataatgggtgctgtgggatcaattctttccggattcatcggtccaacattcgctattgtcatgagtaatatgatcgaggtcttttactataataaccctgctaaaatggaaagcaagactaaagagtgtgttttcatctacgttggagccggtttgtatgcagttgtagcatatttgatacaacattacttctttagtattatgggtgagaatcttactactagagtaagaaggatgatgcttgcagcaatcttgaggaatgaagttggatggttcgatgaggaagagcataactcgagtctagttgcagcccggctagccacggatgctgcagacgttaagtctgcaatcgccgagaggatagcggttatattgcaaaacgtgacgtcactccttacatcatttgtagttgcattcatagtggaatggagggtttcacttctaattcttggcaccttccctctgcttgtcatggcatattttgctcagcaactttcactcaaaggctttgctggtgacacagccaaggcacacgcaaaaactagtatgattgcaggggaaggagtaagcaacatccgaacaatcgcagcgtttaacgcccaagacaagattctaacattattctccaacgaacttcgtgtccctcaaagccaaagtcttcgtcgtagtcaattttccggaatcctattcggtatttcccaactcgcgctcttctcatccgaagctctaatcctctggtacggtgcccacctcgttagcgtacacgtctccaccttctccaaagtcatcaaagtgtttgtagtcctggtcattaccgctaactcagtagccgaaacagttagcctagcccctgaaatcatccgaggtggtgaagccatcggctcggtattttcggttcttgataggtcgactcgaattgacccggacgatccagatgccgagactgttgaaacaattcgaggtgagatagagttacgtcatgttgacttttcttacccgtcaagacccgatgtgatgatttttaaagaccttagtcttagaatccgtgcgggccagagtcaagccctagttggagccagcggttcgggtaaaagttccataattgcgttaatagagcgattttacgacccgacagctggaaaagttatgattgatgggaaagacattagacggttaaacttacgggcccttcgggccaagatcgggctggtccaacaagagcccgctttattcgcagctagtataatggaaaatattgcttatgggaaagacggtgctacagagtcggaagtcatagaagcagcacgtgcagcaaatgttcatacatttgtgagcggtttacctcaagggtacaaaacgccagttggcgagagaggggttcagctctcaggcggccagaaacaacgaatcgctatagctcgggctgtactcaaagacccaacaatattgctattagatgaagcgactagtgctctagatgctgaatccgaatgtgtgcttcaagaggcacttgaaaggctcatgagaggacgaaccacggttctagtggctcaccggttatcaaccatacgtggtgtggataatatcggggtggttcaagacggtcgaattgtggaacaaggtagccattcggaattgttgagccgaggtagcgatggggcttactttaggctgttgcagctacaacagcatcgagcatgaattaaagattatgtggtataagtttagtaaattatgtgtatgtggtattaacctattgttttaacttatattcgggcttttataagccaagtttggttgatatagcaaaatagttttttcttaataaatgtttgtaattttaagttacctaaatagaacaatataataaagtt

SEQ ID NO: 3116 - DNA, 4024 bp, Chrysanthemum coronarium
acattctcgccctcacttatttcaccacaataaatgatcctcacaatcacatacatagagtcacaccatttctcacactcaaaacacactcacattccccatgcttgttcattcctagatctctcttactcactcactcacacttctctcatgaactaaactcaatacaagcattttgttattcagtgaaccaaaccaaaattatatacaaaatggctgactcaactgagccaaccaaaccaatgccaccaccgccagaaaagaaaaaagaacatagcctcccttttttcaaactcttttcatttgctgataaacttgattacatgttaatgtcacttggtaccattggtgccattattcatggttcttctatgccttgtttctttcttttatttggtcagatgattaatggttttggtaaaaaccaatctgatttaactaccatgacacatgaagtctccaagtatgctctatatttcgtgtatcttggattagtggtttgtgtatcatcttatgctgagattggatgttggatgtatactggtgaaagacaagtgagtgcattgaggaaaaggtatctggaagctgttttgaaacaagatgttggattttatgatactgatgccagaacaggtgatattgtgtttagtgtgtccactgatacactacttgttcaagatgccatcagtgagaaggtgggaaactttatacactatctttcgacgtttttggctggattggtggttggtttcgtgtcggcatggaagctagctcttttgagtgttgctgttattcccgggatcgcatttgcaggaggcttgtatgcgtatactcttactggtctcacttccaagagccgtgaatcctatgcaaatgctggcattatcgccgagcaggctattgcacaagtaaggacggtgtactcatacgttggtgagaccaaggcccttgattcatattcagatgcaatacaacacacccttaagctcggctacaaggctgggatggcaaagggtttaggacttggatgtacatatggaattgcatgcatgtcatgggcacttgtgttttggtatgctggtgtatttattaggaatgggcagacagatggtggaaaagcattcactgctattttctcagcaattgttggtggcatgagtttgggtcagtctttttcgaatcttggagcgttcagcaaaggcaaagcagctgggtataaactatttgaaatgataaagcaaaagccaactatagtccaggactctacagatgggaagtgtttttcggaggtcaatggtaacattgagttcaaggatatatcttttagttacccttcaaggccagatgttcttatcttcagaaatttctccattttcttcccagccggcaagacagttgctgtggttggtggcagtgggtctggtaaaagtactgttgtttctctgatagaaaggttttacgaccctaatcaaggacaaatattgctagacaatgttgacattaagaccttgcaactacgttggctgcgtgatcaaattggtcttgtgaaccaagaacctgcattgtttgccaccacaatccttgaaaacatactttatggaaaacctgatgcaactacagctgaagtcgaagctgcaacatctgctgcaaatgctcatagtttcattaccttgcttcctaatggttacaacactcaggtcggtgagcgtggggtccagctatctggtggtcaaaaacaaagaatcgcaattgctagagcaatgttaaaagaccctaaaattctgcttcttgacgaggccaccagcgcccttgattcaggttctgaaagcatagttcaagaagctcttgacaggttaatgattggaagaacaacagttgtggttgcacatcgtttatccaccataagaaatgttgactcgatagcagttcttcaacaaggacaaattgtggagacgggaacacatgaagaactaatttcaaaacctggtgcctacgcttcacttattagattccaagaaatggtgggaaatcgagacttttcaaacccttcaactcaccgcacacgttcatcacgattaagtcattcattgtcaacaaaatcccttagcctcaggtctggaagcttaagaaatttaagctatcagtacagcacgggtgctgatggtcgtatagaaatggtatccaatgctgaaactgatagaaaaaatccagctccaagtggttatttcttccgtcttttaaaaatgaacgctcctgagtggccttattcaataatgggagctgtaggatcaatcctatctggatttatcggtccaacttttgccattgtgatgagtaacatgattgaagttttttacttcaataaccccgctcgaatggagagaaagaccaaagagtatgtttttatatacgttggagccggtctatacgctgttgttgcatacttgatccaacattacttctttagtattatgggcgagaacctcactacaagagtaagaaggatgatgctttcagcgatcatgagaaatgaagttggatggtacgacgaggaggagcacaactctagtttagttgcagcccgactagccacagatgctgcagacgtgaaatctgcaatagccgagaggatctcagttatactacaaaacatgacatctcttctaacttcattcgtcgttgccttcattgtggaatggagggtctcgcttctgattctcgcgactttcccgctccttgtcctagcccattttgctcagcaactttcgctcaaaggttttgctggagacacagcaaaggcgcatgcaaaaactagcatgattgccggggaaggagtgagcaacattaggacggttgcagcctttaacgcgcaagacaagatcctttcattattctcagctgaactacgtgtcccacaaaaacaaagccttcgtcgtagtcagttttctggaatgctttttggcatctcacaactcgccctctttgcatccgaagcgcttatcttatggtatggcgcgcaccttgttaacaaaggcctttcaaccttctcaaaagtgatcaaagtgtttatcgttctggtcatcactgcaaactcagtagctgaaactgttagccttgctcctgagattattaggggtggtgaagccattggttctgtgttttcaattctcgacagatcaacacggattgatcctgatgatcctgatgccgaagtggttgaaactatgcgaggcgagattgaattacgtcatgttgactttgcttacccttcaagaccggatataatggttttcaaggactttagtcttagaatacgggccggtcaaagccaagcactcgtgggagccagtggttcgggaaaaagctcagtgattgcattgattgaaagattctatgacccaattacaggaagggttatgattgatgggaaagatattagacggttaaatctaaagtccctacgtttgaaaatcggtcttgtccaacaagaacctgcgctattcgcagcaagcatcatggaaaacattgcgtatggaaaagagggagccacagaagcagaaattatagcagcagcaacagcagcaaatgtgcatacatttgttagcggtttgccagaagggtatcacactccagttggcgaaagaggagttcagctctcaggtggacaaaaacaaagaatagcaatagcccgagctgttttaaagaacccaacaattctcttacttgatgaagccacgagcgctttagacgctgaatcagagtgtgtgcttcaagaagcacttgaaagactaatgaggggtcgaacagtggttctaatagcccaccgtttatcaacaattcgtggagtagacagtataggcgtggttcaagatggtcgaatagttgaacaaggtagtcatggtgaacttgtaagccgacccgaaggggcttactctaggctcttgcaactacaacaacatcgcatatgataataataataatacaagggtttgttacgtagaagattatagtaaaattgtgcatg

SEQ ID NO: 3117 - DNA, 3794 bp, Chrysanthemum coronarium
ccaaccaaaccaatgccaccaccgccagaaaagaaaaaagaacatagcctcccttttttcaaactcttttcatttgctgataaacttgattacatgttaatgtcacttggtaccattggtgccattattcatggttcttctatgccttgtttctttcttttatttggtcagatgattaatggttttggtaaaaaccaatctgatttaactaccatgacacatgaagtctccaagtatgctctatatttcgtgtatcttggattagtggtttgtgtatcatcttatgctgagattggatgttggatgtatactggtgaaagacaagtgagtgcattgaggaaaaggtatctggaagctgttttgaaacaagatgttggattttatgatactgatgccagaacaggtgatattgtgtttagtgtgtccactgatacactacttgttcaagatgccatcagtgagaaggtgggaaactttatacactatctttcgacgtttttggctggattggtggttggtttcgtgtcggcatggaagctagctcttttgagtgttgctgttattcccgggatcgcatttgcaggaggcttgtatgcgtatactcttactggtctcacttccaagagccgtgaatcctatgcaaatgctggcattatcgccgagcaggctattgcacaagtaaggacggtgtactcatacgttggtgagaccaaggcccttgattcatattcagatgcaatacaacacacccttaagctcggctacaaggctgggatggcaaagggtttgggactcggatgtacatatggaattgcatgcatgtcatgggcacttgtgttttggtatgctggtgtatttattaggaatgggcagacagatggtggaaaagcattcactgctattttctcagcaattgttggtggcatgagtttgggtcagtctttttcgaatcttggagcgttcagcaaaggcaaagcagctgggtataaactatttgaaatgataaagcaaaagccaactatagtccaggactctacagatgggaagtgtttttcggaggtcaatggtaacattgagttcaaggatatatcttttagttacccttcaaggccagatgttcttatcttcagaaatttctccattttcttcccagccggcaagacagttgctgtggttggtggcagtgggtctggtaaaagtactgttgtttctctgatagaaaggttttacgaccctaatcaaggacaaatattgctagacaatgttgacattaagaccttgcaactacgttggctgcgtgatcaaattggtcttgtgaaccaagaacctgcattgtttgccaccacaatccttgaaaacatactttatggaaaacctgatgcaactacagctgaagtcgaagctgcaacatctgctgcaaatgctcatagtttcattaccttgcttcctaatggttacaacactcaggttggtgagcgtggagtccagctatctggtggtcaaaaacaaagaatcgcaattgctagagcaatgttaaaagaccctaaaattctgcttcttgacgaggccaccagcgcccttgattcaggttctgaaagcatagttcaagaagctcttgacaggttaatgattggaagaacaacagttgtggttgcacatcgtttatccaccataagaaatgttgactcgatagcagttcttcaacaaggacaaattgtggagacgggaacacatgaagaactaatttcaaaacctggtgcctacgcttcacttattagattccaagaaatggtgggaaatcgagacttttcaaacccttcaactcaccgcacacgttcatcacgattaagtcattcattgtcaacaaaatcccttagcctcaggtctggaagcttaagaaatttaagctatcagtacagcacgggtgctgatggtcgtatagaaatggtatccaatgctgaaactgatagaaaaaatccagctccaagtggttatttcttccgtcttttaaaaatgaacgctcctgagtggccttattcaataatgggagctgtaggatcaatcctatctggatttatcggtccaacttttgccattgtgatgagtaatatgattgaagttttttactacaataaccccgctagaatggagaaaaaaaccaaagagtatgtttttatatacgttggagccggtctatacgctgttgttgcatacttgatccaacattacttctttagtattatgggcgagaacctcactacaagagtaagaaggatgatgctttcagcgatcatgagaaatgaagttggatggtacgacgaggaggagcacaactctagtttagttgcagcccgactagccacagatgctgcagacgtgaaatctgcaatagccgagaggatctcagttatactacaaaacatgacatctcttctaacttcattcgtcgttgccttcattgtggaatggagggtctcgcttctgattctcgcgactttcccgctccttgtcctagcccattttgctcagcaactttcgctcaaaggtttcgctggagacacagcaaaggcgcatgcaaaaactagcatgattgccggggaaggagtgagcaacattaggacggttgcagcctttaacgcgcaagacaagatcctttcattattctcagctgaactacgtgtcccacaaaaacaaagccttcgtcgtagtcagttttctggaatgctttttggcatctcacaactcgccctctttgcatccgaagcgcttatcttatggtatggcgcgcaccttgttaacaaaggcctttcaaccttctcaaaagtgatcaaagtgtttatcgttctggtcatcactgcaaactcagtagctgaaactgttagccttgctcctgagattattaggggtggtgaagccattggttctgtgttttcaattctcgacagatcaacacggattgatcctgatgatcctgatgccgaagtggttgaaactatgcgaggcgagattgaattacgtcatgttgactttgcttacccttcaagaccggatataatggttttcaaggactttagtcttagaatacgggccggtcaaagccaagcactcgtgggagccagtggttcgggaaaaagctcagtgattgcattgattgaaagattctatgacccaattacaggaagggttatgattgatgggaaagatattagacggttaaatctaaagtccctacgtttgaaaatcggtcttgtccaacaagaacctgcgctattcgcagcaagcatcatggaaaacattgcgtatggaaaagagggagccacagaagcagaaattatagcagcagcaacagcagcaaatgtgcatacatttgttagcggtttgccagaagggtatcacactccagttggcgaaagaggagttcagctctcaggtggacaaaaacaaagaatagcaatagcccgagctgttttaaagaacccaacaattctcttacttgatgaagccacgagcgctttagacgctgaatcagagtgtgtgcttcaagaagcacttgaaagactaatgaggggtcgaacagtggttctaatagcccaccgtttatcaacaattcgtggagtggacagtataggcgtggttcaagatggtcgaatagttgaacaaggtagtcatggtgaacttgtaagccgacccgaaggggcttactctaggctcttgcaactacaacaacatcgcatatgataataataataatacaagggtttgttacgtagaagattatagtaaaattgtgcatg

SEQ ID NO: 3118 - DNA, 3903 bp, Euphorbia peplus
tttacacaaaatggcagctgaaaacattgacagtaacaaatcagcattaccattagcagaagctgagaagaagaaagaacaaagcttaccctttttccaacttttctcttttgctgataagtatgattggcttcttatgatcattggtaccattggagctatcatccatggctcttccatgccttgctttttcttgctttttggagaaatgatcaatgggtttggcaagaaccaatctgatttgtctctcatgactcatgaagttgaaaagtatgctctgtattttgtgtatcttggaggagtggtgtgcgtggcatcttatgcagaggttgcatgctggatgtatagtggggaaagacaagtgggtacactgaggaagaagtatcttgaagctgtgttgaaacaagatgtaggcttctttgatacagatgctagaactggtgatattgtcttcagtgtctctacggacactcttcttgttcaagatgccattagcgagaaggtggggaactttatacattacctatcaacatttctggcggggctagtggttggttttgtgtcagcatggcggttagcattgctgagtgtggcaatcattcctggcattgctttcgcgggtggcttatatgcgtatactctcaccggccttacttcgaagagccgtcaatcttatgcacttgccaacgttattgccgagcaggccattgcgcaagttcggacagtgtactcctatgttggggagaccaaagccctgaattcatattcagatgcaatacagaacactttaaagcttggatacaaggctgggatggctaaaggtttaggacttggatgtacttatggaatagcatgtatgtcgtgggcccttgtgttctggtatgccggcgtttttatcaggaatggacaatctgatggagggaaggcgttcacggcggtcttctctgccattgttggtggcctgagtttaggccagtcattttcgaaccttgggccctttagcaaaggtaaagcagctggatacaagttgatggaaattataaagcaaaagcctaccataattcaagatctttctgatgggaaatgcttgcctgaggttaatgggaatatagaattcaaagacgtaactttcagctatccatcaagaccagatgtgatgatattccgtgacttttctattttctttcctgctggaaagactgtagctgttgttggtggtagtggatcaggcaaaagtacagttgtttctctaatagagcggttttatgatcctaatcaggggcaagttttgctggataatgtggacattaagaccctgcagttaaagtggttgcgtgatcagattgggctcgtcaaccaagaacccgcactttttgcaactaccatacttgagaatatactctacggaaagcctggtgcaacgatggatgaagtggaagctgctacttccgctgcaaatgctcacagctttattactttacttcctaaggggtacaatactcaggtgggagagcgaggagtgcaactctctggtggacagaaacaaagaattgcaattgctagagctatgttgaagaacccgaaaatcctgcttcttgatgaagcaactagtgcacttgatgccggctctgaaagcatcgttcaagaagcattagatcgtctaatggttggaagaactactgtagtagtagcacatcgactatccactattagaaatgttgatacaattgctgtcattcaacaaggacaggttgttgagacagggactcatgaagagttgatttccaaaggaggatcatatgcttcattgatccggttccaagaaatagtgcgaaatagggactttgcaaatccatcaactcgccggactcgttcatctcgcctaagccattcactttccacaaaatcgttaagcctccgctcgggcagtttacgaaacttgagctattcatacagcactggtgcagatggtcgcattgagatggtctcaaatgctgaaactgaccggaaaactacagcacctgatggttattttttgagattgctgaagctaaatgctccggagtggccatattctattatggctgtagtaggatccatacttgctggtttcattggtccaatctttgccataacgatgagcaatatgattgaggttttctactatacagatcttgctgccatggaacggaagacaaaggagtatgtcttcgtttacatcggtgctggcgtttatggggttgtagcttatttgattcaacattatttcttcagcattatgggagagaacctcacaacaagagtgagaagaatgatgcttgcagcgattctaaggaatgaagtcggatggttcgatgaagatgagcacaattctagcctggtatcagctcggttatctgcagacgcggctgacgtaaaatctgcggtaccggagagaatttcagttatattacaaaacctgacttctctcctcacttctttcatagttgctttcattgtggaatggaaggtggcccttctcattttggctaccttccccattcttgtccttggcaactttgctcaatcactcgctctcaaagggtttgcaggagacacagccaaggctcatgctaagactagcatgattgctggcgagggagtgagcaatatccgaacagttgcagcttttaatgcacaggataaaatccactctttgttctgccacgagcttcgaattcctcagcttcgtagcctacggaaaagtcaaacatccggcatcctctttggcctttctcagtttgcgctctatggatctgaagctctaattctctggtacggtgttcatctagttagcaaaggggcctccacattctcaaaagttattaaggtttttgtagtcctggtagtcacagctaattcagttgccgaaactgttagcctggctccagaaattattaggggcggtgaagctgtaggttctgtattttctatattagaccgttccactaggattgaccctgatgatccggaggctgaatctgtcgaatcaatgcgcggggaaatcgagcttagacatgttgactttgcatacccttcaagacctgatgttccggtgtttaaagacttgagccttagaatccgagctggccaaagccaggcccttgttggggccagtggatccggaaagagttctgtgattgcattgattgagcgcttttatgatccaagtgctggaaaggtaatgatcgatgggaaggatattcgaagattgaatttgaagtccctgaggcttaaaattggattagttcagcaagagccagcacttttcgcatcaagcattttcgataacattgcctacggaaaagagggcgcaacagaagccgaagtgatcgaagcagctcgttcagcgaacgtgcatggtttcgtaagcgcattgcctgatggatacaaaacgccagtcggtgaaagaggagttcaactctccggtggacaaaaacaaagaatcgcaatagcaagagctgtacttaaagacccaacaattcttttgctagatgaagctacaagtgcactagatgcagaatccgaatgtgtgctacaagaagcactcgagaggctaatgagaggccgaacaaccgtgctggtagcacaccgtttatccaccatcagaggagtggatagcatcggagttgtgcaagacggaagaattgttgaacaaggtagccattcggagttagttagtcgacccgagggagcgtattctaggctgttgcagctacaacatcataacatctaaagattaattacatttggggtcccattaacctttatgtttcttccatattctctttttttctttttctatctttttttggaatgatgatgatgatgacatgttgtagatatgagaatgtggagaatgta

SEQ ID NO: 3119 - DNA, 3790 bp, Malus domestica
atggcggagccagcggcagaggcgaagacattgccggaggcggagaagaagaaggagcagagcctaccctttttccagctcttctcctttgcagataagtacgattggctcctcatgatcttcggaagcttgggcgccgtcgtgcacggctcctccatgccggtgttcttcctcatgttcggggaaatggttaacgggttcggcgaaaaccaaatgaatttgcagaaaatgaccgcagaagtagcaaagtatgctctgtactttgtgtatctcggtctcatagtatgcgtaacatcctacgcagagattgcatgctggatgtacaccggcgagaggcaggtgagcaggctgaggaagaagtatctggaggccgtgctgaaacaggacgtcggcttcttcgacaccgacgctagaactggagacattgtctttagtatctcaacggacactcttctggtccaagatgccatcagtgagaagggtggggaacttcatacactatctgtcaacgtttctggcggggctggtggtagggtttgtgtcagcatggaggctggcgctgctgagtattgcggtgattcccggaatcgcttttgccggcggcttatatgcctacacactcaccggcctgacgtccaaaagtcgccagtcgccatcgcgcaagttcggacagtttattcatacgttggtgaaagcaaggccctcaattcgtattcggatgcaatacagaacaccttgcagcttggttacaaggccggaatggccaaaggtctcggcctagggtgtacctacggcattgcttgtatgtcatgggcactcgttttctggtacgctggtgtgtttatccgaaacgggcagactgatggagggaaggcgttcaccgccattttctccgccattgttggtggcatgagcttgggccagtcattttcgaacctcggggcctttagcaaaggtaaatcagccggatacaagttgatggagataattaagcaaaagccgaccatagttcaagaccccttggacggaaagtgcttatcggatgttagtggcaatatcgaattcaaggaagtaaccttcagctacccttcgagaccggatgttattatcttccgagatttttcgatcttctttccagccggaaagacggttgccgttgttggtggcagtggttcagggaagagcactgttgtctctctaatcgaaaggttctacgatcctaaccaggggcaggttttgattgatagcgtggacataaaaacgctgcaattgaaatggttgcgcgatcagattgggctggtaaaccaggaaccggcactctttgcaactacgatactcgagaacattctctatggaaagcctgacgcaacaatggaagacgttgaagttgcggcttcctcagcgaacgctcacagtttcatcaccttgcttccaaacggatataacactcaggtaggagagcgaggagttcaactctctggtggtcaaaagcagaggattgcaattgccagagcaatgttgaaaaacccgaagatcctcctacttgacgaagcaaccagcgcccttgatgcaagctcggagagcattgttcaagaagctctagaccgtctcatggtcggaagaacaaccgttgttgtggcgcatcgcctttccaccattagaaatgttgatagcattgctgttatacaacaaggccaagttgtcgagacaggaacacatgaagaactgattgctaaagcaggggcctacgcttctctaattcgattccaagaaatggttgggaacagagacttcaggaacccatctactcgctgctcgcgctcatcacgtctaagccactcattgtcaacgaagtctttaagccttcggtctggcagcttaaggaacctgagctattcgtacagtacgggtgctgatgggcggatagagatgatttcaaatgctgaaactgacaggaaaactcgagctcctaagaactatttcttccggcttctgaagctaaacgctcccgaatggccctattcaatcatggccgctataggatcagtactctccgggttcatcggtccaacatttgctattctaatgggcaacatgattgaggttttctactataaaaaccccgcctcaatggaaaggaagacgaaggaatacgttttcatgtacattggagtcgggctatacgctgtggttgcgtatttgatacagcattacttcttcagcatcatgggagagaacctcactactagagtgagaaggatgatgcttgcagcaatcttgaggaacgaagttggatggttcgatgaggaggagcacaactccaaccttctaacaactaaattggcaacggatgctgctgatgtgaaatcagctatttctgagaggatatctgtgatattgcagaacatgacttcactcctcacttcattcattgttgccttcatagtggaatggagagtctccctcctcattttagctaccttcccacttcttgtgctttccaactatgctcagcaactttctttgaagggctttgctggagacacagccaaagctcatgcaaagacgagcatgattgcaggggagggagtgagcaatattcggacagtcgccgcgttcaatgcccaaaacaagatcctctctctcttctgccacgagctccgtctcccacagctgggaagcctccgccgcagccaaactgctggcgtcttattcggcctctctcagtttgctctccatgcatctgaagctctcattttgtggtatggtgcccacctcgttagcaaaggtgtctcgaccttctcgaaagttattaaggttttcgttgtccttgttgtaacggccaattcagttgctgaaaccgttagccttgccccggagattattaggggcggtgaagctgttggttcggttttttcaatcctcgatcgtcaaacaaagattgatccggatgatcctgaggctgaggtggttgaatcagttcgcggagaaattgaacttaggcatgttgattttgcgtacccatcgcgacctgatgtcatggtgttcaaagattttagtctcagaatccgcactggccaaagccaagcacttgttggagctagtggttcaggaaagagttccgtgattgcattgatcgagcggttttatgatccgatggttggtaaagtaatgatcgatggcaaagacattcgccgactgaacttgaagtcacttaggttgaagattggattggtgcaacaagaaccagccctgtttgcatcaagcattttcgaaaacattgcctacggcaaagaaggcgcgaccgaagcagaagtaattgaagctgcacgtactgccaacgtgcatggttttgttagcgggttgccagacggatacaaaaccccggtgggggagagaggagttcagctctccggtggacagaaacaaagaattgcaattgcacgggcggtgctcaaggacccgagaatactattgctagatgaggctacaagtgcacttgatgccgagtcagaatgtgtgctgcaagaagcactcgagaggctaatgaggggccgcaccaccgtgcttgttgcccaccgtttgtctacaattagaggggtggacagcatcggcgtggtgcaagacgggcgcattgttgagcacggcagccattcggagctagcgagccgccccgacggagcttatacaaggctgttgcagctgcaaaatcatcacatatgagaagagttttggtcaaaaacatgcatgcatggccttcttgggtgttaattatgtgtatcccctatta

SEQ ID NO: 3120 - DNA, 4171 bp, Brassica oleracea
ccacactctcattctctctccatttctttcttttatttcgtcactccaaaacaaaacactcataaagagttctcgaactcacaaatcaattgtcagttttttttaaaatacaaaacgttattatttcttttctttatctctctgctctggatctctcctccattgccaatgatctcgtcctctctctgagccaactcgtgtctgactcgcttctccttccttaatctcacgccgcaaaaatgtcagagacaacggcagatgcaaagccggttcctccggctgaagccgagaagaagaaagaacagagcttacccttcttcaaactcttctcattcgctgataaattcgatcatctgttaatgatcactggctcaataggcgccattattcacggctcgtccatgcctgtcttcttcttgcttttcggtgaaatggttaatggattcggcaagaaccagatggatttacaccaaatgacacatgaagtctccaaatatgctctgtactttgtctacttgggtttggttgtctgcgtctcttcgtacgcagagattgcatgttggatgtactctggagaaagacaagtagctgcgttaaggaagaagtatcttgaagctgtcttgaaacaagacgttggattcttcgacaccgatgcaagaactggcgacattgtcttcagtgtctccaccgatactcttcttgtccaagacgccatcagcgagaaggttgggaacttcatacattacttgtcaacgtttttggcggggcttgtggttgggtttgtgtcagcatggaggttagctttgttgagtgtggcggtgattcccggaatcgcattcgccggcgggttatacgcttacactctcaccggcatcacttcaaagagccgtgagtcttacgcaaacgccggtgttatagccgagcaggcaattgctcaggttcgaactgtttactcttatgttggagagagcaaggctcttagctcgtactcagaggcgattcagtacactcttaagcttggttataaagctgggatggctaaaggattaggtttaggatgtacttatggaatagcttgcatgtcatgggctctagtgttctggtacgctggtgttttcatcaggagtggaacaacagatggaggaaaagcattcactgctatattctcagccattgttggtggaatgagtttgggacaatctttctcaaatcttggagcgtttagtaaaggaaaagctgctggttacaagctgatggagataatcaaccagagaccaacgatagtacaagaccccttggatgggaagtgcttggagcaagttcatggaaacattgagtttaaagatgtgacgtttagctatccttcgcgtcctgatgttatcatcttcagaaacttctctatcttcttcccttctgggaagaccgtagctgtggttggtggtagtggctctgggaagagtactgttgtttcccttatagagagattctacgacccaaacaacgggaagattctgttggatggtgttgagataaagacgcttcagttgaagttcttgcgtgaacagatcggtcttgtgaatcaagaacctgctctcttcgccacaaccattcttgagaacatactctacgggaaacctaatgcaacactagatgaagttgaagctgctgcgtccgctgccaacgcgcatagcttcatcacgttgcttcctaaaggctacgacacacaggttggagagcgtggtgttcaactctcaggtggacagaagcaaagaatcgcaatcgctagggcgatgctaaaagaccccaagattctgttactagacgaagcaacgagcgctcttgacgctagctctgagagcatagttcaagaggctttagacagagtcatggtcgggagaaccacagtggtcgtcgctcatcgcctctgcaccatacgtaacgttgactccatcgcggtgatacagcaaggacaagttgttgagaccggaacacacgaagagctcatagctaagtctggtccttacgcatcgctcatcaggtttcaagagatggttggtactcgtgacttctctaacccgtcaacacgtcgcactcgttctacacgtttgagccattccttgtcgaccaagtcactgagcttaaggtcagggagtttgaggaatttgagctactcttacagcactggagctgatggtcggatagagatgatatcaaacgcagagagtgatagaaagactcgtccccctcaaaactacttttataggcttctcaagcttaatgcacctgaatggccttactcaatcatgggagctgttggctcggttctgtctggttttatcggtccaacctttgctattgtgatgagtaatatgattgaagtgttctactacactgactatgtttcaatggagaggaagacaaaagagtatgtgttcatctacattggtgctggtatctatgctgtgatagcttatttgatccagcattacttctttagcatcatgggagagaatctcacaacaagagtaagaagaatgatgctctcagctatcttgaggaatgaggttggttggtttgatgaggatgaacacaactcgagtttggttgctgcaaggttagccactgatgcagctgatgttaaatcagcaatagcagagaggatctcagtgattctgcagaacatgacttcacttctcacatctttcatagttgctttcatcattgagtggagagtctcacttctcatcttatgcacattcccacttctagtccttgctaactttgctcagcaactatctctgaagggttttgctggagacacagctaaggctcatgcaaagacatcaatgattgctggtgaaggagtcagcaacattagaaccgtagcagccttcaatgcacaaagcaagatcctctccttgttcagccacgagctccgtgtccctcagaaaagaagcttctacagaagtcaaacctcaggtttcctctttggcctctcccagcttgccctctacggttccgaggctctaatcctctggtacggtgcccaccttgtgagccaaggcaagtcaaccttctccaaagtgatcaaagtctttgtggttttagtcattacagcaaactctgttgctgaaactgtaagtcttgctcctgagatcatccggggaggtgaggccgttggttcggttttttcggtgttggataggcagacaaggattgatccggacgatgctgatgctgatccggccgagacaatacgtggagacattgagtttagacatgtggattttgcgtacccttcaagaccggatgtaatggtgttcacagactttaaccttaggatacgagctggacatagccaagctcttgtcggggcgagtggctcagggaaaagctctgtgatagcgatgatcgaacggttctacgacccgcttgctggtaaagttatgattgatggtaaagacatccgcaggctaaacctaaagtctctgaggctgaagataggtcttgttcaacaagaaccagctctctttgcagctaccatcttcgacaacatcgcatatggtaaagatggtgcgactgagtccgaggttatcgaggcggctagagctgcaaacgctcatggtttcatcagtggtttgcctgaaggctacaagactccagtgggtgagagaggagtgcagttatcaggtggacagaagcagaggatcgctatagcaagagcagtgctcaagaaccctagtgtgttgcttcttgacgaagcaacaagcgcgttagatgctgagtctgaatgtgtgcttcaggaagctttagagaggctcatgagaggtaggactacggtggtggttgctcacaggttgtcaaccataagaggtgttgattgcattggtgtgattcaagatgggaggattgtggagcaaggcaggcattctgagcttgtaagccgaccagagggagcttattcaaggctgttacagcttcaaactcataggatttgaagcttgatggattaagaacaaaaagtgaatttatgtaatttatttatcagaactttaatttgggaagattatatggactataatgataatatgaacaggtgtagataatgaagcttttgattgtttatgaaggttctttaaggttcctcttttattttattttattttatttt

SEQ ID NO: 3121 - DNA, 3902 bp, Manihot esculenta
atggctgcagagactgtagatactaatactagtagttgtaaagcatcactgccagaggcagagaagaagaaagaacagaccttgccatttttccagcttttctcttttgctgataagtatgattggttgcttatgatctctggtagcataggagccattattcatggctcttcaatgccagtttttttcttgttgtttggtgaaatggttaatgggtttgggaagaatcaatctgatttgccaaaaatgacccatgaagtctctaagtatgcgctatattttgtctatcttggcattgttgtgtgcctatcatcatacgcagagattgcttgctggatgtacactggagaaaggcaagtaggcacactaaggaagaagtatctagaggctgtgttgaaacaagatgttgggttctttgatacagatgcaagaactggagatattgtcttcagtgtgggaaactttatacactatttgtcaacatttctagctgggctagtggttggttttgtatcagcatggaggctagcactgctaagtgtggcagtgataccaggtatagctttcgctggcggcttatatgcatatactctcactggtctcacatccaagagccgcgaatcctatgcacaagctggcataattgccgagcaggcaattgcccaagttcggacagtttactcttatgtaggagagagcaaagccttaaattcatattcagaggcaatacagaacactttaaagcttggatataaagccgggatggctaaaggtttggggctgggatgtacctatggaatagcttgcatgtcatgggccctcgtgttttggtatgctggtgtttttatccggaacggacagactgatggagggaaggcattcacagcaattttctctgccattgttggtggcatgagtttgggccagtcattttcaaaccttggggcatttagcaaaggtaaagcagctggatacaagttgatggaaattattaagcaaaagcctactataattcaagacccctctgatgggaagtgtttgtctgagtttaatggaaacatagaattcaaggatgtaactttcagctacccatcaaggccagatgttatcatatttcgtgatttctcaatcttctttcctgctggaaagactgttgccgttgttggtggtagcgggtctgggaaaagtactgttgtctctctgatagagaggttttatgatcctaatcaggcaggacaagttctgcttgataatgtggacataaagaccttgcaactgaggtggttacgtgatcagattgggttggtgaaccaagaacctgctctctttgccaccacaatacttgagaatatattgtatggaaagcccgacgccacaatggatgaagtggaagctgctgctgcttctgcaaatgcacatagctttattactcttcttcctaatggatacaacactcaggtgggagagcgaggagtccaactttctggtggtcaaaaacaaagaattgcaattgctagagctatgttgaagaacccaaagatccttcttctagatgaagctactagtgcccttgatgcaggctctgaaagtgttgttcaagaagcattggaccgtctcatggttggaagaacaacagttgttgttgcacatcgactctccaccattagaaatgttgatacaattgcagttattcaacaagggcaagttgttgaaacaggaacccacgaagaactgattgccaaaggaggagcatatgcttcattaattcgattccaagaaatggtaagaaatagagactttgcaaacccatcaactcgacgatcacgctcatcacggttaagtcattcactttcaacaaaatctttaagcctccggtctggcagtttaaggaacttgagctattcatacagtactggtgctgatggccgcattgagatgatctcaaatgctgaaactgaccgtaaaaatccagctccacatggctatttctgcagactacttaaactaaatgctcctgaatggccatattctattatgggtgctataggatctgtgctttctgggtttattggtccaacatttgccttggtaatgagcaacatgattgaggttttctattatggaaatcccgcctcaatggaaagaaaaacaaaggagtaccattacttcttcagtattatgggagagaacctcactacaagagtgagaagaatgatgcttgcagcaattctgaggaatgaagttggatggttcgatgaagaggagcacaactcgagtctcgttgcagcacgattagctacagatgctgccgatgtaaaatctgcaatagccgagagaatatctgtgatactacaaaacatgacatctctactcacttcattcatagttgctttcatagtggaatggagggtctctcttctcattttagccactttccctctacttgtccttgccaactttgcccagcaactctctctcaaagggtttgctggagacacagccaaggcgcatgcaaggacgagcatgattgctggtgagggagttagcaatattagaactgttgcagcttttaatgcccaaggtaaaatcctctctctgttctgccacgagcttcgtgttccacagcttcacagcctacgcaggagtcaaacttctggcctcctctttggcctctctcagcttgctctctatgcctctgaagctctcatcctctggtatggtgctcaccttgtcagcaaaggggcctccacattctcaaaggttatcaaggtttttgtagttctggtgatcacagctaattcagtggcagaaactgttagtcttgctccagagattataaggggcggtgaatcagttggttctgtattttcaattttggaccgttccactaggattgatccagatgatcctgaagctgaccctgttgaatcaatgcgtggggagattgaacttagacatgtcgattttgcatacccctcacgacctgatgttccagtgtttaaagaccttagcctcagaatacgagctggccaaagccaggccctcgtgggagctagcgggtgtggaaagagttctgtcattgcattgatcgagcgattttatgatccaactgctggaaaggttatgattgatgggaaggatattcgacgattgaatttgaagtccctaaggcttaaaattggattagtgcaacaagagccagctctctttgcagcaagcatttttgacaacattgcctatggaaaagatggtgcaaccgaagcagaagtcatcgaagcagcacgagcagccaatgtgcatggattcgttagcgcattgccagatggctacaaaacaccagttggtgaaagaggagttcagctctctggaggacaaaaacagagaattgcaattgcaagagctgttcttaaggatccaacaatacttttactagatgaggcaacaagtgcccttgatgccgaatctgaatgtgtgctacaagaagcactcgagaggttaatgcgaggtcgcacaacagttctcgtagctcaccgattatcgaccattagaggtgtggacagtattggggttgtgcaagacggccggattgtcgaacaaggcagccactctgaattagtgagccgagccaacggggcatattctagacttttgcagctacagcaccatcaaatatgagagaaaggggaaagattgggttttgatggaagcaacatggccttgttggttggtaattatgtttggggtccccttaacctttatgtttccatttttttttttcttctttgatgatagttgtagatatgggaacgtgaagactatatcttgagaattatcgccccatttccaatggggcagcaagtgttgtatttattaatatctaatggttcataagcctgttgtct

SEQ ID NO: 3122 - DNA, 4863 bp, Valeriana officinalis
tatggatgtctaaaaacttgtcccgaccgtccagataacatccatagttacgacgactccgaaacccgaacgaacgaactgaatacgaaccgaaaaaacccgaaaaaaattagaaccgaatcaaaaaccgaacccgaaacaaaaaccgaaccgaaaccgaagaaatcggttcggttcgggtttcaagtctgtcccgataaacccgaatagacccgaattagataaaacacagtcgttttaatgcatagaaaaatagggtaaaccctaaaattaggcatctcgtatgatttctatctctgaatctctcgctcgctctctctcttcttgcgcagcttctctcgtagcctaaaattgtaaataaacataattaacttaaactgtataaaaccaaaattcataattaacttactaaaattcattatttattgtaaataaacataattaacttaaactgtataaaaccaaaaaaaatattaatgtaatcttgttcggaaattaagttgacctctcaaaagatcgacaaaatcggactccaaccctcgctaaatttgtacttagataaatttgtctaaaatttgtatgatgatattcaaatgatttaccgttaatatctaggtaaagattcccttgaaccaagagtaatcttattttactaatttaccaaccacggttaactcgcctgcctctatatataattacactaacttcacaccactctcactcacacacacacacaaaaacacacacacacaaaaacaccactccttccttcacacactttctccctccttttcttcccggcaactcaaccgcaatcatcgtcactctcatctcttctccgatcactccattttaacctcatacacacctccaatggtggaaaacggagctataacggtttccgtttaactaattaagtaatcatcctttttttttgtttgaatctgcgagtgcgttttttggttttgaaaatggcggagatgacggaggcgaaaccaatgccggagatggagaagaagaaggagcagagtcttcctttctatcagcttttttcgttcgctgataagttcgattatttactcatggcttctggaaccttcggtgctatcattcacggctcatccatgcctgttttcttccttctcttcggtcaaatggttaacggctttgggaaaaatcaatccgatttgcagaaactaactgaagaagtatcaaagtacgctttgtatttcgtttatctcggattagtcgtctgcttcgcctcatacgcagagattagttgttggatgtacactggagaaaggcaagtgagtgcattaaggaaaaagtatttggaatcagtgctgaaacaagatgtagggttctttgatacagatgcaagaactggtgatattgttttcagtgtctctacagatactcttcttgttcaagatgctatcagtgagaaggtgggaaacttcattcattatttatccacattcttggcgggtctggtggtgggtttcgtgacggcatggaggctagctctgcttagtattgcagttattccggggattgcttttgctggtggtttatatgcttatactctcacaggtctcacttcgaaaagccgtgaatcttatgctaatgctaatattgctgctgagcaggctattgcacaagttcggacggtatactcgtatgttggggagagtaaagtgctgaatgcatattcagatgcgattcagcatacgcttaagcttggttataaagctggcatggctaaagggcttggacttggatgtacttacggtatcgcatgtatgtcttgggctcttgttttctggtatgccggtgtatttatcaggaacggacagacagatggcggcaaagcgtttactgcgattttttctgctattgttggtggcattagtttgggccagtccttttcgaatcttgaagctttcagtaaaggtaaagcagctggcttcaagttaatggagatcataaagcaacaaccatccatagttcaggattctttggacggaaaatgcttagctgaagttagtggtcaaattgaatttaaagatgtaacattcagctacccgtctcggcctgatgtaattatttttagagatttctcaatatcattcccaacggggaaaaccgtcgcagttgttgggggaagtggttcagggaaaagtaccgttgtgtccctcatagaaagattctacgacccaagtcaaggccaaattttacttgataatgtggacataaaaacgttacagctaaagtggttacgagatcagattggtcttgtgaaccaagaacctgcactttttgccaccactatacttgaaaacataatgtatggaaagcccgacgcaactatggaagaagttgaagcttcttcttctgctgctaatgctcatagctttatcaccttgctgccatatggatataacacacaggtgggagagcgaggagtacaactttcagggggtcaaaagcaaagaatcgctattgcaagggcaatgttgaaaaacccgaaaattcttcttcttgatgaagcaacaagtgctcttgatgcaggttccgaaagtatcgttcaagaagcccttgaccgtctcatggtaggaaggacaaccgttgtggttgctcaccggctgtccaccataagaaacgtggactcgattgcggttctacaacaaggtcaagttgttgagaccgggacccacgaagaacttatctccaaaccaggcggggcctactcctcactcatcagattccaagaaatggtgggcaacagagacttttcaaacgcatcaacgactcaccgttcacgttctacgaggctaagccattcattgtccacaaaatctctaagcctccgttcgggcagcttgaggaatctaagttatcagtacagcacaggcgcagatggtcgaatcgaaatgatctcaaatgcagaaaccgataagaaaaatccggcaccaaccggatatttcttaaggcttcttaagctaaatgcacccgaatggccttactcaataatgggtgctgttgggtccatactttccggtttcatgggtcccacttttgcgattgtcatgagcaatatgattgaggtcttttactataataatcccgctcgaatggaaaggaaaaccaaagaatatgttttcatctacattggagccggtctgtacgctgttgtcgcgtatttaatacagcattatttcttcagtatcatgggagagaacctgacaacacgtgttaggaggatgatgctcgcagcaattttgagaaacgaagtcgggtggtacgacgaggaagagcataattcgagcctcgttaccgctcgtttagcaactgatgcagcagatgtgaaactagcgatatcggaaagaatatcagtaatattgcagaacatgacttctcttctgacgtcgtttatcgttgcatttataatcgaatggagagtctcgctcctcattttaggcaccttccctcttctcgtcctcgccaatttcgctcagcaactttcgctcaagggttttgccggagatacggcgaaagcacatgcgaaaactagcatgattgctggtgaaggagtgagcaatatccgaactgtcgcagctttcaatgcacaggacaagattttgtctctgttttgtcagcaacttaaggtccctcagctcgtaagtcttcgtcggagtcaatcttccggtattcttttcgggttatctcagcttgcgctgtattcgtcagaagctttgatcttgtggtacggtgctcaccttgttggtacaggtgtgtcgacattctcgaaagttattaaggttttcgttgtgctggttatcacggctaattctgtggccgaaactgttgggcttgccccggaaataattcggggtggcgaagcgattggatcggttttctcgattcttgataggtcaactaagattgagtctgatgatcctgacgccgagattgttgaaacaattcgcggggaaatcgaattacgccacgttgacttttcttacccttcgagacccgatattagtatcttcaaggagttcaatctaagaatccgagctggtcacagccaagctctagttggcgctagtgggtcgggaaaaagcacagttattgcattgatcgaacgtttctacgatccgacagccgggaaagttatgatcgacgggaaagacatccgcagactaaatctaaaatccctccgcctcaaaatcgggctggttcagcaagaacccgccctattcgccaccagcatctttgacaacatcgcgtacggaaaagacgaagccacagaagccgaagtaatcgaagccgcacgcgcagcaaacgttcacgcattcatcagcagtctacccgacggatacaaaacgagcgtcggagaacgaggcgtccagctatccggcgggcagaaacagagaatcgcaatcgcccgcgcagttctcaaggacccgagaatcctcctactagacgaagcaacaagcgcactcgacgcagaatccgaatgcgtcctccaagaagcactcgagaggctaatgaaaggtcgaaccaccgtcctcgttgctcatcgtttatcaaccatacgcggcgtcgacaccatcggagtagtacaagatggacggataatcgaacacggcagccacgccgagctcacgagccggccggaaggaccgtactctcgactcttgaagctacaaaaccaccgattgtgaaacctcgattaatcattaatgattttaattaactaaattaatcactttcatcttcttctttgtagatattatggggcttgtgtgaactgaacactctttatctggatttgaatatgaattaaagattgtgtttttt

SEQ ID NO: 3123 - DNA, 3936 bp, Panicum virgatum
aatgctgactgaaacatccttgaacaggcaattgcccaagtaagaacagtttactcttttgttggagagagcaaagcactcaattcctattctgaggcgattcagaacacactgaagctcggttacaaagctgggatggctaaaggtcttggaatcggatgtacttatgggatagcatgcatgtcttgggctctggtattctggtatgctggtgttttcatcaggaatgggcagactgatggtggaaaggcttttacggcaatcttttctgcaatcgttggtggcatgagccttgggcaggctttctcaaatcttggagccttcagcaaagggaaaattgctggttacaaactgcttgaggtcattcgccagaaaccgtctatagtcaacgatcacaaggatggaaagtggttggctgaggtccatggaaacatagaatttaaggaagttactttcagttacccttcaaggcctgatgtgatgatctttcgggacttctctcttttctttcctgctggtaaaactgtcgcggtcgttggaggcagtggatccggaaaaagcactgttgttgctttgatagaaaggttttatgatcctaatgaaggccaggttttgcttgacaatgttgacataaaaacactccaattaaggtggctgagagatcagatcggtctagtaaaccaagaacctgctctttttgcaaccactatcctagagaatatactgtacggaaagccagatgccactatttcagaagttgaggctgcagcaactgcatccaatgctcatagttttatttctcttcttccaaatggctacaacacaatggtgggtgagcgaggcacccaactttctggtggtcagaagcaacgtatagcgatagctcgtgctatgctgaagaacccgaagattctgctccttgatgaagctaccagtgctttagatgcagactcagaaagcattgtgcaagaagctcttgaccgtttaatggttgggaggacgactgtagttgttgcccaccgtctgtccactataagaaatgtgaacatgattgctgtgatccaacaaggccaagttgtcgagactgggacacatgatgaactcctagcaaaaggaagcactggagcatatgcctcgctggtccgttttcaggaatcaatgcggaatagggatcttggaggtgcatctacccgcaggtcacgatcaatgcacttgacaagctcactttccacaaaatctcttagcctgaggtcgggaagtctaaggaacttgagctatcagtacagtactggagcagatggacgcatcgagatgatctccaatgcagataatgaccgcaaatacccagcaccacgtggttacttcttgaagctcctgaaattgaatgctcctgagtggccttatgctgtgttgggcgccattggttctgtcctttcgggatttattggtccaacatttgcaattgttatgggtgaaatgcttgatgtgttctactacagggaccccaatgaaatggagaagaaaacaaagctatatgtgttcatctatattggcacaggtatatatgccgttgttgcttatcttgtgcagcattacttcttcagcatcatgggagaaaatcttacaaccagggttaggaggatgatgttatctgcaatacttaggaatgaagtgggctggtttgacgaagaagaaaacaactcaagtcttgtggctgctcgcctagcagtcgatgcagcagatgtgaagtcggctatagctgagagaatatcagtcatcctgcagaacatgacgtcccttatgacttcatttgttgtcggttttatcattgaatggagagtggcactccttattctggctactttcccgcttcttgtgcttgccaactttgcccagcaaatttcaatgaagggctttgctggtgacacagcaaaggcgcatgccaagagcagtatggtcgcaggtgaaggagtgagcaatatccgcactgtggctgccttcaacgctcaaagcaagatcttgtcactcttcagccatgaactgcgcataccagagcagcaaatccttcgacgtagccagacatcaggtcttctgtttggcctttcacagctctgcctgtactcctcagaagcactcattctctggtatggttctcatctggtccggtcacatggatccaccttctccaaggtcatcaaggtttttgttgtccttgtggtgactgctaactccgtagctgagacagtgagcctagccccagagattgtccgcggaggtgaatcgatccgatccatctttggcatcctcaacagggcaacaagaattgagcctgatgatccagagtcggagcgtgttaccaccatccgaggggacattgagttgcggcatgtggactttgcctatccatcacgcccagacattcagatcttcaaggatttcaacctgaaaattcaagctgggcgcagccaggctctagtcggagccagcggttcagggaagagcactgtcattgctctcattgagcgattctatgatccgactgggggaaaagttagtattgatggaaaggacatcaggaggctgaacttgaagtccttgcggctcaagattggcctggtgcagcaggagccggtcctcttcgcagcgagcatactagaaaacattgcatacggcaaggatggtgcaacagaggaggaagtgatcgaggcggcaaagacagcaaacgtccatggcttcgtcagccagcttcctgacggctacaagacagcagtcggcgagcgtggcgtgcagctctcgggtgggcagaagcagcggatcgccatcgccagggcagtgctcaaggacccggccatcctgctgctggacgaggcaacaagcgccctggacgcggagtccgagtgcgtgctgcaggaggcgctggagcggctgatgaaggggcgaaccaccgtcctggtggcgcaccgcctctccacgatccgaggggtggaccgcatcgcggtggtgcaggacgggcggatcgtggagcacggcagccactcggagctcctgacccggccggagggcgcgtactcgcggctgctgcagttgcagcaccaccgtgtctgacggcgctgtgcaggagcatcctctgattaaaatacctgatgacaccttcattttggaggctgggatggccggaattttttttcggttggcggtggtcgtacggatgtagatactagggcaatcgtgtatgtgttaatgctgtcaatcgcaagattaaacttggaacctgtgatctgtatcttctccccggaatgtacggtgcgactcttctttttattaacgtcccccctttctgttctcgcattcttcttcagttctttgggtttacgtgcgtcgtgaaatgaatggttatgtgattctgaagaggaatcgatcaagatgccccacagccaagcgcattctatgttccaggggacccagcgttggttgattcctcacctgcacggaggccgcaggtcgtatgatccccgagaactgtcgcagtcggagtcggagccgagccaacatcagcgtccccggcgggcatggcgcggtggcgacggtcctcctggcggtcatggcagctccggaaatgggacggagaggaggcagcagctgaggctacccgcactgggggacggtaaaccgtccgccagtatcatttaccggaccggagggctgcagcggggcacggtaaaagctacgcaagcgtcccggatgagcgcccctacgctattcctaccgcactcccagggcaacgccatcacgtgggccccttcctccgccgcagcatcttccaaccaccgctcactcacgcggtcgcgccaacccgcggacctcgctggagacaaggagggagacaagggcgaggccacccggaggacccgccgccgccgccgctcggggtgccgc

SEQ ID NO: 3124 - DNA, 4031 bp, Conyza canadensis
tcacacacctggtttcattcaatccaattaccaactgactaaataaaaaatgtccgaaacaacaaagcaggcaatgccagcagcagctgaaaagaaaaaagaacaaagtctacctttctaccaattgttttcatttgcagataaatacgattacattctcatgatctttggtagcattggtgccattattcatggatcttccatgccttttttcttccttttgttcgggcaaatggtcaacggtttcggtaaaaaccagtctgatttaatcaccatgactcatgaagtctccaagtatgctctgtatttcgtatatctggggctagtagtgtgtgtatcatcatatgcagaaattgggtgttggatgtataccggtgaaagacaagtgagcacattgagaaaaaagtatttagaagcagttttgaaacaagatgttgggttttacgacactgatgcaagaacaggagatattgtttttggtatttcaaccgatactcttcttgttcaagacgccattagtgaaaaggtggggaactttatacattatctttcaacatttttggctggattggttgttggatttgtatcagcttggaagttagctcttttaagcattgcagttattccgggtattgcattcgccggtgggttgtacgcgtatactctaacgggtctcacgtccaagagccgcgaatcgtatgccaatgccggcattattgccgaagaggctattgcacaagttaggactgtgtactcgtatgttggcgagaccaaggcccttaactcgtattcagatgctatacaacataccctcaagctcggttacaaggccggaatggctatgggtttggggttgggatgtacttatggaatagcttgcatgtcttgggcacttgttttctggtatgcgggtgtatttattaggaatggacagactgatggtggaaaggcagttaccgccattttctctgccattgttggtggcatgagtttaggtcaatcattttcaaatcttggagcttttagcaaaggcaaatcagctggatacaagttgctagaaattatcaaccaaaaacctactataactaccaactctgtaaatggcaagtgcctaaccgaggtcaatggaaatattgagtttaaggaagtaactttcagttacccatcaaggccagatgtcatcatcttcagagatttctccattgtctttgcggctggaaagacagttgcggtggttggtggcagtggatcagggaaaagcactgttatttcgttaatcgagaggttttatgatccaaatgaagggcaaatactcctagacaatgtggacatcaagacattgcaacttcgatggttgcgtgatcaaattggtcttgtgaaccaagaacctgcactttttgccaccactatccttgaaaacatactttatggaaaacctgatgcaactatggccgatgtggaagctgctacctctgcagccaatgctcatagcttcattaccctgcttcctaatggctataacactcaggtgggggaaagaggagttcagctatctggtggtcagaaacaaaggattgcaattgctagagcgatgttaaaggacccaaagatcctacttcttgatgaggcaaccagtgctcttgactcgggttctgagagcatcgtgcaagaagctcttgatcgtctaatgattggcaggacaactgttgtggttgcacatcggctatccaccataagaaacgttgactcgatagcagtcattcaacaaggacaagttatcgagactgggacccatgaagatctaatttcaaaacctggtgcctatgcttccttaatcaggtttcaagaaatggcaggaaaccgagatttctccaatccttcaacccaacgcacaaggtcaacaagactgagtcactcattgtcaactaagtctcttagtctaaggtctggaagcttaagaaacttaagctatcagtacagcacaggcgcagatggtcgtatagaaatgatctcaaatgctgaaactgataagaaaaacccagcaccaagtgggtactttctccgccttttgaaaatgaatgctccagaatggccttattcaatcatgggagctgtaggatcaattctttctggatttatcggtccaacatttgccattgtaatgagcaatatgattgaggtcttttactacactaatcctgctagaatggagagtaagaccaaagagtgtgttttcatctacgttggagctggtctgtatgctgtagtagcatatttgatacaacattacttctttagtattatgggtgaaaatctcacaacaagagtaagaagaatgatgcttgcagccataatgaggaacgaagttggttggtttgacgaagaagaacataactcaagcctagttgcagcccggctagccacagatgctgcagacgtgaagtctgcaatagccgagaggatcgcagtcatactacaaaacatgacatctctactcacttcatttgtagttgcattcatagtggaatggagggtgtcccttctcattctcggcacgttccctcttcttgtcctagcatatttcgctcagcaactttcactcaaaggatttgctggggacacagccaaggcacacgcgaaaacaagtatgattgctggagaaggagttagcaacattcgaaccattgcagccttcaatgcccaagacaagattctctccttgttctcagacgaactccgtgtgccccagaatcaaagtcttcgcaggagtcagtattcgggcatgttatttggaatttcccaactcgctctctttgcatccgaagctctaatcctttggtacggtgcccatctcgttaaagacggcgtatccaccttctctaaagtcatcaaagtgtttgtggtcctagttataactgcaaactcagtagctgagacggttagtcttgcacccgagattatcagaggtggtgaagccattggctctgtgtttgctgttcttgataggtcaactcgtatcgacccagacgatcccgatgctgagatggttgaaactattcgaggcgagatcgagctacgtcatgtggacttttcatacccttcaagacctgatgtaatcatattcaaggaccttagtcttagaatccgagcgggccagagccaagcccttgtgggagctagtggttctggaaaaagttccataattgcattaatcgagcgtttttatgacccgaccgcaggaaaagtcatggttgatggaaaagacatcagaaggttaaacttaaggtcccttcgggccaaaatcgggttggtccaacaagaacctgccctattcgcagctagcataatggaaaacatcgcttacgcgaaagaagaagctacagaagccgaagtcatcgaagcagcacgtgcagcaaatgttcatacattcgtaagcgggttacctcaagggtacaacacaccagtaggcgaaagaggtgttcaactctcgggaggccaaaaacaaagaatagcaatagctcgggccgttctgaaaaacccaacgatactcctactagacgaggcaactagtgctctagatgctgaatcagaatgtgtgcttcaagaagcacttgaaagactaatgagaggccgaaccacggttctagtggctcatcgattatcaaccatacgaggtgttgatagtatcggtgtggtccaagatgggcgcatcgtggaacaaggaagccatagcgaattgttaggccgaggaaccgatggagcttactcaaggctgttgcagcttcaacaacatcgcatatgatttacagagtatggtatgagttagtaaattgtgtctatgtgttgtgttctaattaacctattgttttaacttattgggtttaatgtaatttgttttgttaattaatctagtaaaagagatatgaattaaagagtatggtatgagttagtaaattgtgtctttttaacctatatggttttaacttgttgggtttaatgtaatctgttttgttaatttaatctagtaaaag

SEQ ID NO: 3125 - DNA, 4195 bp, Brassica rapa
cttttctttatctctctgctctggatctctcctccattgccaatgatctcgtcctctctctgagccaactcgtgtctgactcgcttctccttccttaatctcacgccgcaaaaatgtcagagacaacggcagatgcaaagccggttcctccggctgaagccgagaagaagaaagaacagagcttacccttcttcaagctcttctcattcgctgataaattcgatcatctgttaatgatcactggctcaataggcgccattattcacggctcgtccatgcctgtcttcttcttgcttttcggtgaaatggttaatggattcggcaagaaccagatggatttacaccagatgacacatgaagtctccagatatgctctgtactttgtctacttgggtctggttgtctgcgtctcttcatacgcagagattgcatgttggatgtactctggagaaagacaagtagctgcgttaaggaagaagtatcttgaagctgtcttgaaacaagacgttggattcttcgacaccgatgcaagaactggcgacattgtcttcagtgtctccaccgatactcttctcgtccaagacgccatcagcgagaaggttgggaacttcatacattacttgtcaacgtttttggcggggcttgtggttgggtttgtgtcagcatggaggttagctttgttgagtgtggcggtgattcccggaatcgcattcgccggcgggttatacgcttacactctcaccggcatcacttcaaagagccgtgagtcttacgcaaacgccggtgttatagccgagcaggcaattgctcaggttcgaactgtttactcttatgttggagagagcaaggctcttagctcgtactcagaggcgattcagtacactcttaagcttggttataaagctgggatggctaaaggattaggtttaggatgtacttatggaatagcttgcatgtcatgggctctagtgttctggtacgctggtgttttcatcaggagtggaacaacagatggaggaaaagcattcactgctatcttctcagccattgttggtggaatgagcttgggacaatctttctcaaatcttggagcgtttagtaaaggcaaagctgctggttacaagctgatggagataattaaccagagaccaactatagtacaagaccccttggatgggaagtgcttggagcaagttcaaggaaacattgagtttaaagatgtgacgtttagctatccttcgcgtcctgatgttatcatcttcagaaacttctctatcttcttcccttctgggaagaccgtagctgtggttggtggtagtggctctgggaagagtactgttgtttcccttatagagagattctacgacccaaacaacggggagattctgttggatggtgttgagataaagacgcttcagttaaagttcttgcgtgaacagatcggtcttgtgaatcaagaacctgctctcttcgccacaaccattcttgagaatatactctacgggaaacctaatgcaacaatagatgaagttgaagctgctgcgtctgctgccaacgcgcatagcttcatcacgttgcttcctaaaggctacgacacacaggttggagagcgtggcgttcaactctcaggtggacagaagcaaagaatcgcaatcgctcgggcgatgttaaaagaccccaagattctgttactagacgaagcaacgagcgctcttgacgctagctccgagagcatagttcaagaggctttagacagagtcatggtcgggagaaccacagtggtcgtcgctcatcgtctatgcaccatacgtaacgttgactccatcgcggtgatacagcaaggacaagttgttgagaccggaacacacgaagagctcatagctaagtcaggtgcttacgcatcgctcattaggtttcaagagatggttggtactcgtgacttctctaacccgtcaacacgtcgcactcgttccacacgtttgagccattccttgtcgaccaagtcactgagcttaaggtcagggagtttgaggaatttgagttactcttacagcactggagctgatggtcggatagagatgatatcaaacgcagagagtgatagaaagactcgtccccctcaaaactacttttataggcttctcaagcttaatgcacctgaatggccttactcaatcatgggagctgttggctcggttctgtctggttttatcggtccaacctttgctattgtgatgagtaatatgattgaagtgttctactacactgactatgtttcaatggagaggaagacaaaagagtatgtgttcatctacattggtgctggtatctatgctgtgatagcttacttgatccagcattacttctttagcatcatgggagagaatctcacaacaagagtaagaagaatgatgctctcagcaatcttgaggaatgaggttggttggtttgatgaggatgaacacaactcgagtttggttgctgcaaggttagccactgatgcagctgatgttaaatcagcaatagcagagaggatctcagtgattctgcagaacatgacttcacttctcacatctttcatagttgctttcatcattgagtggagagtctcacttctcatcttatgcacattcccacttctagtccttgctaactttgctcagcaactatctctgaagggttttgctggagacacagctaaggctcatgcaaagacatcaatgattgctggtgaaggagtcagcaacattagaacagtagcagccttcaatgcacaaagcaagatcctctccttgttcagccacgagctccgtgtcccacagaaaagaagcttctacagaagtcaaacctcaggtttcctctttggcctctcccagcttgccctctacggttccgaggctctaatcctctggtacggtgcccaccttgtgagccaaggcaagtcaaccttctccaaagtgatcaaagtctttgtggttttggtcattacagcaaactctgttgctgaaactgtaagtcttgctcctgagatcatccggggaggtgaggccgttggttcggttttctcggttttggataggcagacaaggattgatccggacgatgctgatgctgatccggtcgagacaatacgtggagacattaagtttagacatgtggacttcgcttatccttcaagaccggatgttatggtgttcacagactttaaccttaggatacgagctggacatagccaagctcttgtgggggcaagcggctcagggaagagttctgtgatcgctatgatcgaacggttctacgacccgcttgctggtaaagtcatgattgatggtaaagacatacgcaggctaaacctaaagtctctgaggctgaagataggtcttgttcaacaagaaccagctcttttcgcggcaaccatcttcgacaacatcgcatatggtaaagatggtgcgactgagtcagaggttatcgaggcggctagagctgcaaacgctcacggtttcatcagtggtttgcctgaaggatacaagactcctgttggtgagagaggagtacagttatcaggtggacagaaacagaggattgctatagctagagcagtgctcaagaaccctagtgtgttgcttcttgacgaagcaacaagcgctttagatgctgaatctgaatgtgtgcttcaggaagctttagagaggctcatgagaggtaggactacggtggtggttgctcacaggttgtctaccataagaggagttgattgcattggtgtgattcaagatgggaggattgtggagcaaggcaggcattctgagcttgtaagccgaccagagggagcttattcaaggctgttacagcttcaaactcataggatttgaagcttgatggattaagaacaaaaagtgaaaatttatgtaatttatttatcagaactttaatttgggaagattatatggactataatgataatatgaacaggtgtagataatgaagcttttggttgtttatgaaggttctttaaggttcctcttttattttattttatgttatattattttattttatttttggcagaagcttttttttttttttttgtcaactggcagaagcttatatatgcttatgtgccctttatatatgcttatgtggccctttatatatatgcttatgtgccctctctgggatttgagaatcaactata

SEQ ID NO: 3126 - DNA, 4057 bp, Chrysanthemum coronarium
aaacaaacgtagaaagtccaactcataaataggaataaaaaacacacttcctaaacacataacaacaagtcttcactttaacaaactaaccacttccttaaaatgtcggacacgtcagcaaagacagcagtaaaaaagaatgaacaacaatctctaccattttacaaactgttctcatttgctgataagttggattacattttaatgatgtttggtagcattggtgccattattcatggatcttctatgccttgtttcttccttttgtttggtcaaatggttaatggctttggtaaaaaccaaactgatttaaccaccatgacacatgaagtctctaagtatgctttgtattttgtgtatcttggactagtggtatgtgtatcatcatatgcagagattggatgttggatgtataccggagaacgacaagtgagcgccttgaggaagaggtacttagaagcagttttgaaacaagacgttggattttacgatactgatgcacgaactggggatatagttttcggtatatcaaccgatactcttcttgttcaagatgccattagcgagaaggtgggcaactttatacattatttgtcaacatttttggctggattggtagttggatttgtatcagcttggaagctagctctactcagcattgcggttatcccagggatcgcatttgctgggggcttatatgcatatacgcttactggtctcacttccaagagccgcgagtcatatgccaatgctggaatcatcgctgaagaggctattgcacaagttaggacagtgtactcatatgttggcgagaccaaggccctcaattcgtattcagatgcaatacaacataccctcaagctcggttacaaggccgggatggccaaggggttggggctaggatgtacttacggtatagcttgcatgtcttgggcacttgttttctggtatgcaggcgtgtttattaggaacggacagactgatggtggaaaagcatttacggcgattttctcagccattgttggtggcatgagtttaggacagtcattttctaatcttggagcgtttagcaaagggaaatcagctggatacaagttgatggaaattataaaccaaaaaccgacaataactaataattctgcagatgggaaggtactagatgaagtcagtggaaatatcgaatttaaagaagtaacttttagttacccttcacggccagatgtcattatctttagagatttttccattttcttccgggctggaaagacagtcgcagttgttggtggcagtggctcggggaaaagcacagttgtttcattgatagaaaggttttacgaccctaatcacggccaaatactgttggataatgtggacataaagacattgcaacttaaatggttgcgtgatcaaattggtctagtgaaccaagaacctgcactcttcgccaccacaatactcgaaaacatactttatggaaaacccgatgcaaccatgactgaagtggaagctgcaacatcagcagccaacgctcatagcttcattacccttcttcctaatggctataacactcaggttggggagagaggggttcaactatctggtggtcaaaaacaacgaattgcaatagctagggcaatgttgaaagacccgaagattctactccttgatgaagcaacaagtgccctggattcgggttcagaaagtattgtgcaagaagctcttgaccgattaatgattggtaggacaactgttgtggttgcacatcgtctctctaccattagaaatgttgattcaatagcagtcattcagcaaggacaagttgtcgagacagggacccatgaagaacttatttcaaagcctggacactatgcgtcattaattaggttccaagaaatggctggaaaccgtgatttttcaaacccttcaactcatcgcacacgttcaacacggcttagccattcgttgtcaacaaagtctctcagcctcagatctggaagcttaagaaacttaagttatcagtacagtacaggtgctgatggtcgtattgaaatgatatcaaatgctgaaaccgataggcagaatccagcacctagcggctactttttcaggcttttgaagatgaatgctccggagtggccttattcaataatgggcgctgtaggatcagtcctttctggatttattggtccaacatttgctatcgtgatgagcaatatgattgaggtcttttactatgataaccctgctagaatggagagtaagactaaagagtgtgtttttatctacgttggagctggtttatatgctgtgggagcgtatttgatacaacattacttctttagcattatgggtgagaatctcactacaagagtaagaaggatgatgctttcagcaatcatgaggaatgaagttggatggttcgacgaggaagaacacaactcgagtctagtagcagcccggctagccacagacgccgcagacgtgaaatctgccatagcagagaggatatcagtcatattacaaaacatgacatctctactcacttcatttgttgttgcattcattgttgaatggagggtctcacttctcattctcggaaccttcccccttcttgtcctagcacattttgcgcagcaactttcacttaaaggttttgctggagacacggctaaagcacatgctaaaacaagcatgattgctggtgaaggagtaagcaacattagaaccattgcagccttcaatgcacaagataaaatcctcacgttattctccaacgagctacgagtcccacagaatcaaagtcttcgatgtagtcagatctctggcattctattcggcatttcccaactcgctctcttcgcatccgaagccctaatcctctggtacggagcccatcttgttagcaaaggcgtgtccacattctccaaagtcatcaaagtgtttatagtcttggtcattacagcaaactcagtggctgagacagttagcctggcacccgagatcatccgaggcggtgaagccattgggtcagtctttgcggttcttgatcggtcaactcggattgacccagatgatctggatgccgaacccgttgaaaaagttcggggcgagatcgagttacgacatgtggacttttcttacccgtcgagaccggacatggtagtgttcaagggctttagtcttagaatccgggcaggccagagccaagccctcgtgggacccagtggttcagggaaaagttcggtaatcgcactaatcgagcgattttatgacccgaatgcaggaaaagttatgatcgatggaaaagatatcagacggttaaatctgcggtccctacgtgccaaaatcggattagtccaacaagaaccagcgttgtttgctgctagtataatggaaaacattgcttatgggaaagaaggggctacagaagccgaaattatagaagcagcacgcgcagcaaatgttcatacattcgttagtggtttgccacaagggtataaaacccctgtaggcgagagaggggttcaactctcaggtggtcaaaaacaaagaatagcaatagctcgggctgttttaaaagacccggcaattctcctactagatgaagcgactagtgctctagatgctgaatccgaatgtgtgcttcaagaagcacttgaaaggctaatgagaggtcgaacaacagtcctagtggctcataggttatcgactatacgaggtgtggataatattggggttgttcaagacggacgaatagtggaacaaggcagccatagcgaactactaagccgaggaagcgatggggcttactttaggctgttgcagctacaacaacatcgcgtataaatcactatgagtacgagttaagtaaatgtgtctatgttctaattaacatgtttaacttatggtttttatgttatctacaaggtggttaatgtttgtatgtttttggttaatctagtaacaaaattatcaatggaaagattataaacacaatgacaaagacaatgaactaacatgacacatttcagagaaacagtatgcaataatgatgata

SEQ ID NO: 3127 - DNA, 4268 bp, Eutrema halophilum
actctcattctctctctctcctccattttttttctttctaatttcatcactttcaaacaagacactcgtaaagagttctcgaactcacaaaacaattgtcagttttttttttctcgagacctttttatacaaacgttttctttctttctttctctctgctctaagatctctcctccacattatagatgacctcgttttctctctgagccaactcgtctctgactcgctctaactcggttcttcttactattttctcgcctaatagctctgatccaaaaaatgtcggaggcgacggcaactgcggcggatggaaaagccgttccgccggcggaggcagagaagaagaaagaacagagcttaccgttcttcaagctattctctttcgccgataaattcgactatctcttgatgatcactggctctcttggcgccattattcatggctcctccatgcctgtctttttcttgcttttcggtgaaatggtcaatggattcggcaaaaatcagatggatttgcagcaaatgacacatgaagtctccaagtatgctctgtatttcgtctacttgggtctggtggtttgcttctcttcatacgcagagattgcatgttggatgtactctggagaaaggcaagtagctgcattgaggaagaaatatcttgaagctgttctaaaacaagacgttggattcttcgataccgatgcaagaactggcgacattgtcttcagtgtctctaccgatactcttcttgttcaagacgccattagcgagaaggttgggaatttcatacattacttgtcaacgtttttggcggggcttgtggttgggtttgtgtcagcatggagattagctttgttgagtgtggcggtgattcccggaatcgctttcgccggcggtttatacgcttacactctcaccggaattacttcaaagagccgtgaatcttatgccaacgccggcgttatagccgagcaggcaattgctcaagttcgaactgtttactcttatgttggggagagcaaggctctgagctcgtattctgatgcgattcagtatacgcttaagctcggttacaaagccgggatggctaaaggattgggtttaggatgtacatatggaatagcttgtatgtcatgggctctggttttttggtatgccggcgttttcatcaggagtggaacaaccgatggaggaaaggcattcactgctatattctctgccattgttggtggaatgagcttgggacaatctttctctaatcttggggcctttagcaaaggtaaagcagccggtttcaagttgatggaaataattaaccagagacccacgataatccaagacccattggacgggaaatgcttggaccaagttcatggaaacattgagtttaaagatgtgacttttagctacccttcacggcctgatgttatcatcttcagaaacttttcgattttcttcccttctgggaaaactgtggcggtggttggtggcagtggctctggaaagagtactgttgtttccctcattgagagattttacgacccaaacaacgggcaaattctgctggatggtgttgagataaagacgcttcaattgaagtttttgcgtgaacaaatcgggcttgtgaatcaagaacctgcgctctttgccaccaccatacttgaaaacatactctacgggaaaccggatgcaacaatggtggaagttgaagctgctgcttctgctgcgaatgcgcatagcttcattacgttgcttcctaaaggttacgacacacaggttggagaacgtggtgttcaactctcaggtggacagaagcagaggattgcaattgctagggcgatgttgaaagaccctaagattctgttactagatgaagctacaagtgctcttgatgctagctctgagagcattgttcaggaagctttagacagagtcatggttgggaggaccaccgtggttgttgctcatcgtctctgcaccattagaaatgttgattccattgcggtgatacaacaaggccaagtcgttgaaaccggaacacatgaagaactcattgccaaatccggtgcttacgcatccctcatcaggtttcaagagatggtcggtactcgggacttctcaaacccgtcaacacgtcgcaaccgttcaacccgtttgagccattctctgtcaacgaaatcactcagtttaagatcaggaagtcttaggaacctgagctattcgtacagcactggagctgatggccggatagagatgatttcaaacgcagagactgatcgaaagactcgtgcgcctcaaaactacttctacaggcttctcaagcttaatgcaccggaatggccttactcaatcatgggagcagttggttcggttctttctggttttatcggtcctacctttgctattgtgatgagtaatatgatcgaagtcttctactacacagactatgattcaatggagagaaaaacaaaagagtatgttttcatctacatcggtgctggtctctacgccgtgggggcttatttgatccaacattacttctttagcataatgggagaaaacctcaccacaagagtaagaagaatgatgctctcagctatcttgaggaacgaggttggttggttcgatgaggatgaacacaactcgagcctggttgctgcacggttagccactgatgcagccgatgttaaatctgccatagccgagagaatctcagtgattctgcaaaacatgacttcacttctcacatccttcatagttgccttcatagttgaatggagagtctctcttctcatactaggcacattccctcttcttgtccttgcaaactttgctcagcaactatctctgaagggctttgccggagacacagccaaggctcatgcaaagacttcaatgattgctggtgaaggagtaagcaacattagaaccgtagcagcctttaatgcgcagagcaaaatcctctctttgttttgtcacgagcttcgtgtccctcagaaaagaagcttataccggagtcaaacctcgggtttcctctttggcctctcccagcttgctctctatggatccgaggctctaatcctctggtacggtgctcaccttgtgagcgaaggcaagtcaaccttctccaaagtgatcaaagtctttgtggttttggtcattactgcaaactctgttgctgaaactgtcagtcttgctcctgaaatcatccggggaggtgaagcggtcggttcagttttctcggtcttagataggcaaacccggattgacccggacgatgctgatgctgatccggtcgagacaatccgtggagacattgattttaggcatgtggatttcgcttacccttcaagacccgacgtcatggttttcagagactttaacctcagaatcagagctggacatagccaagctcttgtaggcgcgagtggttcagggaaaagctctgtgatcgccatgatcgagcggttttacgacccgcttgccgggaaagtcatgattgatggcaaagacatccgccggctgaacctgaagtctttgaggctcaagatcggtcttgttcaacaagaaccagctcttttcgcagcaaccatcttcgataacattgcatatgggaaagatggtgcgactgaatctgaggtaatcgaggcggctcgagcagcaaacgctcacggtttcatcagtggtttacccgaaggttacaaaactccagtgggagagagaggagtgcagttatcaggtggacagaaacagaggattgctatagcaagagccgttctcaagaaccctactgtgttgcttctagatgaagcaacaagcgcactggatgcagaatcagaatgcgtcttgcaagaagctttagagagactcatgagaggccggaccactgtggtagttgctcaccgcttgtccaccataagaggcgttgactgcatcggtgtgattcaagacgggaggattgtggagcaaggcagccattccgagctcgtaagccgaccagagggagcttattcaaggctgctacagcttcaaacgcataggatttgaagcgtgtgatggattaaaaaacaaaagtgggtttgtgtaattttttttatcaaaaactttaatatggaaggtttctttggacgataatcataatatgaataggtgtagataatgaagcttttgagtgtttatcaaggttctttaaggttttttctcttatgtgccctttctgagacatgagacgcaactatgttttcgttatgtttttgacttatgcctca

SEQ ID NO: 3128 - DNA, 4189 bp, Arabidopsis lyrata
acactctcattctctctctcatcacttcaaaacaagacactcgtagaagagttcttgaacttcacaaaacaattttcaagaaaaactttttaaacaaaaaacattttattctctctctctctgctcaatgatctcgttttctcactgagccaactcgtttcttctttctttctttaactcggatctaaaaaaccatgtcggaacctaacacaaccgatgccaagactgttccgacagaagcagagaagaagaaagaacagagtttaccattctttaaactcttctctttcgctgataaatttgattatctcttaatgttcgttggttctcttggtgccattgttcatggctcttccatgcctgtcttttttttactgtttggtcaaatggttaatggatttggtaaaaaccaaatggatttacatcaaatggttcatgaagtctcaaaatattctctgtatttcgtctacttgggtttggtcgtttgcttctcttcatacgcagagatagcatgttggatgtattctggagaaagacaagtagcagcattaaggaagaaatatcttgaagcagtattaaaacaagacgttgggttctttgatactgatgcaagaactggtgacattgtctttagtgtttctactgatactcttcttgttcaagatgccattagtgaaaaggttggaaactttatacattacctctcaacatttttggcgggactagtcgttggatttgtatcagcatggaaattagctttgttaagtgttgcggtgattcccggaatcgctttcgccggaggtttatacgcttatacactcaccggaattacttcaaagagccgtgaatcttatgctaacgccggcgttatcgccgagcaggcaattgctcaagttcgaactgtttactcttatgttggagagagtaaggcacttagttcgtattcggatgcgattcagtatacgcttaagctcggttataaagctgggatggctaaagggttgggtttaggatgtacttatggaatagcttgtatgtcatgggctttggtgttttggtatgccggggttttcattcggaatgggcagaccgatggaggaaaagcgtttacggctatattttctgccattgttggtggaatgagtttggggcaatctttctcgaaccttggggcttttagtaaaggtaaagcggctggttacaagttgatggagataattaaccagaaaccaacgataattcaagacccgttagacggaaaatgcttggaccaagttcatgggaacattgagtttaaagatgtgacttttagctatccttcacggcctgatgttatgatcttcagaaactttaatattttctttccttccgggaaaactgtggcggttgttggtgggagtggctctggaaagagtactgttgtttccctcattgagagattttacgatccaaacagcgggcaaattctgttggatggtgttgaaataaagactcttcagttgaagtttttgcgtgaacaaatcgggcttgtgaatcaagaaccagctctgtttgccaccaccatacttgagaacatactctacggaaagcctgatgcaacaatggttgaagttgaagctgctgcttccgctgcgaatgctcatagtttcattacattgcttcctaaaggttacgacacacaggttggagaacgtggagttcaactctcaggtggacagaaacagagaattgcaattgctagggcaatgttgaaagacccaaagattctgttactagatgaagctacaagtgctcttgatgctagctctgagagcattgttcaggaagctttagacagagtcatggtagggaggaccaccgttgttgttgctcatcgtctctgcaccatcagaaatgttgactccattgccgtgatacaacaaggccaagttgttgaaaccggaacacatgaagaactcattgccaaatccggtgcttacgcatccctcatcaggtttcaagaaatggttggtactcgagatttctcaaatccgtcaactcgtcgcactcgttcaacccgtttgagccattctctgtcgacgaaatcactcagtttaagatcaggaagtttgaggaatctgagctattcttacagcactggagctgatggtcggatagagatgatttcaaacgcagagacagatcgaaagactcgtgcacctgaaaattacttttacaggcttctcaagcttaattcacctgaatggccttactcaatcatgggagccattggctcaattctttctggtttcatcggacctacatttgctattgtgatgagtaatatgatcgaagtcttctactacacagactacaattcaatggagagaaaaacaaaggaatacgttttcatctacatcggtgctggtctctacgcagtgggtgcttatttgatccaacattacttctttagcatcatgggagaaaacctcacaacaagagtaagaagaatgatgctctcagctatcttgagaaacgaagttggttggttcgatgaggatgaacacaactcaagcctgatcgctgcacggttagctactgatgcagccgatgttaaatccgctatagccgagagaatctcagtaattctacaaaacatgacttcacttctcacatccttcatagttgccttcatagtagaatggagagtctcacttctcatcttaggcacattcccacttctagtcctcgccaactttgctcagcaactatctttgaagggttttgctggagatacagccaaggctcatgcaaagacctcaatgattgctggtgaaggagttagcaacattagaactgtagcagcgttcaatgcacagagcaaaattctctctttgttctgtcacgagcttcgtgttcctcagaaaagaagtttataccgaagtcaaacctcgggtttcctatttggcctctcgcagcttgctctctatggttctgaggctttgattctctggtatggcgcccaccttgtgagcaaaggcgtgtcaaccttttccaaagtgatcaaagtgtttgtggttttggtcattactgcaaactctgttgctgaaactgtcagtcttgctcctgaaattatccggggaggtgaagcggttggttcggttttctcggtcttggataggcaaactcggattgacccggatgatgctgatgctgatcccgttgagacaatccgtggagacatagagtttaggcatgtggatttcgcttacccttcaagaccagatgtcatggttttcagggactttaacctcagaatccgagctggacatagccaagctctagtgggcgcaagtgggtcagggaagagttctgtgatcgcgatgattgagcggttttatgatccacttgctggaaaagtcatgattgatggcaaagacatccgcaggctaaaccttaaatctctaaggctcaaaatcggtcttgttcaacaagaaccagctcttttcgcagcaaccatcttcgacaacatcgcatatgggaaagatggtgcaactgaatccgaggtaattgaggcagcgcgggccgcaaatgctcatggtttcatcagtggtttgcctgaaggttacaaaactccagtgggcgaaagaggagtgcagttatcaggtgggcagaaacagaggatcgcgatagcaagagctgtgctcaagaaccctacagtgttgcttctagacgaagcaactagtgcactagatgcagaatcagaatgtgtgctgcaagaggcgttagagaggctcatgagaggtcggaccaccgtggtagttgctcaccgcttgtccaccatacgaggtgttgattgcataggtgtgattcaagacgggcggattgtggagcagggaagccattcagagctcgtaagccgaccagatggagcttattcaaggctgttacagcttcaaacgcataggatttgaagcttgatcatggtttaaaaacaaaaaaaaatcggtttctgtaattttttttaaatcaaaactttaatctggaagatttctatggactataacgataatatgaataggtgtagataatgaagcttttgcttatgaaggttatttaaggggttttcttttttcgcatttgcttatgtgcccgttttggaacatgagactaaactatgttttcgttgtttttaacttatgcctaaaaa

SEQ ID NO: 3129 - DNA, 4214 bp, Arabidopsis thaliana
acactctcattctctctctcttctcaccacttcaaaacaagacactcgtaaaagagttcttgaacttcacaaaacaattgtcagattttcaagaaaaactttatattcattctttctctctctctctctcactgctcaatgatctcgttttctcactaaaccaactcgtttcttcttactttctttaactcggatctacaaaaaccatgtcggaaactaacacaaccgatgccaagactgttccaccagaagcagagaagaagaaagaacagagtttaccattctttaaactcttttctttcgctgataaatttgattatctcttaatgttcgttggttctcttggtgccattgttcatggctcttccatgcctgtcttctttttactctttggtcaaatggttaatggatttggtaaaaaccaaatggatttacatcaaatggttcatgaagtctctagatattctctatatttcgtctacttgggtttggtcgtttgcttctcttcttacgcagagatagcatgttggatgtattctggagaaagacaagtagcagcattaaggaagaaatatcttgaagcagtattaaaacaagacgttgggttctttgatactgatgctagaactggtgacattgtctttagtgtttctactgatactcttcttgttcaagatgccattagtgaaaaggttggaaactttatacattacctctcaacatttttggcgggattagtagttggatttgtatcagcatggaaattagctttgttaagtgttgctgtgattcccggaatcgctttcgctggaggtttatacgcttatacactcaccggaattacttcaaagagccgtgaatcttatgctaacgccggtgttatcgccgagcaggcaattgctcaagttcgaactgtttattcttatgttggagagagtaaggcacttaatgcgtattcggatgcgattcagtatacgcttaagctcggttataaagcggggatggctaaagggttgggtttaggatgtacttatggaatagcttgtatgtcatgggctttggtgttttggtatgctggagtttttattcggaatggacaaaccgatggaggaaaggcgtttactgctatattctctgctattgttggtggaatgagtttggggcaatctttctcgaatcttggggcgtttagtaaaggtaaagcggctggttataagttgatggagataattaaccagagaccgacgataattcaagacccgttggatggaaaatgtttggatcaagttcatgggaacattgagtttaaagatgtgacttttagctatccttcacggcctgatgttatgatcttcaggaactttaatattttcttcccttctgggaaaactgtggcggttgttggtgggagtggctctggaaagagtactgttgtttccctcattgagagattctatgatccaaacagcgggcaaattctgttggatggtgttgagataaagacgcttcagttgaagtttttgcgtgaacaaatcgggcttgtgaatcaagaacctgcgctctttgccactactatactagagaacatactctatggaaagcctgatgcaacaatggttgaagttgaagctgctgcttccgctgcgaatgcgcatagtttcattacattacttcctaaaggctacgacacacaggttggagaacgtggtgttcaactctcaggtggacagaagcagagaattgcaattgctagggcgatgttgaaagacccaaagattctgttactagatgaagctacaagcgctcttgatgctagctctgagagcattgttcaggaagctttagacagagtcatggtggggaggaccactgttgttgttgctcatcgtctctgcaccatcagaaatgttgattccattgccgtgatacagcaaggccaagttgttgaaaccggaacacatgaagaactcattgccaaatccggtgcttacgcatccctcatcaggtttcaggaaatggttggtactcgagatttctcaaacccgtcaactcgtcgcactcgttcaacccgtttgagccattcactgtcaacgaaatcactcagtttaagatcaggaagtttgaggaatctgagctattcttacagcactggagctgatggtcggatagagatgatttcaaatgcagagactgaccgaaagactcgtgcccctgaaaattacttctacaggcttctcaagcttaattcaccggaatggccttactcaatcatgggagcagtaggctcaattctttctggtttcattggtcctacatttgctattgtgatgagcaacatgatcgaagtcttctactacacagactatgattcaatggaaaggaaaacaaaagagtatgtcttcatctacattggtgctggtctctatgctgtgggtgcttatttgatccaacattacttctttagcatcatgggagaaaacctcacaacaagagtaagaagaatgatgctctcagctatcttgagaaacgaagttggttggttcgatgaggatgaacacaactcaagcctgatcgctgcacgtttagctactgatgcagcagatgttaaatccgctatagccgagagaatctcagtaattctacaaaacatgacttcacttctcacatccttcatagtcgccttcatagtagaatggagagtctcacttctcatcttaggcacattcccacttctagtcctcgctaactttgctcagcaactatctctgaagggttttgctggagacacagctaaggctcatgcaaagacttcaatgattgctggtgaaggagtcagtaacattagaaccgtagcagctttcaatgcacagagcaagattctctctttgttctgtcatgagcttcgtgtacctcagaaaagaagcttataccgaagtcaaacctcgggtttcctatttggcctctcgcagcttgctctctatggttctgaggctttaattctctggtatggtgcccaccttgtgagtaaaggcgtgtcaaccttttccaaagtgatcaaagtgtttgtggttttggtcattactgcaaactctgttgctgaaactgtcagtcttgctcctgaaattattcggggaggtgaagctgttggttcggttttctcggtcttggacaggcagaccaggattgacccggatgatgctgatgctgatcccgtggagacgatccgtggagacattgagtttaggcatgttgatttcgcttacccttcaagacccgacgtcatggttttcagggactttaacctcagaattcgagctggacatagccaagctcttgtgggcgcgagtgggtcagggaagagttctgtaattgcgatgatcgagcggttttacgaccctcttgctggaaaagtcatgattgatggcaaagacatccgccggctaaacctgaaatctctaaggctcaaaatcggtcttgttcaacaagaaccagctctcttcgcagcaacgatcttcgacaacatcgcctatggtaaagatggtgcaactgaatccgaggtaattgatgcagctcgagccgcaaatgctcacggtttcatcagtggtttacctgaaggttacaaaactccagtaggcgaaagaggagtgcagttatcaggtggacagaaacagaggatcgcgatagcaagagctgtgctcaagaaccctacagtgttgcttctagacgaagcaactagcgcactagatgcagaatcagaatgcgtgctgcaagaggcgttagagaggctcatgagaggtcggaccaccgtggtagttgctcaccgcttgtccaccataagaggtgttgattgcattggtgtgattcaagacgggcggattgtggagcaaggcagccattcagagctcgttagccgaccagagggagcttattcaaggctgttacagcttcaaacacataggatttgaagcttgatcatggattaaaaacaaaaaatcggtttgtgtaattttttttatattaaaactttaatttggaagatttctatggactataacgataatatgaataggtgtagataatgaagcttttggagtgtttatgaaggttctttaattaagggttatttttttcgcattttgcttatgtgcccgttttggaacataagactgaactatgttttcgttatgtttttaatttatgcctcgaaacaaaac

SEQ ID NO: 3130 - DNA, 4794 bp, Brassica oleracea
tggccttttttcactaatttttctgcttaccagttaaattaccgatcccagtccacgagcgcacacataggaggggtacacacgaatctctctcatttcatttctcaatgctcttgtagtctttgaccactggtcttcttcaacagttgtgctctctctccctctctctctctctctctctctctctctctctctctctctctctctctctcatctcttcttctctatatatacacataacaccttcctctccacactctcattctctctctatctctctctccatttttcgatttcaccactcccaaacaagactctagtgcagagttctcgaactcacaaaacaattgtcagttttttctttcgagacatttttattcaaaacattattatctcagctctggatctctcctccatttaccaatgacctcgtttcctctctgagccaactcgtctttgactcactataactcagtcccttcctccttctcctcactccacaacttcggatccacaaaaatgtctgagacaacggcggacgccaagccggttccaccggccgaagctgagaagaagaaagaagagagcttaccgttcttcaaactcttctctttcgcagacaaattcgattacctcttgatgatcactggcactcttggcgccatcgttcacggctcctccatgcctgtcttcttcttgctcttcggtgaaatggttaacggattcggcaaaaaccagatggatttacaccaaatgacacacgaagtctccaaatatgctctgtacttcgtctacttgggtttggtcgtgtgcttctcttcatacgcagagattgcatgttggatgtactctggagaaagacaagtagctgcgctgaggaagaagtatcttgaagctgttctgaaacaagacgttggtttcttcgacactgatgcaagaactggtgacattgtcttcagtgtctctaccgatactcttcttgttcaagacgccattagcgagaaggttgggaactttattcattacctgtcgacgtttttggcggggcttgtggttgggtttgtgtcagcatggagactagctttgttgagcgtggcggtgattcccggaatcgctttcgccggcggtttatacgcttatacgctcaccggaatcacttccaagagccgtgagtcttatgctaacgccggcgttattgccgagcaggcaattgctcaagttcgaactgtttactcttatgttggggagagcaaggccctgagctcgtattctgatgccattcagtacactcttaagcttggatataaagcagggatggctaaaggattgggtttgggatgtacatatgggatagcttgtatgtcgtgggctctggtgttctggtacgctggcgttttcatcaggagcggaacaaccgatggaggaaaggcattcactgctatcttctcagccattgttggtggaatgagcttgggacaatctttctcaaatcttggggcgtttagtaaaggcaaagctgctggtttcaagttgatggagattataaaccagagaccgacgataatccaagacccgttggatgggaaatgcttggaccaagttcgtggagacattgagtttaaagatgtgacctttagctatccttcacgtcctgatgttatcatctttagaaacttctctattttcttcccttctgggaagactgtggctgtggttggtggtagtggctctgggaaaagtactgttgtttccctcatagagagattctacgatccaaacaacgggcaaattctgttggatggtgttgagataaagacgcttcagttgaagtttttgcgtgaacagattgggcttgtgaaccaagaacctgcgctcttcgccactactatacttgagaacatactctacggaaagccagatgcaacaatggttgaagttgaagctgctgcctctgctgctaacgcgcatagcttcattacgttgcttcctaaaggttacgacactcaggttggagaaagaggtgttcaactctcaggtggacagaagcagagaatagcaatcgctagggcgatgctgaaagaccctaagattctgttactagatgaagctacaagcgctcttgatgctagctctgagagcattgttcaggaagctttagacagagtcatggttgggaggaccaccgtggttgttgctcatcgtctctgcaccataagaaacgtcgactccatcgctgtgatacagcaaggccaagtcgttgaaaccggaacacatgaagagctcatcgccaaagccggcgcttacgcatccctcatcaggtttcaagagatggttggaactcgagacttctcaaacccttccacacgtcgcacccgttccacccgtctgagtcactccctgtcgacaaagtcacttagcttgagatcaggaagcttgaggaacctgagctactcgtacagcacaggagctgatggtcggatagagatgatctctaacgcagagacggatagaaagactcgtgctcctcagaactacttctacaggcttctcaagcttaatgcaccggaatggccttactcaatcatgggagcagttggctctgttctgtctggtttcattggtcctacgtttgctattgtgatgagtaatatgatcgaagtcttctactacacagactatgattcaatggagaggaaaacaaaagagtatgtgttcatctacatcggtgctggtatctacgcagtgatcgcctacttgatccaacattacttctttagcatcatgggagaaaacctcacaacaagagtaagaagaatgatgctctcagctatcttgaggaatgaggttggttggttcgatgaggatgaacacaactccagcctgatagctgcacgtttagccacggatgcagcagatgttaaatctgccatagctgagagaatttcagtgatactgcaaaacatgacttcacttctcacatccttcattgttgccttcatagtagagtggagagtttctcttctcatcttagccacgttcccacttctagtccttgccaactttgctcagcaactatctctaaagggttttgccggagacacagccaaggctcatgcaaagacttcaatgattgctggtgaaggagtcagcaacattagaaccgtagcagcattcaatgcgcaaagcaaaatcctctccttgttctgtcacgagctccgtgtccctcagaaaagaagcttctaccgaagccagacctctggtttcctctttggcctctctcagcttgctctctatggctccgaggctctaatcctctggtacggcgcccaccttgtgagcgaaggcaagtcaacattctccaaagtgatcaaagtctttgtggttttagtcatcaccgcaaactctgttgctgaaaccgtcagtcttgctcctgagatcatccggggaggtgaagctgttggttcggtcttctcggtgttggataggcaaaccaggattgaccctgacgatgctgatgctgatccggttgagacaatccgtggagacattgattttaggcatgtggactttgcttacccttcaagaccggacgtcatggtgttcagagactttaacttaagaatcagagctggacatagtcaagctcttgttggagccagtgggtcagggaaaagttctgtgatcgctatgatcgagcggttttatgatccccttggtggaaaagttatgattgatggcaaagacatccgcaggctaaacctaaaatctctgaggctcaagataggtcttgttcaacaagagccagctcttttcgcagcaaccatcttcgacaacatcgcatatgggaaagatggtgcgactgagtccgaggttattgaggcagctcgagcggcaaacgctcatggtttcatcagtggtttgccggaaggttacaaaactccagtgggtgaacgaggagtgcagttatcaggtggacagaaacaaaggatcgccatagcaagagcagtgctcaagaaccctactgtgttgcttcttgatgaagctacaagtgcgctagatgcggaatctgaatgcgtgctgcaggaagctttggagaggctcatgagaggcaggaccactgtggtagttgctcaccggttgtcgaccataagaggtgttgattccatcggtgtgattcaagacgggaggattgtggagcaaggaagccattccgagcttgtaagccgaccagagggagcttattcaaggctgttacagcttcaaacacataggatttgagcttatttaaggctgttacagcttcaaacgcttatgatttgatgcttgatgaattaagaacaaaagttggcttgtgtaacttttatcaaaactttaatatgggaggtttctatggattataatgataatatgaataggtgtagataatgaagcttttgagtgttatggaagttctttcaggtttttcttttaatttgaattttgtcagaagcttatgtatatgcttatgcgcccttcctgggacatgaggctaaactatattttcattatgcttttaacttgtgcctcaaggaaacgtgttgtcctatattttggttcatcaatatttggcagaaacgtttggatggtaagtagacttggtcggagatggtgtgagtggtttaatcaggcatggtctgatccggtcaagtggtcttagagtggatgagtccatgattaaattaaccatcaaaatgtaagaaactaatgaagcttctttggctcaaaaggccttcacacatgtctcagaaatgttca

SEQ ID NO: 3131 - DNA, 4257 bp, Eutrema parvulum
actctcattctctctcttatctctctccattttttatttcatcactttcaaacaagacactcgtaaagagttctcgaacttacaaaacaattgtcagttttttcttttcttttcgagaccatctctgctcttgatctctcctccattaccgatgatctcctttcctatctgagccaactcgtctctgactcgctttaactcgtttctgttcctttttctcaccccacaactcggatccacaaaaatgtcggagacgacggcgacggcggcggatgcgaagcctgttccgccggcagaggcggagaagaagaaagaacagagcttaccgttcttcaagctcttctcttttgctgataaattcgattatctcttgatgatcactggctctcttggcgccattattcatggctcctccatgcctgtcttcttcttgcttttcggtgaaatggtcaatggattcggcaaaaaccagatggatttacatcaaatgacacatgaagtctccaaatatgctctgtatttcgtatacttgggtttggttgtttgcttctcttcttacgcagagattgcatgttggatgtattctggagagaggcaagtagctgcattgaggaagaaatatctcgaagctgttttgaaacaagacgttggattcttcgataccgatgctagaactggtgacattgtcttcagtgtctctaccgatactcttcttgttcaagacgccattagcgagaaggttgggaatttcatacattacttgtcaacgtttttggcggggcttgtggttgggtttgtttcagcatggagattagctttgttgagtgtggcggtgattcccggaatcgctttcgccggcggtttatacgcttacacgctcaccggaatcacttccaagagccgtgaatcttatgccaacgccggcgttatcgccgagcaggcaattgctcaagttcgaactgtgtactcttatgttggagagagcaaggccctgagttcgtattcggatgcgattcagtatacgcttaagctcggttataaagccggtatggctaaaggattgggtttaggatgtacatatggtatagcttgtatgtcatgggctctggttttttggtatgccggcgttttcatcaggagtggaacaaccgatggaggaaaggcattcactgctatattctctgccattgttggtggaatgagcttgggacaatctttctctaatcttggggcctttagcaaaggtaaagcagccggtttcaagttgatggaaataattaaccagagacccacgataatccaagacccattggacgggaaatgcttggaccaagttcatggaaacattgagtttaaagatgtgacttttagctacccttcacggcctgatgttatcatcttcagaaacttttcgattttcttcccttctgggaaaactgtggcggtggttggtggcagtggctctggaaagagtactgttgtttccctcattgagagattttacgacccaaacaacgggcaaattctgctggatggtgttgagataaagacgcttcaattgaagtttttgcgtgaacaaatcgggcttgtgaatcaagaacctgcgctctttgccaccaccatacttgaaaacatactctacgggaaaccggatgcaacaatggtggaagttgaagctgctgcttctgctgcgaatgcgcatagcttcattacgttgcttcctaaaggttacgacacacaggttggagaacgtggtgttcaactctcaggtggacagaagcagaggattgcaattgctagggcgatgttgaaagaccctaagattctgttactagatgaagctacaagtgctcttgatgctagctctgagagcattgttcaggaagctttagacagagtcatggttgggaggaccactgtggttgttgctcatcgtctctgcaccataagaaatgttgactccattgcggtgatacaacaaggccaagtagttgaaaccggaacacatgaagaactcattgccaaatccggtgcttatgcatccctcatcaggtttcaagagatggtgggtactcgggatttctcaaacccatcaacccgtcgcacccgttcaacccgtttaagccattctctgtcaactaaatcactcagcttaagatcaggaagtttgaggaacctgagctattcgtacagcactggagctgatggccggatagagatgatttcaaacgcagagactgatcgaaagactcgtgcgcctcaaaactacttctacaggcttctcaagcttaatgcaccggaatggccttactcaatcatgggagcagttggttcggttctttctggttttatcggtcctacctttgctattgtgatgagtaatatgatcgaagtcttctactacacagactatgattcaatggagagaaaacaaaagagtatgttttcatctacatcggtgctggtctctacgccgtgggggcttatttgatccaacattacttctttagcataatgggagaaaacctcaccacaagagtaagaagaatgatgctctcagctatcttgaggaacgaggttggttggttcgatgaggatgaacacaactcgagcctgattgctgcacggttagccactgatgcagccgatgttaaatctgccatagccgagagaatctcagtcattctgcagaacatgacttcacttctcacatccttcatagttgccttcatagtagagtggagagtctccattgtcattttatgcacattcccacttctagttcttgctaactttgctcagcaactatctctgaagggttttgccggagacacagccaaggctcatgctaagacttcaatgattgctggtgaaggagtcagcaacattagaaccgtagcagccttcaatgcgcaaagcaaaatcctctctttgttctgttacgagctccgtgtccctcagaaaagaagcttctaccgaagtcagacctcgggaatcctctttggcctctcccagcttgctctctatggatctgaggctctaatcctctggtacggagcccgccttgtgagtgaaggcaaatcaaccttctccaaagtgatcaaagtctttgtggttttggtcatcactgcaaactctgttgctgaaactgtcagtctagctcctgaaatcatccggggaggtgaagcggtcggttcagttttctcggtcttggataggcaaacccgaattgacccagatgatgctgatgctgattcagtcgaaacaatccgtggagacattgattttaggcatgtggatttcgcttacccttcaagaccagacgtcatggttttcagagactttaacctcagaatccgagctggacatagccaagctcttgtcggcgccagtgggtcagggaaaagttctgtgatcgcgatgatcgagcggttttatgatccccttgccggaaaagtcatgattgatggcaaggacatccgccggctaaacctgaaatctctgaggctgaaaatcggacttgttcaacaagaaccagctcttttcgcagcaaccatcttcgacaatatcgcatatgggaaagatggtgcaactgagtccgaggttatcgaggctgctcgagccgcaaacgctcatggtttcatcagtggtttgcccgaaggttacaaaactcctgtgggcgaaagaggagtgcagttatctggtggacagaaacagaggatcgcaatagcaagagcagtgctcaagaaccctactgtgttgcttctagacgaagcaacaagcgcactagatgcagaatcagaatgcgtgctgcaagaagctttagagagactcatgagaggccggaccaccgtggtagttgctcaccgattgtccaccataagaagcgttgactgcatcggtgtgattcaagacgggaggattgtggagcaaggaagccattccgagcttgtaagccgaccagagggagcttattcaaggctgttacagcttcaaacgcataggatttgaagcttgatggattaaaaacaaaaatgggtttgtgtaattttttttatcaaaactttaatttgggaggtttctgtggactgtaagtctataatgataatatgaataggtgtagataatgaagcttttgagtgtttatgaaggttcttgaaggtttcttttttatttttatgagtgcttatgtgcccgttttgggacatgagactcaactatgttttggtaatgtttttaacttatgcctcaaaaaaa

SEQ ID NO: 3132 - DNA, 4358 bp, Brassica rapa
actctcattctctctctatctctctctccattttttcaatttcatcactcccaatcaagactccagtgcagagttctcgaactcacaaaacaattgtcagtttcttcttttcgagacatttttactcaaaacattattatctcagctctggatctctcctccatttaccaccaatgatctcattttctctctgagccaactcgtctctgtctcgctctaacacagttccttctcccttctcctcactccacaacttcggatccacaaaaatgtctgaaacaacggcagataccaagcctgttccaccggccgaagccgagaagaagaaagaagagagcttaccgttcttcaaactcttctccttcgcagacaaattcgattacctcttgatgaccactggcactcttggcgccatcgttcacggctcatccatgcctgtcttcttcttgctcttcggtgaaatggttaacggattcggcaaaaaccagatggatttacaccagatgacacatgaagtctccaaatattctctgtacttcgtctacttgggtttggtcgtgtgcttctcttcatacgcagagattgcatgttggatgtactctggagaaagacaagtagctgcgctgaggaagaagtaccttgaagctgttctgaaacaagacgttggtttcttcgacactgatgcaagaaccggtgacattgtcttcagtgtctctaccgatactcttcttgttcaagacgccattagcgagaaggtggggaactttatacattacctgtcaacgtttttggcggggcttgtggttgggtttgtgtcagcatggagactagctttgttgagtgtggcggtgattcccggaatcgctttcgccggcggtttatacgcttatacgctcaccggaatcacttccaagagccgtgagtcttatgctaacgccggcgttattgccgagcaggcaattgctcaagttcgaactgtttactcttatgttggggagagcaaggccctgagctcgtattctgatgccattcagtacactcttaagcttggatataaagcagggatggctaaaggattgggtttgggatgtacatatgggatagcttgtatgtcgtgggctcttgtgttctggtacgctggcgttttcatcaggagcgggacaacagatggaggaaaggcattcactgctatcttctctgccattgttggtggaatgagcttgggacaatctttctcaaatcttggggcgtttagtaaaggtaaagctgctggtttcaagttgatggagattataaaccagagaccgacgataatccaagacccgttggatgggaaatgcttggaccaagttcgtggagacattgagtttaaagatgtgacttttagctatccttcgcgtcctgatgttatcatcttcagaaacttctctattttcttcccttctgggaaaactgtggctgtggttggtggtagtggctctgggaagagtactgttgtttccctcattgagagattctacgatccaaacaacgggcaaattctgttggatggtgttgagataaagacgcttcagttgaagtttttgcgtgaacagattgggcttgtgaaccaagaacctgcgctcttcgccactactattcttgagaacatactctacggaaagcctgatgcaactatggttgaagttgaagctgctgcctctgctgctaacgcgcatagcttcattacgttgcttcctaaaggttacgacacacaggttggagaacgaggtgttcagctctcaggtggacagaagcagagaatagcaatcgctagggcgatgttgaaagatccaaagattctgttactagatgaagcaacaagcgctcttgatgctagctcagagagcattgtacaagaagctttagacagagtcatggtggggaggaccaccgtggtcgttgctcatcgtctctgcacaataagaaacgtcgactccatcgctgtgatacagcaaggccaagtcgttgaaaccggaacacatgaagagctcatcgccaaagccggcgcttacgcatccctcatcaggtttcaagagatggttggaactcgagacttctcaaacccgtccacacgtcgcacccgttccacccgtctgagccactccctgtcgacgaagtcactcagcttgagatcaggaagtttgaggaacctgagctactcgtacagcactggagctgatggtcggatcgagatgatctcaaacgcagagacggatagaaagacacgtgcgcctcaaaactacttctacaggcttctcaagcttaatgcacctgaatggccttactcaatcatgggagcagttggctcggttctctctggtttcattggtcctacgtttgctattgtgatgagtaatatgatcgaagtcttctactacacagactatgattcaatggagaggaaaacgaaagagtacgtgttcatctacatcggtgctggtatctacgcagtgatcgcctacttgatccaacattacttctttagcatcatgggagaaaacctcacaacaagagttagaagaatgatgctctcagctatattgaggaatgaggttggttggttcgatgaggatgaacacaactcgagcctgatagctgcacggttagccactgatgcagcagatgttaaatctgccatagccgagagaatctcagtgatactgcaaaacatgacttcacttctcacatccttcattgttgccttcatagtagagtggagagtttctcttctcatcttagccacgttcccacttctagtccttgccaactttgctcagcaactatctctaaagggttttgccggagacacagccaaggctcatgcaaagacttcaatgattgctggtgaaggagtcagcaacattagaaccgtagcagcattcaatgcgcaaagcaaaatcctctccttgttctgtcacgagctccgtgtccctcagaaaagaagcttctaccgaagccagacctctggtttcctctttggcctctctcagcttgctctctatggctccgaggctctaatcctctggtacggcgcccaccttgtgagcgaaggcaagtcaacattctctaaagtgatcaaagtctttgtggttttggtcattaccgcaaactctgttgctgaaaccgtcagtcttgctcctgaaatcatccggggaggtgaagctgttggttcggtcttctcggtgttggataggcaaaccaggattgaccctgacgatgctgatgctgatccggtggagacaatccgtggagacattgattttaggcatgtggactttgcttacccttcaagaccggacgtcatggtgtttagagactttaacctcaggatcagagctggacatagccaagctcttgtcggagccagtggatcagggaagagttctgtgatcgctatgatcgagcggttttatgatccccttggtggaaaagttatgattgatggcaaagacatccgcaggctaaacctaaaatctctgaggctcaagataggtcttgttcaacaagagccagctcttttcgcagcaactatcttcgacaacatcgcatatgggaaagatggtgccactgagtccgaggttatggaggctgctcgatcagcaaacgctcatggtttcatcagtgggttgcctgaaggttacaaaactccagtgggtgaaagaggagtgcagttatcaggtggacagaaacagaggattgcgatagcgagagcagtgctcaagaaccctactgtgttgcttcttgatgaagcaacaagcgcgctggatgccgaatctgaatgcgtgctgcaggaagctttggagaggctcatgagaggcaggaccaccgtggtagtcgctcaccgtttgtcgaccataagaggtgttgattccatcggtgtgattcaagacgggaggattgtggagcaaggaagccattccgagcttgtaagccgaccagagggggcttattcaaggctgttacagcttcaaacacataggatttgaacttatttaaggctgttacagcttcaaacgcttatgatttgatgcttgatggattaagaacaaaagttggcttgtgtaacttttatcaaaactttaatatgggaggtttctatggattataatgataatatgaataggtgtagataatgaagcttttgagtgttatgcttccttaaggtttctcttttaatttgaattttgtcaggagcttatgtatttgcatgcttatgcgtcctttctggaacataaggctaaactatattttcattatgctgttaacttttgcctcaagaaaacatattgtcttatattttggctcatcaatatttg

SEQ ID NO: 3133 - DNA, 3783 bp, Brassica napus
cccaaagccggttccaccggccgaagccgagaagaagaaagaagagagcttaccgttcttcaaactcttctctttcgcagacaaattcgattacctcctgatgatcactggcactcttggcgccatcgttcacggctcatccatgcctgtcttcttcttgctcttcggtgaaatggttaacggattcggcaaaaaccagatggatttacaccaaatgacacacgaagtctccaaatatgctctgtacttcgtctacttgggtttgatcgtgtgcttctcttcatacgcagagattgcatgttggatgtactctggagaaagacaagtagctgcgctgagaaaaaagtatcttgaagctgttctgaaacaagacgttggtttcttcgacactgatgcaagaactggtgacattgtcttcagtgtctctaccgatactcttcttgttcaagacgccattagcgagaaggttgggaactttattcattacctgtcgacgtttttggcggggcttgtggttgggtttgtgtcagcatggagactagctttgttgagcgtggcggtgattcccggaatcgctttcgccggcggtttatacgcttatacgctcaccggaatcacttccaagagccgtgagtcttatgctaacgccggagttattgccgagcaggcaattgctcaagttcgaactgtttactcttatgttggggagagcaaggccctgagctcgtattctgatgccattcagtacactcttaagcttggatataaagcagggatggctaaaggattgggtttgggatgtacatatgggatagcttgtatgtcgtgggctctggtgttctggtacgctggcgttttcatcaggagcggaacaaccgatggaggaaaggcattcactgctatcttctcagccattgttggtggaatgagcttgggacaatctttctcaaatcttggggcgtttagtaaaggcaaagctgctggtttcaagttgatggagattataaaccagagaccgacgataatccaagacccgttggatgggaaatgcttggaccaagttcgtggagacattgagtttaaagatgtgacatttagctatccttcacgtcctgatgttatcatcttcagaaacttctctattttcttcccttctggaaagaccgtggctgtggttggtggtagtggctctgggaaaagtactgttgtttccctcatagagagattctacgatccaaacaacgggcaaattctgttggatggtgttgagataaagacgcttcagttgaagtttttgcgtgaacagattgggcttgtgaaccaagaacctgcgctcttcgccactactatacttgagaacatactctacggaaagccagatgcaacaatggttgaagttgaagctgctgcctctgctgctaacgcgcatagcttcattacgttgcttcctaaaggttacgaaactcaggttggagaaagaggtgttcaactctcaggtggacagaagcagagaatagcaatcgctagggcgatgctgaaagaccctaagattctgttactagatgaagctacaagcgctcttgatgctagctctgagagcattgttcaggaagctttagacagagtcatggttgggaggaccaccgtggttgttgctcatcgtctctgcaccataagaaacgtcgactccatcgctgtgatacagcaaggccaagtcgttgaaaccggaacacatgaagagctcatcgccaaggccggtgcttacgcatccctcatcaggtttcaagagatggttggaactcgagacttctcaaacccttccacacgtcgcacccgttccacccgcctgagcaactccctgtcgacaaagtcactcagcttgagatcaggaagcttgaggaacctgagctactcgtacagcacaggagctgatggtcggatagagatgatctctaacgcagagacggatagaaagactcgtgctcctcagaactacttctacaggcttctcaagcttaatgcaccggaatggccttactcaatcatgggagcagttggctctgttctgtctggtttcattggtcctacgtttgctattgtgatgagtaatatgatcgaagtcttctactacacagactatgattcaatggagaggaaaacaaaagagtatgtgttcatctacatcggtgctggtatctacgcagtgatcgcctacttgatccaacattacttctttagcatcatgggagaaaacctcacaacaagagtaagaagaatgatgctctcagctatcttgaggaatgaggttggttggttcgatgaggatgaacacaactccagcctgatagctgcacgtttagccacggatgcagcagatgttaaatctgccatagctgagagaatatcagtgatactgcaaaacatgacttcacttctcacatccttcattgttgccttcatagtagaatggagagtttctcttctcatcttagccacgttcccacttctagtccttgccaactttgctcagcaactatctctgaagggttttgccggagacacagccaaggctcatgcaaagacttcaatgattgctggtgaaggagtcagcaacattagaaccgtagcagcattcaatgcgcaaagcaaaatcctctccttgttctgtcacgagctccgtgtccctcagaaaagaagcttctaccgaagccagacctctggtttcctctttggcctctctcagcttgctctctatggctccgaggctctaatcctctggtacggcgcccaccttgtgagcgaaggcaagtcaacattctccaaagtgatcaaagtctttgtggttttagtcatcaccgcaaactctgttgctgaaactgtcagtcttgctcctgagatcatccggggaggtgaagctgttggttcggtcttctcggtgttggataggcaaaccaggattgaccctgacgatgctgatgctgatccggttgagacaatccgtggagacattgattttaggcatgtggactttgcttacccttcaagaccggacgtcatggtgttcagagactttaacttaagaatcagagctggacatagtcaagctcttgttggagccagtgggtcagggaaaagttctgtgatcgctatgatcgagcggttttatgatccccttggtggaaaagttatgattgatggcaaagacatccgcaggctaaacctaaaatctctgaggctcaagataggtcttgttcaacaagagccagctcttttcgcagcaaccatcttcgacaacatcgcatatgggaaagatggtgcgactgagtccgaggttattgaggcagcccgagcggcaaacgctcatggtttcatcagtggtttgccggaaggttacaaaactccagtgggtgaacgaggagtgcagttatcaggtggacagaaacaaaggatcgccatagcaagagcagtgctcaagaaccctactgtgttgcttcttgatgaagctacaagtgcgctagatgcggaatctgaatgcatgctgcaggaagctttggagaggctcatgagaggcaggaccactgtggtagttgctcaccggttgtcgaccataagaggtgttgattccatcggtgtgattcaagacgggaggattgtggagcaaggaagccattccgagcttgtaagccgaccagagggagcttattcaaggctgttacagcttcaaacacataggatttgagcttatttaaggctgttacagcttcaaacgcttatgatttgatg

SEQ ID NO: 3134 - DNA, 3961 bp, Brassica napus
gaagaagaaagaagagagcttaccgttcttcaaactcttctccttcgcagacaaattcgattacctcttgatgaccactggcactcttggcgccatcgttcacggctcatccatgcctgtcttcttcttgctcttcggtgaaatggttaacggattcggcaaaaaccagatggatttacaccagatgacacatgaagtctccaaatattctctgtacttcgtctacttgggtttggtcgtgtgcttctcttcatacgcagagattgcatgttggatgtactctggagaaagacaagtagctgcgctgaggaagaagtaccttgaagctgttctgaaacaagacgttggtttcttcgacactgatgcaagaaccggtgacattgtcttcagtgtctctaccgatactcttcttgttcaagacgccattagcgagaaggtggggaactttatacattacctgtcaacgtttttggcggggcttgtggttgggtttgtgtcagcatggagactagctttgttgagtgtggcggtgattcccggaatcgctttcgccggcggtttatacgcttatacgctcaccggaatcacttccaagagccgtgagtcttatgctaacgccggcgttattgccgagcaggcaattgctcaagttcgaactgtttactcttatgttggggagagcaaggccctgagctcgtattctgatgccattcagtacactcttaagcttggatataaagcagggatggctaaaggattgggtttgggatgtacatatgggatagcttgtatgtcgtgggctcttgtgttctggtacgctggcgttttcatcaggagcgggacaacagatggaggaaaggcattcactgctatcttctctgccattgttggtggaatgagcttgggacaatctttctcaaatcttggggcgtttagtaaaggtaaagctgctggtttcaagttgatggagattataaaccagagaccgacgataatccaagacccgttggatgggaaatgcttggaccaagttcgtggagacattgagtttaaagatgtgacttttagctatccttcgcgtcctgatgttatcatcttcagaaacttctctattttcttcccttctgggaaaactgtggctgtggttggtggtagtggctctgggaagagtactgttgtttccctcattgagagattctacgatccaaacaacgggcaaattctgttggatggtgttgagataaagacgcttcagttgaagtttttgcgtgaacagattgggcttgtgaaccaagaacctgcgctcttcgccactactattcttgagaacatactctacggaaagcctgatgcaactatggttgaagttgaagctgctgcctctgctgctaacgcgcatagcttcattacgttgcttcctaaaggttacgacacacaggttggagaacgaggtgttcagctctcaggtggacagaagcagagaatagcaatcgctagggcgatgttgaaagatccaaagattctgttactagatgaagcaacaagcgctcttgatgctagctcagagagcattgtacaagaagctttagacagagtcatggtggggaggaccaccgtggtcgttgctcatcgtctctgcacaataagaaacgtcgactccatcgctgtgatacagcaaggccaagtcgttgaaaccggaacacatgaagagctcatcgccaaagccggcgcttacgcatccctcatcaggtttcaagagatggttggaactcgagacttctcaaacccgtccacacgtcgcacccgttccacccgtctgagccactccctgtcgacgaagtcactcagcttgagatcaggaagtttgaggaacctgagctactcgtacagcactggagctgatggtcggatcgagatgatctcaaacgcagagacggatagaaagacacgtgcgcctcaaaactacttctacaggcttctcaagcttaatgcacctgaatggccttactcaatcatgggagcagttggctcggttctctctggtttcattggtcctacgtttgctattgtgatgagtaatatgatcgaagtcttctactacacagactatgattcaatggagaggaaaacgaaagagtacgtgttcatctacatcggtgctggtatctacgcagtgatcgcctacttgatccaacattacttctttagcatcatgggagaaaacctcacaacaagagttagaagaatgatgctctcagctatattgaggaatgaggttggttggttcgatgaggatgaacacaactcgagcctgatagctgcacggttagccactgatgcagcagatgttaaatctgccatagccgagagaatctcagtgatactgcaaaacatgacttcacttctcacatccttcattgttgccttcatagtagagtggagagtttctcttctcatcttagccacgttcccacttctagtccttgccaactttgctcagcaactatctctaaagggttttgccggagacacagccaaggctcatgcaaagacttcaatgattgctggtgaaggagtcagcaacattagaaccgtagcagcattcaatgcgcaaagcaaaatcctctccttgttctgtcacgagctccgtgtccctcagaaaagaagcttctaccgaagccagacctctggtttcctctttggcctctctcagcttgctctctatggctccgaggctctaatcctctggtacggcgcccaccttgtgagcgaaggcaagtcaacattctctaaagtgatcaaagtctttgtggttttggtcattaccgcaaactctgttgctgaaaccgtcagtcttgctcctgaaatcatccggggaggtgaagctgttggttcggtcttctcggtgttggataggcaaaccaggattgaccctgacgatgctgatgctgatccggtggagacaatccgtggagacattgattttaggcatgtggactttgcttacccttcaagaccggacgtcatggtgtttagagactttaacctcaggatcagagctggacatagccaagctcttgtcggagccagtggatcagggaagagttctgtgatcgctatgatcgagcggttttatgatccccttggtggaaaagttatgattgatggcaaagacatccgcaggctaaacctaaaatctctgaggctcaagataggtcttgttcaacaagagccagctcttttcgcagcaactatcttcgacaacatcgcatatgggaaagatggtgccactgagtccgaggttatggaggctgctcgatcagcaaacgctcatggtttcatcagtgggttgcctgaaggttacaaaactccagtgggtgaaagaggagtgcagttatcaggtggacagaaacagaggattgcgatagcgagagcagtgctcaagaaccctactgtgttgcttcttgatgaagcaacaagcgcgctggatgccgaatctgaatgcgtgctgcaggaagctttggagaggctcatgagaggcaggaccaccgtggtagtcgctcaccgtttgtcgaccataagaggtgttgattccatcggtgtgattcaagacgggaggattgtggagcaaggaagccattccgagcttgtaagccgaccagagggggcttattcaaggctgttacagcttcaaacacataggatttgaacttatttaaggctgttacagcttcaaacgcttatgatttgatgcttgatggattaagaacaaaagttggcttgtgtaacttttatcaaaactttaatatgggaggtttctatggattataatgataatatgaataggtgtagataatgaagcttttgagtgttatgcttccttaaggtttctcttttaatttgaattttgtcaggagcttatgtatttgcatgcttatgcgtcctttctggaacataaggc

SEQ ID NO: 3135 - DNA, 4429 bp, Zea mays
gccatgcgggcccatatggccatattcatctgcatagttgcctctctttttttctccttttttttgctgaagaaaaggctactgtatgctgtattcgttgtatcaagtgaaaatgccacggttgctgaactggctacaactttacaagccgacctttaccagctccaggcagctgcatcgtttgcttgccgactaggatgggctgtgaagcttctggataccgactctgttcttagggattcgagcactcctgcactgtccaacaacattctcagcgatgaagttgaaagctctcgtacgagtgtcgcctcagaaaagtctggtcatgagttgcttagcagtgattctgatggacacaagaactccgggatggcttatgtgggcttcattgtcgatgctaatgtaacttcatacttaatgatgggctcactatctccaggtttgaagtcgcatgctgtgacactatacgaggcaggaaagcttggcgattcttgtaaggctgatctatgcaatgatcttgccagtttagaggggaaacggtttgaaggtgttgtttctgttggtcgcttggccagcgaccgtgcaggtggtgccagagctgcttggggtcatggaattggaaacccaacgatcgtcaatctcgtcatgtctctgccgcacctcagtctccgccgcacagatcggcatgccacacgtgcgccctggactgcagcccctgcacctccctccatcgccctcgtcaatcccgtcatggaaggcccgtcctcgcctccccgcgcgcggcgcctccctggatcttccccaccatcctcgcctctcggcgcgtggggattccctggatcttcctcacctcccgtcaacaaaacaaaaggaaacacaacggcctcttaccatctttttcctcgcctcccgttcctcctcctaccttgtacggcgactccaaacagcaaaagtgaggaggaagatagtggcactgcagcgctcgtggaagaagaagcggtgaagcaggcagaggggttcgaggctgtggaggcaagggcaaagaacgtcgacaagtttgatctcagctaccttgacaaccaagtcttcttttggtctgtccgcgacatcttcaacagggatctcctcaataaaaaggcttgtgtcataacaagccaaaaaatcggtggcaaccgcaatagttccggaagttgtatctcacgattgtttgctctagactatatttgcacgcagggcgaccttgcactcatcgattttattaaggaaatcccttgtgaaccaagggtggaagtcgtgcttattgatgatgcctttgttgaaagaaagtcgatggaatgtttatttcagccgaatgcatatctaggtgacgaggttatagactgttatataaatttgataaaagctcaaaagcatctaaagtgccgatctggaggtcgcgttcacatagaaaatgctttccagtttaatttcttgaagcgagatggcgatgttgaaattaaaacagaggagctatatccaattgaagacatgacacaaatatgtagcgctgaacgaagggtgttactttacctagaccatgacatggtgtttattccgataaacatccgagagacgcactggtatcttgccgtgatccatgcaagaaatatggagatacaagtgctcgattcacttgctacttcacaagatcgtaaaaacctcacggactctattaaaggactccaaagacaaattgatatgatatctcaacgtaaggagttaaaagaccacaggtggccaaacctccaagttgcttcttggccgctcagagaaatagacatgggatatgcaaagcagacagatagcccatcggatgttgagatattagaaaacccaacagattctaagaagaggaagctactccacgtgcttgatgatagcgaagtagtgtatgaagatgagaaaggccctattactcaagcagacttgcaaaagtggtttgttgatgattgggataaaagaactcctgtaaaagtatctaacgatgtgtgcaccaatgactttttaatggttggtctttccacaaaggacatgctagtgaccaaagtcgattcaatatttgttttatgtgattatatcatgacaatagaagacgatacaacactagagatgacatgggtgcgaagtttcaatccttttaagatagaaatatctgttaaagacctacaaaacatattaacgataaataaagatatgactctaagatgttttgacatggctgttcggctgcttgccaataaagagtcatgtaggccgaaaggagaaatcataaataatagaaagcattatatggacatgcgtttctgggttcttatgccatggaaattcaacggatgtcacgcccttttcgtaatagatcatgttaaaaaacatgtgacttttatcgactttacaccgactcaaaattggtgtaaacacatgccatacaagaggtttgcggaagcgattatcatggcctcaaagaaatataagattgcttacagcaaaaaacgttctggatgggcggaggatatctttaagtgggaacatacaattcagactggtgttccaattgacttaagagggtgtaataccagctacctcgttctacaagctatggccatgtgggggaatgacagacgaatgaaatttgttggggaagaggccccgctcctctccctgctcgctgcacagggactcggcctccgggacggcagacccacaagcgccagcacgctcgagactgtgccgtgggagtgggaggttcctcaggtgctgagcagtcgccggcggcgaccgccggtgtcggagatgaaggagagaagcggctccagggcggcggtggacgagcgctacgcgcagtggaagtcgctcatccccgtcctctacgactggtttgccaaccacaacctcgtctggccatccctctcctgccggtgggggccacagtttgagaaagctacctacaagaatcgtcagcgcctgtacctatctgaacagacggatgggagtgtgcctaatactctggttatcgcaaattgtgaagttgtgaaacctagggttgcagctgctgaacatatctcacagttcaatgaggaagcacggtcaccttttgtaaagaagtacaaaactatagttcatcctggtgaggttaacagaatcagggaacttccacagaacagtaagatcatagccactcacactgacagtccagatgtacttatttgggatgttgaagcacaaccaaatagacatgctgtcctaggagcaagcgagtctcgccctgatctgatattaacaggacataaggaaaatgcggaatttgcgcttgccatgtgtccagcagaaccatatgtcctatcaggaggaaaggacaaatctgttgtcttgtggagcatccaagaccatatatctgcccttggggattcctcgtcttctcctggagcatctggcagcaagcagtctattaaaactgcaaatgaaaaggagagccctaaagttgatcctagaggtatatttcatggacatgacagcacggttgaagatgttcagttctgcccttccagtgcgcaggagttttgtagtgtgggtgatgatgcttgtcttattctgtgggatgctcgaactggcactgccccagctgttaaggttgagaaagctcacagtggagatgttcattgtgttgattggaatccccttgatgttaactatatcttaactgggtctgccgataactctgtccgaatgtgggatcgtcggaatctgggttcaggaggagctggttctccaattcacaaatttgaaggccataaagctgctgttctttgtgttcagtggtcacctgacagagcatctgtttttggaagttctgcagaagatggtttcttaaacgtgtgggatcatgagaaggtggggaagaagaaaaattctaatgtcccagccgggcttttctttcagcacgctggtcatagggataagattgtagacttccactggaattcgtcagatccttggacaattgtcagtgtctctgatgatggcgagagcactggtggaggtggaacactgcagatttggcgcatgagtgatttgatctaccgcccagaggatgaagttcttgcagagctggagaatttcaaggctcatttggccagctgtgcaccgaagaattgagtcatttgacattgaatctgtcctctgatgctcctagagctgtacccttgaggggcttgtgcttttgtgagcttgtgttaaacctgctgtacgagtaaactagtatgtccgcaaacgcgtcagagccggatgtctgtgggccagctattgggatactgccggatatcgtcaacaattgttccagattggtgtattggatctaatgagattgtcagcaattgcttgtttttatggcttc

SEQ ID NO: 3136 - DNA, 1772 bp, Echinochloa colona
gcattggatcctctgtgctctctgctcgcaacgcagtggctcggccgcggaggcagacagaaacatccaggactcgggacgccagcacgctcccgcagtagcagagagcgtgggcttgggaggcgcggagcagtcgccgccgttggaagccaccggtgtcggagatgaaggagagaagtggctcgagggcggcggtggacgagcgctacgcgcagtggaagtcgctcatcccggtgctctacgactggttcgccaaccacaacctcgtctggccgtccctctcctgccggtggggtccacaatttgagaaagctacctacaagaatcgacagcgcctttacctatctgagcagacggacgggagtgtgcctaatactctggttatcgcaaactgtgaagttgtcaaaccaagggttgcagctgctgaacatatctcacagttcaatgaggaagcacgatcaccttttgtgaagaagtacaagactatagttcatcctggtgaggttaacagaatcagggagcttccacagaacagtaagatcatagccactcacaccgacagtccagatgtacttatttgggatgttgaagcccaaccaaatagacatgctgtcctaggagcaactgaatcgcgccctgatctgatattaacagggcacaaggaaaatgctgaattcgctcttgccatgtgtccagcagaaccatatgtactttcaggaggaaaggacaaatctgttgtcttgtggagcatccaagatcacatatctgcccttggagattcctcgtcttctcctggagcatctggcagcaagcagtctggtaaaactgggaatgaaaaggagagtcctaaagttgatcctcgaggtatattccatggacatgacagcaccgttgaagatgttcagttctgcccttcaagtgcacaggaattctgtagtgtgggtgatgatgcttgtcttattctctgggatgctcggactggtactaacccggctgttaaggtcgaaaaagctcacagtggagatgttcattgtgttgattggaatccgcttgatgttaactatatcttaactggatctgctgataactctgtccgtatgtgggatcgtcgcaatctgggttctggaggagctggttcccctatccacaaatttgagggccataaagctgctgttctttgtgttcagtggtcacctgacagagcatctgtttttggaagttctgctgaagatggtttcttaaatgtgtgggatcatgagaaggttgggaagaagaaaaactctaatgtaccagctgggcttttctttcaacatgctggtcacagggataagattgtagacttccactggaattcatcggatccttggacgattgtcagcgtctctgatgatggtgagagcactggtggaggtggaactctgcagatatggcgtatgagtgacttgatttaccgcccagaggaggaagttcttacagagctggagaatttcaaggctcacttggccagctgcactccgaggaactgaattatgtgattatctgtggaatccaatccagtgaaaactccctgtaggtgttttagtttcctagccataactatggctccagttgacattggtgttctctgatgctccagacctgtgacgtttgtgagcttgtgttaagcttgttgtgtgactaaactgtgtgtccgcgaacatagcagagctggatatctctgtagtctgtaggccggctattcggatattgctggatatttatgacaattattc

SEQ ID NO: 3137 - DNA, 2586 bp, Setaria italica
ggtgacatgctcgtcgacagcgagacgttagtgatgatttcgtcaatctcgaggatttaccggctcagtctttcgaagatgctcatataggtagggttttatgtatatatttgtaggggtgagtgtgcgtatgtgtatgtgactgtagacgtctgtgtgattcgaaaaaaaaatgaggtcgaagaaaagagatgttattaaatcagcatagaggggaaagaagttgaaaagaacgaagaccaacttcttaacaggccttataagattcacgcaccagcccaacttcttcctaacgcagccaccggccccacaccccccggcccaaatgcaacttggcccagcccacgcgtctcgtccgtcttcagctccccgctccgctctgcaggaaactctctgctcgcaccgcagtgactcgacagaaacgtctccagactcgggtgccagcacgctccctcagtagccgagagcgtgggagtgggaggcgccgagcagtcgccgccggcggagaccaccggcgtcggagatgaaggagagaagcggctcgagggcggcggtggatgagcgctacgcgcagtggaagtcgctcatcccggtgctctacgactggttcgccaaccacaacctcgtctggccatccctctcctgccggtggggcccgcaatttgagaaagctacctacaagaatcgtcagcgcctttacctatctgagcagacggatgggagtgtgcctaatactctggttattgcgaattgtgaagttgtcaaaccaagggttgcagctgctgaacatatctcacagttcaatgaggaagcacggtcaccttttgtgaagaagtataagactatagttcatcctggtgaggttaacagaatcagggagcttccacagaacagtaagatcatagccacacacaccgacagtccagatgtacttatttgggatgttgaagcccaaccaaatagacatgccgtcctaggagcaactgaatctcgccctgatctgatattaacaggacatcaggaaaatgctgaattcgcgcttgccatgtgtccagcggaaccatatgtactgtcaggaggaaaggacaaatctgttgtcttgtggagcatccaagatcacatatctgcccttggagattcctcgtcttctcctggagcatctggcagcaaacaatctggcaaaaccacgaatgaaaaggagagtcctaaagttgatcctcggggtatcttccatggacatgacagcactgttgaggatgttcagttctgcccttccagtgcacaggaattctgcagtgtgggtgatgatgcttgtcttattctctgggatgcccggactggtactagcccggctgttaaggttgagaaagctcacagtggggatgttcattgtgttgattggaatccgcttgatgttaactatatcttaactggttctgctgataactctgtccgtatgtgggatcgtcgcaatctgggttctggaggagctggttctccgattcacaaatttgagggtcataaagctgctgttctttgtgtccagtggtcacctgacagggcatctgttttcggaagttctgccgaagatggtttcttaaatgtgtgggatcatgagaaggttgggaagaagaaaaactctaacgtaccagctgggcttttctttcaacatgctggtcacagggataagattgtagacttccactggaattcatcggatccttggacgatcgtcagtgtgtcagatgatggtgagagcactggtggaggtggaacactacagatatggcgcatgagtgacttgatctaccgcccagaggaggaagttctcacagagttggagaatttcaagtctcacttggccagctgcactccgaggaactgagtcatgtgattatctgtggaatccaatccgttgaaagctccgtgtaggtgttctagtttcctagccagtaactgtggctccagttgacattggtattgtactgtgatgctctagacctgtgacttctgagcttgtgttaagcttgttgtgtgattaaactgagtatgtccgcagacaagcagagctggatatctccgtagtctgtaggctgactattcggatattgctggatatttttgacaattattctggattgtgctattggacctagtgagattgtggagtactggagtgtgtaatgcttcatgtctaaaatatgcttacagccttaactcccacgtggaacgagtgctgtatagcgtcattgtggtaacgtggaggccactgtctagactcctaagatggtggaatagttggtgatataggttagaaacctaataggccttgtggaatttgcttgtgtcactattggtgttttgctgcagatggttatgttgcctgccagtgactgaatagcgtcaggtgtttcactgttgatgattaagttgcctgcccctaaccaggtggtgtcacatgctagtaagcgagctaagtcaagggctcgctcgctgtggtgggttgagaaacctacagctcagttcgtgttgttgtccttggtgtgtaaaacggacagtccaacacaaggaacacctgggtattac

SEQ ID NO: 3138 - DNA, 1761 bp, Saccharum officinarum
agcgtccaggatcgagacgccagcacgctctcgcagtagcagcgagcgtgccgtggccgtgggagtgaggtgcggagcagtcgccggcgtcgaccatcggtgtcggagatgaaggagagaagcggctccagggcggcggtggacgagcgctacgcgcagtggaagtcgctcatccccgttctctacgactggtttgccaaccacaacctcgtctggccatccctctcgtgccggtgggggccacagtttgagaaagctacctacaagaatcgtcagcgcctttacctatctgagcagacggatgggagtgtgcctaatactctggttattgcaaactgtgaagttgtgaaacctagggttgcagctgctgaacatatctcacagtttaatgaggaagcacgatctccttttgtgaagaagtacaagactatagttcatcctggtgaagttaacagaatcagggagcttccacagaacagtaagatcatagccacgcacactgacagtccagatgtacttatttgggatgttgaagcacagccaaatagacatgccgtcctaggagcaagcgagtctcgccctgatctgatattaacaggacataaggaaaatgcggaatttgcgcttgccatgtgtccagcagaaccatatgtcctatcaggaggaaaggacaaatctgttgtcttgtggagcatccaagaccacatatctgcccttggggattcctcttcttctcctggagcatctggcagcaagcagtctgctaaaaccgcaaatgaaaaggagagccctaaagttgatcctagaggtatattccatggacatgacagcactgttgaagatgttcagttctgcccttccagtgcgcaggagttttgtagtgtgggtgatgatgcttgtcttattctgtgggatgctcgaactggcactggcccagctgttaaggttgagaaagctcacagtggagatgttcattgtgttgattggaatccccttgatgttaactatatcttaactgggtctgccgataactctgtccgaatgtgggatcgtcgcaatctggcttcaggaggagctggttctccagttcacaaatttgagggccataaagctgctgttctttgtgttcagtggtcacctgatagagcatctgtttttggaagttctgcggaagatggtttcttaaacgtgtgggaccatgagaaggttgggaagaagagaaattctaatgtcccatctgggcttttctttcagcatgctggtcatagggataagattgtagacttccactggaattcgtcagatccttggacaattgtcagtgtctctgatgacggtgagagcactggtggaggtggaacactgcagatttggcgcatgagtgatttgatctaccgcccagaggacgaagttcttacagagctggagaatttcaaggctcacttggccagctgcgctccaaggaattgagtcatgtggttacctgcggaattcaatcctgtgatatctgagtaggtgatgtagtttcctggccataagtatggccccagttgacattggatgtctgatgctgctagagctgtacccttgaggggcttgtgcttttctgagcttgtgttaaacctgttgtatgactaaatctgtatgtctgcagacgcgtcagagccggatttctagtctctaggccaactattgggatattgccggatattgtcaacaattgttccagattggtgtattggatctaatgagattgtccgc

SEQ ID NO: 3139 - DNA, 2243 bp, Sorghum bicolor
aaaaagaaaaaaaacaaggaagatttctttctttctttttatttttttatttaaaaaggaatcacaggctattagaaggtccacggtccagcccaacttacagcagcccacaaaatactctcttagcctctgtgactgccggcccaacagtactcggcccagcccagacagcccccgctccgctccgctcgtccgaacattggatctctgctcctctctctgctcgctacgcaaggactccccacaagcgcccagcacgctctcgcagtagcagcgagcgagcgtgccgagggagtgagaggtgcggagcagtcgccggcgtcgaccttcgttgtcggagatgaaggagagaagcggctccagggcggcggtggacgagcgctacgcgcagtggaagtcgctcatccccgtcctctacgactggtttgctaaccacaacctcgtctggccatccctctcctgccggtgggggccacagtttgagaaagctacctacaagaatcgtcaacgcctttacctatctgagcagacggatgggagtgtgcctaatactctagttatcgcaaactgtgaagttgtgaagccacgggttgcagctgctgaacatatctcgcagtttaacgaggaagcacgatcaccttttgttaagaagtacaagaccatagttcatcctggtgaagttaacagaatcagggagcttccacagaacagtaagatcatagccactcacactgacagtccagatgtacttatttgggatgttgaagcacagccaaatagacatgccgtcctaggagcttctgaatctcgccctgatctgatattaacgggacataaggaaaatgcggaatttgcgcttgctatgtgcccagcagaaccatatgtcctatcaggaggaaaggacaaatctgttgtcttgtggagcatccaagaccacatatctgcccttggggattcctcgtcttctcctggagcatctggcagcaagcagtctggtaaatctgcaactgaaaaggagagccctaaagttgatcctagaggtatattccacggacatgacagcactgttgaagatgttcagttctgcccttccagtgcgcaggagttttgtagtgtgggtgatgatgcttgtcttattctgtgggatgctcgaactggcactggcccagctgttaaggttgagaaagctcacagtggagatgttcattgtgttgattggaatccccttgacgttaactatatcttaactggttctgccgataactctgtccgaatgtgggatcgtcgtaagctgggttcgggaggagctagttctccaattcataaatttgagggccataaagctgctgttctttgtgttcagtggtcacctgacagagcatctgtttttggaagttctgcggaagatggtttcttaaacgtgtgggatcatgagaaggttgggactaagaaaaatactaatgtcccagctgggcttttcttccagcatgctggtcatagggataagattgtagacttccactggaattcgtcagatccttggacaattgtcagtgtatctgatgatggtgagagcactggtggaggcggaacactgcagatatggcgcatgagtgatttgatctaccgccctgaggatgaagttcttacagaactggagaatttcaaggctcacttggccagctgtgctccaaggacttgagtcatgtggttatctgcggaattcaatcctgtgaaaactctgagtaggtgatttagtttcgtggccataagtatggccccaattgacattggatatgtcctctgatgctcctagagctgtacccttgaggggctcgtgcctttgtgagcttgtgttaaacctgttgtatgactaaattagtatgtccgcaaacacatcacagctggatgtctagtctgtaggccaactattgggatatttgccggatattgtcaacaattgttccagatttgtgtattggatctgatgagtgttttgctggcttcttgtgagtgtgggtttatggtcttaggcatatcgttcggtcgaaggccgattgtctgcgtgcatttcagctttgttctccatggtgtttgctctggctgtataggttcgatgcgcctaggcagctcacctgtgctccctaaacaccgtagagttgtagcgtagtggtagttttacctatcattggctttgcatttgtattagctgtgccccagaaagaacaaagggcctggtccgc

SEQ ID NO: 3140 - DNA, 1817 bp, Cenchrus ciliaris
ctgctcgaggcgccagcacgctccctcagtagccgagagcgtgggagtgggaggcgcggagcagtcgccgccggcggagaccaccggcgtcggagatgaaggagagaagcggctcgagggcggcggtggatgagcgctacgcgcagtggaagtcactcatcccggtgctctacgactggttcgccaaccacaacctcgtctggccatccctctcctgccggtggggcccgcaatttgagaaagctacctacaagaatcgtcagcgcctttacctatctgagcagacggatgggagtgtgcctaatactctggttatcgcgaactgtgaagttgtcaaaccaagggttgcagctgctgaacatatctcacagttcaacgaggaagcgcgatcaccttttgtgaagaagtataagactatagttcatcctggtgaggttaacagaatccgagagcttccacagaacagtaagattatagcaactcacaccgacagtcccgatgtacttatttgggatgttgaagcccaaccaaatagacatgctgtcctaggagcaactgaatctcgccctgatctgatattaacaggacatcaggaaaatgctgaatttgcgcttgccatgtgtccagcggaaccctatgtactgtcaggaggaaaggacaaatctgttgtcttgtggagcatccaagatcacatatctgcacttggggattcctcatcttctcctggagcatctggcagcaagcaacctggcaaaagtgcgaatgaaaagcctcctctgagaggggatcctcggggtatattccatggacatgacagcactgttgaagatgttcagttctgcccttccagtgcgcaggaattctgtagtgtgggtgatgatgcttgtcttattctctgggatgcccggactggtactagcccggctgttaaggttgagaaagctcacagtggggatgttcattgtgttgattggaatccgcttgatgttaactatatcttaaccggttctgctgataactctgtccgtatgtgggatcgtcgcaatctgggttctggaggagctggttctccgattcacaaatttgagggccataaagctgctgttctttgtgtccagtggtcacctgacagggcatctgttttcggaagttctgctgaagatggtttcttaaatgtgtgggatcatgagaaggttgggaagaagaaaaattccaacgtgccagctgggcttttctttcaacatgctggtcacagggataagattgtagacttccactggaattcatcggatccttggacgatcgtgagtgtgtcagatgatggtgagagcactggtggaggtggaacattgcagatatggcgcatgagtgatttgatctaccgcccagaggaggaagttctcacagagttggagaatttcaagtctcacttggccagctgcactccgaggaactgaatcatattctctgtggagtcctccaatccgttgaaagctccgcgtaggtgttctagtttcctagccagcaactgtggctccagtcgacattggtattgtactgtgatgctcctagcactgtgacttgtgagcttgtgttaaagcttgttgtgtgactaaactgagtatgtccgcgaacgaagccgagctggatatctccgtagtctgtaggccgactattcggatattgctgaatattgttgacaattattctggattgtgctatttgaacctagtgagattgtggagtactggagtgtgtaacgattcatgtctaaaatatgtttacagccttaactcccacgtggttcgagcgctgta

SEQ ID NO: 3141 - DNA, 1638 bp, Pennisetum glaucum
gggcggcggtggatgagcgctacgcgcagtggaagtcactcatcccggtgctctacgactggttcgccaaccacaacctcgtctggccatccctctcctgccggtggggcccgcaattcgagaaagctacctacaagaatcgccagcgcctttacctatctgagcagaccgatgggagtgtgcctaatactcttgttatcgcgaactgtgaagttgtcaaaccaagggttgcggctgctgaacatatctcacagttcaatgaggaagcacgatcaccttttgtgaagaagtataagactatagttcatcctggtgaggttaacagaatccgggagcttccacagaacagtaaaattattgcaactcacaccgacagtccggatgtacttatttgggatgttgaagcccaaccaaatagacatgccgtcctaggagcaactgaatctcgacctgatctgatattaacaggacatcaggaaaatgctgaatttgcgcttgccatgtgtccagcggaaccatatgtactgtcaggaggaaaggacaaatctgttgtcttgtggagcatccaagatcacatatctgcacttggggattcctcatcttctcctggagcatctggcagcaagcaatctggcaaaagtgcaaatgaaaaggagagtcctaaagttgatcctcggggtatattccatggacatgacagtactgttgaagatgttcagttctgcccttccagtgcacaggaattctgtagtgtgggtgatgatgcttgtcttattctctgggatgcccggactggtactagcccggctgttaaggttgagaaagctcacagtggggatgttcattgtgttgattggaatccgcttgatgttaactatatcttaacaggttctgctgataactctgtccgtatgtgggatcgtcgcaatctgggttctggaggagctggttctcctattcacaaatttgagggccataaagctgctgttctttgtgtccagtggtcacctgacagggcatctgttttcggaagttctgctgaagatggtttcttaaatgtgtgggatcatgagaaggttgggaagaagaaaaattccaacgtgccagctgggcttttctttcaacatgctggtcacagggataagattgtagacttccactggaattcatcggatccttggacgatcgtgagtgtgtcagatgatggtgagagcactggtggaggtggaacattgcagatatggcgcatgagtgatttgatctaccgcccagaggaggaagttctcacagagttggagaatttcaagtctcacttggccagctgcactccgaggaactgaatcatattattatctgtggaatcctccaatccgttgaaagctcgctataggtgttctagtttcctagccattaactgtggctccgttggcattggtattgtaccgtgatgctcctagaccggtgacttgtgagcttgtgttaagcttcttgtgtgactgaactgagtatgtccgtgaacgaagcagagctggatatctccatagtctgtaggccgactattcggatattgctggatattgttgacaattattctggattgtgctattgaacctagtgagattgttagagtactggagt

SEQ ID NO: 3142 - DNA, 1926 bp, Triticum aestivum
cgcatctgttaccgttttcaccccagccgcagcctagatactcctctgcgcctgggcagttcgcaccgagcgggaggcagacaggaacagtccagactccagagagcgccccccctgcacagagagggagagggagagagagagagagggcggagcagtcgccggcggcggccagcagcggagcggagatgaaggagagaggcgggtcgagggcggcggtggacgagcggtacgcgcaatggaagtcgctcatccccgtcctctacgactggttcgcgaaccacaacctcgtctggccatccctctcctgccggtggggtcctcagtttgagcaggctacctataagaatcgtcagcgcctttacctatcagagcagacagatggaagtgtcccaaataccctggtcattgcaaactgtgaagttgtgaagccacgggttgcagctgcagaacacatatcacagttcaatgaggaagcacgatcaccttttgtaaagaagtacaagactatcattcaccctggagaggttaaccgaatcagggagcttccacagaacagtaggatcattgcaactcatacggacagtccagatgtgcttatttgggatgttgaggcccagccaaatagacatgctgtcctaggagctactgattctcgccctgatttgattttaagaggacatcaggaaaatgctgagtttgctcttgccatgtgtccagcagaaccatatgtgctctcaggaggaaaggacaagtctgtggtttggtggagcatccaagatcacatatctggacttggagactcctcaaaaagtgagacttccccaggggcatcaggcagcaagcatagcaaaactgcaaatgaaaaggatagtcctaaagttgatcctcgaggtgtattccacgggcatgatagcactgttgaagatgtccagttctgcccttcgagtgcacaggagttctgcagcgtcggtgatgatgcttgtcttattctctgggatgcccggactggtactagcccagctgttaaggttgagaaagctcatggtggagatgttcattgtgtcgattggaatcttcatgatgttaactacatcttaactggctccgctgataactctgtccgtatgtgggatcggcgaaatctgggtcctggaggtgctggttctccaattcacaaattcgagggccataaagctgccgtcctttgtgttcagtggtctcctgacaaagcatctgttttcggaagctctgcggaagatggtttcttaaatgtgtgggaccatgagaaggtgggaaagaagaaaaatcccaattcacctggcgggcttttctttcaacacgcaggtcatagggacaagatcgtagatttccactggaactcttcagatccttggaccattgtgagtgtatctgatgatggtgagagcactggtggaggtggaactttgcagatatggcgtatgagtgatttgatctaccgcccagaggacgaggttgtttcagagctggagaccttcaagtctcacttggccagctgcactccgagggcttgaatcatgagatagtagttatctgtccatttgaaacattggtcatgtcctctgatgctagaacaacctagacttgtacccttaaggtgcttgtgagcttatttaacttgttgtatgattcgaatctgtatgctctgcgaacacagcggagctttatttctgtagccagactattggggtattggcctattgggaacattgtaccggtagcttctagtggaccttatgagattgcttgtaatgagtttgtgtttatgacttggtcagtttgttctcaattgtgtagttgcttcttcccccctctttttgagcctgtctagttgcttcttacttaacaatttttattgatcatgttgttgcctttttccttgac

SEQ ID NO: 3143 - DNA, 1744 bp, Secale cereale
gcagacaggaacagtccagactccagagagcgccccctctgcccagagagcgagagagagagagagaggagggcagagcagtcgccagcggcggccaccagcggagcggagatgaaggagagaggcgggtcgagggcggcggtggacgagcggtacgcgcaatggaagtcgctcactccccgtcctctacgactggttcgcgaaccacaacctcgtctggccatccctctcctgccggtggggtcctcagtttgagcaggctacctataagaatcgtcagcgcctttacctatcagagcagacagacggaagtgtcccgaataccctggtcattgcaaactgtgaagttgtgaagccacgggttgcagctgcagaacacatatcacagttcaatgaggaagcacgatcaccttttgtaaagaagtacaagactatcattcaccctggagaggttaaccgaatcagggagcttcctcagaacagtaggatcatcgcaactcatacggacagtccagatgtgcttatttgggatgttgaggcccagccaaatagacatgctgtcctaggagctactgattctcgccctgatttgattttaagaggacatcaggaaaatgctgagtttgctcttgccatgtgtccagcagaaccatatgtgctctcaggaggaaaggacaagtctgtggtttggtggagcatccaggatcacatatctggacttggagactcctcaaaaagtgagacttccccaggggcatcaggcagcaagcatagcaaaactgcaaatgaaaaggatagtcctaaagttgatcctcgaggtgtattccacgggcatgatagcactgttgaagatgtccagttctgcccttcgagtgcacaggagttctgcagcgtcggtgatgatgcttgtcttattctctgggatgcccggactggtactagcccagctgttaaggttgagaaagctcatggtggagatgttcattgtgtcgattggaatcttcatgatgttaactacatcttaactggctccgctgataactctgtccgtatgtgggatcggcgaaatctgggtcctggaggtgctggttctccaattaacaaattcgagggccataaagctgctgtcctttgtgttcagtggtctcctgacaaagcatctgttttcggaagctctgcggaagatggtttcttaaatgtgtgggaccatgagaaggtgggaaagaagaaaaatcccaattcacctgctgggcttttctttcaacacgcaggtcatagggacaagatcgtagatttccactggaactcttcagatccttggaccattgtgagtgtatctgatgatggtgagagcactggtggaggtggaactttgcagatatggcgtatgagtgatttgatctaccgcccagaggacgaggttgtttcagagctggagaccttcaagtctcacttggccagctgcactccgagggcttgaatcatgagatagtagttatctgtccatttgaaacattggtcatgtcctctgatgctagaacaactagacttgtacccttaaggtgcttgtgagcttatttaacttgttgtatgattcgaatctgtatgctctgcgaacacagcaggagctttatttctgtagccagactattggggtattggcctattgggaacattgtaccggtagcttctagtggaccgtatgagattgcttgtaatgagtttgtgtttatgacttggtcaa

SEQ ID NO: 3144 - DNA, 1804 bp, Avena sativa
actctacttgcacacccgggggcactgcgcaccgagcgggaggcagacgggaacagtccagagacacgctcctcccacgcagagcgtgagagaggcccggagcagtcggcggcggcggccacctgcggcgcggagatgaaggagagaggcgggtcgagggcggcggtggacgagcggtacgcgcagtggaagtcgctcatccccgtcctctacgactggttcgcgaaccacaacctcgtctggccgtccctgtcctgccggtggggtcctcagttcgagcaggctacctataagaatcgtcagcgcctttacctatcagagcagacagacgggagtgttcctaataccctggttattgcaaactgtgaagttgtcaagccacgggttgcagctgcagaacacatatcacagttcaatgaggaagcacgatcgccctttgtaaagaagtacaagactatcattcatcctggagaggttaaccgaatcagggagcttccacagaacagtaggatcatcgccactcatacggacagtccagatgtgcttatttgggatgttgagtcccagccaaatagacatgctgtcctaggagcaactgattctcgccctgatttgatattaagaggacatgaggaaaatgctgagtttgctcttgccatgtgtccagcagaaccatatgtgctctcaggaggaaaggacaagtctgtggtctggtggagcatccaagatcacatatctggacttggagattcctcaaaaagtgagacttcgccaggggcatcaggcagcaagcatagcaaaacagcaaacgaaaaggatagtcctaaagttgatcctcgaggtgtattccacgggcatgatagcactgttgaagatgtccagttctgcccttcaagtgcacaggagttctgtagtgtgggtgatgatgcttgtcttattctttgggatgctcggactggtaccagcccagctgttaaggttgagaaagctcatggtggagatgttcattgtgtcgattggaatctgcacgatgttaactatatcttaactggctctgctgataactcagtccgtatgtgggaccggagaaatctgggttctggaggagctggttctccaattcacaaatttgagggccataaagctgctgtgctttgtgttcagtggtctcctgacaaatcatctgtgtttggaagctctgcggaagatggtttcttaaacgtgtgggatcacgagaaggttgggaagaagaaaaatcccaattcacctggcggacttttcttccaacatgcaggtcatagggacaagatcgtagacttccactggaactcgtcagatccttggaccattgtgagtgtttctgatgatggtgagagcactggtggaggtggaactttgcagatatggcggatgagcgatctgatctaccgcccggaggaggaggtgctctcagagctggagaacttcaagtctcacttggccagctgcactccaaggggttgaattatgtaatttgtgcaacccagtcatgtggttgctctaggtatcttagttatctgtccatttagaacattggttctgtcatctgatgttaaacctagacttgtacccttaaggtccttgtgagcttatttaactttctgtatgacttaaatctgtatgctctgcaaacacacagtagagctgcatttctctgtagccagactattggtgtatcgggaaacattctactggtagcttctagtttggacctattgagattgcttgtaatgagtttgcattgatgaattggtcagtttgttct

SEQ ID NO: 3145 - DNA, 1444 bp, Avena sativa
gcggagatgaaggagagaggcgggtcgagggcggcggtggacgagcggtacgcgcagtggaagtcgctcatccccgtcctctacgactggttcgcgaaccacaacctcgtctggccgtccctgtcctgccggtggggtcctcagttcgagcaggctacctataagaatcgtcagcgcctttacctatcagagcagacagatggaagtgttccaaataccctggtcattgcaaactgtgaagttgtgaagccacgggttgcagctgcagaacacatatcacagttcaatgaggaagcacgatcgccctttgtaaagaagtacaagactatcattcaccctggagaggttaaccgaatcagggagcttccacagaacagtaggatcatcgccactcatacggacagtccagatgtgcttatttgggatgttgagtcccagccaaatagacatgctgtcctaggagcaactgattctcgccctgatttgatattaagaggacatgaggaaaatgctgagtttgctcttgccatgtgtccagcagaaccatatgtgctctcaggaggaaaggacaagtctgtggtctggtggagcatccaagatcacatatctggacttggagattcctcaaaaagtgagacttcgccaggggcatcaggcagcaagcatagcaaaacagctaacgaaaaggatagtcctaaagttgatcctcgaggtgtattccacgggcatgatagcactgttgaagatgtccagttctgcccttcaagtgcacaggagttctgtagtgtgggtgatgatgcttgtcttattctttgggatgctcgtactggtaccagcccagctgttaaggttgagaaagctcatggtggagatgttcattgtgtcgattggaatctgcacgatgttaactatatcttaactggctctgctgataactcagtccgtatgtgggaccggagaaatctgggttctggaggagctggttctccaattcacaaatttgagggccataaagctgctgtgctttgtgttcagtggtctcctgacaaatcatctgtgtttggaagctctgcggaagatggtttcttaaacgtgtgggatcacgagaaggttgggaagaagaaaaatcccaattcacctggcggacttttcttccaacacgcaggtcatagggacaagatcgtagacttccactggaactcgtcagatccttggaccattgtgagtgtttctgatgatggtgagagcactggtggaggtggaactttgcagatatggcggatgagcgatctgatctaccgcccggaggaggaggttctctcagagctggagaacttcaagtctcacttggccagctgcactccaaggggctgaattatgtaatttgtgcaacccaatcatgtggttgctgtaggtatcttagttatctgtccatttagaacat

SEQ ID NO: 3146 - DNA, 1740 bp, Festuca arundinacea
ggcgcggagatgaaggagaaaggcgggtcaagggcggcggtggacgagcggtacgcgcagtggaagtcgctcatccccgtcctgtacgactggttcgcgaaccacaacctcgtctggccgtccctctcctgccggtggggtcctcagttcgagcaggctacctataagaaccgtcagcgcctttacctatcagagcagaccgacggaagtgttcctaataccctggttattgcaaactgtgaagttgtcaagccacgggttgcagctgcagaacacatatcacagttcaatgaggaagcacggtcaccttttgtaaagaagtacaagactatcattcatcctggagaggttaaccgaatcagggagcttccacaggacagtaggatcatcgccactcatacggacagtccagatgtgcttatttgggatgttgaggcccagccaaatagacatgctgtcttaggagcaactgattctcgccctgatttgatattaagaggacatcaggaaaatgctgagtttgcccttgccatgtgtccagcggaaccatatgtgctctcaggaggaaaggacaagtctgtggtctggtggagcatccaagatcacatatctggacttggagattcctcaaaaagtgagacttccccaggggcatcaggcagcaagcatagtaaaactgcaaacgaaaaggatagtcctaaagttgatcctcgaggtgtattccacgggcatgatagcactgttgaagatgtccagttctgcccttcaagtgcacaggagttctgtagtgtgggtgatgatgcttgtcttattctttgggatgctcggactggtaccagcccagctgttaaggttgagaaagctcatggtggagatgttcattgtgtcgattggaatctccatgatgttaattatatcttaactggctctgctgataactcagtccgtatgtgggaccgccgaaatttgggtcctggaggaggagctggttctccaattcacaaattcgagggccataaagctgctgtgctttgtgttcagtggtctcctgacaaagcatctgtgtttggaagctctgcagaagatggtttcttaaacgtgtgggatcatgacaaggttgggaagaagaaaaatcccaattcacctggcggacttttctttcaacatgcaggtcacagggacaagattgtagacttccactggaactcatcagatccttggaccattgtgagtgtttctgatgatggcgagagcactggtggaggtggaactttgcagatatggcgtatgagtgatctgatctaccgcccggaggatgaggttctttcagagctggagaacttcaagtctcacttggccagctgcactccaagggcttgaattatgtaatttgtgcaacccaatgctgtgctagctctaggtatcttagttacctatccatttagaacattggttctgtcatctgatgttaaacctagacttgtacccttaaggtgcttgtgagcttatttaactttctgtgtgactcgaatctctatgctctgcaaacacagtagagctgtatttctctgtagccagactattggtgtatcgggaaacattgtactggtagcttctagttggacctattgagtttgcttgtgatgaatttgcgttgatgaatttgggcaaaaatattttaaaaaaaacccccccccccccccccccccccccccccccccccccccccccccccccctg

SEQ ID NO: 3147 - DNA, 1777 bp, Festuca arundinacea
caggaacagcccagagacgagctcctcccctcccacacagagcgtgagagaggcccggagcagtcgccggcggcggccaccagcggcgcggagatgaaggagaagggcgggtcgagggcggcggtggacgagcggtacgcgcagtggaagtcgctcatccccgtcctctacgactggttcgcgaaccacaacctcgtctggccgtccctctcctgccggtggggtcctcagttcgagcaggctacctataagaaccgtcagcgcctttacctgtcagagcagaccgatggaagtgtccctaataccctggtcattgcaaactgtgaagttgtcaagccacgggttgcagctgcagaacacatatcacagttcaatgaggaagcacgatcaccttttgtaaagaagtacaagactatcattcatcctggagaggttaaccgaatcagggagcttccacaggacagcaggatcattgccactcatacggacagtccagatgtgcttatttgggatgttgaggctcagccaaatagacatgccgtcttaggagcaactgattctcgccctgatttgatattaagaggacatgaggaaaatgctgagtttgcccttgccatgtgtccagctgaaccatatgtgctctcaggaggaaaggacaagtctgtggtctggtggagcatccaagatcacatatctggacttggagattcttcaaaaagtgagacttccccaggggcatcaggcagcaagcatagtaaaactgcaaacgaaaaggatagtcctaaagttgatcctcgaggtgtattccacgggcatgatagcactgttgaagatgtccagttctgcccttcaagtgcacaggagttctgtagtgtgggtgatgatgcttgtcttattctttgggatgctcggactggtaccagcccagctgttaaggttgagaaagctcatggtggagatgttcattgtgtcgattggaatctccatgatgttaattatatcttaactggttctgctgataactcagtccgtatgtgggaccgccgaaatttgggtcctggaggaggagctggttctccaattcacaaattcgagggccataaagctgctgtgctttgtgttcagtggtctcctgacaaagcatctgtgtttggaagctctgcagaagatggtttcttaaacgtgtgggatcacgacaaggttgggaagaagaaaaatcccaattcacctggcggacttttctttcaacatgcaggtcatagggacaagattgtagacttccactggaactcatcagatccttggaccattgtgagtgtttctgatgatggcgagagcactggtggaggtggaactttgcagatatggcgtatgagtgatctgatctaccgcccggaggaggaggttctttcagagctggagaacttcaagtctcacttggccagctgcactccaagggcttgaattatgtaatttgtgcaacccaatcctgtggtagctctaggtatcttagttatctgtccatttagaacattggttctgtcgtctgatgttaaacctagacttgtacccttaaggtgcttgtgagcttatttaactttctgtgtgactcaaatctctatgctctgcaaacacagtagagctgtatttctcggtagccagactattggtgtatcgggaaacattgtactggtcgcttctagttggacctattgagattgcttgtgatgaatttgcgttgatgaatttggccagtttgttctcgactggtgtggct

SEQ ID NO: 3148 - DNA, 1833 bp, Lolium multiflorum
tgaccattttccagttcaccccaacctaggatactctactttactcacacccgggggacactgcgagcagagcgggaggcagacaggaacagcccagagacgagctcctcccctcccacacagagcgagcgagagagagagaggcccggagcagtcgccggcggcggccaccagcggcgcggagatgaaggagaagggcgggtcgagggcggcggtggacgagcggtacgcgcagtggaagtcgctcatccccgtcctctacgactggttcgccaaccacaacctcgtctggccctccctctcctgccggtggggtcctcagttcgagcaggctacctacaagaaccgtcagcgcctttacctgtcagagcagaccgatggaagtgtccctaacaccctggtcattgcaaactgtgaagttgtcaagccacgggttgcagctgcagaacacatctcacagttcaatgaggaagcacgatcaccttttgtaaagaagtacaagactatcattcatcctggagaggttaaccgcatcagggagcttccacaggacagcaggatcatcgccactcatacggacagtccagatgtgcttatttgggatgttgaggctcagccaaatagacatgccgtcttaggagcaactgattctcgccctgatttgatattaagaggacacgaggaaaatgctgagtttgcccttgccatgtgtccagcggaaccatatgtgctctcaggaggaaaggacaagtcagtggtctggtggagcatccaagatcacatatctggacttggagattcttcaaaaagtgagacttccccaggggcatcaggcagcaagcatagtaaaactgcaaacgaaaaggatagtcctaaagttgatcctcgaggtgtattccacgggcatgatagcactgttgaagatgttcagttctgcccttcaagtgcacaggagttctgtagtgtgggtgatgatgcttgtcttattctttgggatgctcggactggtaccagcccagctgttaaggttgagaaagctcatggtggagatgttcattgtgtcgattggaatctccatgatgttaattatatcttaactggttctgctgataactcagtccgtatgtgggaccgccgaaatttgggtcctggaggaggagctggttctccaattcacaaattcgagggccataaagctgctgtgctttgtgttcagtggtctcctgacaaagcatctgtgtttggaagctctgcagaagatggtttcttaaatgtgtgggatcacgacaaggttgggaagaagaaaaatcccaattcacctggcggacttttcttccaacatgcaggtcatagggacaagattgtagacttccactggaactcatcagatccttggaccattgtgagtgtttctgatgatggcgagagcactggtggaggtggaactttgcagatatggcgtatgagtgatctgatctaccgcccggaagaagaggttctttcagagctggagaacttcaagtctcacttggccagctgcactccaagggcttgaattatgtaatttgtgcaacccaatcctgtggtagctctaggtatcttagttatctgtccatttagaacattggttctgtcgtctgatgttaaacctagacttgtacccttaaggtgcttgtgagcttatttaactttctgtgtgactcaaatctctatgctctgcaaacacagtagagctgtatttctcggtagccagactattggtgtatcgggaaacattgtactgttagcttctagttggacctattgagattgcttgtgatgaatttgcgttga

SEQ ID NO: 3149 - DNA, 2224 bp, Brachypodium distachyon
agcccaaagacgaaatggctcggcccacgcgcaccgcagctgttaaccccacagcctaggatgctctaatcaatcgcaccgggacactgcgggaggagcgggaggcagacagaaacagttcagagccgctctccacccacagagagcgtgagagaggcgcggagcagtcgccggcagcggccagtagcgggtccggagatgaaggagagaggcgggtcgagggcggcggtggacgagcgctacgcgcagtggaagtcgctcatccccgtcctctatgactggtttgcgaaccacaacctcgtctggccgtccctgtcctgccgatggggccctcagtttgaacaggctacctataaaaatcgtcagcgcctttacttatcagagcagacagatggcagtgtccctaatactctggttattgcaaattgtgaagttgtgaaaccaagggttgctgcagcagaacatatatcacagttcaatgaggaagcacgatcaccttttgtaaagaagttcaagactatcattcatcccggcgaggtcaaccgaatcagggagcttccgcaggacagcaggatcatcgctactcatactgacagtccagatgtacttatttgggatgttgactcccagccaaatagacatgctgtcctaggagcaagtgattctcgccctgatttgatattgagaggacaccaggaaaatgctgagtttgcccttgccatgtgtccagcagaaccatttgtactctcgggaggaaaggacaagtctgttgtctggtggagcatccaagaccacatatctggacttggagattcctcaaaaaacgaatcttccccaggggcatcaggcagcaagcagtctggcaaaactgcaaacgataaggatagtcctaaagttgatcctcgaggtgtattccacgggcatgatagcactgttgaagatgtccagttctgcccttctagtgcacaggagttctgcagcgtaggtgatgatgcttgtcttattctttgggatgctcggactggtaccagcccagctattaaggttgagaaagctcatggtggagacgttcattgtgttgattggaatctccatgatgttaactatatcttaactggttctgctgataactctgtccgtatgtgggaccgacgaaatctggggcctggaggagctggctctccagttcacaaatttgatggccacaaagctgctgtcctatgtgttcagtggtcacctgacaaagcatctgttttcggaagctctgcggaagatggtttcttaaatgtgtgggatcacgagaaggctgggaagaagaaaaatcccaattcacctgctgggcttttctttcaacatgcaggtcatagggataagattgtagacttccagtggaactcctcagatccttggaccattgtgagtgtttctgatgatggtgagaccactggtggaggtggcactttgcagatatggcgtatgagtgatttgatctaccgcccagaggaggaggttctttcagagctggagaactttaagactcacttggcaagctgcactccgaggacttgaatgatgaagaagaccaatcctgtgataactgtaataggtatcgtagttacccatcgattcgaaacattgattctatcctctgatgttaaacctagacttgtacccttaaggtgcttgtgagcttaagttaacttgttgtatgactcagattggtatgctcgtgcaaacacagcggagctgaatttctctgtaggcagactattggggtatcaggaaacattgtaccggtagcttctagtggacctaatgagattggttgtaatgagtttgcgttggtcagtttgtttgttgcaaatcgtcgcagtcttgcgttacctgtttctacacttcagctttggtaatgccgcggtgctcgtttagggattgttgttgtagcgtaccgtggaattaaagcacctgcatatcataattttagtgagggcaaatgtgaggagtaaacgcataaacgttaataatggatggggcagaagcaacggctgggatgcatccgaacataacagctttcgacgatcctggcctctcggtgctgctgctgtctgtcattaagacttctttctttcgcatctgatgaatataaattgattggcatcctaagatggacatgtgctgatgggttgcctggacttctcatcagcgcacttgacgttaagtcgcg

SEQ ID NO: 3150 - DNA, 1840 bp, Oryza sativa
gggcacaagaggggtggcatctctgagcgggagccacgcgcaagggtccagagcaaacgctcctcatacgacagagagagcgtgacagcgcgaaggggttcggaggcgggagcgggcgacggcggcggcggcgggcgccagcgagcggcgaagggcgcgctggagatgaaggagaaggggtcgagggcggcggtggacgagcgctacgcgcagtggaagtcgctcatcccggtgctctacgactggttcgccaaccacaacctcgtctggccgtccctctcctgccggtggggaccccagtttgagaaggctacctacaagaatcgtcagcgtctttacctttcagagcagacggatgggactgtccctaatactctggttattgcaaattgtgaagttgtcaaaccaagggttgcagctgctgaacatatatctcagttcaatgaggaagcacgatcaccttttgtaaagaagtacaagactataattcatccaggcgaggtgaacaggattagggagcttccgcagaacagtaagatcattgccactcataccgacagcccagatgttctcatttgggatgtcgaggcccagccaaatagacaagctcaactggcacagatggagtctcgtcctgatttgatattaagaggacataaggatattgctgagtttgcgcttgctatgtgcccagctgagccatatgtgttatctggaggaaaagacaaatctgttgtatggtggagcatccaagaccacatatctgcactgggagattcctcgaaaactgaatcttctccaggggcatcaggaagcaagggaaaaactgcaaatgataaggatagtcctaaagttgatcctcgtggtatctttcttggccacgacagtactgttgaagatgtccagttctgcccttctagtgcacaggagttttgtagtgtgggcgatgattcttgtcttattctttgggatgcccggagtggtacaggcccagctgttaaggttgagaaagctcatggtggtgatgttcattgtgttgactggaacctccatgatgttaactatatcttaactggttctgcggataattctgtccgtatgtgggaccggagaaatctgggttctggaggagctggcattccagttcacaaatttgagggtcataaagctgctgttctttgtgttcagtggtcacctgacaaggcatctgtatttggaagctctgcggaagacggtttcttaaatgtgtgggatcatgagaaggttggaaataagaaaaatcccaacgcacctgctgggcttttctttcaacatgctggtcatagggataagattgtagacttccactggaattcttcggatccttggactattgtgagtgtgtctgatgatggtgagagtactggtggaggtggaacattgcagatatggcgcatgagtgacctgatataccgtccagaagatgaagttcttgcagagctggagaacttcaagactcacttggccagctgtgctccaaggagctgaatcgtgtgactatctgtgtaacccagtcctgtaataactctagtaggtttctaatttcttgtccatttagaatgttcctttcaaatattggttatatcctctggtgcggaacccaggcttgtacccttcaagtgcttgtgcgactcttttaccttactgtatcgactcaaatcggtaagctagtgcaaacacagcagagcagaatctctgtgggcagattatttggatgctaaacattgttctggagtctcgtattggacctagttgtattgttagcctgacttggtgacttaatcagatggttcttcagata

SEQ ID NO: 3151 - DNA, 1786 bp, Musa acuminata
gttgcccagttaatagacgggtgataggactactctactgacaggttccagcgcaccgaggtttagtgagggttcgccgaaggattccaaagcggagttgccgaggaggagaaggcggaggtggaggaggatgagggagcgaggagggaaggcgacggtggacgagaggtacacgcagtggaagtcactcatccccgtcctatacgactggctcgccaaccacaatcttgtgtggccttccctctcctgccggtgggggccacaacttgagcaagcaacatacaaaaatcgccagcgtctgtacctctccgagcagactgatggctctgtaccaaatacccttgttatagcaaattgtgaagttgtcaagccaagagttgcggctgcggagcatatatcccagttcaatgaagaagctcgttctcctttcgttaagaagtataaaacaattatacatcctggggaggtcaacagaattagggagcttcctcagaacagcaaaatagtcgcaacacatactgatagtcctgatgttcttatttgggatgttgaggcacaaccaaatcgtcatcctatgttaggagctgctgaatcccgtccagatttgatattgacaggtcatcaacaaaatgcagaatttgctctggctatgtgtcctactgaaccttttgtgctttctggaggaaaggataagtcagttgtcttgtggagcatccatgatcatatctcttctgtagcagagtcaacttcgaaatctcctgcatcagcttcaaactcaagtggtaagcaatccattaaagctggtaatgagaaaagctcagacagcacaactgttggaccaagaggtgtgtaccaagggcatgaggatacagttgaagatgtgcagttctgtccatcaagtgcacaggaattttgtagcgtaggtgatgattcttgcctcattctctgggatgcccgagttggtactagtccagttgttaaggttgagaaagctcataatgctgaccttcattgtgtggattggaacccccatgatcagaatcttattttgactggatctgctgataattctgttcgtatgtttgaccgccgtaacttaacttctggaggtgttgggtcacccatatacaagttcgaaggtcacaaagctgctgttctttgtgtccagtggtctcctgacagagcatcagtttttggaagtgctgctgaggatggcttcctcaatatctgggatcatgagagggtgggaaagaagaaagaacgtgctggaacaaagacacctaattcacctcccggtctattctttcaacatgcagggcacagagataaagtcgtagattttcactggaatgcatctgatccgtggacaattgttagtgtttccgatgactgtggtagtactggtgggggtggtactttgcagatctggcgcatgagtgacttgatatacaggccagaagaagaggttctagctgagctggaaaagttcaaagcccacttattgtcatgctcacccaagtcctaaatcttcgattgttgctcacccaaatcagagtgcgtatggcctttaattagttctgacagtatatcgtagaaccctcatcagggatcaacggatgttaatttttatgctgtagtcgtacttgccgagtttgctggactggaatggtatctactgttgtatggcttgcctgcctgcgtattcccactttgtttggactttgaactttaagtgggtttgatttctactgtcttaattacatgtgatcaattgtctcctactcgc

SEQ ID NO: 3152 - DNA, 1681 bp, Ananas comosus
catgagagagaagagcggagagctccggagctcggtcgatcggacggtggagatgaaggagaggggcgggaaatcggggcatccgacggtggacgagaggtacacgcagtggaagtcgctcgtccccgtcctctacgactggctcgccaaccacaacctcgtttggccctccctctcatgccgatgggggccgcagcttgagcaggcgacgtacaagaatcgccagcgtttgtacctctcggagcagaccgatggcagtgttccgaatactcttgttatagcgaattgtgaagttgtgaagccaagggttgccgctgctgagcatatctcgcagttcaacgaagaagcacggtctccttttgtgaagaagttcaagactattatacatcctggggaggtcaacagaatcagggagcttcctcaaaatagcaagatagtggcgacgcatactgacagccccgatgtattaatttgggatgttgaggcccaacctaatcgtcatgctgtgctaggagctgctgaatctcgtccagatctgatattgacagggcacaaagaaaatgcagagtttgctctagctatgtgtccaacggaaccttttgtactctctggaggaaaggacaagtcggttgtcttgtggagcatacaagatcatatatccaccttggcggagtcagcttccaaatctcctgtgtcacctggtagctcaggcagtaagcaggttgttggaaaatctggtacagagaaaagctcagatactccaaccattgggcctcgaggtgtctatcaagggcatggagatactgttgaagatgtgcaattttgtccatctagtgcacaggagttctgtagtgttggtgatgattcttgcctcattttctgggatgcacgagttggtactagtccagttgttaaggttgagaaagctcataatgctgatcttcactgtgttgactggaacccccatgatatgaaccttattttgactggatctgctgatacttctgttcgaatgtttgaccgccggaatctaacttctggaggtgttggatcccccattcacaagttcgaaggccacaaagctgctgttctctgtgttcagtggtctcctgacaaagcgactatctttggaagtgctgcggaagatggtttcctgaatatttgggatcatgagaaggttgggaagaagaaagaacgcactggaacaagaacgtccaatacacccccaggtttattctttcagcatgcgggtcacagagataaagtcgttgatttccattggaatgcatacgatccatggacaattgttagtgtctctgatgatggggagagtactggcggcggtgggacattgcagatatggcgcatgagtgacttgatatataggccggaagaagaggtgcttgcggagctggagaagttcaaagctcacttggcttcatgcactcccaaagcctagatcttttgataaatatctagccttttaggaactcgccggaactgttaacatatgtttcgttatctgcttctgtttcttaggacctttctagacgctgttgctgtaaactttgttaggatcgaaggggtgctttgaatttctaatcgtggttttgctctggtctgattccaaggacgaaaactgatgtcagcttttcatgcttaggctcaccttcttctcttt

SEQ ID NO: 3153 - DNA, 1620 bp, Amorphophallus konjac
tgagggagcgggggaaggccccttcggtggacgagcggtacacacagtggaagtctctggtgccggtgctctacgactggttcgccaaccacaacctcgtgtggccgtccctctcttgcaggtgggggcctcagttggaacaagcaacatataagaatcgccaacgtctctacctatctgaacagactgatggcactgttcccaatacgcttgtcatagcaaattgtgaaatagtaaaaccaagggttgctgctgcagagcacatatcccagtttaatgaggaagctcgctctccttttgtgaagaagttcaaaactattatccatcctggagaggtcaacagaattagagaacttccccagaatagtaagatagtggcgactcacactgacagtcctgatgttctcatttgggatgttgagactcaacccaatcgtcatgctgttcttggagctggtgaatctcgtcctgatttgatattgacaggccatcaggataatgcagaattcgcccttgccatgtgtcccacagagccttatgtattatctggagggaaagacaaatcagttgttttgtggagcattcaagatcacatttctgcttcagctgaaccttctgcaaaatctcctggatcttccgggagctcagtcaccaaaccttcgaagtctggtggtgaaaaagcagtcctgtgattggaccacgtggtgtcttccaaggtcacgaggatacagttgaagatgttcaattctgcccctcaatgcacaagaattttgtagtgttggtgatgattcttgccttatactctgggatgctcgtgctggtagaagtccagccgttaaggttgagaaggctcataatgctgatcttcactgtgttgattggaatccacatgatcaaaatcttattcttacagggtcagcagatacttctgttagaatgtttgaccgccgtaacctcacgtctggaggggttggttcacccattcacaaatttgaaggtcacaaagcggctgtcctttgtgtacagtggtgtccagacaaagcatcggtctttggaagtgctgcagaggatggtttcttaaatgtttgggatcatgagaaggttggtaaaaaggatcatgccgggacaagggtgccaaatgcacccccgggtttattctttcagcatgctggacacagagacaaagtggttgattttcattggaacgcatctgatccttggacagttgtcagtgtctctgatgactgcgagagtactggtggaggtggaacactgcagatatggcggatgaatgacttgatttataggcccgaagaagaggttcttgcggaactggagaagttcaaacagcacatcctgacctgcacacctaggtcttaaatgtttctgcgagttctatcagtggtgactatcttctacaagatgtgcatgcaaggggtccacatgttggaatttctgtctctttgtaatctagagtaagctgcatgctcttgttaaaactaggtgagtgtagtttccatcacttttaactatggtcttaactagcggtgagtttccaaaaatcttaccatggtctaaacttgcgccttgtagcattcctcgtttaaaccgtggtcttca

SEQ ID NO: 3154 - DNA, 1977 bp, Aquilegia formosa
gcagagttaccaaaacagagagagagagagagagagagtgaagtgttgtagtagagagagagagagagagtgaagtgttgtagtagagagagagagagagaagaagaagaagaagaagatgaaagaaagagggaaatcaggaaaaccatctgtagacgaaagatacacacaatggaaatctcttgtacctgttctttacgactggctcgctaatcacaatctcgtctggccgtctctttcatgccggtggggtcctcagcaagaaacagctacttacaagaatcgccagcgtctctacctttctgaacagactgatggtagtgttccaaacactcttgtcatagccaactgtgaggttgtaaaacctagggttgcagctgctgaacacatatcacagttcaatgaagaagcacgttctccatttgttaagaaatacaaaactatcatacatcctggagaggttaatagaatccgggaactgccacagaacagtaaaatagttgccacacatactgacagccctgatgttctcatctgggatgttgaatctcaacctaatcgtcatgcagtccttggcgctgcggaatcccgtccagatctgatcttaactggacatcaagataatgcagaatttgctcttgcaatgtgcccaactgaaccttttgtgctctctggaggaaaggacaagtcggttgttttgtggagtatacatgatcatataactgcgtcagcaacagattcaggctctggaaaatctccagcttctgcttcaaagtctggtggagataaggctccagacagtcttgctgttggaccccgtggtgtttaccaagggcatgaggacactgttgaagatgtgcagttttgtccttcaagtgcccaggaattttgtagcgtaggtgatgattcctgccttattttatgggatgctcgagctgggactagtccagccaccaaggttgagaaggctcataatgcagatcttcattgtgttgattggaacccccatgatgaaaaccttattttgactgggtcagctgataattctgtacgcatgtatgaccgccgaaacctcgtttctaatggagttggttcgcctatttacaaatttgaaggtcacaaagctgctgttctttgtgtgcagtggtctccagacaaggcatcagtttttggtagtgctgcagaggatggtcttttaaatgtttgggatcatgagaagattggtaagaagaaagaacgtgtgggaactaggatgccaaattcgcctcctggcttatttttccagcatggcgggcacagggataaagtcgttgacttccattggaacacatctgatccatggactattgtaagtgtgtctgatgattgtgaaagtactggtggaggtggaacgctacagatatggcgcatgagtgatctaatttataggcccgaagaggaggttttggcagagctggagaagttcaaatctcatatattgacatgctcctcgaagtcataaactgtttcaaatggtactatacagtttgatgtggatagctgaaccatagtgttctcatgatctactttgttggtgtgggtcatgaaaagtatcatttatggtcatgatgatgatgatgtttgtgtgctctaattagtagtgtctggaaagatgcttatcaactgtgttctaacatgtagctatggtggatgttgaattaggagactcagttgagctaatcagttgcttggtctattaacagtgactatgtgggtgcatgtaggcggtttaatttttggtcattcacatcatatgtttgtgtactgtagcatgatgttaaagtggagtaatgacttgctttgtctattagcaatgactatttgggtgtatgtacttttggtattgcgtcattctcatcatgggtttgtgtactgaagtgtgattttcaactgttcaagtgaggaagttcactcccttttattgcaaatccttctggc

SEQ ID NO: 3155 - DNA, 1517 bp, Eschscholzia californica
atctgtagacgagagatacacacaatggaagtcgctggttccagtcctctacgactggctcgctaaccacaaccttgtttggccttcactctcttgccggtggggtcctcagctcgagcaagctacttacaagaaccgtcagcgtctttacctttctgaacagactgatggtagtgttccaaatactcttgtaattgcaaattgtgaagttgtaaaaccaagggtggcagctgctgaacacatatcacagttcaatgaggaagcacgttctccttttgtgaagaagttcaaaacaattattcatcctggagaggtcaacaggatcagggaactgcctcagaatagtaagattgttgctactcatactgacagtcccgatgtcctaatttgggatgttgatgcccaacctaatcgtcatgctgtcctgggagctgcagaatcacgacctgatctgatattaactggccatcaagacaatgcagaatttgcacttgctatgtgcccaactgaaccatttgtattatctggagggaaagacaagtcagttgttttgtggagtatacaagatcatatctctgccgcagcagttgatcaagaggctgctaaatctccagggtctaaacaaccttccaaggttggcggcgacaaatctgaaagcctttctgttggaccacgtggtatctaccaagggcatgatgatactgttgaagatgttcagttttgtccttcaagtgcacaagagttctgcagtgtaggtgacgattcatgccttattctatgggatgctcgtacaggcacaagtcctgctgtcaaggttgagaaggctcataatgctgacctgcactgtgttgattggaatccccttgatgaaaaccttattttaacagggtcggccgacaattctgttcgcatgtttgatcggcgaaatctcacttctggtggcgttggtgccccaatttataagtttgaaggacacaaagctgctgttctttgcgttcagtggtgtccagataaggcttctgtctttggcagtgctgctgaggatggctttttgaatgtgtgggatcacgagaaggttgggaaaaagaaggaacgtgttggaactaggatgccgaattctcctccaggcttattcttccaacatgccggccacagggataaagtagtcgacttccactggaacacatctgatccatggaccattgttagcgtctccgatgattgtgaaagtagcggtggtggtgggactctacagatttggcggatgagtgatctgatttacaggccggaagaggaggttctagctgagctggagaagttcaagtctcatatactggcttgttcttcaaaatcttaaaatgcccacttggaatcagctattagaggactgtaagaatcaaacttaagaactgttttactgtgggtttagagatgttttaatggattttcttgttggattaagtagttggacatattttgtttcctgcactaatgaatgctacggagtatgtataaac

SEQ ID NO: 3156 - DNA, 1720 bp, Chelidonium majus
aacaaggaagttttagtagagagagcgaaaatgagggagagcgggaaaagcaggacaaccttcggtggacgaaagatacacacaatggaagtcactggttccagtcctctacgactggctcgctaaccacaacctcgtctggccatctctttcttgccgtgggggccacaactagaacaagcaacttacaagaatcgtcagcgtctttacctttctgaacagactgatggtagtgttccaaacactctggttatagcaaattgtgaagttgtaaaaccaagggttgcagctgctgagcacatatcacagttcaatgaggaagcacgttctccctttgtgaagaagttcaaaaccattatacatcctggagaggtcaacagaatcagagaactcccgcagaacagcaagatagttgctacgcatactgacagtcccgatgttcttatctgggatgtcgatgctcaacctaatcgtcatgctgtccttggagctgcagaatcgcgcccagatttgatattaactgggcatcaggataatgccgaatttgcgcttgctatgtgccctactgaaccatttgtcttatctggagggaaagacaagtcagtgttttgtggagtattcaggatcatatctctgccgcagcagtagatcaagggtccacaaaatcacctgggtctaaaacaccctctaaggttggtgagaaatcttctgagagcccatctgttggaccacgtggtatctaccaagggcatgacgatactgtcgaggatgtgcagttttgtccttcaagcgcacaagagttctgcagcgtcggtgatgattcttgccttattctctgggatgctcgagctggtacaggtccagcagtcaaggttgagaaggctcataatgctgatctgcactgtgttgattggaaccgccatgacgaacaccttattttaactgggtcggctgataattctgttcgcatgtttgaccggcggaatctaacttctggtggcgtaggtgcccctatttataaatttgaaggacacaaagctgctgttctttgcgttcagtggtctccagacaaggcatctgtctttggcagtgctgcagaggatggctttttgaatgtttgggaccacgagaaggtgggtaaaaagaaagaacgtgttggaacgaggatgcctaattctcctccaggcttatttttccaacatgccggtcacagggataaagttgttgatttccactggaacgcatctgatccatggacaattgttagtgtctctgatgattgtgagagtagtggtggcggagggacattacagatatggcgtatgagcgatctgatttacaggcccgaggaggaggttctggaagagcttgagaagttcaagacacacatacttgcttgttcttcaaagtcttgaagtctattgtgtacgaaattgtgaagccatgagatgcactttatgatcttcaacgaggattgtgagatcaatcaggtcctagttactgttacgaatatgttgatcattcgtgtttctttcgacgcagtacttagaagagatgtttgaattgctttatagagttttgtttggtcaagtctgagtagttctcacatttagttaagcttctctgatgactgctgaactcagtagatagcaacggatcttctttgtgtattcaaaaggcagttgcagttgttgtgatctgttaatgaatttatggattt

SEQ ID NO: 3157 - DNA, 1986 bp, Aristolochia fimbriata
caaaattgaaaaatatgtaaaattatgaatgtaaattgcccgaaagtcgaaaccaccactttcccgccttcccgcgcttctggcatcacacgtgcctcgtcctctcgctgcctgtccacactctctgtccagctggccctggtaactagggctcacccgctctctccttcccatttctcatttccggttctgctctccgagacgaatttctctttcgattgggcgggaacagagatttcaaggaagccatgagggaccgtgggaaagccggacagcccagcgtcgacgaacgatacacgcagtggaagtctcttgttcctgttctatacgactggctcgctaaccacaacctcgtctggccgtctctctcttgccgatggggaccacaactagagcaagcaacttacaagaatcgtcaacggctctacctatctgaacagacggatgggagtgtgcctaatacactcgtcatcgcaaactgtgaagttgttaaacctagggtggctgctgcagagcacatttcgcagttcaatgaagaagcacgatctccctttgtcaaaaagtacaagaccataatacatccaggagaggtcaacagaataagggagctgccccagaacagcaagatagtggccacccacacagatagtccagatgttctcatctgggatgttgaggcacaacctaatcgacatgctgtgctgggagcaggagattcacgtcctgatctgatattgacgggtcaccaagataatgcagaatttgcacttgctatgtgtccaacggaaccacatgtgctctctggagggaaagataagctagttgttttgtggagcatacaagatcacatatccaatgctgtggtggacccatcatccaccaaatctccatcagggggctcgatagttaaacaaacgtccaagtctgataagtcagtagaaagtccaacaattggaccgcgaggtacattccaagggcacgaggatactgttgaagacgttcagttctgcccctcaagtgcacagatattctgtagcgtaggtgatgactcttgccttatactctgggatgctcgtgctggtaattctccttcaatgaaggtggagaaggctcataatgcagatcttcattgtgttgattggaaccctcatgatgaaaatcttattttgactggttctgccgataactctgtccgaatgtttgaccggcggaatctaatttctggtggcattggagcccctgttcataaatttgaaggtcacaaggctgctgttctttgtgtgcagtggtcaccagataagtcatctgtttttggtagttctgctgaggatggctttctgaatgtctgggattatgaaaaggttggtaaaaagaaagatcgtgtgggaaccaggatgcctaactctcctccaggcttgttctttcaacatgctgggcaccgggataaagttgttgatttccattggaatgcatctgatccatggacaattgttagcgtatcggatgactgtgagagtacaggtggcggaggcactctacagatttggcgtatgagtgacttgatctaccgtccagaagaagaggttcttgccgaactggagaagttcaaatcacatatacttacatgctcgtccaagtcatgaataatgtataacgaatgtattatgatcatctggttaagaagacctatgtatttgtaccagtgtctgtttgtgggcagtttccgggagggtgatatgcgcattgctgatgagatatgtagctgttagatggtttttaacttaggcattaacgtagggaatttgatgtgtacattgccagcagcttgtttggtgactgccaaggatctcaatctcgaactattgcaatgtacagttatccagtcattatggcagaaattgttgtcagattcagttcgagctcctaaccaggttgttcgagactgagatgtaaagtatctggtgattgaccctgtctttgttgact

SEQ ID NO: 3158 - DNA, 1850 bp, Oryza sativa
cttggatgctctgctctgcccttgcattcgggcacaagaggggtggcatctctgagcgggagccacgcgcaagggtccagagcaaacgctcctcatacgacagagagagcgtgacagcgcgagggggttcggaggcgggagcgggcgacggcggcggcggcgggcgccagcgagcggcgaagggcgcgctggagatgaaggagaaggggtcgagggcggcggtggacgagcgctacgcgcagtggaagtcgctcatcccggtgctctacgactggttcgccaaccacaacctcgtctggccgtccctctcctgccggtggggaccccagtttgagaaggctacctacaagaatcgtcagcgtctttacctttcagagcagacggatgggactgtccctaatactctggttattgcaaattgtgaagttgtcaaaccaagggttgcagctgctgaacatatatctcagttcaatgaggaagcacgatcaccttttgtaaagaagtacaagactataattcatccaggcgaggtgaacaggattagggagcttccgcagaacagtaagatcattgccactcataccgacagcccagatgttctcatttgggatgtcgaggcccagccaaatagacaagctcaactggcacagatggagtctcgtcctgatttgatattaagaggacataaggatattgctgagtttgcgcttgctatgtgcccagctgagccatatgtgttatctggaggaaaagacaaatctgttgtatggtggagcatccaagaccacatatctgcactgggagattcctcgaaaactgaatcttctccaggggcatcaggaagcaagggaaaaactgcaaatgataaggatagtcctaaagttgatcctcgtggtatctttcttggccacgacagtactgttgaagatgtccagttctgcccttctagtgcacaggagttttgtagtgtaggcgatgattcttgtcttattctttgggatgcccggagtggtacaggcccagctgttaaggttgagaaagctcatggtggtgatgttcattgtgttgactggaacctccatgatgttaactatatcttaactggttctgcggataattctgtccgtatgtgggaccggagaaatctgggttctggaggagctggcattccagttcacaaatttgagggtcataaagctgctgttctttgtgttcagtggtcacctgacaaggcatctgtatttggaagctctgcggaagacggcttcttaaatgtgtgggatcatgagaaggttggaaataagaaaaatcccaacgcacctgctgggcttttctttcaacatgctggtcatagggataagattgtagacttccactggaattcttcggatccttggactattgtgagtgtgtctgatgatggtgagagtactggtggaggtggaacattgcagatatggcgcatgagtgacctgatataccgtccagaagatgaagttcttgcagagctggagaacttcaagactcacttggccagctgtgctccaaggagctgaatcgtgtgactatctgtgtaacccagtcctgtaataactctagtaggtttctaatttcttgtccatttagaatgttcctttcaaatattggttatatcctctggtgcggaacccaggcttgtacccttcaagtgcttgtgcgactcttttaccttactgtatcgactcaaatcggtaagctagtgcaaacacagcagagcagaatctctgtgggcagattatttggatgctaaacattgttctggagtctcgtattggacctagttgtattgttagcctgacttggtgacttaa

SEQ ID NO: 3159 - DNA, 1932 bp, Cocos nucifera
gctccgctcccttctattttaacccttggcccttcctcccctgctcaaccgataccctttcaggcaagggcacgagctcggggatttccttcttctttactgcagcgggcgggaaaaagtgtgagaaagagacagcgagcgacggagagatgagggagagaggaaaggcggagcaacccacggtggacgagcggtacagccagtggaagaccctcattcccgtcctctacgactggctcgccaaccacaacctcgtctggccctccctctcctgccggtggggtccgcagctcgaacaagcaacatacaagaatcgtcaacgtctatatctttctgagcagactgatggcagcgttcctaatactcttgtcatagcaaattgtgaagttgtcaaaccaagggttgcggctgcggagcatatctcccagtttaatgaagaagcacgctctccctttgttaaaaagttcaaaaccatcatacatcctggggaggttaacagaatcagagagcttccgcagaacagtaagatagtggcaacacatactgacagccctgatgtactcatctgggatgttgaggcacagcctaatcgtcatgctgttttaggagctgctgactctcgtccagatttgatattgacaggacataaagaaaatgcagaatttgcgctttccatgtgcccttcagatccttttgtactctctggagggaaggacaaattggttgttctgtggagcattcaagatcatatctccacgttagcagagtcatcaactgctaaatctcctgcaacacctgcaagctcaagtgggaagcagcctgcaaaagctggtaatgagaaaagctcagacagtcctacagctgggccacgaggtgtatatcaagggcatgaggatactgttgaagatgtgcaattctgtccttctagtgcacaagaattctgtagtgttggtgatgattcttgcctcattctttgggatgcccgagctggtactggcccagccatcaagattgaaaaggctcacaatgctgatcttcactgtgttgattggaacccacatgatgaaaatcttattttaactggatctgctgataattctgttcgaatgtttgatcgccggaacctaacttctggaggtgttggaacaccaatatataaatttgaaggtcacaaagctgctgttctttgtgtacagtggtctcctgacaaagcatcagtttttggaagtgccgcagaggatggcttgctcaatatttgggatcatgagaaggttggcaagaagaaggaacgtgttggaacaaagatgcccaattcgcctcctggtttattctttcaacatgcagggcacagagataaagtcgtagatttccattggaattcatctgacccatggacaattgttagtgtctctgatgatggtgagagtactggtggtggtggtactttacagatatggcgcatgagtgacttgatatacaggccagaagaggaggttctggctgagctggaaaagttcaaatcccatattctgacatgtgcacctaattcgtaaatcttcagatattgctaagtgataaactctaggatttgctggagctgttaaatttgaaagagtgccagtttatttagaggttgatgaggttttatcctggaaactttgtaggataattgggatggtgatgtcgtcacttctgttacttaaataccaaatttagatatcttggttagtttgttggaatacctgctttctccgagccactggtgatttattgggggtattgcgccttataccattttgaccgctggatgaggattgaagtactaccactgattgttctcttcaccatagagctttttctacatgttctgtatcgtcgaacctgaactaggagaatccaattttgaattaaagcatttcagcggttaaaaaa

SEQ ID NO: 3160 - DNA, 3871 bp, Sorghum bicolor
ggacgcgcggcgggcaggcgtacgggccccaccggaggcagcggccgctataaaagagggctcggcgcggccccgtaaccctcgcctcggtcacgacgcgcagccagtcgcacggtccgcatctcgcccgcccccctctcccgtcctccgcttggccgccgcccgcatccgtccgcctctcctcgtgaacgagaccgacgagcgagcgagcgagccagcccgcgaccgtacccgagagccgccgccgtcgtcgccgtcccaccccgactcctcctgaccgccggcgtggggtgcccgggctcctccaccggcgacgacaccttccccgccgtgcgcgccaccaccgcctgctccgtttgcgggggtagccggggctccggcctcggcggctttcaaagcccccttcctcacaacaggatccaaaatcccgtcctagagttcttctacctccctttccagaactttctcttttggcatccctcacgatcgatctcgatcccccccgcttcgatttcgatttcatctcttcttgttattgattggtttttctagcttctttcatatatcattttgaattttgattccttccttcttccccagtagctaatccgatccaatccaatcccccgttccatttcgttcttccctgttcatcatccgcacccagctaacgcctcccagaacagcaattttatagcacaggaaaaaaaaaccaaccaaatcctacccaccgcccaaaaaaaaaagaaagcctaactttattttccccatctgtggaattctccggttttttctgacgagatgcctgcgctcgccgtcgacgccacaacacccgtggcgcacgccatcgcatcatgcgacgcggcggctcgcttccctgccccgcccgtggtgggccccgccgctgccgcagccgctgaccccgtcccgtggtcggccgacctctccgcggcgctctacaacgtggacggctggggcgcgccctacttcttcgtcaacgacgacggcgacgtcgccgtgcgcccgcacggccccgcgacgctcccgggccaggagatcgacctggccaaggtcgtggccaaggccgcgggaccgcgcgagggcggtgggctcggcctgccgctgcccttgctcgtgcgcttccccgacgtcctgcgccaccgcgtcgagaccctcaacgccgccttcggctacgccgtccgctccaccggctacggctccaggtaccagggcgtgtacccggtcaagtgcaaccaggacaggtacgtcgtcgaggacattgtcgagttcggcgcgccctttgggttcggcctcgaggctggctccaagcccgagttgctgctcgccatgagctgcctcgccgcgcgcggcaacccggacgctctgctcatctgcaacggctacaaggacgacggctacgtctcgctcgcgctcatggcacgctccatgggcctcaacaccgtcatcgtgctcgagcaggaggaggagctcgacattgtcgtcgaagccagccgccgcctcggcgtgcgccccgtcgtcggcatgcgcgccaagctgcgcaccaagcacgccggccacttcggctccacgtccggggagaagggcaagttcggcctcaacgccgcgcagatactgtccgtggtcaccaagctcaaggccattgctatgctcgactgcctccagctgctgcacttccacattggctcccagatcccgaccaccgccctgctctccgacggcgtcggcgaggccgcgcagatctactgcgagctcgccaggctcggcgccgacatgcgcgtcatcgacgtcggcggcggcctcggcattgactacgacggaacccactcggcgcagaccgacatgtcggtggcgtacagcctggaggagtacgcgacggccgtggtggccgccgtcggccgcgtctgtgaccgcaaggtggtgcagcaccccatcatctgcagcgagagcggccgcgcgctggtgtcccaccactcggtcctggtgttcgaggccttctcggctacggcgccaggtcgcctggacgcggccacggcctacctcctcgacgagctcaccgacgactgccgcggcgactaccgcaacgtcatggccgccgccgtgcgcggtgactacgacacctgcgccctgtacgccgaccagctgaagcggcgctccgccgagcagttcaaggagggagttcttggcctggagcaccttgccgcggtggacgccttctgcgagctcgtcgcccgcggcatgggcgcgcccgagccgccgcgcacctaccacatcaacctgtccgtgttcacctccctgccggacatgtgggccatcgggcagcagttccccatcatcccgatccagcgcctgcaggagcgccccgccgtcgacggtgtcctctcggacctcacctgcgacagcgacggcaaggtcagcgagttcatcggcgggaggcacagcctgccgctgcacgagctccccacccacgccacccgcggctactacctgggcatgttcctcggtggcgcctaccaggaggccctcggcgggctgcacaacctcttcggcgggcccagcgtggtgcgcgtgtcgcagtgcgacggcccccactgcttcgccgtgacgcgcgctgccgcgggcccgtcctgcgccgacgtgctccgcgcgatgcagcacgagcccgaggtgatgtacgaggtgctgaagcagaggaccgacggcgccacggccgccgccctcgccagagccttcggcgcaatgccgtacctggtgttcgacccggaggccgcggtgttgtccagcggcgagagtagcggcatgagcagcgactcggaagggtcagccgccggcgccgccgaggaggaagacgatgaggagtgggagttcatgcgcggcctcaccgtctgatgcatggctgcagcagcagcgcccctgttcccgtgtccgtcctggtgaaacaagtccagtcgccagcaagttgtcaagtcgccggccggcgttggtaatctaacccccaccgcccggtgttgtatcgtgtcatggtcgtagtcgtcgggtgtctcgtcgtcgccggagttcatggcgccacctttttattccgaatgcgtcagtgtccactgttcgcctttttttttatttctctctttttcttccatgggaataacatgaaggaactaatagcaagtttctctgcaactgttatctagtttcgtttttcaagaattcattcagcttttgtcaatgggatatccatccatggttgccttgcttgtttctttctgtgattgttcttctccttttgctttgaaaatgctatcggcgatccactggaaacctcgagcggtgctcccatttgtccctgagcttttcccgagagaaaaaaagggtgctttccaagattctgggcttctggcggccatgagcagcaagacacagataaactcgaaggcaagatgagcacggcgccgacgtcttcgtccccgtcgtcgtcgggacacagtatcatccgagacgtgtacggtgcagccggggaaagtaacggcaaagtcggcggccttgtcgccgtcggctcggccgcccggctctcgccttcctctttcgtgcgctctcgtagctttctccggcgtcgcgtcgagggcaaggcagggcaggtgtcatggccgcgagcgccggaatctctggataaaccccgagatattcggacgtcacgcggtgggcggcggcggattccaacgcagctcccaggacgctacctgtcgcgcggcgcggcgctcgtcagcgtcatcggcatggtaggtgtgtggggcttgcttgctgtgcgtctgcactgcacatgtgttgcgagacgacgaggacgaaaaggaagacgaac

SEQ ID NO: 3161 - DNA, 3132 bp, Setaria italica
tcaccacgacgcttgcgcagtcgccccgcccgcccatcccgcatctcgccctcccggcctctgattggccgccgccccgcccgcccgtccgcgcccccgcctcgtcgcgagcgagcgagccctcgccgcggcgacccgccgcagccgacccgccaagctcatacccgcccctctcctgaccgccggcgtggggtgcccgggctccacctccggcgacgacacccttcccgccgcgcgcgcccccacagcctgctccgtttgcgggggtagccggggctccggcctcggcggctttcaaagcccccttcctcacaacaggatccaaaatcccgtcctagagttcttctatctccccttccagaacttcctcttttggcatccccaacaatcgatctcgatccccttcgatttcgattgttttcttctttgattgatttcccttttattttggtagctgccaccgcccccctcagccgatttccattcccttttgttcatccgattctgttcattagcagctaactccaccaccaccacccaatagcaattttactactgcacataaaaaacaaccaaatcccaaaaaaggttttttcccctgtggactcaatagcgttctccggttgttgtttgatttgattgacgagatgcctgcactcgccgtcgacgccgcgacacctgtggcgcacgccttcgcgtcctgcgacgcggcgcgcttcccggccccgctcatggcggtgcccacctccgccaccgcagcggccgacaaacccgaggcggccgcgtggtcggccgacctctccgcggcgctctacaacgtggacggctggggcgccccctacttcttcgtcaacgacgacggcgacgtcgccgtgcgcccgcacggcgccgccacgctgccggggcaggagatcgacctggccaaggtcgtggccaaggccgccggcccgcgcgacggcggggggctcggcctgccgctgcccctgctcgtgcgcttccccgacgtgctgcgccaccgcgtcgagaccctcaacgccgccttcgactacgccgtccgctccaccggctacggctccaggtaccagggcgtgtacccggtcaagtgcaatcaggataggtacgtcgtcgaggacattgtcgagttcggcgagcccttccgcttcggcctcgaggccggctccaagccggagctgctcctcgccatgagctgccttgccgcgcgcggcaacccggacgccctcctcgtctgcaacggctacaaggacgacggctacgtctcgctcgcgctcacggcgcgcaccatgggcctcaacaccgtcatcgtgctcgagcaggaggaggagctcgacatcgtcctcgaggccagccgccgcctcggcgtgcgccccgtcgtcggcatgcgcgccaagctgcgcaccaagcacgccggccacttcggctccacctccggggagaagggcaagttcggcctcaacgccgcccagatactgtccgtggtcaccaagctcaaggccgttggtatgctcgactgcctccagctcctgcacttccacattggctcccagatccccaccaccgccctgctctccgacggcgtcggcgaggccgcgcagatctactgcgagctcgcccgcctcggcgctggcatgcgcgtcatcgacgttggcggcggcctcggcatcgactacgacgggacccactcggcgcagaccgacatgtcggtggcctacagcctcgaggagtacgcggtggccgtggtcgccgccgtcggccgcgtctgtgaccgcaagggggtgcagcaccccatcatctgcagcgagagcggccgcgcgctggtgtcgcaccactcggtcctggtgttcgaggccttctcggccacggcgcccgggcagcttgatgcggccacggcctacctgctcgacgagctcaccgacgactgccgcgccgactaccgcaacgtcatggccgccgccgtgcgcggcgactacgacacctgcggcctctacgttgaccagctgaagcgccgctccgccgagcagttcaaggagggggttcttggcctggagcacctcgccgcggtcgacgccttctgcgagatcgtcgcccgtggcatgggcgctcccgaggcgccgcgcacctaccacatcaacctatcagtgttcacctccctgccggacatgtgggccatcgggcagcagttccccatcattcccatccagcgcctgcaggagcgcccggccgtggacggcgtcctctccgacctcacctgcgacagcgacggcaaggtttgcgagttcatcggcgggaggcacagcctgccgctgcacgagctccccacccacgccacccgcggctactacctgggcatgttcctcgggggcgcctaccaggaggccctcggcgggctgcacaacctcttcggcgggcccagcgtggtgcgcgtgacgcaaagcgacggcccccactgcttcgcggtgacgcgcgcggcggcggggccctcgtgcgccgacgtgctccgcgcgatgcagcacgagcccgaggtgatgttcgaggtgctgaagcagaggaccgacgacgccacggccgcgtcgctcgccagggcgttcggcgcaatgccgtacctggtgttcgaccccgaggccgcggtgatgtccagcggggagagcagcggcatgagcagcgactcggaggggtcggccgccggcgccgccgaggaagaagatgaggaggagtgggagttcatgcgcgggctcaccgtctgacgatgaagaagcagcagaagctcccctgtaccgtccctggtgaaacaagtcgccagcaagtttgtcagtcgccggcgttggtaacctaaccctccgcccggtgttgtatcgtgtcatggtcgtagtcgtcgggtgtctcgtcgtcgccggagttcttggcgccacgtttttattccggatgcgtcagttgtccactgttcgcctttttttcttgggaaaaataagaaggaactcttcaagtttctctgcaactgctatctagtttcatttttcgagtattcatccccgtgtctatgggatgtccattgttgtttgtttcctccttcggaccggaaggacagtaattcagataaaaaagaagttcccaaaa

SEQ ID NO: 3162 - DNA, 3812 bp, Panicum virgatum
atgcgggtgcggcgagagcgcggcggcccccggcgagagcgcggccggctcgggacgcgccgcgagagcaagagcacgggtcaaacgagtttctcttccccgggcgccagaaacccggctgggcggctcaccgctcacgggccccccgcgcgttttgaatccgttctccgctgtggccgccgcagcggatcccagaggcgcgcgggtaaaccgcatacaacacccggcacaagtccgatctgggccgcccatccgacgcaaccgaacaagggagggatcaaagaacgtgaccccccaggcccgagccgtgcaggtccaacaaccgccccaagccgagcgccccggtcgcaattcacgggcccaaccacctcccccagtcaagccagcgcccagccacgaggcggcttcctccccttgaacccttgcacgctcacggccactgacgcccggggtcaaactcaaacctcaccgcgacgcaacgcacctaccccagagccgtagaggagcctccgctgcgcagccagccacggagccaggccaggccaccaccagcaaaagtgaatggggggcccacgggaggcgcggcccgctataaaaggggcctcggcgcccggccgtaaccctcgccagtctcggtcacgacgcgcagtcgcgcccattccgcatctcgccctcccggcctccgattggccgccgccgcgccgcgccgcatccacccctcccgacgaacgcgcgagcgcttcgccgtcccaccccctcctgaccgccgccggcgtggggtgcccgggctccaccaccggcgacgccaccctccccgccgcgcgcgcacccaccgccggctccgtttgcgggggtagccggggctccggcctcggcggcttgcaaagcccccttcctcacaacaggatccaaaatcccgtcctagacttcttctacctccccttccagaacttcctcttttggcaccccccacaatcgatctcgatccccttcgatttcgattgttttcttctttgattttcatttcttctcctattattatcgctagctcatcgacccccctcatccaattccggttccatttccttttgttcatccgattctcttcattcgcagctaacaccaccaccatccagacaacaattttacagcacatagaaccaaccaaccaaaatcccaccaaaaaaaaggctaacatattttttccccctgtggactctccggttgtttgatttgacgagatgcctgcgctcgccgtcgacgccgcgacacctgtggcgcacgccttcgcgtcctgcgacgcggcgcgcttcccggccgccccgctcatggccaccgacaagcccgaggcggccgcgtggtccgccgacctctccgccgcgctctacaacgtggacggctggggcgccccatacttcttcgtcaacgacgacggcgacgtcgccgtgcgcccgcacggcgccgccacgctgcccggccaggagatcgacctggccaaggtcgtcgccaaggccgcgggcccgcgccaggccggcggcctcggcctgcccatgcccctgctcgtgcgcttccccgacgtgctgcgccaccgcgtcgagaccctcaacgccgccttcgactacgccgtccgctccaccggctacggctccaggtaccagggcgtctacccggtcaagtgcaaccaggacaggtacgtcgtcgaggacattgtcgagttcggcgagccattccgcttcggcctcgaggccggctccaagcccgagctgctgctcgccatgagctgcctcgtcgcgcgcggcaaccccgacgccctcctcgtctgcaacggctacaaggacgacggctacgtctccctcgcgctcacggcgcgcaccatgggcctcaacaccgtcatcgtgctcgagcaggaggaggagctcgacattgtcatcgaggccagccgccgcctcggcgtgcgccccgtcgtcggcatgcgcgccaagctgcgcgccaagcacgccggccacttcggctccacgtccggggagaagggcaagttcggcctcaacgccgcccagatactgtccgtggtcaccaagctcaaggccatcggcatgctcgactgcctccagctcctgcacttccacatcggctcccagatccccaccaccgccctgctctccgacggcgtgggcgaggccgcgcagatctactgcgagctcgcccgcctcggcgccggcatgcgcgtcattgacgttggcggcggcctcggcatcgactacgacgggacccactcggcgcagaccgacatgtccgtggcgtacagcctggaggagtacgcggtggccgtggttgccgccgtgggccgcgtctgcgaccgcaagggggtgccgcaccccatcgtctgcagcgagagcggccgcgcgctggtgtcgcaccactccgtcctggtgttcgaagccttctcggctacggcgcccgggcagcttgatgcggccacggcctacctgctcgacgagctcaccgatgactgccgcgccgactaccgcaacgtcatggccgccgccgtgcgcggcgactacgacacctgcggcctctacgccgaccagctgaagcggcgctccgccgagcagttcaaggagggggtcctgggcctggagcacctcgccgcggtggacgccttctgcgagatcgtcgcccgtggcatgggcgcgcccgagccgccgcgcacctaccacataaacctgtccgtgttcacctccctgccagacatgtgggccatcgggcagcagttccccatcatcccgatccagcgcctgcaggagcggccggccgtcgacggcgtcctctccgacctcacctgcgacagcgacggcaaggtctgcgagttcatcggcgggaggcacagcctgccgctgcacgagctccccacccacgccacccgcggctactacctgggcatgttcctcgggggcgcctaccaggaggccctcggcggcctgcacaacctcttcggcgggccgagcgtggtgcgcgtgtcgcagagcgacggtccccactgcttcgcggtgacgcgcgcggcggcggggccctcgtgcgccgacgtgctccgcgcgatgcagcacgagcccgaggtgatgttcgaggtgctcaagcagaggaccgacgacgccacggccgcgtcgctcgccagggcgttcggcgcaatgccgtacctggtgttcgaccccgaggccgcggtgatgtccggcggggagagcagcggcatgagcagcgactcggaggggtcggccgccggcgccgccgaggaagatgatgatgagtgggagttcatgcgcgggctcaccgtctgacgacgaagcagcagcagcagcagcagcagctcccatgtatgtccctggcgaaacaagtcggaacgccagcaagtgtttcagtcgccggccggcgttggtaacctaaccctccgcccggtgttgtatcgtgtcatggtcgtagcagtcgggtgtctcgtcgtcgccggagttcttggcgccacttttttattccgaacgcgtcagttgtccactgttcgccttttttttcttgggaaataagaaggaacacttgagtttccctgcaactcttgtctagtttcattttgtttttcaagtaaaattcagctgtgtctatgggatacatgtccattgttgtttcatttgtttcttcttcagaccggaaggacaacaattcaggaaaaaaatggttcttaaaatcttgtctgggtgtgtttagatccctaaactttccatcacatcaaaatcacatcgaaacattaaatatagcaaatgacttat

SEQ ID NO: 3163 - DNA, 2515 bp, Echinochloa colona
ggcttaacttttttgttgttttcctgtggactctaccgttctccggttgtgtttgatttgatttgacgagatgcctgcgctcgccgtcgacgccgcgacacccgtggcgcacgccttcgcgtcctgcgacgcggcgcgcttcccggccccgctcgtggcgggccccgccgccgctgctgccgacaagcccgacgccgccgcgtggtcggccgacctctccgcggcgctctacaacgtggacggctggggcgccccctacttcttcgtcaacgacgacggcgacgtcgccgtccgcccgcacggcgccgccacgctcccgggccaggagatcgacctcgccaaggtcgtcgccaaggccgcgggcccccgcgccggcggcggcctcggcctcccgctgcccctgctcgtccgcttccccgacgtcctccgccaccgcgtcgagaccctcaacgccgccttcgactacgccgtccgctccaccggctacggcaacaggtaccagggcgtgtacccggtcaagtgcaaccaggacaggtacgtcgtcgaggacattgtcgagttcggcgagcccttccgcttcggcctcgaggccggctccaagccggagctcctcctcgccatgagctgcctcgccgcccgcggcaaccccgacgccctcctcgtctgcaacggctacaaggacgacggctacgtctcgctcgcgctcatggcgcgcaccatgggcctcaacaccgtcatcgtgctcgagcaggaggaggagctcgacattgtcgtcgaggccagccgccgcctcggcatgcgccccgtcgtcggcatgcgcgccaagctgcgcaccaagcacgccggccacttcggctccacctccggcgagaagggcaagttcggcctcaacgccgcccagatactgtccgtggtcaccaagctcaaggccttgggtatgctcgactgcctccagctcctgcacttccacatcggctcccagatccccaccaccgccctgctctccgacggcgtcggcgaggccgcgcagatctactgcgagctcgcccgcctcggcgccggcatgcgcgtcatcgacgtcggcggcggcctcggcatcgactacgacggcacccactcggcgcagaccgacatgtccgtggcctacagcctggaggagtacgcggtggccgtcgtcgccgccgtcggccgcgtctgcgaccgcaagggcgtgccgcaccccgtcgtctgcagcgagagcggccgcgcgctcgtgtcgcaccactcggtgctcgtgttcgaggccttctccgccacggcgcccggccagctcgacgccgccacggcctacctcctcgacgagctcaccgacgactgccgcgccgactaccgcaacgtcatggccgccgccgtgcgcggtgactacgacacctgcggcctgtacgccgaccagctgaagcggcgctccgccgagcagttcaaggaggggctcctcggcctcgagcacctcgcggccgtggacgccttctgcgagatcgtcgcccgcggcatgggcgccgccgagccgccgcgcacctaccacatcaacctgtcggtgttcacctccctgccggacatgtgggccatcgggcagcagttccccatcatcccgatccagcgcctcggggagcgcccggccgtcgacggcgtgctctcggacctcacctgcgacagcgacggcaaggtgtgcgagttcatcggcgggaggcacagcctgccgctgcacgagctccccacccacgccacccgcggctactacctgggcatgttcctcgggggcgcctaccaggaggccctcggcggcctgcacaacctcttcggcggtcccagcgtggtgcgcgtcacgcagagcgacgggccgcactgcttcgcggtgacccgcgcggcggcggggccctcgtgcgccgacgtgctccgcgcgatgcagcacgagccggaggtgatgttcgaggtgctcaagcagaggactgacgacgccaccgccgcgtccatcgccagggtgttcggggcaatgccgtacctggtgttcgacccggaggccgccgtgatgtccagcggggagagcagcgggatgagcagtgactcggaggggtcggccgccggcgccgccgaggaagatgacgaggattgggagttcatgcgcgggctcaccgtctgacgatgaagaagcagcaaagctcccctgtatcgctggtgaatcaagtggccagcaagtctgtctgtcagtcgccggcgttggtaatctaaccctccgcccggtgttgtatcgtgtcgtggccgtagtcgtcgggtgtctcgtcgccgccggagttcttggcgccacttttttattccgaatgcgtcagtgtccactgttcgccttttttttcatgggaataagaaggaactgttattaggtttctctgaaactgttgactagtttcttaattttacaattactcagctgtgtcgatggcatgtccatgttttgcttgttacttctcggagaataattcag

SEQ ID NO: 3164 - DNA, 5071 bp, Panicum virgatum
caatatcgtgccaaacgtgagccaataatcttgtttggcagcaatgctatctttttttgcaaacaaaatatcttgtttcgaccccttgattttagttggaatggtatactgtactccacatgagcagcactacaccccttgttgttccaccccgcctcccctcttcatcaaaattgccatccgtccaccaaccaaaagatggaatgttcctcggtagaccgatctgagaaaaaagaaagaataaaaaaccctgccgctcacgtgtccctcgcccggcacgcaactgaacaagggagggatcaaagaacgtgacccccccgagccggcgagccgcgcgcacccacccgcgtccagtccaacaaccgccactgacggacggagctgggcggcatgtggctgctgcgcctcgcgctcgctcggccgccgcgaccggggaccggaccggaccgagccagccacccaagcggcccggtcgcatttcacgggcgcaaccaccctcccccagtcaagccagcgcccagccacgaggcttcctccctccccctgaaggctcgaaccctcgctggttcacggtcactgacgtccgggccaacctcaccgcgacgcacctacgcgacgcacctaccccggcagtagagggaggagggacgacgcgaggtctcgcacgcctctgctgcgcagacgccagccagccacggagccagggcaaccaggccaccaccagcaacagcgaacggcgcagggggcgggtgggcccacgggaggcgcggcccgctataaaaggggcctccgcgcccggccgtaaccctcgcctcggtcacgacgcgcagtcgcccgcccattccgcatctcgccctcccggcctccgattggccgccgcccccgcctccgcctcctcgtcgcagcgccaggccaggccgccgcaccaccccccgacgaacccgcgggccctcgccgccgggagcacctcgccgtcccgcccccgtcctccgccgcctcctgaccgccggcgtggggtgcccgggctccaccaccggcgacgccaccctccccgccgcgcgcgcacccaccacctgctccgtttgcgggggtagccggggctccggcctcggcggcttgcaaagcccccttcctcacaacaggatccaaaatcccgtcctagacttcttctacctccccttccagaacttcctcttttggcatcccccacaatcgatctcgatccccttcgatttcgattgctttcttcttcttctttgattcattcattttcctaaccttatctcgctagctcgtcgatcgacccctcatccatttccagttccatttccttttgttcatccgatttctcttcattcgcagctaacaccaccaccatccagataacaattttacagcacataaaaccaaccagccaaccaaaatctcccaaaaagaaaaggctaatttttccccccagtggactctccggttgtttgatttgatttgacgagatgcctgcgctcgccgtcgacgccgcgacacctgtggcgcacgccttcgcgtcctgcgacgcggcgcgcttcccggccgccccgctcatggccgacaagcccgaggcggccgcgtggtcgcccgacctctccgccgcgctctacaacgtcgacggctggggcgccccctacttcttcgtcaacgacgacggcgacgtcgccgtgcgcccgcacggcgccgccacgctgcccggccaggagatcgacctggccaaggtcgtcgccaaggccgcgggcccgcgcgaggccggcggcctcggcctgcccatgcccctgctcgtgcgcttccccgacgtgctgcgccaccgcgtcgagaccctcaacgccgccttcgactacgccgtccgctccaccggctacggctccaggtaccagggcgtgtacccggtcaagtgcaaccaggacaggtacgtcgtcgaggacattgtcgagttcggcgagcccttccgcttcggcctcgaggccggctccaagcccgagctgctgctcgccatgagctgcctcgtcgcgcgtggcaaccccgacgccctcctcgtctgcaacggctacaaggacgacggctacgtctccctcgcgctcatggcgcgcaccatgggcctcaacaccgtcatcgtgctcgagcaggaggaggagctcgacattgtcatcgacgccagccgccgcctcggcgtgcgccccgtcgtcggcttgcgcgccaagctgcgcaccaagcacgccggccacttcggctccacgtccggggagaagggcaagttcggcctcaacgccgcccagatactgtccgtggtcaccaagctcaaggccatcggcatgctcgactgcctccagctcctgcacttccacattggctcccaggtccccaccaccgccctgctctccgacggcgtcggcgaggccgcgcagatctactgcgagctcgcccgcctcggcgccggcatgcgcgtcatcgacgtcggcggcggcctcggtatcgactacgacgggacccactcggcgcagaccgacatgtccgtggcctacagcctcgaggagtacgcggtggccgtggtggccgccgtcggccgcgtctgcgaccgcaagggggtgccgcaccccatcgtctgcagcgagagcggccgcgcgctcgtgtcgcaccactccgtcctggtgttcgaggccttctcggccacggcgccagggcagcttgacgccgccgcggcctacctgctcgacgagctcaccgacgactgccgcgccgactaccgcaacgtcatggccgccgccgtgcgcggcgactccgacacctgcggcctctacgccgaccagctgaagcggcgctccgccgagcagttcaaggagggggtcctgggcctggagcacctcgccgcggtggacgccctgtgcgagttcgtggcccgcggcatgggcgcgcccgagccgccgcgcacctaccacatcaacctgtccgtcttcacctccctgccggacatgtgggccatcgggcagcagttccccatcctcccgatccagcgcctgcaggagcgcccggccgtcgacggcgtgctctcggacctcacctgcgacagcgacggcaaggtgtgcgagttcatcggcgggaggcacagcctgccgctgcacgagctgcccacccacgcgacccgcggctactacctgggcatgttcctcgggggcgcctaccaggaggccctcggcgggctgcacaacctcttcggcgggccgagcgtggtgcgcgtgtcgcagagcgacgggccgcactgcttcgcggtgacgcgcgcggcggcggggccgtcgtgcgccgacgtgctccgcgcgatgcagcacgagcccgaggtgatgttcgaggtgctcaagcggaggaccgacgacgccacggccgcgtcgctcgccagggcgttcggcgcaatgccgtacctggtgttcgaccccgaggccgcggtgatgtccagcggggagagcagcggcatgagcagcgactcggaggggtcggccgccggcgccgccgaggaagatgatgaggagtgggagttcatgcgcgggctcaccgtctgacgctcatgaagcagcagcggcagcagcaagtttgtgagtcgccggccggcgttggtaccctaaccctccgcccggtgttgtatcgtgtcatggtcgtagtagtcgggtgtctcgtctcgtcgtcgccggagttcttggcgccacttttttattccgaatgcgtcagttgtccactgctcgcctttttttttcttgggaaataagaaggaacagagtttccctgcaactcttgtcccgtttcatttccccccctctcaattagtattgagctgtgtctatgggatagatgtccattgttgcttcatttgtttcttattcagaccggaagcaaggacaataattcagaaaaaaggttctcaaaatcttgtctgttgctgtgattcttcctcctctttctttcgctttgaaaatgtttttttttgaaaaggtcgatttgaaaatgttatcagcaatctggaccagcaatctactggaaacctcgagcggtgtggttccatttgtccctgcgctttcctgactcccgagaggggagaaagaaaaggtgctttccaagattctgatcgggcaccagcaagacaaacccaaagccaggacgggcgaggacggtattcgagcccatcgcggctgcatccgcatcatccgtcgcctcgcctcgtcggagacgtgctagcagccggggccgctgctctgctcccgttgcatgtcatgtcagcctcgccatggactatggtaggtgatggggcgaagttgctgggcgacctgctggtttgttctcgagcgcgactgggattgggatcccatcccggcccgggggtaggtgacagcgcgcggctccgggtggcgccgctcggctcgggtgccggttaaactatgaccggttgcgtgtcgccgccggcgccggcgccggcgcggcgttcgggggactccgggcggacacctgtggcatctgtcgcaggagcgggaagaagcttgcattttaagcagaatctggaacgcaatttggcgcggcacattgtgctccgtacagttgcggcgtcgtgaccacaagggttgctgtcatctgaatctttctttattttttttacatgccagatgatcaggtttggccgatcccggcgcgcgatcccggccgctcgtttcccgatcaggtttggccggagccctcgaggagcatgtggtgtgttcccagccaagaggaaggatcgccctcgcccagtggttggcacaggcaggcggcagcagcgcggggtcgcgagagaggatagtcggccatccatccccctcctccatgatcccagttgggccgtgagtgagattccagatccaacacctgccgaccctgtcctgatcacgcccaggcaaggcacaaaacatgtcaagctcccggccaagaaaacccaaaccgaaaccctctccctcccctcccctcccctgccacttgctgtctgcgtgagctggtggctcggtgccgaactgcaatgaactccaac

SEQ ID NO: 3165 - DNA, 3349 bp, Oryza sativa
ctcgcatttcccatctcatctctcgctcgctcgctcgctcgccgctacgcctcacgattccgacgactccgacgccggtagggtcataacaccctcctagacgccggcgacgacgagggtggttgggttgtggatagcggctgcgacgacgagggcgctctcctgaccgccggcgtggggtgccccagctccaccaccggcgacgactcctcctccgccgcgagcgctcccccagcctgcttcttttgcgggggtagccggggctccggcctcggcggctttcaaagcccccttcctcacaacaggatccaaaatcccgtcctagagttcttctacctccccttccaaaacttcctcttttggcatccttgattcaatttcccttccctttctttctttctttctttctttctttcgatttcttcttcttgctttagatttcttatccttcttcttgttgctaatctcgatcgatccatctatccatccaaacaacctcattcttttttcctttgatttgattcttcgctgctaacgccaccgaaacagacaacagatttacagcaaaagaaaaaaaaagaaggaaggctaacctttttctgtggattttagcgttctccggtttgtgacgagatgcctgcgctcgccgtggacgccgctgcacctgtcgcgcacgccttcgcgtgcgacgcggcgcgcttccccgcgccgctgctgggccccgccgccgcggctgcggcggtggcggagaagccggacgcggccgcgtggtcggccgacctctcgtccgcgctgtacaacgtggacggctggggcgcgccgtacttcttcgtcaacgacgacggcgacgtcgccgtgcgcccgcacggcgccgcaaccctgcccgggcaggagatcgacctcgccaaggtggtggccaaggccgccggcccgcgctccggcggcgggctcggcctgccgctccccctgctggtgcggttccccgacgtgctccgccaccgcgtggaggccctgaacgcggcgttcgactacgccgtgcgctccaccggctatggcgggaggtaccagggcgtgtaccccgtcaagtgcaaccaggaccgccacgtcgtggaggacattgtggagttcggcgagccgttccgcttcggcctggaggccggctccaagcccgagctgctgctcgccatgagctgcctcgccgcgcgcggcaacccggacgccctgctcatctgcaacggctacaaggacgacgagtacgtctcgctcgcgctcatcgcgcgcaccatggggctcaacacggtcatcgtgctcgagcaggaggaggagctcgacattgtggtcgacgctagccgccgcctcggcgtgcgcccggtggtcggcatgcgcgccaagctgcgcaccaagcacgccggccacttcggctccacgtccggggagaagggcaagttcggcctcaacgccgcgcagattctctccgtcgtcgccaagctcaagacccttggtatgctcgactgcctccagctcctgcacttccacattggctcccagatcccgaccactgctctgctcggcgatggcgtcggggaggccgcgcagatctactgcgagctcgcccgcctgggcgcggccatgcgcgtcatcgacgttggtggaggcctcggcattgactacgacgggagtcactcggcgcagaccgacatgtccgtggcatacagcttggaggagtacgcggcggccgtggtggccgccgtcggccgcgtctgtgaccgcaagggcgtcgcgcatcccatcatctgcagcgagagcggccgcgcgctggtgtcgcaccactctgtcctggtgttcgaggccttctcggcttcggcgcccggccgcattgacccggccacgggctacctgctcgacgagctcaccgacgactgccacgccgactaccgcaacctcatggccgccgcggtgcgcggcgacttcgacacctgcgctctgtacgccgaccagctgaagcggcgctgcgccgatcagttcaaggacggcgttcttggcctggagcacctcgccgcggtggacagcctctgcgagatcgtcgcccgcggcatgggcgccgccgagccgccgcgcacgtaccacatcaacctgtccgtgttcacctccctgccggacatgtgggcgatcgggcagatgttcccgatcatcccaatccagcgcctcggtgagcgccctgcggtcgacggcgtcctctccgacctcacctgcgacagcgacggcaaggtcgaccacttcatcggcgggaggcacagcctgccgctgcacgagctccccgtccacggcacccgcggctactacctcggcatgttcctcggcggcgcctaccaggaggccctcggcggcctccacaacctgttcggcgggccgagcgtggtgcgcgtgtcgcagagcgacgggccgcactgcttcgccgtcacgcgcgcggcggcggggccgtcgtgcgccgacgtgctccgctcgatgcagcacgagcccgaggtgatgttcgaggtgctcaagcagaggaccgacggcgccaccgccgccgcgctcgccagggcgttcggcgcaatgccgtacctgtcgttcgacccggaggccgcggcgatggccagcggggagagcagcggcatgagcagcgactcggaggggtcggccgccggcgcggcggaggaggatgacgacgagtgggagttcatgcgggggctcaccgtgtgaccgaggcagccatcgccggcttcttggtgttcacgcgaggagttcttgcacctccttctcctcctccattgtacctgtcgcactgagcagtcgtcgtcgccgtcgtgttcgtcgccgtcgccgacggtaatctccacccagtgtgtggttgtatcgtgtcatggtcgttgtcgtcgggcgtctcgtcgccgtagtctcgccggagtttctggcgccacctttttatttcgcaagcgtcagtgtccactgtttcgctctccttttgaaatttcatcagagaataagatgaggaacaaataagtttcgttcgattattagttgcttcattcatttcatttcatgacaattttttaccattgttcattttggatgcaatgagatgagaattttgtttttgtttcgttttaataatttctctctctctctccaaagatttcaatctttgagcagtggatggatgcaacgagatgagatgatgagattgggatgtgtgggattggtaggggcgtctcaatctcctcgatctccatccccctcttgtccattgtattttttctctcttagaattcaacatggcaaggacgacaataatacatgcaaagtccag

SEQ ID NO: 3166 - DNA, 3362 bp, Oryza sativa
ctcgcatttcccatctcatctctcgctcgctcgctcgctcgccgctacgcctcacgattccgacgactccgacgccggtagggtcataacaccctcctagacgccggcgacgacgagggtggttgggttgtggatagcggctgcgacgacgagggcgctctcctgaccgccggcgtggggtgccccagctccaccaccggcgacgactcctcctccgccgcgagcgctcccccagcctgcttcttttgcgggggtagccggggctccggcctcggcggctttcaaagcccccttcctcacaacaggatccaaaatcccgtcctagagttcttctacctccccttccaaaacttcctcttttggcatccttgattcaatttcccttccctttctttctttctttctttctttctttcgatttcttcttcttgctttagatttcttatccttcttcttgttgctaatctcgatcgatccatctatccatccaaacaacctcattcttttttcctttgatttgattcttcgctgctaacgccaccgaaacagacaacagatttacagcaaaagaaaaaaaaagaaggaaggctaacctttttctgtggattttagcgttctccggtttgtgacgagatgcctgcgctcgccgtggacgccgctgcacctgtcgcgcacgccttcgcgtgcgacgcggcgcgcttccccgcgccgctgctgggccccgccgccgcggctgcggcggtggcggagaagccggacgcggccgcgtggtcggccgacctctcgtccgcgctgtacaacgtggacggctggggcgcgccgtacttcttcgtcaacgacgacggcgacgtcgccgtgcgcccgcacggcgccgcaaccctgcccgggcaggagatcgacctcgccaaggtggtggccaaggccgccggcccgcgctccggcggcgggctcggcctgccgctccccctgctggtgcggttccccgacgtgctccgccaccgcgtggaggccctgaacgcggcgttcgactacgccgtgcgctccaccggctatggcgggaggtaccagggcgtgtaccccgtcaagtgcaaccaggaccgccacgtcgtggaggacattgtggagttcggcgagccgttccgcttcggcctggaggccggctccaagcccgagctgctgctcgccatgagctgcctcgccgcgcgcggcaacccggacgccctgctcatctgcaacggctacaaggacgacgagtacgtctcgctcgcgctcatcgcgcgcaccatggggctcaacacggtcatcgtgctcgagcaggaggaggagctcgacattgtggtcgacgctagccgccgcctcggcgtgcgcccggtggtcggcatgcgcgccaagctgcgcaccaagcacgccggccacttcggctccacgtccggggagaagggcaagttcggcctcaacgccgcgcagattctctccgtcgtcgccaagctcaagacccttggtatgctcgactgcctccagctcctgcacttccacattggctcccagatcccgaccactgctctgctcggcgatggcgtcggggaggccgcgcagatctactgcgagctcgcccgcctgggcgcggccatgcgcgtcatcgacgttggtggaggcctcggcattgactacgacgggagtcactcggcgcagaccgacatgtccgtggcatacagcttggaggagtacgcggcggccgtggtggccgccgtcggccgcgtctgtgaccgcaagggcgtcgcgcatcccatcatctgcagcgagagcggccgcgcgctggtgtcgcaccactctgtcctggtgttcgaggccttctcggcttcggcgcccggccgcattgacccggccacgggctacctgctcgacgagctcaccgacgactgccacgccgactaccgcaacctcatggccgccgcggtgcgcggcgacttcgacacctgcgctctgtacgccgaccagctgaagcggcgctgcgccgatcagttcaaggacggcgttcttggcctggagcacctcgccgcggtggacagcctctgcgagatcgtcgcccgcggcatgggcgccgccgagccgccgcgcacgtaccacatcaacctgtccgtgttcacctccctgccggacatgtgggcgatcgggcagatgttcccgatcatcccaatccagcgcctcggtgagcgccctgcggtcgacggcgtcctctccgacctcacctgcgacagcgacggcaaggtcgaccacttcatcggcgggaggcacagcctgccgctgcacgagctccccgtccacggcacccgcggctactacctcggcatgttcctcggcggcgcctaccaggaggccctcggcggcctccacaacctgttcggcgggccgagcgtggtgcgcgtgtcgcagagcgacgggccgcactgcttcgccgtcacgcgcgcggcggcggggccgtcgtgcgccgacgtgctccgctcgatgcagcacgagcccgaggtgatgttcgaggtgctcaagcagaggaccgacggcgccaccgccgccgcgctcgccagggcgttcggcgcaatgccgtacctgtcgttcgacccggaggccgcggcgatggccagcggggagagcagcggcatgagcagcgactcggaggggtcggccgccggcgcggcggaggaggatgacgacgagtgggagttcatgcgggggctcaccgtgtgaccgaggcagccatcgccggcttcttggtgttcacgcgaggagttcttgcacctccttctcctcctccattgtacctgtcgcactgagcagtcgtcgtcgccgtcgtgttcgtcgccgtcgccgacggtaatctccacccagtgtgtggttgtatcgtgtcatggtcgttgtcgtcgggcgtctcgtcgccgtagtctcgccggagtttctggcgccacctttttatttcgcaagcgtcagtgtccactgtttcgctctccttttgaaatttcatcagagaataagatgaggaacaaataagtttcgttcgattattagttgcttcattcatttcatttcatgacaattttttaccattgttcattttggatgcaatgagatgagaattttgtttttgtttcgttttaataatttctctctctctctccaaagatttcaatctttgagcagtggatggatgcaacgagatgagatgatgagattgggatgtgtgggattggtaggggcgtctcaatctcctcgatctccatccccctcttgtccattgtattttttctctcttagaattcaacatggcaaggacgacaataatacatgcaaagtccagaaaagattttgcc

SEQ ID NO: 3167 - DNA, 2589 bp, Oryza sativa
taaaacgaaacaaaaacaaaattctcatctcattgcatccaaaatgaacaatggtaaaaaattgtcatgaaatgaaatgaatgaagcaactaataatcgaacgaaacttatttgttcctcatcttattctctgatgaaatttcaaaaggagagcgaaacagtggacactgacgcttgcgaaataaaaaggtggcgccagaaactccggcgagactacggcgacgagacgcccgacgacaacgaccatgacacgatacaaccacacactgggtggagattaccgtcggcgacggcgacgaacacgacggcgacgacgactgctcagtgcgacaggtacaatggaggaggagaaggaggtgcaagaactcctcgcgtgaacaccaagaagccggcgatggctgcctcggtcacacggtgagcccccgcatgaactcccactcgtcgtcatcctcctccgccgcgccggcggccgacccctccgagtcgctgctcatgccgctgctctccccgctggccatcgccgcggcctccgggtcgaacgacaggtacggcattgcgccgaacgccctggcgagcgcggcggcggtggcgccgtcggtcctctgcttgagcacctcgaacatcacctcgggctcgtgctgcatcgagcggagcacgtcggcgcacgacggccccgccgccgcgcgcgtgacggcgaagcagtgcggcccgtcgctctgcgacacgcgcaccacgctcggcccgccgaacaggttgtggaggccgccgagggcctcctggtaggcgccgccgaggaacatgccgaggtagtagccgcgggtgccgtggacggggagctcgtgcagcggcaggctgtgcctcccgccgatgaagtggtcgaccttgccgtcgctgtcgcaggtgaggtcggagaggacgccgtcgaccgcagggcgctcaccgaggcgctggattgggatgatcgggaacatctgcccgatcgcccacatgtccggcagggaggtgaacacggacaggttgatgtggtacgtgcgcggcggctcggcggcgcccatgccgcgggcgacgatctcgcagaggctgtccaccgcggcgaggtgctccaggccaagaacgccgtccttgaactgatcggcgcagcgccgcttcagctggtcggcgtacagagcgcaggtgtcgaagtcgccgcgcaccgcggcggccatgaggttgcggtagtcggcgtggcagtcgtcggtgagctcgtcgagcaggtagcccgtggccgggtcaatgcggccgggcgccgaagccgagaaggcctcgaacaccaggacagagtggtgcgacaccagcgcgcggccgctctcgctgcagatgatgggatgcgcgacgcccttgcggtcacagacgcggccgacggcggccaccacggccgccgcgtactcctccaagctgtatgccacggacatgtcggtctgcgccgagtgactcccgtcgtagtcaatgccgaggcctccaccaacgtcgatgacgcgcatggccgcgcccaggcgggcgagctcgcagtagatctgcgcggcctccccgacgccatcgccgagcagagcagtggtcgggatctgggagccaatgtggaagtgcaggagctggaggcagtcgagcataccaagggtcttgagcttggcgacgacggagagaatctgcgcggcgttgaggccgaacttgcccttctccccggacgtggagccgaagtggccggcgtgcttggtgcgcagcttggcgcgcatgccgaccaccgggcgcacgccgaggcggcggctagcgtcgaccacaatgtcgagctcctcctcctgctcgagcacgatgaccgtgttgagccccatggtgcgcgcgatgagcgcgagcgagacgtactcgtcgtccttgtagccgttgcagatgagcagggcgtccgggttgccgcgcgcggcgaggcagctcatggcgagcagcagctcgggcttggagccggcctccaggccgaagcggaacggctcgccgaactccacaatgtcctccacgacgtggcggtcctggttgcacttgacggggtacacgccctggtacctcccgccatagccggtggagcgcacggcgtagtcgaacgccgcgttcagggcctccacgcggtggcggagcacgtcggggaaccgcaccagcagggggagcggcaggccgagcccgccgccggagcgcgggccggcggccttggccaccaccttggcgaggtcgatctcctgcccgggcagggttgcggcgccgtgcgggcgcacggcgacgtcgccgtcgtcgttgacgaagaagtacggcgcgccccagccgtccacgttgtacagcgcggacgagaggtcggccgaccacgcggccgcgtccggcttctccgccaccgccgcagccgcggcggcggggcccagcagcggcgcggggaagcgcgccgcgtcgcacgcgaaggcgtgcgcgacaggtgcagcggcgtccacggcgagcgcaggcatctcgtcacaaaccggagaacgctaaaatccacagaaaaaggttagccttccttctttttttttcttttgctgt

SEQ ID NO: 3168 - DNA, 2852 bp, Leymus cinereus x Leymus triticoides
gcaaaccctagccgccgcctcggcccgccgttttcttcgccccgaccgaacgccggcgtggggtgcccagcctccacaaccggcgacgcgaccctccccgccgcgtgctccccacccgcctgctccttttgcgggggtagccggggctccggcctcggcggctttctaagcccccttccttacagcaggatccaaaatcccgtcctagatttcttctatctaccgttccagaacttcctcttttggcatcagtaatcgtcggaatcaacacctagatttcgattgttattatttttgccttaaattttcgttactgttcttcgttccatctacagccttttcgcctcatacaattcttttcttcttcgatttttacatcgccgctaacatcaccaccgccgccagaaacaagtagcacaaaaatttacagcacaaagaaacaaaaagactttttcccagtggattagctttgaatctccggtttgtgtgacgagatgcctgcgctcgctgtggacgctgccgcccccgtggcccacgccttcgccgcctgcgacgcggcgcgcttcgccgcgcccctgctgggccccgctgctgagaagcccgagatggccgcctggtcggccgacctctcgtcggcgctctacaacgtcgacggctggggcgcgccctacttcttcgtcaacgacgacggcgacgtcgccgtgcgcccgcacggcgccgccacgctgcccggccaggagatcgacctcgccaaggtcgtcgccagggccgccggcgcgcgcaccggcggcgggctcggcctcgcgctgccgctgctcgtgcgcttccccgacgtgctgcgccaccgcgtcgagaccctcaacgccgccttcgactacgccgtgcgctccaccggctacggcgggaggtaccagggcgtctaccccgtcaagtgcaaccaggaccggttcgtcgtcgaggacatcgtcgagttcggcgcgccctacggcttcggcctcgaggccggctccaagcccgagctgctgctcaccatgagctgcctcgtcgcccgcggcagccccgacgccctgctcatctgcaacggctacaaggacctcgagtacgtctcgctcgcgctcatcgcccgcaccatgggcctcaacaccgtcatcgtgctcgagcaggaggaggagctcgacattgtcgtcgaggccagtcgccgcctcaacatccgccccgtggttggcatgcgcgccaagctacgcaccaagcacgccggccacttcggcgccacctccggggagaaaggcaagttcggcctcaacgccgcgcagattctctccgtggtggccaagctcaaggccctcggcatgctcgactgcctccagctcctgcacttccacattggctcccagatcccgaccaccgctctgctcgccgacggcgtcggcgaggccgcgcagatctactgcgagctcgcccgcctcggcgctgccatgcgcgtgattgacgttggtggcggcctcggcatcgactacgacgggacgcactcggcgcagaccgacatgtcggtggcgtacagcttggaggagtacgcggcggccgtggtcgccgccgtcggccgcgtgtgcgaccgcaagggcgtgcagcaccctgtcatctgcagcgagagcggccgtgcgctggtgtcgcaccactcggtcctcatcttcgaggccttttcggcgacggcgcccgcttccgacatgatggacccagccaccgcctacctgctcgacgagctcaccgacgactgccgcaacgactaccgcaacctcatggcctccgccgtgcgcggcgacttcgatacctgcggtctgtacgccgaccagctgaagcggcgctgcgctgagcagttcaaggagggactcctcggcctggagcacctcgccgccgtcgacgggctctgcgagatcgtcgcccgcggtatgggcgcggtggaggggccgcgcaggtaccacatcaacctgtccgtgttcacctccctgccggacatgtgggccatcgagcagctcttccccatcatcccgatccagcgcctccaggagcgccccgccgtgaacggcgtcctctcggacctgacctgcgacagcgacggcaaggtggaccagttcatcggcggccggaacagcctccccctgcacgagctccccagccacggcacccgcggctactacctgggcatgttcctgggcggcgcctaccaggaggcgctcggcggcctgcacaacctgttcggcgggccgagcgtggtgcgcgtgtcgcagagcgacggcccacactgcttcgccgtgacgcgcgccgcgccaggcccgtcctgcgccgacgtgctccgcgccatgcagcacgagcccgaggtgatgttcgaggtgctcaagcagaggaccaccgacgacggcgccaccgccacggcgctcgccagggcgttcgggtcaatgccgtacctgtcgttcgactccgaggaggcggcgatgagcggcgcggagtccagcggcatgagcagtgactcggaggggtcggcagccggcgccgccgaggatgatgatgaagagtgggagttcatgcgcgggctcaccgtgtgagggcgtccctctcctgtatctatcgccggtccaactggccggtgatgtttaccagcggcagctgccggtgttgtatcgtgtcatggtcgtagtgaggtcgtcgggcgtctcgtcgtcgtttagtttcgccggagtttgttttggcgccatctttttatttcccaagcgtcagtccactgtttggttcaacctttttcttggaataacaaaaggaaactagtagtactatgtttctttcgattacaattatta

SEQ ID NO: 3169 - DNA, 3150 bp, Secale cereale
gatcgatcctccatctctccatccacccacccagcgagcgagcgagcaggcaagagcaaaccctagcgccgccgtcggttccgcaagttttctccaaccccgactgaacgccggcgtggggagcccagcctccacaaccggcgccgcgaccctccccgccgcgcgctccccgcccgcctgcaacttttgcgggggtagccggggctccggcctcggcggctttctaagcccccttccttacaacaggatccaaaatcccgtcctagatttcttctatctccccttccagaacttcctcttttggcatcagtgatcctcggaatctcatcgccttagatcgatttcgattgttattatcactgacttttttccccttaattttcttcgctcttcttcgttcgatccacacaccattcttttcttcttcatccgattctgatttttccccaccgtctagaagcaaatagcagaaaagttcctgacaacagcacaaagaaacagaaaaatttcctgactttttcccagtggattagctttctccggtactaagtttgtgtgacgagatgcctgcgctcgctgtcgacgccgctgcccccgtggcccacgccttcgccgcgtgcggcgacgcggcgcacttcgccgctcctctgctgggccccgccgccgtcgttgcggccgccgagaagcccgagatggccgcctggtcggccgacctctcgtcggcgctctacaacgtcgacggctggggcgcgccctacttcttcgtcaacgacgacggcgacgtcgcggtgcgcccgcacggggccgccacgctgcccggccaggagatcgacctcgccaaggtggtcgccagggcggccggcgcgcgcgcggcaggcgggctcggcctcgcgctgcccctgctcgtgcgcttccccgacgtgctccgccaccgcgtcgagaccctcaacgccgccttcgactacgccgtgcgctccacgggctacggtgggaggtaccagggcgtctaccccgtcaagtgcaaccaggaccgctacgtcgtcgaggacatcgtcgagttcggggcccccttcggcttcggcctcgaggccggctccaagcccgagctgctgctcaccatgagctgcctcgtcgcccgcggcagccccgacgccctgctcatctgcaacggctacaaggacctcgagtacgtctcgctcgcgctcatcgcccgcaccatgggcctcaacaccgtcatcgtgctcgagcaggaggaggagctcgacattgtcgtcgaggccagccgccgcctcaacatccgccccgtggtgggcatgcgcgccaagctccgcaccaagcacgccggccacttcggggccacctccggcgagaagggcaagttcggcctcaacgccgcgcagattctctccgtggtcgccaagctcaaggccctcggcatgctcgactgcctccagctcctgcacttccacattggctcccagatcccgaccaccgccctgctcgctgacggcgtcggcgaggccgcgcagatctactgcgagctcgcccgcctcggcgcggccatgcgcgtcattgacgttggtggcggcctcggcatcgactacgacgggacgcactctgcgcagaccgacatgtcggtggcctacagcctggaggagtacgcggcggccgtggtcgccgccgtcggccgcgtctgcgaccgcaagggcgtgcagcaccctgtcatctgcagcgagagcggccgcgcgctggtgtcgcaccactcggtcctcatcttcgaggccttctccgcgacggcgcctgcttccaacatgatggacccggccaccgcctacctgctcgacgagctcaccgacgactgccgcagcgactaccgcaacctcatggcctccgccgtgcgcggcgacttcgacacctgcggtttgtacgccgaccagctgaagcggcgctgcgccgagcagttcaaggagggggtcctcggcctggagcacctcgccgccgtggacgggctctgcgagatcgtcgcccgcggcatgggcgcggcggaggggccgcgcaggtaccacatcaacctgtccgtgttcacctccctgccggacatgtgggccatcgagcagctcttccccatcattcccatccagcgcctccaggagcgcccggcggtgaacggcgtgctctcggacctgacctgcgacagcgacggcaaggtggaccagttcatcggcggcaggagcagcctccctctgcacgagctgcccagccacggcacccgcggctactacctgggcatgttcctgggcggcgcctaccaggaggctctcggcggcctgcacaacctgttcggcgggccgagcgtggtgcgcgtctcccagagcgacgggccacactgcttcgccgtgacgcgcgccgcgccgggcccgtcctgcgccgacgtgctccgcgccatgcagcacgagccggaggtgatgttcgaggtgctcaagcagaggactaccgacgacggcgccacggccgcggccctggccagggcgttcgggtcaatgccgtacctgtcgttcgacgcggaggaggcctcggcgatgagcggcgcggagtcgagcggcatgagcagcgactcggaggggtcggcggccggcgcggccgaggacgacgacgaggagtgggagttcatgcgcgggctcaccgtgtgaccacggccagctcttcaccctcctgtatctgtcgccggtccaaccggccggtgacgtttaccttacctgccagccagccagcggcggctgccggtgttgtatcgtgtcactcgtggtcgtagcgaggtcgtcgggcgtctcgtcgccgtttagtttcaccgccggagttcgttttggcgccacctttttattccccatgcgtcggtccactgtttcgttcatctttttctcttggaataaataacaaaaggaaactagcagtactatgtttctttcgattcacaattgtttactcctccagctcttcatttctccgtggcaatgctccgtgggttcgtggctgtgatcacttggtatgggtgtgtggtctcagtctcctcgatatgcatccccgtcgactgtaattttctctcttggagttcagaccgggaaatgaacagagaagttccaaaaaaaagtc

SEQ ID NO: 3170 - DNA, 3078 bp, Hordeum vulgare
attcatcccatcccaccgcaaccgtctcccctcgctcgctcgctcgctcgtccatctcccatatctcgccgcagcgcgcgcatcagcacagcagagatccctccaccgcccggcgagcgaaagcaaaacctagcgccgcctcggctcgccgtccccgccgtcttcttcgcatccgactgaacgccggcgtggggtgcccagcctccacaaccggcgacgcgaccctccccgccgcgcgctccccacccgcctgctccttttgcgggggtagccggggctccggcctcggcggctttctaagcccccttccttacaacaggatccaaaatcccgtcctagatttcttctacctccccttccagaacttcctcttttggcatcagtgatcgccggaatctccccctcccccccagtagatttcgtcgattccttgttgtaatttttgcctccattttcttcttcttcttccttcgatcgatcgatctacagccggtttcgcctcatacagattcttttcttcttcgagatttgtccattccatcgccgctaacctccgtcgccgccaccagaaacaaacagcacagagattaacgtatacagcacaaagaaacaaaaaaaattcctgacttttcccccccttcccagtggattagctttctccggtttgtgacgagatgcctgcgctcgctgtggacgctgccgcccccgtggcccacgccttcgccgcgtgcgacgcgtcgccgcgtttcgccgctcccctgctgggccccgccgccgtggtggttgccgcggccgctgccgagaagcccgagatggccgcgtggtcggccgacctctcgtcggcgctctacaacgtggacggctggggcgccccctacttcttcgtcaacgacgacggcgacgtcgccgtgcgcccgcacggcgccgccacgctgcccggccaggagatcgacctcgccaaggtcgtcgccagggccgccggtgcgcgctccggcggcgggctcgggctcgcgcttccgctgctcgtgcgcttccccgacgtgctccgccaccgggtcgagaccttgaacgccgccttcgactacgccgtgcgctccaccggctacgccgggaggtaccagggcgtctaccccgtcaagtgcaaccaggaccgctacgtcgtcgaggacatcgttgagttcggtgcgcccttcgggttcggcctcgaggccggctccaagcccgagctgctgctcaccatgagctgcctcgtcgcccgcggcagccccgacgccctgctcatctgcaacggctacaaggacctcgagtacgtctcgctcgcgctcatcgcccgcaccatgggcctcaacaccgtcatcgtgctcgagcaggaggaggagctcgacattgtcgtcgaggccagccgccgcctcaacatccgccccgtcgtcggcatgcgcgccaagctgcgcaccaagcacgccggccacttcggcgccacctccggcgagaagggcaagttcggcctcaacgccgcgcagattctctccgtggtggccaagctcaaggccctcggcatgctcgactgcctccagctcctgcacttccacattggctcccagatcccgaccaccgctctgctcgccgacggcgtcggcgaggccgcgcagatctactgcgagctcgcccgactcggcgcggccatgcgcgtcattgacgttggtggcggcctcggcatcgactacgacgggacgcactctgcggagaccgacatgtcggtggcctacagcctggaggagtacgcggcggccgtggttgccgccgtcggccgcgtctgcgaccgcaagggcgtgcagcaccctgtcatctgcagcgagagcggccgcgcgctggtgtcgcaccactcggtcctcatcttcgaggccttctccgcgacggcgccggcttccaacatgatggacccggccaccgcctacctgctcgacgagctcaccgacgactgccgcaacgactaccgcaacctcatggcgtccgccgtgcgcggcgacttcgacacctgcggcctgtacgccgaccagctgaagcggcgctgcgccgagcagttcaaggagggggtcctcggcctggagcacctcgccgccgtggacgggctctgcgagatcgtcgcccgcggcatgggcgcggcggaggggccgcgcaggtaccacatcaacctgtcggtgttcacctccctgccggacatgtgggcgatcgagcagctgttccccatcatccccatccagcgcctccaggagcgcccagccgtggacggcgtgctctcggacctgacctgcgacagcgacggcaaggtggaccagttcatcggcggcaggagcagcctcccactgcacgagctcccgagccacggcacccgcggctactacctgggcatgttcctgggcggcgcctaccaggaggcgctgggcggcctgcacaacctgttcggcgggccgagcgtggtgcgcgtgtcgcagagcgacgggccacactgcttcgccgtgacgcgcgccgcgccggggccgtcctgcgccgacgtgctccgcgccatgcagcacgagccggaggtgatgttcgaggtgctcaagcagaggaccaccgacgacggcgcgaccgcggcggccctcgccagggcgttcgggtcaatgccgtacctgtcgttcgacgccgaggaggcggcggcgatgagcagcgcggagtcgagcggcatgagcagcgactcggaggggtcggcggccggcgccgccgaggacgatgacgaggagtgggagttcatgcgcgggctcaccgtgtgacggcgagctcttttctgtacctattatcaccggcccaaccggccggtgatgtttaccagccagcggcagcagccggtgttgtatcgtgtccatggtcgtagtgaggtcgtcgggcgtctcgtcgccgtttagtttcgccgccggagtttgttttggcgccacctttttcattcccatgcgtcagtccactgtttcgttcgtccctttttttctcttggaataacaaaaggaaactagcactactatgtttctttcgattacagaatta

SEQ ID NO: 3171 - DNA, 2945 bp, Triticum aestivum
cgccgcgcgccccccgcccgcctgcaacttttgcgggggtagccggggctccggcctcggcggctttctaagcccccttccttacaacaggatccaaaatcccgtcctagatttcttctacctccccttccagaacttcctcttttggcatcagtgatcgtcggaatctcaacacccgccagtagatttcgatcgtcataattactgactttttgccgtaattttcttcttcgctgttcgtcgatcgatctacagctttttcgccacacacaattcttttcttcttcgatttttccatcaccagaaacgaatagcagagaaattcctgactacagcacaaagaaacaaaaaagatttctgacttttttccccagcggattagctttctccggttgttaattccgtgacgagatgcctgcgctcgctgtcgacgccgccgcccccgtggcccacgccttcgccgcgtgctgcgacgcgtcgccgcgcttcgccgcgccgctgctgggccccgccgccgccgtcgtcgctgccacggccgccgagaagcccgagatggccgcgtggtcggccgacctctcgtcggcgctctacaacgtcgacggctggggcgcgccctacttcttcgtcaacgacgacggcgacgtcgcggtgcgcccgcacggcgccgccacgctccccggccaggagatcgacctcgccaaggtggtcgcccgggccgccggcgcgcgcgccggcggcgggctcggcctcgcgctgccgctgctcgtgcgcttccccgacgtgctgcgccaccgcgtcgagaccctcaacgccgccttcgcctacgccgtgcgctccacgggctacgccgggcggtaccagggcgtctaccccgtcaagtgcaaccaggaccggtacgtggtggaggacatcgtcgagttcggcgcgcccttcgggttcggcctcgaggccggctccaagcccgagctgctgctcaccatgagctgcctcgtcgcccgcggcagccccgacgccctgctcatctgcaacggctacaaggacctcgagtacgtctcgctcgcgctcatcgcccgcaccatgggcctcaacaccgtcatcgtgctcgagcaggaggaggagctcgacattgtcgtcgaggccagccgccgcctcaacatccgcccggtggtcggcatgcgcgccaagctgcgcaccaagcacgccggccacttcggcgccacctccggcgagaagggcaagttcggcctcaacgccgcgcagattctctccgtggtggccaagctcaaggccctcgccatgctcgactgcctccagctcctgcacttccacattggctcccagatccccaccaccgccctgctcgccgacggcgttggcgaggccgcgcagatctactgcgagctcgcccgcctcggcgcggccatgcgcgtcattgacgtcggcggcggcctcggcatcgactacgacgggacgcactcggcgcagaccgacatgtcggtggcctacagcctggaggagtacgcggcggccgtggtcgccgccgtcggccgcgtctgcgaccgcaagggcgtgcagcaccctgtcatctgcagcgagagcggccgcgcgctggtgtcgcaccactcggtcctcatcttcgaggccttctccgcgacggcgccggcttccaacatgatggacccggccaccgcctacctgctcgacgagctcaccgacgactgccgcagcgactaccgcaacctcatggcctccgccgtgcgcggcgacttcgacacctgcggcctgtacgcggaccagctgaagcggcgctgcgccgagcagttcaaggagggggtcctcgggctggagcacctcgccgccgtggacgggctctgcgagatcgtcgcccgcggcatgggcgcggcggaggggccgcgcaggtaccacatcaacctgtcggtgttcacctcgctgccggacatgtgggccatcgagcagctcttccccatcatccccatccagcgcctccaggagcggcccgccgtggacggcgtgctctcggacctgacctgcgacagcgacggcaaggtggaccagttcatcggcggcaggagcagcctccccctgcacgagctcccgacccacggcacccgcggctactacctgggcatgttcctgggcggcgcctaccaggaggcgctgggcggcctgcacaacctgttcggcgggccgagcgtggtgcgcgtctcccagagcgacgggccacactgcttcgccgtgacgcgcgccgcgccaggcccgtcgtgcgccgacgtgctccgcgccatgcagcacgagccggaggtgatgttcgaggtgctcaagcagaggaccaccgacgacggcgccaccgccgcggcgctcgccagggcgttcgggtcaatgccgtacctgtcgttcgacgccgaggaggcctcggccatgagcggcgcggagtcgagcggcatgagcagcgactcggaggggtcggctgccggcgccgccgaggatgatgacgaggagtgggagttcatgcgcgggctcaccgtgtgagggcgagctctttctatatctatcaccggtccaaccggccggtgatgttgtatcgtgtcactcatggtcgtagcgaggtcgtcgggcgtctcgtcgccgtttagtttcgccggagtttgttttggcgccatcttttttatttcccatgcgtcggtccactgtttctttcacccttttcttcttggaataaataacaaaaggaaactagcagtagtatgtttctttcgaatacaattgtttaccccagctcttcgtttcttcgtgacaatgctcggtggattcgtggatgtggtctcaatctcctcgatctccatccctgtcgactgtaattttgtttctccaagttcagacctggaaatgcacagcagagaggttccaaaaggaaattggccctg

SEQ ID NO: 3172 - DNA, 2478 bp, Avena sativa
ctttctccggtttgtgacgagatgcctgcgctagctgtggacgccacggcacctgtcgcgcacgcgttcggcgcgtgtgacgcggcgcgcttcgccgcaccgctgctgggccccgcggacgtcctccccgcggctgagaagcccgcctggtcgcccgacctctcctcggcgctctacaacgtcgacggctggggcgcgccctacttcttcgtcaacgacgacggcgacatcgccgtgcgcccgcacggcgccgccacgctgcccggccaggagatcgacctcgccaaggtcgtctccagggccgccggccagctctccgccggcgggctcggcctgcccctgccgctcctggtgcgcttccccgacgtgctgcgccaccgcgtggagaccctcaacgcggcgttcaactacgccgtcagctccaccggctacggcgggaggtaccagggcgtgtaccctgtcaagtgcaaccaggacaggtacgtcgtcgaggacatcgtcgagttcggcgcccccttcggattcggcctcgaggccggctccaagcccgagctgctgctcaccatgagctgcctcgccgcccgcggcagccccgacgccctgctcatctgcaacggatacaaggacctcgagtacatctccctcgcgctcatcgcccgcaccatggggctcaacaccgtcatcgtgctcgagcaggaggaggagcttgacattgtcgtcgaggccagccgccgcctcaacatccgtcctgtggtcggcatgcgcgccaagctgcgcaccaagcatgccggccacttcggcgccacctccggggagaagggcaagttcggcctcaacgccgcggagatactctccgtcgtgtccaagctcaaggccctcggtatgctcgactgcctccagctcctgcacttccacattggctcccagatcccgaccaccgcgctgcttgccgatggcgtcggcgaggccgcgcagatttactgcgagcttgctcgccttggcgcggccatgcgtgtgattgatgttggtggcggcctcggcatcgactacgatggaactcactccgcggagacggacatgtcggtggcgtacagcttggaggagtacgccgcggctgtggtcgccgccgttggccgggtctgtgaccgcaagggcgtgcagcacccagtcatctgcagcgagagcggccgcgcgctggtgtcccaccactcggtcctcgtgttcgaggccttctctgcgtcggcgcctgcttccaacatcgactctgccacagcctacctgctggacgagctcaccgacgactgccgcggcgactaccgcaacctcatggccgccgccgtgcgcggcgacttcgagacctgcgctctgtacgccgaccagctgaagcggcgctgcgctgagcagttcaaggaaggagtccttggtctggagcaccttgctgccgtggacgggctctgcgagatcgtggcccgcggcatgggcgctgtggagcgtccacggacgtacaacatcaacctgtccgtgttcacctccatcccggacatgtgggccatcgagcagctcttccccatcatccccatccagcgcctccaggagcgccccgccgttgatggtatcctctccgacctgacatgtgacagcgacggcaaggtggaccacttcatcggcggcaggaacagcctccctctgcacgagctccccagccacggcacctgcggctactacctgggcatgttcctcggcggcgcctaccaggaggccctcggcggcctgcacaacctgttcggcggaccaagcgtggtgcgcgtgtcccagagcgacggtccgcactgcttcgcggtgacgcgcgctgctccgggcccgtcctgcgccgacgtgctccgcgccatgcaccacgagcccgaggtgatgttcgaggtgctcaagcagaggaccgacgacggcgccaccgccgccgcgctggccagggcgttcggcgcaatgccgtacctgtccttcgacaacgaggtcgtggagatggcaagcggcatgagcagcgactcggaggggtcggcggcgggcgcggccgaggatgatgatgaggagtgggagttcatgcgcgggctcaccgtgtgacgacgaggaagctttggtccctcgccttggcgctggtggtgggtgatctgaagcaagcagcagctgccagtgtctgtatcgtgtcatggtcgtgtcgtcaggcgtctcgtcgccgttagtatcgccggagtcttttttggcgccagtttttatttcacatgcgtcaccagtcagtccactgtttctcttgctgatcggttgaataagaaaaggagctagtaccaccaagtttctttcgacgaacatttctatcttttatgattataggtatgaatgagggtgtgtgtgtggactcaatccccttttatctcatttgtaatttttctgttttcaaagttgataccggaaagacatggaggaagt

SEQ ID NO: 3173 - DNA, 3385 bp, Brachypodium distachyon
cacaacggtgaccaagcgctcatctccctctcccatctctcgtttccaaccgctcgctccgtccctccgatcaaccagccaaatcccgatcgaggaagaacacaacgaacaaaccctagcgtagccgccgcagccgaaggcttccgaaaatctccttcctgaccgccggcgtggggcgactagcctccaccaccggcgacgacaccctccccgccgcgcgcgcccaacccgactgctccgtttgcgggggtagccggggctccggcctcggcggctttctaagcccccttccttacaacaggatccaaaatcccgtcctagatttcttctacctccccttccagaacttcctcttttggcatcagtgatacgccgatctcgatttatttttctttcgatttctttttcttcttcttcttgttgttcatctcgatcgaatagcaccaccgccgccttcaacaccagattttttctgttcatttcgcctgattttcttccgccgctaacacccaccgagacatcgtaaacagatttacagcacagagaaaccagaaaaaaacttcgcagcagtagcaaacttttttttttattcttcttcttcccagtggattcctagctttctccggtttgtgacgagatgcctgcgctcgccgtggacgctgctgcaactgtggcgcacgctttcaccacctgcgacgccgcggcgcgcttccctgccgcgccgctgtttgcccccgccgccgtcgttgcggcggcggcggccgccgcggacaagcccgatgtcggggctgctgcatggtccgctgacctctcctcggcgctgtacaacgtggacggctggggcgcgccctacttcttcgtcaacgacgacggcgacatcgccgtccgcccgcacggcgccgccacgctgcccggccaggagatcgacctcgccaaggtggtcgccagggccgccgggcccagcgccggcggcggcctcggcctccccctgccgctgctggtgcgcttccccgacgtgctccgccaccgcgtggagtccctcaacgccgccttcgactacgccgtgcgctccacgggctatggcgggaggtaccagggcgtgtaccctgtcaagtgcaaccaggacaggtacgtcgtggaggacattgtggagttcggcgcgcccttcggcttcggcctcgaggccggctccaagccggagctgctgctcaccatgagctgcctcgtcgcgcgcggcagccccgacgccctgctcgtctgcaacggctacaaggacctcgagtacgtctcgctcgcgctcatcgcccgcaccatggggctcaacacggtgatcgtgctcgagcaggaggaggagctcgacattgtcgtcgaggccagccgccgtctcgacatccgccccgtcgtcggcatgcgcgccaagctgcgcaccaagcacgccggccacttcggcgccacgtccggggagaagggcaagttcggcctcaacgccgcgcagatactctccgtggtctccaagctcaaggccctcggtatgctcgactgcctccagctcctgcacttccacattggctcccagatccccaccactgccctgctcgccgatggcgtcggcgaggccgcgcagatctactgcgagctcgcccgcatgggcgccgccatgcgcgtcattgacgtcggcggtggcctcggcattgactacgacgggactcactcggcgcagaccgacatgtcggtggcgtacagcctggaggagtacgcggcggccgtggtcgccgccgtcggccgcgtctgcgaccgcaagggcgtgcagcacccggtcatctgcagcgagagcggccgcgcgctggtgtcgcaccactcggtgctggtgttcgaggccttctcggcttcagcgccggcggccaacatcgactctgccaccgcctacctgttggacgagctcaccgacgactgccgcaacgactaccgcaacctcatggccgccgccgtgcgcggcgacttcgagacctgcgctctgtacgccgaccagctgaagcggcgctgcgccgagcagttcaaggaaggggtcctcggcctggagcacctggccgccgtcgacgggctctgcgagatcgtcgcccgtggcatgggcgtggcggagcgcccccgcacgtacaacatcaacctgtcagtgttcacctccctgccggacatgtgggccatcgagcagcaattccccatcatccccatccagcgcctgcaggagcggcccgccattgacggcatcctctcggacctcacctgcgacagcgacggcaaggtggaccagttcatcggcggcaggcacagcctcccgctgcacgagctccccagccacggcaccaggggctactacctcggcatgttcctcggcggcgcctaccaggaggcgctcggcggcctgcacaacctcttcggcgggccgagcgtggtgcgcgtctcgcagagcgacggcccgcactgcttcgccgtgacccgggccgcgccgggtccgtcctgcgccgacgtgctccgggcgatgcagcacgagccggaggtgatgttcgaggtgctcaagcagaggatcaccgacgacggcgccacggcggccgcgctcgccagggcgttcggcgccatgccgtacctgtcgttcggcggctccgaggtctcgctggagagcagcggcatgagcagcgactccgaggggtcggccgccggcgccgcagaggatgatgatgacgagtgggagttcatgcgcgggctcaccgtgtagcgtggcgacctctcctgtttcctgtacactggtgatctcgtggcagcccagtgcttgtatcgttccatggtcgtagtcgtcgggcgtctcgtcgccgtttattagtttcgccggagcttttttttggcgccgctctttttattccgcaagcgtcagtccactgtttgttttctctgaataacaaaaaggaaccagaacctatgtttctttcgaataattatttgttttgttttgctacacttgttgtgaacttttagagcttgtggctgcaatgagacgaagaaatggggatgggtgcagtcaagtcagtctctttgaatgctgcccatgctcgtctgatttaaagctcaaactggaagctccagaaagaaatagccaaagctttctgttattctttttcgattcttttgtcctcgtgggctgctcctgctgcttgggaatctactccatagatctattggaaacctcgagcggctcttcagtttgtccttactctttctttctgtgataaagtttgctttgccatactgtattctctttcttttctctgcacgaggcctcaagagatcaactcatcaacacgacgcagcagccgcagagcttttcgagcctagc

SEQ ID NO: 3174 - DNA, 2094 bp, Avena sativa
acggctggggcgcgccctacttcttcgtcaacgacgacggcgacatcgccgtgcgccgcacggcgccgccacgctgcccggccaggagatcgacctcgccaaggtcgtctccagggccgccggccagctctccgccggcgggctcggcctgcccctgccgctcctggtgcgcttccccgacgtgctgcgccaccgtgtggagaccctcaacgcggcgttcaactacgccgtcagctccaccggctacggcgggaggtaccagggcgtgtaccctgtcaagtgcaaccaggacaggtacgtcgtcgaggacatcgtcgagttcggcgcccccttcggattcggcctcgaggccggctccaagcccgagctgctgctcaccatgagctgcctcgccgcccgcggcagccccgacgccctgctcatctgcaacggatacaaggaccttgagtacatctccctcgcgctcatcgcccgcaccatggggctcaacaccgtcatcgtgctcgagcaggaggaggagcttgacattgtcgtcgaggccagccgccgcctcaacatccgtcctgtggtcggcatgcgcgccaagctgcgcaccaagcatgccggccacttcggcgccacctccggggagaagggcaagttcggtctcaacgccgcggagatactctccgtggtgtccaagctcaaggccctcggtatgctcgactgcctccagctcctgcacttccacattggctcccagatcccgaccaccgcgctgcttgccgatggcgtcggcgaggccgcgcagatttactgcgagcttgctcgccttggcgcggccatgcgtgtgattgatgttggtggcggcctcggcatcgactacgatggaactcactccgcggagacggacatgtcggtggcgtacagcttggaggagtacgccgcggctgtggtcgccgccgttggccgggtctgtgaccgcaagggcgtgcagcacccagtcatctgcagcgagagcggccgcgcgctggtgtcccaccactcggtcctcgtgttcgaggccttctctgcatcggcgcctgcttccaacatcgactctgccacagcctacctgctggacgagctcaccgatgactgccgcggcgactaccgcaacctcatggccgccgccgtgcgcggcgacttcgagacctgcgctctgtacgccgaccagctgaagcggcgctgcgctgagcagttcaaggaaggagtccttggtctggagcaccttgctgccgtggacgggctctgcgagatcgtcgcccgcggcatgggcgctgtggagcggccacggacgtacaacatcaacctgtccgtgttcacctccatcccggacatgtgggccatcgagcagctcttccccatcatccccatccagcgcctccaggagcgccccgccatcgacggcatcctctccgacctgacatgcgacagcgacggcaaggtggaccacttcatcggcggcaggaacagcctccctctgcacgagctccccagccatggcacctgcggctactacctgggcatgttcctcggcggcgcctaccaggaggccctcggcggcctgcacaacctgttcggtggaccaagcgtggtgcgcgtgtcccagagcgacggtccgcactgcttcgctgtgacacgcgccgcacccggtccgtcctgcgccgacgtgctccgcgccatgcaccacgagcccgaggtgatgttcgaggtgctcaagcagaggaccgacgacggcgccaccgccgccgcgctggccagggcgttcggcgcaatgccgtacctgtccttcgacaacgaggtcgtggagatggcaagcggcatgagcagcgactcggaggggtcggcggcgggcgcggccgaggatgatgatgaggagtgggagttcatgcgcgggctcaccgtgtgacgacgaggaagcagctttggtccctcgccttggcgctggtggtgatgatgccagtgtctgtatcgtgtcatggtcgtgtcgtcaggcgtctcgtcgccgttagtatcgccggagtctttctttggcgccagtttttattcacatgcgtcaccagtcgtgggagg

SEQ ID NO: 3175 - DNA, 2147 bp, Secale cereale
cggtgcgcccgcacggcgccgccacgctgcccggccaggagatcgacctcgccaaggtggtcgccagggcggccggcgcgcgcgcggcaggcgggctcggcctcgcgctgccgctgctcgtgcgcttccccgacgtgctccgccaccgcgtcgagaccctcaacgccgccttcgactacgccgtgcgctccacgggctacgccgggcggtaccagggcgtctaccccgtcaagtgcaaccaggaccgctacgtcgtcgaggacatcgtcgagttcggggcccccttcgggttcggcctcgaggccggctccaagcccgagctgctgctcaccatgagctgcctcgtcgcccgcggcagccccgacgccctgctcatctgcaacggctacaaggacctcgagtacgtctcgctcgcgctcatcgcccgcaccatgggcctcaacaccgtcatcgtgctcgagcaggaggaggagctcgacattgtcgtcgaggccagccgccgcctcaacatccgccccgtcgtgggcatgcgcgccaagctccgcaccaagcacgccggccacttcggcgccacctccggcgagaagggcaagttcggcctcaacgccgcgcagattctctccgtggtcgccaagctcaaggccctcggcatgctcgactgcctccagctcctgcacttccacattggctcccagatcccgaccaccgctctgctcgccgacggcgtcggcgaggccgcgcagatctactgcgagctcgcccgcctcggcgcggccatgcgcgtcattgacgtcggtggcggcctcggcatcgactacgacgggacgcactctgcgcagaccgacatgtcggtggcatacagcctggaggagtacgcggcggccgtggtcgccgccgtcggccgcgtctgcgaccgcaagggcgtgcagcaccctgtcatctgcagcgagagcgggcgcgcgctggtgtcgcaccactcggtcctcatcttcgaggccttctccgcgacggcgcctgcttccaacatgatggacccggccaccgcctacctgctggacgagctcaccgacgactgccgcagcgactaccgcaacctcatggcctccgccgtgcgcggcgacttcgacacctgcggcctgtacgccgaccagctgaagcggcgctgcgccgagcagttcaaggagggggtcctcgggctggagcacctcgccgccgtggacgggctctgcgagatcgtcgcccgcggcatgggcgcggcggaggggccgcgcaggtaccaaatcaacctgtccgtgttcacctccctgccggacatgtgggccatcgagcagctcttccccatcatccccatccagcgcctccaggagcgcccggccgtggacggcgtgctctcggacctgacctgcgacagcgacggcaaggtggaccagttcatcggcggcaggagcagcctccccctgcacgagctccccagccacggcacccgcggctactacctgggcatgttcctgggcggcgcctaccaggaggctctcggcggcctgcacaacctgttcggcgggccgagcgtggtgcgcgtctcccagagcgacgggccacactgcttcgccgtgacgcgcgcggcgccgggcccgtcctgcgccgacgtgctccgcgccatgcagcacgagccggaggtgatgttcgaggtgctcaagcagaggaccaccgacgacggcgccacggccgcggccctggccagggcgttcgggtcaatgccgtacctgtcgttcgacgccgccgaggaggcctcggccatgagcggcgcggagtcgagcggcatgagcagcgactcggaggggtcggcggccggcgcggccgaggacgacgacgaggagtgggagttcatgcgcgggctcaccgtgtgaccacggccagctcttcactctcctgtatctgtcgccggtccaaccggccggtgacgtttaccttaccagcaagccagcggcagctgccggtgttgtatcgtgtcactcgtggtcgtagtgaggtcgtcgggcgtctcgtcgccgtttagtttcaccgccggagttcgttttggcgccacctttttattccccatgcgtcggtccactgtttcgttcatctttttctcttggaataaataa

SEQ ID NO: 3176 - DNA, 2044 bp, Saccharum officinarum
tctgcccaacaatagatagctcacctcacctcacctcacctccgcacccgctgtttcgtgcaccgcacttcaccccccaccaacctccccccctcaaaaactatccaccccaccccaccccacctctacccgccgacgagcgcgatcgattgattcggttcgagccgggcggaggagggagcgccgggcggcggggggagcccaccagatccggcggctatgatgaagtcgctgctgccgcagagccagctgcggcgctcgtcggcggcggccgtgcgctcgtcgggcggcggcgcagcgggggcagacggggctatggccgacggcggcggggcggggccgcgggcgcccgcctcctccaccttctggttcctgctccacgcgctctgctgcctcatctcgctcttcctcggcttccgcttctcgcggctcctcttcttcatgctcttctccaccaccgcgctctaccactccaccacctcctcctcctcggacgcggtcctgcgcgccatcacgactaccaccacgacgaccacgacgacgaccacgacgaccaacaccttcacgctctgcttcgccgccggcaacactcccccctccggccccgctaatcgcaccgcgctggaggcggccgacaacaagggggcggcgtcgtccgggaacccgcagagccacgtcgtggtggggaggcacgggattcggatccggccgtggccgcacccggaccccgtcgaggtgatgcgcgcgcaccggatcatggagcgcgtgcaggaggagcagcgccgctggtacggcgtcaaggagcccaggcaggtgctcgtcgtcaccccgacctactcccgcgcgttccaggcgctccacctcaccggcctcctccactccctccgcaacgtgccgtacccgctcacctggatcgtcgtcgaggcaggcggcaccaccaacgccacggcgtcgatgcttgcgcgctctggcctcactttcgtccacatccccttccctgaccgcatgccccacgaatgggccgaccgtcacgccactgagaaccggatgcgcctccacgccctacgcgtgatccgtgagaggaagatggatggtgtagttgtgtttgcggacgacagcaatgttcatagcatggagctgttcgatgaggtgcagaaggtccagtggatgggtgctgtatccgttggaattcttgcgcatactggaacggcagaccaactacggctcagcgaggaggacaagcagaatatgcctcttccagtccagggccctgcttgcaactcctcagggcatctggctggatggcacacgttcaactcattgcccttctctgggaagaccgccacagtggttggtgaggcagcccctgttctgcccaggggtttggagtgggctggctttgtgttgaactccagaatgctgtggaaggaggctgacggcaagcctgactgggtgaaggatcttgatgctgtgggcgagaatggagaggagattgagaatccacttactctgttgaatgatccgtcctctgttgagccactgggcaactgtgggaagaaggtcctgctgtggtggctccgtgttgaagcacgggctgatagcaagtttcctcaagggtgggtaattgagccacctttggaagttgtcgtccctgcaaagcgcactccatggcctgaaaccaccaccgagcttccatctgagttgttggacgacaagcaagagcaggaggataggcggctgtccagagccaacaaatcatctcggccccgaggcaccacgaaacggaagggcgaccctcaagggcaagataattgatggagaacgtactggcattgtaatgtatatctcttacaccctgcaaaaacacagtaggaagcgtatccggttaatctggcggtggctgtgtttattatttttttttgctgatgtttttgctcttgtggcgatggtccacgcttgggtaatgggtatgttatctgtagagtgcacaattttaatgtagctgtatctgttgtgttgtaatgtacgctgcattgggaactga

SEQ ID NO: 3177 - DNA, 2085 bp, Sorghum bicolor
ccgcacccgctgtttcgtgcaccgcacttcaccccccaccaacctctccccctcaaaaactatccaccccccccccccccccccccccccccccacccctacccgccgacgagcgcgatcgattgattcgcttcgagccgggcggaggaggaggaggagggagcgccgggcggcggggggaacccaccagatccggcggctatgatgaagtcgctgctgccgcagagccagctgcggcgctcgtcggcggcggccgcgcggtcgtcgtcgggcggcggcgcagcggggggagacggggctatggccgacggcggcggcgcgggcccgcgggcgccggcctcctccaccttctggttcctgctccacgcgctctgctgcctcatctcgctcttcctcggcttccgcttctcgcggctcctcttcttcctgctcttctccaccaccgcgctctaccactccaccacctcgtcctcctcggccgcggtcctgcgcgccaccacgactaccaccacaacgacgacaaccacgacgacgaccaccaacaccttcacgctctccttcgccgccgccaacactcccccttccggccccgctaaccgcaccgcgctggaggcggcgggcgacaacaagggggcggcgtcgtcggggaacccgcagagccacgtcgtggtggggaggcacgggattcggatccggccgtggccgcacccggaccccgtcgaggtgatgcgcgcgcaccggatcatggagcgcgtgcaggaggagcagcggcgctggtacggcgtcaaggagcccaggcaggtgcttgtcgtcaccccgacctactcccgtgcgttccaggcgctccacctcaccggcctcctccactccctccgcaacgtgccgtacccgctcacctggatcgtcgtcgaggcaggcggcaccaccaacgccacggcgtcgatgctggcgcgctctggcctcactttcgtccacatccccttccctgaccgcatgcctcatgaatgggccgaccgccacgccactgagaaccggatgcgcctccacgccctacgcgtgatccgtgagaggaagatggatggtgtggttgtgtttgcggacgacagcaatgttcatagcatggagctgttcgatgaggtgcagaaggtccagtggatgggtgctgtatccgttggaatccttgcgcatactggaacggcagatcaactacggctaagcgaggaggacaagcagaatatgcctcttccagtccagggccctgcttgcaactcctcagggcatctggctggatggcacacgttcaactcactgcccttctctgggaagaccgccacagtggttggtgaggcagcccctgttctgcccaggggtttggagtgggctggttttgtgctgaactcgagaatgctgtggaaggaggctgatggcaagcctgactgggtgaaggatcttgatgctgtgggcgagaatggagaggagattgagaacccacttgctctattgaatgatccatcctctgttgagccactagggaactgtgggaagaaggtccttctgtggtggctccgtgttgaagcacgggctgatagcaagtttcctcaggggtgggtgattgagccgcctttggaagtcgtcgtccctgcaaagcgcactccatggcctgaaaccaccaccgagcttccatccgagttgttggatgacaagcaagagcaggaggatagacggctgtctagagccaacaaatcatctcggccccgaggcaccacgaaacggaaggctgaccctcaagggcaagaaaactgatggagaacttactggcattgtaatgtatatctcttacaccctgcaaaaaacacagtaggaagcgtatccagttaatctggcggtggctgtgtttatttttttttttctgatgtttttgctcttgtggcgatggtccacgcttgggtatgttatctgtagagtgcacatttttaatgtagctgtatctgttgtgttgtaatgtacgctgcattgggaactgaaaatggtggctgaattctggaaatctgtcgccttgtgttcctaaaaaaatttaaaattttt

SEQ ID NO: 3178 - DNA, 2149 bp, Zea mays
aacccaacgctctcctcctcgcttcccttcctttccctctgcccaccaattgatagctcacctcacctccgcacccgctgtttcgtgcaccgcacttcacaccccaccaaccttctccccccctgaaaaactatctaccccaccccaaaccacccctacccgccgacgagcgcgatcgattgattcgtttcgcgccgggcggcggcggagggagcccaccagatccggctaccgccgcggctacgatgaagtcgctgctgccgcggagcgagctgcggcgctcgtcggcagcggccgtgcggtcgtcggccggcggcgccgcggggggagacggtgctgtggccgacggcggcggggctgggccgcgagcgcccgcctcctccaccttctggttcctgctgcacgcgctctgctgcctcatctcgctcttcctcggcttccgcttctcgcggctcctcttcttcatgctcttctccaccaccgcgctctaccactccacatcctcctcctcctcggccgcggtcctgcgcgccaccaccacgacgaccacaaccaccaccactaccaccaccacgaccaacaccttcacgctctccttcgcggccgccaacactcccccctccggcccggctaaccgcacggcgctggaggcggccgcggaggccgacaaggcggcggcgtctgggaacccgcagagccacgtcgtggtcgggaggcacgggattcggatccggccgtggccgcacccggaccccgtcgaggtgatgcgggcgcacgggatcatggagcgcgtgcaggaggagcagcgccgctggtacggcgtcaaggagccgaggcaggtgctcgccgtcaccccgacctactcccgcgcgttccaggcgctccacctcaccggcctcctccactcgctccgcaacgtgccgtacccgctcacctggatcgtcgtcgaggcaggcggcaccaccaacgccaccgcgtcaatgcttgcgcgctctggcctcactgtcgttcacatccccttccctgaccgcatgcccaccgagtgggccgaccgccacgctactgagaaccggatgcgcctccacgccctacgcgtgatccgtgagaggaagatggatggtgtagttgttttcgcggacgacagcaatgttcatagcatggagctgttcgatgaggtgcagaaggtccagtggatgggtgctgtgtccattggaatccttgcgcatactggaacggcagaccaacttcggctcagcgaggaggacaagcagaatatgcctctcccagtccagggccctgcttgcaactcctcagggcatctggctggatggcacacgttcaactcattgcccttctctgggaagacagccaccgtggtcggtgaggcggcccctgttcttcccaggggtttggagtgggctggctttgtgttgaactcgagaatgctgtggaaggaggctgaaggcaagcccgactgggtgaaggatcttgatgctgttggcgagaatggagaggagattgagaacccacttactctgttgaatgatccatcctctgttgagccactggggaactgtgggaagaaggtcctactgtggtggcttcgtgttgaagcacgggcggatagcaagtttcctcaagggtgggtaattgagccacctttggaagtcgtcgtccccgcaaagcgcactccatggcctgaaaccacccccgagcttccatccgagttattggatgacaagcaaaagctggaggataggcacttgtcaagaggcaacaaatcgtctcagccccgaggcaccacgaaacggaagggcgaccctcaagggcaagataactgatggagaacgcactggcattgtaatgtatatctcttgcaccctgcaagaacacggtaggaagcatatcgggttactctggcggtggcggtgtttaatttctttttttctgatgtttttgctcttgtggcgatggtccacgcttgggtgtgttatctgtagagtgcacatttctaaagtagctgtacctgttgtgttgtaatgtaactgcattgggaactaaaaaaatgggggctggattctggaagcctatctatgcttgtgaagggaggactgaactcttgggtgctgcagcacgggctgatggctgg

SEQ ID NO: 3179 - DNA, 2041 bp, Setaria italica
ccgcacccgctgtttcgtgcaccgcacttcaccccccacctacctctctctccccttctcaaaaactatccacctccacccctcacccgccgacgagctcgatcgatcgaccgacggattcggttccggtcggagctcggaggaggggccggggggagcccagatccgggcaccggtagccggcggcgatgatgaagtcgctgctgccgcagagccagctgcggcggtcgtcggcggcggccgcgcggtcggctgggggcggcggcgccgcggggggaggagacggggccgcgggggccgacggcggcggcgccgggtcccgggcgcccgcgtcgtccaccttctggttcctgctccacacgttctgctgcctcctctcgctctacctcggcttccgcttctcccggctcctcttcttcctgctcttctccaccaccgcgctctaccacgccaccacctcttcctcctccgcggcggtcctgcgcgccaccaccaccacgacaaccacgacgacgacgaccaccaccaccaccaacaccttcacgctctccttcgccgccgcgaaccctcccccgtccaaccccgccaaccgcaccgcgctggaggcggccgcggcggcggaggggaacccgcagagccatgtggtggtggggcggcacgggattcggatccggccgtggccgcaccccgaccccgtcgaggtgatgcgggcgcaccgaatcatggagcgcgtgcaggaggagcagcgccgctggtacggcgtcaaggagcccaggcaggtgctcgtcgtcaccccgacctactcccgcgcgttccaggcgctccacctcaccggcctcctccactccctccgcaacgtgccatacccgctcacctggatcgtcgtcgaggcaggcggcaccaccaacgccacggcgtccctacttgcgcgctccggcctcaccttcgtccacatccccttccctgaccgcatgccccatgactgggcggaccgccatgccactgagaaccggatgcgcctccatgccctacgggtgattcgggagaggaagatggatggcgtagttgtatttgcggatgacagcaatgtccatagcatggagctgttcgatgaggtgcagaaggtccagtggatgggcgccgtgtccgttggaatccttgcacacactggagcggcagaacaaccacgcctcagcgaggaggacaagcagaatatgcctcttccagtccagggcccagcttgtaactcctctgggcatctcgctggatggcacacattcaactcattgccgttttctgggaagactgccacagtggttggcgaggcagcccctgttctgcccaggggtttagagtgggctggctttgtgttgaactcgagaatgctgtggaaggaggcagagggcaagcctgactgggtgaaggatcttgatgctgtgggtgagaatggagaggagattgagaacccacttactctgttgaatgatccgtcctctgttgagccactaggaaactgtgggaagaaggtcctactgtggtggcttcgtgttgaagcacgggctgatagcaagtttcctcaggggtgggtgatagagccacctttggacatcgttgttcctgcaaaacgcactccgtggcctgaaaccaccaatgagcttccatccgagttgttgaatgacaagaaagaccaggaggacaggcggttgtcaagagccaacaaatcatctcggccccgaagcaccacaaaacggaagggtgaccttcaaggacaagagaactgatgagaattgtactggccttgtaatgtatatctcttacacctgcaaaacacagtaggaagcatatatctggttaatctggtggtggttgcgttcatttttctgatgttttttgctcatgtggcaatggtccatacttctgtagaatgggcactttttcagtagttgtatctgttgtgttgtaatatacaactgcattggaaactgagatgggggctgaattatggaaaatcgtctatgcttctgaagaaaggattcaaact

SEQ ID NO: 3180 - DNA, 1829 bp, Pennisetum glaucum
agctgctgccgcagagccagctgcggcggtcgtcggcggcggccgcgcggtctgcgggcggcggcggcgccgccggaggggacggggccgcgggtgccgacggcggcggcgcggggtcccgggcgcccgcctcgtcaaccttctggttcctgctccacgcgctctgctgcctcgtctcgctcttcctcggcttccgcttctcccggctcctcttctttctgctcttctccaccaccgcactctaccactccacctcgtcgtcctcctccgcggccgtcctgcgcgccaccaccacgacgaccaccaccaccacgacgaccaccaccaccaccaacaccttcacgctctccttcgccgccgggaaccctcccccgtccaacccatccaaccgcaccgcgctggagacggcggcggcggcggcggcggacaaggggaacccgcagagccatgtggtggtggggcggcacgggattcggatccggccgtggccgcacccggaccccgtcgaggtgatgcgggcgcaccggatcatggagcgcgtgcaggaggagcagcgaagatggtacggcgtcaaggagcccaggcaggtgctcgtcgtcaccccgacctactcccgcgcgttccaggcgctccacctcaccggcctcctccactccctccgcaacgtgccgtacccgctcacctggatcgtcgtcgaggcgggcggcaccaccaacgccacagcgtccctgcttgcgcgctctggcctcaccttcgtccacatcccattccctgaccgcatgccccacgactgggccgaccgccatgctactgagaaccggatgcgcatccacgccctacgggtgattcgggagaggaagatggatggtgtagttgtatttgcggatgacagcaatgtccatagcatggagctgttcgatgaggtgcagaaggtccagtggatgggtgcagtgtccgttggaatccttgcacacactggagcggcagagcaacctcgcctcagtgaggaggacaagcagaacatgccacttccagtccagggccctgcttgcaactcctctgggcatcttgctggatggcacacattcaactcattgccgttttctgggaagactgcaacggtggttggcgaggcagcaccggtcctgcccaggggtctggagtgggctggttttgtgttgaactcgagaatgctttggaaggaagcagagggcaagcctgactgggtgaaggatctcgatgctgtgggtgagaatggagaagagattgaaaacccacttactctattgaatgatccatcctctgttgagccactggggaactgtgggaagaaggtcctactgtggtggctccgtgttgaagcgcgggctgatagcaagtttcctcaggggtgggtgattgagccacctttggacattgttgttcctgcaaaacgcactccgtggcctgaaaccaccaatgagcttccatccgagttgttggatgacaagcaagaccagcaggacaggcggttgtcaagagccaacaaatcatctcggccccgaagcaccacgaaacggaaggctgaccttcaaggacaagtgaactgatgagaattgtactggccttgtaatgtatatctcttacacctgcaaaacacagtaggaagcatatatccggttaatctggcggtggttgagttaattttttctgatgttttttgctcctgtggcgatggtccatatttctgtagaatgggcacttttttcgttagttgtatctgttgtgttgtaatatacactgcattggaacagagatggtggctgaatcatggaaaatcgtgtatgctt

SEQ ID NO: 3181 - DNA, 2061 bp, Panicum virgatum
cggcgctcgtcggcgcggccgtcgggggccgccgccgccgcgggcggagacggggccgcggctgacggcggcggggccttggcgcgggcgcccgcctcgggcaccttctggttcctgctccacgcgctctgctgcctcatctcgctcttcctcgggttccgcttctcgcggctcctcttcttcctgctcttctccaccaccgcgctctaccactccaccacctcgtcctcctccgccgcggtcctgcgcgccaccacgacgaccacaaccaccacgaccacgacgaccaccaccaccaacatcttcacgctctccttcgcggcggcgaaccctccgccctccaaccccgccaaccgcaccgcgctggaggcggcctcggcggcggacaagggcgcgacctccgggaacccccagagccacgtggtggtggggcggcacgggattcggatccgcccgtggccgcacccggaccccgtcgaggtgatgcgggcgcaccagatcatggagcgcgtgcaggaggagcagcgccgctggtacggcgtcaaggagccgaggcaggtgctcgtcgtcacgccgacctactcccgcgccttccaggcgctccacctcaccggcctactccactccctccgcaacgtgccgtacccgcttacctggatcgtcgtcgaggcgggcggcaccaccaacgccacggcgtccctgcttgggcgctccggcctcaccttcgtccacgtccccttccctgaccacatgccccatgactgggcagaccgccatgctactgagaaccggatgcgcctccatgccctgcgggtgattcgggagaggaagatggatggcgtagtggtatttgcggatgacagcaatgttcatagcatggagctttttgatgaggtgcagaaggtccagtggatgggtgctgtatccgttggaatcctagcacatactggagcggcagaccaaccgcacctcagcgaggaggacaagcagaacatgcctcttccagttcaaggccctgcttgcaactcctctgggcatctggctggatggcacacatttaactcattgccattttctgggaagactgccacggtggttggcgaggcagcccctgttctgcccagaggtttggagtgggctggctttgtgttgaactcgagaatgctgtggaaggaggcagagggcaagcctgactgggtgaaggatctcgatgctgtcggtgagaatggagaggagattgagaacccacttactctattgaatgatccgtcctctgttgaaccactggggaactgtggcaagaaggtcctgctgtggtggctccgcgtggaagctcgggctgatagcaagtttcctcagggatgggtgattgagccacctttggacattgtcgttcctgcaaaacgcactccatggcctgaaaccaccaccgagcttccatccgagttgttggatgacaagcaagaccaggaagataggcggttgtcaagagccaacaaatcatctcggccccgaagcaccacgaaacggaagggtgaccttcaagggcaagtgaactgatgcaaattgtactggccttataatgtatatctcttacacctgcaaacacacagtaggaagcatgtccggttaatctggtggtggttgtgtttatttttttctgatgtttttgctcatgtggcaatggcctgtacttctgtagaatgggcactttttcctgtagttgtatctgtaatctgttgtgttgtaatgtacactgcattggaaactgagatggtggctgaattatgggaagtcgtctatgcttctgatgaaaggattcaaactcttgcaagctctagcatcagatcatttggtagcatcggttcatggcgtgcactcaaatgcctgcattttgggtgacgtttttgacatcgaatatggttaagataatgtctggtggttcatttggtacatgaatatgaaacaatatactaagatcatgcagattccatccagtttcacggactgatggatgatctcatggtgcgcatatgaatcttcgctgaaagagttttcctc

SEQ ID NO: 3182 - DNA, 1947 bp, Panicum virgatum
gccgcggccgacggcggcggggccggggcgcgggcgcccgcctcgtccaccttctggttcctgctccacgcgctctgctgcctcatctcgctcttcctcggattccgcttctcgcggctcctcttcttcctgctcttctccaccaccgcgctctaccactccaccacctcctcctcctccgccgcggtcctgcgcgccaccacgacgaccacaaccaccacgaccacgacgaccaccaccaccaacaccttcacgctctccttcgccgccgcgaacccaccgccctccaaccccgccaaccgcaccgcgctggaggcggcagcggcggcggacaagggcgcgacctccgggaacccccagagccacgtggtggtggggcggcacgggattcggatccgcccgtggccgcacccggaccccgtcgaggtgatgcgggcgcaccggatcatggagcgcgtgcaggaggagcagcgccgctggtacggcgtcaaggagccgaggcaggtgctcgtcgtcacgccgacctactcccgcgcgttccaggcgctccacctcaccggcctactccactccctccgcaacgtgccgtacccgcttacctggatcgtggtcgaggcgggcggcaccaccaacgccacggcgtccctgcttgcgcgctctggcctcaccttcgtccacatccccttccctgaccgcatgccccatgtctgggcagaccgccatgctactgagaaccggatgcgcctccatgccctacgggcgattcgagagaggaagatggatggcgtagttgtatttgcagatgacagcaatgttcatagcatggagctctttgatgaggtgcagaaggtccagtggatgggtgctgtatccgttggaatcctagcacatactggagcggcagaccaaccacgcctcagcaaggaggacaagcagaacatgcctcttccagtccagggccctgcttgcaactcctcggggcatctggctggatggcacacgtttaactcattgccgttttctgggaagactgccacagtggttggtgaggcagcccctgttctgcccaggggtttggagtgggctggctttgtgttgaactcgagaatgctgtggaaggaggcagagggcaagcctgactgggtgaaggatcttgatgctgttggtgagaatggagaggagattgagaacccacttactctattgaatgatccgtcctctgttgaaccactggggaactgtgggaagaaggtcctactgtggtggctccgtgtggaagctcgggctgatagcaagtttcctcaggggtgggtgattgagccacctttggacattgtcgttcctgcaaaacgcaccccatggcctgaaaccaccaccgagcttccatccgagttgttggatgacaagcaagaccaggaagataggcggctgtcaagagcgaacaaatcatctcggccccgaagcaccacgaaacggaagggtgaccttcaagggcaagagaactgatgcaaattgtactggccttataatgtatatctcttacacctgcaaacacagtaggaagcatatccggttaatctggtggtggttgtgtttattttttctgatgtttttgctcatgtggcgatggcccgtacttctgtagaatgggcacttttttctgtagttgtatctgttgtgttgtaatgtacactgcattggaaactgagatggtggctgaattatgggaagtcgtctatgcttctgaagaaaggattcaaactcttgcaagctctagtatctgatcattcggtagcatcggttcatggcgtgcactcaaatgtctgcattttgtgccaattttgacatcgaatatgattaagacattgttggtggttcattttggtacatgaatatgaaacaagatactagatcatccagtttcacgggctgatggatgatttcatg

SEQ ID NO: 3183 - DNA, 2502 bp, Oryza sativa
cgcctctctcgccgaccccgtccactccgccgaattcccccccaaacccaaacccaacgcgacctcacctcacccgcacgacgacggcacgacgcgacgcgttgcccgagctgacggcttgacgacgcctccgtccccgtccggcaccaacccaccccaacccaacgctccccttttccactgaccaattgatagcccaacctcacctctcctcttccccctcctctcctcctcgcctccgcaccagcagtttcgtgcaccgcacttcacccacctacctcccccaacctccccatcaaaaactagtagtagcagtatccacccatccacgcacgcgaccgcacgcgatcgattcgagtcggcggcggcggaggagggggagtagatccggcgggcggcagcgatgatgaagtcgctgctgccgcagagccagctgcggcggtcggcggcggcggcttcggcggcgcggtcttcgggaggaggcacggggtcgggcggcgccgatggggccggctccgacggcggcgcgggcgggcgtgcccccgccacgtccacgttctggttcctcctccacgcgctctgctgcctcgtctcgctcttcctcgggttccgcttctccaggctcctcttcttcctgctcttctccaccaccgcgctctactcctccacctcgtcgtcgtcctcctccgccgtgctccgcgccacgacgacgacgacgaccaccaccacaaccaccacgaccaccaccaacaccttcaccctctccttccaagccaacccaaaccctcccccatctaacctctccaaccacaccgccctggacgcggcgggggcggccgggcacacgcagagccacgtggtggtggggcggcacgggatacggatccggccatggccgcaccctgaccccgtggaggtgatgcgggcgcaccggatcatggagcgcgtgcaggaggagcagcgcaggtggtacggcgtcaaggagccgcgccatgtcctggtcgtgacgcccacctactcccgcgcgttccaggcgctccacctcaccggcctcctccactccctccgcaatgtgccctacccgctcacctggatcgtggtcgaggcaggcggcaccaccaacgccaccgcgtccatccttgcacgctccggcctcaccatcgttcacatccccttccctgaccgcatgcctcacgactgggctgaccgtcacgcaaccgagaatcgtatgcgcctccacgcactgcgggtgatccgggaaaggaagatggatggtgtgattgtgtttgcggatgacagcaatgttcatagcttggagctgtttgatgaggtgcagaaggtccagtggatgggtgcggtgtctgtgggtatactcgcacatactggaacggcagaccagccacgacttagtgaagaggacaagcagaatatgcctcttccagttcaaggccctgcctgcaactcttctgggcacctagctgggtggcacacatttaactcattgccttttgccgggaagactgccactgttgttggagaggcagcaccggttctaccaaggggtttggagtgggctggttttgtgttgaactctaggatgctttggaaagaggcggagggaaaacctgattgggtgaaggatctggatgctgtgggtgagaacggcgaggaaatcgagaacccccttattttgttgaatgatccatcctccgttgagccattggggaactgtgggaagaagatcctcttgtggtggctccgtgttgaagcgcgagctgacagcaaatttcctcaggggtgggtaattgagccacctttggacatagttgttcccgccaagcgcaccccatggcctgaaactaccgctgagctttcggctgaattagtagattccaaacaagatcaggagggtaggcggttgtcaagaaccgacagatcatctcggtcccgaagcaccacaaagcggaaggagaactgaagcaaaataaacacatcttgtaatgtatatcttacatctgcacaaactacaataggaaccatgtctggttaatctggtgggtattatgtttattttttttcctgatgttttgctaatgtggcagcgcttcatactcgtatgtcttctgtagaagactgtttttttattggtagctgtattatctatgttgtaatatacagtgcaatctgaatcaaggaaatggaagctggatcctggatatcatatacgctccctgaagtaagggtttcgtgctcgttttatgtgcttctgtgttggtgatctctgttactattcttgctgttggcagtggaatggtggaaaattcactttaatatagcgtttcgacaacggttctactaagtattgccgcttcattccaatcgatttggttgtgtattaacccttttgttaacagcgccaagctaataatcagtgcgcagaaagaaccttaagtatatatgatacaatttctttcgtacaaactatctcaagtttatactcac

SEQ ID NO: 3184 - DNA, 2513 bp, Oryza sativa
caccgcctctctcgccgaccccgtccactccgccgaattccccccaaacccaaccccaacgcgacctcacctcacccgcacgacgacggcacgacgcgacgcgttgcccgagctgacggcttgacgacgcctccgtccccgtccggcaccaacccatcccaacccaacgctccccttttccactgaccaattgatagcccaacctcacctctcctctcctcctcccccctcctctcctcctcgcctccgcaccagcagtttcgtgcaccgcacttcacccacctacctcccccaacctccccatcaaaaactagtagtagcagtatccacccatccacgcacgcgaccgagcgcgatcgattcgaggcggcggcggcggaggaggaggagggggagtagatccggcgggcggcagcgatgatgaagtcgctgctgccgcagagccagctgcggcggtcggcggcggcggcttcggcggcgcggtcttcgggaggaggcgcggggtcgggcggcgccgatggggccggctccgacggcggcgcgggcgggcgtgcccccgccacgtccacgttctggttcctcctccacgcgctctgctgcctcgtctcgctcttcctcgggttccgcttctccaggctcctgctcttctccaccaccgcgctctactcctccacctcgtcgtcctcctcctccgccgtgctccgcgccacgacgacgacgacgaccaccaccacaaccaccacgaccaccaccaacaccttcaccctctccttccaagccaacccaaaccctcccccatctaacctctccaaccacactgccctggacgcggcgggggcggccgggcacacgcagagccacgtggtggtggggcggcatgggatacggatccggccatggccgcaccctgaccccgtcgaggtgatgcgggcgcaccggatcatggagcgcgtgcaggaggagcagcggaggtggtatggcgtcaaggagccgcgccatgtcctggtcgtgacgcccacctactcccgcgcgttccaggcgctccacctcaccggcctcctccactccctccgcaacgtgccctacccgctcacctggatcgtggtcgaggcaggcggcaccaccaacgccaccgcgtccctccttgcacgctccgaccttaccatcgttcacatccccttccctgaccgcatgcctcatgactgggctgaccgtcacgcaaccgagaatcgtatgcgcctccacgcactgcgggtgatccgggaaaggaagatggatggtgtgattgtgtttgcggatgacagcaatgttcatagcttggagctgtttgatgaggtgcagaaggtccagtggatgggtgcggtgtctgtgggtatactcgcacatactggaacagcagaccagccacgacttagtgaagaggacaagcagaatatgcctcttccagttcaaggccctgcctgcaactcttctgggcacctagccgggtggcacacatttaactcattgccttttgccgggaaaactgccactgttgttggagaggcagcaccggttctaccaaggggtttggagtgggctggttttgtgttgaactctaggattctttggaaagaggcggagggaaaacctgattgggtgaaggatctggatgctgtgggtgagaacggcgaggaaatcgagaacccccttattttgttgaatgatccatcctccgttgagccattggggaactgtgggaagaagatcctcttgtggtggctccgtgttgaagcgcgagctgacagcaaatttcctcaggggtgggtaattgagccacctttggacatagttgttcccgccaagcgcaccccatggcctgaaactaccgctgagctttcggctgaattagtagattccaaacaagatcaggagggtaggcggttgtcaagaaccgacagatcatctcggtcccgaagcaccacaaagcggaaggagaactgaagcaaaataaacacatcttgtaatgtatatcttacatctgcacaaactacaataggaaccatgtctggttaatctggtgggtattatgtttattttttttcctgatgttttgctaatgtggcagcgcttcatactcgtatgtcttctgtagaagactgtttttttattggtagctgtattatctatgttgtaatatacagtgcaatctgaatcaaggaaatggaagctggatcctggatatcatatacgctccctgaagtaagggtttcgtgctcgttttatgtgcttctgtgttggtgatctctgttactattcttgctgttggcagtggaatggtggaaaattcactttaatatagcgtttcgacaacggttctactaagtattgccgcttcattccaatcgatttggttgtgtattaacccttttgttaacagcgccaagctaataatcagtgcgcagaaagaaccttaagtatatatgatacaatttctttcgtacaaactatctcaagtttatactcactccgtt

SEQ ID NO: 3185 - DNA, 1587 bp, Echinochloa colona
ggcggggcccgggcgcccgcctcgtccaccttctggttcctgctccacgcgctctgctgcctcatctcgctcttcctcggcttccgcttctcccgcctcctcttcttcctgctcttctccaccaccgcgctctaccactccaccacctcctcctccgccgccgcggtcctccgcgccaccaccacgacgacgaccacaacaaccacgacgacgaccaccaccaacaccttcacgctctccttcgccgccgcgaacccgcccccgtccaaccccgccaaccgcaccgcgctggaggcgggggccgcggcggcggcggacaaggggaacaacccgcagagccacgtcgtggtgggccggcacgggattcggatccggccctggccgcacccggaccccgtcgaggtgatgcgggcgcaccagatcatggagcgcgtgcaggaggagcagcgacgctggtacggcgtcaaggagcccaggcaggtgctcgtcgtcaccccgacctactcccgcgcgttccaggcgctccacctcaccggcctcctccactccctccgcaacgtgccctacccgcttacctggatcgtcgtcgaggctggtggcaccaccaacgccacggcgtcactgcttgcccgctccggcctcaccttcgtccacatccccttcccagaccggatgccccatgactgggcagaccgccatgccactgagaacaggatgcgactccatgccctacgggtgattcgggagaggaagatggacggcgtagttgtatttgcggatgacagcaatgttcatagcatggagctgttcgatgaggtgcagaaggttcagtggatgggtgccgtatctgttggaatccttgcacatactggagcgtcagagcaaccgcgcctcagtgaggacgacaagcagaacatgcctcttccagtccagggacctgcctgcaactcatctgggcatctggctggatggcacacgtttaactcattgccgttttctgggaagaccgccacagtggttggcgaggcagcccctgttctgccgaggggtctggagtgggctggctttgtgctgaactcgagaatgctgtggaaggaggcagagggcaaacctgattgggtgaaggatcttgatgctgtgggtgagaatggagaggagattgagaacccacttactctactgaatgacccatcctctgttgagccactggggaactgtgggaagaaggtcctactgtggtggctccgcgttgaagcacgggctgatagcaagtttcctcaggggtgggtaattgatccacctttggacatcgttgttcctgcaaaacgcactccatggcctgaaaccaccaccgagcttccatctgagttgttggatgacaagcaggaccaggaggataggcggttgtcaagagccaacaaatcatctcggccccgaagcaccacgaaacggaagggtgaccttcaagggcaagagaactgatgcaacatgtactggccttgtgatgtatatctcttacaccagcaaaatacagtaggaagcatatccggttgatctggtggtggctgtgttcattttttctgatgt

SEQ ID NO: 3186 - DNA, 2611 bp, Brachypodium distachyon
ctttcccttcttcccttttccacactgaccacccaacgatagccagcccaccgcggggcacccgcaatttcgtgcaccgcacttcacccaccacctaccatcctgccccctcaaaaactatccatccaccctaccggcgaccgattacgatcgattcggcacgacctgaaggagagaggaaggacggcggaggaggaggtggtggtggccagatctgggtagctgcggcgatgatgaagtcgctgctgccgcagagccagctgcggcggtcggcggcggcggcttcggctgctgccgcgcggtcgtcgggcggcggcgctgagggggccgcgtcggacggcggcgcgggcgcgggcgcgcgggccgcctcctcgtccaccttctggttcctgctccacgcgctctgctgcttcatctccctcttcctcgggttccgcttctcccggctcctcttcttcctgctcttctccagcagcgcgctctacgccgcctccaacaacaagtccgccgccgtcctccgcgccatcaccaccaccaccaccaccaccactaccaccaccaccaccaccaacaccttcaccctgtccttcgccgccgccgggaaccctcccccttccaacccggacaactacaccgcgctggacgcggcgggggacgcggcgacgtccgggagcacgcagagccatgtcgttgtgggccggcacgggatacggatccggccgtggccgcaccctgatcccgtcgaggtgatgcgggcgcaccggatcatggagcgcgtgcaggaggagcagcgccggtggtacggcatcagggagccgcgccaggtgctcgtcgtcaccccgacctactcccgcgcgttccaggcgctccacctcaccggcctcctccactccctccgcaacgtgccctacccgctcacctggctcgtcgtcgaggccggcggcaccaccaacggcaccgcgtccctccttgcacgctccggtctcaccttcgtccacatccccttcccggaccgcatgccccttgaatgggccgaccgccacgccaccgagaacagcatgcgcctccacgccctgcgggtgatccgggagaggaagatggatggtgtagttgtgtttgcggatgacagcaacgtccatagcatggagctgtttgatgaggtgcaaaaggtacagtggatggctgcggtgtctgtgggtatccttgcgcataccggaacggcggagcagccacgccttagcgaagaggacaagcagaatatgcctcttccagtccagggtcctgcctgcaactcttcggggcatttggctggatggcacacatttaactccttgccgttttctgggaagactgccacggttgttggcgaggcagcaccggtgctaccgaggggtttggagtgggctgggtttgtactgaactcaaggatgttgtggaaggaggcagagggcaagcctgattgggtgaaggaccttgatgctgtgggggagaatggggaggagattgagaacccccttacactcttgaatgatccgtcctttgttgagccattggggaactgtgggaagaagatcctgctgtggtggctccgtgttgaagctagggctgacagcaagttcccacaggggtgggtaattgatccacctttggaggttgtcattcctgccaagcgaacaccatggccagaaaccaccaccgagctttcatctgagttgtcaggcgccaagcaagagcaggaggacaggcggctaacaagaaccagcagatcaactcggcctagaagcaccaccacgaaacggaaggctgacattcagaactgaggcaggataaacagaccatgtaatgtatatctcacatccgcgcaaactattataggaggcatatccagtcaatctggtgggtattgtgtttatttttttgctgatgttttgctcctgcggcagcgatgcttcatgcttggatatgtcttcctgtagaagactgtttctttaccagcagttgtacttgttgtgctgtaatatacaccgcaatcggagtcaagaaaatggtgtctgaattcaggataacctatatgcatctgaattctgaagtactgtgtgatcatttcttgaagcacagtttccctttctctggggttgcaccagattctgctaattaaatatgaaaaaggagtaattcgctttttgattcgatgttgatctgaaaaacgcaagtcattccacggagggtcgcataggatttttttaccagcaggaagtgctaagaactttggagctcttttgccaacggtttccaaaccttggtccgtgtgtccttgttgcataggaaaagaaccgatccttcgcatttaaaaaaaaaggaagagaacaaaagaaccgatccttcggtcctcacaataggcgtgctataaatactagcagagtgtgtttagcaaaatccatccaaaaccaaagggtgtttgcaaaatccatccaaaaccaaagggtttttctgggaaacaaacaaacaaataatctggttttggaataatctgaattgacctatcaaaaaacaattccaattatttaatatgaataatttggattaattaatgaatgtacttttatgtgtc

SEQ ID NO: 3187 - DNA, 1456 bp, Echinochloa colona
ggcccgggcgcccgcctcgtccaccttctggttcctgctccacgcgctctgctgcctcatctcgctcttcctcggcttccgcttctcccgcctcctcttcttcctgctcttctccaccaccgcgctctaccactccaccacctcgtcctcctccgccgcggtcctccgcgccaccaccacgacgacgaccacaacaaccacgacgacgaccaccaccaacaccttcacgctctccttcgccgccgcgaacccgcccccgtccaaccccgccaaccgcaccgcgctggaggcgggggccgcggcggcggcggacaaggggaacaacccgcagagccacgtcgtggtgggccggcacgggattcggatccggccctggccgcacccggaccccgtcgaggtgatgcgggcgcaccagatcatggagcgcgtgcaggaggagcagcgccgctggtacggcgtcaaggagcccaggcaggtgctcgtcgtcaccccgacctactcccgcgcgttccaggcgctccacctcaccggcctcctccactccctccgcaacgtgccctacccgcttacctggatcgtcgtcgaggctggtggcaccaccaacgccacggcgtcactgcttgcccgctccggcctcaccttcgtccacatccccttcccagaccggatgccccatgactgggcagaccgccatgccactgagaacaggatgcgactccatgccctacgggtgattcgggagaggaagatggacggcgtagttgtatttgcggatgacagcaatgttcatagcatggagctgttcgatgaggtgcagaaggtccagtggatgggtgccgtatccgttggaattctcgcacatactggagctgcagagcaaccacgcctcagcgaagaggacaagcagaacatgcctctcccagtccagggacctgcttgcaactcctctgggcatctggctggatggcacacgtttaacacattgccgttttctgggaagaccgccacggtggttggcgaggcagcccctgttgtgcccaggggtctggagtgggctggctttgtgttgaactcgagaatgctgtggaaggacgcagagggcaaacctgactgggtgaaggatcttgatgctgtgggtgagaatggagaggagattgagaacccacttactctactgaatgacccgtcctctgttgagccactgggaaactgtgggaagaaggtcctactgtggtggctccgcgttgaagcacgggctgatagcaagtttcctcaggggtgggtaattgatccacctttggacatcgttgttcctgcaaaacgcactccatggcctgaaaccaccaccgagcttccatctgagttgttggatgacaagcaggaccaggaggataggcggttgtcaagagccaacaaatcatctcggccccgaagcaccacgaaacggaagggtgac

SEQ ID NO: 3188 - DNA, 2038 bp, Triticum aestivum
gcggaccatccacccaccgacgagcgattacgatcgattcaggggactcggagtcggcgtcggcggcggcggtggcagagggagtccgccagatccggccgcggcggcgatgatgaagcagctgctgccgcagagccagctgcggcgctcggcggcggcatcggcggcgcgctcctcggggggcggggtcgagggcgcggggggccccgacggcgtcggcgcgggcgcgggcgggcggaccgcctcctcctccaccttctggttcctgctgcacgcgctctgctgcctcatctcgctcttcctcggcttccgcttctccaggctgctcttcttcctgctcttctccagcagcgcgctctacgcggccacctccaacaacaagtcggccgtgctccgcgccatcaccaccaccaccaccaccaccaccacgacgaccaccaccaccaacaccttcaccctctccttcgccgccgcgggcaacccgcccccctccaacccggacaacctcaccgccgccgcgctcgaggaggccgcggggagcacgcagagccacgtcgtggtcggccgccacgggattcggatccgcccctggccgcaccccgaccccgtcgaggtcatgcgggcgcaccggatcatggagcgcgtgcaggaggagcagcgccgctggtacggcgtcagggagccgcgccaggtgctcgtcgtcaccccgacctactcgcgcgccttccaggcgctccacctcaccggcctcctccactcgctccgcaacgtgccctacccgctcacctggatcgtcgtcgaggccggcggcgtcaccaacgccaccgcggccatgcttgcgcgctccagtctcaccttcgtccacgtccccttcccggaaaaaatgcccctcgaatgggccgaccgccacgccactgagaaccgcatgcgcctccacgccctacgggtgatccgggagaggaagatggacggtgtggttgtgtttgcggatgacagcaacgtgcatagcatggagctgttcgatgaggtgcagaaggtccagtggatggccgcggtgtctgtgggtatccttgcgcacaccggaacagcagagcagccacgcctcaccgaagaggacaagaagaacatgcctcttccagtccagggtcctgcctgcaactcttccgggcatttggctgggtggcacacattcaacacgttgccgttctctgggaagaccgccacggtggttggcgaggcagcgccggtgctaccgaagggtttggagtgggctgggtttgtgatgaactcgagaatgctgtggaaggaggcagagggcaagcctgattgggtgaaggaccttgatgctgttggagagaatggggaggagattgaaaatcctcttactctcttgaatgacgcgtcctatgttgagccgttggggaactgtgggaaaaaggtcctactctggtggctccgtgttgaagcccgggccgacagcaagtttccacaagggtgggtgattgagccacctctggaggtcgttgttcccgccaagcgcacaccatggccagaaaccaccatggatgtttcatcggagatgttggatgccaagcaagagcaggaggacaggcagctgccaaggaccaacaacaggtcagccaggccccgaagcaccaccacgaaacggaagggcgacgtccacaactgaggcaggataaacagaccatgtaatgtacatctcacaccaccttacacccgcggtatctgcaataggaggcatgtccggtcgatctagtgggtattgtgtttatttttttgtttcctgatgttttgctctggtggtaacgacgacggcctcgtgctggggatatgtcttccatagaagaccgtttgtttcgttatctgtagctctacctgttgtgctgtaatataacaccgcagttgatgtctcaagaaaatggcgtctgaattctggatgacctatacgcatgtcaactctgaagtatgtatcttgcgatgaatgttttcaaggcacagtttccccttttattggggc

SEQ ID NO: 3189 - DNA, 2106 bp, Triticum aestivum
caccagatccggccgcggcggcgatgatgaagcagctgctgccgcagagccagctgcggcgctcggcggcggcgtcggcggcgcgctcctcggggggcggcgtcggggccgagggcgcgggtgggcccgacggcgtcggcgcgggcgcgggggcgggcgggcggacggcctcctcctccaccttctggttcctgctgcacgcgctctgctgcctcatctcgctcttcctcggcttccgcttctccaggctgctcttcttcctgctcttctccagcagcgcgctctacgccgccacctccaacaacaagtcggccgtgctccgcgccatcaccaccaccacgacgacgaccacgacgaccacaaccacgaccaacaccttcaccctctccttcgccgccgcgggcaacccgcccccgtccaacccggacaacctcaccgccgccgcgctcgaggaggccgcggggagcacgcagagccacgtggtggtcggccgccacgggattcggatccgcccctggccgcaccccgaccccgtcgaggtcatgcgcgcgcaccggatcatggagcgcgtgcaggaggagcagcgccgctggtacggcgtcagggagccgcgccaggtgctcgtcgtcaccccgacctactcgcgcgccttccaggcgctccacctcaccggcctcctccactcgctccgcaacgtgccctacccgctcacctggatcgtcgtcgaggccggcggcgtcaccaacgccaccgcctccatgctcgcgcgctccagcctcaccttcgtccacgttccattcccggaaaaaatgcccctcgaatgggccgaccgccacgccactgagaaccgcatgcgcctccacgccctacgggtgatccgggagaggaagatggacggtgtggttgtgtttgccgatgacagcaacgtgcatagcatggagctgttcgatgaggtgcagaaggtccagtggatggccgcagtgtctgtgggtatccttgcgcacaccggaacagcagagcagccacgccttaccgaagaggacaagaagaacatgccacttccagtccagggtcctgcctgcaactcttccgggcatttggctggatggcacacattcaacacgttgccgttctctgggaagaccgccacggtggttggcgaggcagcgccggtgctaccgaagggtttggagtgggctgggtttgtgatgaactctaggatgctgtggaaggaggcagagggcaagcctgattgggtgaaggaccttgatgctgtgggggagaatggggaggagattgagaatcctcttactctcttgaatgatgcgtcctatgttgagccgttggggaactgtgggaagaaggtcctactgtggtggctccgtgttgaagcccgggccgacagcaagttcccacaagggtgggtgattgagccaccgttggaagttgttgttcccgccaagcgcacaccatggccagaaaccaccatggatgtctcatcggagatgttagacgccaagcaagagcaagaggacaggcagctgccaaggaccaacaacaggtcagcccggccccgaagcaccaccacgaagcggaagggcgacgtccacaactgaggcaggataaacagaccatgtaatgtacatctcacaccaccttacacccgcggtatctgcaataggaggcatgtccagtcgatctagtgggtattgtgtttattttttgtttcctgatgttttgctctggtggtaacgacgacggcctcgtgctgggatatgtcttccgtagaagaccgtttcgttatctgtagctctacctgttgtgctgtaatataacaccgcagttgatgtctcaagaaaatggcgtctgaacttggatgatctatacgcatgtcaactctgaagtttgtatcgtgtgatgaatgttttcaaagcacagtttccccttttattggggcgttgtacaacttttactggactgtaccccctcggtatagttggtgatctaaacgctctcatatttctttacaaagggtatattagttactgcctccatctcacaatgtaagacgttttctggggacattatgagacgttttctgggcgg

SEQ ID NO: 3190 - DNA, 2242 bp, Hordeum vulgare
acactgaccaacgaacgatagccaggccacctctccctccccccgcacccgcagttccgtgcaccgcacttctccacccaccacctaccttcccccgtgttcccctcccccctcaaaacctatcgccgcagaccgtccacccaccgacgagcgattgcggccgattgatccgcggggcgaggcggaggcggaggcggagtcggtggtggcggcggcggagggagcacgccagatccggccgcggcggcgatgatgaagacgctgctgccgcagagccagctgcggcgcacggcgccgcgctcctccgtcggcggcgtcgagggcgcgggggcccccgacggggtcggcgcgggagcgggcgcggggtcgggcgggcggacggcctcctcctccaccttctggttcctgctgcacgcggtctgctgcctcatctcgctcttcctcggcttccgcttctccaggctgctcttcttcctgctcttctccagcagcgcgctctacgccgccacctccaacaacaagtcggcagtgctccgcgccatcaccaccaccacgacgaccacgacgacgaccaccaccaccaccaacaccttcaccctctccttcgccgccgcgggcaacccgccgccggccaacccggacaacctcacagccgccgcgctcgaggaggccgcggggagcacgcagagccacgtcgtcgtcggccgacacgggattcggatccgcccctggccgcaccccgaccccgtcgaggtcatgcgcgcgcaccggatcatggagcgcgtgcaggaggagcagcgccgctggtacggcgtcagggagccccgccaggtgctcgtcgtcaccccgacctactcgcgcgccttccaggcgctccacctcaccggcctcctccactcgctccgcaacgtgccctacccgctaacctggatcgtcgtcgaggccggcggcgtcaccaacgccaccgcggccctcctcgcgcgctccagcctcaccttcgtccacgtccccttcccggaaaaaatgcccctcgaatgggccgaccgccacgccactgagaaccgcatgcgcctccatgccttacgggtgatccgggagaggaagatggacggtgtggttgtgtttgcggatgacagcaacgtgcatagcatggagctgtttgatgaggtgcagaaggtccagtggatggccgccgtgtctgtgggtatccttgcacacaccggaacagcagagcagccacgccttaccgaagaggacaagaagaacatgccacttccagtccagggtcctgcctgcaactcttcggggcatttggctggatggcacacattcaacacgctgccgttctctgggaagactgccacggtggttggcgaggcagcaccggtgctacccaggggtttggaatgggctgggtttgtaatgaactctaggatgttgtggaaggaggcagagggcaagcctgattgggtgaaggaccttgatgctgtgggggagaatggggaggagattgaaaatcctcttactctcttgaatgatgcgtcctatgttgagccgttggggaactgtgggaagaaggtcctactctggtggctccgtgtcgaagcccgggccgatagcaagtttccacaagggtgggtgattgagccacctttggaagtcgtcgttcccgccaagcgcacaccatggccagaagccaccatggatatttcatcggagctgttagacgccaagcaagagcaggaggacaggcagctgccaaggaccaacaacaggtcggcccggccccgaagcaccaccacgaaacggaagggcgacgtccagaactgagtcaggataaacagatcatgtaatgtaaatctcacatcatcttacacccgcggtatctgcaataggaggcatgtccggtcgatctagtgggtattgtgtttatttttttgtttcctgatgttttgctctggtggcaacgacgacgccctcgtgctggggatatgtcttctttaggagaccgtttcgttgtctgtagccctacttgttgtgcttgtaatataacaccgcaattgatgtcaagaaaatggtgtcagaattctggatgacctatacgcatgtcgactctgaagtattgtgtgatcagtgttttcaggcatagtttcccttcctttagggcttgtactgaaattggaatgtttgtttgtttaccattatcaaatgtaagcctttaaaacggagtatgatttttgta

SEQ ID NO: 3191 - DNA, 2289 bp, Hordeum vulgare
gaccaacgaacgatagccaggccacctctccctccccccgcacccgcagttccgtgcaccgcacttctccacccaccacctaccttcccccgtgttcccctcccccctcaaaacctatcgccgcagaccgtccacccaccgacgagcgattgcggccgattgatccgcggggcgaggcggaggcggaggcggagtcggtggtggcggcggcggagggagcacgccagatccggccgcggcggcgatgatgaagacgctgctgccgcagagccagctgcggcgcacggcgccgcgctcctccgtcggcggcgtcgagggcgcgggggcccccgacggggtcggcgcgggagcgggcgcggggtcgggcgggcggacggcctcctcctccaccttctggttcctgctgcacgcggtctgctgcctcatctcgctcttcctcggcttccgcttctccaggctgctcttcttcctgctcttctccagcagcgcgctctacgccgccacctccaacaacaagtcggccgtgctccgcgccatcaccaccaccacgacgaccacgacgaccaccaccaccaccaccaacaccttcaccctctccttcgccgccgcgggcaacccgccgccggccaacccggacaacctcacagccgccgcgctcgaggaggccgcggggagcacgcagagccacgtcgtcgtcggccgacacgggattcggatccgcccctggccgcaccccgaccccgtcgaggtcatgcgcgcgcaccggatcatggagcgcgtgcaggaggagcagcgccgctggtacggcgtcagggagccccgccaggtgctcgtcgtcaccccgacctactcgcgcgccttccaggcgctccacctcaccggcctcctccactcgctccgcaacgtgccctacccgctcacctggatcgtcgtcgaggccggcggcgtcaccaacgccaccgcggccctcctcgcgcgctccagcctcaccttcgtccacgtccccttcccggaaaaaatgcccctcgaatgggccgaccgccacgccactgagaaccgcatgcgcctccatgccttacgggtgatccgggagaggaagatggacggtgtggttgtgtttgcggatgacagcaacgtgcatagcatggagctgtttgatgaggtgcagaaggtccagtggatggccgccgtgtctgtgggtatccttgcacacaccggaacagcagagcagccacgccttaccgaagaggacaagaagaacatgccacttccagtccagggtcctgcctgcaactcttcggggcatttggctggatggcacacattcaacacgctgccgttctctgggaagactgccacggtggttggcgaggcagcaccggtgctacccaggggtttggaatgggctgggtttgtaatgaactctaggatgttgtggaaggaggcagagggcaagcctgattgggtgaaggaccttgatgctgtgggggagaatggggaggagattgaaaatcctcttactctcttgaatgatgcgtcctatgttgagccgttggggaactgtgggaagaaggtcctactctggtggctccgtgtcgaagcccgggccgatagcaagtttccacaagggtgggtgattgagccacctttggaagtcgtcgttcccgccaagcgcacaccatggccagaagccaccatggatatttcatcggagctgttagacgccaagcaagagcaggaggacaggcagctgccaaggaccaacaacaggtcggcccggccccgaagcaccaccacgaaacggaagggcgacgtccagaactgagtcaggataaacagatcatgtaatgtaaatctcacatcatcttacacccgcggtatctgcaataggaggcatgtccggtcgatctagtgggtattgtgtttatttttttgtttcctgatgttttgctctggtggcaacgacgacgccctcgtgctggggatatgtcttctttaggagaccgtttcgttgtctgtagccctacttgttgtgcttgtaatataacaccgcaattgatgtcaagaaaatggtgtcagaattctggatgacctatacgcatgtcgactctgaagtattgtgtgatcagtgttttcaggcatagtttcccttcctttagggcttgtactgaaattggaatgtttgtttgtttaccattatcgaatgtaagcctttaaaacggagtatgatttttgtacagtactttatcaatgctgattcctgtgttccaaatgtggaacggagtttgt

SEQ ID NO: 3192 - DNA, 4140 bp, Sorghum bicolor
gtggagaggaaagaaacccgaaaccctttgcgtcgtctcggcatctctctccgcttcgaaaccccggccggactcgaaggaagataggaaaccctcgcgagtcgcgttgcctcgcctccgtcccctcagctgccccgccgccgcctcgaatccgcccgggctcggaaggtcccgcgcccccacggatcggattcgtgaggttggcggattcggggctagggtttggggattggctgcaatcgtggggctttttggcctaaatctgaggagcaatgggcagcatggtctggaagtggacctaaggaggacggacggatggtggcgatggagggtaagggggacgcgtcagtgacgccggtgaggactagtgaccggctgcggcagcgtccgaagtactatggtcgtggctatatgtactacaagccacccatgaggaagaaggttaagtctaagaagcgaactactgcatcacagattgttaagaaactgcttcgcaagccagctgcacgtccgccacctgctgattctattgcagcaaatttgcgccgttcaacgcgaaagcgaaggatttctgtaaatctggagggctatgatacagatagttccagtacgggagatcatgatcttatgagacctagatatcgatcttcaaagagtaaagggggaaacaatgctgcacatgatgaagtgtcagctaggccaaagcgccagaagttgtctaactccatgcctcgccgcgaaggtttacggcctagaagatctttgcgaggacaaagactgcatccataccatgaatctgaggatgaccaggaaagctctgaagaacaaggtgcagaagatcaaagagaaaatggcaatgagattgaagaggatgttggtgatgaggaggttgatggaggtgatgaagctgaaggagatggagatgatgaagatggcgaggaagagcaagaaggaaggaggagatatgatttaagggaacgttcagaggttcgtaggccatcccctcgtaaggaaggaaagcacagaccccaatctcctcgtagagtactagttcacggaattggtccaaagaacagcaagtatctaaaaaaaggtgggtcgcgcatgcataagcgccctcgtttctctttgccagatgattcagatgactcccttcttgtggatgagccagacgagggtccatccatgccatggatgcgcagtgggaggggaggtatgccatggttgatgggtgggttggacatgcatagtccagcagcatggggcctgagtgttggagcatctggttggggtcatcagggcgacacttctacttcactcatgcctggggtgcaaactgctggaccaagttctaagggaggagctgacattcagcctctgcaggttgatgagaatgtgagctttaaagatataggtggactatcggagtatattgatgctctgaaggaaatggttttcttcccattgctgtatccagatttttttgcaaactatcacatcactcctcctagaggtgttctgctttgtggcccaccgggcacaggaaaaacattgattgcccgtgccttagcttgtgctgcctctaaagctggccagaaggtcagtttttacatgcgcaaaggagctgatgttcttagtaaatgggtgggagaggctgaaaggcagctaaagttactttttgaggaagctcaaaagaatcagccgtcaattatattttttgatgaaatagatggcctggcgcctgtgaggtctagcaagcaagagcagattcacaattcaattgtttcgacattgcttgctttgatggatggccttgattcacgtgggcaagttgttttgattggagcaactaacagaattgatgccattgatggggcattgcgtagacctggccggtttgaccgtgagttttattttcctttacctggctatgaggctcgatcagaaatactggatattcatacaaggaaatggaaggatcctccaccgaaggaactaaagatggaacttgctgctagctgtgtgggctattgtggagctgatttgaaggcattgtgtacagaagcagctattagagcatttagagagaagtatcctcaagtctacactagtgacgacaagtttgtcattgatgttgattcggtcactgttgagaagtaccactttttggaagctatgtctacaataactcctgctgcgcacaggggatctattgtgcattcaaggccactttcaacggttatcgctccatgtctgaagaggcatcttgagaaaataatggaacaaatttctgatattttccctttcctttcatccatagattttagcaagttctccgctctttcctatggatcttccatcccccttgtttatagacctcgccttttgatatgtggtggtgaaagtgttggactggatcatgtgggaccagctgttttacatgagcttgagaagttctctgttcactctttgggattgccatctcttctctctgatccaagtgcaaagacacctgaagaagctcttgtgcatatttttggggaagccaagagaacaaccccatccattctatacttgcctcagttccatctttggtgggaaacggcgcatgaacaactcagggctgtgttattgactctgttgaatgagttgccctccaaccttccagttttattgcttggaacatcatcagtggctttcactgacctcgaagaagagtgtgcttctatattctcttctcgcaacgtgtatcaagtggatcatccaagttatgacgataaattgagatacttcagtatattgtttgagtcattgctctctttccaatcggaggaatcaagaaacaagtcaaagaaacagaagtctgctattgatcttcccaaagccccgaaagaagtggagggccctaaggcttctgagctaaaggctaaggcagaagctgagcagcatgctgttcgtcgaatgaggatgtgtctccgagatatctgcaaccgcattttgtacaacaaaaggttcaatgtatttcacttcccggtatcagaagaggaggtgcctgactatcgatcaataatccacaagcccatggatatggctactgttttgcagcgggtggactctggacagtaccttaccagggcagcatttatgaaggatattgatcttattgtctcaaatgcaaagacttacaatggggatgactacaatggatctaggatcgtcagtagagcatgtgaactcagagatgtggtccaaggtatgttgtcacagatggacccatgtttggtgtccttttgtgataaaattgctttacagggggggccacagcaggttgtggatgatgaagatagctctattcttcaagcagcgcctgttgctcagctggtttctggtactagaataagtgcaaggcttcgcaatgtactgcccgaagtaaacctgtcacaaagttatgaagtgctaaagcggcaaaagaaaagtgctgaaaatgaacagagcatgaccaaagatgtggcagctagagatgaaaagtctccggaagatgtagatttgtcaaagccaactgacccagaagaagctgcaaaagaaccagagttaaatggcacaacgaaagaagccaacgaatcaccagccgaagaaccagaagtacctactcctgaacccatggagtctgacaacgttcaagtcgccactaccgtggctactggtgacgacttgctaggacagctagaagccctaaagcaacgcttcatggaactcactgcaggctacggcgtgccacagctcgagaggctgtattcccggataatgaaaggagcaatagagttgacaagtaaagaaagcaacgaggatcatagacggttagtagttaggtatttgttgacattcgttgagaacagcaacaatttttaactccggcgcgcaataagattcttgtttttccttgtacatcctctttggaacgaaagaatagtagtggttcatctggggagcttatcccccttgtaacaaatctgccaaatgctctagtgtcagtgacacagttttgccatgaatgatgtagcaagtgcaccctttgtaattttgtcatgtacattcctcagcgtttggtgtacctcagcttgcataacatgtggttactat

SEQ ID NO: 3193 - DNA, 4397 bp, Panicum virgatum
cgctgccggcctgctccgagtggggctctggggccctgccgagcaggcgccgccgccctggctcgagcgggcgccacatcctatctcgagcgggcggccccgccctgccctgagccggctgagggagggagcagaagagcggcgcaccggagaggcgctggaagagcacctgacgcccggccggagggaggcgcaccggagcaccagcgatgcacggaggagcagcgctcgaagcagccgatccgtttctctcagggagaaggcagccagggaaagaatggaatagtgtcctggacctaattttgtcaactcggaaaccctcgcgtcgtctcggcaccctcctccgcttcgaaacccccgacgcgaaggaagagaggaaacccttgcggaggcgcctcaacccccggctcccgcccgcccgccgccgcctcgaatccgcccggattcgcgcggcgccggaccacggcggatcggatcccggaggttggtggattcggggctagggtttgggattggctgaagtcgtgggactgtttgagcgtttggcctagtttaaggaacaatgtgcttcatggtttgggagtgcacctgaggacggagggatggtggcgatggagggaaagggggatgcgtcagtgacgccattgaggaccagtgaccggctccggcagcgcccaaagtactacgctcgtggctatatgtattacaagccagccatgcggaagaaggtcaagtctaagaagcgaacagcggcatcacagattgctaagaaactgcttcgcaagccagctgcccggccaccacctgctgattcaattgcagcaaatttgcgccgttcgacgcggaagcgaaggatttctgtaaatctggagggctatgatacggatagttcaagtatggaagatgatgatcttatgaggcccagatatcgttcttcaaagagtaaaggggaaaacaatgctgcacatgatgaagtgtcagcgcggccaaagcgccagaagttatccaactctatacctcgccgcgaaggtttacgacccagaagatctttgcgaggaaaaaggctgcatgcataccaggaatctgaagatgaacaggaaagctctgatgaacagggtgcagaagatcaaagagaaaatggcaatgagattgaggaggatgcaggtgatgatgatgaggttgatggaggcgatgaagctgaagcagatggagatgatgaagatggtgaggaagaacaagaaggaaggaggagatatgatttaagggatcgttcagaggttcgtagaccatcccctcgtaaggaagggaagcacaggccacaatctcctcgtagagtactagttcatggaattggtccaaagaacagcaaatatttaaaaaaaggcgggtcgcgtatgcataagcgccctcgtttctctttaccagacgattcggatgattcccttcttgtggatgagccggatgaaggtccatccatgccatggatgcgtagtgggaggggaggtatgccgtggttgatgggtggattggacatgcatagtccagcagcatggggtctgaatgttggagcatctggttggggtcaccagggtgacagttctacttcactcatgcccggggtccaaactgcgggaccaagttccaagggaggagctgatattcagcctctgcaagttgatgagagtgtgagttttaaagatattggtggactatcagagtacattgatgctttgaaggaaatggttttcttccctttgctgtatccagatttttttgcaaactaccacattactccacctagaggagttctgctttgtggcccgccgggtactggaaaaacattgattgcccgtgccttagcttgtgctgcctctaaagccggccagaaggtcagtttttatatgcgcaaaggggctgatgttcttagtaaatgggttggagaggctgaaaggcagctcaagttactttttgaggaagctcaaaagaatcagccatctattatattttttgatgaaattgatggcctggcacctgtgaggtctagcaagcaggagcagattcacaattcaattgtttcgacattgcttgctttgatggatggtcttgattcacgtgggcaagttgtcttgattggagcaactaacagaattgatgccattgatggagcattgcgtagacctggccgatttgatcgtgagttttattttcctttacctggctacgaggctcgagccgaaatactggatattcatacaaggaaatggaaggatcctccaccaaaggaactaaagatggagcttgctgttagctgtgtgggatattgtggagctgatttgaaagcgttgtgtactgaagcagctattagagcatttagagagaagtatcctcaggtctacacaagtgatgacaagtttgtcattgatgttgattcggtcagtgttgagaaataccactttttggaagctatgtctacaataactccagctgcgcataggggatccattgtgcattcaaggccactttcatcagttattgctccctgtctgaagaggcatcttgataaaataatggaacggatttctgatatttttccttttctttcatccgtagattttagcaagttctctgccctttcctatggatcttccattcctcttgtttatagacctcgccttttgatatgtggtggtgagagtgttggactggatcatgtgggaccagctgttttgcatgaacttgagaagttttctgttcactcgttgggactgccttctcttctctctgatccaagtgcaaagacgcctgaagaagctcttgtgcatatttttggggaagccaagagaacaactccatccattctctacctgcctcagttccatctttggtgggatacggcacacgaacagcttagggctgtgttactgactctattgaatgagttaccatccaaccttccagttttgttgctaggaacatcatcagtggctttcactgatctcgaagaagagtgtgcttccatattctcttctcgcaatatgtaccaagtggatcaaccaagttatgatgatagattgagatacttcaatatattgtttgagtcattgctctcgttccaaacggaggaatcaagaaacaagttaaagaaacagaaatctgctattgatcttccgaaagctccaaaggtagtggagggtcctaaggtttcggagctaaaggctagggcagaagccgagcagcatgctgtccgtcgaatgaggatgtgcctccgagatatttgtaaccgcattttatacaacaaaaggttcaatgtgtttcacttcccagtatcagaagaggaggtacctgactatcgatcagtaattcacaagcctatggatatggctactgtcttgcagcgggtggactctggacaataccttaccagggcagcatttatgaatgatattgatcttattgtctcgaatgcaaagacttataatgggaacgactacaatggatctaggatcgtcagtagagcatgtgaactccgagacgtggtgcaaggtatgttgtcacagatggacccgtctttggtgtccttctgtgataaaatcgcttcacaggggggaccactgcaggttatggatgatgaagatagctccattcttcaagcagcacctgttgctcagctggtttctggcactagaataagtgcaaggcttcgcaatgtgcagccagaagtaaatctctcacaaagttatgaagtgcttaagcggcaaaagaaaagtgcagaaaatgaacagggcttgactaaagatgtggctgccagagacgaaaggtctccagaagatgtagatttgtcaaaaccaatttccccagaagaaactccaaaagaaccagattcaaatggcacactgaaagaagccgacaattcaccagctgaagcagcagaagtacctgctcgtcctgaacccatggagactgacagcagtgaagttgccaccaccgtgagtactggtgacgacttactcggacagctagaagccctaaagcaacgctttatggagcacacggcaggctacggcgtcccacagctggagaggctgtattcccggataatgaaaggcgtgatagagttgacaagtaaagaaagcaatgaagatcataggcggttagttgttagatatttgttgacatttgttgagaacagcgacaatttttaactccggcgcgtaataagattcttgttttttcatgtgtacattctctttggaatgaaaaaaaaaatagtggatcaccttgggagctttcccagttccatgccgtgtaatagaaatgtgccaaatgttcaaagtgtcagcgacacaattttgcaatgaatgatgtagaaagtgcatcctgtgtagatttgttttttt

SEQ ID NO: 3194 - DNA, 4098 bp, Setaria italica
cgcttcgaaacccccgacgcgacggaagcgaggaaaccctcgcgagtctctcacccccgccccccacagccgcccgccgccgcctcgaatccgcccggattcgcgcggcgccggacccctgcggatcggatcccggaggttggtggattcggggctagggtttggggattggcggaaatcgtgggattgttcggcctaatttgaggagcaatgcgcttcatggtttggcagtgcacctgaggaggacagagggatggtggcgatggagggaaagggggatgcgtcagtgacgccggtgaggaccagtgaccggctccggcagcggccgaagtactatgctcgtggctatatgtattacaagccagcaatgcggaagaaggtcaagtctaagaagcgaacagctgcatcacagattgctaagaaactgcttcgcaaaccagctgcccgtccaccaccggccgattctatcgcagcaaatttgcgccgttcaacgcgaaagcgaaggattcctgtaaatcttgagggctatgatacagatagttccagtatggaagatgatgatcttatgagacctagatatcgtacttcaaagaataaagggggaaacgatgctgcacatgatgaagtgtcagctcggccaaagcgccagaagttgtctaactccataccccgccgtgaaggtttacggcctagaagatctttgcggggacgaaggctgcatccataccaggaatctgaagatgaacaggaaagctctgaagaacagggtgcagaagatcgaagagaaaatggcaatgacattgaagaggatggtgatgatgatgaggttgatggaggcgatgaagctgaagcagatggagatgatgaagatggtgaggaagagcaagaaggaaggaggagatatgatttaagggatcgttcagaggttcgtagaccatcccctcgtaaggaagggaagcacagaccacaatctcctcgaagagtactagtccatggaattggtccaaagaacaacaagtatttaaaaaaaggtgggtcgcgcatgcataagcgccctcgtttctctttgccagatgattcagatgattcccttcttgtggatgagccggatgaaggtccatccatgccatggatgcgtagtgggaggggaggtatgccgtggttgatgggtggattggacatgcacagtccagcagcatggggtctgaatgttggagcgtctggatggggtcaccagggtgacagttctacttcactcatgcccggggtccaaactgccggacctagttccaagggaggagctgatattcagcctctgcaggttgatgagagtgtgagttttaaagatattggtggactatcagagtacattgatgctttaaaggaaatggttttctttcctttgctgtatccagatttttttgcaaactatcacattactcctcctagaggagttctgctttgtggcccgccaggtacaggaaaaacattgattgcccgtgccttagcttgtgctgcctctaaagccggccagaaggtcagtttttatatgcgcaaaggggctgatgttcttagtaaatgggtgggagaggctgaaaggcagctcaagttactttttgaggaagctcaaaagaatcagccgtccattatattttttgatgaaattgatggcctggcacctgtgaggtctagcaagcaggagcagattcacaattcaattgtttcgacattgcttgctttgatggatggtcttgattcacgtgggcaagttgtcttgattggagcaactaacagaattgatgccattgatggagcattgcgtcgacctggccgatttgatcgtgagttctattttcctttacctggctacgaggctcgagccgaaatactggatattcatacaaggaaatggaaggatcctccaccaaaggaactaaagatggagcttgctgctagctgtgtgggctattgtggagctgatttgaaagcattgtgtactgaagcagctattagagcatttagagagaagtatcctcaggtctacactagtgacgacaagtttgtcattgatgttgattcggtcagtgttgagaagtaccactttttggaagctatgtctacaataactccagctgcgcataggggatccattgtgcattcaaggccactttcatcagttatcgctccctgcctgaagaggcatcttgataaaataatggaacggatttctgatattttcccttttctttcatccgtagatgttagcaagttctctgccctttcttatggatcttccatccctcttgtttatagacctcgccttttgatatgtggtggtgagagtgttggactggatcatgtgggaccagctgttttgcatgagcttgagaagttttccgttcactcattgggactgccttctcttctctctgatccaagtgcaaagacacctgaagaagctcttgtgcatatttttggggaagccaagagaacaaccccatccattctctacctacctcagttccatctttggtgggatacggcacatgaacagctcagggctgtgttattgactctattgaatgagttgccatccaaccttccagttttgttgctaggaacatcatcagtggctttcaccgacctcgaagaagagtgtgcttccatattcacttctcgcaatgtgtaccaagtggatcaaccaagttatgatgatagattgagatacttcaatatattgtttgagtcattactctctttccaaactgaggaatcaagaaacaagtcgaagaaacagaaatccgctattgatcttcccaaagctccaaaggaagtggagggcccaaagatttcagagctaaaggctaaggcagaagctgagcagcatgctgttcgtcgaatgaggatgtgcctccgagatatctgtaaccgcattttatacaacaaaaggttcaatgtgtttcacttcccagtatcagaagaggaggtacctgactatcgatcagtaatacacaagcccatggatatggctactgtcttgcagcgggtggactctggacaataccttaccagagcagcctttatgaaggatattgatcttattgtcttgaatgcaaagacttataatggggacgactacaatggatctaggattgtcagtagagcatgtgaactccgagatgtggtgcaaggtatgttgtcgcagatggacccatctttggtgtccttctgtgataaaattgcttcacaggggggaccactgcaggttgtggatgatgaagatagctctattcttcaagcagcacctgttgctcagctcgtttctggtactagaataagtgcaaggcttcgcaatgtacagccagaagtaaacctgtcacaaagttatgaagtgctaaagcggcaaaagaaaagctcagaaaatgatcagggcatgactaaagatgcggctgcaagagatgaaaggtctccagaagatgtagatttatcaaaaccaatttccccagaagaagctccaaaagaaccagattcaaatggcactctgaaagaaaccgacaattcaccagctgaagcaccagaagtacctgctcctcctgaacccatggagactgacagcagtgaagttgccaccaccttgactactggtgatgacttactcgggcagctagaagccctaaagcaacgcttcatggagctcacggcaggctatggcgtgccacagctcgagaggctgtattcccggataatgaaaggcgcgatagagttgacaagtaaagaaagcaatgaagatcatagggggttagttgttagatatttgttgacatttgttgagaacagcgacaatttttaactccgcgtaataagattcttgttttccatgtgtacattctctttggaacgaaaaatagtggatcatcttgggagatatccccgttccatgccctgtaacaaaaatgtgccaaatgctcaagtgtcagtgacacaattttgcaatgaatgatgtagcaagtgcacattttgtagatttatcatgtttttgaaaaatcgtatatctaccatgttcttatcgtgtacatttctttgtatttgtagatgccc

SEQ ID NO: 3195 - DNA, 4288 bp, Panicum virgatum
ccccgctcccgcccgcccgccgccgcctcgaatccgcacggattcgcgtggtgcgggaccccggcggatcggatcccggaggttagctccccggcggcgcctgactcgggaatttttcctccggatttttcgcgcttttttggggctcattttgggggtttagctcggggttctgtcttgggccggggttctgttggtttgtatgaattttggatggttcgtggttgggtgattggagtttggcgggacggattcgtattaattgttcctgggtttgattttttgtttttgtctttttgggggcagtttgcagtgtggaaataaacgtccggttccattttgtaatgcattaccagtaaatctgccgttatttgatattttatttgtgtatgaaaattggtggattcggggctagggtttggggattggctgaagttgtgggactgtttgagcgtttggcctagtttaaggaacaatgtgcttcatggtttgggagtgcacctgacgaggacggagggatggtggcgatggagggaaagggggatgcgtcagtgacgccgttgaggaccagtgaccggctccggcagcgcccaaagtactatgctcgtggctatatgtattacaagccagccatgcggaagaaggtcaagtctaagaagcgaacagctgcatcacagattgctaagaaactgcttcgcaagccagctgcccggccaccacccgccgattccattgcagcaaatttgcgccgttcgacgcggaagcgaaggatttctgtaaatctggagggctatgatacagatagttcaagtatggaagatgatgatcttatgaggcccagatatctttcgtcaaagagtaaaggggaaaacaatgctgcacatgatgaagtgtcagctcggccaaagcgccagaagttatccaactccatacctcgccgtgaaggtttacgacccagaagatctttgcggggacaaaggctgcatgcataccaggaatctgaagatgaacaggaaagctctgaagaacagggtgcagaagatcaaagggaaaatggcaatgagattgaggaggatgtaggtgatgatgatgaggttgatggaggcgatgaagctgaagcagacggagatgatgaagatggtgaggaagagcaagaaggaaggaggagatatgatttaagggatcgttcagaggttcgtagaccatcccctcgtaaggaagggaagcacagaccacaatctcctcgtagagtactagttcatggaattggtccgaagaacagcaagtatttaaaaaaaggtgggtcgcgtatgcataagcaccctcgtttctctttaccagacgattcggatgattcccttcttgtggatgagccggatgaaggtccatccatgccatggatgcgtagtgggaggggaggtatgccatggttgatgggtgggttggacatgcatagtccagcagcatggggtctgaatgttggagcatctggttggggtcaccagggtgacagttctacttcactcatgcccggggtccaaactgcgggaccaagttccaaaggtggagctgatattcagcctctgcaggttgatgagagtgtgagttttaaagatatcggtggactatcagagtacattgatgctttaaaggaaatggttttcttccctttgctgtatccagatttttttgcaaactaccacattactccacctagaggagttctgctttgtggtccgccgggtactggaaaaacattgattgcccgtgccttagcttgtgctgcctctaaagccggccagaaggtcagtttttatatgcgcaaaggggctgatgttcttagtaaatgggtgggagaggctgaaaggcagctcaagttactttttgaggaagctcaaaagaatcagccgtctattatattttttgatgaaattgatggcctggcacctgtgaggtctagcaagcaggagcagattcacaattcaattgtttcaacattacttgctttgatggatggtcttgattcacgtgggcaagttgtcttgattggagcaactaacagaattgatgccattgatggagcattgcgtagacctggccgatttgatcgtgagttttattttcctttacctggctacgaggctcgagccgaaatactggatattcatacaaggaaatggaaggatcctccaccaaaggaactaaagatggagcttgctgctagctgtgtgggatattgtggagctgatttgaaagcactgtgtactgaagcagctattagagcatttagagagaagtatcctcaggtctacactagcgatgacaagtttgtcattgatgttgattcggtcagtgttgagaagtaccactttttggaagctatgtctacgataactccagctgcgcataggggatccattgtgcattcgaggccactttcatcagttattgctccctgtctgaagaggcatcttgataaaataatggaacggatttctgatattttcccttttctttcatccgtagattttagcaagttttctgccctttcctacggatcttccatacctcttgtttatagacctcgccttttgatatgtggtggtgagagtgttggactggatcatgtgggaccagctgttttgcatgaacttgagaagttttctgttcactcgttgggactgccttctcttctctctgatccaagtgcaaagacgcctgaagaagctcttgtgcatatttttggggaagccaagagaacaactccatccattctctacctgcctcagttccatctttggtgggatacggcacacgaacagcttagggctgtgttactgactctattgaatgagttgccatccaaccttccagttttgttgttaggaacatcatcagtggctttcactgatctcgaagaagagtgtgcttccatattctcttctcgcaatatgtaccaagtggatcaaccaagttatgatgatagattgagatacttcaatatattgtttgagtcattgctctcgttccaaacggaggaatcaagaaacaagtcaaagaaacagaaatctgctattgatcttcccaaagctccaaaggtagtggagggccctaaggtttcggagctaaaggctagggcagaagcagagcagcatgctgtccgtcgaatgaggatgtgcctccgagatatttgtaaccgcattttattcaacaaaaggttcaatgtgtttcacttcccagtatcagaagaggaggtacctgactatcgatcagtaattcaaaagcccatggatatggctactgtcttgcagcgggtggactctggacaataccttacgagggcagcatttatgaaggatattgatcttattgtctcgaatgcaaagacttataatgggaacgactacaatggatctaggatcgtcagtagagcatgtgaactccgagatgtggtgcaaggtatgttgtcacagatggacccgtctttggtgtccttctgtgataaaatcgcttcacaggggggaccactgcaggttatggatgatgaagatagctccattcttcaagcagcacctgttactcagcttgtttctggtactagaataagtgcaaggcttcgtaatgtgcagccagaagtaaacctctcacaaagttatgaagtgcttaagcggcaaaagaaaagcgcagaaaatgaacagggcatgactaaagatgtggctgtaagaggtgaaaggtctccagaagatgtagatttgtcaaaaccaatttccccagaagaagccccaaaagaaccagattcaaatggcacgctagaagaagccgacaattcaccaactgaagcagcagaaatacctgctcgtcctgaacccatggagactgacagcagtgaagttgccgccaccgtgagtactggcgacgacttactcggacagctagaagccctaaagcagcgctttatggagcacacggcaggttatggtgtgccacagctggagaggctgtattcccggataatgaaaggcgtgatagagttgacaagtaaagaaagcaatgaagatcataggcggttagttgttagatatttgttgacatttgttgagaacagcgacaatttttaactccggcgcgtaataagattcttgttttcctcatgtgtacattctctttggagtgaaaaaaaaaatagtggatcatcttgggagctttcccagttccatgccgtgtaatagaatgtgccaaatgctagtgtctgtgacacaattttgcaatgaatgatttggcatgtgca

SEQ ID NO: 3196 - DNA, 4110 bp, Oryza sativa
tctctctctctctctcgcctccgcttcgaaacccccgacgcgaaggaagcgagacgaaaccctcgcgcgagccgcctccgccaccgccgcctccttccgaccagccgccgccgccgccgccgcgtcgccgaatccgggcgggggctaggcgcgggctccccgctccccgccgatcgaatccttcgagggagcaatggccggcgtggtgtggatgaggacgtgaggtgggagcgatggtggggatggaagggaagggggatgcatcggtgacaccagtgaggactagtgaccggctgcgtaagcggcccaagtacttcggtcgcaattatatgtactacaatccagccatacgcaagaagatgaagtctaagaagagagcggctgcatcacagattgccaagaagctgcttcgcaagtcagctgccagggcaccgcctgctgattctattgcagcaaatctacgtcgttcaacacgaaagcgaagaatgtctgtaaatctggaggactatgacaccgatagttctagtatggaagatgatgatcttatgaggcccagatatcgatcttcaaagaataaagtggatgacgaagtgtcagctaggccaaagcgcaagaagctgtccaactctagctccattcctcgccgtgagggtttacggcctagaagatctatccgaggacaaagacttcatccataccaagaatctgaggatgaccaggaaagctctgaagaacagcctgcacaagataggagggaaaatggtaatgatatcgaagaggatggcaatgaggaggaagttgatggaggtgatgaagctgaagcggatggagatgatgaagatggtgaggaagaacaagaagggaggaggagatatgatctcagggatcgttcagaagttcgtagaccctccccacggaaggaagggaagcacagaacacaatcaccccgtagagtactagtacatggaattggtccaaagaacagcaaatatttgaaaaagggtggttcacgcatgcataagcgccctcgattctcattgccagatgattcagatgattctcttcttgtggatgagccagatgaaggtccatccatgccatggatgcgtggtgggagaggaggtatgccgtggtttttaggtggattggatatgcattgtccaggagcatggggtctgaatgttggagcatccggttggggtcatcagggtgacaacacagtgagtacttcttcacttatgccagggatccaaactgctggaccaagttccaagggaggagctgatattcagcctctccaggttgacgggagtgtgagttttaatgatataggggggctgtccgattacattgatgcattgaaggaaatggttttcttccctttgctttatccagatttttttgcaaactatcacattactcctcctaggggtgttcttctctgtggccctcctggtacagggaagacattgattgctcgtgccttagcgtgtgctgcctctaaagctggtcagaaggttagcttttatatgagaaaaggagctgatgttcttagtaagtgggttggagaggctgaaaggcagctcaagctactgtttgaggaagctcagaagaatcagccatcaatcatattttttgacgaaatagatggtttggcacctgtgaggtctagcaagcaagagcagattcacaattcaattgtttctacattgcttgctttgatggatggtctggattcacgtggacaagttgttttgattggagcaacaaaccgaattgatgccattgatggagcattgcgtaggcctggccgatttgatcgtgagttcttttttcctctacctggttatgaggcaagggctgaaatactggacattcatacacggaaatggaaggaccctccaccaaaggaattaaagacggagcttgctgcaagctgtgtggggtattgtggagctgatttgaaagccttatgtacagaagctgctattcgagcatttagggagaagtatcctcaggtctacacgagtgacgataagtttgtcattgatgttgattcagtcagggttgagaagtaccacttcttggaagctatgtctacaataactccagctgcacatagggggtcgattgtgcattcaaggccgctgtcaccagttatcgctccttgtctaaaaaggcatcatgaaaaaataatggaaagaattgctgatattttccctttcctatcatcagtagatgttagcaagttctctgccctttcctatggatcatccatccctcttgtttatagacctcgacttttgatgtgcggtggtgtgagtgttggactggatcatgttgggccagctgttttgcacgaacttgagaaattttctgttcactccttggggttgccgtctcttctgtctgatccaagtgcaaagacacctgaagaagctcttgtgcacatttttggggaagctaggagaacaaccccgtcaatactgtacttgcctcagtttcatctttggtgggatacggcacatgaacagcttagggctgtgctattgactttgttgaatgagctgccatccaaccttccagttttgttgctaggaacctcgtcagtggcctttggtgaccttgaagaagagtgtgcttccatattttcttctcgtaatgtatatgaagtggatcaaccaagtgatgatgatagaatgagatacctgcatgcactgtttgagtcattgctctcatttcaaatggaagagtctaggagtaagtctaaagaccagaagtcttctgttgatcttcccaaagcaccaaaggaagtggatggtcccaaactttcagagctaaaagcgaaggcagaagccgaacaacatgctgttcgacggatgagaatgtgtcttcgagatatttgtaaccgcattctgtacaacaaaaggttcaatgtgtttcacttcccagtatccgaagaggaggtacctgactatagatctgtagttcacaatcctatggatatggctactgtcttacagcaggtggactctgggcagtaccttactcgggcctcatttatgaaggacattgatcttatagtctcaaatgcaaagacatataatgggagtgactacaatggatctcgtattgtcagtagagcatgtgaactacgagatgtggtgcaaggaatgttgtcacagatggacccatctttggtgtccttttgtgataaaattgctgaacaggggggaccactacaggttacggatgatggagatagctctattcttcaagcagcgcctgttgctcagctggtatctggtactaggatgagcgcaaggcttcgtaatgtacaaccagaagtaaatctatcacgaagttatgaggcgttgaagcggcaaaagaaaagcaccgaaactgaacaaggcatggttaaagaatcgacaacaagagatgacaagtctcttggtgatgttgatttgtcaaagccaatctccccagaagaagctccaaaagaaccagattcaaatggtgttctgaaagaaactgacaatccaccaactgaattaccagaattaccggaactaaatcctgaacccatggtgactgacaacggtgaaaacgcggccatgcctgctagcgacgacatacctgaacaactggaagtcgtgaagcgacgcttcatggaactcaccacaggctatggcgtgccacagctcgaaaggctttgcacccgggtaatgaaaggcatgatagaattgagcggtaaagaaagcaacgaggatcataggcggttagtcgttaggtatttgttgacatttgttgagaacagcgacaatttttaactcggaacggtaataagatattaagattcttgttccccaatgtacattctctttgccacaaagaatagtagtggaacgccccctatgagagtcaccaccctgcttccatgatgtaagaaagtaacaaactaccagatgctcagtgtgtcagtgacacagttttgccatggatgtttgtagccagccttgtagattaaatcctgatcaatttcagcatcttgtaatgtgatggatgatgtacctctctttgcacaaatatattagcaaggtttctcaattt

SEQ ID NO: 3197 - DNA, 4137 bp, Oryza sativa
gtcgtctcctctctctctctctctctctctcgcctccgcttcgaaacccccgacgcgaaggaagcgagacgaaaccctcgcgcgagccgcctccgccaccgccgcctccttccgaccagccgccgccgccgccgccgcgtcgccgaatccgggcgggggctaggcgcgggctccccgctccccgccgatcgaatccttcgagggagcaatggccggcgtggtgtggatgaggacgtgaggtgggagcgatggtggggatggaagggaagggggatgcatcggtgacaccagtgaggactagtgaccggctgcgtaagcggcccaagtacttcggtcgcaattatatgtactacaatccagccatacgcaagaagatgaagtctaagaagagagcggctgcatcacagattgccaagaagctgcttcgcaagtcagctgccagggcaccgcctgctgattctattgcagcaaatctacgtcgttcaacacgaaagcgaagaatgtctgtaaatctggaggactatgacaccgatagttctagtatggaagatgatgatcttatgaggcccagatatcgatcttcaaagaataaagtggatgacgaagtgtcagctaggccaaagcgcaagaagctgtccaactctagctccattcctcgccgtgagggtttacggcctagaagatctatccgaggacaaagacttcatccataccaagaatctgaggatgaccaggaaagctctgaagaacagcctgcacaagataggagggaaaatggtaatgatatcgaagaggatggcaatgaggaggaggaggttgatggaggtgatgaagctgaagcggatggagatgatgaagatggtgaggaagaacaagaagggaggaggagatatgatctcagggatcgttcagaagttcgtagaccctccccacggaaggaagggaagcacagaacacaatcaccccgtagagtactagtacatggaattggtccaaagaacagcaaatatttgaaaaagggtggttcacgcatgcataagcgtcctcgattctcattgccagatgattcagatgattctcttcttgtggatgagccagatgaaggtccatccatgccatggatgcgtggtgggagaggaggtatgccgtggtttttaggtggattggatatgcattgtccaggagcatggggtctgaatgttggagcatccggttggggtcatcagggtgacaacacagtgagtacttcttcacttatgccagggatccaaactgctggaccaagttccaagggaggagctgatattcagcctctccaggttgacgggagtgtgagttttaatgatataggggggctgtccaattacattgatgcattgaaggaaatggttttcttccctttgctttatccagatttttttgcaaactatcacattactcctcctaggggtgttcttctctgtggccctcctggtacagggaagacattgattgctcgtgccttagcgtgtgctgcctctaaagctggtcagaaggttagcttttatatgagaaaaggagctgatgttcttagtaagtgggttggagaggctgaaaggcagctcaagctactgtttgaggaagctcagaagaatcagccatcaatcatattttttgacgaaatagatggtttggcacctgtgaggtctagcaagcaagagcagattcacaattcaattgtttctacattgcttgctttgatggatggtctggattcacgtggacaagttgttttgattggagcaacaaaccgaattgatgccattgatggagcattgcgtaggcctggccgatttgatcgtgagttcttttttcctctacctggttatgaggcaagggctgaaatactggacattcatacacggaaatggaaggaccctccaccaaaggaattaaagacggagcttgctgcaagctgtgtggggtattgtggagctgatttgaaagctttatgtacagaagctgctattcgagcatttagggagaagtatcctcaggtctacacgagtgacgataagtttgtcattgatgttgattcagtcagggttgagaagtaccacttcttggaagctatgtctacaataactccagctgcacatagggggtcaattgtgcattcaaggccgctgtcaccagttatcgctccttgtctaaaaaggcatcttgaaaaaataatggaaagaattgctgatattttccctttcctatcatcagtagatattagcaagttctctgccctttcctatggatcatccatccctcttgtttatagacctcgacttttgatgtgcggtggtgtgagtgttggactggatcatgttggaccagctgttttgcacgaacttgagaaattttctgttcactccttggggttgccgtctcttctgtctgatccaagtgcaaagacacctgaagaagctcttgtgcacatttttggggaagctaggagaacaaccccgtcaatactgtacttgcctcagtttcatctttggtgggatacggcacatgaacagcttagggctgtgctattgactttgttgaatgagctgccatccaaccttccggttttgttgctaggaacctcgtcagtggcctttggtgaccttgaagaagagtgtgcttccatattttcttctcgtaatgtatatgaagtggatcaaccaagtgatgatgatagaatgagatacctgcatgcactgtttgagtcattgctctcatttcaaatggaagagtctaggagtaagtctaaagaccagaagtcttctgttgatcttcccaaagcaccaaaggaagtggatggtcccaaactttcagagctaaaagcgaaggcagaagctgaacaacatgctgttcgacggatgagaatgtgtcttcgagatatttgtaaccgcattctgtacaacaaaaggttcaatgtgtttcacttcccagtatccgaagaggaggtacctgactatagatctgtagttcacaatcctatggatatggctactgtcttacagcaggtggactctgggcagtaccttactcgggcctcatttatgaaggacattgatcttatagtctcaaatgcaaagacatataatgggagtgactacaatggatctcgtattgtcagtagagcatgtgaactacgagatgtggtgcaaggaatgttgtcacagatggacccatctttggtgtccttttgtgataaaattgctgaacaggggggaccactacaggttacggatgatggagatagctctattcttcaagcagcgcctgttgctcagctggtatctggtactaggatgagcgcaaggcttcgtaatgtacaaccagaagtaaatctatcacgaagttatgaggcgttgaagcggcaaaagaaaagcaccgaaactgaacaaggcatggttaaagaatcgacaacaagagatgacaagtctcttggtgatgttgatttgtcaaagccaatctccccagaagaagctccaaaagaaccagattcaaatggtgttctgaaagaaattgacaatccaccaactgaattaccagaattaccggaactaaatcctgaacccatggtgactgacaacggtgaaaacgcggccatgcctgctagcgacgacatacctgaacaactggaagtcgtgaagcgacgcttcatggaactcaccacaggctatggcgtgccacagctcgaaaggctttgcacccgggtaatgaaaggcatgatagaattgagcggtaaagaaagcaacgaggatcataggcggttagtcgttaggtatttgttgacatttgttgagaacagcgacaatttttaactcggaacggtaataagatattaagattcttgttccccaatgtacattctctttgccacaaagaatagtagtggaacgccccctatgagagtcaccaccctgcttccatgatgtaagaaagtaacaaactaccagatgctcagtgtgtcagtgacacagttttgccatggatgtttgtagccagccttgtagattaaatcctgatcaatttcagcatcttgtaatgtgatggatgatgtacctctctttgcacaaatatattagcaaggtttctcaatttactctcacg

SEQ ID NO: 3198 - DNA, 4076 bp, Brachypodium distachyon
atctttcaccttttctttccttggcaatcttctttcccctggcccatcttgctgccgggcgccccaaccccgtcgctcgtcttcctcttcgagccagcgccgccacccctccccccccgtcccgctgccgagcagcgccccagctccgtcgctcgtcttcctcctcatgcgagcgcctccaccgcagggagcaatgggcagcagtccgtgaggaggagggagatatggtgggaatggatgggaagggagatgcatcagtggcgcctgtgaggactagcgaccggctgcggcagcggccgaaatactacggacgaggatatctgtactactcaccaaacatgcgcaagaagataaagtctaagaagcgaacggctgcatcgcagattgccaagaagctgctccacaagccagctgcacctgccgattctattgcagcaaatctgcggcgttcaacgcggaagcgaagaatgtctgtaactctggaggactatggcacagatacttccagttcggaagatgatgatcttatgagacccagatatcggtcttcaaagagtaaagtgaatgatgaagtttctccaaggccgaaacgcaagatgtctaactcgaactccattccccgacgtgaaggtctacggcctagaagatctctgcgaggacaaagacatcatccataccaagattccgatgatgaccaggaaagttctgaagaacaacatacacaagatcagagagaaaatggtaatgatgttgaagaagatgatgctaatgaagatgaggttgatggaggtgatgaggctgaagcagatggagatgatgaagatggtgaggaagagcaagaaggaaggaggagatatgacctaagggatcgttcagaagttcgtaggccctccccacggaaggaagggaagcacagaccacaatctccccggagagtactagtacatggaattggtccgaagaatagcaagtatttaaaaaaaggtgggtcacgcatgcataagcgccctcgcttctcattgccagacgattccgatgattctcttctcgtggatgagccagatgaaggtccatccatgccatggatgcgtagtgggagaggaggcatgccatggtttttgggtgggttggacatgcatagttcagcagcatggggtctcaatgctggagcgtctggatggggtcatcaaggtgacagcacagtcagtacttcgtcacttatgccaggggcgcaaactgctggaccaagttcgaagggtggagctgatattcagcctctgcagattgatgaaagtgttagttttaatgatataggggggctgtctgagtacattgatgctttaaaggaaatggttttcttccctttgctgtatccagatttttttgcaaactatcacattactcctcccaggggagttcttctctgtggccctcctggtacagggaaaacattgattgcccgtgccttggcttgtgctgcctctaaagctggccagaaggtcagcttttatatgcgaaaaggagctgatgttcttagtaaatgggttggagaggctgaaagacagctcaaattactttttgaggaagctcaaaagaatcagccggcaatcatattttttgacgaaatagatggcctggcccctgtgagatctagcaagcaagagcaaattcacaattcaatagtttcaacattgctcgcgttgatggatggtcttgattcacgtgggcaagttgttttgattggagcaaccaatcgaatcgatgccattgatggtgcattgcgtagacctggccgatttgatcgcgagttctattttcctttgcctggctatgaagcacgagctgaaatactggatattcatacacggaaatggaaggatccccccccaaaggagctaaagttggagcttgctgcaagttgtgtgggatattgtggggctgatttgaaagcattatgtacagaagctgctattcgtgcgtttagagagaagtatcctcaggtttacacaagcgacgacaagtttgtcattgatgttgattcggtcagggttgagaagaaccacttcttggaagctatgtctacaataactccagctgcacataggggatcgattgtgcatgcaaggccactatcatcagttgttgctccatgtctgaagagacatcttgagaaaataatggaacggatttctgatgtttttccgttcatttcatcattagatgttagcaaattctcttctctttcgtatggatcttccatccctcttgtttataggcctcgccttttgatatgtggcgttgagggtgttggattggatcatgttgggccagctgttctgcatgagcttgagaaattttctgttcactccttgggcctgccatctcttctctccgatccaagtgcaaagacacctgaagaagctctcgtgcatatttttggagaagcaaggagaacaacaccgtccatactctacctgcctcagttccatctttggtgggatacggcacacgaacagcttagggctgtgttactgaccctgttgaatgagttggcatccaaccttccagttttcttgctaggaacatcctcagtggcctttgatgacctcgaagaagagtgtgcttccatattttcctcccgtaatgtatatcaagtggatcgaccaagtgatgatgataggttaagatacttcagtatattgtttgagtcattgttctcacttcaaatggatgactcaagatgtaagtcgaaagacaaaaaagcttctattgatcttccaaaagcaccaaaggaagtagatggtcctaaggtttccgagctgaaagctaaggcagaagctgagcaacacgccgttcgtcggatgagaatgtgtctccgagatatttgtaaccgcattctgtacaacaaaaggttcaatgcatttcacttcccagtatcagaagaggaagtacctgactatagagtaatagtccacaaccccatggatatggcttctgtcttgcagcgcgtggactctggacagtacttcactcgggcaacatttatgaaggatattgatcttatagtttcaaatgcgaagacttataatggtgatgactacaacggctctaggatcgtcagtagagcctgtgaactccgagatgtggtgcaaggtatgttgtcacagatggacccatctttggtgtctttttgtgataaaattgctgcacaggggggaccactgcaggctatggatgatgaggatagttccattctccaagcagctcctgttgttcagttagtttctgttactaggacgagtgcgaggcttcgtaatgtacagccagaagttgatctgtcacgaagttatgaggtgctaaagcggcacaaaaaaagtactgaaaacgaacaaggcatgaccatcaaagagtcaacagcaagggatgaaaggtctcctggtgatatagttctgccgaagccaacttccccagaagaagccttaaaagaaccagattccaatggccctttgaaagatactgacaatgtaccagctgaagcacccgcatcatctggttctcctcctgaacccatggttactgacaacggctatcccgccatgcataccagcgatgacacacttgaacagctggaagccgtgaagcagcgctttatggagctcaccgtgggctacggtgtgcctcaactcgagaggctttattcccggattatgaaaggtgtgatagagctgggaggtaaagaaagcaaagaggaccacagacggttagttgttaggcatttgttagtatttgttgagaacagcgacaatttttagctccagtggtaataagatattcttggttttccttgtgtacattctgttgtcttttggaacaacgaaatagtggaaaatcaatcttagggagctgtccatgcctcctgatgtaacaacaatctgcggaatgctcgaatgtcagtgacacagttttgcgtagcaactagcaactgctgtctttgtgcatttgagttttcagcatcacctttaacttgtgccatggtagtctcttatttctttagtttctcggtgtactttatcatg

SEQ ID NO: 3199 - DNA, 3785 bp, Triticum aestivum
gggggacgaatcggttgcgcccgtgaggtccagcgaccggctgcggcagcggcccaagtactacgggcggggatacctgtactactcgcccaacatgcgcaacaagatgaactccaacaagaagcggacggctgcatcgcagatcgccaagaagctgcttcgcaagccagctgcacgggaacctcctgccgattccattgcagcaaatctgcgccgttcaacgcggaagcgaagaatgtccgtaactctggaggactatggcacagatagttccagtatggaagatgatgaccttatgagacccagatatcggtcttcatcaaagagtaaaggggatgatcaagtgtcggcacggccgaagcgcaagaaaatgtctaactctaactccattccccgccgtgaaggtttaaggcctagaagatctctgcggggacaaaggcatcttccataccaagtttctgatgatgatcaggaaagttctgaagaagaacatgaacaagatcagagagaaaatggcaatgaaatcgaagaggatggtgccaatgaagaggagattgatggaggtgatgaagctgaagaagatggagatgatgaagacggcgaggaagagcaagaagttaggaggagatatgatctaagggatcgtgcagaagttcgtagaccctccccacagaaggaagggaagcacagaccacaatctccccgcagagtacttgtacaaggagttggtccaaagaacagcaagtatttaaaaaaaggtggttcacgcatgcataagcgccctcgtttttcaatgccagatgattcagatgattctcttctcgtggatgagccggatgaaggtccatccatgccatggatgcgtagtgggagaggcggtatgccaccatggcttatgggtggattggacatgcataattcagcagcatggggtctcaatgctggagcatctggatggggtcatcagggtgatactggagtcagtacttcatcacttatgccaggggcacaaactgctggcccaagttccaagggaggagctgatattcagcctctgcagattgatgagagtgtaagttttaatgatattggaggtttgtctgagtacattgatgccttaaaggaaatggtgttcttccctttgctgtatccagatttttttgcaaactatcacataactcctcctcggggagttcttctctgtggacctcctggtacagggaagacattgattgcccgtgcattagcttgtgctgcctctaaagctggccagaaggtcagcttctatatgcgaaaaggagctgatgttcttagtaaatgggttggagaggctgaaaggcagctcaagttgctttttgaggaagctcaaaagaatcagccggcaatcatattttttgatgaaatagatggccttgcccctgtgagatctagcaagcaagagcagattcacaattcaatagtctcaacattgcttgctttgatggacggtcttgattcacgtggacaagttgttttgattggagcaaccaatcggattgatgccattgatggggcattgcgtagacctggccgttttgatcgcgagttctattttcctttacctggctatgaggcacgagctgaaatactggatattcatacacggaaatggaaggaacccccgccaaaggagctaaagatggagcttgctgcgagctgtgttgggtattgtggtgctgatttgaaagcattatgtactgaagctgctattcgagcatttagggagaaatatcctcaggtttacacaagtgatgacaagtttgtcattgatgtagactcggtcagggttgagaggaaccacttcttggaagctatgtctacaataactccagctgcacataggggatcaattgtgcattcaagaccactgtcaccggttattgctccatgtttgaagagacatcttgagaagataatggaaaggatttctgatatttttccttacctttcagcattggatcttagcaaatactctaccctttcatatggatcttccatccctcttgtttataggcctcgccttttgatgtgtggcgttgagggtgttggactggatcatgttgggccagctgttttgcatgagcttgagaaatttcctgtgcactccttggggctgccatctcttctctctgatccaagtgcaaagacacctgaagaagctcttgtgcatatttttggggaagcaaggagaacaacaccgtccatactctacttgccacagttccatctttggtgggatacggcacatgaacagcttagggcagtgttattgactcttctgaatgaattggcatccaaccttccagtattgttgctaggaacatcatcagtggcctttgatgatctcgaagaagagtgtgcttccatattttcttctcgtaatgtatatcaagtggatcgaccaagtgatgatgatagattaagatacttcagtatactgtttgagtcactgctctcacttcaaatggaagattcaagaagcaagtcaaaagagcaaaagtctatcgatcttccaaaagcaccaaagaaagtagatgggcctaaggtttctgagctgaaagctaaggcagaagctgagcaacacgctgttcgtcggatgagaatgtgtctacgagatatttgtaaccgcattctatacaacaaaaggttcactgcatttcacttcccagtatcagaagaggaagtacctgactatcgaacaatagttcacaaccccatggatatggctgctgtcttgcagcgggtggactctggacagtacttctctcaggcagcatttttgaaggatattaatcttatagtcaccaatgcaaagacttataatggcgacgattacaatggatctaggatcgtgagcagagcatgtgaacttcgagatgtggtgcaaggtatgttgtcacagatggacccatcgttggtatccttttgtgataaaattgctgcacaagggggaccactgcaggctatggatgatgaggatagctccatcctccaagcgccgcctgttgttcagttagtttctgttactagaacaagtgcgaggcttcgtaatgtacaaccagaagttgatctgtcacgaagttatgaggtgctaaagcggcacaagaaaagcactgaaaacgaacatggcacctctgccaaagaatcgacagcaagagacggaacgtcttctggcgatgtagatctgtcaaagccaacttccccagaggaagctccaaaaggaccacattcaaatggccctttgaaagaagctgacaaagcaccagatgaagcacctccaattctacctggttctcctcccgacccaatggagactgacaatggcgaagattctgccatgcctactagcgatgacacgcttgaacagctggaaggcttgaaacagcgcttcatggagctcaccgtgggctacggggtgccgcagctcgagaggctctactcgcggataatgaaaggcgcgatagagttgacaggtaaagaaaccaacaaggatcatagacggttagttgttaggcatttgttggcattcgttgagaacagcgacaatttttaactctagcaggaataagaggttttactggttttccctgtgtacattctgttgtctgttggagcaacaaccccgaggagctgtccatgcctcctgatgtagtgatgtaacaacattttctgaaatgctcagtggcattacaacagttttgtgtagcaagttctgttctggtctttgaggatttgaattttcagaa

SEQ ID NO: 3200 - DNA, 4134 bp, Hordeum vulgare
gcgcaggagagaggagaggtgaggaaaggaaggaaaccctcgcgtcgtctcctccgctccgaaacccccgacgccaaggaaaccctcgcgagcccgcagccgcctccgcccccgcccgcgccgccgccccgaatccggccggtgctcgccgccccgcccccctcgccgctcctttccccgagggagcaatgggcggcagcagcagcagcagtgattgaggaggagtgagatatggcgggaatggctgggaagggggacgattcggttgcgcccgtgaggtccagcgaccggctgcggcagcggaccaagtactacagccggggatacctgtactactcgcccagcatgcgcaacaagatgaagtccaacaagaagcggacggctgcgtcgcagatcgccaagaagctgcttggcaagccagccgcacgggaacctcctgccgattctattgcagcaaatttgcgccgttcaacgcggaagcgaagaatgtctgtaactctggaagactacggcacagatagttccagtatggaagatgatgaccttatgaggcccagatatcggtcttcatcaaagagtaaaggggatgatcaagtgtcgtcacggccgaaatgcaagaaaatgtctaactctaactccattccccgtcgtgaaggtttaaggcctagaaggtctctgcggggacaaaggcatcttccataccaagtttctgatgatgatcaggaaagttctgaagaagaacatgaacaagatcagagggaaaatggcaatgaagtcgaagaggatggtgccaatgaagaggagattgatggaggtgatgaagctgaagaagatggaggtgatgaagctgaagaagatggagatgatgaagacggcgaggaagagcaagaagttaggaggagatatgatctaagggaccgtgcagaagttcgtagaccctccccacagaaggaagggaagcaccgaccacaatctccccgcagagtacttgtacaaggaattggtccaaagaacagcaagtatttaaaaaaaggtgggtcacgcacgcataagcgccctcgtttttcagtgccagatgattcagatgattctcttctcgtggatgagccggatgaaggtccatccatgccatggatgcgtagtgggagaggcggtatgccaccatggcttatgggtggattggacatgcataattcaacagcatggggtctcaatgctggagcatctggatggggtcatcagggtgatactggagtcagtacttcatcacttatgccaggggcgcaaactgctggcccaagttccaagggaggagctgatattcagcctctgcagattgatgagagtgtaagttttaatgatattggaggtttgtctgagtacattgatgctttaaaggaaatggtattcttccctttgctgtatccagatttttttgcaaactatcacataactcctcctaggggagttcttctctgtggacctcctggtacagggaagacattgattgcccgtgcattagcttgtgctgcctctaaagctggccagaaggtcagcttttatatgcggaaaggagctgatgttcttagtaaatgggttggagaggctgaaaggcagctcaagttgctttttgaggaagctcaaaagaatcagccggcaatcatattttttgatgaaatagatggccttgcccctgtgagatctagcaagcaagagcagattcacaattcaatagtctcaacattgcttgctctgatggacggtcttgattcgcgtggacaagttgttttgattggagcaaccaatcggattgatgccattgatggggcattgcgaagacctggccgttttgatcgcgagttctattttcctttacctggctatgaggcacgagctgaaatattggatattcatacacggaaatggaaggaaccccctccaaaggagctaaagatggagcttgctgcgagctgtgttgggtattgtggtgctgatttgaaagcattatgtactgaagctgctatccgagcttttagggagaaatatcctcaggtttacacaagtgatgacaagtttgtcattgatgtagactcggtcagggttgagaggaaccacttcttggaagctatgtctacaataactccagctgcacataggggagcaattgtgcattcaaggccactgtcaccggttattgctccatgtttgaagagacatcttgagaagataatgcaaaggatttctgatacttttccttacctttcagcattggatattagcaaatactctaccctttcatatggatcttccatccctcttgtttataggcctcgccttttgatgtgtggcgttgagggtgttggactggatcatgttgggccagctgttttgcatgagcttgaaaaatttcctgtgcactccttggggctgccatctcttctctctgatccaagtgcaaagacacctgaagaagctctcgtgcatatttttggggaagcaaggagaacaacaccgtccatactctacttgccacagttccatctttggtgggatacggcacatgaacagcttagggcagtgttattgactcttttgaatgagttggcatccaaccttccagtattgttgctaggaacatcatcagtggcctttgatgaccttgaagaagagtgtgcttccatattttcttctcgtaatgtatatcaagtggatcgaccgagtgatgatgatagatcaagatacttcagtatactgttcgagtcactgctctcacttcaaatggaagattcaagaagtaagtcgaaagagcaaaagtctgtcgatcttccaaaagcaccaaagaaagtagatggacctaaggtttctgagctgaaagctaaggcagaagctgagcaacacgctgttcgtcggatgagaatgtgtctccgagatatttgtaaccgcattctatacaacaaaaggttcagtgcatttcacttcccggtatcagaagaggaagtacctgactatcgaacaatagttcacaaccccatggatatggctgctgtcttgcagcgggtggactctgggcagtacttctctcaggcagcatttttgaaggatattaatcttatagtcactaatgcaaagacttacaatggtgatgattacaatggatctaggatcgtgagtagagcatgtgaacttcgagacgtggtgcaaggtatgttgtcacagatggacccatcattggtatccttttgtgataaaattgctgcacaagggggaccactgcaggctatggatgatgaggatagctccattcttcaagcgccgcctgttgttcagttagtttctgttactagaacaagtgcaaggcttcgtaatgtacaaccagaagttgctctgtcacgaagttatgaggtgctaaagcgacacaagaaaagcaccgaaaacgatcatggcaccgctgccaaagaatcaacagcaagagatgaaaggtctcctggtgatgtagatctgtcaaagccaacttccccagaggaggctccaaaaggatcacacccaaatggcccttcgaaaaaagctgacaaagcgccagctgaatcacccccaatactacctggttctcctcccgacccaatggagactgacaatggcgaagactctgccatgcctaccagcgatgacacgcttgaacagctggagggcgtgaagcagcgcttcatggagctgaccgtgggctacggggtgccgcagctcgagaggctttactcgcggataatgagaggcgcgatagagttgacaggtaaagaaaccaacaaggatcatagacggttagttgttaggcatttgttggcatttgttgagaacagcgacaatttttaactctagcaggaacaagagattttactggttttccctgtgtacattctgttgtctgttggaacaacaaccctgaggagctgtccatgcctcctgatgtagtggtgtaacaacattttctgaaatgctcagtggcattacaacagttttgcatagctagttctgttgccgtcttctgaggatttgactttcagcaccgcctttgtttgttactccctttgtagtgatctaaacgcttttatatttctttatggagggagtactatataa

SEQ ID NO: 3201 - DNA, 3951 bp, Hordeum vulgare
tcagggagcaatgggcggcagcagcagcagcagtgattgaggaggagtgagatatggcgggaatggctgggaagggggacgattcggttgcgcccgtgaggtccagcgaccggctgcggcagcggaccaagtactacagccggggatacctgtactactcgcccagcatgcgcaacaagatgaagtccaacaagaagcggacggctgcgtcgcagatcgccaagaagctgcttggcaagccagccgcacgggaacctcctgccgattctattgcagcaaatttgcgccgttcaacgcggaagcgaagaatgtctgtaactctggaagactacggcacagatagttccagtatggaagatgatgaccttatgaggcccagatatcggtcttcatcaaagagtaaaggggatgatcaagtgtcgtcacggccgaaatgcaagaaaatgtctaactctaactccattccccgtcgtgaaggtttaaggcctagaaggtctctgcggggacaaaggcatcttccataccaagtttctgatgatgatcaggaaagttctgaagaagaacatgaacaagatcagagggaaaatggcaatgaagtcgaagaggatggtgccaatgaagaggagattgatggaggtgatgaagctgaagaagatggaggtgatgaagctgaagaagatggagatgatgaagacggcgaggaagagcaagaagttaggaggagatatgatctaagggaccgtgcagaagttcgtagaccctccccacagaaggaagggaagcaccgaccacaatctccccgcagagtacttgtacaaggaattggtccaaagaacagcaagtatttaaaaaaaggtgggtcacgcacgcataagcgccctcgtttttcagtgccagatgattcagatgattctcttctcgtggatgagccggatgaaggtccatccatgccatggatgcgtagtgggagaggcggtatgccaccatggcttatgggtggattggacatgcataattcaacagcatggggtctcaatgctggagcatctggatggggtcatcagggtgatactggagtcagtacttcatcacttatgccaggggcgcaaactgctggcccaagttccaagggaggagctgatattcagcctctgcagattgatgagagtgtaagttttaatgatattggaggtttgtctgagtacattgatgctttaaaggaaatggtattcttccctttgctgtatccagatttttttgcaaactatcacataactcctcctaggggagttcttctctgtggacctcctggtacagggaagacattgattgcccgtgcattagcttgtgctgcctctaaagctggccagaaggtcagcttttatatgcggaaaggagctgatgttcttagtaaatgggttggagaggctgaaaggcagctcaagttgctttttgaggaagctcaaaagaatcagccggcaatcatattttttgatgaaatagatggccttgcccctgtgagatctagcaagcaagagcagattcacaattcaatagtctcaacattgcttgctctgatggacggtcttgattcgcgtggacaagttgttttgattggagcaaccaatcggattgatgccattgatggggcattgcgaagacctggccgttttgatcgcgagttctattttcctttacctggctatgaggcacgagctgaaatattggatattcatacacggaaatggaaggaaccccctccaaaggagctaaagatggagcttgctgcgagctgtgttgggtattgtggtgctgatttgaaagcattatgtactgaagctgctatccgagcttttagggagaaatatcctcaggtttacacaagtgatgacaagtttgtcattgatgtagactcggtcagggttgagaggaaccacttcttggaagctatgtctacaataactccagctgcacataggggagcaattgtgcattcaaggccactgtcaccggttattgctccatgtttgaagagacatcttgagaagataatgcaaaggatttctgatacttttccttacctttcagcattggatattagcaaatactctaccctttcatatggatcttccatccctcttgtttataggcctcgccttttgatgtgtggcgttgagggtgttggactggatcatgttgggccagctgttttgcatgagcttgaaaaatttcctgtgcactccttggggctgccatctcttctctctgatccaagtgcaaagacacctgaagaagctctcgtgcatatttttggggaagcaaggagaacaacaccgtccatactctacttgccacagttccatctttggtgggatacggcacatgaacagcttagggcagtgttattgactcttttgaatgagttggcatccaaccttccagtattgttgctaggaacatcatcagtggcctttgatgaccttgaagaagagtgtgcttccatattttcttctcgtaatgtatatcaagtggatcgaccgagtgatgatgatagatcaagatacttcagtatactgttcgagtcactgctctcacttcaaatggaagattcaagaagtaagtcgaaagagcaaaagtctgtcgatcttccaaaagcaccaaagaaagtagatggacctaaggtttctgagctgaaagctaaggcagaagctgagcaacacgctgttcgtcggatgagaatgtgtctccgagatatttgtaaccgcattctatacaacaaaaggttcagtgcatttcacttcccggtatcagaagaggaagtacctgactatcgaacaatagttcacaaccccatggatatggctgctgtcttgcagcgggtggactctgggcagtacttctctcaggcagcatttttgaaggatattaatcttatagtcactaatgcaaagacttacaatggtgatgattacaatggatctaggatcgtgagtagagcatgtgaacttcgagacgtggtgcaaggtatgttgtcacagatggacccatcattggtatccttttgtgataaaattgctgcacaagggggaccactgcaggctatggatgatgaggatagctccattcttcaagcgccgcctgttgttcagttagtttctgttactagaacaagtgcaaggcttcgtaatgtacaaccagaagttgctctgtcacgaagttatgaggtgctaaagcgacacaagaaaagcaccgaaaacgatcatggcaccgctgccaaagaatcaacagcaagagatgaaaggtctcctggtgatgtagatctgtcaaagccaacttccccagaggaggctccaaaaggatcacacccaaatggcccttcgaaaaaagctgacaaagcgccagctgaatcacccccaatactacctggttctcctcccgacccaatggagactgacaatggcgaagactctgccatgcctaccagcgatgacacgcttgaacagctggagggcgtgaagcagcgcttcatggagctgaccgtgggctacggggtgccgcagctcgagaggctttactcgcggataatgagaggcgcgatagagttgacaggtaaagaaaccaacaaggatcatagacggttagttgttaggcatttgttggcatttgttgagaacagcgacaatttttaactctagcaggaacaagagattttactggttttccctgtgtacattctgttgtctgttggaacaacaaccctgaggagctgtccatgcctcctgatgtagtggtgtaacaacattttctgaaatgctcagtggcattacaacagttttgcatagctagttctgttgccgtcttctgaggatttgactttcagcaccgcctttgtttgttactccctttgtagtgatctaaacgcttttatatttctttatggagggagtacta

SEQ ID NO: 3202 - DNA, 3709 bp, Secale cereale
cggggatacctgtactactcgcccaacatgcgcaacaagatgaactccaacaagaagcggacagctgcatcacagatcgccaagaagctgcttcgcaagccagccgcacgggaacctcctgccgattctattgcagcaaatttgcgccgttcaacgcggaagcgaagaatgtctgtaactctggaggactacggcacagatagttccagtatggaagatgatgaccttatgagacccagatatcggtcttcatcaaagagtaaaggggatgatcaagtgtcggaacggccgaagcgcaagaaaatgtctaactctaactccattccccgccgtgaaggtttaaggcctagaagatctctgcggggacaaaggcatcttccataccaagtttctgatgatgatcaggaaagttctgaagaagaacatgaacaagatcagagagaaaatggcaatgaaatcgaagaggatggtgccaatgaagaggaggttgatggaggtgatgaagctgaagaagatggagatgatgaagacggcgaggaagagcaagaagttaggaggagatatgatctaagggatcgtgcagaagttcgtagaccctccccacagaaggaagggaagcacagaccacaatctccccgcagagtacttgtacaaggaattggtccaaagaacagcaagtatttaaaaaaaggtgggtcacgcatgcataagcgccctcgtttttcaatgccagatgattcagatgattctcttctcgtggatgagccggatgaaggcccatccatgccatggatgcgtagtgggagaggcggtgtgccaccatggcttatgggtggattggacatgcataattcagcagcatggggtctcaatgctggagcatctggatggggtcatcagggtgatactggagtcagtacttcatcacttatgccaggggcacaaactgctggcccaagttccaagggaggagctgatattcagcctctgcagattgatgagagtgtaagttttaatgatattggaggtttgtctcagtacattgatgctttaaaggaaatggtgttcttccctttgctgtatccagatttttttgcaaactatcacataactcctcctaggggagttcttctctgtggacctcctggtacagggaagacattgattgcccgtgcattagcttgtgctgcctctaaagctggccagaaggtcagcttttatatgcgaaaaggagctgatgttcttagtaaatgggttggagaggctgaaaggcagctcaagttgctttttgaggaagctcaaaagaatcagcctgcaatcatattttttgatgaaatagatggccttgcccctgtgagatctagcaagcaagagcagattcacaattcaatagtctcaacattgcttgctttgatggacggtcttgattcacgtggacaagttgttttgattggagcaaccaatcggattgatgccattgatggggcattgcgtagacctggccgttttgatcgcgagttctattttcctttacctggctacgaggcacgagctgaaatactggatattcatacacggaaatggaaggaacccccgccaaaggagctaaagatggagcttgctgcgagctgtgttgggtattgtggtgctgatttgaaagcattatgtactgaagctgctattcgagcatttagggagaaatatcctcaggtttacacaagtgatgacaagtttgtcattgatgtagagtcggtcagggttgagaggaaccacttcttggaagctatgtctacaataactccagctgcacataggggatcaattgtgcattcaagaccattgtcaccggttattgctccatgtttgaagagacatcttgagaagataatggaaaggatttctgatatttttccttacctttcagcattggatcttagcaaatactctaccctttcatatggatcttccatccctcttgtttataggcctcgccttttgatgtgtggcgttgagggtgttggactggatcatgttgggccagctgttttgcatgagcttgagaaatttcctgtgcactccttggggctgccatctcttctctctgatccaagtgcgaagacacctgaagaagcccttgtgcatatttttggggaagcaaggagaacaacaccgtccatactctacttgccacagttccatctttggtgggatacggcacatgaacagcttagggcagtgttattgactcttctgaatgaattggcatccaaccttccagtattgttgctaggaacatcatcagtggcctttgatgacctcgaagaagagtgtgcttccatattttcttctcgtaatgtgtatcaagtggatcgaccgagtgacgatgatagattaagatacttcagtatactgtttgagtcactgctctcacttcaaatggaagattcaagaagcaagtcgaaagagcaaaagtctatcgatcttccaaaagcaccaaagaaagtagatggccctaaggtttctgagctgaaagctaaggcagaagctgagcaacacgctgttcgtcgaatgagaatgtgtctacgagatatttgtaaccgcattctatacaacaaaaggttcactgcatttcacttcccagtatcagaagaggaagtacctgactatcgaacaatagttcacaaccccatggatatggctgctgtcttgcagcgggtggactctggacagtacttctctcaggcagcatttttgaaggatattaatcttatagtcactaatgcaaagacttataatggtgacgattacaatggatctaggatcgtgagtagagcatgtgaacttcgagatgtggtgcaaggtatgttgtcacagatggacccatcattggtatccttttgtgataaaattgctgcacaagggggaccactgcaggctatggatgatgaggatagctccattctccaagcgccgcctgttgttcagttagtttctgttactagaacaagtgcgaggcttcgtaatgtacaaccagaagttgatctgtcacgaagttatgaggtgctaaagcggcacaagaaaaacaccgaaaacgaacatggcaccgctaccaaagaatcgacagcaagagacgggaggtctcctggtgatgtagatttgtcaaagccaacttccccagaggaagctccgaaaggaccacattcaaatggcccttcgaaagaagctcacaaagcaccagatgtagcacctccaatactacctggttctcctcctgacccaatggagactgacaacggcgaagattctgccatgcctaccagcgatgacatgcttgaacagctggaaggcgtgaaacagcgcttcatggagctcaccgtgggctacggggtgccgcagctcgagaggctctactcgcggataatgaaaggcgcgatagagttgacaggtaaagaaaccaacaaggatcatagacggttagttgttaggcatttgttggcatttgttgagaacagcgacaatttttaactctagcaggaataagaggtttttactggttttccctgtgtacattctgttgtctgttggagcaacaaccctgaggagctgtccatgcctcctgatgtagtgatgtaacaacattttctgaaatgctcagtggcattacaacagttttgtgtagcaagttctgttgcggtctttgaggatttga

SEQ ID NO: 3203 - DNA, 3626 bp, Triticum aestivum
gccgattctattgcagcaaatttgcgccgttcaacgcggaagcgaagaatgtctgtaactctggaggactatggcacagatagttccagtatggaagatgatgaccttatgagacccagatatcggtcttcttcaaagagtaaaggggatgatcaagtgtcggcacggccgaagcgcaataaaatgtctaactcgaactccattccccgccgtgaaggtttaaggcctagaagatctctgcggggacaaaggcatcttccataccaagtttctgatgatgatcaggaaagttctgaagaagaacatgaacaagatcagagagaaaatggcaatgaagtcgaagaggacggtgccaatgaagaggagattgatggaggtgatgaagctgaagaagatggagatgatgaagacggcgaggaagagcaagaagttaggaggagatatgatctaagggatcgtgcagaagttcgtagaccctccccacagaaggaagggaagcacagaccacaatctccccgcagagtacttgtacaaggaattggtccaaagaacagcaagtatttaaaaaaaggtggttcacgcatgcataagcgccctcgtttctcaatgccagatgattcagatgattctcttctcgtggatgagccggatgaaggtccatccatgccatggatgcgtagtgggagaggtggtatgccaccatggcttatgggtggattggacatgcataattcagcagcatggggtctcaatgctggagcatctggatggggtcatcagggtgatactggagtcagtacttcatcacttatgccaggggcacaaactgctggcccaagttccaagggaggagctgatattcagcctctgcagattgatgagagtgtaagttttaatgatattggaggtttgtctgagtacattgatgctttaaaggaaatggtgttcttccctttgctgtatccagatttttttgcaaactatcacataactcctcctaggggagttcttctctgtggacctcctggtacagggaagacattgattgcccgtgcattagcttgtgctgcctctaaagctggccagaaggtcagcttttatatgcgaaaaggagctgatgttcttagtaaatgggttggagaggctgaaaggcagctcaagttgctttttgaggaagctcaaaagaatcagcctgcaatcatattttttgatgaaatagatggccttgcccctgtgagatctagcaagcaagagcagattcacaattcaatagtgtcaacattgcttgctttgatggacggtcttgattcacgtggacaagttgttttgattggagcaaccaatcggattgatgccattgatggggcattgcgtagacctggccgttttgatcgcgagttctattttcctttacctggctatgaggcacgagctgaaattctggacattcatacacggaaatggaaggaacccccgccaaaggagctaaagatggagcttgctgcgagctgtgttgggtattgtggtgctgatttgaaagcattatgtactgaagctgctattcgagcatttagggagaaatatcctcaggtttacacaagtgatgacaagtttgtcattgatgtagactcggtcagggttgagaggaaccacttcttggaagctatgtctacaataactccagctgcacataggggatcaattgtgcattcaagaccactgtcaccggttattgctccatgtttgaagagacatcttgagaagataatggaaaggatttctgatatttttccttacctttcagcattggatcttagcaaatactctaccctttcatatggatcttccatccctcttgtttataggcctcgccttttgatgtgtggcgttgagggtgttggactggatcatgttgggccagctgttttgcatgagcttgagaaatttcctgtgcactccttggggctgccatctcttctctctgatccaagtgcaaagacacctgaagaagctctcgtgcatatttttggggaagcaaggagaacaacaccgtccatactatacttgccacagttccatctttggtgggatacggcacatgaacagcttagggcagtgttattgactcttctgaatgaattggcatccaatcttccagtattgttgctaggaacatcatcagtggcctttgatgacctcgaagaagagtgtgcttccatattttcttctcgtaatgtatatcaagtggatcgaccaagtgatgatgatagatcaagatactttagtatactgtttgagtcactgctctcacttcaaatggaagattcaagaagcaagtcgaaagagaaaaagtctatcgatcttccaaaagcaccaaagaaagtagatgggcctaaggtttctgagctgaaagctaaggcagaagctgagcaacacgctgttcgtcggatgagaatgtgtctacgagatatttgtaaccgcattctatacaacaaaaggttcactgcatttcacttcccagtatcagaagaggaagtacctgactatcgaacaatagttcacaaccccatggatatggctgctgtcttgcagcgggtggactctggacagtacttctctcaggcagcatttttgaaggatattaatcttatagtcaccaatgcaaagacttataatggcgacgattacaatggatctaggatcgtgagcagagcatgtgaacttcgagatgtggtgcaaggtatgttgtcacagatggacccatcattggtatccttttgtgataaaattgctgcacaagggggaccactgcaggctatggatgatgaggatagctccattctccaagcgccgcctgttgttcagttagtttctgttactagaacaagtgcgaggcttcgtaatgtacaaccagaagttgatctgtcaagaagttatgaggtgctaaagcggcacaagaaaagcaccaaaaacgaacatggcactgctgccaaagaatcgacggcaagagatggaaagtctcctggtgatgtagatctgtcaaagccaacttccccagaggaagctccaaaaggaccacattcaaatggccctttgaaagaagctgacaaagcaccagatgaagcacctccaacactacctggttctcctcccgacccaatggagactgacaacggcgaagattctgccatgcctaccagcgatgacatgcttgaacaactggaaggtgtgaaacagcgcttcatggagctcaccgtgggctacggggtgccgcagctcgagaggctctactcgcggataatgaaaggcgcgatagagttgacaggtaaagaaaccaacaaggatcatagacggttagttgttaggcatttgttggcatttgttgagaacagcgacaatttttaactctagcaggaataagaggttttactggttttccctgtgtacattctgttgtctgttggagcaacaaccctgaggagctgtccatgcctcctgatgtagtgatgtaacaacattttctgaaatgctcagtggcattacaacagttttgtgtagcaagttctgttgcggtctttgaggatttgaattctcagtgccgcctttctttgatctataccagtcat

SEQ ID NO: 3204 - DNA, 3598 bp, Echinochloa colona
cctccctccccctcccctgacctccagccttccagagcccactgccctcatcggcggcggcggcgggatgagcgtgtggaactacgtcgttacggcgcacaagccgaccagcgtcagccactcctgcgtcggcaacttcaccagctccaaccagctcaacctcatcatcgcgaaatgtacccgcatcgagatccatttgcttactcctcagggcctacagcctatgcttgatgtacctatatatggaagaattgcaacgattgagctcttccggcctcataatgagactcaggattttcttttcattgctacggagaggtacaaattctgtgttctgcaatgggatgcagaaaaatcggagcttctcaccaggtccatgggtgatgtttctgatcgcattggtcgtcctactgacaatggacagattggaattatcgacccagactgtagacttattggtcttcacctctatgacggcttatttaaggttataccatttgacaacaaaggacagctgaaggaagctttcaatatcaggcttgaagaacttcaagtactggacatcaagtttttgcatggttgtgttaaacctactattgttgtcctctaccaggataataaagatgcaaggcatgttaagacatatgaagttgcactgaaggacaaagattttgttgaaggtccttggtcccagaataatttagacaatggtgccggtttgttaatacctgtaccagctccacttggtggcgtgataattattggcgaggagacaatagtttactgcaatgccaatgctacatttaaagctattccaataaaacaatccattataagagcttatggacgggttgacccagatggttctcggtatttactcggtgataatacaggaattcttcatttacttgtccttacccatgaacgagaaagggttactggtttgaaagtagaatacttgggagagacttcaattgcatcgtcaatttcatatctcgataatggcgttgtttacgttggttcacgttttggggattcccagttggtaaagctgaacctccaagctgatgcaagtggttcatttgttgaagttctggaacggtatgtgaatcttggacctattgtggacttctgtgttgttgaccttgataggcagggtcagggtcaggttgtcacttgttctggggctttcaaagatggttcccttcgtgtggttcggaatggtatagggattaatgagcaggcttcagtagaactccaaggcatcaagggattatggtcgttgaaatcttctttcaatgatccttacgacatgtacctagtcgtgagcttcataagcgagacacggttcttggcaatgaacatggaggatgaactagaagaaactgagattgaggggtttgatgcacaaacccagaccctgttttgtcaaaatgcgataaatgatcttcttatacaggttactgctaattctgttcggttagtcagttgtacctctcgggagctagtggatcaatggaatgcaccatctggattttcagtcaatgttgcttcagctaatgccagtcaggttctgttggcaacaggtggtggccatctcgtttacctagaaattagggatgctaagctcgttgaagtgaagcatgcacagctagaacatgagatttcttgtcttgatttgaacccaattggcgagagtccacagtatagttccctagctgctgttgggatgtggactgatataagtgttagaatattttcacttccagaccttgaattaataaagaaggaaaatttgggtggagaaattgttcctcggtctgttctgctgtgcaccttggagggggtttcatatttgctttgcgctcttggagatggtaacctgttcagttttctgctgaatgcaagtacaggcgaactgactgatagaaagaaggtttcccttgggacacaaccaatcagccttcgcacattctcatcaaagggtaccacccacgtgtttgcttcatcagataggccaactgtcatctatagcagcaataagaagcttctctatagcaatgtcaatttgaaagaagttaatcatatgtgtcctttcaatacagccgcttttccagacagtcttgcaattgctaaagaaggtgaactctcaattggaacaattgatgatatccaaaagcttcatatccgcacaatcccccttaatgaacaagcacggcgcatttgccaccaggagcaatcaaggacaatagcattttgcagtttcaagtacaaccagaccagtatggaggaaagtgagactcattatattcgtctgttagatcatcagacttttgagttcctgtctacatatcctctagatcaatatgaatgtggctgctccatcattagctgctcatttgcggatgatagtaatgtttattactgtgtgggaactgcatatgttatacctgaggaaaatgaaccaacaaagggccgaatccttgtatttgcagttgaagatggaaggttgcaattaattgtagaaaaagaaactaaaggagcggtttattcactgaatgcattcaatgggaaattgttggctgctatcaaccagaagattcaattatataagtggatgctacgtgatgatagttcacatgagctgcagtctgagtgtgggcaccatgggcacatactggccttgtatacgcaaacccgtggcgatttcattgtggttggagatctgatgaaatcaatatccttgctggtctacaagcatgaggaaagtgcgatcgaagagcgcgctagagattacaatgcgaactggatgactgcagttgagatgcttgatgatgaagcctatatcggggcagagaacagctataacctattcactgtgcgtaagaacagtgatgcagccacagatgacgaaagggccaggctggaggttgtcggggagtaccatcttggagagttcgtgaatcgattccgccatggttcacttgtaatgcgccttccggactcagagatagggcagattcccacggttatctttggcacaataaacggggtaattggcatcatcgcctccctcccacatgaccaatatgtgtttctggagaagctccagtccactcttgtgaagttcataaagggtgttggaaacctgagccatgagcaatggcgttcgtttcataatgacaagaagacggcggaggctcggaacttccttgatggcgacctgatcgaatcattccttgaccttagcaggagcaagatggaggaggtatcaaaggctatgggtgttcctgtggaggagttgtccaagagggtggaagagttgaccaggcttcactagataaataatatagaagtttgctgtaacttaattgcatgtaaatcctttgtaacctgtattttgtgttgtcgcagtgccatgtagtagttcctagtgcagggagttgcctctgcaatgctgttgccaccggtcgcacaagcagtgttcacccgtggttgtactttgagtttcctttgctttgttggatgacccaagtacttttcagcagccagtttgttgagattgttttcttaaatgctgaattgaaatattagaaaa

SEQ ID NO: 3205 - DNA, 5335 bp, Setaria italica
cctcgtccctctctgaccaccaccgcctccttccccgaccttccagagcccactgcccccggcggcggcggcggcggagatgagcgtgtggaactacgtggtcacggcgcacaagccgaccagcgtcagccactcctgcgtcggcaacttcaccagccccaaccagctcaacctcatcatcgcgaaatgtacccgcatcgagatccatttgcttactcctcagggccttcagcctatgcttgatgtacctatatacggaaggatcgcaacaattgagctcttccggcctcataatgagactcaggattttcttttcattgctacggagaggtacaaattctgtgttctgcaatgggacacagaaaaatcagagctcctcaccagagcaatgggtgatgtttctgatcgcattggccgtcctactgacaatggacagattggaattatcgaccctgactgtagacttattggtcttcacctctatgacggcttatttaaggttataccatttgacaacaaaggacagctgaaggaagctttcaatatcagactcgaagaacttcaagtactggacatcaagtttctgcatggttgtgttaaacctactattgttgtcctctaccaggataataaagacgcgaggcatgtgaagacatatgaagttgcactgaaggacaaagattttgttgagggtccttggtcccagaataacttagacaatggtgccggtttgttaatacctgtaccagctccacttggtggcgtcataattattggcgaggagacaatagtttactgcaatgccaatgctacatttaaagctataccaataaaacaatccatcataagagcttatggacgggttgacccagatggttctcgatatttgctcggcgataatacaggaactctgcatttacttgtccttacccatgaacgagaaagggttactggtttgaaagtagagtacttgggagagacttcaattgcatcatcaatttcatatcttgataatggtgttgtttatgttggttcacgatttggcgattcacagctggtaaagctgaacctccaagctgatgcaagtggttcatttgttgaagttctggaacgttatgtgaatcttggacctattgtggacttctgcgtggttgaccttgataggcagggtcagggtcaggtggttacttgttctggggcatttaaagatggttcccttcgtgtggttcgcaatggtatagggattaatgagcaggcttcagtagagctccaaggtatcaagggattatggtcattgaaatcttctttcaatgatccttacgacatgtacctagttgtgagctttataagtgagacacggttcttggcgatgaacatggaagatgaactagaagaaactgagatagaggggtttgatgcacaaacccagaccctgttttgtcaaaatgtgatcaatgatcttcttatacaggttactgctaattctgttcggttagtcagttgtacctctcaggagctagtggatcaatggaatgcaccagcaggattttcagtcaatgttgcctcagctaatgccagtcaggttctgttggcaacaggtggtggccatcttgtttacctagaaattagggattctaagcttgttgaagtgaaacatgcacagctagaacatgagatttcttgtcttgatttgaacccaattggggagaatccacagtatagttccctagctgccgttgggatgtggacagatataagtgttagaatattttcacttccagatcttgaattaataaggaaggagaatttgggtggagaaattgttcctcggtctgttctgctgtgcaccttggagggggtttcgtatttactttgtgctcttggagatggtaacctgttcagttttctgctgaatgcaagtactggtgaactgactgatagaaagaaggtttccctcgggacccaaccaatcagccttcgtacattctcatcaaagggtaccacccacgtgtttgcttcatcagataggccaacggtcatctatagcagcaataagaagcttctctatagcaatgtcaatttgaaagaagttaatcatatgtgccctttcaatacagccgcttttccagacagccttgcaattgctaaagaaggtgaactctccattggaacgattgatgacatccaaaaacttcatatccgcacaatcccccttaatgaacaagcacgtcgcatttgccaccaggagcaatcaaggacactagcattttgcagtttcaagtacaaccagactagtatggaggaaagtgagactcattatattcgtctgttagatcatcagacttttgagttcctgtctacatatcctctagatcaatacgaatgtggctgctcaatcattagctgctcatttgcggatgataataatgtttattactgtgtgggaactgcatatgttttacccgaggaaaatgaaccaacaaaggggcgaatccttgtatttgctgttgaagatggaaggttgcaattaatcgtagagaaagaaactaaaggtgcagtttattcgctgaatgcattcaatgggaaattgttggctgctatcaaccagaagattcaattatataagtggatgcttcgtgaggatggttcacatgagctgcaatctgagtgtgggcaccatgggcacatactggccttgtatactcaaacccgtggggacttcattgtggttggagatctgatgaaatcgatatccctgctggtctacaagcacgaggaaagtgcgatcgaagagcgtgctagggattataacgccaactggatgactgcagttgagatgcttgatgatgaagcctatatcggggcagaaaatagttataacctattcactgtgcgcaagaacagtgatgccgccacagatgatgaacgggccaggctggaggtcgtcggggagtaccatcttggagagtttgtgaataggttccgccatggttcactcgtgatgcgccttccggactcagagatagggcagattcccacggtcatctttggcacaataaatggggtaattggcatcatcgcctccctcccacatgaccaatacgtgtttctggagaaactccagtccactcttgtgaaattcataaagggtgttggaaacctgagtcatgagcaatggcgttcgttccataatgataagaagacggcggaagctcggaacttccttgatggtgacctgatcgagtcattccttgaccttagcaggggcaagatggaggaggtgtctaaggctatgggtgttcctgtggaggagctgtccaagagggtggatacaattctagacaaggagaactttacattggaggagcttcttgacgaggatgagattattcaagagtgcaaagcactgaatactcgactcataaatttcttgcgagataaagcccaagtggagcagttacttcgttacatcatggaagaagttccggaggattcagagaagaaacgatctttcaagtttccatttattgcttgtgagatttttacttgtgaaattgacattatcttgagaaccttggtagaggatgttgagttaatggatttacttttctcatttgtaaaacctgaccatccacatagcactttgctagctggttacttcagtaaggtggtgatatgtttgatgctacggaagactgctcctcttatgaattatgttcaggagcatccagacattgttgtccagcttgttgacctcattggtatcacttcaataatggaggtgttgatgagattgattggtgctgatgaaaccatatactcgaattttgcggatacattgcaatggttagagaatacagatgtcctggaaatgatcgtggataaatttagctcatctgactcccctgaagtacacgcgaatgctgcagaaatcctttctgcagtaactcgatgcgccccccctgctcttgctgcaaaaatatgcagcccaagttttgttggtaggttgtttcgtcacgctcttgaagaatcaagaccaaaatctgttctgattgtggagttcatctctgttttgctaacaattggtagtgaaattgctgagaaggagctaataagccaatcagcaataaagcattgcattgatttgttctttcagtacccttataataactttttgcatcatcatgtcgagaacattattgtttcttgcctcgaggttaaaagaaatcaactaattgaccatgtccttaatgactgtgaccttgtcggtaaagtccttgccgcagaaaaaaaatcatctctgtcagtggactctaatgggccaacattaccgtcagaagggaaagaacccccgagaattgggaatattggccacataactcgtatagcaaataagctcattcagttgggaaatagtagcagtgtgatccagaatcacttgcaggagaacagcgagtgggctgaatggcagacaggtgtcctggtcaaacgcaatgaggtggagaacgtttaccattgggcatgtggccgtccaacttctctacacgatcgtgggagggatagtgatgatgacgacttccgagacagagactatgatgtggcagcacttgcaaataatcttagtcaggcatttcgatatgggatatatagcaacgatgacattgaagaggcacaaggatcccatgaacgagatgatgaggatgtctactttgatgatgaatcagctgaagtggtaatatcttcgttgcggttgggggatgatcaggacagcagctccctcttcacgaattcaaactggtttacgtttgatggtgatagaggaatcaatgaccgcttagctgcctctgttccttcaccatccccgaattctgaagagactacccttagtatggaggaaactgatgaagtgctaattggtgaagcccctggcactgagtcacagctggaaagcgtgtctcttgaaaatggccctgttgaggagaccaaggaactagcagaagatgctgagcgcaatgatgagaaactgttgtgcacagaagaggaaaatgtatcccaggaagctgaagcctctgagcggcctatggatgttcaagatggccagactgacacacaagttggaagtgcagctgaagcctcaagtacagagggagcagcggatgaaccttgcagctcttctgagcctggcaatgccttgcctggagccttgcctcaatctgctgatactgaaaatcagtctgctgacccatcagggtgtagtgagattgcccatgaatcaggctcacccgcagaggttgatgatggaaaaacggttgaggttgccacaacaaatgaatga

SEQ ID NO: 3206 - DNA, 6739 bp, Panicum virgatum
aagtagttatttgctttcagagaattgagatagaatcatgccacataatgcgtggagtgccaacattggtatacatatgtcgagggtctaggggggaggggtaaagagtctttattttttttgtctagataatgtaagggctgaattttaaaagaattgggctctaatcttatataattttaagataaaaatattaagagctaagttggattgtgaagagaatattaaagtcatgacccattaccaaacccagtagaggcaaatttctttcaacatgaagctatgtgaaattgattccagagccaagaaaagaagaatgatcgtgctgataataaaaagggccggcccaacgattagataactaggccaaaagttacggggtaataataaaaataaaaaggcccaactttaagataactgggcctgttaagatgatgggccagcgacgtccaataacagctccaccgcgttagaaaagaagctgcgcgagcgcgagagcgagcgacatctctctcgtcgtccctctctgtggctcggaccacctccttccgcgaccttccagaccccactgcccccggcggcggcggcaccgtcggcggcggcggcggagatgagcgtgtggaactacgtagtcacggcacacaagccgaccagcgtcagccactcctgcgtcggcaacttcaccagccccaaccagctcaacctcatcatcgcgaaatgtacccgcattgagatccatttgcttactcctcagggccttcagcctatgcttgatgtccctatatacggaaggatcgcgacgattgagctcttccgtcctcataatgagactcaagattttcttttcattgctacggagaggtacaaattctgtgttctgcaatgggatgcagaaaaatcagagctcctcaccagagccatgggtgatgtttctgatcgcattggccgtcctactgataatggacagattggaattatcgaccctgactgcagacttattggtcttcacctctatgatggcttatttaaggttataccatttgacaacaaaggacagctgaaggaagctttcaatatcagacttgaagaacttcaagtactggacatcaagtttctgcatggttgtgttaaacctactattgttgtcctctaccaggataataaagacgcgaggcatgctaagacatatgaagttgcactgaaggacaaagattttgttgagggtccttggtcccaaaataatttagacaatggtgctggtttgttaatacctgtaccagctccacttggtggcgtgataattattggcgaggagacaatagtttactgcaatgccaatgctacatttaaagctataccaataaaacaatccatcataagagcttatggacgggttgacccagatggttctcgatatttactcggtgataatacaggaactctgcatttacttgtgcttacccatgaacgagaaagggttactggtttgaaagtagaatacttgggggagacttcaatcgcatcatcaatttcatatctcgataatggtgttgtttatgttggttcacgatttggcgattcacagctggtaaagctgaacctccaagctgatgcaagtggttcatttgttgaagttctggaacggtatgtgaatcttggacctattgtggacttctgtgtggttgaccttgatagacagggtcagggtcaggtggtcacttgttctggggcatttaaagatggttcccttcgcgtggttcggaacggtatagggattaatgagcaggcttcagtagaactccaaggtatcaagggattatggtcattgaaatcttctttcaatgatccttacgacatgtacctagtcgtgagctttataagtgagacacggttcttggcaatgaacatggaagatgaactagaagaaactgagatagaggggtttgatgcgcaaacacagaccctcttttgtcaaaatgcgatcaatgatcttctcatacaggttactgctaattctgttcggttagtcagttgcacctctcgggagctagtggatcaatggactgcacctgcaggattttcagtcaatgttgcttcagctaatgctagtcaggttctgctggcaacaggtggtggccatcttgtttacctagaaattagggatgctaagcttgttgaagtgaagcatgcacagctagaacatgagatttcttgtctcgatttgaacccaattggggagaatccacagtatagttccctagctgctgttggaatgtggacagatataagtgttagaatattttcacttccagatcttgaattaataaggaaggaaaatttgggtggagaaattgttcctcggtctgttctgctgtgcaccttggagggggtttcgtatttgctttgtgctcttggagatggtaacctgttcagttttctgctgaatgcgagtacaggtgaactcactgatagaaagaaggtttcccttgggacccaaccaatcagccttcgtacattctcatcaaagggtaccactcacgtgtttgcttcatcagataggccaactgtcatctatagcagcaataagaaacttctctatagcaatgtcaatttgaaagaagttaatcatatgtgccctttcaatacagccgcttttccagacagccttgcaattgctaaagaaggtgaactctcaattggaacaattgatgatatccaaaaacttcacatccgtacaatcccccttaatgaacaagcacggcgcatttgccatcaggagcaatcaaggacactagcattttgcagtttcaagtacaaccagactagtatggaggaaagtgagactcattatatccgtctgttagatcatcagacttttgagttcctgtctacatatcctctagatcaatatgaatgtggctgctccatcattagctgctcatttgcggatgataatagtgtttattactgtgtcggaactgcatatgttatacctgaggaaagtgaaccaacaaagggccggatccttgtatttgctgttgaagatggaaggttgcaattaatcgtagagaaggaaactaaaggagcagtttattcgctgaatgcattcaatgggaaattgttggctgctatcaaccagaagattcagttatataagtggatgttacgtgatgatggttcacacgagctgcaatctgagtgtgggcaccatgggcacatactggccttgtatactcaaacccgcggtgacttcattgtggttggagatatgatgaaatcgatatccttgctggtctacaagcatgaggaaagtgcgattgaagagcgtgctagggattacaatgcaaactggatgactgcagtcgagatgcttgatgatgaagcctatatcggggcagaaaatggctataacctattcactgtacgcaagaacagtgatgcagccacagatgacgaaagggccaggctggaggttgttggggagtaccatctcggagagtttgtgaataggttccgccatggttcactcgtaatgcgccttccggactcagagatagggcagattcccacagtcatctttggcacaataaatggggtaattggcatcatcgcctccctcccacatgaccagtatgtgtttctagagaagctccagtccactcttgtgaagttcataaagggtgtcggaaacctgagccatgagcaatggcgttcgttccataatgacaagaagacggctgaggctcggaacttccttgatggcgacctgatcgaggcatttcttgaccttagcaggagtaagatggaggaggtgtccaaggctatgggtgttcctgtggaggagctgtctaagagagtggacacaattctagacaaggaaaactttacattggaagagcttcttgacgaggatgagattattcaggagtgcaaagcgctgaatactcgactcataaatttcttgcgagataaatcccaagtggagcagttacttcgttacatcgtggaaaatgttccagaggattcagagaagaaacgatctttcaagtttccatttattgcttgtgagatttttacttgtgaaattgacattatcttgaggaccttggtagaagatgttgagttaatggatttacttttctcatttgtaaaacctgaccatccgcatagcactttgctagctggttacttcagtaaggtggtgatatgtttgatgcttcggaagaccgcgcctctcatgaattatgttcaggagcatccagatattgttgtccaacttgttgacctcattggtatcacctcgataatggaggtgttgatgagattgattggtgctgatgaaaccatatactcaaattttgctgatacattgcaatggttagagagtacagatgttctggaaatgattgtggataaatttagctcatctgactcccctgaagtacatgcgaatgctgcagagatcctttctgcagtaactcgatgcgcccctcctgctcttgctgcaaaaatatgcagcccaagttttgttggtaggttgtttcgccacgctctcgaagaatcaagatcaaaatcggttctggttcactcactgtcagtgtgtatatctttgttggacccaaaaagactagcatcagcctcatatcaagcgtttaaaagtaacttgagccatggcacactggtcacagctagtccagagacagttgatggtatgctggagagtttaggtgctttgctaaagttattggacattacttcttctgaaaatgttttgcctacaacatatggatgtctgcgcccgcctcttggaaaacaccgtttgaagattgtggagttcatctctgttttgctaacaattggtagcgaaatagctgagaaggagctaataagccaatcagcaataaagcattgcatcgatttgttttttcagtacccttataataactttttgcatcatcatgttgagaacattattgtttcttgcctcgaggttaaaagaaatcagctgattgaccatgtccttaatgactgtggccttgttggtaaagtgcttgccgcggaaaaaaaatcatctctgtcagtggactctaatgggccaacgttaccatcagaagggaaagaacccccgagaattgggaatatgggccacataactcgaatagcgaataaactcattcaattgacaaatagtagcagcatgatccagaatcacttgcaggagaacagtgagtggtctgaatggcaaactggtgtcctagttagacgcaatgaggtggagaatgtttaccattgggcatgtggccgtccaacttctttacatgatcgtgggagggatagtgatgatgacgactaccgagacagagactatgatgtggcagcacttgctaataatcttagccaggcatttcgatatgggatatacagcaacgatgacattgaagaggcacaaggatcccatgaacgagatgatgaggatgtctactttgatgatgaatcagctgaggtggtaatatcttcgttgcgtttgggggatgatcaggacagcagctccctcttcacaaattcgaactggtttacctttgatggtgatagaggaatcaatgaccgcttagctgcctccgttccttcaccatcccccaattctgaagacacttccctgaacatggaggaaaccgatgaaatgcttattggtaaagtcactggcactgagtcacatctggaaagcgtgtctcctgaaaatggtcctgttgagaagaccaaggaactagcaggagtcgctgagcaaaatgatgctagtgcagatgatgagaaactgttgagcacagaagaggtgaatgtttcccaggaagctgaagcctctgagcagcctatggatgttcaagatggccagactgacacacaaggtggtgatgctgctgaagcctcaagtacagagggagcagctgatgaaccttgcggctctcctgagcctggacatgccttgactggagcctcatctgaatcttgtgacactgatcatcagtctgccaacacatcaggttctaatgagatagcccatgaatcagggttacctcatgatagtaaaatagttgaggttgccacatcaaatgaatgaagtatatgggctggaatcataccacaaaacctgagcagtattgccagccagattttttttgccaggtgagcaatgtcaccttgttttgcatcacatgctcaggaaccacggacaagccttcagaaggcaagtaatctgtacaattgaaggcgccgctttgctatgtgcagtttttggtactgcatgaatgagcatattcgtgcagctgggcacgccctgttatgatcgggctgtctcacctcatccccatccccagaagcaatttcctcagttcacatggacttcttacccagcaatggtgggaaaattaattcttgcctatgtcatttggtggttgatgcatgcgaggaggggattaattcatttggtggttcttgattttgggtacggtggttatttccttggctagggtactcgaactgtaatatctgcagtgagtttttcccgtgtttaccttttttttgttcctttggtattagcgttctgtaattgttatcagttcaattgaaacatctacctttcccttttgggttctaaactcgatgttctcagcaaaaattgggggcaaatctttcatgatataccattatggtccagactgctttgcaacccagaaagtgccat

SEQ ID NO: 3207 - DNA, 5883 bp, Sorghum bicolor
cgtgtctccttcaccgccaccaccaccacctccttttccctcaccttccagagcccactgctctccggcggcggcggcggcagcggcagcggagatgagcgtgtggaactacgtcgtcacggcgcacaagcccaccagcgtcagccactcctgcgtcggcaactttaccagccccaaccagctcaatctcattatcgcgaaatgtacccggatcgagatccatttgctgacccctcagggccttcagccgatgcttgacgtacctatatatggaagaattgcaacgattgagctcttccggcctcataatgagactcaggattttcttttcattgctacggagaggtacaaattctgtgttctgcaatgggatgcagaaaaatcagagctaatcaccagagccatgggtgatgtttctgatcgcattggccgccctactgacaatggacagattggaatcatcgaccctgactgcagactcattggcctccatctctatgatggcttatttaaggttataccatttgacaacaaagggcagctgaaggaagctttcaatatcagactggaagaacttcaagtactggacatcaaatttctgcatggttgtgttaaacctactattgttgtcctctaccaggataataaagacgtgaggcatgttaagacttatgaagttgcactgaaggacaaagattttgttgagggtccttggtctcagaataatgtagacaatggtgctggtttgttaataccagtaccagctccacttggtggtgtgataataattggcgaggagcaaatagtttactgcaatgccaattctacatttaaagcgataccaataaaacaatccatcattagagcttatggacgggttgacccagatggttctcgatatttactcggtgataatactggaattcttcatttacttgtccttacccatgaacgagaaagggttactggtttgaaaattgaatacttgggagagacttccattgcatcatcaatttcatatctcgataatggcgttgtttatgttggttcacggtttggcgattcacagctggtgaagctgaacctccaagctgatgcaagtggttcatttgtggaaatccttgaacggtatgttaatcttggaccgattgtggacttttgcgtggttgaccttgataggcagggtcaaggtcaggtggtcacttgttctggggcatttaaagatggttcccttcgggtggttcggaatggtatagggattaatgagcaggcttcagtagaactccaaggcataaagggattatggtcattgaaatcttcgttcaatgatccatatgacatgtaccttgttgtgagctttataagtgagacacgattcttggcaatgaacatggaagatgaactagaagagactgagatagaggggtttgatgcacaaactcaaaccctgttttgtcagaatgcgaccaatgatcttcttatacaggttactgctaattctgttcggctagtcagttgtacctcccgggagctagtggatcaatggaatgcaccagcaggattctcagtcaatgttgcttcagctaatgctagtcaggttctgttggcaaccggtggtggccatctcgtttacctggaaattagggattctaaacttgttgaagtgaagcatgcacagctagaacatgagatttcttgccttgatttgaacccaatcggggagaatccacagtatagttccctagctgctgttgggatgtggacagatataagcgttagaatattttcacttccagaccttgaattaataaggaaggaaaatttgggtggagaaattgttcctcggtctgttctgctgtgcaccttggagggggtttcatatttgctttgtgctcttggggatggtaatcttttcagttttctgctgaatgcaagtacaggtgaactgactgatagaaagaaagttacccttgggacccaacccatcagccttcgtaccttctcatcaaagggtaccacccatgtgtttgcttcatcagataggccaactgtcatctatagcagcaataagaagcttctctatagcaatgtcaatttgaaagaggttaatcatatgtgccctttcaatacagctgcttttccagacagtcttgcaattgctaaagagggtgagctttcaattggaactattgatgatatccagaagcttcatatccgcacaatcccccttaatgaacaagcacgtcgcatttgtcaccaggagcaatcaaagacactagcattttgcagtttcaagtacaaccagagtgtggaggaaagtgagactcatttaatacgtctgctagatcatcagacttttgagtccctgtgtgtatatcctctagatcaatatgaatttggctgctccatcattagctgttcttttgcggatgataataatgtttattactgtgtgggaactgcatatgttatacctgaagaaaatgaaccaacaaagggtcgaatccttgtatttgcagttgaagatggaagtttgcaattaattgtggagaaagaaaccaaaggagcagtttattcactgaatgcattcaatgggaaattgttggctgctatcaaccagaagattcaattatataagtggatgtcacgcgaggatggttcacatgagctgcaatctgagtgtggccaccatgggcacatacttgccttgtatactcaaacgcgtggtgacttcattgtggttggcgatctgatgaaatcaatatctttgctggtgtataaggtggttcctctaactgtttgcttgactcacattgtattatctgtaattttttttgtcagtctctttgttgtgttggaaagtgcaattgaagagcgtgctagggattacaatgcaaactggatgactgcagttgagatgcttgatgatgaagtctatgttggggcggagaatggctataacctattcaccgtgcgcaagaacagcgatgcagccacagatgacgaaagggccaggcttgaggtcgtgggggagtaccatcttggggagtttgtgaacagattccgccatggttcactggtgatgcgccttccagactcagagattgggcagatccctacagtcatctttggcacaataaacggggtaattggcattattgcctccctcccgcatgatcaatacgtcttcctggagaagctgcagtcgactcttgtgaagtacataaagggcgttgggaacctgagccatgagcaatggcggtcgttccataacgacaagaagacggcggaggctcggaacttccttgacggtgacctgatcgagtcgttccttgaccttagccggagcaagatggaggaggtgtccaaggctatgggcgtcccggtggaggagctgtccaagagggtggatacaattctggacaaggagaactttacgttggaagagcttcttgacgaggatgaaatcatccaggagtgcaaagcactgaatactcgactcataaatttcttgcgagataaggcccaagtgcagcagttgcttcgttacattgtggaagaagttccagaggaatcagagaagaaacagtctttcaagtttccatttatcgcttgtgagatttttacttgtgaaattgacattattttgagaaccttggtagaggatgttgagctaatggatttacttttctcatttgtaaaacctgaccatccgcatagtaccttgttagctggttacttcagtaaggtggttatatgtttgatgctacggaagactgcttctcttatgaattatgttcaggagcatccaaatattgttgtccagcttgtcgacctcattggtatcacatcaataatggaggtgttgatgagattgattggtgctgatgaaaccatatactcgaatttcgcggatacgttgcattggttagagaatacagatgtactggaaatgattgtggataaatttagctcatcagactctcctgaagtgcatgcaaatgctgctgaaatcctttctgccgtaactcgatgcgctcctcctgctcttgctgcgaaaatatgcagcccaagatattattatgttcattcttctttacttgttcctggtatcagttttgttggtaggttgtttcgtcacgctcttgaggagtcaagaccaaaatctgttctgattgtagagttcatctctgttttgctaacaattggtagcgaagttgctgagaaggagctaataaaccaatcagtgataaagcattgcattgatttattttttctgtacccttataataactttttgcatcatcatgttgagaacattattgtttcttgccttgaggttaaaagaaatcaattgactgaccatatccttaatgactgtggccttgtcgttaaagtccttgctgctgaaaaaagtccatctctgccagtggattctaatgggccaacgttaccgtcagaagggaaacaacctccaagaattgggaatattggacacataactcgaatagcgaataagctcattcaattgggaaatagtaacagcatgatccagagtcacttgcaggagaacagcgagtgggctgtatggcaaacagatgtcctggtcaaacgcaatgaggtggagaacgtttaccattgggcatgtggccgtccaacttctctacatgatcgtgggagggatagcgacgacgacgacttccgagacagagactatgatgtggcagcacttgctaataatctgagccaggcatttcgatatgggatatacagcaatgatgacattgaagaggcacaaggatcccacgaacgagatgatgaggatgtctactttgatgacgagtcggctgaagtagtaatatcttcattgcgtttgggggatgatcaggacagcagttccctcttcacgaattcaaactggtttacgtttgatggagatagaggaatcaatgatcgcctagctgcctctgttccttcatcatcccccaattctgaagagatttccttgaacacggaggaaactgatgaagtgctaactggtgaaaccactggcactgagtcactgctggaaagtgcatcccttgaaaatggtcctgttgaggaggccaaggagctagcagaagttgctaacgacagtgatgctaccacggttagtgagaaaattttgtgtacagaagagcatagcgcctcccatgagcctgaaacctctgagcggcctgtggatgctcaagagggccagactggaggtgtggctgaagcaacgagcacagagggagcaacgaatgaacctttcagctcttctgagcctggcaacttgccagaatctggtgacaccgattgtcacactgccaactcatctgagcctaatgagattgcccatgaatcaggatcacctgcggaggttgatgatgaaaagaaatctgagattgccacaacaaatgaatgaagcgtatgggctggaatggtaccacaaaccaaggcaggatcgccgacctaattcgttttgcatcgcatgctcagggaccacggactaccattcagaagcaggggcgccctacaattttagtggcactgctttgctatgagcagtcgattgttactgcttggatgagcatactcgtgcagctgggcacgctctgttatgatctcagctcatcaccatcccacatgaacttattacaccgtattagttggtggttgatgcacagggcgtttaattcatttggtacttcctgattttggctcagggttttttttttcttttgctagggtactcgaactgtaatatctgcagttgagtttttccctcaattcttatattactgttcctttctgattatagctgcctctgtaattgttatttgttcaagtgcaaaatctgcc

SEQ ID NO: 3208 - DNA, 3793 bp, Oryza sativa
gttgcgctctagactgtgcaggagagaccaccccctccctccttctagaagactagaaccctcgccatcctccccttcccccaccctagcgtcggcggcggcggcggtggcggcggagatgagcgtgtggaactacgtcgtgacggcgcacaagcccaccagcgtcacccactcctgcgtcggcaacttcaccggccccaaccagctcaacctcatcgtcgcgaaatgcacccgtatcgagatccacttgcttactcctcaaggcctccagcctatgattgatgtacctatctatggaagaatcgccacactagagctcttccgccctcataatgagactcaggacttccttttcattgcgactgaaagatacaaattctgtgttctgcagtgggatggagaaaaatcggagcttctcactagagcgatgggagatgtttctgatcgcattggtcgccctacggacaatggacagattgggatcatcgaccctgactgtagacttattggtcttcacctctacgatggattatttaaggttataccgtttgataacaaagggcagctgaaggaagctttcaatatcaggcttgaagaacttcaagtattggacatcaagttcctgtatggctgtgttaaacctactatagttgtcctctaccaggataacaaagatgcaagacatgttaagacatatgaagttgcattgaaggacaaagactttgttgagggtccttggtcgcagaacaatttagacaatggtgctggtctgttaatacctgtaccagctcctcttggtggtgtcataattattggtgaggagacaatagtttactgcaatgccaactctacatttagagctataccaatcaaacagtcaatcataagagcttacggacgggttgacccagacggttcgcgctatttacttggtgataatgcaggcatattgcatttacttgtccttacccatgaacgagagagggtaaccggtctgaaaatcgagtacttgggagagacttcaattgcatcatcaatatcatatctcgataatggtgttgtctacgttggttctcgatttggtgattcacagcttgtaaaactaaatctccaagctgacccaaatggttcatatgttgaagttcttgagcgatatgtgaaccttggacccatcgtggacttctgtgtggttgaccttgacaggcagggtcagggtcaggttgtcacttgttcaggagcatttaaagatggttcccttcgggtggttcggaatgggataggtatcaatgagcaggcttcagtagaactacaagggatcaagggtttatggtcgttgaaatcttccttcaatgatccgtatgacatgtacctagttgtgagctttataagcgagacaagattcttggctatgaacatggaagatgagttagaagaaactgagatagaaggctttgatgcgcagactcagactttgttttgtcaaaatgccatcaatgatctgcttatacaggttactgctaattctgttcgtctggttagttgtacctctcgggagctagtggatcaatggaatgcaccagaaggattttcagtcaatgttgcatcagctaatgccagtcaggttctgctggcaacaggtggtggccatcttgtttacctcgaaattaaggattctaagctggttgaagtgaaacatatacagttagaacatgagatctcctgtgttgatttgaatccaattggggagaatccacagtatagctctctggctgctgttgggatgtggactgatataagtgttagaatactttcacttccagaccttgaattaatcaggaaggagaacttaggtggagaaattgttcctcggtctgttctgctttgtaccttggaaggggtttcatatttgctctgtgctcttggagatggtcatctgttcagttttctgttgaatgcaagtacgggtgaattaactgatagaaagaaggtttctcttggtacccaaccgataagccttcgtacattctcatcaaagggtacaacccacgtgtttgcttcatcggatagaccgactgttatttatagcagcaacaagaagttgctgtatagcaatgtcaatttgaaggaagtcaaccatatgtgtccttttaatacagctgctattcctgacagccttgcaattgctaaagaaggtgaactctcaattggaaccatcgatgacatccagaagcttcatatccgtacaatccccttgaatgaacaagcacgtcgcatttgccatcaggaacagtccaggacactagcgttctgcagcttcaagcacaaccagactagtatagaggaaagcgagacacattttgttcgtcttttggatcatcaaacttttgagttcctgtcaatttatcagcttgatcaatatgagcatggctgctccatcattagctgctcattctcagatgataataatgtttattattgtgtgggaacagcatatgttttaccagaggaaaatgaaccatcaaagggccggatccttgtatttgcagttgaagatggcagactgcaattaattgtagagaaagaaactaaaggagctgtctattcgctgaatgcattcaacggaaaattgttggcagctatcaaccagaagattcaactatataagtggatgctacgggaggacggttcacatgagctgcagtctgagtgtgggcatcatgggcacatattggctttgtacactcagactcgtggcgatttcattgtagttggagacttgatgaaatcaatatccttgctcgtgtacaagcacgaggaaagtgcgattgaagagcttgctagggattacaatgcaaactggatgagtgcagttgagatgcttgatgacgagatctatattggagcagagaataactacaacattttcactgtgcggaagaacagtgatgcagcgacagatgaagagaggggcaggctggaggttgttggagagtaccatcttggagagtttgtgaatagactccggcatggttcgctggtaatgcggcttccggactcagagatgggccagatcccgacggttatctttggcaccatcaacggggttattgggattattgcttcgcttccacatgagcagtatgtatttcttgagaagctccagtcgactctggtgaagttcataaagggcgtggggaacctgagccatgagcaatggcggtcgttccacaacgacaagaagacgtcggaggcccgcaatttcctggatggtgacctgatcgagtcattccttgatctaagcagaaacaagatggaggaggtggccaagggtatgggggtccccgttgaggagctatccaagagggtggaggagctgactagattgcactaggtctcgataatgatgatataattaatacgtagaagatgtttgctggaacttatttctgaaatgtatatttttttttctactccagtttattaagcatgtgttggtgggttgaatgttgatgccgctggtggcacaggaagaagcattcctgttaagaagagttactaagttacccatgtggttcggttgtagattttactctgttttgttggttggatggtccagtaattaacgtttgagctgccagttttaagatgtactcctagtagtattagaaattgttttcctctgttggttgtgattgttgtggtgggcacgctgtttgaacactttgtacaaggagttgtaaagcaggtccctcggcttgattcttgatgagtatagtagtattttgattggttg

SEQ ID NO: 3209 - DNA, 3797 bp, Oryza sativa
gcgttgcgctctagactgtgcaggagagaccaccccctccctccttctagaagactagaaccctcgccatcctccccttcccccaccctagcgtcggcggcggcggcggtggcggcggagatgagcgtgtggaactacgtcgtgacggcgcacaagcccaccagcgtcacccactcctgcgtcggcaacttcaccggccccaaccagctcaacctcatcgtcgcgaaatgcacccgtatcgagatccacttgcttactcctcaaggcctccagcctatgattgatgtacctatctatggaagaatcgccacactagagctcttccgccctcataatgagactcaggacttccttttcattgcgactgaaagatacaaattctgtgttctgcagtgggatggagaaaaatcggagcttctcactagagcgatgggagatgtttctgatcgcattggtcgccctacggacaatggacagattgggatcatcgaccctgactgtagacttattggtcttcacctctacgatggattatttaaggttataccgtttgataacaaagggcagctgaaggaagctttcaatatcaggcttgaagaacttcaagtattggacatcaagttcctgtatggctgtgttaaacctactatagttgtcctctaccaggataacaaagatgcaagacatgttaagacatatgaagttgcattgaaggacaaagactttgttgagggtccttggtcgcagaacaatttagacaatggtgctggtctgttaatacctgtaccagctcctcttggtggtgtcataattattggtgaggagacaatagtttactgcaatgccaactctacatttagagctataccaatcaaacagtcaatcataagagcttacggacgggttgacccagacggttcgcgctatttacttggtgataatgcaggcatattgcatttacttgtccttacccatgaacgagagagggtaaccggtctgaaaatcgagtacttgggagagacttcaattgcatcatcaatatcatatctcgataatggtgttgtctacgttggttctcgatttggtgattcacagcttgtaaaactaaatctccaagctgacccaaatggttcatatgttgaagttcttgagcgatatgtgaaccttggacccatcgtggacttctgtgtggttgaccttgacaggcagggtcagggtcaggttgtcacttgttcaggagcatttaaagatggttcccttcgggtggttcggaatgggataggtatcaatgagcaggcttcagtagaactacaagggatcaagggtttatggtcgttgaaatcttccttcaatgatccgtatgacatgtacctagttgtgagctttataagcgagacaagattcttggctatgaacatggaagatgagttagaagaaactgagatagaaggctttgatgcgcagactcagactttgttttgtcaaaatgccatcaatgatctgcttatacaggttactgctaattctgttcgtctggttagttgtacctctcgggagctagtggatcaatggaatgcaccagaaggattttcagtcaatgttgcatcagctaatgccagtcaggttctgctggcaacaggtggtggccatcttgtttacctcgaaattaaggattctaagctggttgaagtgaaacatatacagttagaacatgagatctcctgtgttgatttgaatccaattggggagaatccacagtatagctctctggctgctgttgggatgtggactgatataagtgttagaatactttcacttccagaccttgaattaatcaggaaggagaacttaggtggagaaattgttcctcggtctgttctgctttgtaccttggaaggggtttcatatttgctctgtgctcttggagatggtcatctgttcagttttctgttgaatgcaagtacgggtgaattaactgatagaaagaaggtttctcttggtacccaaccgataagccttcgtacattctcatcaaagggtacaacccacgtgtttgcttcatcggatagaccgactgttatttatagcagcaacaagaagttgctgtatagcaatgtcaatttgaaggaagtcaaccatatgtgtccttttaatacagctgctattcctgacagccttgcaattgctaaagaaggtgaactctcaattggaaccatcgatgacatccagaagcttcatatccgtacaatccccttgaatgaacaagcacgtcgcatttgccatcaggaacagtccaggacactagcgttctgcagcttcaagcacaaccagactagtatagaggaaagcgagacacattttgttcgtcttttggatcatcaaacttttgagttcctgtcaatttatcagcttgatcaatatgagcatggctgctccatcattagctgctcattctcagatgataataatgtttattattgtgtgggaacagcatatgttttaccagaggaaaatgaaccatcaaagggccggatccttgtatttgcagttgaagatggcagactgcaattaattgtagagaaagaaactaaaggagctgtctattcgctgaatgcattcaacggaaaattgttggcagctatcaaccagaagattcaactatataagtggatgctacgggaggacggttcacatgagctgcagtctgagtgtgggcatcatgggcacatattggctttgtacactcagactcgtggcgatttcattgtagttggagacttgatgaaatcaatatccttgctcgtgtacaagcacgaggaaagtgcgattgaagagcttgctagggattacaatgcaaactggatgagtgcagttgagatgcttgatgacgagatctatattggagcagagaataactacaacattttcactgtgcggaagaacagtgatgcagcgacagatgaagagaggggcaggctggaggttgttggagagtaccatcttggagagtttgtgaatagactccggcatggttcgctggtaatgcggcttccggactcagagatgggccagatcccgacggttatctttggcaccatcaacggggttattgggattattgcttcgcttccacatgagcagtatgtatttcttgagaagctccagtcgactctggtgaagttcataaagggcgtggggaacctgagccatgagcaatggcggtcgttccacaacgacaagaagacgtcggaggcccgcaatttcctggatggtgacctgatcgagtcattccttgatctaagcagaaacaagatggaggaggtggccaagggtatgggggtccccgttgaggagctatccaagagggtggaggagctgactagattgcactaggtctcgataatgatgatataattaatacgtagaagatgtttgctggaacttatttctgaaatgtatatttttttttctactccagtttattaagcatgtgttggtgggttgaatgttgatgccgctggtggcacaggaagaagcattcctgttaagaagagttactaagttacccatgtggttcggttgtagattttactctgttttgttggttggatggtccagtaattaacgtttgagctgccagttttaagatgtactcctagtagtattagaaattgttttcctctgttggttgtgattgttgtggtgggcacgctgtttgaacactttgtacaaggagttgtaaagcaggtccctcggcttgattcttgatgagtatagtagtattttgattggttgag

SEQ ID NO: 3210 - DNA, 3673 bp, Hordeum vulgare
agcgcatctctcctaccacctctccaccgctccacagagcccagaaccctcctcctcctccggcggcggcggcggacggcggcgatgagcacgtggaactacgtcgtgacggcgcacaagcccaccagcgtcagccactcctgcgtcggcaacttcaccggcccccaccagctcaacctcatcgtcgcgaaatgcacccgcatcgagatccacctcctcacgccgcagggcctccagccgatgctggacgtgcccatatatgggaggatcgcgacgatcgagctcttccgccctcacaatgaggcccaggacttcctcttcattgccacggagaggtacaagttctgcgtcctgcagtgggacgcagaaaaatcagagcttctcactagatccatgggagatgtttctgatcgcatcggccgccctacggacaatggacagattgggatcatcgaccctgactgtagacttattggccttcacctctatgatgggttgtttaaggttataccattcgacaacaaaggacagctgaaggaagctttcaatatcagactagaagagcttcaagtgttggacataaagttcctgtatggctgtctcagacctacgatagttgtcctctaccaggataacaaagatgccaggcatgttaagacatatgaagttgcactgaaggagaaagatttcgtcgagggcccttggtcacagaacaatttagacaatggagctggtcttttaatacctgtaccagctccactcggcggtgtcataattattggtgaggagacaatagtttactgcaatgctaattctacatttagagctataccaatcaaacagtccatcacaagagcttatggaagggttgacccagatggctctcgctatttacttggtgataattcaggcattttgcatttacttgtccttacccaggaacgagaaagggtaactggtttgaaaattgagcatttgggagagacttcagttgcatcgtcaatatcgtatcttgataatggtgttgtctatgttggttctcggtttggtgattcacagctggtaaagctgaatctccaacctgatgcaactggttcattcgtcgaaatccttgaacggtatgtgaatcttggacctattgtggacttctgcgtggttgaccttgataggcaagggcaaggtcaggtggtcacttgttcaggagcattcaaagatggttccattcgagtggttcgtaatggtatagggattaatgagcaggcttcagtagagctgcaaggcatcaagggattatggtcactgaagtcttccttcagtgacctgtatgacatgtatctggtggtgagctttataagtgagactaggttcttggctatgaacatggaagatgaattagaagaaattgagatagaagggtttgatgcacaaatccagactttgttctgccaaaatgctatcaatgatctgcttatacaggttaccgctaattctgtccggttagtcagttgcacttctcgggagctagtggatcaatggaatgcaccggaaggattttcagtcaatgttgcatcagctaatgccagtcaggtcctgttggctactggtggtggccatctcgtttacctagagattagggatgctaagttggttgaagtgaaacatgcgcagctagaacatgagatttcttgtgttgatttgaacccagtaggggagaatccacagtatagctctctggctgctattgggatgtggactgatataagtgttagcatattttcacttcctgaccttgaattaatcaggaaggaaaatttaggtggagaaattgttcctcggtcagttctgatgtgcaccttggaagggatttcatatttgctttgtgctcttggagatggtcaccttttcagttttctattgaatgcaagcacaggtgaactaaccgatagaaagaaggtttctcttggtacccagccaattagccttcgtacattctcatcaaagggcacaacccatgtgtttgcttcgtctgatagaccaactgttatctacagtagcaataagaagctgctgtacagcaatgtcaatctgaaagaagttaatcatatgtgtcctttcaatacagctgcttttcctgacagccttgcaattgctaaagaaggtgaactttcaattggaactattgatgatattcagaagcttcatatccgcacgattccgttgaatgaacaagcacggcgcatttgccatcaggaacagtccaggacactggcgttctgcagtttcaagtacacacagaatagcatggaggagagcgaggcgcatttcattcgtctgatggatcatcaaacttttgagtttctgtctacacatcctctcgatcaatacgaatgtggttgctccatgattagctgctcgttctcggatgataataacttctattactgtgtgggaacagcatatgttttacctgaggagaatgaacccacaaagggccggatccttgtatttgcagttgaggatggaaggttgcaattaatcgtagagaaagaaacgaaaggagctgtctattctctaaatgcattcaatgggaaattgttggcagctatcaaccagaagattcagttatacaagtggatgacaagggaggatggttcgcatgagctgcaatctgaatgtggccatcatgggcacatacttgccctgtatacccaaactcgtggtgatttcattgtagtcggggacctgatgaagtcgatatctttgctcgtgtacaagcatgaggagagtgcgatcgaagagcttgctagggactacaacgcgaactggatgactgcagttgagatgattgacgatgacatctatgttggtgcagagaacagctacaacctcttcaccgtgcgcaagaacagcgatgcggccacagacgaggagaggggtaggctggaggtggtcggggagtaccacctcggagagtttgtcaacaggttccggcacgggtcacttgtgatgcgcctcccagactctgagatgggccagatccccacggtcatctttggcaccatcaacggggtcattggtatcatcgcctccctgccccacgaccactatgtgttcctggagaagctccaggcaaccctggtcaagttcatcaagggcgtgggcagcctgagccacgagcagtggcggtcgttccacaacgacaagaagacgtcggaggcccgcaacttcctggacggcgacctgattgagtcattcctcgacctcaacaggtccaagatggaggaggtggccaaggcgatggcggtccctgtcgaggagctgtccaagcgggtggaggagctgacgagactgcactaggtagcgccgtgccgtgtacatcctgttttatttgttcgttttcgctgtgttgtaaaccgttggcggcctgagaatgatcctctgcaagtgtttgtagcaacattccgtttctctgttttcgactttgataagagtgtaactttatctgtgctgatgtagaattttagtggtgaatcgccgttgtttatcagcagtgcattgtcaaacatgacacccagaaagtttggtataattatcaggcgaatgtaaacggtgataaccatcttggaatgcaaagctttaagcttgaggtttcatattcaggtatagtggcaga

SEQ ID NO: 3211 - DNA, 6738 bp, Triticum aestivum
ttgatcaattcgattggagaagtatacgaaatcaatactatacatgacatgttgcatcgaaaggaaaatcaatatgacaacaatagtacataactgccgatatctttattctagcccatcatatcaggatcttacaggctgtgtggtttttgcaaagactttcccttttgcgaaggatgcctgggttcatgaatctggtgctctagggttgctcctgtagctaaggaagctaagacagctccacagacgccattaatttacggggagcatcatgaatcttgtgcggagggtagctcttggagctggtaagcatctggtttccgtgaacctcgccattgggagaatgactctctcgcaaaggatctgcaggagcgggtggaggctgctgagcggccggagtgtcccgggcttgagcaccagctggagatgccagagcatcatccacagttgctgggttgagtagcaccagctcggatgccattgattctcactagcagctagctatgttaaggacagcttaattagtcgatggatcagtagaccgtaccccccctcctgtctctctctcccagcaccgctgcacagagcccagaaccctcctcctcctcctcctcctccggcggcggcggcggcggcgggcggcgaggggagatgagcacgtggaactacgtcgtcacggcgcacaagcccaccagcgtcagccactcctgcgtcggcaacttcaccggcccccaccagctcaacctcatcgtcgcgaaatgcacccgcatcgagatccacctgctcacgccgcagggccttcagcctatgcttgacgtgcccatatatgggaggatcgcgacgatcgagctcttccggcctcacaatgaggcccaggacttcctcttcatcgccacggagaggtacaagttctgcgtcctgcagtgggacgcagaaaaatcagagcttctcaccagatccatgggagatgtttctgatcgcattggccgccctacggacaatggacagattgggatcatcgaccctgactgtagacttattggccttcacctctatgatggattgtttaaggttataccattcgacaacaaaggacagctgaaggaagctttcaatatcagactagaagaacttcaagtattggacatcaagttcctgtatggctgtctcagacctacgatagttgtgctctaccaggataacaaagatgccaggcatgttaagacatatgaagttgcactgaaggagaaagactttgttgagggtccttggtcacagaacaatttagacaacggagctggtcttttaatacctgtaccagctccactcggcggtgtcataattattggcgaggagacaatagtttactgcaatgctaattctacatttaaagctataccaatcaaacagtccatcacaagagcttatggaagggttgacccagatggctctcgctatttacttggtgataattcaggcattttgcatttacttgtccttacccaggaacgagaaagggtaactggtttgaaaattgagcatttgggagagacttcagttgcatcgtcaatatcgtatcttgataatggtgttgtctatgttggttctcgatttggtgattcacagctggtaaagctgaatctccaacctgatgcaactggttcattcgtcgaaatccttgaacggtatgtgaatcttggacccattgtggacttctgcgtggttgaccttgataggcaagggcaaggtcaggtggtcacttgttcaggagcattcaaagatggttccattcgagtggttcgtaatggtatagggattaatgagcaggcttcagtagagctgcaaggcatcaagggattatggtcactgaagtcttccttcagtgatctgtatgacatgtatctggtggtgagctttataagtgagactcggttcttggctatgaacatggaagatgaattagaagaaattgagatagaagggtttgatgcacaaatccagactttgttctgccaaaatgccatcaatgatatgcttatacaggttactgctaattctgtccggttagtcagttgcacttctcgggagctagtggatcaatggaatgcaccggaaggattttcagtcaatgttgcatcagctaatgccagtcaggtcctgttggcgaccggtggtggccatcttgtttacctagagattagggatgctaagctggttgaagtgaaacatgcgcagctagaacatgagatttcttgtgttgatttgaacccagtaggggagaatccacagtatagctctctggctgctattgggatgtggactgatataagtgtcagcatattttcacttcctgaccttgaattaatcaggaaggaaaatttaggtggagaaattgttcctcggtcagttctgatgtgtaccttggaagggatttcatatttgctttgtgctcttggagatggtcaccttttcagttttctactgaatgcaagcacaggtgaactaaccgatagaaagaaggtttctcttggtacccagccaattagccttcgtacattctcatcaaagggcacaacccatgtgtttgcttcgtctgatagaccaactgttatctacagtagcaataaaaagctgctgtacagcaatgtcaatctgaaagaagttaatcatatgtgtcctttcaatacggctgcttttcctgacagccttgcaattgctaaagaaggtgaactttcaattggaactattgatgatatccagaagcttcatatccgcacgattccgttgaatgaacaagcacggcgcatttgccatcaggaacagtccaggacactggcgttctgcagttttaagtatacccagaatagcatggaggagagcgaggcgcatttcattcgtctgatggatcatcaaacatttgagtttctgtccacacatcctcttgatcaatacgaatgtggttgctccatgattagctgctcattctctgatgataataacttctattactgtgtgggaacagcatatgttctacctgaggagaatgaaccgacaaagggccggatccttgtatttgcagttgaagatggaaggttgcaattaattgtagagaaagaaacaaaaggagctgtctattccctaaatgcattcaatgggaaattgttggcagctatcaaccagaagattcagttatacaagtggatgacgcgggaggatggttcccatgagttgcagtctgaatgtggccatcatgggcacattctcgccctgtatacccaaacccgtggtgatttcatcgtagtcggagacctgatgaaatcgatatccttgcttgtgtacaagcatgaggagagtgcgattgaagagctcgctagggactacaacgcgaactggatgactgcagttgagatgattgacgatgacatctatgttggtgcagagaacagctacaaccttttcactgtgcgcaagaacagcgacgcggccacagacgaggagaggggcaggctggaggtagtcggggagtaccacctcggagagtttgtgaacaggttccggcatggctcgctggtgatgcgcctccccgactctgagatgggccagatccccacggtcatctttggcaccatcaacggggtcattggcatcatcgcctccctgccccacgaccactatgtgttcctggagaagctccagacaaccctggtcaagttcatcaagggtgtgggcagcctgagccacgagcagtggcggtcgttccacaacgacaagaagacgtcggaggctcgcaacttcttggacggcgacctgatcgagtcgttcctcgacctcaacaggtccaagatggaggaggtggccaaggccatggcagtccctgttgaggagctgtccaagcgggtagaggagctgatgagactgcactaggtggtagcgccgggccatgtatatcctgttttatttgttcgttttcgctgtgttgtaaaccgtcggctgctcgagaatgatcctctgcaagtgtttgtagcaacatcccttctctgtgataagattgtaactttatctgtgctgatgtagaactttagtggtgaatctctcttgttgaaatggtatcaagaaagtttggcacaattactaggtgaacgtagacggtgataaccatctggaaatgcaaagctttggacttgaggtttctgattaagatactgacacaacagcacaggacattttgtctcactgatcacaaatataaatacggagagcactgataatattttttgacaatgcatatataatctccatacaccagtgaataaaattggcaatgcatatcttcataccacgtcacacaaccaacccagtgaatgaataaaaagtacctaaacttgatggcaaatcagccactcaaagatgtagatggtgccatggcatgcaattctttggcttctctcacgagggacactagggtacgcctgtcaagctttgatccggtttcggagctgctggcggaagagcaaaccatggagtagtcgagatctagcatgttctcagaagcactagagagtgcctctatcaagctcccaaagtgttcttgtttgaagaacccgccactgtagtatttcagcattgatatgaccatattaccggcagccttgcacactgacaggttttcgacggtggggccacttcttttcactaccatgtccctgagattgtttagaaagctagatgcatccagctgaggaggcaaatcaacgaccaacggcgtgttgtagaccgtcccgcaaaggcataacaatgatgaaagcaagttcggtgacatagttgagagtgtgtttacttggaatccctgggcatccttgtccggctcattgttttcttgtgtgccatcacattggctctctatgtcttctccattatgtgttccgtctccacaacaaagtatttttccaatcaccttgaggattgctttcttaagtttgtgaaggtattcatcatccttggtgtaatgggtacatagacgctcaaggatttcagctgatgcttgtctgcacgtctcgttttcttcatgtaaaagcacttgagtgagactatcaacaacatcaccacttgtttgtatgatagttgtggcatcactaattccgccaagggaacatatatttgacagcgcttctcccgcgtatcctctgatggagctgctatactcattatcccgagtgaagatgttgactagcatcccaacaaagtcttctccgcaacaactattttcatttttgagaagatgaaaaccagctgatctgttgattccgttggtatccatgtatagtcgtgcgagaatccaaatggctctttgccgcaactcttctttgcaatttttacagctaagaatccttagtagtgtgccgattgtttctgcgcaacttgagatttcacggcgtagcttggccccagtttctccttgagcaccgcttaaatggctcatcacctccatcgatcggcctactacttcgcaccatgtaccatgatcatcggcggtgtggtcgagtaggtcgcaagtgacaggtgccatgatcttgcagaccagatctcgggtgtcgctcatgattctgcaattgttttcgtctgcggcaaggttccggaggatagacaggccttgtagcaacaactccttgtaggccttcccaagttcgccggctggtgagggccgccgacgagtaacctgcagtttcagatgctgctcgtatccatccttggatctgggatatggctcggctatactatattgttcaaacgtcccgatcaaggaagatatgtgttgaatactccgaggaaactgctccaaattaatgtagaatgcaagtcgctccactatcatcgcggcttgaattctaccctttctgtcatgtaggcctcttgaatctagcatctctagcagtttcggcagtacattccgagaggatgatgtagacaagacaagatgttttatcagcatgcgctgcccatggacattggaccaatcattctttctctccaccatgcatatggctgcgtataggatctttaccccggaaatgcagtcaacaggtgaattggaaccaatcttgtctacagcatgtgtgacgaggttccttccttgggtaaatgtcgggtccttctcacatcctctccttgttttacgcaagtagttgtaaagtactgcttgaacttccgagtcttcagtggccatcgagtcttcggtgaccagagtcttagaaaacttcttctccgtgagagtcaacaaaaacctatagcagaagagcacgccctggagcagagcaaggcagtacaagatctgcattgctggtgctaggtttgatgctttttcatctgagttgcccccgtgatcgtgctctaccagacgccacaatgagatcaccccggacatgaatatcccaagcacatatataattgcgaaagggcttaatattaaggccaacaccattacttgaaccaacactaaaagaattaccgagaaaaagagaagaaaagacaacaaatcttgggcgcaactcttgctcggcgcgtcatcgggtacaatgccaaatgaaatggccgccaagaacccgaggagcgcatcctccatatagcctagtttctcattcagagtaacatcaaaaatctgtttgtacaagggtgatgaacgccgcacaccaaaagtcctccttatgtagctcagacacgaaaccaccaagaagtacaaca

SEQ ID NO: 3212 - DNA, 3635 bp, Triticum aestivum
cctaccaccgctccacagagcccagaaccctcctcctccggcggcggcggcgggcggcgaggggagatgagcacgtggaactacgtcgtgacggcgcacaagcccaccagcgtcagccactcctgcgtcggcaacttcaccggcccccaccagctcaacctcatcgtcgcgaaatgcacccgcatcgagatccacctgctcacgccgcagggccttcagcctatgcttgacgtgcccatatatgggaggatcgcgacgatcgagctcttccggcctcacaatgaggcccaggacttcctcttcgtcgccacggagaggtacaagttctgcgtcctgcagtgggacgcagaaaaatcagagcttctcaccagatccatgggagatgtttctgatcgcattggccgccctacggacaatggacagattgggatcatcgaccctgactgtagacttattggccttcacctctatgatggattgtttaaggttataccattcgacaacaaaggacagctgaaggaagctttcaatatcagactagaagagcttcaagtgttggacatcaagttcctgtatggctgtctcagacctacgatagttgtcctctaccaggataacaaagatgccaggcatgttaagacatatgaagttgcactgaaggagaaagacttcgttgagggtccttggtcacagaacaatttagacaacggagctggtcttttaatacctgtaccagctccactcggcggtgtcataataattggcgaggagacaatagtttactgcaatgctaattctacatttaaagctataccaatcaaacagtccatcacaagagcttacggaagggttgacccagatggctctcgctatttacttggtgataattcaggcattttgcatttacttgtccttacccaggaacgggaaagggtaactggtttgaaaattgagaatttgggagagacttcagttgcatcgtcaatatcgtatcttgataatggtgttgtctatgttggttctcgatttggtgattcacagctggtaaagctgaatctccaacctgatgcaactggttcattcgtcgaaatccttgaacggtatgtgaatcttggacccattgtggacttctgcgtggttgaccttgataggcaagggcaaggtcaggtggtcacttgttcaggagcattcaaagacggttccattcgagtggttcgtaatggtatagggattaatgagcaggcttcagtagagctgcaaggcatcaagggattgtggtcactgaagtcttccttcaatgatctctatgacatgtatctggtggtgagctttataagtgagactcggttcttggctatgaacatggaagatgaattagaagaaattgagatagaagggtttgatgcacaaatccagactttgttctgccaaaatgccatcaatgatatgcttatacaggttactgctaattctgtccggttagtcagttgcacttctcgggagctggtggatcagtggaatgcaccggaaggattttcagtcaatgttgcatcagctaatgccagtcaggtcctgttggcgaccggtggtggccatcttgtttacctagagattagggatgctaagctggttgaagtgaaacatgcgcagctagagcatgagatatcttgtgttgatttgaacccagtaggggagaatccacagtatagctctctggctgctattgggatgtggactgatataagtgttagcatattttcacttcctgaccttgaattaatcaggaaggaaaatttaggtggagaaattgttcctcggtcagttctgatgtgcaccttggaagggatttcatatttgctttgtgctcttggagatggtcaccttttcagttttctgctgaatgcaagcacaggtgaactaaccgatagaaagaaggtttctcttggtacccagccaatcagccttcgtacattctcatcaaagggcacaacccatgtgtttgcttcgtctgatagaccaactgttatctacagtagcaataaaaagctgctgtacagcaatgtcaatctgaaagaagttaatcatatgtgtcctttcaatacagctgcttttcctgacagccttgcaattgctaaagaaggtgaactttcaattggaactattgatgatatccagaagcttcatatccgcacgattccgttgaatgaacaagcacggcgcatttgccatcaggaacagtccaggacactggcgttctgcagtttcaagtacacccagaatagcatggaggagagcgaggcgcatttcattcgtctgatggatcatcaaacttttgagtttctgtctacacatcctcttgatcaatacgaatgtggttgctccatgattagctgctcattctcggatgataataacttctattactgtgtgggaacagcatatgttctacctgaggagaatgaaccgacaaagggccggatccttgtatttgcagttgaagatggaaggttgcaattaattgtagagaaagaaacaaaaggagctgtctattccctaaatgcattcaatgggaaattgttggcagctatcaaccagaagattcagttatacaagtggatgacgcgggaggatggttcacatgaactgcaatctgaatgtggccatcatggtcacattctcgccctgtatacccaaacccgtggtgatttcattgtagttggagacctgatgaaatcgatatccttgcttgtgtacaagcatgaggagagtgcgatcgaagagcttgctagggactacaacgcaaactggatgactgcagttgagatgattgatgacgacatctatgtcggtgcagagaacagctacaaccttttcaccgtgcgcaagaacagcgatgcagccacagatgaggagaggggcaggctggaggtggtcggggagtaccacctcggagagtttgtgaacaggttccggcacgggtcgcttgtgatgcgcctcccggactctgagatgggccagatccccacggtcatcttcggcaccatcaacggggtcatcggcatcatcgcctccctgccccacgaccactatgtgttcctggagaagctccagacaaccctggtcaagttcatcaagggcgtgggcagcctgagccacgagcagtggcggtcgttccacaacgacaagaagacgtcggaggcccgcaacttcctggacggcgacctcatcgagtccttcctcgacctcaacagggccaagatggaggaggtggccaaggcgatggcggtccccgtagaggagctgtccaagcgggtggaggagctgatgagactgcattaggtggtagcgccgggccgtgtatatcctgttttattcgttcgttatcgctgtgttgtaaaccgttggcggcttgagaatgatcctctgcaagtgtttgtagcagcattccttttctgttttttgactttgataagagtgtaactttatctgtgctgatgtagaattttagtggtgaatcgccgtggtttatgtgcaattgtcaacatgacacccagaaagtttggcataattgttaggcgtatgtaaaacggtgataaccatcctgaatgcaaagctttaaacttgaggtttcagat

SEQ ID NO: 3213 - DNA, 3561 bp, Secale cereale
gactcatctctcccttctctctctcctaccaccgctccacagagcccagaaccctcctcctccggcggcggcgggcggcgaggggagatgagcacgtggaactacgtcgtgacggcgcacaagcccaccagcgtcagccactcctgcgtcggcaacttcaccggcccccaccagctcaacctcatcgtcgcgaaatgcacccgcatcgagatccacctgctcacgccgcagggccttcagccgatgctggacgtgcccatatatgggaggatcgcgacaatcgagctcttccggcctcacaatgaggcccaggacttcctcttcgtcgccacggagaggtacaagttctgcgtcctgcagtgggacgcggaaaaatcagagcttctcaccagatccatgggagatgtttctgatcgcattggccgccctacggacaatggacagattgggatcattgaccctgactgtagacttattggccttcacctctatgatggattgtttaaggttataccattcgacaacaaaggacagctgaaggaagctttcaatatcagactagaagagcttcaagtgttggacatcaagttcctgtatggctgtgtcagacctacgatagttgtcctctatcaggataacaaagatgccaggcatgtgaagacatatgaagttgcactgaaggagaaagacttcgttgagggtccttggtcacagaacaatttagacaacggagctggtcttttagtacctgtacccgccccactcggcggtgtcataattattggcgaggagacaatagtttactgcaatgctaattctacatttaaagctataccaatcaaacagtccatcacaagagcttacggacgggttgacccagatggctctcgctatttacttggtgataattcaggcattttgcatttacttgtccttacccaggaacgagaaagggtaactggtttgaaaattgagcatttgggagagacttcagttgcatcgtcaatatcgtatcttgataatggtgttgtctatgttggttctcgatttggtgattcacagctggtaaagctgaatctccaacctgatgcaactggttcattcgttgaaatccttgaacggtatgtgaatcttggacccattgtggacttctgcgtggttgaccttgataggcaaggccaaggtcaggtggtcacttgttcaggagcattcaaggatggttccattcgagtggttcgtaatggtatagggattaatgagcaggcttcagtagagctgcaaggcatcaagggattatggtcactgaagtcttccttcagtgatctgtatgacatgtatctggtggtgagctttataagtgagactcggttcttggctatgaacatggaagatgaattagaagaaattgagatcgaagggtttgatgcacaaatccagactttgttctgccaaaatgccatcaatgatctgcttatacaggttactgctaattctgtccggttagtcagttgcacttctcgggagctagtggatcagtggaatgcaccggaaggattttcagtcaatgttgcatcagctaatgccagtcaggtcctgttggcgaccggtggtggccatcttgtttacctagagattagggatgctaagctggttgaagtgaaacatgcgcagctagaacatgagatttcctgtgttgatttgaacccagtaggggagaatccacagtatagctctctggctgctattgggatgtggactgatataagtgtgagcatattttcacttcctgaccttgaattaatcaggaaggaaaatttaggtggagaaattgttcctcggtcagttctgatgtgcaccttggaagggatttcatatttgctttgtgctcttggagatggccaccttttcagttttctactgaatgctagtacaggtgaactaacagatagaaagaaggtttctcttggtacccagccaattagcctccgtacattctcatcaaagggcacaacccatgtgtttgcttcttctgatagaccaactgttatctacagtagcaataagaagctgctgtacagcaatgtcaatctgaaagaagttaatcacatgtgtcctttcaatacagctgcttttcctgacagccttgcaattgctaaagaaggtgaactttcaattggaactattgatgatattcagaagcttcatatccgcacgattccgttgaatgaacaagcacgacgcatttgccatcaggaacagtccaggacactggcgttctgcagtttcaagtacacccagaatagcatggaagagagcgaggcacatttcattcgtttgatggatcatcaaacttttgagtttctgtctacacatcctctcgatcaatacgaatgtggttgctctatgattagctgctcgttctcggatgataataacttctattacattgtggggacagcgtatgttttacctgaggagaatgaaccgacaaagggccggatccttgtatttgctgtcgaggatggaaggttgcaattaatcgtagagaaagaaacaaaaggagctgtctattctctaaatgcattcaatgggaaattgttggcagctatcaaccagaagattcagttatacaagtggatgacgcgggaagatggttcccatgagctgcagtctgaatgtggccatcatgggcacatacttgccctgtatacccaaactcgtggtgatttcattgtagtcggagacctgatgaagtcgatatctttgctcgtgtacaagcatgaggagagtgcgatcgaagagctcgctagggactacaatgcgaactggatgactgcagttgagatgattgacgatgacatctatgtcggtgcagagaacagctacaaccttttcacagtgcgcaagaacagcgacgcggccacagacgaggagaggggcaggctggaggtggttggggagtaccaccttggagagtttgtgaacaggttccggcacgggtcgcttgtgatgcgcctcccagactctgagatgggccagatccccacggtcatcttcggcaccatcaacggggtcattggcatcatcgcctccctgccccacgaccactatgtgttcctggagaagctccagacaaccctggtcaagttcatcaagggcgtgggcagcctgagccacgagcagtggcggtcgttccacaacgacaagaagacgtcggaggcccgcaacttcctggatggggacctgatcgagtcgttcctcgacctcaacagggccaagatggaggaggtggccaaggccatggcggtccccgtcgaggagctgtccaagcgggtggaggagctgacgagactgcactaggtggtagcgccgggccgtgtatatcctgttttatttgttcgtttaagctgtgttgtaaaccgtgaatgatcctctgctcgagaatgatcctctgcaagtgtttgtagcaacattcctttttctgttcttgactttgataagagtgtaactttaactgtgctgatgtagaattttagtggtgaatcgccgtggtttatgtgc

SEQ ID NO: 3214 - DNA, 4722 bp, Brachypodium distachyon
gctctccgcttcccttcccttccggagcctagaactagaacccttctcctccagcggcggcggcggagatgagcacgtggaactacgtcgtcacggcgcacaagcccaccagcgtcagccactcctgcgtcggcaacttcaccagcaacacccagctcaacctcatcgtcgcgaaatgcacccgcatcgagatccacttgcttactccacagggaattcagcctttgctagatgtacctatatatggaagaatcgcaacgatcgagctcttccggccgcctactgaggctcaggacttccttttcattgccacggaaagatacaagttctgtgtcctgcagtgggatgcagaaaaatcagagcttatcactagatccgtgggagatgtctctgatcgcattggccgccctacggacaatggacagattgggatcatcgaccctgactgtagacttattggccttcacctctatgacggattatttaaggttataccatttgataacaaagggcagctgaaggaagctttcaatatcagactagaagagcttcaagtattggacatcaagttcctgtatggctgtctcagacctacgatagttgtcctctaccaggataacaaagatgcaaggcatgttaagacatatgaagttgcactgaaggacaaagactttgttgagggtccttggtcacagaataatttagacaatggggctggtcttttaatacctgtaccagctccacttggtggtgttataattattggcgaggagaccatagtttactgcaatgctaattctacatttaaagctataccgatcaaacaatcaatcataagagcttatggacgggttgatccagatggttcccgttatttacttggggataatacgggcattttgcatttacttgtccttacccaagaacgagaaagggtaactggtttgaaaattgagcacttgggagagacttcagttgcatcgtcaatatcatatcttgataatggtgttgtctatgttggctctcgatttggtgattcacagctggtaaagcttaatcttcaagctgatgcaactggttcatttgttgaagtccttgaacggtatgtgaatcttgggcccattgtggacttctgtgtggtggaccttgataggcaggggcaaggtcaggtggtcacttgttcaggagcatttaaagatggttccattcgggttgttcgcaatggtataggaattaatgagcaggcttcagtagagctgcaaggcatcaagggattatggtcattgaaatcttccttcaatgatccatatgacacattcctggtggtgagctttataagcgagacacgattcttggctatgaacatggaagatgaattagaagaaactgagatagaaggctttgatgcacaaatccagactttgttttgccaaaatgctatcagtgatctacttatacaggtcactgctaattctgttcggttagtcagttgcgcttctcgggagctagtggatcattggaatgcaccagatggattttcagtcaatgttgcatcagctaatgccagtcaggtcctgttggcaaccggtggtggccaccttgtttacctagagattagggatgctaagctggttgaagtaaaacatgcacagctagaacatgaaatctcttgtgttgatttgaacccaatcggggagaatccacagtatagttctctggctgctattgggatgtggactgatataagtgttagcctattatcacttccagaccttgaattaatcaggaaggaaaatttaggtggagaaatagtacctcggtctgttctgctatgcaccctggaaggggtttcttatttgctttgtgcccttggagatggtcacctgttcagttttctgttaaatgtgagtacaggggaactaactgacaaaaagaaggtttctcttggtacccaaccaattagccttcgtacattctcatcaaagggtacaacccacgtgtttgcctcatctgatagaccgacggttatctacagcagcaataagaagcttctgtatagcaatgtcaatttgaaagaagttaatcatatgtgcccttttaatacagccgcttttcctgacagccttgcaattgctaaagaaggtgaactttctattggaactattgacgatatccagaagcttcatatccgcacgatccccttgaatgaacaagcacgacgcatttgccaccaggaacaatccaggacattagcgttctgcagtttcaagtacaacccgaacagtatggaggaaagcgaggcacacttcattcgtcttttggatcatcaaacctttgagtttctgtctacacatcctcttgatcaatatgaatgtggttgctccatgattagctgctcattctcggatgataataacttctattactgtgtgggtacagcttatgttttacctgaggagaatgaaccaacaaagggccggattcttgtatttgcagttgaagatggaagactgcaattaattgtagagaaagaaaccaaaggagctgtctattcgctcaatgcattcaatggaaaattgttggccgctatcaaccaaaagattcagttatataagtggatgacacgcgaggatggttcgcacgagctgcaatctgagtgtggccatcatggtcacatactggccctgtttacccaaacccgtggtgatttcattgtagtcggagacctgatgaaatcaatatccttgcttgtgtacaagcatgaggagagtgcaatcgaagagcttgctagggattacaacgcaaattggatgactgcagttgagatgattgatgatgacatttatgttggtgcagagaatagctataaccttttcactgtgcgcaagaacagcgatgcggccacagatgaagagaggggtaggctcgaggttgtcggggagtaccatcttggcgagtttgtgaacagattccgtcacggttctcttgtgatgcgccttccagacacggagatgggccagatccccacggtcatcttcggcacaataaatggggtcattggcatcatcgcctccctcccacatgaccagtacgtgttcctcgagaagctccagtcgattctggggaagttcataaagggcgtcggtagcctgagccacgatcagtggcggtcgttccacaacgagaagaagacggcggaggcccgcaacttcctggacggcgacctgattgagtcgttcctggacctcaacaggagcaagatggaagaggtgtccaaggggatgggtgtctctgtggagaatctgtccaagagggtggaagagctgacgagactgcactagatgagatgggctggggtgggtggggctagataacattatgcagtgtatgtatgtcatcagctttccgctgttgcaaggctcaatgatatgatgctattgaagtatttgtagtcgtaacatgaattttgatggtttacacctacaagcaagttgtgtctaccagttactcctccgttcctaaatatttgtcgctgttttagttcaagtatttaggaactgagggagtacgtgatatgacttgcgaaatatttcgaaggaaatacttttttgaaaataaatacaggtgaaatgaacaagtagtcctactaagctgggcctaagttgaggaagaaaatgggctgcctagtgggtgttagagagagacatggcggaagacgagcgagtggggaagagaaggaaggaaccctaagacgattccgagcgggacacggagccggagcaagaagctgtacaacgatcggagccggagccggagtcgggaggcacacaaggcaagcgccgccaaggctgcacaggcgacgccagagatcgagacagaggcagagacagatatcggcgaccggcggcggcgcttcggaactcggcgaggaggctcgagggctgcctgctccagcggacgcaagagggcctgggcctgggccttccgaggaggctcgtccacagcggcggccctgaggccccttgtcgccagactatccccacccgtgattcccaccggcccaacggcgccaaagtcgagcatcctagtgcaaaacctgctgctgctgcagggactcgaaacgacgggaagatcaatgcgtacaggcagatcagcgacaagagagaagagctgttcgatctgctggccgacacagagcggcggaatatccaaaggaatgccttcaaaacatacgcctgctccagcaactcgctgtgcaagttaaacctaggcccaatgactccgtgtggcgctccaagcgaagatcgaaaaggatcaatgattttctagggtttaccggggcttaccaagaaattgattcactataagaaacaagtattggaggcaactccagaagaggcaaagatggatctagctggcgaggaacaataatgcggcttcacgagcacaaagattgctggatttgttttgcatcatagtgtatttgacaagtttggaagtgcattttagaataacaagttattactgtttcgctctttttggtcttttgatcaacaattgtttagtgtaatcgttgtgagtatatccttttctttattcaatttctccaaaaccctgttatggccagtaatgtacagttaaataggctgacaggaagtgtcggccttcatcacaagttgaaagaaatatctctatctcatatgagatgagagcctgagacac

SEQ ID NO: 3215 - DNA, 3484 bp, Lolium multiflorum
ccccctgctgccaccgccccccttccagaaccctccggcggcggcgccggcgctcggcggagatgagcacctggaactacgtcgtcacggcgcacaagcccaccagcgtcagccactcctgcgtcggccacttcaccggccccaaccagctcaacctcatcgtcgcgaaatgcacccgcatcgagatccatctgctcacgcctcagggccttcagcctatgctagatgtaccgatatatggaaggatcgcgaccatcgagctcttccgacctggcaatgaggcccaggacttccttttcatcgccacagagagatacaagttctgtattctgcagtgggatgcagaaaaatcggagcttctaaccagatccatgggcgatgtttctgaccgcattggccgccctacggacaacggacagattgggatcgtcgaccctgactgtaggattattggccttcacctgtacgatggattatttaaggttataccatttgacaacaaaggacaactgaaggaagctttcaatatcagactagaagagcttcaagtattggacatcaagttcctgtatggctgtctcagacctacgatagttgtcctctaccaggataacaaagatgcaaggcatgctaagacatatgaagttgcacttaaggacaaagactttgttgagggtccttggtcacagaataatttagacaatggagctggtcttttaatacctgtaccggctccacttggtggtgttataattattggcgaggagacgatagtttactgcaatgccaattctacattcaaagctatacccatcaaacaatccatcataagagcttatggacgggttgacccagatggttcccgctatttacttggtgataatacaggcactttgcatttacttgtgcttacccaagaacgagaaagggtaactggtttgaaaattgagcacttgggagagacgtcggttgcatcgtcaatatcatatcttgataatggcgttgtctatgttggttctcgatttggtgattcacagctcgtaaagttgaatctccaacctgatgcaagtggttcgtttgttgaagtccttgaacgatatgtgaatcttggacccattgtggacttctgcgtggttgaccttgataggcagggccaaggtcaggttgtcacttgttcaggagcatttaaagatggttcaattcgggtggttcgtaatggtatagggattaatgagcaggcttcagtagagctgcaaggcatcaagggattatggtcattgaaatcttccttcaatgatccgtacgacatgtacctggtggtgagctttataagcgagacacgattcttggctatgaacatggaagatgaattagaagaaacggagatagaaggttttgatgcacaaatccagactttgttttgccagaatgccatcaatgatctgcttatacaggttactgctaattctgttcggttagtcagttgcacttcacgggagctagtggatcaatggaatgcaccagaaggattttcagtcaatgttgcatcagctaatgccagtcaggtcctgttggcaaccggtggtggccatcttgtttacctagagattagggatgctaagctggttgaagtgaaacatgcacagctagaacatgagatttcttgtgttgatttgaacccagtcggcgagaacccacagtatagttctctggctgctattgggttgtggactgatataagtgttagcatatattcacttccagaccttgaattaatcaggaaggaaagtttaggaggagaaatagttcctcggtctgttttgctatgcaccttggaaggggtttcatatttgctctgtgctcttggagatggtcacctgtttagttttctgttaaatgcaagtacaggtgaactaactgatagaaagaaggtctctcttggtacccaaccaatcagccttcgtacattctcatcaaagggaacaacccatgtgtttgcttcatctgatagaccgactgttatctatagcagcaataagaagctgctgtatagcaatgtcaatttgaaagaagtcaatcatatgtctcctttcaatacagctgcttttcctgacagccttgcaatcgctaaagaaggtgaactttcgattggaactattgacgatatccagaagcttcatatccggacgatccccttgaatgaacaagcacggcgtatctgccaccaggaacagtccaggacactagcgttctgcagtttcaagtacaaccatgacagtatggagcaaagcgaggcacattttattcgtctgttggatcatcaaacttttgagttcctgtctacacatcctcttgatccgtatgagtgcggttgctccatgattagctgctcattctcagacgataataacttctattactgtgtgggaacagcgtatgttttacctgaggagagcgaaccaacaaagggccggatcctcgtattcgcagttgaagatggaagattgcaattaatcgtagagaaagaaacaaaaggagctgtctactctctaaatgcattcaatgggaaattgttggcggctatcaaccagaagatccaattatataagtggatgacacgggacgatggttcgcatgagctgcagtccgagtgtggccatcatggacacatactggccttgtatacccaaacccgtggcgattttattgtggtcggtgacctgatgaaatcaatatccttgcttgtgtacaagcatgaggagagtgcaatcgaagagcttgctagggattacaacgcaaactggatgactgcggtggagatgatcgatgatgatatctatgttggtgcggagaatagctataaccttttcactgtccgcaagaacagtgatgcagccacggatgaagagaggggcaggcttgaggttgtcggggagtaccaccttggggagtttgtgaacaggttccgtcacggctcccttgtgatgcgccttccagactcagagatgggccagatcccaactgtcatcttcggcacaataaacggggtcattggcatcatcgcatccctgccccatgaccactacgtgttcctcgagaagctccaggccaccctggtgaagttcataaagggcgttggcagcctcagccacgagcagtggcggtcgttccacaatgacaagaagacctcagaggcccgcaacttcgtggacggcgatctgattgagtcttttctcgacctcaataggggcaagatggaggaggtggccaaggtgatggcggtccccgtggaggagctgtcgaagagggtggaggagctgacgagactgcactagataacgtcatgccatgtacatctttgtttttactgttgtactttttggcagctcaagaataatcctgtggagttcttagtaacattgttttcctgctttaagtgtattttttccctctgctgatgttgaagttggtggttcaatggcgg

SEQ ID NO: 3216 - DNA, 3360 bp, Avena sativa
gccacctcaccgcgccctcccccttccagaaccctcctcctcctccggcggcggcgcgcggcggagatgagcacgtggaactacgtcgtcacggcgcacaagcccaccagcgtcagccactcctgcgtcggccacttcaccggcccccaccagctcaacctcatcgtcgcgaaatgcacccgcatcgagatccatctgcttacgccgcagggccttcagcctatgctagatgtacctatatacggaaggatcgccacgatcgagcttttccgacctatcaatgaggcccaggacttccttttcattgcaacagagagatacaagttctgcgtcctgcagtgggatgcagaaaaatcggagcttctaaccagatccatgggagatgtttctgaccgcattggccgccctacggacaatggacagattggaatcgttgaccctgactgtaggattattggccttcacctctacgatggattatttaaagttatacccttcgacaacaaaggacagctaaaggaagctttcaatatcagactagaagagcttcaagtattggacatcaagtttctgtatggctgtatcagacctacgatagttgtcctctaccaggataacaaagatgcaaggcatgttaagacatatgaagttgcactgaaggacaaagactttgttgagggtccttggtcacagaacaatttagacaatggagctggtcttttaatacctgtaccaaatccacttggtggtgttataattattggcgaggagacgatagtttactgcaatgccaattctacattcagagctatacccatcaaacaatcaatcataagagcttatggacgggttgacccagatggttcccgctatttacttggtgataatacaggcactttgcatttacttgtgcttacccaagaacgagaaagggtaactggtttgaaaattgagcacttgggagagacgtcggttgcatcgtcaatatcatatcttgataatggtgttgtctatattggttctcgatttggtgattcacagctcgtaaagctgaatctccaacctgatgtaactggttcgtttgttgaagtccttgaacgatatgtgaatcttggacccattgtggacttctgcgtggttgaccttgataggcaggggcaaggtcaggtggtcacttgttcaggagcatttaaagatggttcaattcgggtggttcgtaatggtatagggattaatgagcaggcttcggtagagctgcaaggcatcaagggattatggtcattgaaatcttccttcaatgatccgtacgacatgtacctggtggtgagctttataagcgagacacgattcttggctatgaacatggaagatgaattagaagaaacagagatagaaggctttgatgcacaaatccagactttgttttgccagaatgccatcaatgatctgcttatacaggtcaccgctaattctgttcggttagtcagttgcacttctcgggagctagtggatcaatggaatgcaccagaaggattttcagtcaatgttgcatcagctaatgccagtcaggttctgttggcaaccggcggtggccatcttgtttacctagagattagggatgctaagctggttgaagtaaaacatgcacagctagaacatgagatctcttgtgttgatttgaacccagtcggcgagaacccacaatatagttctctggctgctattgggttgtggactgatataagtgttagcatatattcactcccagaccttgaattaatcaggaaggaaagtttaggtggagaaatagttcctcggtctgttctgctatgcaccttggaaggggtttcatatttgctttgtgctcttggagatggtcacctgtttagttttctattaaatgcaagtacaggtgaactaactgatagaaagaaggtctctcttggtacccaaccaattagccttcgtacattctcatcaaagggaacaacccatgtgtttgcttcatctgatagaccgactgttatctatagcagcaataaaaagctgctgtatagcaatgtcaatttgaaagaagtcaatcatatgtgtcctttcaatacagccgcttttcctgacagccttgcaattgctaaagaaggtgaactttctattgggaatatcgatgatatccaaaagcttcatatccgcacgatccccttgaatgaacaagcacgtcgtatttgccaccaggagcagtccaggacactagcattctgcagtttcaagtacaaccatgacagtatggagcaaagcgaggcacattttattcgtctgttggatcatcaaacttttgagtttctgtctacacatcctcttgatcaatatgaatgtggttgctccatgattagctgctcattctcagatgataataacttctattactgtgtgggaacagcatatgttttacctgaggagaacgaaccgaccaagggacggatcctcgtatttgcagttgaagatggaaggttgcaattaatcgttgagaaagaaacaaaaggagcggtctactctctaaatgcattcaatgggaaattgttggcagctatcaaccagaagatccaattatataagtggatgacacgggacgatggttcacatgagctgcaatctgagtgtggccaccatggacacatacttgccctgtatacccaaacccgtggtgatttcattgtggtcggagacttgatgaaatcgatatccttgcttgcgtacaagcatgaggagagtgcaatcgaagagcttgctagggattacaacgcaaactggatgactgcggttgagatgatcgatgatgatgtctacattggcgcagagaatagctacaacctgttcactgtccgcaagaacagcgatgcggccacggatgaagagaggggcaggctcgaggttgtcggggagtaccatcttggagagtttgtgaacaggttccgtcacggttcgcttgtgatgcgccttccagactcggagatgggccagatccccacggtcatcttcggcacgataaatggggtcatcggcatcattgcctccctgccccacgaccactatgtgttcctggagaagctccaggcaaccctggtgaagttcataaagggcgtcggcagcctgagccacgagcagtggcggtcgttccacaacgacaagaagacgtcggaggcccgcaacttcctggacggcgacctgattgagtcgttcctggacctcaacaggggcaagatggaggaggtggctaagattatggcggtcccagtggaggagctgtccaagagggtggaggagctgacgagactgcactagatagtgtcctgccatgtacat

SEQ ID NO: 3217 - DNA, 3353 bp, Avena sativa
cctcctcctcctccggcggcggcgcgcggcggagatgagcacgtggaactacgtcgtcacggcgcagaagcccaccagcgtcagccactcctgcgtcggccacttcaccggcccccaccagctcaacctcatcgtcgcgaaatgcacccgcatcgagatccatctgctcactccgcagggccttcagcctatgctagatgtaccgatatacggaagaatcgcgacgatcgagctcttccgacctgataatgagactcaggacttccttttcatcgtcacggaaaaatacaagtactgtgtcctgcagtgggatggagaaaaatcggagctgctcaccatatccatgggagatgtttctgatgtccgtggctgccctacagacaatggacaaattgggatcattgaccctgactgtaggcttattggccttcacctctacgatggattacttaaggttatgccgttcgacaacacaggacagctgaaggaagctttcaatatcagactagaggagcttcaagtattggacatcaagttcctgtatggctgtgttaaacctacgatagttgccctctaccaggataacaaagttacaaggcatgttaagacatatgaagttgcactaaaggacaaaaactttttgagggtccttggtcacacaataatttagacaaaggagctagtctattaatacctgtaccagctccacctggtgtgttataatcattggcgagcagacaatagtttactgcaatgccaattctacattcaaagctatacccatcaaacaatccatcataagagcgtatggacgggttgacccagatggttcccgctatttacttggtgatcagacaggcactttgcatttacttgtgcttacccaagaacgagaaagggtaactggtttgaaaattgagcacttgggagagacttcagttgcatcctcaatatcatatcttgataatggtgttgtctatgttggttctcgttttggtgattcacagctcgtaaagctgaatctccaacctgatgcaactggttcgtttgttgaagttcttgaacgatatgtgaatcttggacccatcgtggacttctgtgtggttgaccttgataggaaggggcaaggtcaggtgatcacttgttcaggagcatttaaagatggttcagttcgggtggttcctaatggtataaggattaatgagcaggcttcagtagagctgcaaggcatcagtggattatggtcattgaaatcttcctccagtgatccatacgacatgtacctggtggtgagctttataagcgagacacgattcttggctatgaacatggaggatgtattaaaagaaacagagatagaaggctttgatgcacaaatccagactttgttttgccagaatgccatcaatgatctgcttatacaggtcaccgctaattctgttcggttagtcagttgcacttctcgggagctagtggatcaatggaatgcaccagaaggattttcagtcaatgttgcatcagctaatgccagtcaggttctgttggcaaccggcggtggccatcttgtttacctagagattagggatgctaagctggttgaagtaaaacatgcacagctagaacatgagatctcttgtgttgatttgaacccagtcggcgagaacccacaatatagttctctggctgctattgggttgtggactgatataagtgttagcatattttcacttccagaccttgaattaatcaggaaggaaagcttaggtggagaaatagttcctcggtctgttctgctatgcaccttggaaggggtttcatatttgctttgtgctcttggagatggccacctgtttagttttctattaaatgcaagtacaggtgaactaactgatagaaagaaggtctctcttggtacccaaccaattagccttcgtacattctcatcaaagggaacaacccatgtgtttgcttcatctgatagaccgactgttatctatagcagcaataaaaagctgctgtatagcaatgtcaatttgaaagaagtcaatcatatgtgtcctttcaatacagccgcttttcctgacagccttgcaattgctaaagaaggtgaactttctattgggaatatcgatgatatccaaaagcttcatatccgcacgatccccttgaatgaacaagcacgtcgtatttgccaccaggagcagtccaggacactagcattctgcagtttcaagtacaaccatgacagtatggagcaaagcgaggcacattttattcgtctgctggatcatcaaacttttgagtttctgtctacacatcctcttgatcaatatgaatgtggttgctccatgattagctgctcattctcagatgataataacttctattactgtgtgggaacagcatatgttttacccgaggagaacgaaccgaccaagggacggatcctcgtatttgcagttgaagatggaaggttgcaattaatcgttgagaaagaaacaaaaggagcggtctattctctaaatgcattcaatgggaaattgttggcagctatcaaccagaagatccaattatataagtggatgacacgggatgatggttcacatgagctgcaatctgagtgtggccatcatggacacatactggccctgtatacccaaacccgtggtgatttcattgtggtcggagacttgatgaaatcgatatccttgcttgcgtacaagcatgaggagagtgcaatcgaagagcttgctagggattacaacgcaaactggatgactgcggttgagatgatcgatgatgatgtctacattggcgcagagaatagctacaacctgttcactgtccgcaagaacagcgatgcggccacggatgaagagaggggcaggctcgaggttgtcggggagtaccatcttggagagtttgtgaacaggttccgtcacggttcgcttgtgatgcgccttccagactcggagatgggccagatccccacggtcatctttggcacgataaatggggtcatcggcatcattgcctccctgccccacgaccactacgtgttcctggagaagctccaggcaaccctggtgaagttcataaagggcgtcggcagcctgagccacgagcagtggcggtcgttccacaacgacaagaagacgtcggaggcccgcaacttcctggacggcgacctgattgagtcgttcctggacctcaacaggggcaaaatggaggaggtggctaagattatggcggtcccagtggaggagctgtccaagagggtggaggagctgacgagactgcactagatagcgccgtgccatgtacatctttcctttttgttttactgttgtctt

SEQ ID NO: 3218 - DNA, 3220 bp, Avena sativa
tcctcctccggcggcggcgcgcggcggagatgagcacgtggaactacgtcgtcacggcgcacaagcccaccagcgtcagccactcctgcgtcggccacttcaccggcccccaccagctcaacctcatcgtcgcgaaatgcacccgcatcgagatccatctgcttacgccgcagggccttcagcctatgctagatgtacctatatacggaaggatcgccacgatcgagcttttccgacctatcaatgaggcccaggacttccttttcattgcaacagagagatacaagttctgcgtcctgcagtgggatgcagaaaaatcggagcttctaaccagatccatgggagatgtttctgaccgcattggccgccctacggacaatggacagattggaatcgttgaccctgactgtaggattattggccttcacctctatgatggattatttaaggttatacccttcgacaataaaggacagctaaaggaagctttcaatatcagactagaagagcttcaagtattggacatcaagtttctgtatggctgtatcagacctacgatagttgtcctctaccaggataacaaagatgcaaggcatgttaagacatatgaagttgcactgaaggacaaagactttgttgagggtccttggtcacagaacaatttagacaatggagctggtcttttaatacctgtaccaaatccacttggtggtgttataattattggcgaggagacgatagtttactgcaatgccaattctacattcagagctatacccatcaaacaatcaatcataagagcttatggacgggttgacccagatggttcccgctatttacttggtgataatacaggcactttgcatttacttgtgcttacccaagaacgagaaagggtaactggtttgaaaattgagcacttgggagagacgtcggttgcatcgtcaatatcatatcttgataatggtgttgtctatattggttctcgatttggtgattcacagctcgtaaagctgaatctccaacctgatgtaactggttcatttgttgaagtccttgaacgatatgtgaatcttggacccattgtggacttctgcgtggttgaccttgataggcaggggcaaggtcaggtggtcacttgttcaggagcatttaaagatggttcaattcgggtggttcgtaatggtatagggattaatgagcaggcttcggtagagctgcaaggcatcaagggattatggtcattgaaatcttccttcaatgatccgtacgacatgtacctggtggtgagctttataagcgagacacgattcttggctatgaacatggaagatgaattagaagaaacagagatagaaggctttgatgcacaaatccagactttgttttgccagaatgccatcaatgatctgcttatacaggtcaccgctaattctgttcggttagtcagttgcacttctcgggagctagtggatcaatggaatgcaccagaaggattttcagtcaatgttgcatcagctaatgccagtcaggttctgttggcaaccggcggtggccatcttgtttacctagagattagggatgctaagctggttgaagtaaaacatgcacagctagaacatgagatctcttgtgttgatttgaacccagtcggcgagaacccacaatatagttctctggctgctattgggttgtggactgatataagtgttagcatatattcactcccagaccttgaattaatcaggaaggaaagtttaggtggagaaatagttcctcggtctgttctgctatgcaccttggaaggggtttcatatttgctttgtgctcttggagatggtcacctgtttagttttctattaaatgcaagtacaggtgaactaactgatagaaagaaggtctctcttggtacccaaccaattagccttcgtacattctcatcaaagggaacaacccatgtgtttgcttcatctgatagaccgactgttatctatagcagcaataaaaagctgctgtatagcaatgtcaatttgaaagaagtcaatcatatgtgtcctttcaatacagccgcttttcctgacagccttgcaattgctaaagaaggtgaactttctattgggaatatcgatgatatccaaaagcttcatatccgcacgatccccttgaatgaacaagcacgtcgtatttgccaccaggagcagtccaggacactagcattctgcagtttcaagtacaaccatgacagtatggagcaaagcgaggcacattttattcgtctgttggatcatcaaacttttgagtttctgtctacacatcctcttgatcaatatgaatgtggttgctccatgattagctgctcattctcagatgataataacttctattactgtgtgggaacagcatatgttttacccgaggagaacgaaccgaccaagggacggatcctcgtatttgcagttgaagatggaaggttgcaattaatcgttgagaaagaaacaaaaggagcggtctactctctaaatgcattcaatgggaaattgttggcagctatcaaccagaagatccaattatataagtggatgacacgggacgatggttcacatgagctgcaatctgagtgtggccaccatggacacatactcgccctgtatacccaaacccgtggcgatttcattgtggtcggagacctgatgaaatcaatatccttgcttgcttacaagcatgaggagagtgcaatcgaagagcttgctagggattacaacgcaaactggatgactgcggttgagatgatcgatgatgatgtctacattggcgcagagaatagctacaaccttttcactgtccgcaagaacagcgatgcggccacggatgaagagaggggcaggctcgaggttgtcggggagtaccatcttggagagtttgtgaacaggttccgtcacggttcacttgtgatgcgccttccagactcggagatgggccagatccccacggtcatcttcggcacgataaatggggtcatcggcatcattgcctccctgccccacgatcactacgtgttcctggagaagctccaggcgactctcgtgaagttcataaagggcgtcggcagcctgagccacgagcagtggcggtcgttccacaacgacaagaagacgtcggaggcccgcaacttcctggacggcgacctgattgagtcgttcctggacctcaacaggggcaa

SEQ ID NO: 3219 - DNA, 3513 bp, Zea mays
tcatttcacagggttttacatgaatagtgagcaatatttcacctgtaacagtaatactaatgaatgatctttttctttattgtgtagattggaatcatcgaccctgactgtagactcattggtcttcatctctatgacggcttatttaaggttataccatttgacaacaaagggcagctgaaggaagctttcaatatcagactggaagaacttcaagtactggacatcaaatttctgcatggttgtgttaaacctacaattgttgtcctctaccaggataataaagatgtgaggcatgttaagacttatgaagttgcactgaaggacaaagattttattgagggcccttggtctcagaataatgtagacaatggtgctggtttgttgatacctgtaccagctccacttggtggtgtgataataattggcgaggagcaaatagtttactgcaatgccaattctacatttaaagcaataccaataaaacaatccattattagagcttatggacgggttgacccagatggttctcgatatttacttggtgataatactggaattctgcatttacttgtccttacccatgaacgagaaagggttactggtttgaaaattgaatacctgggggagacttcgattgcatcatcgatttcatatcttgataatggcgttgtttatgttggttcacggtttggcgattcacagctggtgaagctgaacctccaagctgatgcaagtggttcatttgttgaaattctcgaacggtatgttaatcttggaccgattgtggacttctgcgtgattgaccttgataggcagggtcaaggtcaggtggtcacttgttctggggcatttaaagatggttcccttcgggtggttcggaatggtatagggattaatgagcaggcttcagtagaactccaaggcataaagggattatggtcattgaaatcttctttcaatgatccatatgacatgtaccttgttgtgagctttataagtgagacacgattcttggcaatgaacatggaagatgaacttgaagagaccgagatagaggggtttgatgcacaaactcagaccctgttttgtcaaaatgcgatcaatgaccttcttatacaggttactgctaattcggttcgattagtcagttgtacctcccgggagctagtggatcagtggaatgcaccagcaggattctcagtcaatgttgcttcagctaatgccagtcaggttctgttggcaaccggtggtggccatcttgtttacctagaaattagggatgctaaacttgttgaagtgaagcatgcacagttagaacatgagatttcttgtcttgatttgaacccaattggagagcatctagagtatagttccctagctgctgttgggatgtggacagatataagtgttagaatattttcacttccagatcttgtattaataaggaaagaaaatttgggtggagaaattgttcctcggtctgttctgctgtgcaccttggagggggtttcgtatttactttgtgctcttggggatggtaatctgttcagttttctgctgaatgcaagcacaggtgaactgactgatagaaaaaaggttaccctcgggacccaaccaatcagccttcgtacattctcatcaaagggtaccacccacgtgtttgcttcatcagataggccaactgtcatctatagcagcaataagaagcttctctatagcaatgtaaatttgaaagaggttaatcatatgtgccctttcaatacagccgcttttccagacagtcttgcaattgctaaagagggtgagctttcaattggaactattgatgatatccagaagcttcatatccgcacaatcccccttaatgaacaagcacgccgcatttgccaccaggagcaatcaaagacactagcattttgcagtttcaagtacaaccagagtgtggaggaaagtgagactcacttaatacgtctgctagatcatcagacttttgagtccctgtgtgtgtatcctctagaccagtatgaatgtggctgctccatcattagctgttcgtttgtggatgacaataatgtctattactgtgtgggaactgcatatgttatacctgaagaaaatgaaccaaccaagggccgaatccttgtatttgcagttgaagatggaagtttgcaattaattgtggagaaagaaaccaaaggagcagtttattcgttgaatgcattcaatgggaaattgttggctgctatcaaccagaagattcaattatacaagtggatgtcgcgcgaggatggttcacatgagctgcaatctgagtgtggccaccatgggcacatacttgccttgtacactcaaacacgtggtgacttcattgtggttggcgatctgatgaagtcaatttccttgctggtgtataagcatgaggaaagcgcgatcgaagagcgtgctagggattacaatgcaaactggatgactgcagttgagatgcttgatgatgaagtctatgttggggcggagaatggctataacttattcaccgtgcgcaagaacagtgatgctgccacagatgacgaaagggccaagcttgaggtcgttggggagtaccatctcggagagtttgtgaacagattccgccatggttcactcgtgatgcgccttccagactcagagatagggaagattcctacggtcatctttggcacaataaacggggtcattggcattatcgcctccctcccgcatgaccattacaccttccttgagaagttccagtccactcttgtcaagtacataaagggagttggaaacatgagccatgagcaatggcggtcgttccataacgacaagaagacagcggaggcacggaacttccttgatggtgacctgatcgagtcgttccttgaccttagccggagcaagatggaggtggtgtccaaggctatgggcgtttcggtggaggatctgtccaagattgtggaagagctgacgaggcttcactagtacatggatacgcagaagctttgcttgtaacttgatgcatagtggagccctgaaattgaggatgagatacgagatggcataggggatctgttgatggtctaaatctggaacgatctctaacgttcaaagggttgctcacgtgcgggcctaccaaaaggactcagatgagtcatcctgctgctacatctgctgggaagccttccgaaccagcctgcacccagaatggagctcccaccaatccctgaagatgaccaacgcaagctctacaaatggatgctggaagagaggcggagccacgcaatgctgccgagaagaagaaactcgatgaggagaagcgcccttctcaaggagttcatccgagcaggatccctcccaagctgtcatttgggtctcttgtgcctggttgggttgtgtacaagcacagtactgtgctatactgctatcttgaaaaccgatgtcttcatgatttagcctcctcgagtccaaaggttctgtggatgcaaaccagtattg

SEQ ID NO: 3220 - DNA, 3487 bp, Elaeis guineensis
tcccgcctgtcctctctcgtaggctcttctgcactctcctccctttgccccatccgcctcctcctaaatccccgcctccgcctcctcgtcctgctcgccctccttcaccaccgccaccaccacctccacctccacgcgcggcggcgagagcatcctagcaaccgagggaaggggcggagatgagcgtgtggaactacgtggtgacggcccacaagccgaccaacgtcacccactcctgcgtcggcaacttcaccagtccccaagagctcaacctcatcatcgctaaatgtactcgcattgagatccatttgcttacaccccatggcctacagcccatgctggatgttccaatatatggaagaattgcgacacttgaacttttccgtcctcatggggaacctcaagatttcctatttattgctacagaaagatacaaattttgtgttcttcaatgggatgcagagacttcagaactcatcacaagagctatgggagacgtttctgatcgcattggtcgcccaacagataatggacagattggcataattgatccagactgtagattaattggtcttcacctatatgacggcttgttcaaggtcatacccttcgataacaaaggacaactaaaggaagcattcaacatcaggcttgaagaacttcaagttttggatatcaaatttctctatggctgtgctaagcccactattgtagtcttataccaggataacaaggatgcacggcatgttaagacatatgaggttgcactcaaggataaagactttgttgagggtccatgggcacaaaataatcttgataatggggctggtcttctaatacctgttcctatgcctcttggtggtgtaataattatcggggaggaaacaattgtgtattgtagtgcgactgcatttaaagctataccaatcaggccatctattataagagcctatggaagagttgatgtggatggttctcgatatttgcttagtgacaatgcaggtcttctgcatctacttgtcatcacccatgagagagaaagggtgactggactcaaaattgaacacttgggagagacctctgtggcgtcaacaatatcttatcttgacaatgcagttgtttatgttggttcaagttatggagattctcagctgataaaactgaatctgcaacctgatgcgaaaggctcgtatgttgaggttcttgaaagatatgtcaatcttgggcctattgtggacttctgtgttgttgatcttgagaggcaaggtcagggtcaggttgttacatgctcgggagcttataaagatggttcccttcgtgtagttcggaatggcatagggattaatgaacaggcatcggtagaactgcaaggcatcaaaggattgtggtctttaagatcttctactagtgatccatatgacaccttcttggttgtaagctttatcagcgagacacgtattctggcaatgaatatggatgatgaattagaagaaactgagatagaaggattttatgcacaagcacaaaccttgttttgccacaatgccatgcatgatcaacttgtacaggttactgctaactctgttcgtttggtgagttctacatctcgggatttgctggatcaatggaatgcaccttcagggttctctgtcaatgttgctactgctaatgcctctcaggttttattggccactggaggtgggcatcttgtttatatagaaattgggaatggcaagttggttgaagcaaaacacatacagctggaatatgaaatttcttgtcttgacataaatccaattggtgaaaattctaattacagttcactggcagcagtaggaatgtggacagacataagcgttaggatattttcactaccaagcctggaaatactgacaaaagaaaatttgggtggagagatcattcctcggtctgttcttctatgtacctttgaaggggtgtcctatctgctatgtgctcttggagatggacacctgttcaattttctattgaacacaggtactggtgaattgtctaacagaaagaaggtttctcttgggacacaacctatcacactccgtaccttttcttcaaaggataccacgcatgtatttgctgcatctgatagaccaacggtcatctacagcagcaacaagaagttgctttatagtaatgtaaatttgaaagaagttagtcatatatgtccttttaactcagctgcttttccagacagcctcgcaattgctaaagaaggagaactttcaattggagccattgatgacatccaaaagcttcacattcgcacgatccctctaggggaacatgcccgacgtatctgccatcaggagcagtctcgaacatttgccgtctgtagtctcaagaactgtcagactagtacagaggaaactgaaatgcactttgttcgattattggatgatcaatcttttgagttcatatcaacctatccacttgatacatatgaatatggctgctccattattagctgttccttctcagatgacaacaatgtttattactgtgtgggaactgcttatgtgttgcctgaggaaaatgagcctagcaaggggcgaatcctggtttttctggtagaagatgggaaattacaattgattgctgaaaaggaaacgaagggagctgtttactctcttaatgctttcaatggaaaattgctggctgccatcaatcagaagatccagttgtacaaatggatgctccgggatgatggatctcgtgagctgcaatctgaatgcggacatcatgggcacatactggccttgtatgttcaaactcggggcgatttcatcatagttggtgatctgatgaagtctatatccttgttgttgtataagcatgaggagggtgcaatcgaggagctagcccgcgactacaatgcaaactggatgactgctgttgagatccttgatgacgacatctaccttggtgctgagaacaatttcaacctctttacagtccgcaagaatagtgatgcagcaacagatgaggagcggggccggcttgaggtagttggggagtaccaccttggtgagtttgtcaaccggttccggcatggatcacttgtcatgcgccttccagactcagaggctggccacataccgacggtcatctttggtactgtcaatggtgtgattggaatcgttgcttctctccctcacgaccaatatgtgtttctagagaaacttcagtccaaccttgtcaaggttataaagggtgtgggtgggcttagccatgagcagtggcggtcattcaataatgagaagaagacagtagatgctaggaattttttggatggagacttgatcgagtcgtttcttgatctgagccgcagtcggatggaggagatctcaaaggcaatgggggtttcagtggaggagctgtgcaagagagttgaggagctgacaagattgcactaaaagacgtaaatcccccttgttgtctgttttttttcctt

SEQ ID NO: 3221 - DNA, 3645 bp, Ananas comosus
ggtgaggcgctggacgacgtcgcggaaggagaggggatcggcttgcacgtaggtggtggtagtggcggaggaggacgaggaggaggcggcggagatgagcgtgtggaactacgtggtgacggcgcacaagccgacgaacgtgacgcactcctgcgtcggcaacttcaccgggccccaagagctcaacctcattatcgcgaaatgtacacgtatcgagatccatttgcttgctccccatggtcttcagcctatgctggatgtaccaatatatgggcgaattgcaacacttgagctctttcgtcctcatggtgaagctcaagatttcctatttgttgctaccgagagatacaaattttgtgttctccaatgggatgcagaatcgtcagagctcatcacaagggcaatgggggatgtttctgatcgcattggtcgccctacagacaatggacagattggtattatagatccggactgtaggctgattggtctccacttatatgatggcttatttaaggttataccctttgataacaaaggacaactaaaagaagcatttaatatcaggcttgaagaacttcaggttctggatgtcaagtttctatatggctgctcaagaccgacaattgctgtgctttaccaggataataaagatgcacggcatgttaagacatatgaagttgcacttaaggataaagactttgtcgaaggcccatggtcgcagaacaatcttgacaatggggcaggacttctaatacctgttccaatgcctttgggtggtgttataattattggtgaggagacaatagtgtattgcagcggtacttcctttaaagctataccgatcagaccatcaattactagagcctatgggagagtcgatgctgatggttctcgatacttgcttagtgataacacgggccttctccatttacttgtcatcactcatgagagagaaagggtaactggtctcagaattgagcaattgggtgagacctctgttgcatcaacaatatcttatcttgacaatgcagttgtttttgtgggctccagttatggtgattcacagttgatcaaactgaatctgcaaccggatgcaaaaggttcatatgttgaagtacttgaaagatatgtcaatcttgggcccattgtagatttctgtgtagttgatcttgagaggcaagggcagggccaggttgtcacttgttcaggagcttataaagatggttcccttcgcatagttcgaaatggaattgggattaatgaacaggcttctgtggaacttcaaggcatcaaaggattgtggtctttacggtcttctatgaatgatccgcatgataccttcttggttgttagcttcatcagtgagacacgtattttggcaatgaacatggaggatgaattagaagaaactgagatagaaggattcaattcacaaacacaaaccttactttgccaaaatgttgtgtatgatcagcttgtacaggttactgctatatctgttggattagtcagttcgaccactcgagagttgcttgatcagtggaatgcacctgcagggttttcagtgaatgttgcagctgctaatgcctcccaggttttattggctactggaggtgggcatcttgtctacctagaaattgggaatgcaaagttggttgaagtaaaacacattcagctggaatatgaaatctcctgtcttgacataaacccgatcggtgagaatcccaattatagctcactagcagcagtgggaatgtggacagatataagtgttagggtattctcactcccaagcttagaactaatgacaaaggaaaatctgggtggagaaatcattcctcgctctgttcttctgtgtaatctcgaaggggtgtcgtatttgctttgtgcccttggtgatgggcacctattcaacttcctactcaacacaaaaactggtgaattatctgataggaagaaggtttctcttggcacacaacctatcagccttcgtacgttctcttcaaaagatgctacccatgtgtttgctgcatcagataggccgactgttatttacagcagcaacaagaagctgctttatagtaatgttaacttaaaagaagtcagccatatgtgtcccttcaattcagctgctttcccagacagccttgcgattgctaaagaaggtgagctttctatcggcaccatcgacgacatccaaaagcttcatatccgcactattcctctgggggaacatgctcgtcgaatttgccatcaagaacagtctagaacgtttgctatctgtagtctgaagaacaatcagaatagtaccgaggaaaccgagacacattttgtccgtttattggatgatcaatctttcgattttatatccacatatgctctcgacacctatgagtatggctgctcgatcatcagttgttctttctcggatgacaacaatgtttactactgtgtggggacagcgtatgtcttgcctgaagaaaatgaacccaccaagggccgcatcttggttttcctagttgaggatgggaaactacaattgattgccgagaaggaaacgaagggagccgtttactcacttaacgcctttaacggaaagctgttggccgccatcaatcagaagatccagttatataaatgggtgcatcgggaagacgcgtcccgtgagctgcaatctgaatgtggtcatcacgggcatatactcgccctttatgttcaaacccgtggcgatttcatcgtggtcggcgacctaatgaagtctatatccttgttgatatataagcatgaggaaggcgcgattgaagagcgagcgagggactacagtgcaaattggatgaccgcacttgagatccttgacgatgacatctacctcggtgcagagaacaacttcaacctcttcaccgtccgtcgcaacagtgatgctgcaactgatgaggagcgtggccgcctcgaagttgttggagaatatcatttgggcgagttcgtcaaccgcttccgacatggctctttggtaatgcgtcttcctgattcagaagctggtcgcatccccaccgtcatttttgggactgtaaacggtgtcattggtgtcgtggcctctctcccccacgaccaatacttgttccttgagaggctacagtccaacttggtgaaggttataaagggggttggtgggcttagccacgagcagtggcggtcgttcaataatgaaaagaagacagccgatgccaggaacttcttggacggcgacttaatcgaatcttttcttgatctcagtagaagccgaatggaggaggtttcaaaggcgatgggggtcccagtggaggaactgtgcaggagagtcgaggagatgacgagactgcattaaaatttggggaaaacaacgatatgctatgcatgtaaattattattcctgggtggaaacttagttgttcgttgtgcaacactatgtggtgttctttgtgtagttttgagacgaaatatcaaacaatatttttgcttttttgttgctcaggagataatagctgtttgattatgcatgtttattgctttttttctcccagttgctttcatggtttttgtcttttcggataattttgttaagtaaatgagtaacaaatttaagttttaaactgcatatttgggtgg

SEQ ID NO: 3222 - DNA, 3637 bp, Musa acuminata
cttgtttcaagcgctggaaacccttacggcccttcctctcgcttcctctcgctcccgaccttttccgccttctccttcctctcttccgtttggcgagcaactcgggcggcggcggtggagatgagcgtgtggaactacgtggtgacggctcacaagccgaccaacgtcacccactcgtgcgtcggcaacttcaccagcccccaagagctcaacctcatcatcgctaaatgcacacgcattgaaatccatttacttacgcctcatggactgcagcccatgttggatgtacctatatatggaagaattgccacactcgaactttttcgtccgcatggtgaacctcaagattttctatttatcgctacggagaggtacaaattctgtgttcttcagtgggatgcagagacatcagagcttattacaagagctatgggtgatgtttctgatcgaattggtcgtccaacagataacggacagattggtttgattgaccctgactgtcggttgattggcctccacttgtatgatggtctatttaaggttataccattcgataataaaggacagttaaaggaagcttttaacatcaggcttgaagaacttcaagttttagatataaaatttctttatggctgtttgaagcctacaattgtggtcctgtaccaggataacaaggatgctcggcatgctaagacttatgagatagcgctcaaggataaggactttgttgagggtccattgtctcatactaatcttgacaacggggctggtattctgattcctgtgcccatgccccttggtggtgtcataattataggggaggagacgatcgtttattgtagtgttactgcttttaaagctataccaatcagaccgtcaattacaagggcctatggaagagttgatgcagatggctctcggtacttgcttggtgataacgcaggccttctacatttactcgtcatcactcacgagagggaaagagtaactggtctgaaaattgagcacttaggagagacctctgttgcatcaacaatatcttatcttgataatgcagttgtgtatattggttcaagctatggtgattcacagcttataaaactgaatctacaacctgatgcaaagggttcatacgttgaagttcttgaaaaatatgtcaacctggggcctattgtggatttctgtgttgttgatcttgagaggcaaggtcagggtcaggttgttacctgttcgggagcttataaagatggatccctccgcatagtccgaaatggaatagggattaatgaacaggcatctgtagaacttcaaggtatcaaagggttatggtccttgcggtcttctactaatgatccatatgacaccttcttggtggtaagcttcatcaatgagacacgtgtcctggcaatgaatatggatgacgaattagaagaatctgagatagaaggattttgcgcagaagcccaaaccttattttgtcaaaatgccatccatgatcaacttgtgcaggttactgctaattctgttcgattagtgagttccaccactcgagagttgctgcatgagtggaatgcaccttcaggctactcagtcaacgttgcaactgctaatgcctcccaggttttgttggccactggcggtggccatcttgtttacttagagattggaaatgggaagctggccgaagttaaacatgtacaattggactatgagatatcttgtcttgacataaatccaagtggtgaaaatcctaattatagcacattagccgcagttggtatgtggacagatattagtgtcaggatattttcacttcctagcctagaactacttgcaaaagaaaatctgggaggtgaaattattcctcgatctgttcttctatgtacctttgaaggggtatcttatcttctgtgtacccttggagatggacacctgctcaattttctactgaatttgagcaccggtgaattatctaataggaagaaggtctctcttggtactcagcctattatgctcagaacattttcttcaaaggataccacacatgtatttgcagcatcagatagacctacagttatctacagtagcaacaagaagttactctatagtaatgtgaatttgaaggaagtcagccacatgtgtccatttaattcagctgcttttcctgacagccttgcaatagcaaaagaaggtgaactttcaattggaactatagatgatatccaaaagcttcacattcgcacaattcctctgggggaacatgcacgtcgaatttgccatcaggagcagtctcgaacatttgccatttgtagtctcaagaactgccagacgagtaatgaggagacagaaatgcactttgttcgcctgttggatgatcaaacctttgagttcatatcaacctaccctcttgatacctatgaatacggttgctccattattagttgttcattctcagacgacaataatgcctattactgtgttggaacagcttatgttttgcctgaagaaaatgagcctagcaagggaagaatcctggtttttgtagttgaagatgggaaattgcaattgattgctgaaaaggaaaccaagggtgctgtgtactctctcaatgctttcaatggtaaattgctggctgctattaatcagaaaatccaactatacaaatggatgcttcgggaagatggatcaagggaattgcaggcggagtgtggacatcatgggcatatacttgctttgtatgttcaaactcgcggtgatttcattgttgttggtgatctgatgaaatctatatctctgttgttatacaagcacgaggaaggtgcgatagaggagctagctagggattataatgcaaactggatgtcagctgttgagattcttgatgatgatgtctttcttggtgctgagaacaactataacctttttacagtgcggaaaaatagtgatgcagctacagatgaggagcgaggccggcttgaggttgttggtgaataccaccttggagagtttgtcaaccgctttcgacatggatcactggtaatgcgacttccggattcggaggcaggccacattccgacggttatatttggcactatcaatggtgtcattggggtggtagcgtcccttcctcatgaccaatatgtgttccttgagaagctccaggccaacctcgtgaaggtaataaagggggtgggtggcctgagccatgagcaatggcgatcgttcaacaacgaaaagaagacagtggatgccaggaacttcttggatggagacttgatcgagtctttccttgatctcagccgcagtcggatggacgagatagcatcctccatgggagttccattggaggagctttgcaagagagtggaggagctgacaagattgcattgaagaatgtctcggatgggaactcattttgctgcttcttcatgttacagcgggcttcctcctatggcggtacatggtgacttgatgggtctgtgtgcccaagtgaaggatgcatgtaagctgtcgtttaccatctgttttataagctaccatctgtttaccatatgttttataagctaccatctgtttaccattcagggtcacagttttttgatcattttccgtaaatggttttattttgtgaggaaaa

SEQ ID NO: 3223 - DNA, 3637 bp, Citrus clementina
gtgagagctggaagctgcaaaggagcagaaaagcccagaattcaaaggaagaatagttataataacaacttcaattagaaaaaaaaaataaaaaatcagcgactccatagagcatcgagcggaagagaaacaacgatgagtatatggaactacgtcgttacggctcacaagccgacaaacgttactcactcttgcgtcggcaatttcaccagcccgcaagaactcaatctcatcattgcgaaatgtacacgtatcgaaatacatttgcttactcctcagggactacagcctatgttggatgtaccgatatatggaagaattgcaacgcttgaacttttccgccctcatggcgaagcacaggattttctatttattgcaacagaaagatacaaattctgtgttcttcagtgggatgcggagtcatctgagctcattacaagagctatgggggatgtctctgaccgtataggccgtcctacagataatggtcagatcggaataattgatcctgattgcagattaattggactccatttgtatgatgggttgtttaaggtcattccttttgacaataaaggccagctcaaagaagcatttaacattaggctggaggaacttcaagttctggatattaagtttctctatggttgtgcaaaaccaacaattgtagtgctctaccaggataacaaagatgctcggcacgttaaaacatatgaagttgccctgaaggataaagattttgttgaggggccttggtctcagaataatctggacaatggggctgatttgctcataccagtacccccacctctctgtggcgtccttataattggagaagagacaattgtctattgtagtgccaatgcttttaaagcaatcccaatcagaccttctatcacgaaagcctatgggagagttgatgctgatggttctagatatttactcggtgatcatgctgggcttcttcacctcctcgtcataacccatgagaaagaaaaggttactggactcaaaattgagcttttgggcgaaacttctattgcatctactatatcatatctggataatgcggttgtgtatattggctcaagctatggagattcacagcttataaaactaaatctacaacccgatgcaaaaggttcatatgttgaagttttggaaagatatgtcaatttggggccaattgtcgacttctgtgtggttgaccttgagaggcaaggccaaggtcaggttgtaacctgctctggagcttacaaggatggttctctccgtatagttcgaaatggaattggaattaatgagcaggcatcagtggaattgcaaggtattaaaggaatgtggtcactaagatcatctacagatgatccatttgataccttcttggtggttagttttatcagcgagacacgaattttggcaatgaatcttgaggatgagcttgaagaaactgagatagagggtttctgttctcaaacgcagactttgttttgccatgatgctatctacaatcaacttgtgcaagtaacttcaggctctgtaagacttgtcagttctacatccagggagctgcgaaatgaatggaaatctccgcccggttattcagttaatgttgcaactgcaaatgcaagccaggttttactagcaactggcggtggacatttagtttatttagaaattggtgatggaatattgacagaagtaaagcatgcacagctggagtacgagatttcatgccttgacattaatcccattggtgaaaatcctagctatagtcagatagctgcagttggaatgtggacagatattagtgttaggatattttcactccctgacctgaatctcatcactaaggagcatttgggtggagaaatcatacctcggtcggttcttctttgtgcctttgaagggatttcttacttgttatgtgcacttggggatggccatctcttaaactttctattgaacatgaaaaccggtgagttgacagataggaagaaggtttctcttgggacccagcccataactctccgtaccttctcatccaagaataccacacatgtattcgctgcatctgataggccaactgtaatttatagcagtaacaagaagctgctttatagtaatgtaaatttgaaagaagttagtcatatgtgccctttcaactctgctgcttttccagacagccttgcaattgcaaaagaaggcgagcttactattggcacaattgatgacatccagaagcttcacatccgctctataccacttggggagcatccacggcgtatctgccatcaggaacagtcccggacttttgccatctgtagtttgaaaaaccagtcatgtgcagaagaatctgaaatgcactttgttcgtttgttagatgaccaaacatttgagttcatatcaacttacccacttgacacttttgagtatggctgctccatactcagttgttctttctctgatgatagtaacgtttactactgtgttggtactgcatatgttctaccagaagaaaatgagccaacaaagggcaggatattggtttttattgtggaagatggaaagttacaactaattgcagagaaggaaaccaagggagctgtttactctttgaatgccttcaacggcaaattacttgctgccatcaatcaaaaaattcagttgtacaagtggatgctccgggatgatggtacacgtgagctgcaatctgagtgcggacatcatggtcacatacttgccctctatgtacaaactcgtggagatttcattgttgttggtgatctgatgaaatcaatttctctgttgatctataagcatgaggaaggtgctatcgaagagcgagcccgtgactacaatgcaaattggatgtcagctgttgaaattcttgatgacgatatctacctaggtgctgaaaacaactttaacctcttcacagtgcggaaaaatagtgaaggtgccacagatgaggaacgaggtcgtcttgaggtggttggcgaataccaccttggagaatttgtcaatcggtttcgccatggatcccttgttatgcgcttgccggactctgatgtgggccagatcccaactgtcatttttggaactgttaatggggtcattggggttattgcgtcacttccacacgagcaatatctattcttagagaagctccagacaaacttgaggaaggtgatcaagggagttggagggttgaatcatgagcaatggaggtcctttaacaacgagaagaaaactgtagatgctaagaatttcctggatggtgatttaatagagtcatttcttgatctcagccgaagccgaatggatgagatttctaagacaatgaatgtttctgtggaggagctttgtaagagagttgaggaacttacgaggttgcattgataaagtgtccaaaatgcaagtatttttttggttcttttatttattgcctttgtttccttatcttgtaacatcttcagacatatctcttgtggccttggagttgtgtggggagttaggaccggcggtgggttgtatgggggcatcgcataaagtgaaatttatcacattttttgtttcatctaatgttatagactttcttggacccctagtggcttgcgtggattgtgcatgtttt

SEQ ID NO: 3224 - DNA, 3858 bp, Citrus sinensis
gtgagagctggaagctgcaaaggagcagaaaagcccagaatccaaaggaagaatacttataataacaacttcaattagaaaaacaaaataaaaaaaattcagcgactccatagagcatcgagcggaagagaaacaacgatgagtatatggaactacgtcgttacggctcacaagccgacaaacgttactcactcttgcgtcggcaatttcaccagcccgcaagaactcaatctcatcattgcgaaatgtacacgtatcgaaatacatttgcttactcctcagggactacagcctatgttggatgtaccgatatatggaagaattgcaacgcttgaacttttccgccctcatggtgaagcacaggattttctatttattgcaacagaaagatacaaattctgtgttcttcagtgggatgcggagtcatctgagctcattacaagagctatgggggatgtctctgaccgtataggccgtccaacagataatggtcagatcggaataattgatcctgattgcagattaattggactccatttgtatgatgggttgtttaaggtcattccttttgacaataaaggccagctcaaagaagcatttaacattaggctggaggaacttcaagttctggatattaagtttctctatggttgtgcaaaaccaacaatcgtagtgctctaccaggataacaaagatgctcggcacgttaaaacatatgaagttgccctgaaggataaagattttgttgaggggccttggtctcagaataatctggacaatggggctgatttgctcataccagtacccccacctctctgtggcgtccttataattggagaagagacaattgtctattgtagtgccaatgcttttaaagcaatcccaatcagaccttctatcacgaaagcctatgggagagttgatgctgatggttctagatatttactcggtgatcatgctgggcttcttcacctcctcgtcataacccatgagaaagaaaaggttactggactcaaaattgagcttttgggcgaaacttctattgcatctactatatcatatctggataatgcggttgtgtatattggctcaagctatggagattcacagcttataaaactaaatctacaacccgatgcaaaaggttcatatgttgaagttttggaaagatatgtcaatttggggccaattgtcgacttctgtgtggttgaccttgagaggcaaggccaaggtcaggttgtaacctgctctggagcttacaaggatggttctctccgtatagttcgaaatggaattggaattaatgagcaggcatcagtggaattgcaaggtattaaaggaatgtggtcactaagatcatctacagatgatccatttgataccttcttggtggttagttttatcagcgagacacgaattttggcaatgaatcttgaggatgagcttgaagaaactgagatagagggtttctgttctcaaacgcagactttgttttgccatgatgctatctacaatcaacttgtgcaagtaacttcaggctctgtaagacttgtcagttctacatccagggagctgcgaaatgaatggaaatctccgcccggttattcagttaatgttgcaactgcaaatgcaagccaggttttactagcaactggcggtggacatttagtttatctagaaattggtgacggaatattgacagaagtaaagcatgcacagctggagtacgagatttcatgccttgacattaatcccattggtgaaaatcctagctatagtcagatagctgcagttggaatgtggacagatattagtgttaggatattttcactccctgacctgaatctcatcactaaggagcatttgggaggagaaatcatacctcggtcggttcttctttgtgcctttgaagggatttcttacttgttatgtgcacttggggatggccatctcttaaactttctattgaacatgaaaaccggtgagttgacagataggaagaaggtttctcttgggacccagcccataactctccgtaccttctcatccaagaataccacacatgtattcgctgcatctgataggccaactgtaatttatagcagtaacaagaagctgctttatagtaatgtaaatttgaaagaagttagtcatatgtgccctttcaactctgctgcttttccagacagccttgcaattgcaaaagaaggcgagcttactattggcacaattgatgacatccagaagcttcacatccgctctataccacttggggagcatccacggcgtatctgccatcaggaacagtcccggacttttgccatctgtagtttgaaaaaccagtcatgtgcagaagaatctgaaatgcactttgttcgtttgttagatgaccaaacatttgagttcatatcaacttacccacttgacacttttgagtatggctgctccatactcagttgttctttctctgatgatagtaacgtttactactgtgttggtactgcatatgttctaccagaagaaaatgagccaacaaagggcaggatattggtttttattgtggaagatggaaaattacaactaattgcagagaaggaaaccaagggagctgtttactctttgaatgccttcaacggcaaattacttgctgccatcaatcaaaaaattcagttgtacaagtggatgctccgggatgatggtacacgtgagctgcaatctgagtgcggacatcatggtcacatacttgccctctatgtacaaactcgtggagatttcattgttgttggtgatctgatgaaatcaatttctctgttgatctataagcatgaggaaggtgctatcgaagagcgagcccgtgactacaatgcaaattggatgtcagctgttgaaattcttgatgacgatatctacctaggtgctgaaaacaactttaacctcttcacagtgcggaaaaatagtgaaggtgccacagatgaggaacgaggtcgtcttgaggtggttggcgaataccaccttggagaatttgtcaatcggtttcgccatggatcccttgttatgcgcttgccggactctgatgtgggccagatcccaactgtcatttttggaactgttaatggggtcattggggttattgcgtcacttccacacgagcaatatctattcttagagaagctccagacaaacttgaggaaggtgatcaagggagttggagggttgaatcatgagcaatggaggtcctttaacaacgagaagaaaactgtagatgctaagaatttcctggatggtgatttaatagagtcatttcttgatctcagccgaacccgaatggatgagatttctaagacaatgaatgtttctgtggaggagctttgtaagagagttgaggaacttacgaggttgcattgatagtgtccaaaattcaagtatttttttggttcttttatttattgcctttgtttccttatcttgtaacatcttcagacatatctcttgtggccttggagtgtgtggggagttaggaccggcggcgggttgtatgggggcatcgcataaagtgaaatttacacattttttgtttcatctaatgttatagactttcttggacccctagtggcttgcgtggattgtgcatgttttggcttagaaattatgatttttcatttttgacaatgtaaaatggcaatggaaaatgtcccttattgatcacagaaggcatgtatcggccaagagtaggagtctaagcaggaagatagggatgttggacatgcatcacttgtgaactagactctagagtacgaattgtcaagcactttttgtcgttacttataaccattattgcaaatatcattacagctctct

SEQ ID NO: 3225 - DNA, 3764 bp, Quercus alba
cactcctgtaactgcaagagaaaaaacaccacagacaaagagagagagagagtgagcgagctacggttcgacacagagagtgagaaagaaggagaagatgagtatctggaactatgtggttacggctcacaagcccaccaacgtgaaccactcttgcgtcggcaatttcaccagccctcaagagctcaacctaatcatagcgaaatgcacccgaatcgaaattcatttacttactcctcagggcttgcagcctatgctggacgtgccaatatatgggagaattgcaacacttgaactttttcgccctcatggtgaggcacaagattttctatttattgcaacagaaagatacaaattctgcgtgcttcaatgggatgctgagacatctgagcttatcacaagagcaatgggggatgtttcggatcgtattggtcgtcctacagacaacggtcagattggcataattgatccagattgcagactaattggactccatttatatgatggattgttcaaggtcattccttttgataataaagggcagcttaaagaagcatttaacattaggcttgaggaacttcaagttttggatatcaagtttctgtatggttgttcaaaacctacaattgtggttctttaccaggataacaaagatgctcgccatgttaaaacgtatgaggttgctcttaaggataaagattttgttgagggtccctggtcccagaacaatcttgacaatggagctaatttgctaataccggtacctccaccactttgtggcgtcattattattggagaagaaacaattgtctactgcagtgccaatgcatttaaagcaattccaatcagaccgtccatcacaagagcctatggaagagttgatgctgatggttctaggtatttacttggtgatcatactggactacttcacctacttgttataacccatgagaaagaaaaggttactggactcaaaattgagctcttgggcgaaacttccattgcatctaccatttcatatctcgataatgcatttgtatatattggctcaagctatggagattcacagcttgtaaagttaaatcttcaccctgatgcaaaaggctcatatgtggaagtactggaacgatatgtcaatttggggccaattgttgacttttgtgttgtggaccttgagaggcaaggccaaggtcaggttgtaacttgttctggagcttataaagatggttctcttcgcatagttcgaaatggaataggaattaatgaacaggcttcagtggaacttcaaggtattaagggaatgtggtcactaagatcttccacagatgatccatttgacacattcctggttgtaagttttatcagtgagacacgaattttggcgatgaatattgaggatgagttggaagaaactgagatagagggcttctgctctcaagtgcagaccctattttgccatgatgctgttttcaaccaacttgtacaagtaacttcaagctctgtgagactggtcagttctacatctagagagctacggaatgaatggaatgctcgacctggctattcaattaatgttgccactgctaatgccacccaggttttattggcaactggtggtggccatttggtttatttagaaattggagatggggtcttgacggaagtaaaacatgcacaattggagtatgagatctcatgccttgacataaaccccattggggagaatcccaactatagtcagctagctgctgttggtatgtggacagatattagtgtgcggatattttcgcttcctgacctgaatcttatcactaaggagcctttggggggagaaattatacctcgctctgttcttctttgtgtctttgaagggatatcttacttgttatgtgcccttggagatggacatttattaaattttctattgaacacaagtactggtgaactagcagataggaaaaaggtctctcttgggacccagcctattactcttcgcactttctcttccaagaatactacacatgtatttgccgcgtcagataggccaactgttatctacagtagcaacaagaagctactttacagcaatgttaatttgaaagaagttagccatatgtgcccttttaactctgcagcttttccagacagccttgcaatcgcaaaagaaggtgaacttactattggcaccattgatgatatccagaaacttcatatccgctctataccgcttggggagcatgcacgccgtatctgtcatcaggagcagtccaggacctttgctatttgcagtctgaagtcaaaccagtccagtacagaagattctgaaacgcactatatccgtctgctggatgaccagacctttgagttcatatccacttaccaacttgacacctttgaatatgcttgctccatccttagttgttctttctctgatgatagtaatgtgtactactgtgctggcactgcatatgtattaccagaagagaatgagccaaccaagggccgaatattagttttcattgttgaagacgggaagctacagcttattgctgagaaggaaaccaaaggatctgtttactctctgaatgctttcaacggcaagctgctggctggtatcaatcaaaaaatccaattgtacaagtggatgctccgggatgatggtactcgtgagttacaatctgaatgtggacatcacggacacatacttgccctctatgtgcaaactcgtggagatttcattgttgttggtgacctgatgaaatcaatctccttgttaatctacaagcatgaagaaggtgccattgaggagcgagcccgtgactataatgcaaattggatgtcagctgttgagattcttgacgatgacatttaccttggtgctgaaaataacttcaatcttttgactgttcggaagaacagtgaaggtgccactgatgaggagcggggccgtcttgaggtagctggcgagtatcaccttggagaatttgtcaatcgattccgacatggttcccttgttatgcgcttgccagattctgatgtgggccagattccaactgtcatttttggtactgttaatggtgtaattggagtcattgcttcacttcctcatgagcagtatctctttttagagaagcttcagtcaaacctgaggaaggtgataaagggtgttggagggttgagccacgagcagtggaggtcatttaacaatgagaagaaagtagttgatgccagaaatttcttggatggagatctcatcgagtcattccttgatctcaaccgtagtaagatggacgaggtttcaaaagcaatgaatgttacagttgaggagctttgcaagagagttgaagaattgacgagattgcattgatattgtaacctagttgaagggttttgttttttcccctcacttgtaacattttgcagattatatcttcttttgttttggaatatttgagtacataatggtttgtaaaaaataatttgtcctgtatgtgtattatatccatgatcattttaagctatcctgtggcattagtaaccattggtttgggtgcatacaaagaatggctgttactcttgtgcttcagcctcgtaagaagtcagatataaggttgctgtggtaatttggtggaagctgatttggtttccacaaatgatccctaggcatgcctttatatgttggatagcgatgaaacacaggttgcttacaagagatggattgtcgaaatggggagtacacagcgatgtattgtgcctattcttga

SEQ ID NO: 3226 - DNA, 3824 bp, Amorphophallus konjac
ggggggcgcggcctactacccctccgtcgtggccttcgtccgtccccaccgacctccgtcccgccccgttcccctaccgcgtcccacccgccgccgcggcagcagtgcgcgcgcgcgagagagagagagagagagagggcggctgctccggcgccggccacttcggcaacagagagagagagagagggagaggagatagaggagctacgagaggggaaccagagggaggggagtgagggaaggagctggtgtggtgtgtggtgtgggggcgagatgagcatgtggaactatgtcgtcacggcccataagccgaccaacgtgacgcattcctgcgtcggcaacttcaccagccctcaggagctcaacctcattatcgcgaaatgtactcgaattgaaatccatttactagctcctcatggtttacagcctatgctagatgttccaatatatggaagaattgccacacttgagctttttcgtcctcacggtgaagcacaagattttctattcattgcgacagaaagatataaattttgtgttctccaatgggatccagagacatctgaactcatcacaagggcaatgggggatgtttctgaccgtataggtcgcccaacagacaatggacagattggcataattgaccctgattgcaaattaattggcctccatctttatgatggattattcaaggttataccctttgataataaggggcaactaaaggaggcatacaatatcaggcttgaagagcttcaggttttggatatcaagtttctttatggttgttcgagacctacaattgtagttctttaccaggataataaggatgcacgccatgttaagacatatgaagtttccttgaaggataaagactttgctgaaggcccctggcagcaagctaatgttgataatggagctggtcttctaatacctgttcctatgccacttggaggtgttatcataattggagaggagacaattgtatactgtagtgctactgcatttaaagccatcccaaccaaaccttcaataactagagcctatggaagggttgatgctgatggttctcgatacttgctcagtgataattcagggattctaagattacttgtaataatccatgagaaggaaagagtaaccggacttagaattgagcacctgggggagacatcagttgcatctactatatcgtatcttgacaatgctgttgtgtatgttggttctagttatggagattctcagcttataaagctgaacatgcaacctgatacgaaaggttcatatgtggaagtcctcgaaaggtatgtcaatctagggccaattgtggacttttgcgttgttgatcttgagaggcaaggtcagggtcaagttgtgacttgctcgggggcatacaaagatggttcattgcgaatagttcgcaatggaataggaatcaatgagcaggcatctgtagaacttcaaggtattaagggattgtggtctctgcggtccttcactaatgatccacatgacaccttccttgttgtgagcttcatcagtgagactcgcatactagcaatgaattcagatgatgaactggagaaactgaaatcgaaggcttctatgcacaagcacaaactttgttttgtcaaaatgctgttcacaatcaacttatacaagttacagctggttctgtacgattggtgagctctaccacccgggaattacttgatgagtggcgtgccccatctgggttttcagttaatgttgctacagctaatgcttcgcaggttctgttggctactggtggtgggcatctagtttacctggaaattggtagtgggaggttgactgaagttaaacacattcaactggaatatgagatatcatgtcttgatataaatcctattggtgaaaactcaaactatagctcattggcagcagttgggatgtggacagatataagtgtcaggatattctctcttcctggactggatctcatcacgaaggagcatctgggtggggagatcatcccacgatctgtccttctgtgtaaatttgaagaagtatcatacttattgtgtgcattgggagatggccacctgttcaattttctattgaacttgactactggtgagctatctgataggaaaaaggtgtctctggggacacagcctatcacgcttcgtaccttctcttccaaggacacaactcatgtgtttgcagcatcagataggcctactgttatatatagcagcaacaaaaaattactgtatagcaatgtaaatttgaaggaagtcagccacatgtgccctttcaactcagctgcttttccagacagccttgcaattgctaaagaaggtgagcttttaattgggaccattgatgatattcagaagcttcatattcgttctattccactgggagagcatgctcgtcgtatttgtcaccaggagcagtcacgcacatttgccatttgcagtctgaagcattgccaaactagtaccgaagatagtgaaatgcactttgtgcggttattggatgatcagacatttgagttcatatcaacctatgcacttgatacctatgaatatggctgctctattctaagctgttccttcactgatgacagtaacgtctattactgtgttggaacagcttacgttctacctgaagaaaattgaacccaccaagggtcgaattctcatttttgttgttgaagatgggaagttacagctgattgcagaaaaggaaactaaaggtgctgtgtactccctcaatgccttcaatggaaaactgttggctgccatcaatcagaagattcaactgtacaagtggatgcttcgggatgatggttcacgtgagctgcaatctgaatgtggacatcatgggcatattcttgctttgtacgttcaaacccgtggtgatttcattgtggttggtgatctgatgaaatcaatctccttactgttgtacaagcatgaggaaggtgcaatcgaggaacgtgctcgtgactacaatgcaaactggatgacagcagtggagatcctggatgatgacatatacctgggtgcagagaacaatttcaacctcttcacagtccgcaagaacagtgatgcagccactgatgaggagagaggccgcctcgaggttgtcggagaataccatcttggcgagttcgttaaccggtttcggcatggttcgcttgtcatgcgcctaccagattctgaggcaggccacatccctacagtcatttttggcactgtcaatggcgtcattggcgtcattgcttcccttccccatgaccagtacctcttcttggagaagcttcaggctaacctagtcaaggtcataaagggcgtgggtggtctgagccatgagcaatggagatcgttcaacaatgagaagaagactgcagaagcgaggaatttcctggatggggacttgatcgagtcgtttctcgaccttagccgaagtcggatggaggaaatttcaaaggcgatgggggcctcagtggaggacctctgtaaaagggttgaagaactcacgagactgcactgagttgcttatggcttgctgtacctttctatgcttccattctgaagatgtccccatctccctcctctgagtcttctttccgcttgcttgcttgcacgcacttgtaggatatcatgcattgtgaataaaaagttttttgtttggcatatatagagtaatttatgtacgcaaggaagaaggaagaaagaaatgctgcgtaggaattattgtgctgtagtattgatctatgtattttttcgtcaagtggttttttttttcgctcggttggagttgaaacaaaaaag

SEQ ID NO: 3227 - DNA, 3824 bp, Theobroma cacao
aaaaaggtgtggtgctactagaaacgaaggcaagccatgacgtgttacctaaataccggctgtctgcaacaccagcgccactgtaacagcgaagcgaagtcgctagaggaagaaagctgagcttcgcaacctttccagaagcaacgccagttgcgacagacttaccctagggcttccccccctttcaaccagagatctgccggaagaggaaaaatgagtgtatggaactacgtggtgacggcgcacaagcctaccaacgttactcactcttgcgtcggcaacttcaccagccctcaagagctcaatctcatcattgcgaaatgtactcggattgaaatccatttgcttactcctcaaggattgcagccgatgttagatgtgccaatatatggaagaattgcaacacttgaacttttccgtccacacggtgaagctcaggattttctatttattgcaacagagcgatacaagttctgtgttcttcaatgggatgctgagacatccgagcttattacaagagcaatgggggatgtttcagaccgtattggtcgacccacagacaatggacagattggcataatagatcctgattgtaggttaattggactccatctatatgatgggctttttaaggttattccttttgataataaagggcaactcaaagaagcatttaatataaggcttgaggaacttcaagttttggacatcaagtttctatatggttgctcaaagcctacaatcgtagttttataccaggacaataaagatgcacgtcacgttaaaacatatgaggttgctctaaaggagaaggactttgtcgagggaccatggtcccaaaacaatcttgacaatggagctgatttgctcatacctgtacccccacctctctgtggtgtccttattattggagaagaaacaattgtctattgcagtgcgaatgcattcaaagcaatcccaatcagaccttcaattacaaaagcctatggaagagttgatgctgatggctctaggtatttgcttggcgatcatgctggccttcttcacctgcttgtcataacccatgagaaagaaaaggttactgggctcaaaatcgaactcttgggggaaacttccattgcatcgacaatatcatatcttgataacgcatttgtctatattggctcaagttatggagattcacagctgataaagttaaatctacaacctgatgcaaaaggttcatatgtagaagttttggagaggtatgtcaatttggggcctattgttgacttttgtgtggttgaccttgagaggcaagggcagggtcaagttgtaacttgctctggagcttataaggatggttcccttcgcatagttcgaaatggaataggaatcaatgaacaggcctcagtagaacttcaaggtatcaaaggaatgtggtcattgagatcctctacagatgatccatttgacacgttcctggttgttagttttattagtgagacgcgtattttggcaatgaatcttgaggatgagttggaagaaacagagattgagggatttaattctcaagtgcagacattgttctgccatgatgctgtttacaatcaacttgtacaggtcacttcaagctctgtaaggcttgtgagttcaatatctagagagctacggcatgaatggaatgctccacctgggtattcagtcaatgttgccactgctaatgccacccaggttttactcgcaacagggggtggtcatttggtttatttggaaattggtgatggcacattgacacaagtaaaacatgtgcagctggagtatgaaatctcatgtcttgacattaaccccatcggtgagaactctaactacagtcagctggctgcagttggaatgtggacagatataagtgtgaggatattttcactccctgacctgaatctcatcacaaaggagcaattgggaggagagattattcctcgttctgttcttctttgctcctttgaagggatctcttacttgttgtgtgcccttggagatggtcatcttctaaattttcaattgaacatgagtagtggtgagttaacagataggaaaaaggtttctcttgggacccagcccataacgcttcgtactttctcctctaagaataccacccatgtatttgccgcatctgataggccaactgtcatttatagtagtaacaagaaactactctacagcaatgtcaatctgaaggaagtcagtcatatgtgcccttttaactctgctgcttttccagatagccttgccattgcgaaagaaggtgaacttactattggcactattgatgatatccagaagcttcacattcgctctatcccacttggggagcatgctcgtcgcatctgccatcaggaacagtctcggacctttgcaatatgtagtttgaaaaaccagcctagtgctgacgaatctgaaatgcattttatccgcctgttagatgatcaaacctttgagttcatttcgacctaccctcttgatacttttgagtatggttgctccatactgagctgttcattctcagatgatcctaatgtatattattgtgtggggactgcatatgttttgccagaagaaaatgagccgactaagggccgtatattggttttcattgttgaagatgggaagttacagcttattgccgaaaaggaaactaagggggcagtttactctctaagtgctttcaacggcaaactactggctgctattaatcaaaaaatccagctgtacaagtggatgcttcgggaggatggcacccgggaactgcaatctgaatgcggacatcatggccacatacttgccctctatgtacaaactcgtggggatttcattgttgttggtgatctgatgaaatcaatatccttgttaatctacaaacatgaggaaggtgcaattgaggaacgagcccgtgactataatgctaactggatgtcagctgttgagattcttgatgatgacatctatcttggtgctgaaaacaacttcaacctcttcacagttcggaagaacagtgaaggggccactgatgaggaacggggccgtcttgaggtggttggtgagtaccaccttggggaatttgtcaaccgattctgtcatggttcccttgttatgcgattgccagattctgatgtaggccagattccaactgttatttttggcaccgttaacggtgtcatcggtgtcattgcttcacttcctcacgagcagtatgcctttttggagaagctccaatcaaacttaagaaaggtaataaagggcgttggagggctgagccatgaacaatggagatcattcaacaacgagaagaaaactgtggaagccaaaaactttctggatggtgatttgatcgaatcattccttgatctgagccgtggtaagatggaggagatttccaaggcgatgagtgtttcagtggaggagctttccaagagagttgaggaactgacgaggttgcattgataggttgttgaatttaattttttattctttgtttggccttgtttagagaccctttttattggcatgcgtagaagaagatttgcatttgctttgaaaactgagatgcatctgtattataattttatcatctcgttgttcatatgacatttcttttgcccttgatgaccactcccatagctattgatttggcagttctcaaggaattccatctctttggctctgttctgaagttctctacatccgaattccgatcatcctgatatttagccttgccacgggattattaacctcttctcgaagagttaaatcttttttgttcgatttttaaaacgttggacgtagac

SEQ ID NO: 3228 - DNA, 3199 bp, Triticum aestivum
agatccatgggagatgtttctgatcgcattggccgccctacggacaatggacagattgggatcatcgaccctgactgtagacttattggccttcacctctatgatggattgtttaaggttataccattcgacaacaaaggacagctgaaggaagctttcaatatcagactagaagagcttcaagtgttggacatcaagttcctgtatggctgtgtcagacctacgatagttgtcctctaccaggataacaaagatgccaggcatgttaagacatatgaagtagcactgaaggagaaagacttcgttgagggtccttggtcacagaacaatttagacaatggagctggtcttttaatacctgtaccagctccactcggcggtgtcataattattggcgaggagacaatagtttactgcaatgctaattctacatttaaagctataccaatcaaacagtccatcacaagagcttacggaagggttgacccagatggctctcgctatttacttggtgataatgcaggcattttgcatttacttgtccttacccaggaacgagaaagggtaactggtttgaaaattgagcatttgggagagacttcagttgcatcatcaatatcgtatcttgataatggtgttgtctatgttggttctcgatttggtgattcacagctggtaaagctgaatctccaacctgatgcaactggttcattcgtcgaaatccttgaacggtatgtgaatcttggacccattgtggacttctgcgtggttgaccttgataggcaagggcaaggtcaggtggtcacttgttcaggagcattcaaagacggttccattcgagtggttcgtaacggtatagggattaatgagcaggcttcagtagagctgcaaggcatcaagggattgtggtcactgaagtcttccttcagtgatctgtatgacatgtatctggtggtgagctttataagtgagactcggttcttggctatgaacatggaagatgaattagaagaaattgagatagaagggtttgatgcacaaatccagactttgttctgccaaaatgccatcaatgatatgcttatacaggttactgctaattctgtccggttagtcagttgcacttctcgggagctagtggatcagtggaatgcaccggaaggattttcagtcaatgttgcatcagctaatgccagtcaggtcctgttggcgaccggtggtggccatcttgtttacctagagattagggatgctaagctggttgaagtgaaacatgcgcagctagagcatgagatatcttgtgtcgatttgaacccagtaggggagaatccacagtatagctctctggctgctattgggatgtggactgatataagtgttagcatattttcacttcctgaccttgaattaatcaggaaggaaaatttaggtgtagaaattgttcctcggtcagttctgatgtgcaccttggaagggatttcatatttgctttgtgcacttggagatggtcaccttttcagttttctgctgaatgcaagcacaggtgaactaaccgatagaaagaaggtttctcttggtacccagccaatcagccttcgtacattctcatcaaagggcacaacccatgtgtttgcttcgtctgatagaccaactgttatctatagtagcaataagaagctgctgtacagcaatgttaatctgaaggaagttaatcatatgtgtcctttcaatacagctgcttttcctgacagccttgcaattgctaaagaaggtgaactttcaattggaactattgatgacatccagaagcttcatatccgcacgattccgttgaatgaacaagcacggcgcatttgccatcaggaacagtccaggacactggcgttctgcagtttcaagtacacccagaatagcatggaggagagcgaggcgcatttcattcgtctgatggatcatcaaacttttgagtttctgtccacacatcctctcgaccaatacgaatgcggttgctccatgattagctgctcgttctcggatgataataacttctattactgtgtgggaacagcatatgttttacctgaggagaatgaaccgacaaagggccggatccttgtatttgcagttgaggatggaaggttgcaattaatcgtagagaaagaaacgaaaggagctgtctattctctaaatgcattcaatgggaaattgttggcagctatcaaccagaagattcagttatacaagtggatgacaagggaggacggttcgcatgagctgcaatctgaatgtggccatcatgggcacatacttgccctgtatacccaaacccgtggtgatttcattgtagtcggagacctgatgaagtcgatatctttgcttgtgtacaagcatgaggagagtgcgattgaagagctcgctcgggactacaacgcgaactggatgactgcagttgagatgattgacgatgacatctacgtcggtgcagagaacagctacaacctcttcactgtgcgcaagaatagcgacgcggccacagacgaggagaggggtaggctggaggtggtcggggagtaccacctcggagagtttgtcaacagattccggcacggctcgctggtgatgcgcctccctgactcggagatgggccagatccccacggtcatctttggcaccatcaatggggtcatcggcatcatcgcctccctgccccacgaccactatgtgttcctggagaagctccagacaaccctggtcaagttcatcaagggtgtgggcagcctgagccacgagcagtggcggtcattccacaacgacaagaagacgtcagaggcccgcaacttcctggacggtgacctcatcgagtcgttccttgacctcaacaggtccaagatggaggaggtggccaaggcgatggcggtccccgtggaggagttgtccaagcgggtggaggagctgatgagactgcactaggtggtagcgccgggccgtgtatatcctgttttatttgttcgttttcgctgtgttgtaaaccgttggcggctcgagaatggtcctctgcaagtgtttgtagcaacatccctcttctgtttttgactttgataagagtgtaactttgtctgtgctgatgtagaattttagtggtgaatctctctgtcgaaatggtatcaagaaaagtttaggcataattattagtggacat

SEQ ID NO: 3229 - DNA, 3713 bp, Euphorbia peplus
ctcaatgtataaaataggctcgactattaagttgtgaaacaatagagtttatagtgtcaatgtataaaatattggcgtgtcacaatttctttagtttcgttttttatgttccattaacctggatttacagttttgagaggttgaatcgagcggtagagaggagctcacatcgcagaagcccacgaagaagatagccgacgagcgaggtagggctcctgctcagtgaagaaagatgagcatatggaactatgtggtgacggctcagaagccgacgaatgtgacccactcttgcgtcggcaatttcactactcccaacgacctcaatctcatcattgcgaaatgcactcgtattgaaatccatttgctcactcctcaaggattacagcctatgttagatgtcccaatatatggaagaattgcaacacttgaacttttccgtcctcatggtgaagcacaagattttctatttattgcaacggaaagatataagttctgtgttcttcagtgggattctgagacatctgagcttattacaagagcaatgggggatgtttcagatcgtatcggtcgtccaacagacaatggtcagattggcatcatcgatccagattgtcgattaataggacttcatttgtatgatgggctcttcaaggttattccttttgataacaaaggacaactgaaggaggcttttaacataaggcttgaggaacttcaagttttggatatcaagtttctctatggttgttctaaaccaacaatcgttgttctttaccaggataataaagatgctcgtcatgttaagacttatgaggtagcgctgaaagataaagattttgtcgagggtccatggtcacagaataatctggataatggtgctgatctgttgataccaagttcccccacctctctgtggtgtccttattattggcgaagaaacaattgtctattgcagtgcaagtgcatttagagccatcccaataagaccttctatcacaagagcatatggaagagttgatgctgatggctcaagatatttacttggcgatcatgctgggctccttcaccttcttgttataactcatgaaaaggaaaaggtcactggactaaaaattgagctcttgggagaaacttcgattgcatctaccatatcatatcttgataatgctgttgtttatgtaggctcaagctatggagattcacagcttgtaaaactgaatctgcaaccagatacaaaaggttcatatgttgaagtcttagaaaattatgtcaatttgggaccaattgtggacttctgtgtggtggaccttgagaggcaaggccaaggtcaggttgtgacttgctctggagcatataaggatggttctcttcgcatagttcgaaatggaataggaattaatgaacaggcttctgtggagcttcaaggtatcaaaggaatgtggtcattaagatcttctactgatgatccatttgacacattcctggtggttagttttataagtgagactcgaattttggctatgaaccttgaagatgagttagaggaaactgaaattgagggtttcaattctcaagtgcagactctgttctgccattatgctgtatacaatcagcttgtccaagttacatcaagctcagtaagactcgtcagttcaaccacaagagaactccggaatgaatggaatgctccttcaggttattcaattaatgtcgccactgctaatgcaacccaggttttactggcaactggtggtggacacctagtctatttggaaatcggtgatggaatattgacagaggtaaaacatgcgcagttggactatgagatatcatgccttgacataaaccccattggtgaaaatcccaactttagtcagttagctgcagttggaatgtggactgatataagcgtcagggtcttctcattgcctgacctgaatctcattacaaaagagcatctcggaggagagataataccacgttctgtactgctgtgttcctttgaagggatatcttacctcttatgtgcccttggagatggacatcttttgaacttccaattgaatttgaattcaggcgaattaacagataggaaaaaggtgtctttagggacccagcctataacacttcgtactttctcatccaaaaacaccacacatgtttttgctgcatcagataggccaactgtcatttacagtagtaacaagaagctgctttacagcaatgtaaacttgaaggaagtgagccatatgtgtcctttcaattctgctgctttccctgacagtcttgcaattgcaaaggaaggtgagcttaccattggcaccattgatgatattcaaaagctccatattcgcactattcctttgggggaacatgcacggagaatctgccaccaggagcagtcaaggacccttgccatttgcagtttaaagaatcaatctagtgctgaagaatctgagacgcacttcatccggttattagatgatcaaaccttcgaattcatatcaacttaccaacttgacccatttgagtatggttgctccatactaagctgttccttttctgatgatgttaatgtgtactattgtgttggcactgcttatgttttgcctgaggaaaatgagccaactaagggccggatactggttttcatggttgaagaagggaagttgcaacttattaccgagaaggagacaaagggggcagtgtactctttgaatgccttcaatggaaagcttctagctgctattaatcagaaaattcagttatataaatggatgcttcgagatgatggttcccgtgagcttcagtccgagtgtggacatcatgggcatatacttgccctctatgtacaaactcgtggagatttcatcgttgttggtgatttgatgaagtcaatctctttgcttatctacaaacacgaggaaggtgctattgaggagagagctcgtgactacaatgcaaattggatgtcagccgttgagattctcgatgatgatatttacttgggagctgaaaataacttcaacttatttacagttaggaaaaacagtgaaggagctactgacgaggaacggggtcggcttgaggtggttggggagtatcaccttggagaattcgtgaatagattccgacatgggtcccttgtgatgaggttgccggattcagatgtgggccaaattccaacagcaatttttggtacagtgaacggtgtaatcggggtgatagcttcacttcctcatgaccaatatttgtttctggagaagctacagtcaaacctccggaaagtgataaagggtgttggagggttgagccatgagcaatggagatcattcaacaatgagaagaaaacagtagatgcaaagaatttcttggatggagacttgatagagtcattccttgacttgagtcgaacccggatggatgagatatcaaaggcaatgagtgtttcagtggaggagctgagcaagagagtggaagagctgacaaggctgcattagtgctacatctttcttttttctgttgttttttggtttccaggtcgacaaaatggtatgtttgttttgttgtaagagaaacccggcaatgcgcagtgtaacatatgttcgatttgatcatgttcataaaatgtcagttttcccctgggtgtgtgaatggagtgagtaaactagtctatatattacatttcacagctcaaatttgttataggttag

SEQ ID NO: 3230 - DNA, 3755 bp, Phaseolus vulgaris
cacactttagctggcgcttaatgaaacgagggcaaaagccaaaagtgaaagccgctcgagggtctgagaaagagagtgtctgtgtgagtgaggttcttgttgcgttctttgacagcgccctaagcggttaatcgttccgaaccgaacccaaacccaaaccctattcaattgggaagaagcgcagaagcagagtgcgtgctctgaggaagcagagaagagaagagaacgatgagtatatggaactacgttgtcacagctcacaaacccaccaacgtcactcactcctgcgtcggcaatttcaccagtcctcaagacctcaacctcattatcgcgaaatgcacgcgcatcgagattcacttgctctcgcctcagggcttgcagcctatgttggacgtgccgatatatggaagaattgctacgcttgaactcttccgccctcatggtgaaacacaggattatctctttatcgcaactgaaagatacaaattttgtgttcttcaatgggattctgagacttctgagcttgttacccgggcaatgggggatgtttctgatcggataggacgtcccactgataacggtcagattggcattattgatcctgattgtaggttgattggacttcacttgtatgatggtttgttcaaagttattccctttgacaataaaggacagctcaaggaagcatttaatataaggcttgaggagctccaagttttggatatcaaatttctttatggttgttcaaagccaaccattgtggttctttaccaggataataaagatgctcgtcatgttaaaacatatgaggttgcactgaaggataaagattttgttgagggtccatggtcccagaacaatcttgataatggggctgatttattgataccagttcccccgccactttgtggcgtgcttattattggagaagagaccatagtatactgcagtgctaatgctttcaaggctatcccattcggaccttcaattacaaaagcctatggacgagttgatcctgatggttctagatatttacttggtgatcatacagggttgcttagcctacttgtaataacccatgagaaagaaaaggttactggactaaaaactgagccccttggagagacttccattgcatctacaatatcatacctggataatgcattcgtctacattggttcaagttacggagattcacagcttataaaactaaatctgcagcctgatgcaaaaggttcttatgtggaagtactggaaaggtatgtcaatttggggcctattgttgacttctgtgtggtagaccttgagaggcagggccaaggtcaggttgtaacttgctctggagcctacaaggatggttctcttcgcgttgttcgtaatgggattggaattaatgaacaggcatcagtagagcttcaaggtatcaaaggaatgtggtcactaagatcctcaacagatgatccttttgatacttttctggttgttagttttatcagtgaaacaagaatcttagcaatgaatcttgaggatgagctggaagaaactgagattgagggattctgttctcaagtgcagacattattttgccatgatgctgttcataatcaacttgttcaagtcacttcaaactctgtcagactggtcagttccacaactagagagctccgcaatgaatggttcgcaccatcaggctattcagtgaatgtagctacagcaaatgctacccaggtgttgttggccacaggaggagggcatttagtttacctggaaattggagatggaatattgcaagaagtaaaacatgcccaactggagtatgagatttcatgtctagacataaatcccatcggtgaaaaccccaatcacagtcagcttgcagctgttggaatgtggacagacataagtgttagaattttttctcttccagacctgaatctcgtcaccaaggaacagctaggaggggagatcatacctcgttctgttcttctttgtgcctttgaagggatatcttacttgctatgtgccctcggtgatggacatctcttaaacttcatgctgaacacaagtactggcgagttaacagataggaaaaaggtatctcttgggacacaacccattacactacggacgttctcctcgaagaatactacccatgtattcgctgcatctgatcggccaactgtgatctacagtagtaacaaaaaattactttatagtaatgtaaatctgaaggaagtgagtcacatgtgtcctttcaattctgctgcttttccagacagtttggcaattgcgaaagaaggtgagcttactattggcaccattgatgacatacaaaaactacatattcgctctataccgcttggagagcatgctcggcgtatctgccaccaagagcactccaggacttttgctatttgtagtttgaaatacaacccaacaagtggagaagactctgaaatgcactttgtccgcttactggatgaccagacttttgagttcatatcaacttactctcttgacacatatgagtatggttgctttataattagctgctcattctcagatgataataatgtttattactgtgttggaactgcatatgtattgccagaggaaaatgaaccaaccaaaggaagaattcttgtttttactgttgaagatggaaaactacagctaattgctgagaaggagacaaaaggagctgtttattgcttgaatgcatttaatggtaaattgcttgctgctattaatcaaaaaattcagctgtacaaatgggtgctacgtgatgatggaacccatgaattgcagtctgaatgtggacatcatggacacatcctagctctttatgtgcaaactagaggagattttattgtagtcggtgatctgatgaagtcaatttccttgttaatctataagcatgaagaaggtgctattgaggaaagagctcgtgactacaatgcaaattggatgtcggctgttgaaatccttgacgatgacatttaccttggtgcggaaaataattttaatctgtttactgttcggaaaaatagtgaaggtgccactgacgaagagcgaggtcgtcttgaagtggttggtgagtatcaccttggagaatttattaatcggttccggcatggctccctcgtaatgcgcttgccagattctgatgttgggcagattccaacagttatctttggcaccattaatggtgttattggggtaattgcttctcttccgcacgagcaatatgtgttcttggagaaacttcagtcaaatttgaggaaggtaattaaaggtgttggaggactcagccatgagcaatggaggtcatttaacaatgagaagaaaactgttgaagccagaaactttttagatggagatttgatcgaatcatttcttgatctcaaccgcagtaagatggatgaaatttccaaggcaatggatgtttctgtagaggagttatgcaaaagagtagaagagttgacgaggttgcactgagtttgttatttttttttctcacttagcgtccttcttccttttttgtttttcagggtatgggtgggggctataatattatatgatatttttttacctctgctcacattcggtttgttttgcaacacatgaatcacaattgatgtatgatatgaatgccatgttctaaggcataatggtgctttcctttctatacttttatcaatttcctaatatttgcttagtaatttatgtgttgatgttctctaaaagataactaa

SEQ ID NO: 3231 - DNA, 3766 bp, Lupinus angustifolius
ttgcgacattgatagtgagcaaagaagagggcaaaagcgaggcgcttctaattctacatgtaaagaaagagagagagagagagagggagagagagaaagcgagggtttttaaaagtgtgtgattttgatttgtaaatttcacaaacacatagtgtgcgtgagagtgtgaagattcagaagaagagaagatgagtatatggaactacgtggtgaccgctcacaaacccactaacgtcactcactcatgcgtcggaaacttcaccagcccccacgacctcaatctcattttagcgaaatgcacccgcatcgagattcatttgctttctccacacggattacaggctatgttggatgtgccaatatatggaaggattgctacacttgaactctttcgcccttatggtgaggcacaggactatctgtttattgcaactgaaagatacaaattctgtgttcttcaatgggatcctgacacctcagagctcattacacgggcgatgggggatgtttctgatcgtataggacgtcccactgataatggtcagattggcattatcgatcctgattgtaggttgattgggctccacctgtatgatggcttgtttaaagttattccctttgacaataaaggacagctcaaggaagcatttaatattaggcttgaggagctccaagtgttggatatcaaattcctctatggttgttcaaagccaactattgtggttctttaccaggataacaaagatgctcgtcatgttaaaacatatgaggttgctctgaaagataaagattttgttgagggtccatggtcccagaacaatcttgataatggggctgatttactaataccagttcctccacctctttgtggtgtgcttattattggagaagaaaccatagtgtactgcagtgctaatgcttttaaagctatcccaatcagaccttcaattacaaaagcctatggaagagttgatcctgatggttctagatatttacttggtgaccatacagggttgcttagtctactagtaataacccatgagaaagagaaagttacaggactcaaaatcgaggcccttggtgagacttcaattgcatctaccatatcataccttgataatgcgtttgtctacattggttcaagttatggagattcacagctcataaagctaaatctacagcctgacgcaaaaggttcatatgtggaagttttggaaaggtatgtcaatttggggccaattgttgacttctgtgtggtagaccttgaaagacaagggcaaggtcaggtcgtaacctgctctggagcttacaaggacggttctcttcgcattgttcgtaatggaattgggatcaatgaacaggcatctgtagaactacaaggtatcaaaggaatgtggtcactgagatcctcaacagatgatccttttgacactttcctagttgtgagttttataagtgaaacgagaatcttagcaatgaatcttgaggatgaacttgaagaaactgagatcgaggggttctgttctcaagtacagacattattttgccatgatgccattcacaatcaacttgtacaggtaacttcaaactctgtaagactggtcagttccacaactagagagctccggaatgaatggcatgcaccgacaggcttttctgtaaacgttgctactgcaaatgctagccaggttttgttagccacaggaggtgggcatttggtttaccttgaaattggagatggcacactgcaggaagtaaagcatgcccaactggagtatgagatctcatgcctagacataaatccaattggtgaaaatcccaatcaaagtaatctagcagcagttggaatgtggactgacataagtgttcagattttttctcttcctgacctgaatctcatcacaaaggagcatttaggaggagagataatacctcgatctgttctactctgtgcctttgaagggatatcttacttgctatgtgccctcggcgatggccatctcttaaactttatgttgaacacaagtactggtgagttaacagataggaaaaaagtctctcttgggacacaacctattacactacggactttctcatcgaagaataccactcatgtatttgccgcatctgatcggccaactgtgatttatagcagtaacaaaaagctactttatagtaatgtaaatctgaaggaagtgagtcacatgtgccctttcaactctgctgcttttccagacagtttggcaattgcaaaagaaggtgaactcactattggcaccattgacgacatacagaaacttcatattcgctctatcccactgggagagcaagcacgtcgtatttgccatcaggagcagtccaggactttcgctatttgtagtttgaaatacaacccaacaagtgctgaagaatctgaaatgcactttgtccgcctgctggatgaccagacttttgagttcatatcaacttatccacttgatacttatgagtttggttgctttataattagctgctccttttcggacgataataacgtgtattactgtgttggaactgcatatgtattgccggaggaaaatgaacccacgaagggaagaattcttgttttttctgtcgaagatggaaagctacaactaattgctgagaaggagacaaaaggagctgtttattgcttgaatgcgtttaatggtaaattgcttgctgctattaatcaaaaaattcagttatacaagtgggtgctccgagatgatggtacccatgaattacaatctgaatgtggacatcatggacatatcctagcactatatgtgcaaactagaggagatttcattgtagtgggtgatttgatgaagtcaatttccttgttaatctataagcatgaggaaggagctattgaggagagagctcgtgactacaatgcgaattggatgtcagccgttgaaatccttgacgatgacatataccttggtgcagaaaataattttaatctcttcactgttcggaaaaatagtgaaggtgccaccgatgaagaacggggtcgtcttgaagtggttggtgagtatcaccttggagaatttgtcaatcgcttccggcatggttcccttgtcatgcgcttgccggattctgacgtgggtcagattccaactgtcatctttggaaccattaatggcgtgattggggtaattgcttcacttcctaatgagcagtatgtcttcttagagaagcttcagtcaaacctaaggaaggtcatcaagggtgttggaggactcaaccacgagcaatggaggtcatttaacaatgagaagaaaactgtcgatgccagaaactttttggatggggatttgattgaatcatttcttgatctgaaccgcagtaagatggatgatatttcaaaggcaatggatgtatcagtagaggagttatgcaagagagtagaagagttgacaaggttgcattgagtttgtcctcatttggagcttctttgttctttattcttgtgtaaggaaaccttttactttttctactagaggttaagatgacattattttatgttgtttttcttattttacaagctttttgccttaaaatgtgttgccagtaatgtgtatgtacagttgagtcaggtctacaaaatgttaacattaagaaaaccggaatgagtcaggattcttatggttgaacaagcttcatatttggtttggtttgatgatgggtaagctctcttgagcatatttttctatgttgattttagctgactagcattagt

SEQ ID NO: 3232 - DNA, 3894 bp, Cajanus cajan
taccgggggattgaaacgagggcaaggccgcaagagcgtaaagccgctccacacttctcttgtgtcctctcttaagaaattgtgagagtgaaagaggtcgctgttgcgttgtggcgcagcgaagcggttaaccactccgaaccctttcagatttcattcttcacccctatcgactgtgagagagtgaagagaagagagaaggatgagtatatggaactacgtagtcacagctcacaaacccaccaacgtcacccactcatgcgtcggcaacttcaccagtcctcaagacctcaatctcattatcgcgaaatgcacgcgcatcgagattcatttgctttctcctcagggcttgcagcctatgttggacgttccaatatacggaagaattgccacactcgaactcttccgccctcatggtgaagcacaggattatctctttattgcaactgaaagatacaaattctgtgttcttcaatgggattccgagactggcgagcttgtcacaagggcaatgggggatgtttctgaccgtataggtcgtcccacagataacggccagattggcattattgatcctgattgtaggttgattggactccacttgtatgatggtttgtttaaagttattccgtttgacaataaagggcagctcaaggaagcatttaatataaggcttgaggagctccaagttttggatatcaaatttctttatggttgttcaaagccaactattgtggttctttaccaggataacaaagatgctcgtcatgttaaaacatatgaggttgcactgaaggataaagattttgttgaaggtccatggtcccagaacaatcttgataatggagctgatttattgataccagttcccccacctctttgtggtgtgcttattatcggagaagaaactatagtatattgcagtgctaatgctttcaaggctatcccaatcagaccttcaattacgaaagcctatggaagagttgatcctgatggttcgagatatttacttggtgaccatacagggatgattagcctacttgtaatcacccatgagaaagagaaggttactggactcaaaattgagccccttggggagacttccattgcatctacaatatcataccttgataatgcttttgtctacattggttcaagttatggagattcacagcttataaaactaaatctacagcctgatgcaaaaggttcttatgtggaagtattggaaaggtatgtcaatttggggcctattgttgacttctgtgtggtagatcttgaaaggcagggccaaggtcaggttgtaacttgttctggagcttacaaggatggttctcttcgcgttgttcgtaatggaataggaattaatgaacaggcatcagtagaacttcaaggtatcaaaggaatgtggtcactaagatcctcaacagatgatccttttgacacttttctggttgtgagttttataagtgaaacaagaatcttagcaatgaatcttgaggatgagctggaagaaacagagattgagggattctgttctcaagtgcagacattattttgccatgatgcagttcataatcaacttgttcaagtcacttcgagctctgtaagactggtcagttctacaacaagagagctccgaaatgaatggcatgcaccatcaggctattcagtaaatgtagctacagcaaatgctacccaggttttgttggccacaggaggagggcatttagtttaccttgaaattggagatggcatattacaggaagtaaagcatgcacaacttgagtatgagatttcatgcctggacataaatcccattggtgaaaatcccaatcacagtcatctagcagcagttggaatgtggacagacataagtgttagagttttttctcttcctgatctaaatctcatcacaaaggaacaattaggtggggagatcatacctcgatctgttcttctttgtgcctttgaagggatatcttacttgctatgtgcccttggtgatggccatctcctaaactttatgttgaacacaagtactggtgagttaacagataggaaaaaggtatcccttggaacacagcctattacactacggacgttctcttccaagaatgctacccacgtatttgctgcatctgatagaccaactgtgatttatagcagtaacaaaaaattactttatagtaatgtgaatctgaaggaagtgagtcacatgtgtcccttcaattctgctgcttttccagacagtttggcaattgcaaaagaaggtgagcttactattggaaccattgatgacatacaaaaacttcatattcgctctattccgctgggggagcatgcacgacgtatctgccaccaggagcaatctaggactttcgctatttgtagtttgaaatacaacccaacaagtggtgaagactctgaaatgcactttgttcgcttgctggatgaccaaacatttgagttcatatcaacttattctcttgacacttatgagtatggttgctttataattagctgctccttctcagatgataataatgtgtattactgtgttggaactgcatatgtattgccagaggaaaatgaaccaaccaaaggaagaattcttgtttttactgttgaagatggaaagctacagctaattgccgaaaaggagacaaaaggagctgtttattgcttgaatgcatttaatggtaaattgcttgctgctattaatcaaaaaattcagctgtacaagtgggtactccgggatgatggtacccatgaattgcagtctgaatgtggacatcatggacacatcctagcactttatgtgcaaactagaggagattttattgtagttggtgatctgatgaagtcaatttccttgttaatctacaagcatgaagaaggtgctattgaggaaagggctcgtgactacaatgcaaattggatgtcagccgttgaaattcttgatgatgacatatacctaggtgcagaaaatagttttaatctgttcactgttcggaaaaatagtgaaggtgccactgatgaagagcgaggtcgtcttgaagtggttggtgagtatcaccttggggaatttatcaatcggttccggcacggctcccttgttatgcgcttgccagattctgatgtgggccagattccaactgtaatctttggcaccattaatggtgttattggggtaattgcctctcttcctcatgatcagtatgttttcttggagaagcttcagtcgaacttgaggaaggtaattaaaggcgttggagggctcagccatgagcaatggaggtcatttaacaatgagaagaaaacggttgaagccagaaactttttagatggggatttgattgaatcatttcttgatctcaaccgcagtaagatggatgagatttccaaggcaatggatgtttcagtagaggagttatgcaagagagttgaagagttgacaagattgcactgagtttatactagcttgtagcttcgttgtttgtttatttttcttttgtcgtcgtttaacattgttcgtccctattttttctttgagggggtcggtggggttaaaataacttaaaatgttgttcttttcccccggcttttgccttcgactttgctgagactagggggaatggtttgcgttttacaatacatgattcacaaatggtgtataatatgcatgtcgtgttccaaggcataatattgctttccattcgacacttttttggacacgatcattgttgtattattcgcttccaagttgtcatacgcttcacttgtcatgttaacaggtgagtggtcggatctaacgtccaatatatatctaaagcttcacttgtttaattttttttttgttgaatattaaaaatgtcattagaaagattttcg

SEQ ID NO: 3233 - DNA, 3803 bp, Glycine max
aaaataagcagctcactgacttggctttacctgacgcatcttggagacgagggcaaaaggcaaaagccgccgctggagggagggtctgagagaaagtgtgagtgagagtgaggtgcttgttgtggggcacgccctaagcggtagcggttaaccactctgtaccgaactgaaacggaactctattcaatttgtaaccgcagaacactcgaaccagagtttgtgttttcgtgtgtgtgtaagagaagaagagaacgatgagtatatggaactacgtcgtcacagctcacaaacccaccaacgtcactcactcctgcgtcggcaatttcaccagtcctcaagacctcaatctcattatcgcgaaatgcacgcgcatcgagattcacttgctttctcctcagggcttgcagcctatgttggatgtgccgatatatggaagaattgcaacacttgaactcttccgtcctcatggtgaagcacaggattatctttttattgcaactgaaagatacaaattctgtgttcttcaatgggattctgaaactgctgagcttgttacacgggcaatgggggatgtttctgaccggataggacgtcccacagataatggccagattggcattattgatcctgattgtaggttgattggactccacttgtatgatggtttgtttaaagttattcccttcgacaataaaggacagctcaaggaagcatttaatataaggcttgaggagctccaagttttggatatcaaatttctttatggttgttcaaagccaactattgtggttctttaccaggataataaagatgctcgtcatgttaaaacatatgaggttgcactgaaggataaagattttcttgaaggtccatggtcccagaacaatcttgataatggggctgatttattgataccagttcccccacctctttgtggtgtgcttattattggggaagaaaccatagtgtactgcagtgctaatgctttcaaggctatcccgatcagaccttcaattacaaaagcctatggaagagttgatcctgatggttctagatatttacttggtgaccatacagggttgcttagcctacttgtaataacccatgagaaagaaaaggttactggactcaaaattgagccccttggggagacttccattgcgtctacaatatcataccttgataatgcattcgtctacattggttctagttatggagattcacagctaataaaactaaatctacagcctgatgcaaaaggttcttatgtagaaggactggaaaggtatgtaaatttggggcctattgttgacttctgtgtggtagaccttgaaaggcagggccaaggtcaggttgtaacttgctctggagcttacaaggatggttctcttcgcgtcgttcgtaatggaataggaattaatgaacaggcatcggtagaacttcaaggtatcaaaggaatgtggtcacttagatcctcaacagatgatccttttgatacttttctggttgtgagttttataagtgaaacaagaatcttagcaatgaatcttgaggatgagctggaagaaactgagattgagggattctgttctcaagtgcagacattattttgccatgatgcagttcataatcaacttgttcaagtcacatcaagctctgtcagactggtcagctccacaactagagagcttcggaatgaatggcatgcaccatcaggctattcagtaaatgtagctacagcaaatgctacccaggttttgttggccacaggaggagggcatttggtttaccttgaaattggagatggcatattacaggaagtaaaacatgcccagctggagtatgagatttcatgcctggacataaatcccattggtgaaaaccccaatcacagtcatctagcagcagttggaatgtggacagacataagtgttagaattttttctcttcctgatctgagtctcatcacaaaggaacaattaggaggggagatcatacctcgttctgttcttctttgtgcctttgaagggatatcgtacttgctatgtgctctcggtgatggccatctcttaaactttatgttgaatacaagtactggtgaattagcagataggaaaaaggtatctctagggacacaacctattacgctacggacgttctcctccaaaaatactactcatgtgtttgctgcatctgatcggccaactgtgatttacagtagtaacaaaaaattactttatagtaatgtgaatctgaaggaagtgagtcacatgtgtcctttcaattctgctgcttttccagacagtttggcaattgcaaaagaaggtgagcttactattggcaccattgatgatatacaaaaacttcatattcgctctattccactgggggagcatgcacgacgtatctgccaccaggagcaatctaggacttttgctatttgtagtttgaaatacaacccagcaagtggtgaagactctgaaatgcactttgtccgtttgctggatgaccagacttttgagttcatatcaacttattctcttgacacttatgagtatggttgcttcataattagctgctccttctcagatgacaataatgtgtattactgtgttggaactgcatatgtactgccagaggaaaatgaaccaaccaaaggaagaattcttgtttttgctgttgaagatggaaaactacagctaattgccgagaaagagacaaaaggagctgtttattgcttgaatgcatttaatggtaaattgcttgctgctattaatcaaaaaattcagctgtataagtgggtgctccgggatgatggtacccatgaattgcagtctgaatgtggacatcatgggcacatcctagcactttatgtgcaaactagaggagattttattgtagttggtgatctgatgaagtcgatttccttgttaatctacaagcatgaagaaggtgctattgaggaaagagctcgtgactacaatgcaaattggatgtcagccgttgaaattgttgatgatgacatatatctaggtgcagaaaacagttttaatctgttcacagttcggaaaaatagtgaaggtgccactgatgaagagcgaggtcgtcttgaagtggttggtgagtatcaccttggagaatttgtcaatcggttccggcatggctcccttgttatgcgcttgccagattctgatgtgggccagattccaactgttatctttggcaccattaatggtgttattggagtaattgcttctcttccacatgagcaatatgttttcttggagaaacttcagtcaaatttgaggaaggtaattaaaggcgttggagggctcagccatgagcaatggagatcatttaacaacgagaagaaaactgttgaagctagaaactttttagatggagatttgatcgaatcatttcttgatcttaaccgaagtaagatggatgaaatttccaaggcattggatgtttcagtagaggagttatgcaagagagtagaagagttgacaaggttgcactgattatatattattttgtagcttcgttgtttttttttctttctcatttaactttgttcttcctttttgaggggttgggtgggggttaaaataaacatatgtttgtatttttcccccgcttttaccttctgtttacatttcacaatacatggatcacaaatggtgtatgatatgaatgtcatgttctaaggcatgatagtgctttctatttgacacttttggacacgctatcattttcctaatatttgctttcaagttagttataccttgcagttctgtcaa

SEQ ID NO: 3234 - DNA, 3462 bp, Chenopodium quinoa
tagtgagccacataccagcttgttaatactagaagaagaggctagaacatttagaagaaaacataaaagagtggaattgaagggtttacaaaactttctcacttctcgcgcgcacacactctaacagcgagaagttaatcggtcatcggaaagatgagcatttggaattacgtcgtcaccgctcacaaacctaccaacgttactcattcttgcgtcggcaatttcaccagccctcaagacctcaatcttattatcgctaaatgcacaagaattgagattcacttgctaactcctcaaggccttcagcctatgctggacgttccaatatatggaagaattgcaacactagaactttttcgaccacatggtgaagcccaagatttcttattcattgctactgaaagatataaattttgtgtccttcaatgggatcccgagacatcagagctcgtcaccagagcaatgggagatgtttcagatcgcattggtcgtccaactgacaatggtcagattggcatcattgatcccgattgcagattgattgggctccatttatatgatgggttattcaaggtcatcccatttgataacaaaggacagctgaaagaagcatttaatattaggcttgaggagcttcaagtgcttgatataaagtttctctatggctgctcaaggcctacaatagtagttctttaccaggataataaggatgctcgtcatgttaaaacgtatgagatttcattaaaggacaaagattttgttgaggggccatggtcccaaaacaatcttgataatggggctgatttgcttattccagttccgccaccactttgtggagttatcattgttggggaggagacaattgtatactgcagtgccactgcttttaaagcaatccccattcgaccttctattacaagagcatatggaagggtggatgctgatggttctcggtatttgcttggtgatcatgcaggacttttgcatctacttgttatcactcatgaaaaagagaaagttactggcctcaaaattgagcttttaggggatacgtctattgcatcaacaatatcttacttggataatgcatttgtttttattggctcaagctacggagattcacagctcataaaattgaatttacaaccagatgcaaaaggatcatatgtagaagtcttggaaagatatgtgaatttgggtccaattgtcgatttctgtgtggttgacctcgaaaggcaagggcaaggtcaggttgtaacttgctctggtgcatacaaagatggttctcttcgtatcgttcgtaatgggattgggataaatgaacaggcatcagtggagcttcaaggcatcaaaggaatgtggtctttgagatcttcaacagatgatgtatatgatactttcttggttgttagcttcattagtgagaccaggattctagctatgaatcttgaggatgaattggaagaaactgaaattgaaggttttgactcgcaagtacagactttattttgccatgatgctttgcacaaccaattggtgcaagtcacctcaagctcagttagactggtcagttcgacatctagagaacttcgaaatgagtggaaagctccaacaggatattctgtgaatgttgctactgctaatgcatcccaggttctacttgccactggtggtgggcatcttgtttatttagaaattggtgatggagttttgacagaagtgaaacatgcacaattggagtatgagatatcatgtcttgacataaatacgatcggtcaagatccaaattatagtcagctagctgctgttggaatgtggacagatattagcgttaggatattttcgcttccagatcttaatctaattaccaaagagaatcttggaggggagataattcctcgctctgttcttctatgctcttttgaagggatatcgtatttattgtgtgctcttggagatggtcatctcttgaacttcatgttgaacatgagttctggtgaactgactgaccgtaagaaggtgtctttgggtacacagcctattacacttaggactttctcatctaaaaatgctactcatgtgtttgctgcttctgatcgaccaacagtaatatacagcagcaacaaaaagttactttatagtaatgtaaatctcaaggaagtcagtcatatgtgcccttttaattcagctgcttttcctgacagtcttgcaattgcaaaagaaggtgaacttacaattggtaccattgatgaaattcagaagcttcatattaggtctatccctctgggggaacatgctcggcgtatctgccaccaggaacaaactcgcacttttgccatttgtagtttgaagtacaaccaagctagtgcagaggaatctgaaatgcattttgtgcgtttgttggatgaccaaacctttgagatcatatccacttatgcgcttgatacctatgaatgtggttgctccatactgagctgctcattctcagatgacatcaatgtttattactgtgttggaacagcatatgttttgcctgaggaaaatgagccaacaaagggaagaattttggtttttgttgtggaagatggaaagctgcaactcattgcggagaaggaaactaaaggtgctgtctactcactaaatgctttcaatggcaagctgctggctgccattaatcagaaaattcagctttataagtggatgcttcgggatgatggtactcatgagttacagtctgaatgtggacaccatgggcacattcttgccttgtatgtgcaaactcgtggtgatttcattgttgtcggggatctgatgaaatcaatttcactgctaatatataagcacgaggaaggtgccattgaggagcgtgcacgggactacaatgctaattggatgtcagctgtagaaattctggatgatgatgtatatcttggtgcagaaaatagtttcaatctgttcacagtgaggaaaaacagcgaaggtgccacagatgaggagcgtgcacgccttgaagtagttggggaataccaccttggagaattcatcaatcgatttcgtcatggttctcttgttatgcggttgccagattccgacattggtcaaataccaactgttatctttggaactgttaatggcgtaataggggtgattgcctctcttccaaatgatcagtacatcttcctggagaagctacaatcaaatatgagaaaggttataaagggtgtaggaggactgagtcatgagcattggcggtcatttcacaatgagaagaagacagtagatgcaagaaacttcttagatggagatctgattgaatctttccttgatctcagtcgcggtcgtatggaagagatttcaaaaacaatgggtgtttcaatagaggaacttagcaagagaattgaggagttgaccagattgcactgatgaagtttgatcaggaaagaggctggctttttgctgagc

SEQ ID NO: 3235 - DNA, 3629 bp, Spinacia oleracea
gagaaacaaggtcatcggagttgagggagaaagatgagcatatggaactacgtcgtcacggctcacaagcctacgaatgtcacacattcctgtgtcggcaatttcaccagtcctcaagagctcaatcttattgtcgctaaatgcacaagaattgagattcacatgttaactcctcaaggtcttcagcccatgctggacgttccaatatatggaagaattgcaacacttgaactttttcgaccgcatggtgaaacacaagatttcttattcattgcaacagaaagatacaaattttgtgttctccaatgggatcctgagacatccgagctcgtgaccagagcaatgggagatgtttcggatcgcatcggtcgtccaactgacaatggtcagattggcatcattgatcctgactgcagattaattgggctccatttatacgatgggttattcaaggttatcccatttgataacaaaggacagctgaaagaagcttttaatatcaggcttgaggagcttcaagtgcttgacataaagtttctatatggctgttctagacctacaattgtagttctataccaggataataaagacgctcgtcatgtaaaaacatacgaggtttcattgaaggacaaagattttgtcgaggggccatggtcccagaacaatcttgataatggggcggatttgcttattccagttccaccaccattttgtggggttatcattgtgggggaggagacaattgtatactgcagtgccacagcatttaaagcaatccccatcagaccttccattacaagagcctatggaagggtggatgctgatggttcccggtatttgctcggtgatcatgcaggacttttgcatctgcttgttatcactcatgagaaagagaaagttactggcctgaaaatagagcttttgggggagacatctattgcatcaacaatatcgtacctggataatgcatttgtttttattggctcaagctatggagattcacagctcataaaactaaatttacaaccagatgttaaaggatcgtatgtagaagtcttggaaagatatgtcaatttgggtccaattgtagacttctgtgtggttgaccttgagaggcaagggcaaggccaggttgtaacttgttctggagcatacaaggatggttctcttcgtattgttcgtaatgggattgggataaatgaacaggcatcagtggagctgcaaggcatcaagggaatgtggtccttgaggtcatcgacggatgatgtatatgatactttcttggtcgttagtttcatcagcgagaccagaattctagctatgaatcttgaggatgaattggaagaaactgaaattgaagggtttgactcacaagtgcagactttattttgccatgatgctttgtacaaccaactcgtgcaagtcacctcaagctcagtcagactggtcagttcgacatcaagagaacttcgaaatgagtggaaagccccaacaggatattctgtaaatgttgctactgctaatgcatcccaggttcttcttgccactggtggtgggcatcttgtttatttggaaattggtgatggaattttgacggaagtgaaacatgcacagttggagtatgagatatcatgtcttgacataaatcccattggtccaaatccaaattttagtcagctagctgctgttggaatgtggacagatataagcgttaggatattttcgcttccagatcttaatctaatcatcaaagagaatctcgggggagaaataattcctcgctctgttcttctatgctcttttgaaggaatatcgtatttattgtgcgctcttggagatggccatctcttgaactttatattgaacatgagtactggtgaactgactgaccggaagaaggtgtccctgggtacacagcctattacactcaggacattttcatctaaaaatgctactcatgtatttgccgcctctgatcggccaactgttatatacagcagcaacaaaaagttgctttacagtaatgtaaatctcaaggaagttagtcatatgtgccctttcaattcagcagcttttcctgacagccttgcgatcgcaaaagaaggtgaactcacaataggcaccattgatgatattcagaagcttcatattcgatctattcctctgggagaacatgctcggcgtatctgccaccaggaacaaactcgcacttttgccatttgtagtttgaagtacaaccaagctagtgcagaggaatctgaaatgcattttgtacgctttttggatgaccaaacctttgagatcatatctacttatgcacttgatacttatgaatgtggttgctccatactgagttgctcattctcagatgacatcaaagtttactactgtgttggaacaacatatgttttacctgaggaaaatgagccaaccaagggaagaattctggtttttgttgttgaagacggaaagctgcaactcattgctgagaaagaaactaaaggtgcagtgtactcacttaatgccttcaacggcaagcttcttgctgccatcaatcagaaaattcagctttataagtggatgcttcgggatgatggaactcacgagttacagtctgaatgtggacaccatgggcacattcttgccttgtatgtccagactcgtggtgatttcattgttgttggggatctgatgaaatcaatttctttactaatatacaagcatgaagaaggtgctattgaagagcgtgcacgggactacaatgctaattggatgtcagctgtagagattcttgatgatgatgtgtatcttggtgcagaaaataatttcaatctatttactgtgaggaaaaatagtgaaggtgcgacggatgaggagcgtgcacggcttgaagttgttggggaataccaccttggagaattcatcaaccgttttcgtcatggttctctggttatgaggttgccagattcagacattggtcaaataccaactgtgatatttggaactgttaatggtgtaattggggtcattgcctcccttccgaatgaccagtacatcttccttgagaagctgcagtcaaacatgaggaaggttataaagggtgtaggaggactgaatcatgagcattggcggtcctttcacaatgagaagaagacagcagatgcgagaaacttccttgatggagatcttattgaatctttccttgatctcagtcgcggtcgtatggaagagatttctaaaacaatgggtacttcaatagaggaacttagcaagagagttgaggagttgaccagattgcactaatcaagttgatcatcctaaatttcactcttattctgctacttttggtcttttacaagttttgttcagtttttgtcccagagtctgccgccattggcgtatgacttaagctgcttgcattcgagttcattttccctgtaatttattaataaacaaactagtctttcatccaccatacttgtcagcccttgtttgcctgctcatcatacttcttctgtatctcttgtatgttcttcaagtagtacatgtacaacttacatttcaaaattctgctgtgtattggaaaacaaaacatttctacccttcttttctgcgttggaaaagaggtc

SEQ ID NO: 3236 - DNA, 3879 bp, Trifolium pratense
aaaccaaaaagggcaaaaaacgaaatcaccgaagcaattaagggctttggggttattgagatacttcttcacagagtggcgtttgcgtcgtaacggcccaaccaatcggttttcttaacaccgccaccaccattccgtagtagtagtactttccagaacccaaactcaaaccctttctcatttctcactctaacaaccatcaacagaaactagcgtctgagtgagaaatcgaagaagacgaagaagaaaaatgagtacatggaactatgtcgttactgctcacaaacctaccaacgttactcactcctgcgtcggcaatttcaccagtcctcaagacctcaatctcattatcgcgaaatgcactcgcatcgagattcacttgcttactcctcagggcttgcagtctatcttagatgtgccgttatatggaagaattgctacgcttgagctttttcgccctcatggtgaaacacaggattttctgtttattgctactgaaagatacaaattctgtgttcttcaatgggatactgagaaatccgagctttttacacgatcaatgggggatgtttctgatcgtataggacggccaacggataatggtcagattggcattatagatcctgattgtaggttgattggtctccacttgtatgacggtttgtttaaagttattcccttcgacaataaaggacagctcaaggaagcttttaatatcaggcttgaggaacttcaagttttggacatcaaatttctgtatggttgtccaaagcccactattgtggttctttaccaggataacaaagatgcccgtcatgttaaaacatatgaggttgctctgaaggagaaagactttgttgagggtccatggtcacaaaacagtcttgataatggggctgatttactgataccggttccccctcctctttgtggtgtgcttattattggagaagaaacaatagtatactgcagcgctaatggttttaaagctattccaatcagaccttcaattacaaaagcttatggaagagttgatcctgatggttctcgatacttacttggtgaccatacagggttgcttagtctacttgtaataacccatgagaaagaaaaggttaccggtctcaaactagagccccttggagagacttccattgcatccacgatttcataccttgataatgcatttgtctatattggttcaagctacggagattcacagctcataaaactaaatctacagcctgatgcaaaaggttcacatgtggaagttttggaaaggtatgtcaatttggggcccattgttgacttctgtgtggtagaccttgaaaggcaaggccaaggtcaggttgtgacttgctctggagcttacaaggatggttctcttcgtgttgttcgtaatggaataggtatcaatgaacaggcatcagtagaacttcaaggtatcaaaggaatgtggtcattaagatcctcaacagatgatccttttgacactttccttgttgtaagttttataagtgaaacaagaatattagcaatgaatcttgaggatgagctggaagaaactgagattgagggattctgttctcaagtacagacattattttgccatgatgcagttcacaaccaacttgtacaagtcacttcgaactctgtacgacttgtcagttccacaactagagagctcctgaatgagtggaatgcaccatcagattattcagtaaatgtagctactgccaatgctactcaggttttattggctacaggtggtgggcacttagtttaccttgaaattggagacggtatattacaggaagtaaagcatgctcaactggagtatgaaatctcatgcctagacataaatcccattggtgaaaaccccaaccagagtcatctagcagcagttggaatgtggactgacataagtgtcaggcttttttctcttcctgaccttaatctcatcacaaaggagcatttaggaggagagataataccccgatctgttcttctttgttcctttgaagggatgtcttacttgctgtgtgcccttggtgatggccatctcttaaactttatgttgaacacaagtaccggtgagttaacagataggaaaaaggtctctcttgggacacaacctattactctacggactttctcatccaagaatactactcatgtctttgctgcatctgatcggccaactgtgatttatagtagcaacaaaaaattactttatagtaatgtaaatctgaaggaagtgagtcacatgtgccctttcaactcggcggcttttccagacagtttagcgattgcaaaagaaggcgagcttacgattggtaccattgatgacatacaaaaacttcatattcgtactattccactgggggagcatgcacgacggatctgccatcaggagcaaactagaacgtttgctatttgtagtttgaagtacaactcagccagtgctgaagaatctgaaaatcattttgtccggttgctggatgaccagacctttgacttcatatcagtttatccacttgacacttatgagtatggttgctttataattagctgctccttctcagatgataataatgtttattactgtgttggaactgcgtatgtattgcccgaggaaaatgaaccaaccaagggaaggattcttgttttttctgttgaagagggaaagctgcagctaattgccgagaaagagacaaaaggagctgtttactgcttgaatgcgtttaatggtaaattgcttgctgctattaatcaaaagattcagctgtacaagtgggtgctccgggaagatggcactcgtgaattccagtccgaatgtggacaccatgggcacatactggctttatatgtacaaactagaggagattttatcgtagttggtgatctgatgaagtcaatctccttgttaatctataagcatgaagaaggtgctattgaggagagagctcgtgactatagtgcaaattggatgtcagctgttgaaatccttgatgatgacatatacctcggtgcagaaaatagtttcaatctcttcactgttcggaaaaatagcgaaggcgccactgatgaagaacggagtcgtcttgaagtggccggagagtatcaccttggagaatttatcaatcggttccggcatgggtcccttgttatgcgcttgccagattccgatgtgggccagattccaactgttatatttggcaccattaatggtgttattggggtaatagcctctcttcctcacgagcagtatgttttcttagagaagcttcagtcaagcttgaggaaggtgatcaaaggagttgggggactcagccatgagcaatggagatcatttaacaatgagaagaaaactgtagaagccagaaactttttggatggggatttaattgaatcatttcttgatctcaatcgtaacaagatggacgaggtttcccaggcaatggatgtttcagtagaggagttagccaagagagtagaagagttgactaggttgcactgagtttatcttctcgctggatgcttcttttgtttcttaattcttaattctccttaaactttttcttttttatgcgtttgttggggttagcataacataatcatgttttatactttccccctagcttttgccttctatgatgctgagaattgggaatggtttgcatttgacaatggatcataaatggtgtctgttaatatgtaaaggcataacagggctttctattatattatttctttcaagctgttggttacgtactgcagttgcatgtaacaaatgataaagttggggaaacaaatcagatggccgtaaacaattcagatattttgcttatataagattatatctttatatcgttaaac

SEQ ID NO: 3237 - DNA, 4227 bp, Trifolium pratense
tactttctagaacctaaactcaaaccctttctcatttctcactctaacaactatcaacatcaaatagcgtagagaaactagtgtgtcagtgagaactgagaaatcgaagaagaaagatgagtacatggaactatgtcgttactgctcacaaacctacaaacgttactcactcctgcgtcggcaatttcacaagtcctcaagacctcaatctcattatcgcgaaatgcactcgcatcgagattcacttgcttactcctcagggcttgcagtctatattggatgtgccgttatatggaagaattgccacgctcgagctttttcgccctcatggtgaaacacaggattttctatttattgctactgaaagatacaaattctgtgttcttcaatgggatactgagaaatccgagctttttacacgatcaatgggggatgtttctgatcgtataggacgaccaacagataatggtcagattggcattatcgatcctgattgtaggttgattggtctccacttatatgacggtttgtttaaagttattcccttcgacaataaaggacagctcaaggaagcttttaatatcaggcttgaggagcttcaagttttggacatcaaatttctgtatggttgtccaaagcccaccattgtggttctttaccaggataacaaagatgcccgtcatgttaaaacatatgaggttgctctgaaggagaaagactttgttgagggtccatggtcacaaaacagtcttgataatggggctgatttattgataccggttccccctcctctttgtggtgtgcttattattggagaagaaacaatagtctactgcagcgctaatggttttaaagctattccaatcagaccttcaattacaaaagcttatggaagagtagatcctgatggttctcgatacttacttggtgaccatacagggttgcttagtcttcttgtaataacccatgagaaagaaaaggttaccggtctcaaactagagccccttggagagacttccattgcatctacgatttcataccttgataatgcatttgtctatattggttcaagctacggagattcacagctcataaaactaaatctacagcctgatgcaaaaggttcatatgtggaagttttggaaaggtatgtcaatttggggcccattgttgacttctgtgtagtagaccttgaaaggcaaggccaaggtcaggttgtgacttgctctggagcttacaaggatggttctcttcgtgttgttcgtaatggaataggtatcaatgaacaggcatcagtagaacttcaaggtatcaaaggaatgtggtcactaagatcctcaacagatgatccttttgacactttccttgttgtaagttttataagtgaaacaagaatattagcaatgaatcttgaggatgagctggaagaaactgagattgagggattctcctctcaagtacagacattattttgccatgatgcagttcacaatcaactcgtacaagtcacttcgaactctgtacgacttgtcagttccacaactagagagctcctgaatgagtggaatgcaccatcagattattcagtaaatgtagctactgccaatgctactcaggttttgttggctacaggcggtgggcacttagtttacctcgaaattggagacggtatagtacaggaagtaaagcatgctcaactggagtatgaaatctcatgcctagacataaatcccattggtgataaccccaaccagagtcatctagcagcagttggaatgtggactgacataagtgtcaggcttttttctcttcccgatcttaacctcatcacaaaggagcatttaggaggagagataatacctcgatctgttcttctgtgtgcctttgaagggatgtcttatttgctgtgtgcccttggtgatggccatctcttaaattttatattgaacacaagtactggtgagttaacagataggaaaaaagtctctcttgggacacaacctattactctacggactttctcatccaagaatactactcatgtctttgctgcatctgatcggccaactgtgatttatagtagcaacaaaaaattactttatagtaatgtaaatctgaaggaagtgagtcacatgtgccctttcaactcggcagcttttccagacagtttagcaatcgcaaaagaaggtgagcttactattggtaccattgatgacatacaaaaacttcatattcgtactattccactgggggagcatgcacgaaggatctgccatcaggagcaaacaaggacgtttgctatttgtagtttgaagtacaacccagcaagcgctgaagaatctgaaaatcattttgtccggttgctggatgaccagacctttgacttcatatcagtttatccacttgacacttatgagtatggttgctttataattagctgctccttctcagatgataataacgtgtattactgtgtgggaactgcatatgtattgcccgaggaaaatgaaccaaccaagggaaggattcttgttttttctgttgaagagggaaagctgcagctaattgccgagaaagagacaaaaggagctgtttactgcttgaacgcttttaatggtaaattgcttgctgctattaatcaaaagattcagctgtacaagtgggtgctccgggaagatggcactcgtgaattacagtctgaatgcggacaccatgggcacatactggctttatatgtgcaaactagaggagattttatcgtagttggtgatctgatgaagtcaatctccttgttaatttataagcatgaagaaggtgctattgaggagagagctcgtgactataatgcaaattggatgtcagctgttgaaatccttgatgatgacatataccttggtgcagaaaatagtttcaatctcttcactgttcggaaaaatagcgaaggtgccactgatgaagaacggggtcgtcttgaagtggcaggagagtatcaccttggagaattcatcaatcggttccggcatgggtcccttgttatgcgcttgccagattccgatgttggccagattccaactgttatatttggcaccattaatggtgttattggggtaatcgcttctcttcctcacgagcagtatgttttcttagagaagctccagtcaagcttgaggaaggtgattaaaggcgttggaggactcagccatgaacaatggagatcatttaacaatgagaagaaaactgtagaagccagaaattttttggatggggatttaattgaatcatttcttgatctcaatcgtaacaagatggacgaggtttcccaggcaatggaagtttcagtagaggagttagccaagagagtagaagagttgactaggttgcactgagtttatcctctcattggaagcttcttttgtttcttaattctttattttccttaaactttttcttcttttttgtgcgtttgttggggttagaataacataatcatgttttatactttccccctggcttttgccttctgtgatgcttgtgcttgggaatggtttgcatttgacaatggatcacaaatggtgtctgttaatatgtaaaggcataacagggcttccgattatagactcttgcccagtttctttatattatttatttctttcaagctgtcggttacgcactgcagttgaatgtaacaaatcagatggccgaatcttatgatattttgctcacaagagtatattgtcaaaacaaaatttcgataatagattctctatgcatcaagtttgattgtttatgagaccatatgattaagttggttaaatttttaataagaacgtgtctcactaaattgtgatgtatcttacaataattttaaatggttatcaaatgaattgtctgcataattaaattataagtaatattcctcttacgaaaaaatcaatcatgtccttaatttttaaaatgttaatccattaggttcattcataagaatcagccgcttaatgatgttagggatggtgatttggtacatttgtgatttgttagaatctggggaagactacatgttacaagatttatttcaaggactaacttgatatctctctcctttcccatcctagttgaaattgaggttagattttaggcaagactccatatcacaggaaggataaataaattacagagaccaacttgataaccaacagattttgatggaagaatgtaacttgcatttga

SEQ ID NO: 3238 - DNA, 3672 bp, Glycine max
agacgagggctcgaaggaggtgcttgttgcgttgtggggcacgccctaagcggaagcggttaatcactctgaaccgaaccgaaactaaaccctattcatttcggaatcgcagaacattcgaaccagagaaacaagagaagagaacgatgactatatggaactacgtcgtcacggctcacaagcccaccaacgtcacccactcctgcgtcggcaatttcaccagtcctcaagacctcaatctcatcatcgcgaaatgcacgcgcatcgagattcacctgctttctccccaaggcttgcagcctatgttggatgtgccgatatatggaagaattgcaacacttgaactcttccgccctcatggtgaagcgcaggattatctttttattgcaactgaaagatacaaattctgtgttcttcaatgggattccgagactggtgagcttgttacacgggcaatgggggatgtttctgaccggataggacgtcccacagataatggtcagattggcattattgatcctgattgtaggttgattggactccacttgtatgatggtttgtttaaagttattcccttcgacaataaaggacagctcaaggaagcatttaatataaggcttgaggagctccaagttttggatatcaaatttctttatggttgttcaaagccaactattgtggttctttaccaggataataaagatgctcgtcatgttaaaacatatgaggttgcactgaaggataaagattttgttgaaggtccatggtcccagaacaatctcgataatggggctgatttattgataccagttcccccacctctttgtggtgtgcttattattggggaagaaaccatagtgtactgcagtgctaatgctttcaaggctatcccaatcagaccttcaattacaaaagcctatggaagagttgatcctgacggttctcgatatttacttggtgaccatacagggttggttagcctacttgtaataatccatgagaaagaaaaggttacgggactcaaaattgagccccttggggagacttccattgcatctacaatatcataccttgataatgcattcgtctacgttggttcaagttatggagattcacagctaataaaactaaatctacagcctgatgcaaaaggttcttatgtggaagtattggaaaggtatgtcaatttggggcctattgttgacttctgtgtggtagacctcgaaaggcagggccaaggtcaggttgtaacttgctctggagcttacaaggatggttctcttcgtgtcgttcgtaatggaatagggattaatgaacaggcatcggtagaacttcaaggtatcaaaggaatgtggtcactgagatcctcaacagatgatccttttgatacttttctggttgtgagttttataagtgaaacaagaatcttagcaatgaatcttgaggatgagctggaagaaactgagattgagggattctgttctcaagtgcagactttattttgccatgatgcagttcataatcaacttgttcaagttacttcaagctctgtcagactggtcagctccacaactagagatcttcggaatgaatggcatgcaccatcaggctattcagtaaatgtagctacggcaaacgctacccaggttttgttggccacaggaggagggcatttggtttaccttgaaattggagatggcatattacaggaagtaaagcatgcccagctagagtatgagatttcatgcctggacataaatcccattggtgaaaaccccaatcacagtaatctagcagcagttggaatgtggacagacataagtgttagaattttttctcttcctgatctgagtctcatcacaaaggaacaattaggaggggagatcatacctcgttctgttcttctttgtgcctttgaagggatatcgtacttgctatgtgccctcggtgatggccatctcttaaactttatgttgaatactagtaccggtgaattaacagataggaaaaaggtatctctagggacacaacctataacactacggactttctcctccaaaaatactactcatgtatttgctgcatctgatcggccaactgtaatttatagtagtaacaaaaaattactttatagtaatgtgaatctgaaggaagtgagtcacatgtgtcctttcaattctgctgcttttccagacagtttggcaattgcaaaagaaggtgagcttactattggcactattgatgatatacaaaaacttcatattcgctctattccgctgggggagcacgcacgacgtatctgccaccaggagcaatctaggacttttgctatttgtagtttgaaatacaacccagctagtggtgaagactcagaaatgcactttgtccgcttgctggatgaccagacttttgagttcatatcaacttattctcttgacacttatgagtatggttgcttcataattagctgctccttctcagatgacaataatgtgtattactgtgttggaactgcatatgtactgccagaggaaaatgaaccaaccaaaggaagaattattgtttttgctgttgaagatggaaaactacagctaattgccgagaaagagacaaaaggagctgtttattgcttgaatgcatttaatggtaaattgcttgcagctattaatcaaaaaattcagctgtataagtgggtgctccgggatgatggtactcatgaattgcagtctgaatgtggacatcacggacacatcctagcactttatgtgcaaactagaggagattttattgtagttggtgatctgatgaagtcaatttccttgttaatctacaagcatgaagaaggtgctattgaggaaagagctcgtgactacaatgcaaattggatgtcagccgttgaaatcgttgatgatgacatatacctaggtgcagaaaacagttttaatctgttcactgttcggaaaaatagtgaaggtgctactgatgaagagcgaggtcgtcttgaagtggttggtgagtatcacctaggagaatttgtcaatcggttccggcatggctcccttgttatgcgcttgccagattctgatgtgggccagattccaactgttatctttggcaccattaatggtgttattggggtaattgcgtctcttccacatgagcaatatgttttcttggagaaacttcagtcaaatttgaggaaggtaattaaaggcgttggagggctcagccatgagcaatggagatcatttaacaatgagaagaaaactgttgaagccagaaactttttagatggagatttgatcgaatcatttctggatcttaaccgcagtaagatggatgaaatttccaaggcagtggacgtttcagtagaggagttatgcaagagagtagaagagttgacaaggttgcactgattttatattaatctgtgtagcttcgttgtttgtttgttttttttttcttatttaatattgttcttccttttttttttgaggggttgggtgggggttaaaataacattatatgcttgtattttctccccgctttttaccttctgtttgcattttacaatacatggatcacaaatggtgtatgaaatggatgtcatgttctaagtttctatttgacacttttggacacgctatcattttcctaatatttgctttcaag

SEQ ID NO: 3239 - DNA, 3479 bp, Tabernaemontana elegans
gattaaaccctgaaactgcaaaccaaagcgccattctatatatcacacaaacatatagaggaagtttctagggtttgtttgacagagaggaagtgcaattaatcttgtgtctataattgtagttccatatatagcgactgagggagatgagtatatggaactatgtggtgacggctcacaagccgacgaatgtaactcactcgtgcgtagggaacttcaccgggccgcaggagcttaatctcatcattgcgaaatgcacaagaatcgagattcatctacttactccccaaggtctacagcctatgctggatgtgccaatatatggaagaattgcgacacttgagcttttccggcctcatggtgaaactcaagatcttctcttcattgcaacagagagatacaaattttgtgttcttcaatgggatattgaggcaggagaagttgtcacaagggcaatgggggatgtctctgatcgaataggccgtcctacagacaatggtcagattggcataattgacccggattgtagattgattggacttcatctgtatgatgggctattcaaggtgattccattcgacaacaaaggccagcttaaggaagcatttaatattaggcttgaggagcttcaagttttggatatcaaatttctttatggttgcgcaaagcctacaattgttgtgctttaccaggacaacaaggatgctcgccatatcaaaacatatgaagtggctttgaaggataaagattttgttgagggtccatggtctcagaacaatcttgataatggggcggatttgctgatacccgtaccacctccactctgcggtgtcctaattataggagaagaaacaattgtctattgtagtgccactgcttttaaagcaatcccgattagaccttccattaccagagcctatggaagggttgatgctgatggttctcgatatcttcttggggatcataatgggcttcttcaccttttggtgattacccatgagaaagagaaagtcactgggctcaaaattgagctgttgggggaaacttctattgcatcaacaatatcatatcttgataacgcttttgtgtatgttggctcaagctatggagactcacagctcataaagttaaatctccaacctgatgcaaaaggttcctatgtagaagtcttggaaagatatgtcaacttggggccaatagttgatttctgtgtagtggatttagaaaggcaaggtcagggccaggttgtaacgtgctctggggcttataaagatggttctctccgtatagttcgaaatggaattgggattaatgaacaggcatctgtagaacttcaaggcattaaaggaatgtggtctctaagatcagccactgatgatccttatgacactttccttgttgtgagcttcattagtgaaacacgtattctggctatgaacctcgaagatgagttggaggaaaccgagatagaaggattttgttctcaagttcagactttgttttgccatgatgctgtatacaatcaacttttgcaggtcacatctaactctgtaagattggtgagctctgcatctagagagctgcgaaatgaatggtttgctcctgctggatattcagtcaatgttgctacagcgaatgccactcaggttttattggcaactgggggtgggcatttggtatacctagaaattggtgatggggtgttgactgaagtaaagcatgctcagttggagtatgatatatcctgcctggatataaatccaattggtgacaatccaaattatagtcaccttgctgctgttggcatgtggacagatattagtgtcaggattttttcactgcctgacttaaatctcgtcacaaaggaacacttgggaggggagataattcctcgatctgttcttctatgttcatttgagggggtttcttacttgttatgtgccctaggagatggtcatctcctaaactttgtgttgaatatgaacaatggggagttaacagatcggaaaaaagtgtctcttgggacacaacctataacccttcgcactttctcatcaaagaacgcgacacatgtatttgctgcttctgacaggcctactgtaatctatagcagtaacaagaaactactttacagcaatgtcaacctgaaagaagtcagtcacatgtgccctttcaattctgcagctttcccagacagccttgcaattgcaaaagaaggtgagctaacaattggcactatagatgacattcagaagcttcatattcgctccatcccactgggggagcatgcacgacgcatctgtcaccaggagcagacaaggacctttgcgatatgtagcttgaagtataatcagtctagcgcagatgattctgatacacattttatccgtttgttagatgaccaaacttttgagtttatatcaacttacgctcttgaccaatatgaatatggttgttcaatacttagctgctccttctcagatgatggaaatgtgtactactgtgttgggacagcatatgtaatgcctgaggagaatgaacccacaaaggggcggatactggtttttatagttgaagatggaaaactccagctaattgcagagaaagagactaagggggctgtttactccctgaatgcttttaatggaaaactgcttgccgcaatcaatcagaagattcaactatataaatggatgctccgtgatgatggtagccgtgaactacagtcagaatgtggacaccatggtcacatactcgcactttatgtacaaacacgaggagatttcattgttgttggtgatctaatgaaatcaatttccctgttgatttacaagcatgaagagggtgccattgaggagcgagctcgtgactataacgcaaattggatgtcagctgttgagattcttgatgatgacatttacctaggtgccgagaacaactacaacctattcactgtccggaaaaacagtgaaggtgcaactgatgaagaacgtagtcgtcttgaggtttctggtgaataccatctcggtgaatttgtgaacaggttccgccatgggtcgcttgtcatgcggctgccagattctgatgttggccaaattcccaccgtcatttttggcacagttaatggtgttatcggtgtgattgcctcactgccgcatgaccagtatcttttcttggagaagttgcaaacgaacttgagaagagtgataaaaggtgttggaggattaagccatgagcagtggaggtctttttacaacgagaagaaaactgtagatgctaaaaatttcttggacggggatcttattgaatcattccttgaccttagccgtgctaggatggaagacatttcaaaggcgatggctgtgcctgtggaggaactcatgaagagagtggaagagttaacaaggttgcattaattgtttatactggttcatgtcccttgccctccaccgcccgcgcccccccccccccctcctccc

SEQ ID NO: 3240 - DNA, 3670 bp, Trigonella foenum-graecum
gcaacggcccaacaaaaccaccaccaatcaatcgagcggtttttaacttcactctatagttccttcctagaactgagagactcaaaaccctttctcatttctcactgtaaaatcatcaacaccgagaaactgttcgaagaagagaaagaaagatgagtatatggaactatgtggttactgctcacaaacctaccaacgttactcactcttgcgtcggcaatttcaccagtcctcaagaccttaatctcattctcgcgaaatgcactcgcatcgagattcacttacttactgctcagggcttgcagtctatcttggatgtgccattatatggaagaattgctacgcttgagctatttcgccctcatggtgaaacacaagattttctgtttatcgctactgaaagatacaagttttgtgttcttcaatgggataccgagaaatccgagcttgttacacgatcaatgggagatgtttctgatcgtataggaagaccaacggataatggccagattggtattatagatcctgattgtaggttgattggactccacttgtatgacggtttgtttaaagttattccctttgacaataaaggacagctcaaggaagcttttaatatcaggcttgaggagctccaagttttggacattaaatttctgtatggttgtccaaagcctactatcgtggttctttaccaggataacaaagatgctcgtcatgttaagacatacgaggttgctctgaaggataaagattttgttgagggtccatggtcacaaaacagtcttgataatggcgctgatttattgataccggttcccccacctctttgtggcgtgcttattattggagaagaaaccatagtatactgcagtgctaatggtttcaaagctattccaatcagagctgcaattacaaaagcctatggaagagttgatcctgatggttctagatatttacttggtgaccatacagggttgcttagtctacttgtaataacccatgagaaagaaaaggttaccggtctcaaaatagagccccttggggagacttccattgcatctacgatttcataccttgataatgcatttgtctatattggttcaagctatggagattcacagcttataaaactaaatctacagcctgatgcaaaaggttcttatgtggaagtcttggaaaggtatgtgaatttggggcccattgttgacttctgtgtggtagaccttgaaaggcaaggccaaggtcaggttgtgacttgctctggagcttacaaggatggttctcttcgtgttgttcgtaatggaataggtatcaatgaacaggcatcagtagaacttcaaggtatcaaaggaatgtggtcactaaggtcctcaacggatgatccttttgacactttcctggttgtaagttttataagtgaaacaagaatattagcaatgaatcttgaggatgaactggaagaaactgagattgagggattctgttctcaagtacaaacattattttgccatgatgcagttcacaatcaacttgtacaggtcacttcaaactctgtaagacttgtcagttccacaactcgagtgctcctgaacgagtggcatgcaccatcagactattcagtaaatgtagctactgccaatgctacccaggttttgttggctacaggtggtgggcacttggtttacctcgaaattggagatggtatattacaggaagtaaagcatgcccaactggagtatgaaatctcatgcctagacattaatcccatcggtgaaaatcccaatcaaagtcatctagcagcagttggaatgtggactgacataagtgttagacttttttctcttcctgatcttaatctcatcacaaaggagcatttaggaggagagataatacctcgatctgttcttctttgtgcgtttgaagggatatcttacttgctttgcgcccttggtgatggccatcttttaaactttatgttgaacacaagcacgggtgagttaacagataggaaaaaggtctctcttgggacacaacctattgctctacggactttctcatccaagaatacgacccatgtatttgctgcatctgatcgaccaactgtgatttatagtagcaacaaaaaactactttatagtaatgtaaatctgaaagaagtgagtcacatgtgccctttcaactctgctgcttttcccgacagtttagcgatagcaaaagaaggagagcttactattggcaccattgatgacatacaaaaacttcatattcgcactatcccattgggggagcatgcacgtcggatatgccatcaggagcaaactaggacatttgctatttgtagtttgaagtataactcagcaagtgctgaagaatctgaaatgcattttgttcgcttgctggatgaccagacttttgacttcatatcagtttatccacttgacacttatgagtatggttgctttataattagctgctccttctcagatgataataacgtgtattactgtgttggaactgcatatgtattacctgaggaaaatgaaccaactaagggaaggattcttgttttttctgttgaagaaggaaagctacagctagttgccgagaaagagacaaaaggagctgtttactgcttgaacgcatttaatggtaaattgcttgctgctatcaatcaaaaaattcagctgtacaagtgggtgctccgggaagatggcactcgtgaattacagtccgaatgtggacaccatgggcacatactggctttatatgtgcaaactagaggagattttattgtagttggtgatctgatgaagtcaatctccttgttaatctataagcatgaagaaggcgctattgaggagagagctcgtgactataatgcaaattggatgtcagctgttgaaatccttgatgatgatgtataccttggtgcagaaaatagtttcaatctcttcactgttcggaaaaatagcgaaggcgccactgatgaagaacggggtcgtcttgaagtagctggcgagtatcaccttggagagtttatcaaccggttccggcatggctctcttgttatgcgcttgccagattccgacgtaggccagattccaactgttatatttggcaccattaatggtgttattggggtaatcgcctctcttcccaacgagcagtatgttttcttagagaagcttcagtcaaacttgaggaaggtgattaaaggcgttggaggactcagccacgagcaatggagatcatttaacaatgagaagaaaactgtagaagccagaaactttttggatggggatttaattgagtcatttcttgatctcaaacgcagtaagatggatgagatttccaaggcaatggatgtttcagttgaggagttagccaagagagtagaagagttgactaggctgcactgagtttatcctcatttgaagcttcttttgtttctttattcttttattctccttgtaacttttttcttcttttttgtgcgtttgttgggctaaaataacataatcatcatgtttatacttttcccctggcttttgccttcagtgatgctgtgactatggaatggtttgcattttgacaatggttcacaaatggtgtctgttaatatgtaaaggcatacctgggctttcgattatagactcttgatcatttt

SEQ ID NO: 3241 - DNA, 3688 bp, Gossypium raimondii
agcagcgagccctccgcaccagaacctgaaagaagaatcgctaagcttaagcttcgctccgcaaaatctctattagggaaataaaagaaagaaccccacacacacactcaaaaaaagaaaaaaactgctgctatactcttacacttcttagggcttcgcctaaaggcagagatctgaaggtaaaaaaatgagtacgtggaactacgtcgtaaccgcacacaaacctaccaacgtcacccactcctgcgtcggcaacttcaccagccctcaggagctcaatctcatcgttgcgaaatgtactcgtattgaaattcatttgcttactgctcaaggattacagcctatgttagacgtgccaatatatgggagaattgcgactcttgaacttttccgtccacatggtgaagcacaggattttctgtttattgcaacagaaagatacaaattttgtgtccttcaatgggattccgagacatcagagcttattacaagggctatgggggatgtttcagatcgtattggtcgaccaacagacaatggacagattggcataattgatcctgattgtaggttaattgggcttcatctatatgatgggttgtttaaggttattccttttgataacaaagggcaacttaaagaagcatttaatataaggcttgaggaacttcaagtattggatatcaagtttctctatggttgctcaaagcctacaattgtagttctataccaggataataaagatgcgcgccatgttaaaacatatgaggtggctttaaaggagaaggactttgttgagggaccatgggcccaaaacaatcttgacaacggagccgatttgctcatacctgtacccccacctctctgtggtgtccttattgttggggaagagacaattgtctattgcagtgccaatgcattcaaagcaattccaatcagaccttcaattacaaaagcctatggaagagttgatgctgatggatcgaggtatttgcttggcgatcatgctggccttcttcacctgcttgtcataacccatgagaaagagaaggtcactggactcaagatcgaactcttgggagaaacatctattgcatctacaatatcttatcttgataacgcagttgtcttcattggttcaagttatggtgattcacagctgataaagttaaatctacaacctgacgcaaaaggttcttatgtggaagttttggaaaggtttgtcaatctggggcctattgttgacttttgtgtggtcgaccttgagagacaagggcagggtcaagttgttacttgctctggagcttacaaagatggttctcttcgtgtagttcggaatggaataggaattaatgaacaggcatcagtagaacttcaaggtatcaaaggaatgtggtcattgagatcctcaacggatgatccatttgacacctttctggttgttagttttatcagcgagacacgcattttggcaatgaatcttgaggatgagttggaagaaacagagattgagggatttaattctcaagtgcagactttgttctgccatgatgctgtttacaatcagcttgtacaggttacgtctagctctgtaaggcttgtgagttcaacatctagagagctacgcaatgaatggcatgctccatctgggtattcggtcaatgttgccactgccaatgctacccaggttttactagcaacaggagggggccatttggtttatttggaaattggtgatggcacattaacagaagtcaaacatgctcagttggagtatgaaatctcatgtcttgacattaatccaattggtgagaactctaactacagtcatctggctgctgttggaatgtggacggatataagtgtgaggatattttcgctccctgaactgaatctcatcacaaaggagcaattgggaggagagattattcctagatctgttcttctttgctcttttgaagggacctcttacttgttatgcgcccttggtgacggtcatctcttgaattttcaagtgaacatgagtaatggtgaattaacagatagaaaaaaggtttctcttgggactcaacccataacgcttcgtactttctcctccaagaataccacccatgtatttgcctcttcggataggccaactgtcatttatagtagtaacaagaaattactctacagcaatgtcaatttgaaggaagtcggtcatatgtgcccttttaactctgctgcttttccagacagcctcgcaattgcaaaagaaggtgaacttactataggcacgattgatgatattcagaagcttcatatccgcactatcccacttggggagcatgcgcgtcgcatctgccatcaagaacagtctcggacctttgcaatatgttgtttgaaaaaccagtctagtgctgacgaatctgaaatgcattttattcgcctgttagatgatcaaaccttggaatgtatctcgacttaccctcttgatacttttgagtatggttgctccattcttagctgttcattctcagatgacactaatgtatattactgtgttgggactgcatatgttttgccagaagaaaatgagccaactaagggccgtatactggtttttattgttgaagacgggaagttacagcttattgctgaaaaggaaactaagggagcggtttactctttaaatgctttcaatggcaaactcctagctgctattaatcaaaaaattcaactatataagtggatgcttcgagaggatggctcccgtgaaatacaaactgaatgcggacatcatggccacatccttgctctctacgtgaaaactcgtggggattttattgttgttggtgatttgatgaaatcaatttcattgttaatctacaagcatgaggaaggtgcgatagaggaacgagcccgtgactacaatgcaaactggatgtcagcagttgaaattcttgatgatgatacttatttaggtgctgaaaacaacttcaatctgttcactgttcggaagaacagtgaaggtgccactgatgaggaacggggccgtcttgaggtgattggtgagtatcaccttggggaatttgtgaataggttccgtcatggttcccttgtgatgcggttgccagattcggaagtgggccagattcaaaccgttatttttggcaccgtcaatggtgcaattggcgtgattgcttctcttccgcatgatcagtatgtgtttctggagaagctgcaatcgaacttaaggaaggtgataaagggcgtgggagggttgagccatgaacaatggaggtcattcaacaacgagaagagaactgcagaagccaaaaactttttggatggagacttgatcgaatcattccttgatctgagccgtggaaaaatggaggaagtttctaaaggaatgggagtttctgtggaggagctgtccaagagagtggaggaactgacgaggttgcattgagtcgatgatgcgtttttttatgtttacttttgctgctatatttaacattttgttattctttgtttggacggtcggtattgtcgtggactgtacggattataattttattctctcgttttgtcttggtgtttatataacatttcgtattatatatagtagcatttacaaatgaggttttggtttgcgatgggtggtaggattgacttgttagaaatcaaggtgtttataataaca

SEQ ID NO: 3242 - DNA, 3744 bp, Medicago truncatula
aaaaagggtcaaattcgaggagggggtttgggttatatagaagtgaaagtgagagagtggcgtcgcaacgcaacggcccaatcagaccacccatctctcaattaatcaatcaatcgagtggttgttaacaccgctccgtagttgtgagaagtgaaagactgaaactcaaaaccctatcgcatttcttactgtaaaaccatcaacaccgaacattacaaagaaagtgttcgaagaaaaagataaagatgagtatatggaactacgttgttaccgctcacaaacctaccaacgttactcactcctgcgtcggcaatttcaccagtcctcaggacctcaatctcattctcgcgaaatgtactcgtatcgagattcacttgcttactgctcagggcttgcagtctattttggatgtgccgttatatggaagaattgctacgcttgaactatttcgccctcatggcgaaacacaggattttctgttcattgctaccgaaagatacaagttttgtgttcttcaatgggataccgagaaatccgagcttgttacacgatcgatgggggatgtttctgatcgtataggaagaccaacggataatggtcagattggtattatagatcctgattgtaggttgattggactccacttgtatgatggtttatttaaggttattccctttgacaataaaggacaactcaaggaagcttttaatatcaggcttgaggagctccaagttttggacataaaatttctgtatggttgtccaaagccaactatcgtggttctttaccaggataacaaagatgcccgtcatgttaaaacatatgaggttgctctgaaggataaagattttgttgagggcccatggtcacaaaacagtcttgataatggggctgatttattgataccggttcccccaccactttgtggtgtgcttattattggagaagaaaccatagtatactgcagtgctaatggttttaaagctattccaatcagagctgcaattacaaaagcctatggaagagttgatcccgatggttctagatatttacttggtgaccatacagggttgcttagtctacttgtaataacccacgagaaagaaaaggttaccggtctcaaaatagagccacttggggagacttccattgcatctacgatttcataccttgataatgcatttgtgtatattggttcaagctacggagattcacagctcattaaactaaatcttcagcctgatccaaaaggttcttatgtggaagtcttggaaaggtatgtcaatttggggcccattgttgacttctgtgtggtagaccttgaaaggcaaggccaaggtcaggttgtgacttgctctggagcttacaaggatggttccctacgcgttgttcgtaatggaataggtatcaatgaacaggcatcagtagaacttcaaggtatcaaaggaatgtggtcactaagatcctcaacagatgatccttttgacactttcctggttgtaagttttataagtgaaacaagaatattagcaatgaatctcgaggatgagctggaagaaactgagattgagggattctgttctcaagtacagacattattttgccatgatgcagttcacaatcaacttgtacaagtcacttcgaactctgtaagactagtcagttcctcaaccagagagctcctgaatgagtggcatgcaccgtcagactattcagtaaatgtagctactgccaatgcaacccaggttttgttggctacaggtggtggtcacttggtttaccttgaaattggagatggtatattacaggaagtaaagcatgcccaactggagtatgaaatctcatgcctagacattaatcccattggtgaaaatcccaatcagagtcagctagctgcagttggaatgtggactgacataagtgttagacttttttctcttcctgaacttaatctcatcacaaaggagcatttaggaggagagataatacctcgatctgttcttctttgtgcgtttgaagggatatcttacttgctatgtgcccttggtgatggccatctcttaaactttatgttgaacacaagcacgggtgagttaacagataggaaaaaggtctctcttgggacacaacctattactctacggactttctcatccaagaatactacccatgtatttgctgcatctgaccggccaactgtgatttatagtagtaacaaaaaactactttatagtaatgttaatctgaaggaagtgagtcacatgtgccctttcaactctgctgcttttcccgacagtttagcgattgcaaaagaaggtgagcttactattggcaccattgatgacatacaaaaacttcacattcgcactattccattgggggagcatgcacgacggatatgccatcaggagcaaactaggacatttgctatttgtagtttgaagtataactcagcaagtgctgaagaatctgaaatgcattttgtccgcttgctcgatgaccagacttttgacttcatatcagtttatccacttgacacctatgaatatggttgctttataattagctgctccttctcagatgataataacgtgtattactgtgttggaactgcatatgtattgcctgaggaaaatgaaccaaccaagggaaggattctcgttttttctgttgaagaggggaagctacagttagttgccgagaaagagacaaaaggagctgtttactgcttgaacgcgtttaatggtaaattgctcgctgctattaatcaaaagattcagctgtacaagtgggtgctccgggaagacggtactcgtgaattacagtctgaatgtggacaccacgggcacatactggctttatatgtgcaaactagaggagattttattgtagtcggtgatctgatgaagtccatctccttgttaatctataagcatgaggaaggtgctattgaggagagagctcgagactataatgcaaattggatgtcagctgttgaaatcctcgatgatgatgtataccttggtgcagaaaacagtttcaatctcttcactgttcgaaaaaatagcgaaggcgccactgatgaagaacggggtcgtcttgaagtggctggtgagtatcaccttggagagtttatcaatcggtttcggcatggctctcttgttatgcgcttgccagattctgacgtaggccagattccaactgttatatttggcaccattaatggtgttattggggtaatcgcctctcttcctcatgagcagtatgtattcttagagaagcttcagtcaaacttgaggaaggtgattaaaggcgttggaggactcagccacgagcagtggagatcatttaataatgagaagaaaactgtagaagccagaaactttttggatggggatttaattgagtcatttcttgatctcaaacgcagtaagatggatgagatttccaaggcaatggaagtttctgttgaagagttagccaagagagtagaagagttgactaggctgcactgagtttatcctcatatgaagcttcttttgtttatttattctttattctccttgtaacttttttcttcttcttttttgtgcgtttgttggggttagaataacttaaccatgtcttatacttttcccatggcttttgccttcagtgatgctgtgactatggaatggtttgcatttgacaatggatcacaaatggtgtatgttaatatgtaaaggcataactgagctttccatt

SEQ ID NO: 3243 - DNA, 4121 bp, Populus trichocarpa
aaagagtgaaaaaggccagaaacggagacggaacagcaaacacactagagagagcaggagccgctagggctctttcatttccttcgagcaaaacacagacgcgcagagaaagagagggggagatctgaaagtgaagatgagtgtatggaactatgtggtgactgctcacaagcccaccaatgtgacgcactcttgtgtcggcaatttcaccagttctcaagagctcaatctcatcattgcgaaatgtacccgtatcgaaatcaatctgcttactcctcagggattacagcctatgttagatgttccaatatatggacgaattgcaactctcgaacttttccggcctcatggtgaagcccaggactttttatttattgcaacagaaagatacaaattctgtgtacttcagtgggacgcagagacgtctgagctaattaccagagcaatgggggatgtatcagaccgtataggtcgcccaacagacaatggtcagattggcataattgatcctgattgtagattaattggactccatttgtatgatgggttgtttaaggtcattccttttgataataaaggacagctcaaagaggcttttaacataaggcttgaggaacttcaagttttggatatcaaatttcttcatggttgttcaaaaccaacgattgttgttctttaccaggataacaaggatgcccgtcatgttaaaacatatgaggttgctttgaaagataaagactttattgagggtccttggtcgcagaacaatcttgacaatggtgctgatttgctaataccagttcccccacctttctgtggtgttcttattattggagaagaaacaattgtatattgcagcgccaatgtttttagagcgatcccaatcagaccttctatcacgaaagcatatggaagagttgatgctgatggttctaggtatttacttggcgatcatgctgggcttcttcaccttctagtcataacccatgagaaagaaaaggtcactggcctcaaaattgagctattgggagaaacttctattgcatctaccatatcatatctcgacaatgcttttgtctttattggttcaagctacggagattcacagcttgtaaagttaaatctgcaacccgatgcaaaaggtacatatgtagaagttctggacaggtatgtcaatttgggaccaattgttgacttctgtgtggtggacctggagcggcaaggccaaggtcaggttgtcacttgctctggagcctataaggatggttctcttcggatagttcgtaatggaataggaatcaatgaacaggcatctgtagagcttcaaggcatcaaaggaatgtggtcattaagatctttgactgatgatccatttgacacctttctggttgtaagttttattagcgagacaagaattttggcaatgaacattgaggatgagttggaggaaactgaaatagagggtttctgttcacaagtgcagacattgttctgccattgtgctgtgttcaaccagcttgtacaagttacatcaagctctgtaagactggtcagttctacaactagagagctcagacaggaatggaatgctccatcaggttattcaataaatgtcgccactgctaatgccacccaggttttattggcaactggtggtggccacctcgtctatctggaaatcggtgatgggacactgacacaggcaaaacatgcacagctagagtgtgagatatcatgcctggacattaaccccattggagagaatcccaactatagtcaactagctgcggttggaatgtggacagacataagtgtcaggatattttcattgcctgatctaaatctcataacaaaggagccattgggaggagagataataccccgttctgttcttctatgttcctttgaagggatatcgtatttattatgtgcccttggagacggacacctcttgaacttcctactgaacttgagtactggcgagttgaaagataggaaaaaggtgtctttggggacccaacctataacactccgtactttctcatcgaagaataccacacatgtatttgctgcatcagataggccaactgtcatttacagcagcaacaagaaactactttacagcaatgtaaacttgaaagaagtcagtcatatgtgtccttttaactctgctgcatttccagacagccttgctattgcaaaagaaggggaacttagcattggcaccatcgatgatatccaaaagcttcacatccgctctattccattgggtgaacatgcacggcgtatatgtcaccaggagcagtctcggactttctccatttgtagtatgaaaaaccaatccaatgcagaagaatctgaaatgcattttattcgattgttagatgatcaaacctttgagttcatatcaacatacccacttgacacatttgagtatggctgctccatacttagctgctccttttctgatgatagcaacgtgtactattgtgttggaactgcatatgttttgccagaagaaaacgagccaaccaagggccgaatactggttttcatagtggaagatgggaagttgcagcttattgctgagaaggaaacaaagggggcagtatactctttgaatgctttcaatggcaaactgctggctgctattaatcaaaagatccagttatacaagtggatgctccgagatgatggaacacgtgagctgcagtctgagtgtgggcatcatgggcacatacttgccctctatgtacaaactcgtggagatttcattgttgttggtgatctgatgaagtcaatctccttgctaatctataagcatgaggaaggtgctattgaggagcgagcccgtgattataatgcaaattggatgtcggcagttgagattcttgatgatgacatttaccttggtgctgaaaataactttaacctattcacggttcggaaaaatagtgaaggtgccactgatgaggaacgaggccgtcttgaggtggtcggtgagtatcaccttggagaatttgtaaatcgattccgacatggttcccttgtcatgcgcttgccagattccgatgttggccagatcccaactgtcatttttgggactgttaatggtgtaatcggggtcattgcttcacttcctcacgagcaatacctctttttggagaagctgcagtcaaacttaagaaaggtgataaagggtgttggaggattgagccatgagcaatggagatcattcaacaatgagaagaaaactgtagatgccaagaatttcttggatggagatcttattgagtcattccttgatctcagccgtagtcggatggatgagatatccaaggcaatggagatctccgtggaggagctttgcaagagagtggaagagctgacaaggctgcattgattcagtctcgatcatgtctactcgtttgttctattttttttttttggttgctttgttgcacatggacgaatcatgtcttgtcggtttggagggatatccaaggacgaaccgtttcttgtaaggaatccagaggtgtatgtacaacatttttttaaaaatcatgttcatatgttatttagagacctgcatgtggagttagcctatacagctgccgatggtttctttctaagtggcacttgtataattattaagagctgagaatctagatctggtttttaggatcaggtcaggattgagagtccatcaaccttttgctgcagcacagataggagaatcttgccctggaagcagacctcctcaaaccgtaagatccttcgaagttgaaaggttctcgtacaagctccaagtaatgcgcaactgggaagtttggtcgatatcagaatttgtgaataagacatcaatctgattctcgtctggttgttcgaagcctcccaggtgagattcaaaacccaagaaaacaagttgcgggaagagactttgtgcatccaaagtttcttgtatttccttctctaacagtgagatagatcctttgactgggattctgcttcgtacaccgcaaatgtctaatgggagagaatttgaggaacacaatcactttctaatgtcattgcatatcaaaaacacaattaaggtataaataactcgagaattgacctaa

SEQ ID NO: 3244 - DNA, 3588 bp, Manihot esculenta
agaaggtcattctagcttctgccgcttactgtaaaaaccagctcacagaagcccaaaaagcaccgagagcgagagcgagagcgctagggctcctccaccgtcgagcgagtgagagagagagagagagagtgagaagaagagatgagcatatggaactacgtcgtgacggctcagaagcctaccaatgttactcactcctgcgtcggcaatttcactagtcctcaagagcttaatctcattattgcgaaatgtactcgcatcgaaatccatttgctaactcctcagggattacagcctatgttagatgtcccaatatatggtagaattgcaacacttgaacttttccgccctcatggtgaagcacaggattttctatttattgctacagaaagatataaattttgtgtccttcagtgggatgctgagacatctgaacttattacaagagcaatgggagatgtatctgaccgtataggtcgtccaacagacaatggtcagattggcataattgatccagattgtagattaattggactccatttgtatgatgggctgttcaaggtaattccttttgataacaaaggacagctcaaagaagcttttaacataaggcttgaggaacttcaagttttggatatcaagtttctctatggttgttcaaaacctacaattgttgttctttaccaggataataaagatgctcgtcatgtcaaaacatatgaggttgctctgaaagataaggattttgttgagggtccatggtctcagaacaaccttgataatggtgctgatttgctcataccagtgcccccacctctgtgtggtgtccttattattggagaagaaacaatcgtctattgcagtgcaaatgcttttaaagcaatccctataagaccttccatcacaagagcatatggaagagttgatgctgatggttctaggtacttgcttggtgaccatgctgggctacttcaccttcttgttataacccatgagaaagagaaggtgactgggctaaaaattgagctcttgggagaaacttctattgcatctaccatatcatatctagataatgctgttgtctatataggatcaagctatggagattctcagcttataaagttaaatctacaacctgatgcaaaaggttcatatgttgaggttttggaaagttatgtcaacttgggaccgattgttgatttctgtgtcgtggaccttgagaggcaaggccaaggtcaggttgtaacttgctctggagcatacaaggatggttctcttcgcatagttcgaaatggaataggaatcaatgaacaggcatctgtggaacttcaaggtatcaaaggaatgtggtcattaagatcttccaccgatgatccatttgacaccttcctggtggttagttttattagtgagactcgaattttggcaatgaaccttgaggatgagttggaagaaactgaaatagagggttttagttcacaagtgcagactttgttctgccattatgctgtctacaatcagcttgtgcaagttacatcaagctgtgtgagattggtcagttctacaactagagagttccggaccgagtggaatgctccatcaggttattcaattaatgttgccactgctaatgccacccaggttttattagcaactgggggcggccacttagtctatttggaaatcggtaatggagtattgacagaggtaaaacatgctcaactggagtatgagatatcatgccttgatattaaccccattggtgaaaatcccaactatagtcagcttgctgcagtcggaatgtggacagacataagtgtcaggatattttcactgcctgacctaaatgtcataacaaaggagcatttgggaggagagattatacctcgttctgttctcctgtgttcctttgaagggatatcatacttgttatgtgcccttggagatggtcatcttttgagcttcttgttgaatttgaatactggcgagctgtcggatcggaaaaaggtgtcattagggacacagcctataacactacgtactttctcttccaagaacaccactcatgtatttgctgcatcagataggccaactgttatttacagcagtaacaagaaactactctatagcaacgtcaatttgaaagaagtcagtcacatgtgtcctttcaactctgctgcttttccagacagccttgcaattgcaaaagaaggtgaacttactattggaacaattgatgatatacaaaagcttcacatccggactattcccttgggagaacatgcacggcgtatctgtcatcaggagcagtctcggacctttgccatttgtagtttgaaaaaccaatctagtgcagaagaatctgaaacacattttattcgtttgttggatgaccaaagctttgaattcatatcgacttaccaacttgatccatttgagtatggctgttccatgcttagctgttcattttctgacgatattaatgtgtactactgtgttggaactgcttatgttttgccagaggaaaatgagccaactaagggtcggatattggttttcatggttgaggaaggaaagttgcagcttataactgagaaggaaactaagggcgctgtttactcattgaatgctttcaatggtaaactgctagctgctataaatcagaaaatccagttatacaagtggatgcttcgagatgatggttctcgtgagctgcagtctgaatgtggacatcatgggcatatactggcactttatgtacaaactcgtggtgatttcattgttgttggtgatctgatgaagtcaatctccttgctaatctacaagcacgaggaaggtgctatggaggagcgagctcgtgattataatgcaaattggatgtcagctgttgagattcttgatgatgacatctacctgggtgcagaaaataacttcaacctgttcacagtacgaaagaacagtgaaggtgctactgatgaggaacggggtcgtcttgaggtggttggtgagtatcatcttggagaatttgtgaatagattccgacatggatcccttgtcatgcggatgccagattctgaagtgggccaaattccaactatcatttttggcaccgttaatggtgtaattggtgtcatcgcttcacttcctcatgaacaatacatgtttttggaaaagctccagacaaacttgaggaaagtgataaagggagtaggagggttgagccatgagcaatggagatctttcaacaatgagaagaaaacagtagatgctaaaaatttcttggatggagatctaatagagtcattccttgatttgagccgagctcggatggatgagatttctaaggcaatgagtgtctcggtggaggaattgtccaagagagtggaagagctaacaaggctgcattgatacaagtcttgttcagattgctgctcctttttcttcgttttgttccttttgtttgaatcgcatacaacaattactcgtctcttggtttggagtgaggtctgaattggtatgcttgggaaatgtatgtgtaacatataaattttctttataatatcatgtccataagaatttcattattcg

SEQ ID NO: 3245 - DNA, 3337 bp, Daucus carota
gagagagcgagagagatgagtacatacaactacgtagtgacggcgcacaagccgacgaatgttacacactcatgcgtcggaaacttcaccagtcctcaagagctcaatctcatcattgcaaaatgcactcggattgagattcatttacttactgcgcaaggtctgcagcccatgttggacgtgccgatatatggaagaatcgcaactctggaactttttcgccctcatggtgaaactcaagatcttctattcattgctacagaaaggtataaattttgcgtacttcagtgggatccagaggcaggtgaagttattacgagggcaatgggggatgtctccgatcgtatagggcgtcctacggacaatggtcagattggtataattgatccagattgcagactaattggactgcacctgtatgatgggttgtttaaggtcattccattcgataataaaggccagttgaaggaagcatttaacataaggcttgaggaacttcaagttttggacatcaaatttctttatggttgtccaaagcctacaattgttgtactttaccaggataacaaggatgctcgacatgttaaaacatacgaggtcgctttaaaagataaagacttcattgagggtccttggtcacagaacaaccttgataatggggcagatttactaatacctgtgccaccacctctttgtggtgtcctaatcattggggaagaaactattgtgtactgcagtgcctctgcattcaaagcaatcccaatcagacctgccattacaagatcctatgggagagttgatgctgatggttcgaggtacttgctaggtgatcataatgggcttcttcacctacttgttattacccatgaaaaggagaaagttactggtttgaaaattgagctccttggggaaacttctattgcttcgacgatatcatatcttgataatgcgtttgtatatgttggctcaagttatggagattcacagctcataaaactaaatctccagcctgatgcgaaaggttcttatgtagaagctttagaaagatatgtaaatttagggccaattgtggacttctgtgtggtagatttagagaggcaaggtcaaggtcaagttgtaacttgctcaggagccttcaaagatggttcccttcgaatagtacgcaatggaattgggatcaatgaacaggcatcagtagaacttcaaggcattaaaggaatgtggtcattacgatcagctaccgatgatccatttgacacatttttggtggttagcttcatcagcgagactcgaattttggcaatgaatattgaggatgagttggaagagactgaaatagaggggttttcctctcaagttcagacattgttctgccatgatgctgtttatgatcaactcgtacaggttacctcaagctctgtaagactggtcagttcaacttctagggagcttcgaaatgagtggaaagctccaccaggctactcggtcaatgttgcaactgctaattccactcaggttttattagctgctggcggtggccatttggtttacctggaaattggtgatgggatactgaatgaagttaaacatgcacaactggagtatgatgtgtcatgtcttgacataaaccccatcggtggtaattccagctacagtagcctagctgcagttggaatgtggactgacataagtgttaggatcttttctcttcctgatctgaacctcgttaccaaggaacatttaggaggagagataatacctcgttcagttcttttatgtacgtttgaagggatttcttacttgttatgtgcgcttggagatggacatcttcttaactttttgttgaacctgacaactggtcagctaacggataggaaaaaggtgtctctcgggacccaaccaattaccctacgaactttctcatcgaagagtactacacatgtttttgctgcctcagacagaccaactgtcatttacagcagcaataagaaactgctctacagcaatgtgaacctaaaagaagttagtcatatgtgccctttcaactctgccgctttccctgacagccttgcaattgcaaaagaaggtgagttgacaataggcacgattgatgatattcagaaacttcacattcgttcgatcccacttggggaacatgcacgtcgtatctgtcatcaagagcactctcggacttttgccttgtgcagtgtaaagtacaaccagtcgagtgcagaagacacagagatgcacattatacgcctgttagacgatcagacttttgagttcatatcaagttactcacttgaccagtttgaatatggttgctccattctgagttgctcgttctcggatgataataatgtctattattgcgttgggactgcatatgttatgccagaggagaacgaaccaagcaaggggagaatactggtattcctagtcgaagatggaaagctgcagttggttgcagagaaagaaaccaagggtgctgtttactccctaaatgccttcaatggtaaactgcttgctgctatcaatcaaaagattcagttatacaaatggatgcttcgtgatgatggtacccgtgagttgcaatctgaatgtgggcatcatggacatatacttgctctttatgtacaaactcgaggagattttattgttgttggcgacttgatgaaatctatatctctgctgatttataagcacgaggaaggtgctattgaggagcgagcccgtgactacaatgctaattggatgacagctgtcgagattcttgatgatgacatttaccttggcgctgagaataattttaaccttttcacagtcagaaagaacagtgaaggtgccactgatgaagagcggagccgtcttgaggtggttggtgaataccatcttggcgagtttgttaatcggttcagacatggttcccttgtcatgcgaatgccagattcagatgttggccagattccaacctgcatttttggaactgttaatggtgtcattggggtagttgcctcacttccacaagatcagtacagtttcttagataagcttcagtctaatttgaggaaggtaataaagggcgttggaggattgagtcatgaacaatggcgatcttattctagcgagaagaaaactgcagatgctaaaaatttcctagacggggatctgatcgaatcatttcttgatcttagccgaagtaaaatggaagaggtttcaaaggctatgactgtaccggtggaggaacttatgaagagagtagaggagttaacaaggttgcattaatgttgctgcttgattctatgtctgcttagttgacttttttcttttctctttg

SEQ ID NO: 3246 - DNA, 3613 bp, Eucalyptus grandis
tctccctcttctttcttgttctccttgcattaagcagtctgcagttcccttctgttgcgacagaggggaggacgggatcgcccccacaagcgggaaagccggggagggccaaacccaagatgagcgtgtggaactatgtggtcacggcgcacaagcccaccaacgtcacccactcctgcgtcggcaacttcaccggccctcaggagctcaacctcataattgccaaatgcactcgaattgaaatacatttgcttactcctcagggtttacaggctatgctggacgtgccaatttatgggagaattgcgacgcttgagctttttaggcctcatggtgaggcgcaggactttttatttattgcaacagaaagatacaagttctgcgttcttcaatgggatgctgagacatctgagcttgttacaagggcaatgggtgatgtatctgatcggataggtcgtcctacagataatggtcagattggaataattgatcctgattgtagattaattggtctccacttatatgatgggttgtttaaggttataccttttgataataaagggcagcttaaagaagcattcaacatccggcttgaagaacttcaagttctggatataaagtttctctatggttgctcaaaaccaacaatagttgttctataccaggataacaaagatgctcgacatgtcaagacatacgaggttgctctgaaagacaaggatttcgttgagggtccctggtctcaaaacaatgtagataatggtgcagatctgttgattccagtgcctccccctctctgcggtgtacttataattggggaagaaacaattgtatattgcagtgcaaatgcatttaaagcaataccaattagaccttccatcacaaaagcatatggaagagtcgatgctgatggttctaggtatctacttggtgatcatgccgggcttctccacttgcttgttataactcatgagaaagaaaaagttacaggtctcaagatcgagcttttaggagaaacttcaattgcatccacgatatcataccttgacaatgcctttgtttttattggctcaagttatggtgattcacagcttatcaagctgaatctacaacctgattcaaagggttcatatgtggaagttctggagcgctatgttaacttgggacccattgttgatttctctgtggttgaccttgagaggcagggtcaaggtcaggttgttacatgttctggagcttacaaggatggttctctccgtatagtccggaatggcataggaatcaatgaacaggcatctgtagaacttcaaggcattaaagggatgtggtcattgagatcttctatagatgatacttatgacactttcctggttgtaagctttattagcgagacaagaattttggccatgaatcttgaagacgagttggaagaaactgagatagagggtttctgttctcaagttcaaactctcttctgccatgatgctgtgcacaatcaacttgtccaagtgacttcaagctccgtgagacttgtaagctctatgacgagagagctgaggaatgaatggcattctccacaaggatattctatcaatgttgctactgctaatgccactcaggttctactggcaactggaggtggtaatcttgtttatctagaaattggcgatgggattctgaaagaaatcaaacatgtacagctggaatatgagatctcatgccttgacattaatcccattggggagaatctccattacagtcagctggcagcagttggaatgtggacggacataagtataaggatattttcattgccggacttgaatctcattaccaaggagaatttgggaggagaaataatacctcgttctgttctgctttgtgcctttgaagggatatcttacctcttatgtgctcttggagatggtcatctcctgaactttcaattgaacatgcattctggtgagttaacagataggaagaaggtgtctctagggactcagcccattactctccgtacgttttcatcaaaaaatactacacatgtatttgctgcatcagataggccaactgtcatttacagcagtaacaaaaagttactctacagtaatgtaaatctcaaagaagtgagccacatgtgccaattcaactctgctgcttttccagacagtcttgcaattgcgaaagaaggtgagcttaccatcggtaccatcgatgatatccagaagcttcacattcgctctatcccccttggggagcatgcgcgacgcatttgccatcaggagcagtctaggacgtttgcaatttgtagcatgaagtacaaccagtcaagtgctgaagaatctgaagtgcattttgttaggcttttagatgaccagactttcgagttcatgtccacttacccgctcgatccatttgagcatggttgctccatacttagttgttccttctctgatgacagtagtgtttattactgcgttgggactgcatatgtgttgccggaagaaaatgaaccaacaaagggtcggatattagttttcattgtggaggatgggaaattacagttgattgctgaaaaagagaccaagggggctgtttactctttgaatgcctttaatggaaagctattagctgcaatcaatcaaaaaattcaattgtacaagtggatgctgcgagatgatggctctcgtgaattgcaatctgaatgtggacatcacggtcacatacttgccctctatgtacaaactcgcggagactttattgttgttggtgatctgatgaagtcaatatccctgctgatatacaagcatgaggaaggtgccattgaggagcgggcacgtgattacaatgcaaattggatgtctgccgtggagattctcgatgatgacacttatcttggtgcggaaaataacttcaacctcttcacagtgaggaagaacagtgaaggcgccaccgatgaggagaggggccgtctcgaggtggttggtgagtatcaccttggagaatttgtcaaccggttccgccatggttcccttgtgatgcggttgccggattccgatgtgggtcagattccgaccatcatatttggcaccgttaatggcgtgattggagtaattgcctcgcttcctcatgatcagtatgtatttctagagaagcttcagtcaaacttgagaaaggttattaaaggcgttggaggactgagccatgagcaatggaggtcgttttacaatgagaagaagaccgtggatgctcggaatttcttggacggagatctcattgagtcgttcctagaccttagccgcgggcggatggatgagatatctaaagcaatggttgtttcggtggaggaactctgcaagagagtggaagagttgaccaggctgcattgattgtaagaccacaaaggatgtaatatttctcttttacttcctgttgttactttggttttttcattttttaccttgtgtcaaaggttttaaatttgtatgggatatctcgcttttgggtctggaacttttatggagcataggcatgatggtatagcacgttgttggctctgttttgcgagtttcatcatataatctgctaatgtggatctcaaacaaagttgttt

SEQ ID NO: 3247 - DNA, 3647 bp, Arabidopsis lyrata
gtctttcttcttccttgttcgattttcgcctcctttggcttttcattgtttctctctctctctctttcttcttcgttgaaattcaaaagctcgtttagagatttccatcttgaggcgtgcgtagagagtgaaactcaaattcctcagggacaaagaagaggaagatgagctcatggaactacgttgttacggcgcacaaaccgaccagtgtcactcactcgtgcgttggcaacttcacaagtcctcaagagctcaatctcattgttgcgaaatgtactcgaattgaaatccatttgcttaccccacagggacttcagcctatgctggatgttcctatatatggaagaatcgctactctggagttgttccggccccatggcgaagcgcaagactttttgttcattgcaactgagagatacaaattctgtgttcttcaatgggatgctgagtcctctgagcttattacaagagcaatgggggatgtttctgatcgtataggccgaccaacagacaatggtcagattggcataattgatccagattgtagattaattggactccatctgtatgacggcttgttcaaggttattccatttgataataagggacagctcaaggaagcttttaatatcaggcttgaggaattgcaggttctggatatcaagtttctgtttggatgtgcaaagcccactatcgcagtactatatcaggacaacaaagatgctcgtcatgtcaaaacatatgaagtctctctaaaagataaggattttgtcgagggtccatggtcacagaacaatctcgacaatggtgctgacttgctgattcctgtaccaccaccgctctgtggtgtccttattattggtgaagaaacaattgtctattgcagtgctaatgcattcaaagcaataccaataagaccttccatcactaaagcatatggaagagttgatgttgatggctctaggtatcttcttggtgaccatgctggactgattcatcttcttgttataacgcacgagaaagaaaaggtcactggcctaaaaattgagcttttgggtgaaacatctattgcatcgactatatcgtaccttgacaatgccgttgtctttgtcggctcaagctatggcgattcacagctagtaaagctgaatctacaccctgatgcaaaaggctcatatgtagaagtcttggaaaggtatatcaacttggggcctattgtcgacttttgtgtagttgacctcgagagacaggggcaaggtcaggttgtaacttgttctggagcatttaaggatggttccctccgcgtagttcgcaatggaataggaatcaatgaacaggcgtctgtggaacttcaaggtatcaaaggaatgtggtcgttgaaatcttcaattgatgaagccttcgatacattcctcgttgttagctttatcagtgaaactcgtatattagccatgaatcttgaggatgaactggaagaaacagagattgagggcttcttgtctcaagtgcagacgttattttgccatgatgctgtgtacaatcaacttgtacaggttacctcaaattctgttagactagtcagttctacaactagagaattgcgggacgagtggcatgccccggctggattcactgttaatgttgcaactgcaaatgccagccaggttcttttggcgactggaggtgggcatttggtgtatctagaaattggagatgggaaattgacggaagtgcaacatgcccttttggagtacgaggtttcttgtcttgatataaaccctattggtgacaatcctaattacagtcagctagcttcggttgggatgtggacagatataagcgtgaggatcttttcgctgccagaattgactcttattacaaaagagcaactcggaggggaaataattccccgatctgttcttctttgtgcattcgaagggatatcttacttgctctgtgctcttggagatggccatcttttgaacttccagttggatacaactactgggcagttgaaagacaggaaaaaagtatcactagggactcagcctataactctgcgtactttttcatcaaaaagcgccacacatgtctttgctgcatcagatagaccaaccgtgatctatagcagcaacaagaagctgttatacagcaatgtcaatcttaaagaagttagtcatatgtgccctttcaactctgctgcttttcccgacagtttagcaattgccagggaaggtgaacttacgattggtaccattgatgatattcagaagcttcacatacgcactattcctcttggagagcatgctcgtcgaatttgccatcaggagcagacacgtacatttggtatctgcagtttgggaaaccagtcaaatgccgaagaatctgaaatgcactttgtccgtcttttagacgaccagaccttcgagtttatgtcaacttaccccttggattcctttgaatacggttgctccattctaagctgctcattcaccgacgataaaaatgtctattactgcgttggaacagcatatgttttaccggaggaaaatgaaccaactaagggaaggatattagtatttatagttgaagatgggaggttgcagttaatcgcggagaaagaaaccaaaggagctgtttattctctcaatgcctttaatggaaaacttcttgctgctattaatcagaagattcagttgtacaagtggatgctgcgggatgatggcactcgtgaactgcagtctgaatgcggacatcacggacacattctagctctctatgtacagacccgtggagactttatcgttgttggtgatctcatgaaatcaatctccttattgttatacaagcacgaggaaggtgcgatagaggagagggctcgggattacaatgcaaattggatgtcagcggttgagatactcgatgatgatatttaccttggtgctgagaacaatttcaatctggtaacagtgaaaaagaacagtgaaggtgctactgatgaagaacgaggacggttggaggtagttggagagtatcaccttggggaatttgtgaacagattccgccatggatctctagtaatgaggctacctgattcagagattggtcagatcccaacagtcatctttggtacagtcaatggagtgattggagtgatagcttcacttcctcaagaacaatatactttcttggagaagctgcagtccagtctgaggaaagtgattaaaggagttggcggattaagccacgagcaatggaggtcgtttaataacgagaaaagaaccgcagaagcgaggaatttcttggatggtgacttaatcgaatcgtttctggatctgagtagaaacaagatggaggatatatcgaaatccatgaatgttcaagtggaggagttgtgtaagagagttgaagaactcactaggcttcactgaaccaaatcaatcgatgccaataggctttgttttatttatttattttatgcttttcttgagttaaaagtctttatttgggttttgttattaataacttgtgttggttaaagtattgtcttctaaatcgaaccgggaagcaaaccggactggactgtcttttgggtcggataatgaatcacttgatcgatatatatataaaaatatattttagtattt

SEQ ID NO: 3248 - DNA, 3665 bp, Citrullus lanatus
cttccgtggggttcggcttcagcgtccacacagccactcccgctggaacgcacacaatagccattactccccaccttcactaagcggcaagccttagcctagggtttttgcccacggaaccatcgcaccatttcatagcttcaagatgagcgtctggaactatgtcgtcaccgctcacaagcccaccaacgtcacccactcctgcgttggcaacttcaccggccctcaggagctcaacctcattatagcgaaatgtacacgcattgaaattcatttgctcactgctcaaggcctgcagcctatgttggatgttccgatatatgggaggattgcaacattggaactttttcgccctcatggggaagcacaagattttcttttcatagcaactgagcggtacaagttctgtgttcttcaatgggatactgaaagttctgagcttattacaagggcaatgggggatgtctcagatcgcattggtcgtcctactgacagtggtcagattggcattatagacccagattgtcgattgattggacttcatttatatgatggtctgttcaaggttattccttttgacaataaaggacagctcaaagaagcatttaacattaggcttgaggaacttcaagttttggatatcaagtttctttatggctgttccagacctacaattgtagttctttaccaggacaacaaagatgctaggcatgttaaaacctatgaggttgttctaaaggacaaggattttgttgaaggtccatggtcccaaaacaatcttgataatggggctgctgttctaatacctgttcccccaccactatgtggtgtcatcattattggagaagagacaattgtttactgcagtgccacagcatttaaagcaataccgattagaccttccatcaccagagcatatgggagggttgatgctgatggttcaaggtacttgcttggtgatcatgctggtctacttcacctacttgtcataactcatgaaaaagaacgggttactggacttaagattgagttgttgggggaaacatctattgcttctacaatatcatatcttgataatgctttcgtatatattgggtcaagctatggggattcacagcttgttaagctaaatgtacagcctgacgcaaaaggatcatatgtagaagtcttggagaggtatgtcaacttggggcctattgttgatttttgtgtggtggaccttgagaggcaaggccaaggacaggttgtaacatgctctggagcttataaggacggttctcttcgtgttgttcgcaatggaattggaattaatgagcaggcatctgtggaactgcaaggaataaaaggaatgtggtcactgagatcttctactgatgatccatttgatatgtttctcgttgtaagctttatcagtgagactagaattttggcaatgaatcttgaggatgaattggaggaaacagagatagagggtttcaactctcaagtgcagacattgttttgccatgatgcactgtttaatcaacttgttcaggttacctcaagctctgtaaggttggttagttctaccactagagaacttctcaatgaatggaatgcaccatcaaactactctatcaatgttgccactgctaatgcctcccaggttttgttggcaactggcggtggtgttttagttcatttagaaatttgcgatggattattggttgaaaagaaacatatacagttggagcatgagatttcatgcctcgatataaacccaattggtgacaaccctaattgtagtcaactcgctgcagttggaatgtggacagatataagtgtcagaatattttcgctacctgacctgaatctccttacaaaggaacaattgggaggggagataatacctcgttcagttcttctttgtacttttgaagggatatcttacttgctgtgcgctcttggagatggtcatttgttgaactttatattgaacacaaattcaaattcttgtgagctaatggacaggaaaaaggtttctcttggaacccaacctataacactccgtactttttcgtccaagaatgctacacatgtatttgctgcatcagatagacctacagtcatttatagcagtaacaagaaactactttacagcaatgttaatctgaaggaagttagccatatgtgtcctttcaattctgctgcttttccagacagccttgcaattgcaaaggaaggagaactcacaattggcaccattgatgatattcaaaagcttcatatccgctctatcccgcttggggagcatgcacgccgcatctgccatcaggagcagtccagaacatttgccatttgcagtttgagatataaccaatcaggcacagaagacactgaaatgcattttattcgcttattagatgaccaaacattcgagtccatctcaacttatgctctcgacacttacgagtatgggtgttctattcttagctgctctttctcagacgacagtaatgtatattactgtgttggaactgcatatgttatgccagaagaaaatgaaccaaccaagggccggatattggtttttgttgtcgaggaaggtaagctacagcttattgctgagaaagaaaccaagggatctgtttattccttgaatgccttcaacggaaagcttctggctgctattaaccagaaaattcaattatacaagtggacacttcgagatgatggtactcgtgagttacaatctgaatgtgggcaccatggacatatacttgctctctacgtgcaaacccgtggagatttcattgttgttggtgatttgatgaaatccatatccctgttaatctacaagcatgaggaaggtgctatcgaggagagagcccgcgactacaatgcaaattggatgtcagcagtcgaaatcctcgatgatgacatttaccttggtgctgaaaattacttcaacctcttcactgttcgaaagaatagtgaaggagcgactgatgaggagcgcagccgcctagaggtggttggtgaataccaccttggcgagtttgttaaccggttccgacatggctcgcttgtaatgcgtttaccagattctgatgtcggccaaattccgacagtcatttttggctctgtcaatggcgtaattggggtcattgcttcacttcctcacgaacaatatgtattcttggagaagctccaatccaacttgaggaaagtgattaagggtgtgggagggctgagccatgagcaatggagatctttcaacaatgaaaagagaactgcagaagctaaaaatttcttggacggagatctaatagaatcattcctcgacctcaaccgcagtaaaatggaagaaatttctcgggcgatgggtgtttcggccgaggagctttgcaagagagtagaagaattgacaaggttacattgactcgaaccaggctgtacttctattcaattttatttattcattgtttctcacttctccagaattacgtttggatttggaattactgttgggttacccttgtttagttttggtacaagaatcctaaactgatgtgctgtatatttggtcatccctgttcatagagccgttctgtcgctctgctttatcgccgagcatatggttcaacatgtagctaatagattttattttgaatttaagacttaaa

SEQ ID NO: 3249 - DNA, 3743 bp, Aquilegia formosa
gttcgagagatcgagaaaccaagcaagaagaagaagaattagtagagagagagagagagagagagaagagagatgagttcatggaattatgttgtgacggctcataagccaactagcgttagtcattcgtgtgttggaaatttcacaggaccgcaagaactcaatcttattattgcgaaatgcacacgtatcgagattcatttactcactccacaagggttgcagcccatgctagatgtcccaatatatggaagaattgcaacacttgagctttttcgtccttatggtgaagcacaggatcttttatttattgctacggacaaatataggatatgtgttcttcaatgggatgcagagacatctgaaataatcacaaaatcgaatggagatgtcgcagatcgtattggccgtcctacagacaatggacagcttggtatgattgaccccgattgtagattgatcggtcttcatctttatgatggtttattcaaggttataccctttgataataaaggacagctaaaggaagcatttaacatcaggctcgaagagcttcaagttttggatatcaagttcctctatggttgttcaaaacctacaattgtagtcctctaccaggataataaagatgcacgtcatgttaagacatatgaagttgcattaaaggaaaaagattttgttgagggcccatggtcacagaataatcttgataatggagctggtctggtaatacctgttcctaggccacttggtggtgttataattattggagaggaaacaattgtttattgcagtgctactgcatttaaagccattccaatcagaccatcaattactagagcctacgggagggtagatgctgatggttcacggtacttgctcagcgatcatactgggcttctccatttactggttattacccatgagagagaaagggtgacaggtctcaaaatcgagctcttgggagagacatctattgcatcgacaatatcttatcttgataatgcgtttgtgtttgttggttcaaattatggagattcacagctcataaagttaaatcttcaacctgatgccaaaggatcctatgtagaagttctggaaagatatgttaatttggggcctattgtagatttctgtgtggtcgaccttgagagacaaggccaaggtcaggttgtaacttgctcgggtgcttacaaagatggctctctgcgcatagttcggaatggcatagggatcaatgagcaggcatcagtagaacttcaaggtatcaaagggatgtggtctctaagatcgtctactgatgatccttttgatacatttttggttgtaagctttatcagtgagacacgaattttggcaatgaatcctgatgacgagttagaggagacagagattgaaggttttgattcacaagttcagactttatgttgccatgatgctattcacaatcagcttttacaggtaactgcaagctctgtacgactagtcagttcaacatctcgggagcttcgtaatgaatggaaagcaccgtctggattttcagttaatgttgccacagctaatgcgactcaggttttactagcaactggtggtggtcatttggtgttcctggaagttggcgatgggatattgactgaagttaaacatgcacaattggaatatgaagtatcatgcctcgacataaaccccattggtgaaaactctaacgcgagtcagttggctgcggttggaatgtggacagatatgagtgttcggatattttcccttcctggtctggacctcatcacaaaggagcatttgggaggagagattattcctcgctcagttcttttgtgcgcctttgaaggggtgtcatacttattatgtgctcttggcgatgggcacctgttcaattttcttctgaacctgagtagtggtgaactttcagatagaaaaaaggtttcgttgggaacccaaccaataactcttcgtaccttttcatctaaaaacaccacccacgtatttgctgcttcagataggccaactgtcatctacagcagtaacaaaaaattactctatagtaatgtaaatttgaaagaagtcagccatatgtgccctttcaactctgctgctttcccagacagccttgcgattgcaaaagaaggggaacttacaatcggcacaattgatgatatccaaaagcttcatatacgtacaattccacttggggagcatgctcgacgtatctgtcatcaagagcagtcacgaacttttgccatctgtagtctaaagtattgccagtcaaacgctgaagaatctgaaatgcactttgttcgtttgcttgatgatcaaacctttgacttcatatcaacctatccacttgatacatatgagtatggttgctgcatcctcagttgttcctttgcagatgacagtaatacatattactgtgtgggaaccgcttatgttttacctgaggaaagtgagcctactaaggggagaatactggtctttatagttgaagatggaaagctacagttaattgcggagaaggaaactaaagggtcggtttactctttgaatgctttcaatggaaaacttcttgctgctatcaatcaaaaaattcaactgtataagtggatgttgcgagatgatggttcacgtgagttgcagtctgagtgtggacaccatggacacatacttgcgatatatgtccaaactcgcggagatttcattgttgttggtgatctgatgaagtctatctcactgttaatatataagcatgaggagggtgcaattgaagagcgtgctcgagactacaatgcaaactggatgagtgcagttgagattcttgatgatgacgtttatcttggtgctgagaatagcttcaacctctttactgtcagaaagaacagtgagggtgctaccgatgaggagcggggccgtttagaggttgttggtgaataccacctcggtgagtttgtgaatcggtttcgacatggttcacttgtcatgcgcttgccagattctgatgtgggccagattccaactgtcatctttggcactgttaatggtgttattggggttattgcatcactccctcatgcacaataccttttcttagagaagttgcagtccctcttagtggaagtcatcaagggtgttgggggtttgggtcatgatcaatggagggctttcaataatgagaaaaagaattctgaagcaaaaaatttcttggatggagatcttattgagtcgttcctcgatcttagtcgaagtaggatggatgaaatctccaaagctatgcttatttcaacggaggaactttgcaagagagtagaagagttgacgaggttgcattaaagcaaagggacctattaaaaccatcccctgaagatatggggtgttggtgtttatcttttctgatgtatcttaatgtgtttctttcttgtatttgttctgttcagtatgaaaaatagtcggaaccgcatgtatagtagatgttctttatttctttgtacaactttccatgtggagcatggtcaattgtagtcttgccaacttcaattagtttggggtcgctgttgacttacattttgaatcttgtaggcggcagctagtgtttctcaccttctcagttgtcttgagttaaaattgttaagtctggtacaatcccaaccttattgcaaatgttgttattgattcttagtagtcataggttctgtacaaataaacgcactggtgcctatgtgcaacaaagagag

SEQ ID NO: 3250 - DNA, 3368 bp, Allium cepa
acttaaaaaacaataatactaaaatatgagtatgtggaattatgtggtgacggcacacaagccgaccaacgtcacccactcatgcgtcggcaacttcaccagtccccacgagctcaacctaattatcgcaaaatgcactcgcatcgagattcattgtcttactcctcttggcttacagcctaagctggatgttccaatatatggaaggatagctactcttgaactctttagaccacatggtgaacaacaagatttcctgtttatagccacagagagatacaaattttgtgttcttcaatgggatcctgaggcatcagagcttgtaacaagggcaatgggtgatgtctctgacagaataggtcgtccaacggacaacgggcagattggcatcattgatccagattgtagattaattggccttcacttatatgatggtctcttcaaggttataccttttgataacaaagggcaattgaaagaagctttcaacatcaggcttgaagagcttcaagttttggatattaaatttctttatggctgtccaaaacctactattgttgtgctttaccaggacaataaagatgctcggcacgttaaaacatacgaggttgccctcaaagataaagacttcgttgagggcctttggtcacagaacaatcttgataatggggctggtcttttaattcccgttcctatgcctcttggtggagtaattataatcggggaggagactattgtttattgcagtgcaactgcattcaaagctatcccaatcaaaccgtcaataaccagagcatatggaagggtagatgcagatggttctcggtacctacttagtgataatacaggatttctgcacttgcttgttatcacacatgacaaagaaagggtaactggactcaaaattgaacatttaggggagacctctgttgcatcaactatatcttatcttgataatgcagtagtatatgttggttcaagttatggagattcacagctcataaaactgaacatgcaacctgacgcaaatggttcctatgttgaagttcttgaaagatacataaatcttggacctattgttgacttctgtgttgttgaccttgagaggcaaggtcaaggtcaggttgtcacttgctctggagcttatagagatggttcacttcgtgttgttcgaaacggcattggaataaatgaacaggctgctgtagaacttcaaggcgtcaaagggttgtggtcgttacgtgcttctactgatgatccgtacgatacttttttggttgtgagctttatcagtgaaacacgtatcctcgcaatgaatatggaagatgaattagaagaaacagagattgaaggttttcaggctcagacacaaaccttattctgccataatgctatctacgatcagctcatacaggttacttcaaactctgttcggttagtcagttctgcatctcgagagatgttggatcaatggagtgcaccatcgggctattctgtcaatgttgcaacagcaaatgctagtcaggttctgctggctactggcggtgggcatcttgtttatctcgaaattgaggagggaaagttgatcgaaaaaaaatacataaagcttgattatgagatgtcatgtctcgatataaatccaataggagaagattctacaagaagttcatttgcagcagttggaatgtggactgatattagtgtcaagatatattccctgccagatcttgacttgatcacaacagaaaatcttgggggtgaaattatacctcgttctgtccttctatgtaaatttgaaggaatatcatacttattatgtgcccttggagatggtcacttgttcaatttccaattgaatatgagtactggtgaactatctgataggaagaaagtatctcttggaacacaaccaatcactcttcgaacattttcctcgaaagacaccactcatgtgttcgctgcatcagataggcccactgtgatatatagcagcaacaagaaattactttatagtaacgtgaatttgaaagaagttagtcacatgtgtcctttcaactcagctgcgtttccggacagccttgcaattgctaaagagggtgagctttcaattggaactattgacgatattcagaagcttcacattcgctcaattgcattgggagagcatgcacggcgtatctgccatcaggagcagtcacgaacttttgcaatatgtagttacaaaaactgccctactaatacagaagaaaccgaaacacatttccttcgattactagacgatcaaacctttgaatttaaatcgacttaccagttggatacttatgagaatggttgctctatcattagttgttccttctcagatgataataatgtttactattgtgtaggaactgcatatgttttacccgaagaaaatgaaccgaccaaagggcgtattctagtgtttgcagttgaagatggaaagctacagttaatcactgaaaaagaaacaaaaggagctgtatattcccttaacgctttcaatggaaaattgttagtagctataaatcagaagattcaattgtacaaatggatgcttagagaagatggttcacgtgaattgcagtctgaatgtgggcaccatggtcatatacttgctttgtatgttcaaacacgtggtgactttattgtagtaggtgatttgatgaaatctatatcccttttactgtacaagcacgaggaaggagcaatcgaagagagagcacgagactacaacgcgaactggatgacggcggtggaaatcctcagcgacgacatctaccttggcgctgaaaacaacttcaacctcttcaccgtgcgcaggaacagtgaaggcgcaaccgatgaggaacgtggccgtctcgaggtggtgggggagttccacctcggcgagttcatcaaccgcttcaggcacggttccctggtcatgcgcctgcccgactctgagatcagccagatcccaaccgtgatcttcggcaccgtgaacggtgtcattggcgtgattgcttctctaccccacgatctgtacctgtttcttgaaaggcttcagggatgccttaacaaggtcatcaaaggggtgggaggattgcttcatgatcagtggcggtctttctacaatgagaagagaacgtgcgaggcccgtaattttttggatggagatttgatcgagtcgttccttgatttgagtagggggaagatggaggaggtggcgagtgcgatggatgttccggttgaggagctttgcaggaaggtcgaggaactcactaggctgcattagaggttttggaatcatgtatttgtaatgtaatgcctgtggtttttacttctcatttgttttgttgttgaacttg

SEQ ID NO: 3251 - DNA, 3547 bp, Capsicum annuum
caaaccccagcgtagccgcgaactctctcttctcctctttcccccctgcaatagccgtccactgtcctcaccataaatcctcctgcagtgaagttcggcgtattcctgtagtcatcggtggaaagatgagtgtatggaactatgtggttaccgctcacaagccaactaacgttactcattcctgtgttggcaatttcaccgctcctcatgacctcaatctcatcattgcgaaatgtactcgaattgagattcatttactcaccccccaaggtttacagcctatgttagatgtgccaatatatgggagaatcgcgacacttgagcttttccggccccacggtgaaacacaagatcttctcttcattgcaacggagcgatataaattctgtgtccttcaatgggatgctgaggcatctgaagttatcacaagagcaatgggagatgtgtcagatcggataggccgtcccacggataatggtcagattggtataatcgatccagactgcagattgatcgggctgcatctttatgatggactatttaaggttattccatttgataacaaaggccaactgaaggaagcttttaacatcaggcttgaggagcttcaagttttggatattaaattcttgtatggttgcccaaagcctaccattgtggttctatatcaggataacaaggatgcccgacacgtcaaaacatatgaggtgtcattgaaggataaagattttattgaagggccatgggctcagaataatcttgataatggagcttctttgctaataccagtacctccaccactgtgtggtgtattgattattggagaagaaaccattgtttattgcagcgcttcagcttttaaggctatcccaattagaccctctatcacaagagcatatgggcgagttgatgctgatggctctcggtatttgcttggggatcataatgggcttcttcacctacttgtaattactcatgaaaaggagaaagttaccggcctcaaaattgagctactgggagaaacttctattgcatcaaccatatcatacctagacaatgcttttgtcttcattggctcaagctacggagattcacagcttgtaaagctcaatctccagcctgacgccaaaggttcttatgtggaagttctagaaagatatgttaatttgggaccaattgtggacttctgtgttgttgacctggagcggcaaggtcaaggtcaggttgtgacttgctctggagcctataaggatggatcgcttcgtattgttcgaaatggaattggcataaatgaacaggcatctgtggaactacaagggattaaaggaatgtggtctcttagatcagctactgatgatccgtatgacacattcttggttgttagcttcattagcgagacacgtgttttggctatgaaccttgaggatgagctggaagaaactgagatagaaggcttcaattctcaagtccaaaccttgttttgtcatgatgctgtatacaatcagctagtacaggttacttcaaactctgttaggttggtcagttctagctctagagagctgaagaacgaatggtttgctccagccggctactccgtcaatgttgcaactgctaatgccactcaggtactgttggctactgggggtggccatctggtatacctggaaattggtgatggggtgttgaatgaagtaaaatatgccaagttggattatgacatctcatgcctggacataaatccaattggtgaaagtccaaactacagtaacattgcagcagttgggatgtggacagacataagtgtcaggatatattcacttccagatttgaatctcattacaaaggaacagctaggaggggagataattcctcgttctgttcttatgtgttcctttgaagggatatcttatttactatgtgctttgggagatggccatctcttgaattttgtattgagcatgagtactggtgaactgacagataggaaaaaagtgtctcttgggacccagcccataacccttcgtacattctcatctaaagatgctacacacgtctttgctgcctccgataggcccacagttatttacagcagtaacaagaagctgctttatagcaatgtaaatctaaaagaagttagtcatatgtgcccattcaatgttgcagcttttccagacagtcttgcaatcgctaaagaaggtgaattaacaattggcactattgatgaaattcaaaagcttcacatccgttcaataccccttggggagcatgcacgtcgcatcagtcatcaagagcagacccgtacatttgctctatgcagtgtaaagtatactcagtcaactgcagatgatcctgaaatgcattttatccgcctgctagacgatcagacatttgagttcatatcaacgtatccccttgaccaatttgaatatggttgctccatacttagctgttccttttctgatgatggtaatgtgtattattgcattggaactgcatatgtgatgccagaggaaaatgaacctaccaagggccgaattctagtttttattgttgaagatggaaaactccaactaattgcagagaaggaaactaagggagccgtctactctctaaatgccttcaacgggaagctgcttgctgcaatcaatcagaagattcaattgtacaagtgggcttcgcgtgaggatggtggcagccgagaattgcagacagaatgtggacaccatggtcatatattagctctttatgttcaaactcgtggggattttattgtcgttggtgatttgatgaagtccatttctctgctgattttcaagcatgaggagggtgctatagaggagcgagcgcgagactataatgcaaattggatgtcggctgttgagattctcgatgatgacatttatcttggtgctgagaacaactttaaccttttcacagtcaggaaaaatagcgaaggtgctacagatgaggagcgcagccgtcttgaagtggttggtgaataccacctcggtgaatttgttaacaggtttagacacggttcacttgtcatgcgactgccagattcagacgttggccagatacccactgtcatatttggcacagtaaatggtgttataggggtcattgcttcgcttcctcatgatcagtatttatttttggagaagctgcagtcaaatttacgtaaagtgataaagggtgtgggaggactgagccatgagcagtggaggtcgttttacaatgagaagaaaactgtagatgctaaaaactttcttgacggggatttgattgagtcattcctagatcttagtaggaatcggatggaagagatttccaaagcaatgtcagttccagttgaggaactaatgaagagagtggaagagttgacaaggttgcattagttaaaatctttaatggtctttagctctttcccagctttgtaatatttcacatttctcgtttgttttctttttggtttttgtgtgagattgtgacacaagttcttatccgtatatctgtacttatcatttaatatattttaatcactact

SEQ ID NO: 3252 - DNA, 3489 bp, Prunus persica
agaagaagatgagtgtctggaactatgtggtcacggcccacaagcccaccaacgtcaccaactcatgcgttggcaatttcaccggacctcaggagctcaatctcatcatagcgaaatgtacacgtattgaaattcttctacttactcctctgggcttacagcctatcttggatgtgccaatatacggaaggatagcgacactccaactttttcgacctcatggtgaagcacaagattttctatttattgccacagaaagatacaaattttgtgttcttcaatgggatgccgaaacatctgagctcattacaagggcaatgggggatgtctcggatcgcataggtcgtcctacagacaatggtcaaattggtataattgatccagattgcagattaattggactccatttgtatgatggattgtttaaggttattccttttgataataaagggcagctcaaggaggcatttaacattcggcttgaggaacttcaagttttggatatccagtttctctatggttgttcaaaaccaaccattgtagttctgtatcaggataacaaagatgctcgccatgtcaaaacatatgaagttgctctgaaagataaagattttgttgagggtccttgggcacagaacaaccttgacaatggggctgatttgttgataccagttcctccaccactttgtggcgttctgattattggagaagaaacaattgtttattgcagtgccaatgcatttaaagcaatcccaataagaccttccatcacgagagcctatgggagagtagatgcagatggttctaggtatttgcttggtgatcatgccgggcttcttcacctacttgttataacccatgagaaagaaaaggtgactggactcaaaattgagctcttgggagagacttccattgcatctactatttcataccttgataatgcatttgtctatatcggatcaagctatggggattcacagcttgtaaagctaaatctacagccggatgcaaaaggttcatatgtcgaagttttagaacggtatgtcaatttggggccgatagttgacttttgtgtggttgatcttgagaggcaaggccaaggtcaggtcgtaacttgttctggagcttacaaggatggttctcttcgcgtagttcgaaatggaattggaatcaatgaacaggcatcagttgagcttcaaggtattaagggaatgtggtcattaagatcctccactgatgatccccatgacaccttcctggttgtaagctttatcagtgagacacgaattttggcaatgaatcttgaggatgagttggaagaaactgagatagaaggcttctgttctcaagtgcagactttattttgccatgatgctgtcttcaatcaacttgtgcaggtcacttcgagctctgtaagactagtcagttctacatctagggagctgaagaacgagtggtttgctccagcaggctattcgatcaatgttgccactgctaatgccacccaggttttattggcaaccggaggaaagcatttagtttatttagaaattggtgatggggtattgacacagaaaacccatgcacagttggactttgagatctcatgccttgacataaaccccataggtgaaaatcccaattatagccagctagcagccgttggaatgtggacagatataagtgtccagatatattcacttcctgacctgagccgcatcaccaaggaacatttgggaggagagatcatacctcgttctgttcttctttgtgcctttgaagggatatcctatctgttatgtgcccttggagatgggcacctcttaaattttatattgaacacgagtactggtgagttaacagacaggaaaaaagtctctcttgggactcaacccattacactccgtactttctcatccaagagtactacgcatgtatttgctgcgtcggataggccaactgtcatttacagtagcaacaagaagctgctttacagcaacgtaaatttgaaagaagtcagccatatgtgcccattcaactctgctgcttttccagacagccttgcgattgctaaagaaggtgaactaactattggcacaattgatgacatccagaagcttcatattcgctctattcccttaggggagcatgcacgccgtatctgccatcaggagcagtccaggacctttgccatatctagcgtgaaatataaccagtctagtgcagaagattcagaaacacacttcatccgcttgttagatgaccagagttttgacctcataacatattatcaactcgatgcttttgagtatggctgctccatacttagctgttccttctctgatgacagtaatgtatattactgtgtcgggacggcatatgttctcccagaagaaaatgagccaaccaaaggtcgcattctagttttcacggttgaagatgggaagctgcaactcgtcgctgagaaggaaaccaagggtgctgtttactctttgaatgcattcaatggcaagttacttgctgctatcaatcaaaagatacagatatacaagtggactctgcgggatgatggtactcgcgagttgcaatcggaatgcggacatcacggccacatactagcgctttatgtccagactcgtggtgatttcattgttgttggggatttgatgaagtcaatttctctgttaatctacaagcacgaggaaagttccattgaggagcgagcacgtgactataatgcaaattggatgtcagctgtagagatccttgatgatgatgtttaccttggagctgaaaacttcttcaacctcttcagtgttcggaaaaatagtgaaggtgcaactgatgaggaacgtggccgtcttgaggttgttggtgagtatcacctaggtgaatttgtcaataggtttcggcatggctctcttgtcatgcgcttgccagactcggatgtgggccagatcccaactgttattttcggcactgtcaacggtgtaattggagtcattgcctcacttccccaagagcagtatgtgtttttggagaagctccagtcaaacttgagaaaggtaataaagggtgttggagggttaagccatgagcagtggaggtcattcaacaatgagaagaaaactgtagatgccaaaaatttcttggacggcgatctaatcgaatcgttccttgatctcagccgtagcaagatggatgaaatttcaaaacaaatgcgcgtttcagtggaggagctctgcaaaagagtagaagaattgacaaggctgcattgagtcagttgatgtttttatttgttaattcttttttctttccccattgttacataacgccggacgatggggcctgtttcttctattttggatagcatgagtggtatatattggcactgtatctccgatgtgttgtgtaaaatacttggcagtgaacttcggtgatgcttccttttgagttaaatgggaaattataacaagaaaaccttatatt

SEQ ID NO: 3253 - DNA, 3531 bp, Solanum phureja
ttttctattttcaagtgattcaactgaaacaagttttagggtttgtaggtatagcgggaagagagaagatacaagatgagtgtatggaactacgtggttacggctcacaagccaacaaatgttacacattcctgtgttggcaatttcactggtcctcaagagctcaatcttatcattgcgaaatgtactcgaatcgagattcatttactcactccccaaggtttacagccaatgttagatgtgccgatatatgggagaatcgcgacacttgagcttttccgtcctcacggtgaaacacaagatcttctcttcatcgcaacagagcgatataaattctgtgtccttcaatgggacactgaggcatctgaagttatcacaagagcaatgggagatgtgtcagaccgaataggccgtcccacagataatggtcagattggtataattgatccagactgcagattgatcgggctgcatctttatgatggactatttaaggttattccatttgataacaaaggccaactgaaggaagcttttaacatcaggctcgaggagcttcaagttttagatattaaattcttgtatggttgcccgaagcctacaattgttgttctatatcaggataacaaggatgcccgacatgtcaaaacatatgaggtgtccttgaaagataaagattttattgaaggtccatgggctcagaataatcttgataatggagcttctttgctaataccagtacctccgccactgtgtggtgtattgattattggagaagaaaccatcgtttattgcagcgcttcagcttttaaggctatcccaattagaccttctatcacaagagcatatgggcgggttgatgctgatggttctcgatatttgcttggggatcataatgggcttcttcacctacttgttatcactcatgagaaggagaaagttaccggacttaaaattgagctactgggagaaacttctattgcatcaaccatatcatacctagacaatgcttttgtcttcattggctcaagctatggagattcacagcttgtaaagctcaatctccagcctgacaccaaaggttcttatgtggaagttctagagagatatgtcaatttgggacctattgtggacttctgtgttgttgatctggagaggcaaggtcaaggtcaggttgtaacttgctctggagcctataaggatggatcgcttcgtattgttcgaaatggaattggcataaatgaacaggcgtctgtggaactacaagggatcaaaggaatgtggtctcttagatctgctactgatgatccatatgacacattcttggttgttagcttcattagtgagacacgcgttttggctatgaaccttgaggatgagctggaagaaactgagatagaaggcttcaattctcaagtccagaccttgttttgtcatgatgctgtatacaaccagcttgttcaggttacttcaaattctgttagactggtcagttctacctctagagatctgaaaaacgaatggtttgccccagccggctactcggtcaatgttgcaactgctaatgccactcaggtactattggctactgggggtggccatctggtatacctagaaattggtgatggggtgttgaatgaagtaaaatatgccaagttggattatgacatctcgtgcctggacataaatccaattggtgaaaatccaaactacagtcccattgcagcagttggaatgtggacagacataagtgtcaggatatattcacttcccgacttgaatctcattacaaaggaacagctaggaggggagattattcctcgttctgttctgatgtgttccttcgaagggatatcttatctactatgtgctttgggagatggccatctcttgaattttgtattgagcatgagtactggtgagctgacagataggaaaaaagtatctcttgggacacagcccataacacttcgtacattctcatctaaagatactacacacgtctttgctgcctccgataggcccacagttatttacagcagtaacaagaagctgctttatagcaatgtaaatctaaaagaagttagtcatatgtgcccattcaatgttgcagcttttccagacagccttgcaatcgctaaagaaggtgagttaacaattggcactattgatgaaattcaaaagcttcacatccgttcaataccccttggggaacatgcacgtcgcatcagccatcaagagcagacccggacatttgctctatgcagtgtgaagtatactcagtcaaatgcagatgatcctgaaatgcattttgtccgcctgttagatgatcagacatttgagttcatatcaacgtatccccttgaccaatttgaatatggctgttccatactaagctgctccttttctgatgatagtaatgtgtattattgcattggaactgcatatgtgatgccagaggaaaatgaacctaccaagggccgaattttagtttttatagttgaagatggaaagctccaactaattgctgagaaggaaactaagggagctgtctactctctaaatgccttcaatgggaaactgcttgctgcaatcaatcagaagattcaattgtacaagtgggcttcgcgtgaggatggtggcagccgagaattgcagacagaatgtggacaccatggtcatatattagctctttatgttcaaacgcgtggggatttcattgttgttggtgatttgatgaaatccatttccctgctgattttcaagcatgaagagggtgctatagaagagcgagctcgagactataatgcaaattggatgtcagctgttgagattcttgatgatgacatttatcttggtgctgagaataactttaaccttttcacggtcaggaaaaatagtgaaggtgctacagatgaggagcgcagccgtcttgaagtggttggtgaataccatcttggtgaatttgttaataggtttagacacggttcgcttgtcatgcgactaccagattcagacgttggccagatacccaccgtcatatttggcacagtgaatggtgttataggggtcattgcatcgctacctcatgatcaatatttatttttggaaaagctgcagacaaacttacggaaagtgataaagggtgtgggaggtctgagccacgagcagtggaggtcgttttacaatgagaagaaaactgtagatgctaaaaactttcttgatggagatttgattgaatcattcctagatcttagcaggaatcggatggaagagatttctaaagcaatgtcagttccagttgaggaactaatgaagagagtggaagagttgacaaggttgcattagttaaatctttaatggtctcaactctgtaatatttcacatttcttccttaattttttttcttctttttcttctgtgaggttgtgatacaagttcttatccttatatctgtacttatcatctcatatatttttagtagctgttgaatttttattttaagttgaaaaagaatcatttgcaaaccca

SEQ ID NO: 3254 - DNA, 3605 bp, Eutrema halophilum
gtctctccgtctctctctccttcgttaaaattcccaaagctcgttagagaaatccagaagcttcctacaattagaggagcgaaaggccctcgcgtagacagtgaaactccaatttctggggacaaataagcagaagatgagctcatggaattacgtcgtcactgctcacaagcccaccagtgtcactcactcttgcgtcggcaacttcaccagtcctcaagagctcaacctcattgtcgcgaaatgtactcggattgagatccatttgcttaccccacagggacttcagcctatgctggatgttcctatgtatggaagaatcgctactttggagttgttccggccccatggagaagcacaagactttttgtttattgcaactgagagatacaaattctgtgttcttcagtgggatgctgagtcgtctgagcttattactagagcaatgggggatgtttctgatcgtataggtcgaccaacagacaatggtcagattggcataattgatccagattgtagattaattggactccatctgtatgacggtttgttcaaggttataccatttgataataagggacagctcaaggaagcttttaatatcaggctggaggaattgcaggttctggatatcaagtttctgtttggatgtgcaaagcccacaattgcagtactttatcaggacaacaaagatgctcgtcatgtcaaaacatatgaagtctctctaaaagataaggattttgtcgagggtccgtggtcacagaacaatctcgacaatggtgctgacttgctgattcctgtaccaccacctctctgtggcgtccttattattggtgaagaaacaattgtctattgcagtgcgaatgcattcaaagcaataccaataagaccttccatcactaaagcatatggaagagttgatgttgatggctctaggtatcttcttggtgaccatgctggactgattcatctgcttgttataacgcacgagaaagaaaaggtcactggcctaaaaattgagcttctgggtgaaacctctattgcatcgactatatcgtaccttgacaatgctgttgtctttgtcggctcaagctatggcgattcacagctagtaaagctaaatctacatcctgatgcaaaaggctcatatgtagaagtcttggaaaggtatgtcaacttggggcctattgtcgacttttgtgtagtcgacctcgagagacaggggcaaggtcaggttgtaacttgttctggagcatttaaggatggttccctccgcatagttcgcaatggaataggaatcaatgaacaggcgtctgtggaacttcaaggtatcaagggaatgtggtcgctgaagtcttcaattgatgaagccttcgacacattcctcgtagtcagctttatcagtgaaactcgtgtattagccatgaatcttgaggatgaactggaagaaacagagattgagggcttcttgtctcaagtgcagactttattttgccatgatgctgtgtataatcagcttgtacaggttacttcaaattctgttagactagtcagctctacaactagagagttgcgagatgaatggcatgccccagctggattcactgtcaatgttgcaaccgcaaatgccagccaggttcttttggcgactggaggtgggcatttggtttatctagaaattggagatgggaaattaacagaagtgcaacatgccgttttagagtacgaggtttcttgccttgatataaatcctatcggcgataatcctaattacagtcagctagcttcggttgggatgtggacagatataagtgtgaggattttttcgctgccggaactgactcttattacaaaagagcaactaggaggagaaataattccccgatctgttctgctctgtgcattcgaagggatatcttacttgctctgtgctcttggagatggccatcttttgaacttccagttggatacaactaccgggcaactaaaagacaggaaaaaagtatcactcgggactcagcctataactctgcgcacattttcatcaaaaaacgccacacatgtttttgctgcatcagatagaccaactgtaatctatagcagcaacaagaagctgttatacagcaatgtcaatcttaaagaagttagtcatatgtgtcctttcaactctgctgcttttcccgacagtttagcgattgctagagaaggtgaacttacgattggcaccattgatgatattcagaagcttcacatacgcactattcctcttggagagcatgctcgtcgaatctgccatcaggaacagacgcgtacatttggtatttgcagtttgggaaaccagacaaatgctgaggaatctgaaatgcattttgttcgtcttttagacgaccaaagttttgaatttgtgtcaacttacccattggatgcctttgagtacggttgctccatacttagctgctcgttcgccgacgacaagaatgtctattactgtgttggaactgcatatgttttaccagaagaaaatgaaccaactaagggaaggatattagtgtttatagttgaagatgggaaattgcagcttatcgctgagaaagaaaccaaaggatctgtttattctctcaatgcctttaatggaaaacttcttgctgctattaatcagaagattcaattatacaagtggatgctccgggatgatggcactcgtgaattacagtctgaatgtggacatcacgggcacattctagctctctatgtccagacgcgtggagactttattgtggttggtgatctcatgaaatcaatctccttactgatctataagcacgaggaaggtgcaattgaggaacgggctcgggattacaatgcaaattggatgtctgctgttgaaatactcgacgacgatatctaccttggtgctgagaacaatttcaatcttttgacagtgaaaaagaacagcgaaggtgctactgatgaagagcgagggcgtttagaggtggttggggagtatcaccttggggagtttgtgaacagattccgccatggatcactggtaatgaggctgcctgattcagagattggtcagatcccaactgttatctttggtacagtcaatggagtgattggagtgatagcttcactgcctcaagaacagtatatgttcttggagaaattgcagtcgagtttgaggaaagtgattaaaggggttggtgggttaagccatgagcaatggagatcgtttaataatgagaagagaaccgcagaagcacgtaatttcttggatggggacttgatcgaatcgtttctggatctgagtaggaacaagatggaggatatatctaaatccatgaatgttcaagtggaagagttgtgtaagagagttgaagagctcactaggcttcactgagccaaacagtcaaaaccataagctctgtttctgttttaattttatgctttcttgagttaaaagtcttcttttggttttgttatcctcaccttttgaagtttgtaataacttggctaaagtgttgttttcttaatcaaaccaattgtctttttgagtcatttggattaaaaataatggtgaatcagttggtcgaactatatta

SEQ ID NO: 3255 - DNA, 3715 bp, Arabidopsis thaliana
gtctttcttcttccttgttcgattttcgcctcctttggcttttcattctctctctaacttctctatgttaaaattccgaaagctcgattcagaaatctagaagcttcctcgagggccctcgcgtagaaagtcgaactcaaattccctggagacaaagaagaggaagatgagctcatggaactacgttgttacggctcacaaaccgaccagtgtcactcactcgtgcgttggcaacttcacaagtcctcaagagctcaatctcattgtcgcgaaatgtactcgaatcgagatccatttgcttaccccacaaggacttcagcctatgttggacgttcctatatatggaagaatcgctactctggagttgttccgaccccatggcgaagcgcaagactttttgttcattgcaactgagagatacaaattctgtgttcttcaatgggatcctgagtcctctgagcttattacaagagcaatgggggatgtttctgatcgtataggccggccaacagacaatggtcagattggtataattgatccagattgtagattaattggactccatctgtatgacggcttgttcaaggttattccatttgataataagggacagctcaaggaagcttttaatatcaggcttgaggaattgcaggttctggatatcaagtttctgtttggatgtgcaaagcccactattgcagtactatatcaggacaacaaagatgctcgtcatgtcaaaacatatgaagtctctcttaaagataaggattttgtcgagggtccatggtctcagaacagtctcgacaatggtgctgacttgctgattcctgtaccaccaccgctctgtggtgtccttattattggtgaagaaacaattgtctattgcagtgctagtgcattcaaagcaataccaataagaccttccatcactaaagcatatggaagagttgatgttgatggctctagatatcttcttggtgaccatgctggaatgattcatctgcttgttataacgcacgagaaagaaaaggtcactggcctaaaaattgagcttttgggtgaaacatctattgcatcgactatatcgtaccttgacaatgccgttgtctttgtcggctcaagctatggtgattcacagctagtaaagctgaatctacaccctgatgcaaaaggctcatatgtagaagtcttggaaaggtatatcaacttggggcctattgtcgacttttgtgtagttgacctcgagagacaggggcaaggtcaggttgtaacttgttctggagcatttaaggatggttccctccgcgtagttcgcaatggaataggaatcaatgaacaggcgtctgtggaacttcaaggtatcaaaggaatgtggtcgttgaaatcttcaattgatgaagccttcgatacatttcttgttgttagctttatcagtgaaactcgcatattagccatgaatcttgaggatgaactggaagaaacagagattgagggcttcttgtctcaagtgcagacgttattttgccatgatgctgtgtacaatcaacttgtacaggttacctcaaattctgttagactagtcagttctacaactagagaattgcgggacgagtggcatgccccagctggattcactgttaatgttgcaactgcaaatgccagccaggttcttttggcgactggaggtgggcatttggtttatctagaaattggagatgggaaattgacggaagtgcaacatgcccttttggagtacgaggtttcctgtcttgatataaaccctatcggtgacaatcctaattacagtcagctagctgcggttgggatgtggacagatataagtgtgaggatcttttcgctgccagaattgactcttattacaaaagagcaacttggaggggaaataattccccgatctgttcttctttgtgcattcgaagggatatcttacttgctatgtgctcttggagatggccatcttttgaacttccagatggatacaactaccggacaattaaaagacaggaaaaaagtatcactcgggactcagcctataactctgcgtacattttcatcaaaaagcgccacacatgtctttgctgcatcagatagaccaaccgtgatctatagcagcaacaagaagctgttatatagcaatgtcaatcttaaagaagttagtcatatgtgccctttcaattctgctgcttttcccgacagtttagcaattgccagggaaggtgaacttacgattggaaccattgatgatattcagaagcttcacatacgtactattcctcttggagagcatgctcgtcgaatttgccatcaggagcagacacgtacatttggtatctgcagtttgggaaaccagtcaaattccgaagaatctgaaatgcactttgtccgtcttttggacgaccagactttcgagtttatgtcaacttaccccttggattcctttgaatatggttgttcaattctgagctgctcattcaccgaagataaaaatgtctattactgcgttggaaccgcatatgttttaccggaggaaaatgaaccaactaagggaaggatattagtatttatagtcgaagatgggaggttgcagctaatcgccgagaaagaaaccaaaggagctgtttattctctcaatgcctttaatggaaaacttcttgctgctattaatcagaagattcagttgtacaagtggatgctgagggatgatggcactcgtgaactgcagtctgaatgcggacatcacggacacattctagctctctatgtgcagacccgtggagactttatagttgttggtgatctcatgaaatcaatctccttattgctatacaagcacgaggaaggtgcaattgaggagcgggctcgggattacaatgcaaattggatgtcagcggttgagatactcgatgatgatatttacctcggtgctgagaacaatttcaatctgttaacagtgaaaaagaacagtgaaggtgctactgatgaagaacgaggacggttagaggtagttggagagtatcaccttggggaatttgtgaacagattccgccatggatctctagtaatgaggctacctgattcagagattggtcagatcccaactgtcatctttggtacagtcaatggagtgattggagtaatagcttcacttcctcaagaacaatatactttcttggagaagttgcagtcaagtttgagaaaagtgattaaaggagtcggcggattaagccacgagcaatggaggtcgtttaataacgagaaaagaaccgcggaagcgaggaatttcttggatggtgacttaatcgaatcgtttctggatctgagtagaaacaagatggaggatatatcgaaatccatgaatgttcaagtggaggagttgtgtaagagagttgaagaactcactaggcttcactgagtcaaatcaatcatcaatcaacgccaataggctttgttttattttatttctttttaagctttcttgagttaaaagtcttcttttgggttttgtgtcttgtaatattaatagcttgtgttggttaaactattgtcttctaaatcgaaccggcaagcaaaccggactgtcttctgggtcccttgacttgatccaaacctatatacatgtttttattttagttttttttctacatattatcaaatatggttttgttaaacgaaacttattatgttttaactgttc

SEQ ID NO: 3256 - DNA, 3644 bp, Solanum lycopersicum
gaactctgtcaacatactagatgtttctcttcattgccgatatatatatgctgtgtctcgttttcccccatttgtgtctcttttctattttcaagtgattcaactgaaacaagtattagggtttgtaggtatagcgggaagaaagaagatacaagatgagtgtatggaactacgtggttacggctcacaaaccaacaaatgttacacattcctgtgttggcaatttcaccggtcctcaagagctcaatcttatcattgcgaaatgtactcgaatcgagattcatttacttactccccaaggtttacagcctatgttagatgtgccaatatatgggaggatcgcgacacttgagctttttcgtcctcacggtgaaacacaagatcttctcttcatcgcaacagagcgatataaattctgtgtccttcaatgggatactgaggcatctgaagttatcacaagagcaatgggagatgtgtcagaccgaataggccgtcccacagataatggtcagattggtataattgatccagattgcagattgatcgggctacatctttatgatggactatttaaggttattccatttgataacaaaggccaactgaaggaagcttttaacatcaggctcgaggagcttcaagttttagatattaaattcttgtatggttgcccaaagcctacaattgttgttctatatcaggataacaaggatgcccggcatgtcaaaacatatgaggtgtccttgaaagacaaagattttattgaagggccatgggctcaaaataatcttgataatggagcttctttgctaataccagtacctccgccactgtgtggtgtattgattattggagaagaaaccatcgtttattgcagcgcttcagcttttaaggctatcccaattagaccttctatcacaagagcatatgggcgggttgatgctgatggttctcgatatttgcttggggatcataatgggcttcttcacctacttgtaatcactcatgagaaggagaaagttaccggactcaaaattgagctactgggggaaacttctattgcatcaaccatatcatacctagataatgcttttgtcttcattggctcaagctacggagattcacagcttgtaaagctcaatctccagcctgacaccaaaggttcttatgtggaagttctagagagatatgtcaatttaggacctattgtggacttctgtgttgttgatctggaaaggcaaggtcaaggtcaggttgtaacttgctctggagcctataaggatggatcacttcgtattgttcgaaatggaattggcataaatgaacaggcgtctgtggaactacaagggatcaaaggaatgtggtctcttagatctgctactgatgatccatatgacacattcttggttgttagcttcattagtgagacacgcgttttggctatgaaccttgaggatgagctggaagaaactgagatagaaggcttcaattctcaagtccagaccttgttttgtcatgatgctgtatacaaccagcttgttcaggttacttcaaattctgttagattggtcagttctacctctagagatctgaaaaacgagtggtttgccccagtcggctactcggtcaatgttgcaactgctaatgccactcaggtactattggctactgggggtggccatctggtatacctagaaattggtgatggggtgttgaatgaagtaaaatatgccaagttggattatgatatctcgtgcctggacataaatccaattggtgaaaatccgaactacagtaacattgcagcagttggaatgtggacagacataagtgtcaggatatattcacttcctgacttgaatctcattacaaaggaacagctaggaggggagataattcctcgttctgttctgatgtgttccttcgaagggatatcttatctactatgtgctttgggagatggccatctcttgaattttgtattgagcatgagtactggtgagctgacagataggaaaaaagtttctcttgggacacagcccataacacttcgtacattctcatctaaagatactacacatgtctttgctgcctccgataggccaacagttatttacagcagtaacaagaagctgctttatagcaatgtaaatctaaaagaagttagtcatatgtgcccattcaatgttgcagcttttccagacagccttgcaatcgctaaagaaggtgagttaacaattggcactattgatgaaattcaaaagcttcacattcgttcaataccccttggggagcatgcacgtcgcatcagccatcaagagcagacccggacatttgctctatgcagtgtgaagtatactcagtcaaatgcagatgatcctgaaatgcattttgtccgcctgttggatgatcagacatttgagttcatatcaacatatccccttgaccaatttgaatatggctgttccatactaagctgctccttttctgatgatagtaatgtgtattattgcattggaactgcatatgtgatgccagaggaaaatgaacctactaagggccgaattttagtttttatagttgaagatggaaagctccagctaattgctgagaaggaaactaagggagctgtctactctctaaatgccttcaatgggaaactgcttgctgcaatcaatcagaagattcaattgtacaagtgggcttcgcgtgaggatggtggcagccgagaattgcagacagaatgtggacaccatggtcatatattagctctttatgttcaaacgcgtggggatttcattgttgttggtgatttgatgaaatccatttctctgctgattttcaagcatgaagagggtgctatagaggagcgagccagagactataatgcaaattggatgtcagctgttgagattctcgatgatgacatttatcttggtgctgagaataactttaaccttttcacggtcaggaaaaatagtgaaggtgctacagatgaggagcgcagccgtcttgaagtggttggtgaataccaccttggcgaatttgttaataggtttagacatggttcacttgtcatgcgactaccagattcagatgttgggcagatacccaccgtcatatttggcacagtgaatggtgttataggggtgattgcatcactacctcatgatcaatatttatttttggagaagctgcagacaaacttacggaaagtgataaagggtgtgggaggtctgagccatgagcagtggaggtcgttttacaatgagaagaaaacagtagatgctaaaaactttcttgatggagatttgattgaatcattcctagatcttagcaggaataggatggaagagatttcaaaggctatgtcagttccagttgaggaactaatgaagagagtggaagagttgacaaggttgcattagttgaatctttaatggtctcaactctgtaatatttcacatttcttaatttttttttcttcttcttctgtgaggttgtgatacaagttcttatccctatatctgtacttattatctcatatacttttaatagctgttgaatttttattttaagttgaaaaagaatcatttgcaaacccaaatgtccaattttttggctcccatttaattgcatcctac

SEQ ID NO: 3257 - DNA, 3635 bp, Prunus mume
aggaaagaattagccgaatccgctcaaaacgaagagagaaagtagagaagtgagagagagaggctgcttctagggctcactggttcggcgccatttctacacaaagcaagatatttgccgcaaacaaattcggacgcagaagaagaagaagatgagtgtctggaactacgtggtcacggcccacaagcccaccaacgtcaccaactcatgcgttggcaatttcaccggacctcaggagctcaatctcatcatagcgaaatgtacacgtattgaaattcttctacttactcctctgggcttacagcctatcttggatgttccaatatacggaaggatagcgacactccaactttttcgacctcatggtgaagcacaagattttctatttattgccacagaaagatacaaattttgtgttcttcaatgggatgccgaaacatctgagctcattacaagggcaatgggggatgtctcagatcgcataggtcgtcctacagacaatggtcaaattggtttaattgatccagattgcagattaattggactccatttgtatgatggattgtttaaggttattccatttgataataaagggcagctcaaggaggcatttaacattcggcttgaggaacttcaagttttggatatccagtttctctatggttgttcaaaaccaaccattgtagttctgtatcaggataacaaagatgctcgccatgtcaaaacatatgaagttgctctgaaggataaagattttgttgagggtccttgggcacagaacaaccttgacaatggggctgatttgttgataccagttcccccaccactttgcggcgttctgattattggagaagaaacaattgtttattgcagtgccaatgcatttaaagcaatcccaataagaccttccatcacgagagcctatgggagagtagatgcagatggttctaggtatttacttggtgatcatgccgggcttcttcacctacttgttataacccatgagaaagaaaaggtgactggactcaaaattgagctcttgggagagacatccattgcatctactatttcataccttgataatgcatttgtctatatcggatcaagctatggggattcacagctggtaaagctaaatctacagccggatgcaaaaggttcatatgtcgaagttttagaacggtatgtcaatttggggccgatagttgacttttgtgtggttgatcttgagaggcaaggccaaggtcaggtcgtaacttgttctggagcttacaaggatggttctcttcgtgtagttcgaaatggaattggaatcaatgaacaggcatcagttgagcttcaaggtattaaaggaatgtggtcattaagatcctccactgatgatcctcatgacaccttcctggttgtaagctttatcagtgagacacggattttggcaatgaatcttgaggatgagttggaagaaactgagatagaaggcttctgttctcaagtgcagactttattttgccatgatgctgtcttcaatcaacttgtgcaggtcacttcgagctctgtaagactagtcagttctacatctagggagctgaagaacgagtggtttgctccagcaggctattcgatcaatgttgccactgctaatgccacccaggttttattggcaactggaggaaagcatttagtttatttagaaattggtgatggggttttgacacagaaaacccatgcacagttggactttgagatctcatgccttgacataaaccccataggtgaaaatcccaattatagccagctagcagccgttggaatgtggacagatataagtgtccagatatattcacttcctgacctgagccgcatcaccaaggaacatttgagaggagagatcatacctcgttctgttcttctttgtgcctttgaagggatatcctatctgttatgtgcccttggagatgggcacctcttaaattttatattgaacacaagtactggtgagttaacggacaggaaaaaagtctctctcgggactcaacccattacactccgtactttctcatccaagagtactacgcatgtatttgctgcatcagataggccaactgtcatttacagtagcaacaagaagctgctttacagcaacgtaaatttgaaagaagtcagccatatgtgcccattcaactctgctgcttttccagacagccttgcgattgctaaagaaggtgaactaactattggcacaattgatgacatccagaagcttcatatccgctctatccccttaggagagcatgcacgccgtatctgccatcaggagcagtccaggacctttgccatatctagcgtgaaatataaccaatctagtgcagaagattcagaaacacacttcatccgcttgttagatgaccagagttttgacctcataacatattatcaacttgatgcttttgagtatggctgctccatacttagctgttccttctcagatgacagtaatgtatattactgtgttgggacggcatatgttctcccagaagaaaatgagccaaccaaaggtcgcattctagttttcacggttgaagatgggaagctgcaactcgtcgctgagaaggaaaccaagggggctgtttactctttgaatgcattcaatggcaagttacttgctgctatcaatcaaaagatacagatatacaagtggactctgcgggatgatggtactcgcgagttgcaatcggaatgcggacatcacggccacatactagcgctttatgtccagactcgtggagatttcattgttgttggggatttgatgaagtcaatttctctgttaatctacaagcatgaggaaagttccattgaggagcgagcacgcgactataatgcaaattggatgtcagctgtagagatccttgatgatgatgtttaccttggagctgaaaacttcttcaacctcttcagtgttcggaaaaatagtgaaggtgcaactgatgaggaacgtggccgtcttgaggttgttggtgagtatcacctaggtgaatttgtcaataggtttcggcatggctctcttgtcatgcgcttgccagactctgatgtgggccagatcccaactgtcattttcggcactgtcaacggtgtaattggagtcattgcctcacttccccaagagcagtatgtgtttttggagaagctccagtcaaacttgaggaaggtgataaagggtgttggagggttaagccatgagcagtggaggtcattcaacaatgaaaagaagactgtagacgccaaaaatttcttggacggcgatctaatcgaatcgttccttgatctcagccgtagcaagatggatgaaatttcaaaacaaatgcgcgtttcagtggaggagctctgcaaaagagtagaagaattgacaaggctgcattgagtcagttgatgtttttatttgttaattcttttttctttccccattgttacataacgctatacgatggggcctgtttcttttattttggatagcatgagtggtatatattggcactgtatttccgatgtgttgtgtaaaatacttggcagtgaacttcggagatgcttccttttgagttaaatgggaaattataacaagaaaaccttatattact

SEQ ID NO: 3258 - DNA, 3530 bp, Panax ginseng
aaagacattagggttccattgaaggagaatctcaagtcgaagagctaattcatatatatataagtatatgtatatgtagaaagagaaagtgttgagatattagagagacggatccggagaggagatgagtgcatacaattatgtagtcacggctcacaagccgaccaatgtgacgcattcgtgcgtaggcaatttcaccagtcctcaggagctcaatctgattactgcgaaatgcactcgtattgagattcatttacttactgctcaaggtttacagcctatgttggatgtgccaatatacggaagaattgcaacacttgaactttttcgccctcatggagaaacacaagatctcctgttcattgctacagaaagatataaattcagtgttcttcaatgggatccagaggcagctgaggttattacaagagctatgggggatgtctcagatcgtataggacgacctacggacaatggtcagattggcatcattgatccagattgcagattaattggactacacctctacgacgggttgtttaaggttattccatttgataataaagggcagctgaaggaagcatttaacataaggcttgaggagcttcaagttttggatatcaaatttctttttggttgcctgaagcctactattgttgttctttaccaggataacaaggatgctcggcatgtcaaaacatatgaggttgctttgaaagacaaagattttattgagggtccatggtctcaaaacaaccttgataatggggctgatctgctaatacccgtcccaccacctctttgtggtgtcctgattattggagaagaaactattgtgtattgtagtgcctctgcatttaaggcaatcccaattagaccagccattacaagatcctacggaagggttgatgctgatggttctaggtatttgcttggcgatcataacggacttcttcacctacttgtcattacacatgagaaagaaaaagttactggactgaaaattgaactattgggggaaacttctattgcctcaacgatatcatatcttgacaatgcctttgtgtatgttggttcaagctatggagattcacagctcataaagctaaatctccagcctgatgcaaaaggttcctatgtagaagttctagaaaggtacgtcaatttggggccaattgtggacttctgtgtggtggacttagagaggcaagggcaaggtcaggttgtaacttgctctggagcctacaaagatggctctcttcgcatagttcgtaatggaatcgggatcaatgaacaggcttcagtagaacttcaaggcattaaagggatgtggtcactacgatcagctactgatgatccgtttgacaccttcttggttgttagcttcattagtgagacacgaattttggcaatgaatctcgaggatgaattggaagaaactgagatagagggctttttctctcaagttcagactttgttttgccatgatgctgtttatgatcaaattgtacaggttacttcaagctctgtaagactggtcagttcgacttctagagagctgcgaaatgagtggaaagctccaccaggctattcagtcaatgttgctactgccaattccactcaggttttattggctgctggtggtggccatttagtttacctggaaataggtgatgggatattgaatgaaataaaacatgcacaactggagtatgatgtctcatgcctggacataaatcctattggcgaaaatctcatctacagtaacctagccgcagttggaatgtggactgatataagtgttagaatattttcacttcctggcctcaatctcattaccaaggagcatttgggaggagagataataccacggtctgttcttctctgtgcttttgaagggatatcttacttgttatgtgccctcggagatggacatctcttaaactttttattgaacatgaacacgggtgaattaacagataggaaaaaggtctctctcgggacccaacccataactcttcgtactttctcatcaaagaatacaacacatgtttttgctgcctcagacagaccaactgttatttacagcagtaacaagaaactgctctacagcaatgtgaacttgaaagaagtcagtgatatgtgccctttcaactctgctgcttttcctgacagcctagcgattgcaaaagaaggtgagctaacaattggcacgattgatgatattcagaaacttcatattcgttccatcccacttggggaacatgcacgccgtatatgccatcaggagcattcccggacatttgctttatgctgtgtaaagtataaccaatcaagtacagaagactcagagatgcacattattcgtttgctagatgaccaaacttttgaattcatatcgagttactcacttgaccaatttgagtacggttgctccatacttagttgttcattcactgatgatagtaatgtgtactattgtgttggtactgcatatgttatgccagaggagaacgaaccaagcaagggccgaatactggtatttgtagttgaagatggaaaattgcagttaattgctgagaaagaaactaagggagctgtttactcactaaatgcctttaatgggaaattgcttgctgctatcaatcaaaaaattcagttgtacaagtggatgcttcgtgatgatggtacccgtgagttacaatccgaatgtggacatcacggacatatacttgccctttatgtacaaactcgtggagattttgttgttgttggtgacttgatgaagtctatatctctgttaatttataagcatgaagagggtgctattgaggagcgagctcgcgactacaatgcaaattggatgacagctgttgagattcttgatgatgacatttaccttggcgctgagaataatttcaacctcttcacagtccgtaagaatagtgaaggtgccactgatgaggagcggggtcgtcttgaggtggttggtgaataccacctcggtgaatttgttaaccggttcaggcacggttctcttgtcatgcgaatgccagattctgatgtgggccagattccaactttcatttttggcacggttaatggtgtcattggggtggttgcctcactccctcaagatcagtacggtttcctggaaaagctgcaggcaaacttgaggagggtgataaaaggcgtaggcgggttgagtcatgagcaatggagatcttattacagcgagaagaaaactgtagatgctaagaatttcttggatggggatctaatcgagtcattccttgatcttagtcggagtaaaatggaagagatttccaaggccatgactgttccagtggaggagcttatgaagagagtggaggagttaacaaggttgcattgattttgctgcctttttttgtgtgatctcctcatttcttctcctatctgtaacttttttctttggaataggaaacatatttattctgtttgctttgtacgagtattatgctcttggttatttattacatgctcgtaaa

SEQ ID NO: 3259 - DNA, 3962 bp, Nicotiana benthamiana
taacaagtttctccaccagaccacgccatttttgtggcgggagccctaaaaagcccaaagtgttcattttatgttgcatgtgtgccctattttaactaataacgacatcgtattggtcttcggtgtacaatcagtccagaggccatctcttcaccaggttcacagtcgatatataaacgcagtgtctcgtttccccccttccaaaactcactattttcaactgattgaactcacgactgtcctatacatatacatatacatatacatatagagagagaaacaaaaggggtcttagggttcctacgcgtagcgcgggatttcgacatatagaagagaagaagttaacaagatgagtatatggaactatgtggttacggctcacaagccaacgaacgctacacattcctgtgttggcaatttcaccgctcctcacgaactcaatcttatcattgcgaaatgtactcgaatcgagattcatttactcactccccaaggtttacagcctatgttagatgtgccaatatatgggagaatcgcgacactcgagcttttccgtccccacggtgaaactcaagattttctcttcattgcgacggagcgatataagttctgtgtccttcaatgggatgctgaggcatctgaagttatcacaagagcaatgggagatgtctcagatcgaataggccgtcccaccgataacggtcagattggtataatcgacccagactgcagattgatcgggttgcatctttatgatggactatttaaggttattccatttgataacaaaggccaactgaaagaagcctttaacatcaggcttgaggagcttcaagttttggatattaaattcttatatggttgcccaaagcctacaattgttgttctatatcaggataacaaggacgcccgacatgtcaaaacatatgaggtgtcgttgaaggataaagattttattgaagggccatgggctcagaataatctcgataatggagcttctttgctaataccagtacctccgccactgtgtggtgtactgattattggagaagaaaccatagtttactgtagcgcttcagcttttaaggctatcccaattagaccttctatcacaagagcatatgggcgggttgatgctgatggttctcgatatttgcttggggatcataatgggcttcttcacctacttgtaatcactcatgaaaaggaaaaagttaccgggctcaaaattgagctactgggagaaacttctattgcatcaaccatatcatacctagacaatgcttttgtcttcattgggtcaagctatggagattcacagctcgtaaagctcaatctccagcccgacaccaaaggttcttatgtggaagttctagagagatatgtcaatttgggaccaattgtggacttctgtgttgttgacctggagaggcaaggtcaaggtcaggtcgtgacttgctctggagcctataaggatggctcacttcgtattgttcgaaatggaattggaataaatgaacaggcgtctgtggaactacaagggatcaaaggaatgtggtcccttagatcagctactgatgatccatatgacacattcttggttgttagcttcattagcgagacacgtgttttagctatgaacctcgaggatgagctggaagaaactgagatagaaggcttcaattctcaagtccagaccttgttttgccatgatgctatatacaaccagcttgtacaggttacttctaactctgtaagattggtcagctctatctctagagatctgaaaaacgaatggtttgctccagccggctactcagtcaatgttgcaactgctaatgccactcaggtactgttggcaactgggggtggccatctggtctacctagaaattggtgatggggtgctgaatgaagtaaaatatgccaagttggattatgatatctcgtgcctggacataaatccaattggtgagaatccaaactttagtcaaattgcagcagttggaatgtggacagacataagtgtcaggatatattcacttcccgacttgaatctcattacaaaggaacagctaggaggggagataattcctcgttcagttcttatgtgttccttcgaagggatatcttatctactatgtgctttgggagatggtcatctcttgaattatgtattgagcatgagttctggtgagctgacagacaggaaaaaagtgtctcttggaacccagcccataacacttcgtacattctcatctaaagatgctacgcacgtctttgctgcctccgataggcccacagttatttacagcagtaacaagaagctgctttatagcaatgtaaatctaaaagaagttagtcatatgtgcccattcaacgttgcagcttttccagacagcctcgcaattgcaaaggaaggagagttaacaattggcactattgatgaaattcaaaagcttcacatccgttcaatacccctcggggagcatgcacggcggatcagccatcaagagcagaccaggacatttgctctatgcagcgtcaagtatactcagtcgaatgcagatgatcctgaagtgcattttgtccgcctgttagatgatcagacatttgagttcatatcaacctacccccttgaccaatttgaatatggttgttccatacttagctgctccttttctgatgacagtactgtgtattattgcgttgggactgcttatgtgatgccagaggaaaatgaacctacaaaaggccgtattttagtttttatagttgaagatggaaagctccaactaattgcagagaaggaaactaagggagcggtctactctctaaatgccttcaatgggaaactgcttgctgcaatcaatcagaagattcaattgtacaagtgggcctcacgtgaagatggtggcagccgagaattgcagacagaatgtggacaccatggtcatatattggctctttatgttcaaacacgtggggattttattgtggttggtgatttgatgaagtccatttctctactgattttcaagcacgaggagggtgctatagaggagcgagcccgggactataatgcaaattggatgtcagctgtcgagatcctcgacgatgacatttatcttggttcggagaacaactttaaccttttcacggtcaggaaaaatagtgagggtgctacagatgaagagcgcagccgtcttgaagtggttggtgaataccaccttggtgaatttgttaataggtttagacacggttcacttgtcatgcgattgccagattcagatgttggccagatacctaccgtcatatttggcacagtgaatggtgttattggggtcattgcctcgcttcctcatgatcagtatttatttttggaaaagctgcagacaagcttaaggaaagtgataaagggtgtaggcggactgagccatgagcagtggaggtcgttttacaatgagaagaaaactgtagaagctaaaaactttcttgacggagatttgattgaatcattcctagatcttagcaggagccggatggaagaaatttctaaagcaatggcagttcctgttgaggaactaatgaagagagtggaagagttgacaaggttgcattagttattctttaatggtcttcctcttccccagcatgtaatatttcacatttctctcctttgatttttgttttctgtgaggttgtgatacaagttcttatccgtatatttgtacttatcatctgatctacttatagtcgctgctaaattttcatttcatctttaagatgatctagtggaataaatattttccaagcgcaaatgtccaggactattttaatatttttggctcccattttagttggcattatacttatacgacaaagagaactagatgataaaagaaatacaagcgactgctcttgggcttgcgcagtggactgtgtatgtatttgttacagcta

SEQ ID NO: 3260 - DNA, 3689 bp, Rosmarinus officinalis
cggccggggggcccttatgtgcatctttatcctgcttgtctccatcagcccgactgcgacgacgccgtttcactcgtctctcactctgcataatcgatactgcaaataagcgcagtttctctctctacaattcgagctgtttccggctgctaaaccttctccatatctccacatcacaggaattggagtgtgtaagggttttttatttatccagccgaagtaggaagctgtacatacacataaacatacagtaggtgaagatgagcatatggaattacgtggtgacggcgcacaagcccaccaacgtgacgcattcgtgcgtcggcaatttcaccggaccgcaggagcttaatctcatcattgcgaaatgcacccggatagagattcatttgctctcgcctcaaggcttacagcctatgttggatgtgcccatatatgggagaatcgccactctcgagctttttcgcccacatggagaaacacaagatctccttttcatagctacagaaagatacaaattctgcgttttgcaatgggatgctgagactggtgaggttatcacaagggccatgggtgatgtttctgatcgaattggtcgccccacagataatggacagattggaatagttgatccagattgcaggttgattggtcttcatctatatgatggattattcaaggtcatcccatttgataacaaaggccaactcaaagaggcatttaatatcaggctcgaggagcttcaggttttagatatcaagtttttgtatggttgccctaagccaaccattgttgtactttaccaggataacaaggatgctcgtcatgtgaaaacgtatgaggttgctttgaaggacaaagattttgttgaaggtccgtggtctcaaaacaatcttgacaatggggcggatttgttaatcccagtgccacctcctctttgtggtgtcctcattatcggtgaagaaactatcgtgtattgcagtgcctcaactttcaaagcaatcccaataagaccttctattacaagagcctatggaagggttgatgcagatggttcacgctacttattgggagatcataatgggcttttgcatctacttgttataactcatgaaaaggagaaagtaactggcctcaaaattgagctattgggggaaacatctattgcatcatccatctcatatcttgataatgccgttgtttttgttggctcaagttatggagattcacagctcataaagctaaatcttcaaccggatgcaaaaggttcttatgtggaagttcttgaaagatatgtcaacttgggcccaattgttgatttctgtgtggttgatttggagaggcaaggccaaggtcaagttgtaacttgctcaggtgcctataaggatggttctctgcgcattgtgcgaaatggtatcggaataaacgaacaggcttctgtagagcttcaaggcattaaaggcatgtggtcgctgcgatcagctactgatgatccatatgacactttcttggtggttagctttatcaacgagacccgtattttggcaatgaatattgaggatgaattggaggaaactgaaattgaaggtttttgttccaatgtgcaaacgctgttttgtcatgatgctgcatatgatcaacttgtgcaggttacttcaagtaccgtgagactagtcagttctaccaccagagatcttcgtaatgagtggtttgctccagaaggttattcaatcaatgttgccacagccaatgtcactcaggttctattggctactggtagtggacatttgatctatctagaaattggtgatggttttctgagagaagtgaaacatacacagttggagtatgacatctcatgcctggacattaatccaattggtgataacaaaaactgcagtcaactagctgcggttggaatgtggactgatatcagtgttaggatattttcacttccagacttgaaccttataacaaaggagcatttgggaggggagataattccccgttctgtacttctgtgtgcttttgaagggatatcttatctgttatgtgctcttggggatggacatctcttgaattttgtgttgactaccagcaacggtgagctgacagacaggaagaaagtttctttagggacccaaccaattacactgcgtactttctcatcaaagaatgccacacatgtgtttgctgcttctgatcgaccaactgtcatttatagcagtaacaagaaattgctttacagcaatgtaaatctgaaagaagtcagttatatgtgccctttcaatacagctgctttccctgacagccttgctattgctaaagaaggcgaactaacaattggaacaatagatgatattcaaaagcttcacatacgctctatcccacttggggagcatgcacggcgtatatgtcatcaggaacaaacacggacctttgccatttgtagtttaaaatacaaccagtcagctgcagatgactctgaaatgcactttgtccgcctgttagatgaccagacatttgagttcatatctacttatccactggatcaatttgagtgtggttgttccgtccttagctgctctttctcggatgaccctaatgtgtattactgcgtggggactgcttacgtaatgccagaagagaatgagcctaccaagggtcgggttttagttttcgctgtagaagatggtaaacttcaactaattgctgagaaggaaaccaaaggcgccgtttattctcttaatgccttcaacgggaaactgcttgctgccattaatcaaaagattcagttgtataaatggatgccacgagatgatggcactcatgagttgcaatccgaatgtggacatcatggccacatacttgccctttatgtacaaactagaggggatttcattgttgttggtgatctgatgaaatcaatatctttgctgatttacaagcatgaggagggtgctattgaggagcgagctcgtgactacaatgcgaattggatgtcagctgtcgagattctagacgatgatatttaccttggagctgaaaataattttaatctctttactgtccgtaaaaatagtgaaggagcaactgatgaggagcgtgggcggctcgaggttgttggcgaattccaccttggcgaatttgtcaatcgattccgacatggttcgctagtcatgcggctgccagattctgatgttggccaaatcccaacggtcatattcggcactgtcaatggagtcattggggtcattgcctctctccctcatgagcagtacattttcttggagaagctgcagatgaatctgaggaaagtgatcaagggcgttgggggtctcagccatgagcaatggagatctttctacaacgagaagaaaaccgttgatgccaagcacttcttagatggcgatttgatcgaatcattccttgatctcactaggaatcggatggaggagatttcgaagtcgatgagcgtccctgtggatgaactaatgaagagggtggaagagctgactaggttacattaaattccattcctccttccttttggcatctgaaatcgctgtgttctatttttgcaggttctgtatgcttgatattgtaagagtctatgctcctcgtggaattcagtttaattttttgcattttgagttgtgtaacggtgcaaccatttgactctttgttcc

SEQ ID NO: 3261 - DNA, 5710 bp, Malus domestica
accaaagcggtttgcagaagaagatgagcgtatggaactacgtcgtaacggctcacaagcccaccaacgtcacccactcctgcgtcggcaacttcaccgcccctcaggagctcaatctcatcactgcgaaatgtacgcgaattgaaattcagctacttactcctctgggactgcagcctatcttggatgtcccgatatatggaagaatagcgacgcttgaacttttccggcctcatggtgaaacacaggattttctatttattgcaacagaaaggtacaaattttgtgttcttcagtgggatgccgaagcatctgagctcatcacaagggcaatgggggatgtctcagatcgcataggtcgtccgacagacaatggtcaaattggtattattgatccagattgcagattaattggactccatttgtatgatggattgtttaaggttattccttttgataataaagggcagctcaaggaagcatttaatatacggcttgaggaacttcaagttttggatatcaagtttctatatggttgttcaaaaccaacaattgtagttctatatcaggataacaaagatgttcgccatgtcaaaacatatgaggtttctctgaaggataaggatttcgttgaaggcccttgggcacagaacaacgttgaaaatggggctgatttgttaataccagttcctccgccactctgcggtgttcttattattggagaagataatattgtttaccgcagcccgaatacatttaaagcaatcccaataagacattccatcacaagagcctatgggagagtagatgcagatggttccaggtatttacttggtgatcatgccgggcaacttcacctacttgttataacgcatgagaaagaaaaggtgtctggactgaaaattgagctcttgggggagacatcaattgcatctactatctcataccttgataatgcatttgtctatatcggatcaagttatggggattcacagcttgtaaagctaaatctacagcctgatgcaaagggttcatatgtggaagtcttagaaaggtatgtcaatttggggccgatcgttgacttttgtgtggttgatcttgagaggcaaggccaaggtcaggttgtaacttgttctggagctttcaaggatggttctcttcgtgtagttcggaacggaattggaatcaatgaacaggcatcagttgagcttcaaggtatcaagggaatgtggtcgttaagatcctccactgatgatccttttgacaccttcctggttgtaagctttatcagtgagacaaggattttggcaatgaatcttgaggatgagctggaagaaactgagatagaaggcttctgttctcaagtacagactttattttgccacgatgctgtctgtaatcaactggtacaggtcacttcaagctctgtacggctagtcagttctacaactagggagctcaagcatgagtggaatgctccagcaggcaattcgattaatgttgccactgctaatgccacccaggtcttattggcgactggtggaaagcatttagtttatttggaaataggtgatggggtattgacagagaaaaaccacgcacagttagattttgagatatcatgccttgacataaaccccataggtgacaatcccaactatagccagctggcagctgttggaatgtggacagatattagtgtccagatatattcacttcctgccctgagccgcatcacaaaggaacatttgggaggggagatcatacctcgttctgttcttctttgtgcctttgaagggatatcctacctattgtgtgcccttggagatgggcacctcttaaactttatattgaacacaagcactggtgagttgacggacaggaaaaaagtctcacttgggacgcagcccattacactccgtaccttctcatccaagagtactacgcatgtatttgctgcatcggataggccaactgtcatctatagtagcaacaaaaaattgctttacagcaatgtaaatctgaaagaagtcagccatatgtgcccattcaactctgctgcttttccagacagccttgcaattgctaaggaaggtgaacttactatcggcactattgatgacatccagaagcttcatattcgctctattcccctaggtgagcatgcgcgtcgtatctgtcatcaggagcagtccaggactttcgccattttgagtgtgaaatataaccagtctagtgcagaagactcagaaacacacttcatccggttgttagatgaccagagttttgacctcataacatattatcaactggacgcttttgagtatgcctgctctatactaagctgttctttctcagatgacagtaatttatattactgtgtcgggactgcatatgttctcccggaagaaaatgagccaaccaagggccgcattctggttttcattgttgaagatgggaagctgcagctcgttgctgagaaggaaaccaaggggtctgtttactcgttgaatgcgttcaatggcaagctacttgctgctattaatcaaaagatacagttatacaagtggactctgcgggatgatggtactcgtgaattgcaatcggaatgtggacatcatggccacatacttgccctttatgtccagactcgtggagacttcattattgttggggatttaatgaagtcaatctctctgttaatgtacaagcatgaggaaggtgccattgaggagcgagcccgtgattataatgcaaattggatgtctgctgtagagatcctcgacgatgatgtttacattggagctgaaaatttcgtcaacctgttcactgttcgtaaaaatagtgagggtgcaactgatgaggaacggggccgccttgaggttgtaggtgagtatcacctaggcgagtttgtcaataggttccggcacggctctcttgtcatgcggttgccagactctgacgtgggccagattccaactgtcatctttggcaccgtcaatggtgtaattggagtaattgcctcacttcctcaagaacattatgcatttttggagaagctccagtcaaacttgaggaaggtgataaagggtgttggagggttgaaccatgagcagtggagatcattcagcaacgagaagaaaactgtagacgccaaaaatttcttggatggcgatctgatagaatcgttccttgatctcaaccgtagcaagatggacgagatctcaaaacaaatgcgcgtttcagtggaggagctctgcaagagagtagaagaattgacaaggctgcattgagtaagttgacacctttttctatcgtttttcttccccccgtcctgttttagttttcgataccacaggtggtacatattgagactctgtcttcgatctgttgtgcaatgtactgtgaacttgggaaaatgcttcctttgagttttacggtaattttattcggtaattttgttttgattgaaaccattgaaatcgttggaatggataattttttcttctggagaaattcatctcctaccgacgaaaaacctatcgctgcttctcgactggtcaggacccaagtattatccatccggggttctcatgcaaacagtgatgattccaaagacgataaaccgatagctactgccagacaactggtgaaaccttctcaagattcggaggacgatgacgacgacgatgataaacctttatcatcaaggctgctgctaacacccaagtccaagggtgaaaagaggaagaggaagaggcccctagatcacaaggccgattcttcacctaaaaggccaaaagtttcacatgcttgttcttcaacatctaccctaaaaattacggaggaaaaagatgacgacgaagatgacgacttgattccaatttcccagaggatcaaggaacctaccttgttgacagagaagaaggcaatgaaggtcggttcatcctccaccaggaaaccgatcaaaaagggccaaaatggtttgaaactttcgagttgccctaagtcgacgaatgtgctaccgagctctaatgatgggcagaaaaaatggaaaactttggttcacaacggtgtgatgtttccgcctccgtacgagccccatggtgtaaagatgatgtatgaagggaagccggtagacttgagtcctgaacaagaggaggtcgcaactatgtacgccgtgatgaaagatacagattacgtgcagaagaagcaaacgttccgaaacaatttttggaatgattggcgtaagttgctcggggagaaccacgtaattcggaggttggatggttgtgatttcaccccaatatacgagtggtgtatgaaagaaaaggaaaacaggaaacaaatgagtagggaagagaagaaggccgcgggggcggagaaaaagaaacaagaggagaagtatgcgtgggcgttcgttgatggtgaaaaggagatagttggaagattcagagttgaacctcctgcattgttcagaggccgaggggagcatccaaaatcgggaaaggtaaaaaggcggattcttccgagtgatgttacgatcaacatagggcaggatgcaccggttccagaatgtcctgtccccggcgaaaggtggaaagaagcgaggcatgatgatacggttacatggttagctttctggacagatccaatcactccaaagaaattcaagtacgtgtatcttggggagagtagctccttgaagatagaaagtgaccagaagaagtacgagaatgcgaggatgctcaaggactacattgggaaaatcagggcagattactctagggattttaccagtaaagattgcgcgaagaggcagatagcggttgcaacctatctcatcgataagcttgctctgagggcgggaaatgaaaagggagaagaggaagctgatactgttggttgctgcacattgaaggtagagcatgtgaaagcaatcgcccctaactcgttggagtttaacttccttggtaaagattctatcagataccaaaataccgttgaagttgaggttcctgtttacaaggaaattagacagttccaggccgggaaacgcggtggtgatgatctctttgacaagttggatgcgagtagattgaatgctcatttaaagcaacagatgcctggccttacggcaaaagtgtttcgtacctacaatgcttctatcacattggatgacttgttgaacaaggaaatcaaagacaaagcagatcttacagagaaagtcgctgtttataaccacgcgaacaaagaggttgccatcatctgtaatcaccagcgtacaatttcaaagtctcacgaagaacaaatgtctaaattgatggaaaagattggcggccttcgtgacaacctcaaagagctgaaaacagagttgaaaagggcgaaaagaggaaagtcacagccgctgactgacgctgatggaaagaagcgaaagaggaattcgaccccagctgagttggagaagaagatagctcaaaaaactgcggacatcgaaaacatggagatgggcatgagaacgaaagaggatctgaaaacagtggcgctgggaacatcgaaactcaactatcttgaccctaggatcacggttgcatggtgcaagcgaaatcaagttccaattcagaagatgttcaacaccactcaactgagaaagtttgcttgggcaatggctgcggatcctgacttcagattctgatgtttggagattaat

SEQ ID NO: 3262 - DNA, 3599 bp, Nicotiana benthamiana
atgagtatatggaactatgtggttacggctcacaagccaacgaacgctacacattcctgtgttggcaatttcaccgctcctcacgagctcaatcttatcattgcgaaatgtactcgaatcgagattcatttgctcactcctcaaggtttacagcctatgttagatgtgccaatatatgggagaatcgcgacactcgagcttttccgtcctcacggtgaaacacaagattttctcttcattgcgacggagcgatataaattctgtgtccttcaatgggatgctgaagcatctgaagttataacaagagcaatgggagatgtctcagatcgaataggccgtcccaccgataacggtcagattggtataatcgacccagactgcagattgatcgggttgcatctttatgacggactatttaaggttattccatttgataacaaaggccaactgaaggaagcctttaacatcaggcttgaggagcttcaagttttggatattaaattcttatatggttgcccaaagcctacaattgttgttctatatcaggataacaaggacgcccgacatgtcaaaacatatgaggtgtcgttgaaggataaagattttattgaagggccatgggctcagaataatctcgataatggagcttctttgctaataccagtacctccgccactgtgtggtgtactgattattggagaagaaaccatagtttactgtagcgcttcagcttttaaggctatcccaattagaccttctatcacaagagcatatgggctggttgatgctgatggttctcgatatttgcttggggatcataatgggcttcttcacctacttgtaatcacccatgaaaaggaaaaagttaacggactcaaaattgagctactgggagaaacttctgttgcatcaaccatatcatacctagacaatgcttttgtcttcattggttcaagctatggagattcacagcttgtaaagctcaatctccagcccgacgccaaaggttcttatgtggaagttctcgagagatatgtcaatttgggaccaattgtggacttctgtgttgttgacctggagaggcaaggtcaaggtcaggttgtgacttgctcgggagcctataaggatggatcacttcgtattgttcgaaatggaattggaataaatgaacaggcgtctgtggaactacaagggatcaaaggaatgtggtcccttagatcagctactgatgatccatatgacacattcttagttgttagcttcattagcgagacacgtgttttagctatgaaccttgaggatgagctggaagaaactgagatagaaggcttcaattctcaagtccagaccttgttttgtcatgatgctatatacaaccagcttgtacaggttacttctaactctgtaagattggtcagctctatctctagagatctgaaaaacgaatggtttgctccagccggctactcagtcaatgttgcaactgctaatgccactcaggtactgttggcaactgggggtggccatctggtctacctagaaattggtgatggggtgctgaatgaagtaaaatatgccaagttggattatgatatctcatgcctggacataaatccaattggtgagaatccaaattatagtcaaattgcagcagttggaatgtggacagacataagtgtcaggatatattcacttcccgacttgaatctcattacaaaggaacagctaggaggggagataattcctcgttcagttcttatgtgttccttcgaagggatatcttatctactatgtgctttgggagatggtcatctcttgaattatgtattgagcatgagtactggtgagctgacagacaggaaaaaagtgtctcttggaacccagcccataacacttcgtacattctcagctaaagatgctacgcacgtctttgctgcctccgataggcccacagttatttacagcagcaacaagaagctgctttatagcaatgtaaatctaaaagaagttagtcatatgtgcccattcaacgttgcagcttttccagacagcctcgcaattgcaaaagaaggagagttaacgattggcactattgatgaaattcaaaagcttcacatccgttcaatacccctcggggagcatgcacggcggatcagccatcaagagcagaccaggacatttgctctatgcagcgtcaagtatactcagtcaaatgcagatgatcctgaagtgcattttgtgcgcctgttagatgatcagacatttgagttcatatcaacttacccccttgaccaatttgaatatggttgttccatacttagctgttccttttctgatgacagtaatgtatattattgcgttgggactgcttatgtgatgccagaggaaaatgaacctaccaagggccgaattttagtttttatagttgaagatggaaagctccaactaattgcagagaaggaaactaagggagcggtctactctctaaatgccttcaatgggaaactgcttgctgcaatcaatcagaagattcaattgtacaagtgggcctcacgtgaagatggtggcagccgagaattgcagacagaatgtggacaccatggtcatatattggctctttatgttcaaacacgtggggattttattgtggttggtgatttgatgaagtccatttctctactgattttcaagcatgaggagggtgctatagaggagcgagcccgggactataatgcaaattggatgtcagctgtcgagatcctcgacgatgacatttatcttggttcggagaacaactttaaccttttcacggtcaggaaaaatagtgagggtgctacagatgaagagcgcagccgtcttgaagtggttggtgaataccaccttggtgaatttgttaataggtttagacacggttcacttgtcatgcgattgccagattcagatgttggccagatacctaccgtcatatttggcacagtgaatggtgttattggggtcattgcctcgcttcctcatgatcagtatttatttttggaaaagctgcagacaagcttaaggaaagtgataaagggtgtaggcggactgagccatgagcagtggaggtcgttttacaatgagaagaaaactgtagaagctaaaaactttcttgatggagatttgattgagtcattcctagatcttagcaggagccggatggaagatatttctaaagcaatggcagttcctgttgaggaactaatgaagagagtggaagaattgacaaggttgcattagttattctttaacgtcttccccttccccagcatgtaatatttgacatttctctcttttgatttttgttttctctgaggttgtgatgcaagttcttatccgtatatttgtacttatcatctgatctatgctctgctgaattttcattttatctttaagatgatctagtgagataattattttccaagcgcaagtgtccaggactattgtaatatttttggctcccattttagttggcattctacttatacgacaaaggaaacaaaatcagaaaaatacaagcgactgctcatgggcttgcggtggactgtgtgtgtttgttacagcta

SEQ ID NO: 3263 - DNA, 3528 bp, Allium cepa
aaataagtgtatccacgctcggtgtccttctacacactcgtctccctcaacttctcttccaaatcgaactggacgcttcaaaaataaaaatagtacaatgagtatgtggaattatgtggtgacggcacacaagccgaccaacgtcacccactcatgcgtcggcaacttcaccagcccccacgagctcaacctaattatcgcaaaatgcactcgcatcgagattcattgtcttactcctcttggcttacagcctaagctggatgttccaatatatggaaggatagctactcttgaactctttagaccacatggtgaacaacaagatttcctgtttatagccacagagagatacaaattttgtgttcttcaatgggatcctgaggcatcagagcttgtaacaagggcaatgggtgatgtctctgacagaataggtcgtccaacggacaacgggcagattggcatcattgatccagattgtagattaattggccttcacttatatgatggtctcttcaaggttataccttttgacaacaaaggacaattgaaagaagctttcaacatcaggcttgaagagcttcaagttttggatattaaatttctttatggctgtccaaaacctactattgttgtgctttaccaggacaataaagatgctcggcacgttaaaacatacgaggttgccctcaaagataaagacttcgttgagggcctttggtcacagaacaatcttgataatggggctggccttttaattcctgttcctatgcctcttggtggtgtaattataattggagaggagactattgtttattgcagtgcaactgcgttcaaagctatcccaatcaaaccgtcaataaccagagcatatggaagggtagatgcagatggttctcgatacctacttagtgataatacaggatttctacacttgcttgttatcacacatgacaaggaaagggttactgggctcaaaattgaacatttaggggagacatccgttgcatcaactatatcttatcttgataatgcagtagtatatgttggttcaagctatggggattcacagctcataaaactgaacatgcaaccagatgcaaatggttcctatgttgaagttcttgaaagatacataaatcttggacctattgttgacttctgtgttgttgaccttgagaggcaaggtcaaggtcaggttgtcacttgctctggagcttatagagatggttcacttcgtgttgttcgaaacggcattggaataaatgaacaggctgctgtagaacttcaaggcgtcaaagggttgtggtcgttacgtgcttctactgatgatccgtacgatacttttttggttgtgagctttatcaatgaaacacgtatcctcgcaatgaatatggaagatgaattagaagaaacagatattgaaggttttcaggcagagacacaaaccttattctgccataatgctatctacgatcagctcatacaggttacttcaaattctgttcgattagtcagttccgcatctcgagagatgttggatcaatggagtgcaccatcgggctattctgtcaatgttgcaacagcaaatgctagtcaggttctgctggctactggcggtgggcatcttgtttatctcgaaattgaggagggaaagttgatcgaaaaaaaatacataaagcttgattatgagatgtcatgtctcgatataaatccaataggagaagattctacaagaagttcatttgtagcagttggaatgtggactgatattagtgtcaagatatattccctgccagatcttgacttgatcacaacagaaaatcttgggggtgaaattatacctcgttctgtccttctatgtaaatttgaaggaatatcatacttattatgtgcccttggagatggccacttgttcaatttccaattaaatatgaacactggtgaactatctgataggaaaaaagtatcccttggaacacaaccaatcactcttcgaacattttcctcaaaagacaccactcatgtgtttgctgcatcagataggcccaccgtgatatatagcagcaacaagaaattactttatagtaatgtgaatttgaaagaagtcagccatatgtgtcctttcaactcagctgcctttccagacagccttgcaattgccaaagagggtgagctttcaattggaactattgatgatattcagaagcttcatattcgctcaattgcattgggagagcatgcacggcgtatctgccatcaggagcagtcacggacttttgcaatatgtagttacaaaaactgccctactaacacagaagaaaccgaaacgcatttccttcgattgctagatgatcaaacatttgaatttaaatcgacttatcagttggatacttatgagaatggttgctccatcattagttgttccttctcagatgataacaatgtttactattgtgtaggaaccgcgtatgttttacctgaagaaaatgaaccgaccaaagggcgtattctagtgtttgcagttgaagatggaaagctacagttaatcactgaaaaagaaacaaaaggagctgtatattcccttaatgctttcaatggaaaattgttggtagctataaatcagaagattcaattgtacaaatggatgcttagagaagatggttcacgagaacttcagtctgaatgtgggcaccatggtcatatactagctttgtatgttcaaacacgtggtgacttcatcgtagtcggcgatttgatgaaatctatatcccttttgctgtacaagcacgaggaaggagcaatcgaagagagagcacgagactacaacgcaaactggatgaccgcggtggaaatcttgagtgacgacatctacctaggcgctgaaaacaacttcaacctgttcaccgtgcgcaggaacagtgaaggcgcgaccgacgaggagcgtggccgcctcgaggtggtgggcgagttccacctgggcgagttcatcaaccgcttcaggcacggttccctggtcatgcgcctgcccgactccgagatcagccagattccaaccgtgatattcggcaccgtgaacggggtcataggtgtgatcgcttccctaccccgtgatctttacctgtttcttgaaaggcttcagggttgcctcaacaaggtcatcaaaggggtgggaggactactgcatgatcagtggcggtctttctacaacgagaagaggacgtgtgaggcccgtaattttttggatggtgatttgatcgagtcgttccttgatttgagcagaggaaagatggaggaggtggccagtgcaatggatgttccggttgaggagctttgcaggaaggttgaggagctcactaggctgcattagagtttttcaatccatgtatttgtaatgtaactctagcggtttttgcttaccattttgtttattgttgaacttatggctcatttgtgtgctggttaggataaaaaagaaaagtttagtttgttgcaattcttgtaaaatttgtgctatttacatcatcgctg

SEQ ID NO: 3264 - DNA, 3543 bp, Fragaria vesca
agaagcgcgaggcggtgagagagtgaaagtagtaatagagaagaaagagagagctagggctccagtagtgtctgagtgagtcgaagaagaagaagaagatgagtgtctggaactacgtcgtcacggcccacaagcccaccaacgtcacccattcctgcgtcggcaatttcaccggccctcaggagctcaatctcatcatcgcaaaatgcacgcggatcgaaattcttctacttactcctctgggtttgcagcctgtcttggatgtgccgatatatggacgaattgcaacccttaaactctttcggccacatggcgaagcacaggattttctgtttattgcaacagaaagatacaagttttgtgtccttcagtgggatgtcgaaacacaggagcttgttaccaaggcaatgggggatgtctcggatcgtataggtcgtcctacagacagtggtcagattggtataatagatccagattgcagattaattggacttcatttatatgatggcttgtttaaggttattccttttgacaacaaagggcagctgaaggaagcatttaacattaggcttgaggaacttcaagttttggatatcaagtttctttatggttgttcaaaacccacaattgtagttctttaccaggataataaggatgctcgccatgtcaaaacatatgaggttgctctgaaggataaagattttgttgagggtccttggtcacagaacaaccttgacaatggggctgagttgttaataccagttcctccaccactttgcggtgttcttattatcggagaggaaacaattgtttactgcagcgccaatgcatttaaagcaatccccataagaccgtccatcacaagagcctatggaagagtggatgcggatggttctaggtatctacttggtgatcatgctgggcttcttcacctacttgttataactcatgagaaagaaaaggtgactggactcaagatggagctcttgggtgaaacatcgattgcatctacaatctcttatcttgataatgcattcgtttatattggatcaagctatggggactcacagcttgtaaagctaaatcttcagccggatgcaaaaggctcatatgtcgaagttttggaaaggtatgtcaacttggggcccatagttgacttctgtgtggttgatcttgagaggcaaggccaaggtcaagtggtaacttgctctggtgcttacaaagatggttctcttcgtgttgttcgaaatggaattggaatcaatgaacaggcatcagttgagcttcaaggtatcaagggaatgtggtcattaagatcttccactgatgatccgcacgacttcttcctggttgttagctttattagtgagacacgtattttggcaatgaatatggaggatgagctggaagaaactgagatagagggcttctcttctgaagtgcaaactttattttgccatgatgctgtcttcaatcaacttgtgcaggtcacttcaagctcagtaaggctagtgagttctacatctagggatctgaagaatgagtggcatgctccggcaggctattctattaatgtagcaacagctaatgccacccaggttttattggcaactggaggaaagcatttagtttatttagaaattggtgacggggtcttgacagaaaagaagtatgtacatttggactttgagatctcatgccttgatataaaccccataggtgaaaaccctaactatagccaactagcagctgttgggatgtggacagatataagtgttcaaatttactctcttcctgatctgaaccgcatcacaaaggaacatttgggaggagagatcatacctcgttctgttcttctctgtacttttgaagggatatcctatctgctatgtgcacttggcgatggacacctcttaaactttacattgaacacaactactggcgagttaactgacaggaagaaagtctctcttgggacgcagcccattacactccgtacattctcatctaagagtactacacatgtgtttgctgcatcggatagaccaactgtcatctacagcagtaacaagaaactactttacagcaatgtcaatttgaaagaagtcagccatatgtgcccattcaactctgctgctttcccagacagccttgcgattgctaaagaaggtgaacttacgattggcacaattgatgacatccagaagcttcatatccgtactattcctctaggtgagcatgcacgccgcatttgccatcaggagcagtcgaggacctttgcgatatgtagtgtgaaaaataatcagactggtgcagaagattctgaaacacacttcatccgtttgctagatgaccaaagttttgacctcgtgacgtattatcaacttgatgcttttgagtatgcctgttccatacttagctgttccttctcagatgatagtaatgtatattactgtgttgggactgcgtatgttcttccagaagaaaatgagccgactaagggtcgcattctggttttcctagttgaagatgggaagatgcagctcattgctgagaaggagactaagggatctgtttattctttaaatgctttcaatggaaaattacttgctgccatcaatcagaagatacagttatacaagtggacactccgggatgatggtacacgtgagctgcagtctgaatgtggacatcatggtcacatacttgccctctatgtacaaactcgtggagacttcattgttgttggtgatttaatgaagtcaatttcgttattaatttataagcatgaggaaggtgccattgaggagcgagcccgagactacaatgcgaattggatgtccgctgtagagatcctcgatgatgatgtttaccttggcgctgaaaacttttacaacctcttcactgttaggaaaaatagtgaaggtgcgactgatgaggaacggggccgtcttgaggttgttggagagtatcaccttggggaatttgtcaatcggtttcggcatggttctcttgtcatgcgcttgccagactctgacgtgggccagattcctacggtgatatttggcactgttaatggtgtgattggagtcatcgcttcacttcctcgagatcattattcctttctagagaagcttcagacaaacttgaggaaggtgataaagggtgttggaggattgagccatgatcagtggaggtcattctgcaacgagaagaagacctcggacaccaaaaatttcttggatggtgatcttatcgagtcattccttgatctcagccgtgggaagatggatgaaatttcaaaacaaatgagtgttccagtagaagagctctgcaagagagtagaagagctcacaaggttgcactgatagtgtttccatctgttcttttgtctccctgttacctgacgctgagtgaccattttatgtttcacattgcttctagtttgggtacatatttgtgttgtgtttttgatgtttgtaaaatactttcactatggaaattcacattaaaggagcatcttgtgtgttacatagtaatcta

SEQ ID NO: 3265 - DNA, 3559 bp, Silene vulgaris
ctatgttgtgacggcacataagcctacaaatgtcactcattcttgtgtcggaaatttcaccagccctcatgaacttaatctcatcatcgcgaaatgcacccgaattgagatccacttgttgactccgcagggtcttcagcctatgctggatgttccaatttacggaagaatcgcaacgctggagctttttcgacctcatggtgaaacacaagatttcttatttgttgcaactgagagatacaagttctgtgttcttcaatgggatcctgaggcatctgagcttctcaccagagcaatgggagatgtctcagatcgtattggccgtccgactgataatggccagatcggcatcattgatcctgattgcagactgattgggctccatttatatgatggattattcaaggtcatcccttttgatattaaaggacaactaaaagaagcttttaatatcagacttgaggagcttcaagtgctggatataaagttcctctatggctgttcaagacctacaattgtagttctttaccaggacaataaagatgctcgccatgttaaaacttatgaggtatcattaaaagacaaagattttgttgaggggccatggtctcagaataatcttgataatggagctgatctgctgattcctgttcctcccccattttgcggagttatcatcattggggaggaaacaatagtatactgcagtgctactcttttaaagcaatacctatcagaccttctataacgagagcgtatgggagggtcgatgctgatgggtctcgatatttgcttggtgatcatgcagggcttcttcatctgctcgttatcactcatgagaaagaaaaagttactggtctgaaaattgagctcttgggtgagacatctattgcgtcgactatatcttatctcgataatgctttcgtttatgtgggttcgagttatggagactctcagctcattaagttaaatttacaaccagatgcaaaaggatcatatgtggaagtcctggaaaggtatgtaaacttgggtccgattgtagacttctgcgtggttgaccttgagagacaaggtcaaggccaggttgtaacttgctctggagcatacaaggatggttcccttcgcatagttcgtaatgggattggcataaatgaacaggcatcagtagagctccaaggtatcaagggcttatggtctttaaaatcgttgactgatgatgtccatgacaccttcttagtagtaagctttatcagtgagaccagaattcttgcaatgaatcttgaagatgaactagaagaaacagaaattgaagggtttgattcagaagtgcaaacattattctgccatgatgctttgttcaaccaacttgttcaagtcacctcaagctcagttagactggttagttcaatatcaagagaactgaggaatgagtggaaagctcctgtaggattctctgtcaacgttgctactgctaatgcctcccaggttctagtggctactggtggtggacatcttgtttatttggaaattggagatggggttttaacagaagtgaaacatgctcaattggaatatgagatctcttgtcttgacataaatcctattggtgataaccctaactatagtcagctagcagctgttggaatgtggacggatataagtgtcaggatgtattcacttccagatctgaatttaattaccaaggagaatcttggcggggagatcattcctcgctctgttcttctatgctcttttgaagggatatcgtatctactctgtgcccttggagatggccatctgttgaacttcatactgaacatgagtacaggtgaactagctgacaggaaaaaggtgtctttgggtacacaaccgattacactaaggacattctcttcaaagaatgctacacatgtatttgctgcctctgatcgaccaactgttatatacagtagcaacaaaaagctgttgtatagtaatgtaaacttgaaagaagtcagccatatgtgtcctttcaactcagctgctttccctgacagtcttgcaattgccaaagaaggcgaacttaccatcggcacaattgatgatattcagaagctccatattcgttctattcctctaggcgagcatgctcggcgtatctgccatcaagaacaaactcgcacttttgccatttgtagtatgaaatacaaccagtcaggtgcagaagaatctgaaatgcattttgtgcgcttgctcgatgaccaaacctttgacattatatcaacttatgcccttgatactttcgaatgtggttgctctatccttagttgctcattctctgatgataataatctttactactgcgttggcacagcatatgttttacccgaggaaagtgagccaaccaagggaagaattcttatttttgtggtggaggatggaaagttgcaactcattgccgagaaggaaactaaaggcgctgtatactctcttaatgcttttaacggcaagcttcttgctgccattaatcagaaaattcagctttataagtggatgcttcgggatgatggtacccgtgagttacagtctgaatgtgggcatcatgggcacattcttgctttgtatgtgcagactcgtggcgattttatagttgttggagacttgatgaaatccatttcacttttaatctataagcatgaagaaggtgctatagaggaacgtgctagggactacaatgcgaattggatgtcagctgtggagatccttgacgatgatgcctatcttggtgcagaaaataacttcaatctgttcacagtgagaaaaaacagtgaaggagccacagatgaagagagggcccgccttgacgttgtcggagagtaccacgtgggtgaattcatcaaccgcttccgccacggttctcttgtcatgcggttgccggattccgaaattggtcagataccgacagtcatttttgggacggtaaacggtgtgataggggtcatcgcctcacttccttctgaacagtacaatttcctagaaaaactgcaggccgcattgaggaaggtaataaagggtgttggaggattgagccatgaacattggcggtcattttacaatgagaaaaagacggttgattcgagaaactttctcgatggggaccttattgaatcttttctcgatcttaatcgtgttcgaatggaggagatttcgaaaacattgaatttttcagtggaagagctttgcaaaagtgtcgaggagctcactagactgcattagataagttgtgtcctctttcttccccgacaaccatttcgactccacatctattttaccttgtttcctctttgcaagttaatttagtttttgcttcttttttcgggtccgtgcctacaaaaaggggatttgagctgtgtatgcttgagttgatttgccctagagcccctagtatttatacgcccctgcacgaggagtatgtttgcttcttgtcctgtatttggtgagtgtatgtttaatcaatccatcgaatgaaaatattgtcctcagggacgtttgttatcccgaacatgttatcaggtttttt

SEQ ID NO: 3266 - DNA, 3809 bp, Malus domestica
atgggacaaagccacgtcggcagcaaagatcctggtgtatccaaatctggaattctggagccacaggttgctcgcgcggctgcggctgcggctgcagactttgttaccctaaaagcttataacgatattatggccattgctcaaccaatgaggcgcaaagggcagggcgctttgggagctcgctgtgatttcattggttcatccaccaatttgataatggtgactactacaagcctaatgctgtttgccggaagattcaggttggccccgtcggcaaacaagaaggcaacggcaggattaaagcttgaaacaagggactctggactgcagaccgacgatccggctgggtttacgcttgctgataccttggcttgtgggactgttggtcacattattagggttagttttgttcttggccttaagaatgttgaagaagaagaagaagaagaagaagaagaggggaagaggaagatgagcatatggaactacgtcgtaacggctcacaagcccaccaacgtcacccattcctgcgtcggcaatttcaccgccccgcaggagctcaatctcatcactgcgaaatgtacgcgaattgaaattcagttacttactcctctgggactgcagcctatcttggatgtcccgatatatggaagaatagcaacgcttgaacttttccggcctcatggtgaaacacaggattttctattcattgcaacagaaagatacaaattttgtgttcttcagtgggatgctgacgcatctgagctcatcactagggcaatgggggatgtctcagatcgcataggtcgtccaacagacaatggtcaaattggtattattgatccagattgtagattaatcggactccatttgtatgatggattgtttaaggtcattccttttgataataaagggcagctcaaggaagcatttaatatacggcttgaggaacttcaagttttggatatcaagtttctatatggttgttccaaaccaacaattgtagtcctatatcaggataacaaagatgttcgccatgtcaaaacatatgaggtttctctgaaggataaggattttgttgaaggtccttgggcacagaacaacgttgaaaatggggctgatttgttaataccagttcctccaccgctctgcggtgttcttattatcggggaagataatattgtttaccgcagcccgaatacatttaaagcaatcccaataagacattccatcacaaaagcctatgggaaagtagatgcagatggttccaggtatttacttggtgatcatgccgggctacttcacctacttgttataacgcatgagaaagaaaaggtgactggactgaaaattgagctcttgggggagacatcaattgcatctaccatctcataccttgataatgcatttgtgtatatcggatcaagttatggggattcacagcttgtaaagctgaatctacatcctgatgcaaagggttcatatgtggaagtcttagaaaggtatgtcaatttggggccgatcgttgacttttgtgtggttgatcttgagaggcaaggccaaggtcaggttgtaacttgttctggagctttcaaggatggttctcttcgtgtagttcgaaatggaattggaatcaatgaacaggcatccgttgagcttcaaggtattaagggaatgtggtcgttaagatcctccactgatgatccttatgacaccttcctggttgtaagctttatcagtgagacaaggattttggcaatgaatattgaggatgagttggaagaaactgagatagaaggcttctgttctcaagtacagactttattttgccatgatgctgtctgtaatcaactggtgcaggtaacttcaagctctgtaagattagtcagttctacaactagggagctcaagcatgagtggaatgctccagcaggctattcgattaatgttgctactgctaatgccacccaggttttattggcaactggtggaaagcacttggtttatttggaaattggtgatgggatattgacagagaaaaaccacgcacagttagattttgagatatcatgccttgacataaaccctataggcgacaatcccaactatagccagctggcagctgttggaatgtggacagatattagtgtccagatatattcacttcctgacctgaaccgcatcacaaaggaacatttgggaggggagatcatacctcgttctgttcttctttgtgcctttgaagggatatcctacctattgtgtgccctaggagatgggcacctcttaaactttatattgaacacaagcactggtgagttgacagacaggaaaaaagtctctcttgggacgcagcccattacactccgtaccttctcatccaagagtactacacatgtatttgctgcatcggataggccaactgtcatatatagtagcaacaagaaactgctttacagcaatgtaaatctgaaagaagtcagccatatgtgcccattcaactctgctgcttttccagatagccttgcaattgctaaggaaggtgaacttaccatcggcacaattgatgacatccagaagcttcatattcgctctattcccctaggtgagcatgcgcgtcgtatctgtcatcaggagcagtccaggactttcgccattttgagtgtgaaatataaccagtctagtgcagaagactcagaaacacacttcatccggttgttagatgaccagagttttgatctcataacatattatcaactggatgcttttgagtatgcctgctctatacttagctgttctttctcggatgacattaatgtatattactgtgtcgggactgcatatgttctcccggaagaaaatgagccaaccaagggccgcattctggttttcattgttgaagatgggaagctgcagctcgtcgctgagaaggaaaccaaggggtctgtttactctttaaatgcattcaatggcaagttacttgctgctattaatcaaaagatacagttatacaagtggactctgcgggatgatggcactcgtgaattgcaatcagaatgtggacatcatggccacatacttgccctttatgtccagactcgtggagattttatcattgttggggatttaatgaagtcaatttctctgttaatgtacaagcatgaggaaggtgccattgaggagcgagcccgtgattataatgcaaattggatgtctgctgtagagatactcgacgatgatgtttacattggagctgaaaatttcttcaacctcttcactgttcgtaaaaatagtgagggtgcaactgatgaggaacggggccgccttgaggttgtaggtgagtatcacctaggcgagtttgtcaataggttccggcacggctctcttgtcatgcggttgccagactctgatgtgggccagattccaactgttatctttggcaccgtgaatggtgtgatcggagtgattgcctcacttcctcaagagcaatatgcatttttggagaagctccagtcaaacttgaggagggtgataaagggtgttggagggttgagccacgagcagtggaggtcattcagcaacgagaagaaaactgtagacgccaaaaatttcttggatggcgatctgatagaatcgttccttgatctaaaccgcagcaagatggatgagatctcaaaacaaatgcgtgtttcagtggaggagctctgcaagagagtagaagaaatgacgaggctgcattgagttgggaccacggtttagttttcgattgcacatgtggtacatattggcactgtatctttgatctgttg

SEQ ID NO: 3267 - DNA, 3591 bp, Brassica oleracea
gagaaatccagaagcttctcccgaatcagaggcgggaaagccctcgcgtagtagacagtgaatccataagaagaagaagaagaagatgagctcatggaactacgtcgtcacggctcacaagcccaccagtgtcactcactcgtgcgtcggaaacttcaccagtccccaagagctcaacctcatcgtcgcgaaatgtactcgaattgagatccatttgcttaccccacaaggccttcagcctatgctggatgttcctatatatggaaggattgctactttggagttgttcaggccccatggcgaaacacaagactttttgttcatcgtaactgagagacacaaattctgtgttcttcagtgggatgctgagtcctccgagcttgtcaccagagcaatgggggatgtgtctgatcgtataggccgaccaacagacaatggtcagattggcataatagatccagattgtagattaattggactccacctgtatgacggcttgttcaaggttataccatttgacaataagggacagctcaaggaagcttttaatatcaggctggaggagttgcaggttctggatatcaagttcctgtttggatgtgcaaagcccacaattgcagtactttatcaggacaacaaagatgctcgtcatgttaaaacatatgaagtctctctaaaagataaggactttgtcgagggtccatggtcacagaacaatctcgacaatggtgctgacttactgattcccgtaccaccacctctctgtggcgtccttattattggtgaagaaacaattgtctattgcagtgctaatgcattcaaagcaataccaatacgaccttccatcactaaagcatatggaagagttgatgttgatggctctaggtatcttcttggtgaccatgctggactggttcacctgcttgttataacacacgagaaagaaaaggtcactggcctaaaaattgagctcctgggtgaaacgtccattgcatccactatatcataccttgacaatgccgttgtctttgtcggctcaagctatggcgattctcagctagtaaagctaaatctacatcctgatgcgaaaggctcatatgtagaagtcttggagaggtataccaacctggggcctattgtcgacttctgtgtagtcgacctcgagagacaagggcaaggtcaggttgtaacttgttctggggcatttaaggatggttccctccgcatagttcgcaatggcataggaatcaatgaacaggcgtctgtggaacttgaaggcatcaagggaatgtggtcgttaaaatcttcagttgatgaagccttcgacacattcctcgtggttagctttatcagtgaaactcgcatattagccatgaaccttgaggatgaactggaagaaactgagattgagggcttcttgtcccaagtccagactttgttttgccatgatgctgtgtacaatcagcttgtacaggttacctcaaattctgttagactagtcagctctacaactagagaattgcgggatgagtggcatgccccagctggattcactgttaatgttgcaaccgcaaatgccagccaggttcttttggcgactggaggtgggcatttggtttatctagaaattggagatgggaaattgacagaagtgcaacatactgttcttgagtacgaggtttcttgccttgacatcaaccccatcggcgacaatcctaactacagtcagctagcttcggttgggatgtggacagatataagcgtcaggattttttccctgccagaactgactcttattacaaaagagcaactaggaggagagatcattccccgttctgttcttctctgttcattcgaagggatatcttacttgctctgtgctctcggagatggtcatcttttgaacttccagttggacacaactactggtcaattgaaagacagaaagaaagtatcacttgggactcagcctataactctgcgtacgttttcatctaaaagcgccacacacgtcttcgctgcatcagatagaccaaccgtaatctatagcagcaataagaagctgttatacagcaatgtcaatcttaaagaagttagttatatgtgtcctttcaactctgctgcttttcccgacagtttggcgattgccagagaaggtgaactcacgattggaaccattgatgatattcagaagcttcacatacgcactattcctctgggagagcatgctcgtcgaatctgccatcaggaacagacacgtacatttggtatctgcagtttgggaaaccagacaaatgctgaagaatctgaaatgcattttgttcgtctgttggacgaccaatccttcgagtttatgtcaacttatcccttggatgcgtttgaatacgcttgctccatactaagctgctccttcaccgacgacaagaatgtctattactgtgttggaaccgcatatgttttaccggaagaaaacgaaccaaccaagggaaggatattggtatttatagtagaggatgcgaaactgcaacttatcgctgagaaagaaaccaaaggagctgtgtactctctcaatgcctttaatggaaagcttctcgctgctatcaatcagaagattcagttatacaagtggatgctgcgtgatgatggcactcgtgaattgcagtctgaatgtggacatcacggacacattctagctctctatgtacagacccgtggagactttatcgttgttggtgatctcatgaaatcgatctccttgcttatctataagcacgaggaaggtgcaattgaggaacgagctcgggactacaatgctaattggatgtctgctgttgagatactcgatgatgatacctaccttggcgctgagaacaatttcaatctgttaacggtgaagaagaacagtgaaggtgctactgatgaagaacgagggaggttagaagtagttggggagtatcacctcggggaattcgttaacagattctgccatggatcgctcgtgatgaggctgcctgattcagagatcggtcagatcccaactgttattttcggtacagtcaatggaatgattggagtcattgcttcgctgccacaagaacagtatgctttcttggagaagttgcagtcgagtttgaggaaagtgatcaaaggagtagggggactgagccacgagcagtggagatcgtttaataacgagaagagaaccgtggaggcgaggaacttcttggatggggacttgatcgaatcgtttctggatctgagtaggaacaagatggaggagatatctaaatccatgaatgttcaggtggaagaattgtgtaagagagttgaagagctcactaggcttcactaaagccctcatcaaaatcaatgccataagctatgtttttcccttcctttttaaaacttatgttgagttgaaagtcttttgtcattaacagcttttgaagtttgattgagttgttgtcttcgtgatgataactttgctcaagtgttgtctgtctttgtcaaaccaactctttttcaagtcttttggattgaaaaaaaacgtgaatcactttatcaaactttatgaaaataaaccttatgtta

SEQ ID NO: 3268 - DNA, 3728 bp, Brassica rapa
tgttgtttcttcttggttcttcgcttttcgcctctttctcattgtttctctctctttcttctccgttaaaatccccaaacctcgtcttagagaaatccagaagcttctcccgaatcagaggcgggaaagccctcgcgtagtagacagtgaatccataagaagaagaagatgagctcatggaactacgtcgtcacggctcacaagcccaccagtgtcactcactcgtgcgtcggaaacttcaccagtccccaagagctcaacctcatcgtcgcgaaatgtactcgaattgagatccatttgctcaccccacaaggccttcagcctatgctggatgttcctatatatggaaggattgctactttggagttgttcaggccccatggcgaaacacaagactttttgttcatcgtaactgagagacacaaattctgtgttcttcagtgggatgctgaatcctctgagcttgtcacaagagcaatgggggatgtttccgatcgtataggccgaccaacagacaatggtcagattggcataatagatccagattgtagattaattggactccacctgtatgacggcttgttcaaggttataccatttgacaataagggacagctcaaggaagcttttaatatcaggctggaggagttgcaggttctggatatcaagttcctgtttggatgtgcaaagcccacaattgcagtactttatcaggacaacaaagatgctcgtcatgttaaaacatatgaagtctctctaaaagataaggactttgtcgagggtccatggtcacagaacaatctcgacaatggtgctgacttactgattcccgtaccaccacctctctgtggcgtccttattattggtgaagaaacaattgtctattgtagtgctaatgcattcaaagcaataccaatacgaccttccatcactaaagcatatggaagagttgatgttgatggctctaggtatcttcttggtgaccatgctggactggttcacctgcttgttataacacacgagaaagaaaaggtcactggcctaaaaattgagctcctgggtgaaacatccattgcatccactatatcataccttgacaatgccgttgtctttgtcggctcaagctatggcgattctcagctagtaaagctaaatctacatcctgatgcgaaaggctcatatgtagaagtcttggagaggtataccaacctggggcctattgtcgacttctgtgtggtcgacctcgagaggcaagggcaaggtcaggttgtaacttgttctggggcatttaaggatggttccctccgcatagttcgcaatggcataggaatcaatgaacaggcgtctgtggaacttgaaggcatcaagggaatgtggtcgttgaaatcttcagttgatgaagccttcgacacattcctcgtggttagctttatcagtgaaactcgcatattagccatgaaccttgaagatgaactggaagaaactgagattgagggcttcttgtcccaactccagactttattttgccatgatgctgtgtacaatcagcttgtacaggttacctcaaattctgttagactagtcagctctacaactagagaattgcgggatgagtggcatgccccagctggattcactgttaatgttgcaaccgcaaatgccagccaggttcttctggcgactggaggtgggcatttggtttatctagaaattggagatgggaaattgacagaagtgcaacatactgttcttgagtacgaggtttcttgccttgacatcaaccccattggcgacaatcctaactacagtcagctagcttcggttgggatgtggacagatataagcgtcaggattttttccctgccagaactgactcttattacaaaagagcaactaggaggagagatcattccccgttctgttcttctctgttcgttcgaagggatatcttacttgctctgtgctcttggagatggtcatcttttgaacttccagttggacacaactactggtcaattgaaagacagaaagaaagtatcacttgggactcagcctataactcttcgtacgttttcatctaaaagcgccacacacgtcttcgctgcatcagatagaccaactgtaatctatagcagcaacaagaagctgttatacagcaatgtcaatcttaaagaagttagttatatgtgtcctttcaactctgctgcttttcccgacagtttggcgattgccagagaaggtgaactcacgattggaaccattgatgatattcagaagcttcacatacgcactattcctctgggagagcatgctcgtcgaatctgccatcaggaacagacacgtacatttggtatctgcagtttgggaaaccagacaaatgctgaagaatctgaaatgcattttgttcgtctgttagacgaccaatctttcgagtttatgtcaacctatcccttggatgcgtttgaatacgcttgctccatactaagctgctccttcaccgacgacaagaatgtctattactgtgttggaaccgcatatgttttaccggaagaaaacgaaccaaccaagggaaggatattggtatttatagtagaggatgcgaaactgcaacttatcgctgagaaagaaaccaaaggagctgtgtactctctcaatgcctttaatggaaaacttctcgctgctatcaatcagaagattcagttatacaagtggatgctgcgtgatgatggcactcgtgaattgcagtctgaatgtggacatcacggacacattctagctctctatgttcagacccgtggagactttatcgttgttggtgatctcatgaaatcgatctccttgcttatctataagcacgaggaaggtgcaattgaggaacgagctcgggactacaatgctaactggatgtctgctgttgagatactcgatgatgatacctaccttggcgctgagaacaatttcaatctgttaacggtgaagaagaacagtgaaggtgctactgatgaagaacgagggaggttagaagtagttggggagtaccacctcggggaattcgttaacagattctgccatggatcgctcgtgatgaggctgcctgattcagagatcggtcagatcccaactgttattttcggtacagtcaatggaatgattggagtgattgcttcactgcctcaagaacagtatgctttcctggagaagttgcagtctagtttgaggaaagtgatcaaaggagtagggggactgagccacgagcagtggagatcgtttaataacgagaagagaaccgtggaggcgaggaacttcttggatggggacttgatcgaatcgtttctggatctgagtaggaacaagatggaggagatatctaaatccatgaatgttcaggtggaagaattgtgtaagagagttgaagagctcactaggcttcactaaagccctcatcaaaatcaatgccataagctatgtttttcccttcctttttaaaacttatgttgagttgaaagtcttttgtcattaacagcttttgaagtttgatcgagttgttgtcttcgtgatgataactttgctcaagtgttgtctgtctttgtcaaaccaactctttttcaagtcttttggattgaaaaaaaacgtgaatcactttgtcaaactttatgaaaataaaccttatgttatcattttcttgaacattttatcaattgcatgcgtttttttttttttgatgtgtt

SEQ ID NO: 3269 - DNA, 3506 bp, Ambrosia trifida
agtacgtataattacgtggtaacagctcataagcctaccaatgtcacacactcatgcgtcggcaatttcaccggtccacaagagctcaatcttatcattgcgaaatgtacgcgtatcgagattcatttacttactcctcaaggcttgcagcctatgttggatgtgccaatatacggaagaattgcaaccctagaactttttcgttctcatggtgaaacacaagaccttctgtttattgcaacagaaagatacaaattttgtgttcttcagtgggatgctgatgcaaatgaggtcattacaagagctatgggtgatgtctcggatcgcataggcagacctacagacaatggccagataggtataatcgaccctgactgcagactcattggacttcatttgtatgatgggttgtttaaggtcattccatttgataacaaaggacaactcaaagaagcatttaacatcaggctagaagaacttcaagttttggatattaaatttctatatggttgtccaaagcctacaatcgttgtcctttatcaggataataaagacgcacgccatgtaaaaacatatgaggtatcgttgaaggataaagactttgttgaaggtccatggtctcaaaacaatcttgacaatggggcggatttgctaataccagtcccaccacctttttgtggtgtattaatcatcggggaggagacaattgtgtattgtagtgcttctgcgtttaaagcaatacccatcagaccttctattactagagcctatggaagggtggatgcggatggttccaggtatctacttggtgaccttagtgggcttcttcacttgcttgtcatagtgcacgagaaagacaaggttactggactcaaaattgagcttctaggggaaacatctatagcatcaactatatcgtatcttgataatgcatttgtatacgtcggctcaagctttggagattcccagcttatcaaattaaatcttcagcctgatgcaaaaggttcttacgtggaagtgctagaaagatatgtcaacttgggcccaattgttgacttttgtgtggttgacttagagagacaaggtcaagggcaggttgttacttgctcaggagcatataaagatggttctctttgcattgttagaaacgggattgggataaacgaacaggcatctgtggaactacaaggtatcaaaggaatgtggtcactaagatcagctacagatgatatgtatgacacgtttttggttgttagtttcattagtgagactcgaatattagcaatgaatgtagaagatgagctagaggaaactgagattgaaggcttttgttctcaagtacaaactttattctgtcatgatgctgtgcataatcaacttgtccaggttacatcaagctccgtgagactcgtgagttcagtatcaagagaattaagacatgaatggcatgcacctactgagaactctattaatgttgccactgctaacgctactcaggttctattggctactagaggtggccatcttgtttaccttgaaattggtgatggagttttagtagaaaaaaaacatgccgaactgaaatatgatatttcatgccttgacataaacccaataggtgaaaatcttaattatagtaatcttgccgcagttggtatgtggacggacattagtgtcagaatattttcactccctgacctagagctcaggactgaacagcatttaggtggtgaaattattccccgttctgttcttctttgcgcctttgaagggataccttacttgctgtgtgcacttggagatggtcatcttttgaactttttactgaacacgggcactggcgaattaacagatgaaaaaaagtgtcacttgggacccagccgataacacttagaacattttcatcaaaaaataccactcatgtttttgcagcctctgataggccaactgttatatacagcagtaacaaaaagttactctacagtaatgtgaacctaaaagaagtcagtcatatgtgcccttttaattctgctgcttttccagacagtcttgcaattgctaaagaaggtgagttaacaatcgggacaattgatgatattcagaagcttcacatccgctcaatccctcttggtgaacatgcaaggcgtatctgccatcaagaaaagtctcgtacatttgctgtatgtagtttaaagtacaaccagtcaagcacagaggattctgaaatgcatttcattcggttgttagatgatcaaacctttgatttcatatcgacttatgcacttgatcaatttgagaatggctgttccatactcagttgctctttctcagatgataataatgcatattattgtgttggtacggcttatgttatgccagaggagaatgaaccaacaaaggggcgcattttggttttcatggttgaagatgggaagcttcaactagtagctgagaaagaaactaagggtgctgtgtactccttgaatgccttcaacggtaaactactagctgctataaatcaaaaaattcagctgtacaagtggatgcttcgtgacgacggtacacgtgaattgcaatctgaatgtgggcatcatggccacatacttgctctttatgtacaaactcgtggggatttcatcgtcgttggtgatttaatgaaatcaatttcactcttgatttataagcatgaggaaggtgctatagaggaacgagcacgtgattacaacgccaattggatgtcagcagtcgagattctcgacgacgacatttacctcggtgccgagaacaacttcaatctttttacagtccgcaaaaacagcgaaggcgccactgacgaggaaagagggcgtctagaggtggttggtgaataccaccttggtgaattcgtgaaccgattccgacatggttcacttgtgatgcggttacccgattctgatgttggtcaaatcccaaccattatttttgggacagtcaacggtgttattggtgtcattgcttcactccctcaagaccagtacattttcatggagaaacttcagtctaacttgagaaaggttataaaaggcgttggcggtttgagccatgaacaatggaggtcgttttataacgaaaagaaaaccgccgactcgagaaatttcttggatggtgatttaatcgagtcgtttcttgatcttggaaggagcagaatggaagagatttcaaaatctatgaatgtttcagttgaggaagttatgaagagagtagaagaattaacaagattgcattaaggttgtatcccatggtttttctaatttttgagaacgttttgaaccttgacatatgtgaaactttgtacttttttttattagtcttgttttgtatataataaaagaaatttgtgtggttgtgaattgtatccttacaacactcacatttgttccttctaatttcgtgagggaaaaccctatatttatataggattttgagtggagaaaattggtaaccaactctttatcaataaaaaagaa

SEQ ID NO: 3270 - DNA, 3608 bp, Helianthus annuus
tatgtttgacatagcccaataccaatacatacccatagcctcacctcaaaacgacgtcgtggcccgcattctcaccagcaacacaataataataagtagcattcgcggtgccggtgtccaacagaaatcgaagaatcgagaagaacagggtttctagggttccatttcgaagaagaagatgagtacgtataattacgtcgttacagctcataagccgacgaatgtcactcattcatgtgtaggtaatttcaccggttctcaagaactcaaccttatcatcgcgaaatgtacgcgtatagagattcatttacttactcctcaaggcttgcagcctatgctggatgtgccaatatacggaagaatcgcaaccctagaacttttccgtcctcatggtgaaacacaagacctgctgtttattgcaacagaaagatacaaattttgcgttcttcaatgggatgctgctgcgaacgaggttattacaagatctaacggtgatgtctcagatcgcataggcagacctacagacaatggccagataggcataattgaccctgactgcagactcattggactccatttgtatgatggcttgttcaaggttattccattcgataacaaaggacaactcaaagaagcatttaacatcaggctagaagaacttcaagttttggatatcaaatttctatatggttgtccaaagcctacgattgttgttctatatcaggataacaaagatgctcgccatgttaaaacatatgaggtttctttaaaggacaaagactttgttgaaggtccgtggtctcagaacaatctcgataatggtgctgatttgctaattccggttcctccacctttttgtggtgtattaattattggggaagagacaattgtctattgtagtgcttctacattttaagcgattccaattaggcccttcattactagatcgtatggaagggtggatgctgatggttctaggtatttacttggtgatcttagtgggcttcttcacttgctcgtcatagcacatgagaaagaaaaggttactggactaaaaattgagcttctcggggaaacatctgtagcatcaaccatatcataccttgataatgcgtttgtatatgtaggctcaagctatggagattcccagcttattaagttaaatctccagcctgatgcaaagggttcttatgtagaagtgctagaaaagtatgtcaacttgggccctattgttgacttttgtgtggttgacttagagaggcaaggtcaaggccaagttgtcacttgctcaggagcatataaagacggctctcttcgcatcgttagaaacggaattgggataaacgaacaggcgtctgtggaactacaaggtataaaaggaatgtggtcactaagatcagcaacagatgatctgtatgacacatttttggttgttagctttattagcgagactcgaatattagcaatgaatatggaagatgagctcgaggaaactgaaattgagggcttttgttctcaagtacaaacattattctgtcatgatgctgtgcataatcaacttgttcaggttacttcaagctctgtgagacttgtgagttcggtatcccgagaattaagacatgagtggcatgcacctgctgactactctatcaatgttgccactgctaatgctactcaggttcttttggctactagaggtggccatcttgtctatcttgaaattggcgatggaatattagttgaaaaaaagcatgcccaactgaaatacgatatttcatgccttgacataaatccgatcggtgaaaatccaaattacagtagccttgctgcggttggtatgtggacggacattagcgttaaaatattttcactcccggacctaaatctcatgactgaggaacagttaggtggtgaaattataccccgatccgttcttctatgtgcctttgaagggataccttacttgttatgtgcacttggagatggtcatcttttgaactttttactgaacacgagtactggcgaattaactgataggaaaaaagtttcacttgggacccaaccaataacccttcgaacgttttcatcgaagaataccacacatgtttttgcagcctctgacaggccaacagttatatacagcagtaacaaaaagttactctacagtaacgtgaaccttaaagaagtcagttacatgtgcccattcaactctgctgctttcccagacagtcttgcaattgctaaagaaggtgaattgacaattgggacaattgatgatattcagaagcttcacatccgttcaattcctctcggtgaacatgcaaggcgtatctgccatcaagagaagtctcgtacatttgcgatatgcagtttaaagtacaaccagtcaagcacagaagaatcggaaatgcattttattcgtttgttagatgaccaaacatttgatttcatatccacttattcacttgaccaatttgagtacggttgctccatactcagctgttctttctcagatgacaacaatgcatattactgtgtcgggactgcttatgttatgccagaggagaacgaaccatcaaagggccgtattttggttttcatagttgaagatgggaagctacaactagtagctgagaaagaaactaaaggtgctgtttactccttgaatgccttcaatggtaaactccttgctgctataaatcaaaaaattcagctgtacaagtggatgcttcgtgacgatggcacacgtgaattacaatctgaatgtggacatcacggtcacattcttgctctctatgtacaaactcgtggggatttcatcgttgttggtgatttgatgaaatcaatttcactcttgatttataagcatgaggaaggtgctatagaggaacgggcccgtgactacaacgccaactggatgtcagctgtagaaattcttgatgacgacatataccttggtgctgaaaacaatttcaatctttttacagtccgtaaaaacagcgaaggtgctactgatgaagaacgaggccgcctagaggttgttggtgaataccaccttggtgaatttgtgaaccgtttccgacacggttcacttgtgatgcggttgccagattctgatgtcggtcacatcccaaccataatttttggaaccgttaacggtgttattggcgttattgcttcactcccacaagaccaatacattttcatggagaaacttcaaaccagtttaagaaaggtcataaaaggtgtcggcgggttgagccacgagcaatggaggtcgttttataacgagaagaaaactgctgactcgagaaatttcttggacggtgacttaatcgagtcgtttcttgatctgggaaggaacagaatggaagaaatatcgaaaactatgaatgtttcggtggaggaacttatgaagagagtagaagaactaacaaggttgcattgagttacttcgcaacagaaaccttctttgaatcttttgtcatatgaaacactgcaccttttttccttggtttggtttgtatcatcttataatgttgttgcacaaaagaaagaaagtttgtcactttatcttgcctttcaccatcttttatttattttttctt

SEQ ID NO: 3271 - DNA, 3408 bp, Chrysanthemum coronarium
cgatctcttctagggttttattttacacagtgccaaacaaatcctgaatcaattaatcaaattgaataaataaaaataaatgagcacgtataattacgtagtaacggctcataagccaacgaatgtcactcattcatgtgtcggcaatttcaccgcttcgaacgagcttaatctcattattgcgaaatgtacccgcatagagattcatttacttactccttcaggcttgcagcctatgttggatgtgccaatatacggaagaattgcaacccttgaactgttccgtccgcatggcgaaacacaagaccttctgtttattgcaacagaaagatacaaattttgtgttcttcagtgggatgctgatgccaatgaggttattacaagagcgatgggtgatgtctcagatcgcataggcagacctacagacaatggccagataggcataattgaccctgattgcagactcattggactccatctgtatgatggactatttaaggttattccattcgataacaaagggcaacttaaagaagcgtttaacatcaggctagaagaacttcaagttttggatatcaagtttctatacggttgtccaaagcctacaattgttgttctttatcaggataataaagatgctcgccatgtaaaaacttacgaggtctctttaaaggataaagactttgttgaaggtccatggtctcagaataatcttgataatggggctgacttgctaataccagttccaccacctttttgtggcgtattaatcataggggaggagacaattgtgtattgtagtgcctcagcatttaaagctataccaataagaccttctattactagagcctatggaagggtggatgcggatggttccagatatttgcttggtgaccatagtgggctacttcacttgcttgtgatagctcatgagagagaaaaagtcacaggactcaaaattgaacttctaggggaaacatcaattgcctctactatatcgtaccttgataatgcatttgtatatgttggctcgagctatggagattctcagctagttaagttgaatgtccagccagatgcaaaaggttcttatgtggaagtgctagaaagatatgtcaacttgggaccgatagttgacttctgcgtggttgacttagaaaggcaaggtcaaggccaggtcgtaacatgctcaggagcttataaagatggttcccttcgcattgttagaaacggaattgggataaatgaacaggcatctgtggaactgcaaggtatcaaaggaatgtggtcgcttagatcagcaacagatgatctgtatgacactttcttggttgttagcttcattagtgagactcggatattggcaatgaatttagaggaagagctagaggaaactgaaattgagggctttaattctcaagtgcagactctattctgtcatgatgctgtacataatcagcttgttcaggttacttcaagctcggtgagattggtgagttcgataacaagagagctaaaacacgaatggtttgcacctgctgattactctataaacgttgcaacagctaacgctactcaggtgctattggctactagaggtgggcatctagtttacctcgaaattgctgatggacaattagtggagaaaaagcatgctcagttggagtatgatatttcatgtcttgatataaatccaattggtgataacccaaattatagtaatcttgccgcggttggtatgtggacggatataagtgtcaaaatattttcactccctgatctgactcttaagaccgaggaacatttaggtggtgaaatcataccgcgatctgttcttctttgtgccttcgaagggataccttacttgttgtgtgcacttggagatggtcatcttttaaactttttactgaacacgacaacgggccaattaacagacaggaaaaaggtgtcacttgggacccaaccgataacactaagaacattttcatcaaagagtaccacacatgtttttgcagcttctgataggccaacagtgatatacagcagtaacaagaaattactctacagcaacgtgaaccttaaagaagtcagttacatgtgccctttcaattctgctgcttttcccgatagtcttgccattgcaaaagaaggtgagttgacaattgggacaattgatgatattcagaagcttcatatccgttctattcctcttggtgaacatgcaagacgtatctgccatcaagaacagactcgtacttttgcaatatgcagtttaaagtacaaccagtcaagcacagaagattctgaaatgcacttcattcgcttgttagatgatcagacattcgactttatatcctcttattcattggaccagtttgagtatggttgttccatactcagttgctctttctcagatgataataatgcatattactgtgttgggactgcctatgtcatgcctgaggagaatgaaccaacaaaggggcgtattttgattttcatggttgaagatgggaagctacagctagtggctgagaaagaaaccaagggtgctgtttactctttgaacgcctttaacggtaaactccttgctgctataaatcagaaaattcagttgtacaagtggatgcttcgtgacgatggtacgcgagaactgcaatctgaatgtggacatcatgggcacatacttgctttatatgttcaaactcgtggggatttcattgttgttggtgacttgatgaaatccatttcgttgttgatatataagcatgaggaaggtgctatcgaggagagagctcgtgattacaatgccaattggatgtcagctgttgagatactcgatgacgatatataccttggagctgagaacaacttcaaccttttcacagtccgtaagaacagtgaaggtgccactgatgaagaacgtggtcgtctagaagtagttggtgaataccatcttggagaatttgtgaaccgtttccgccatggttcactcgtgatgcggttacctgattctgatgtgggacaaatcccaaccgtaatatttggaaccgttaacggtgttattggtgtcattgcttcacttccccaagaccaatatcttttcatggaaaaacttcaaacaaacttgagaaaggttataaaaggtgttggagggttgagtcatgagcaatggagatcgttttatagtgagaagaaaactgttgactcgagaaatttcttggatggtgatttaatcgagtcgtttcttgatcttggaaggagcagaatggaagaaatctcaaaaacgatgaatgtttcagttgaggaacttatgaagagagtagaagagttaacaaggttgcattagttagctctcaaggtttttctagttcctgaaaaaactttcgtttaaaacttttgacgtgt

SEQ ID NO: 3272 - DNA, 3551 bp, Olea europaea
ccgatgctatctattgatgcagagatagaaacatatatatacacagagtaaaataaagatgagtatatggaactatgtggtaacggcacacaagccaacgaatgtcacgcattcgtgcgtcggctatttcaccggtccgcaagagtgcaatctcataattgcgaaatgcacccgactggagattcattcggtcgccaatcaaggtttacaggctatgttggatgtgccaatatatggaagaattgctacacttcagcttttccgtccacatggagaaacacaagatcttctttttgttgcaacagaaagatataaattctgtgttttgcaatgggatgctgaggcagctgaggttattacaagggcaatgggagatgtttcggatcgaatagggcgcccgacggacaatgggcagattggcataattgatcctgattgcagattgattggactccatctctatgatggattatttaaggttattccatttgacaataaaggccagctcaaggaagcatttaacattcggcttgaggagcttcaagttttggatatcaaatttctacatggttgcccaaagcctacaattgttgtgctttaccaggataacaaggatgcccgacatgccaaaacatatgaggtggctttgaaggataaagattttattgagggtccatggtctcagaacaatcttgataatggggcagagttgctaataccaatacctcctccactttgcggtgtcttaattattggagaagaaaccattgtgtattgtagtgcctcgacttttaaagctatcccaatcagaccttctatcacaaaagcttatgggaggattgatgctgatggttctcggtacctactaggggaccatagcggtcttctttacctccttgtcataacccaagaaaaagagaaagtaacgggactcaagatcgagcttttgggggaaacatctattgcttcaactatttcatatcttgatagtggcattgtttatgttggctcaagctatggggattcacagcttataaggcttaatcttcagcccgatgaaaaaggttcttatgtagaagttatggaaaggtatgtcaatttgggacccattgttgacttctgtgtggttgacttagagaggcagggtcaaggtcaggttgtaacttgctcaggagcatataaagatggttctcttcgcattgttcgaaatggaattggtattaatgaacaggcatctgtagaacttcaaggaatcaaaggcatgtggtcattacgatcagctactgatgatccatatgacaccttcttggttgtaagctttatcagcgagacacgtattttggcaatgaatcttgaggatgagttggaggaaactgagatagaaggattttgttcacaagtccagactttgttttgccatgatgctatatatgatcaacttgtccaggttacttcaaattccgtgagattggtcagttctacctctagagagttgcgacatgaatgggttgctccggcggggtattcgatcaatgtagctacagctaatgctacacaggttttactagctactgggggtggctatttagtttatttagaaattggtgatggagcgctgacagaagtaaaacatgcccagttggagtatgacatctcatgcctagacataaattcaattggtaataatccaaaatacagtcaacttgcagcagttggaatgtggacagatattagtgtcaggatattttctctccctgacttgaatctgatcacgaaggaacatttgggaggggagataattcctcgttctgtacttctgtgttcctttgaagggatatcttatttgctatgtgctcttggagatggtcatcttctaaactttgtgttgaatgtgattactggcgagctaacggataggaaaaaagtctcccttggtacccagcctataacacttcgtactttctcatctaagaatgccacacatgtttttgctgcatccgatagaccaactgtcatctacagtagcaacaaaaagttactttacagcaatgtaaatctaaaagaagttagtcacatgtgcccgttcaactcagctgcttttccagatagccttgcgattgcaaaagaaggtgagttgactattggcaccattgatgacattcagaagcttcatattcgctctatcccacttggggagcaggcacgccgtatatgccatcaggagcagactcggactttcgcaatctgtagtttaaagtataatcaatcaagcatagaagattatgaaatgcactttatccgcctgttagatgaccaaacttttgagttcatatccacttacccacttgaccaatttgagtggggttgctccattcttagctgctccttctctgatgacagtaacgtgtactattgtgtagggactgcatacgtaatgcctgaggagaatgaacccaccaagggcagaatactggtttttacagtagaagatagaaaacttcaactaattgcagagaaagaaactaagggagctgtttactctctcaatgccttcaatgggaaactgcttgctgctattaatcaggagattcaattgtataaatggatgcttcgtgaggatggctctcgtgaattgcaatcggaatgtggacatcatggacatattcttgcactttatgtgcaaactagaggagattttattattgtgggtgatctgatgaaatcaatttctctgttaatttacaagcacgaggagggtgccattgaggagcgagctcgtgattacaacgcaaattggatgacggccatcgagattctagatgatgacatttatctcggtgctgaaaatggtttcaatctctttactgttcggaaaaatagtgaaggtgccactgacgaggaacgtggacgtctcgaggtggttggagaataccacctcggcgaatttgttaatcgattccgacatggttctcttgtaatgcgattaccagattctgatgttggccagatcccaaccgtcatttttggcactgtcaacggtgttatcggggttattgcttctcttccttatgagcagtatgctttcatggagaaactgcaaacgaatctaagaagagtgataaagggcgtgggaggactaggccatgagcagtggaggtctttctacagcgagaagaaaacttctgatgctaagaactttttggacggcgatttgattgagtcattcctggatcttggccggaatcggatggaggagatttctaaggcaatgtgtgtttcagtggaggaattaatgaagagagtagaagagctgactaggttacattaactctgcttcatgagccttctattttccccgtcctgggattttctgtttgcatggcaggctgaacgcgtttcttttgtatctaatatctatagcatgttttctaaaaacattttcttttcgttttccctttccgaggatgtttgttatattaccgtctataagacaaatatcttaaatttttgtaaacaatttatgctccgttaagttttgcttgtgtttacca

SEQ ID NO: 3273 - DNA, 3418 bp, Chrysanthemum coronarium
ctcttctagggttttattttacacagtgccaaacaaatcctgaatcaattaatcaaattgaataaataaaaataaatgagcacgtataattacgtagtaacggctcataagccaacgaatgtcactcattcatgtgtcggcaatttcaccgcttcgaacgagcttaatctcattattgcgaaatgtacccgcatagagattcatttacttactccttcaggcttgcagcctatgttggatgtgccaatatacggaagaattgcaacccttgaattgttccgtccgcatggcgaaacacaagaccttctgtttattgcaacagaaagatacaaattttgtgttcttcagtgggatgctgatgccaatgaggttattacaagagcgatgggtgatgtctcagatcgcataggcagacctacagacaatggccagataggcataattgaccctgattgcagactcattggactccatctgtatgatggactatttaaggttattccattcgataacaaagggcaacttaaagaagcgtttaacatcaggctagaagaacttcaagttttggatatcaagtttctatacggttgtccaaagcctacaattgttgttctttatcaggataataaagatgctcgccatgtaaaaacttacgaggtctctttaaaggataaagactttgttgaaggtccatggtctcagaataatcttgataatggggctgacttgctaataccagttccaccacctttttgcggtgtattaatcataggggaggagacaattgtgtattgtagtgcctcagcatttaaagctataccaataagaccttctattactagagcctatggaagggtggatgcggatggttccagatacttgcttggtgaccatagtgggctacttcacttgcttgtgatagctcatgagagagaaaaagtcacaggactcaaaattgagcttctaggggaaacatcaattgcctctactatatcgtaccttgataatgcatttgtatatgttggctcgagctatggagattctcagctagttaagttgaatgtccagccagatgcaaaaggttcttatgtggaagtgctagaaagatatgtcaacttgggaccgatagttgacttctgcgtggttgacttagaaaggcaaggtcaaggccaggtcgtaacatgctcaggagcttataaagatggttcccttcgcattgttagaaacggaattgggataaatgaacaggcatctgtggaactgcaaggtatcaaaggaatgtggtcgcttagatcagcaacagatgatatatatgacactttcttggttgttagcttcattagtgagactcggatattggcaatgaatttagaggacgagctagaagaaactgaaattgagggctttaattcgcaagtgcagactctattctgtcatgacgctgtgcataatcagcttgttcaggttacttcaagctcggtgagattggtgagttcgataacaagagagcttaaaaacgaatggtttgcacctgctgattactctataaatgttgcaacagctaacactactcaggtactattggctactagaggtgggcatctagtttatcttgaaattactgatggactattagtggaaaaaaggcatgctcagctagagtatgatgtttcatgccttgatataaacccaattggtgataacccaaattatagtaatcttgctgcggttggtatgtggacgggtataagtgtcagaatattttcactccctgacctgactcttaagactgaggaacacttaggtggtgaaatcatacctcgatctgttcttctttgtgccttcgaagggataccttacttgttgtgtgcacttggagatggtcatcttttaaactttttactgaacacgacaacgggccaattaacagacaggaaaaaggtgtcacttgggacccaaccgataacactaagaacattttcatcaaagagtaccacacatgtttttgcagcttctgataggccaacagtgatatacagcagtaacaagaaattactctacagcaacgtgaaccttaaagaagtcagttacatgtgccctttcaattctgctgcttttcccgatagtcttgccattgcaaaagaaggcgagttgacaattgggacaattgatgatattcagaagcttcatatccgttctattcctcttggtgaacatgcaagacgtatctgccatcaagaacagtctcgtacttttgcaatatgcagtttaaaatacaaccagtcaagcacagaagattctgaaatgcattttattcgcttgttagatgaccagactttcgactttatatcctcttattcactggaccagtttgagtatggttgttccatactcagttgctctttcactgatgatactaatgcatattactgtgttgggacggcctatgttatgcctgaggagaatgaaccaacaaaggggcgtattttgattttcatggtcgaagatgggaagctacagctagtggctgagaaagaaaccaagggtgctgtttactctttgaacgcctttaatggtaaactactagctgctataaatcagaaaattcagttgtacaagtggatgcttcgtgacgatggtacacgagaattgcaatccgaatgtggacatcatgggcacatacttgctctatatgtacaaactcgtggagatttcattgttgttggtgatttgatgaaatccatttcattgttgatgtataagcatgaagaaggtgctattgaggaaagagctcgtgattacaatgccaattggatgtcagctgttgagatactggatgacgatatataccttggagctgagaacaacttcaaccttttcacagtccgtaagaacagtgaaggcgccactgatgaagaacgtggccgtctagaagtagttggtgaataccatcttggagaattcgtgaaccgtttccgccatggttcactcgtgatgcggttacctgattctgatgtgggacaaatcccaaccataatattcggaaccgttaacggtgttattggtgtcattgcttcacttccccaagaccaataccttttcatggaaaaacttcaaacaaatttgagaaaggttataaaaggtgttggagggctgagtcatgagcaatggagatcgttttatagtgagaagaagactgttgactcgagaaatttcttggatggtgatctaattgagtcgtttcttgatcttggaaggagcagaatggaagagatctcaaaaacgatgaatgtttcagttgaggaacttatgaagagagtagaagagctaacaaggttgcattagttaagctctcaaggttttctagttcctgaaaagactttctttcaatacttttgacgtgtgaaactttgtaccg

SEQ ID NO: 3274 - DNA, 3611 bp, Lactuca sativa
ctttagccatatttatatctagaagagcgactctttagcggcagagtgaacccctaagtagcgatcgaaaacgtcgtcgtacggaccatcgcatcggcgaaataataggtaagcatcgaccttagtttggcttgcagaaatcgaagaagagaggagggagagagaaagggttttagggttccattttagcaagagatctccagtcctgtaaagggagatgagtacgtataattacgttgtcacggctcacaagccaacgaatgtcactcattcatgcgtcggcaatttcactggccctcaagaactcaatcttattatcgcgaaatgtacacgaatcgagattcatttactcactcctcaaggcctgcagcctatgttggatgtgccaatatatggaagaattgcaacactagaacttttcagacctcacggtgaaacacaagaccttctgtttattgcaacagaaagatacaagttttgtgttcttcagtgggatgctgatgcaaatgaggttcttacaagagcaatgggtgacgtgtcagatcgaataggaagacctacagacaatggccagataggcataattgacccagactgcagactcattggactccatctgtatgatggattattcaaggtcattccattcgataacaaaggacagctcaaagaagctttcaacatcaggcttgaagaacttcaagttttggatatcaaatttctctatggttgtccaaagcctacaattgttgttctttatcaggataacaaagatgctcgacatgtaaaaacatatgaggtttctttaaaagataaagactttgttgaaggtccatggtctcagaacaatcttgataatggggctgatttactgataccagttccaccacctttttgtggtgtattaatcattggggaagagacaattgtctactgcagtgcctctgcttttaaagcaataccaattagaccttctattactagagcatatggaagggtggatgcagatggttccagatatttacttggtgaccatagtggccttcttcacttgcttgtcattgcccatgagaaagaaaaagttactggactcaaaattgagcttctaggggaaacttctatagcatctactatatcatatcttgataatgctttcgtgtatgttggctcaagctatggagattcccagcttattaagttgaatctccaacctgatccaaaaggctcttacgtggaagttctagaaaggtatgtcaacttgggtccaattgttgacttttgtgtggttgacttagagagacaaggtcaagggcaagttgtcacttgctcaggagcatataaagatggttcccttcgcattgttagaaatggaattgggataaacgaacaggcctctgtggagctacaaggtatcaaaggaatgtggtcactaagatcagcaacagacgacatttatgacacatttttggttgttagcttcatcagtgagactcgaatattggcaatgaatttagaggatgaattagaggaaactgagattgaaggtttttgttctcaagtacaaactttattctgtcatgatgctatccataatcaacttgttcaggttacttcaagctcagtgagactggtgagttcaagttcaggagagctacgaaacgaatggcatgcacccaatgactactctataaatgtcgcgactgccaatgctactcaggttcttttggctactagaggtggccatctggtttaccttgaaattggtgatggtgttttagtagaaaaaaaacacgcagaactgaaatatgatatctcatgtcttgacataaatccaattggtgaaaatccaaattatagtaatcttgctgcagttgggatgtggactgatattagtgtcaagatattttcactacctgatttaaatctcatcactgaagaacatctaggtggcgaaattataccgcgttctgttcttctttgtgcctttgaagggataccttacttgttgtgtgcacttggagatggacatcttttgaactttttactcaacacaagcacaggggaattaacagacaggaaaaaggtgtcacttgggacacaaccgataactttgaggacattttcatcaaagagtaccacacatgtttttgcagcctctgatagaccaacagttatatacagcagtaataaaaaattactctacagcaatgtaaacctgaaagaagtcagtcacatgtgccctttcaattctgctgcttttcctgacagtcttgctattgcaaaagagggtgagttgacaattggcacaatcgatgatattcagaagcttcatattcggtcaattcctcttggagaacatgcaaggcgcatctgtcatcaagaacaatctcggacatttgcaatatgtagtttgaagtacaatcaatcaagcacagaagattctgagatgcattttatccggttgttggatgatcaaacattcgatttcatttcaacttactcacttgaccaatttgagtatggttgctctattttgaattgctctttctcagatgataacaatgcatattactgtgttgggacagcttatgttatgccagaggaaaatgagccaacaaaggggcgcatattggttttcatggtggaagataggaagctacagctagtagctgagaaagaaaccaaaggcgctgtttactctttaaatgctttcaatggtaaactccttgctgctataaatcaaaaaatccagctctacaaatggatgctccgtgacgatgggacccgcgaattacaatccgaatgtggacaccatggccatattctcgctctttatgtacaaactcgtggggatttcattgttgttggtgatctcatgaaatcaatctcactcttaatatacaagcatgaagaaggtgcgatagaggagcgggcccgcgactacaacgcgaattggatgtcggcggttgagattttggatgatgatatttacctgggagctgaaaacaattttaacctttttacggtccgtaaaaacagtgaaggagctacggatgaagaacgggggcgtttagaagtggtaggtgaatatcatttgggtgaatttgtgaaccgattccaacatgggtcacttgtgatgcgtcttcctgattcggatgtggggaagatcccgactataatctttggaactgtgaatggtgtgattggtgttattgcttcgcttcctcaagatcagtatgtgtttatggagaggcttcagacgaatttgaggaaggtgataaaaggggttggggggttgagtcatgaacaatggaggtcgttttatagtgagaagaagactgtggattcgaggaatttcttggatggggatttgattgagtcgtttcttgatcttggaaggagtagaatggaggagatttctaaggttatgagtgtttcggttgaggaacttatgaagagagtagaagagttgactaggttgcattaatggaaacaagtttgtttgggaactttggtatggaatgttgctattttttttttctttttaatgttggtttgtattttgtgatcatgttgcataatggaaatgaaaagagtatggtgttgtgaaa

SEQ ID NO: 3275 - DNA, 3110 bp, Secale cereale
gacctctatgatggattgtttaaggttataccattcgacaacaaaggacagctgaaggaagctttcaatatcagactagaagagcttcaagtgttggacatcaagttcctgtatggctgtgtcagacctacgatagttgtcctctaccaggataacaaagatgccaggcatgtgaagacatatgaagttgcactgaaggagaaagacttcgttgagggtccttggtcacagaacaatttagacaacggagctggtcttttagtacctgtacctgctccactcggcggtgtcataattattggcgaggagacaatagtttactgcaatgctaattctacatttaaagctataccaatcaaacagtccatcacaagagcttatggacgggttgacccagatggctctcgctatttacttggtgataattcaggcattttgcatttacttgtccttacccaggaacgagaaagggtaactggtttgaaaattgagcatttgggagagacttcagttgcatcgtcaatatcgtatcttgataatggtgttgtctatgttggttctcgatttggtgattcacagctggtaaagctgaatctccaacctgatgcaagcggttcattcgttgaaatccttgaacggtatgtgaatcttggacccattgtggacttctgcgtggttgaccttgataggcaaggccaaggtcaggtggtcacttgttcaggagcattcaaggatggttccattcgagtggttcgtaatggtatagggattaatgagcaggcttcagtagagctgcaaggcatcaagggattatggtcactgaagtcttccttcaatgatctgtatgacatgtatctggtggtgagctttataagtgagactcggttcttggctatgaacatggaagatgaattagaagaaattgagatagaagggtttgatgcacaaatccagactttgttctgccaaaatgccatcaatgatctgcttatacaggttactgctaattctgtccggttagtcagttgcacttctcgggagctagtggatcagtggaatgcaccggaaggattttcagtcaatgttgcatcagctaatgccagtcaggtcctgttggcgaccggtggtggccatcttgtttacctagagattagggatgctaagctggttgaagtgaaacatgcgcagctagaacatgagatttcttgtgttgatttgaacccagtaggggagaatccacagtatagctctctggctgctattgggatgtggactgatataagtgtgagcatattttcacttcctgaccttgaattaatcaggaaggaaaatttaggtggagaaattgttcctcggtcagttctgatgtgcaccttggaagggatttcatatttgctttgtgctcttggagatggccaccttttcagttttctactgaatgctagtacaggtgaactaactgatagaaagaaggtttctcttggtacccagccaattagcctccgtacattctcatcaaagggcacaacccatgtgtttgcttcttctgatagaccaactgttatctacagtagcaataagaagctgctgtacagcaatgtcaatctgaaagaagttaatcacatgtgtcctttcaatacagctgcttttcctgacagccttgcaattgctaaagaaggtgaactttcaattggaactattgatgatattcagaagcttcatatccgcacgattccgttgaatgaacaagcacggcgcatttgccatcaggaacagtccaggacactggcgttctgcagtttcaagtacacccagaatagcatggaagagagcgaggcacatttcattcgtttgatggatcatcaaacttttgagtttctgtctacacatcctctcgatcaatacgaatgtggttgctctatgattagctgctcgttctcggatgataataacttctattacattgtggggacagcgtatgttttacctgaggagaatgaaccgacaaagggccggatccttgtatttgctgttgaggatggaaggttgcaattaatcgtagagaaagaaacaaaaggagctgtctattctctgaatgcattcaatgggaaattgttggcagctatcaaccagaagattcagttatacaagtggatgacgcgggaagatggttcccatgagctgcagtctgaatgtggccatcatgggcacatacttgccctgtatacccaaacccgtggtgatttcattgtagtcggagacctgatgaagtcgatatctttgctcgtgtacaagcatgaggagagtgcgattgaagagctcgctagggactacaacgcgaactggatgactgcagttgagatgattgacgatgacatctatgtcggtgcagagaatagctacaacctcttcaccgtgcgcaagaacagcgatgctgccacggacgaggagaggggcaggctggaggtggtcggggagtaccacctcggagagtttgtgaacaggttccggcacgggtcgcttgtgatgcgcctcccagactctgagatgggccagatccccacggtcatcttcggcaccatcaacggggtcattggcatcatcgcctccctgccccacgaccactatgtgttcctggagaagctccagacaaccctggtcaagttcatcaagggcgtgggcagcctgagccacgagcagtggcggtcgttccacaacgacaagaagacgtcggaggctcgcaacttcctggacggggacctgatcgagtcgttcctcgacctcaacagggccaagatggaggaggtggccaaggcaatggcggtacccgtcgaggagctgtccaagcgggtggaggagctgacgagactgcactaggtggtagcgccgggccgtgtatatcctgttttatttgttcgtttaagctgtgttgtaaaccgttggctcctctgctcgagaatgatcctctgcaagtgtttgtagcaacattccttttctgtttttgactttgataagagtgtaacttcaactgtgctgatgtagaattttagtggtgaatcgccgtggtttatgtgcaattgtcaacatgacacacagaaagtttggcagtc

SEQ ID NO: 3276 - DNA, 3576 bp, Chrysanthemum coronarium
ccgggtttgggttgtattgaaagagctgggccgtacatctcatcacccaccaacaaacgacgccgcatcattcatcttcatcacacattttcaacccccaaattaactagacacacacactgtcacacaaacaaacaaacacagttctagggtttacaggagtaccaaaatccttgaaattgaatcaattcaatcaatcaatcagtttaaatgagcacgtataattacgtagtaacggctcataagccaacgaatgttactcattcatgtgtcggcaatttcaccgcttccaacgaactcaatctcattattgcgaaatgtacccgtatagagattcatttacttacttcttcgggcttgcagcctatgctggatgtgccaatatacggacggattgcaactctcgaactgttccgtcctcatggtgaaacccaagaccttctgttcattgccacagaaagatacaagttttgtgttcttcagtgggatgccgatgccaatgaggttattacaagagcgatgggtgatgtctcagatcgcataggtagacctacagacaacggccagattggaataattgaccctgattgcagacttattgggctccatctgtatgatggactatttaaggttattccattcgataacaaaggacaacttaaagaagcatttaacatcaggctagaagaactccaagttttagacatcaagtttctatacggctgcccgaagcctacaattgttgttctttatcaggataataaagatgctcgccatgtgaaaacgtacgaggtctctttaaaggataaagactttgttgaaggtccatggtctcagaataatctcgataacggggctgacttgctaataccggttccaccacctttctgtggtgtattaatcataggggaggagacaattgtgtattgtagtgcctcagcatttaaagctataccaataagaccttctattactagagcatatggaagggtggatgcggatggttccagatatctgcttggtgaccatagtgggctacttcacttgcttgttatagctcatgagagagaaaaagtcacgggactcaaaattgaacttctaggggaaacatcagtagcatctacgatatcatatcttgataatgcatttgtatatgttggctcgagcttcggagattctcagcttgttaagttgaatgtccagccagatgcaaaaggttcttatgtcgaagtgctagaaagatatgtcaacttgggtccgatagttgacttctgcgtggttgacttagaaaggcaaggtcaaggccaggttgtaacatgctcaggagcttataaagacggttcccttcgcattgttagaaacggaattgggataaatgaacaggcatctgtggaactgcaaggtatcaaaggaatgtggtcgcttagatcagcaacagatgatatatatgacactttcttggttgttagcttcattagcgagactcgaatattggcaatgaatttagaggacgagctagaagaaactgaaattgagggctttaattcgcaagtgcagactctattctgtcatgacgctgtgcataatcagcttgttcaggttacttcaagctcggtgagattggtgagttcgataacaagagagcttaaaaacgaatggtttgcacctgctgattactctataaatgttgcaacagctaacactactcaggtactattggctactagaggtgggcatctagtttatcttgaaattactgatggactattagtggaaaaaaggcatgctcagctagagtatgatgtttcatgccttgatataaacccaattggtgataacccaaattatagtaatcttgctgcggttggtatgtggacgggtataagtgtcagaatattttcactccctgacctgactcttaagactgaggaacacttaggtggtgaaatcatacctcgatctgttcttctttgtgccttcgaagggataccttacttgctgtgtgcacttggagatggtcatcttttaaactttttactgaacacgacaacgggccaattaacagataggaaaaaggtgtcacttgggacccaaccgataacactgagaacattttcatcaaagagtaccacacatgtttttgcagcttctgatagaccaacagttatatacagcagtaacaagaaattactctacagcaacgtgaaccttaaagaagtcagttacatgtgccctttcaattctgctgcttttcccgatagtcttgccattgcaaaagaaggcgagttgacaattgggacaattgatgatattcagaagcttcatatccgttctattcctcttggtgaacatgcaagacgtatctgccatcaagaacagtctcgtacttttgcaatatgcagtttaaaatacaaccagtcaagcacagaagattctgaaatgcattttattcgcttgttagatgaccagactttcgactttatatcctcttattcactggaccagtttgagtatggttgttccatactcagttgctctttcacagatgatactaatgcatattactgtgttgggacggcctatgttatgcccgaggagaatgaaccaacaaaggggcgtattttgattttcatggtcgaagatgggaagctacagctagtggctgaaaaagaaaccaagggtgctgtttactctttgaacgcctttaatggtaaactactagctgctataaatcagaaaattcagttgtacaagtggatgcttcgtgacgatggtacacgagaattgcaatctgaatgtggacatcatgggcacatacttgctttatatgtacaaactcgtggagatttcatcgttgttggtgatttgatgaaatccatttcattgttgatgtataagcatgaagaaggtgctatcgaggaaagagctcgtgattacaatgccaattggatgtcagctgttgagatactcgatgacgatatataccttggagctgagaacaacttcaaccttttcacagtccgtaagaacagtgaaggcgccaccgatgaagaacgtggtcgtctagaagtagttggtgaataccatcttggagaattcgtgaaccgtttccgccatggttcactcgtgatgcggttacctgattctgatgtgggacagatcccaactataatattcggaaccgttaacggtgttattggtgtcattgcttcacttccccaagaccaataccttttcatggaaaaacttcaaacaaatttgagaaaggttataaaaggtgttggagggttgagtcatgagcaatggagatcgttttatagtgagaagaaaactgttgactcgagaaatttcttggatggtgatttaatcgagtcgtttcttgatcttggaaggagcagaatggacgaaatctcaaaaacgatgaatgtttcagtcgaggaacttatgaagagagtagaagagctaacaaggttgcattagttaagctctcgaaggttttctagttcctgaaaagactttctttcgagacttttgacgtgtgaaactttgtaccgtttttgttggcacgagtagtgt

SEQ ID NO: 3277 - DNA, 3580 bp, Arabidopsis lyrata
ctttgcatcgtctctctctctttttctcttaccttttttcgtttaaatctcaaagagaacccagaagcttcttataaaagaggcgggaaatttctcacgcgtgttgcatagaaaatcgaaaaccctagtttttctgggccaagaagaaaatgagcgtatggaactacgccgttacggctcaaaaaccgacctgtgtcactcactcttgcgtcggaaacttcaccagtcctcaagaactcaatctcattgttgcgaaatccactcgaatcgagatccatctgctttctccacagggacttcagactatactggatgttcctctatatgggaggatcgccactttggaattgttccgtccccatggtgaagcacaagattttttgtttgttgcaactgagagatataaattctgcgttcttcaatgggattatgagtcctctgagcttataacaagggcaatgggggatgtttctgatcgtataggccgaccgacggacaatggtcagattggtataattgatcctgattgcagattaattggtctgcatctgtatgacggcttgtttaaggtcattccatttgacaataaaggccagctcaaggaagcttttaacataaggctcgaggagttgcaggtcctagatatcaagtttctgtatggatgcacaaagccaacaattgcagtactttatcaggacaacaaagatgctcgtcatgtcaaaacatatgaagtttctctaaaggagaaggactttgtcgaaggtccatggtcacagaacaatctcgacaatggtgctgacttattgatccctgtaccttcacctctctgtggcgtcctcatcattggagaagaaacaattgtctattgtagtgccaatgcattcaaagcgataccaataagaccttccatcacaaaagcatatggaagagttgatcttgatggttctaggtatcttcttggtgaccattccggactgattcacctgcttgttataacccatgagaaagaaaaggtcactggcctcaaaattgagcttttgggtgaaacctctattgcatcttccatctcgtatcttgacaatgctgtcgtctttgtcggttcaagctatggagattcacagcttattaagctaaacttgcaaccggatgcaacagggtcatacgtagaaattttagaaaagtatgtcaacctggggcctattgtcgacttttgtgtagttgaccttgagagacaggggcaaggtcaggttgtaacttgctctggagcatacaaggatggttctcttcgcatagttcgcaatgggataggaataaatgaacaggcgtccgtggaacttcaaggcatcaaaggaatgtggtcgttgaaatcgtcaattgatgaagcctttgatacattccttgtagttagttttatcagtgaaactcgtatactagccatgaatatagaggatgaactggaagaaacggagattgagggtttcttgtctcaagtgcagactttattttgccatgatgctgtctacaaccaacttgtacaggttacctcaaattctgttagattagttagttctacaactagagaattgaggaataaatgggatgccccagctggattcgctgttaatgttgcaactgcaaatgcgagccaggttcttttggccactggaggtgggcatttggtctatcttgaaattggggatgggacattgacggaagtcaaacatgtcctgttggagtacgaggtttcctgtcttgacatcaatcccattggcgataatcctaattacagtcagctagctgcagtcgggttgtggactgatataagtgtgaggatttttgtgctgccggacttgactcttattactaaggagcaactaggaggagagataattccccgatctgttcttctttgtgcatttgaagggatatcttacttgctctgtgctcttggagatggtcatctcttaaacttccagttggatacaagtagtgggaaattaagagaccggaaaaaagtatcactagggactcagcctataactctgcgtactttttcatctaaaagtgcaactcatgtctttgctgcatcagatagaccagctgttatatatagcaacaacaagaagctgttatacagcaacgtgaatctgaaagaagttagtcatatgtgtcccttcaactctgctgcttttccagacagtctagcaattgcaagggaaggcgaacttacaattggcaccatcgatgacattcagaagcttcacatacgtaccattcctattggagagcatgctcgtcgcatatgccatcaggaacaaacacggacatttgctatctgctgtttgagaaaccaaccaagtgcagaagaatctgaaatgcattttgtccgtctgctggatgcccaaagtttcgagttcttgtcaacttaccctttggatgcctttgaatacggttgctccatattgagctgctcgtttacagacgacaaaaatgtctattattgtgttggtacggcatatgttttgcccgaggaaaatgaacccactaagggaaggatactggtgtttatagttgaagaagggagattgcagcttattacagagaaggaaaccaagggagctgtttattctctcaatgccttcaatggcaaacttcttgctgctattaatcaaaaaattcagttgtataagtggatgctacgggatgatggcactcgcgagctgcagtctgaatgtggacatcacggtcacatactagctctttacgtgcagacccgtggagacttcattgtcgttggtgacctcatgaaatcaatctctttattgatctacaagcacgaggaaggtgcgatcgaggagagagcacgggactataatgcaaactggatggcggcagttgagatactcgatgatgacatctaccttggtgctgataattgcttcaacctattcacagtaaagaagaacaatgaaggtgctacagatgaagaacgggctcgtatggaggttgttggtgagtatcacataggggaatttgtgaaccgattccgccatggctctcttgttatgaggcttcctgattcagagattggtcagataccgaccgtcatatttggcactgtcagtgggatgattggagtgatagcttctctgccccaagaacagtatgcgtttctagagaaactgcagacgagtctgaggaaagtgattaaaggagttggtggtctaagccacgagcaatggagatcattcaataacgaaaaaagaactgcggaagcgaagagttacttggatggagatctaattgaatcgtttttggatttaagcaggggtaagatggaggagatctccaaaggtatggatgttcaagtggaagagttgtgcaagagagttgaagaactcactaggcttcactgagcaatccaaagctctctctctctctacctctttctctttggtttgtttctcgacaatccttttagttttgaagagttgtctttttaaattgcgtattttactgataaacaaattgtataatttatgcgattttgagaacttttatcaataagaatttctttgtg

SEQ ID NO: 3278 - DNA, 3237 bp, Flaveria ramosissima
caattacgtcgttacagctcataagcctacaaacgtcactcactcatgcgtcggcaatttcaccggtccacaagaactcaatctcatcatcgcgaaatgtacccgcatcgagattcatttacttactcctgaaggtttgcagcctatgttagatgtgccaatatacggaagaattgcaaccctagaacttttccgtccccatggtgaaacgcaagaccttctgtttattgcaacagaaagatacaaattttgtgttcttcaatgggacgctgacgcgagtgagcttattacaagatgtatgggagatgtctcggatcgcataggcagacccacagacaatggccagataggcataattgaccccgactgcagacttattggactccatttgtatgatgggttgttcaaggttattccatttgataacaaaggacaactcaaagaagcatttaacatcaggctagaagaacttcaagttttggatatcaaatttctttatggttgtccaaagcctacgattgttgttctttatcaggacaataaagatgctcgtcatgtaaaaacatatgaggtttctttaaaggataaagactttgttgaaggtccatggtcccagaacaatcttgataatggggctgatttacttattccggttccaccacctttttgtggtgtattaatcatcggggaagagacaattgtgtactgtagtgcttctacatttaaagctataccaattagaccttctattactagagcctatggaagggtggatgctgatggttctaggtatttacttggtgatcttagtgggcttcttcacttgcttgtcatagcgcatgagaaagaaaaagttactggactaaaaattgagcttctaggggaaacgtctgtggcatcaactatatcctatcttgacaatgcgtttgtatatgtaggctcaagctatggagattctcagcttattaagttaaatctccagcctgatgcaaaaggttcttatgtggaagtgctagaaaaatatgtcaacttgggccccattgttgacttttgtgtggttgacttagaaaggcaaggtcaagggcaagttgtgacttgctcaggagcatataaagacggttcgcttcgcattgttagaaatggaattgggataaacgaacaggcatctgtggaactacaaggtataaaaggaatgtggtcactgagatcagcaacagaggatctatatgacacatttttggttgttagcttcattagcgagactcgaatattagcaatgaatctagaagatgaactggaggaaactgaaattgagggcttctgttctcaagtacaaactttattctgtcatgatgctgtgcataatcaacttgttcaggttacttcaagctcggtgagacttgtgagttctgtatcaagagaattaagacacgagtggcatgcacctgctgactactctatcaatgtcgccactgcaaatgctactcaggttctattggctactagaggtggccatcttgtttaccttgaaattggcgatggagtattagttgaaaaaaagcatgctgaactgaaatatgatatttcatgccttgacataaacccgatcggtgataatccaaattatagcaaccttgctgcagttggtatgtggacggatattagtgtcagaatattctctcttcccgacctaaatctgatcaccgaggaacatttaggtggtgaaattataccacgatctgttcttctatgtgcctttgaagggataccttacttgttatgcgcacttggagatggccaccttttaaactttttactgaacacgagtacaggtgaattaacggataggaaaaaggtttcacttgggacccaaccaataaccctccgaacattttcttcgaagagtaccacacatgtttttgcagcctcagataggccaacagttatatacagcagtaataaaaagttactctacagtaatgtgaacctaaaagaagtcagtcacatgtgccccttcaattctgctgcttttccagacagtcttgctattgctaaagaaggtgaattgacaattgggacaatcgatgatattcaaaagcttcacatccgttcaattcctcttggtgagcatgcaaggcgtatctgccatcaagaacagtcccgtacatttgcaatatgcagtttaaagtacaatcaatcaagcgcagaagattctgaaatgcattttattcggttgttagatgaccaaacatttgatttcatatccacatacgctcttgaccaatttgagtacggttgttccatactcaattgttctttctcagatgacaataacgcctattactgtgttgggactgcttatgttatgccagaggagaatgaaccatctaagggccgtatattggttttcatagttgaagatgggaagctacaactagtagctgagaaagaaactaaaggtgctgtttactccttgaatgccttcaatggtaaactcctcgctgctataaatcaaaaaattcaattgtacaagtggatgcttcgtgatgatggtacacgcgagttgcagtctgaatgtggacaccatggtcacatacttgctctctacgtacaaacccgtggtgattttattgttgtcggtgatttgatgaaatcaatttcactcctgatttataagcatgaagaaggtgctatagaggaacgagcccgtgactacaacgccaactggatgtcagcagttgagattcttgacgacgacgtttacctcggcgctgaaaacaatttcaatctttttacagtccgtaaaaacagtgaaggtgccactgatgaagagcgaggccgtctagaggtggtcggagaataccaccttggtgaattcgtgaaccgtttccaacatggctcactcgtgatgcgattacccgattctgatgttggtcacatccccaccatcatttttggaaccgttaatggcgttattggcgtcattgcttcgctccctcaagatcagtacatgttcttggagaaacttcaaaccaatttgagaaaggtcataaaaggcgttggcgggttgagccacgagcaatggagatcgttttataacgagaagaaaaccgctgactcgaaaaatttcttggatggcgacttgatagagtcgtttcttgatctgggaaggaacagaatggaagagatttcaaaaaatatgaatgtttcagtggaggaacttatgaagagagtaga

SEQ ID NO: 3279 - DNA, 3576 bp, Arabidopsis thaliana
ctccctttgcatcgtctccgtctctttctcttatttttttcccgtttaaatctcaaagagaacccagaagcttggtataaaagaggcgggaaatttctcacgtgtgttgcaatagaaagcaaaacccctagtttttttctgggcgaagaagaagatgagcgtatggaactacgccgttacggctcagaaaccgacctgtgtcactcactcttgcgtcgggaacttcacaagtcctcaagaactcaatctcattgttgcgaaatccactcgaatcgagatccatctgctttctccacagggacttcagactatactggatgttcctctatatgggagaatcgcaactatggaattgttccgtccccatggtgaagcacaagactttttgtttgttgcaactgaaagatataaattctgtgttcttcaatgggattatgagtcctctgagcttattacaagggcaatgggggatgtttctgatcgtataggccgaccgacagacaatggtcagattggtataattgatcctgattgcagagtaattggtctgcatctgtatgacggcttgtttaaggtcattccatttgacaataaaggacagctcaaggaagcctttaacataaggctggaggagttgcaggtcctagatatcaagtttctgtatggatgcacgaaaccaacaattgcagtactttatcaggacaacaaagatgctcgtcatgtcaaaacatatgaagtttctctaaaggataagaactttgtcgaaggtccatggtcacagaacaatctcgacaatggtgctgacttattgatccctgtaccttcacctctatgtggcgtcctcatcattggggaagaaacaattgtctattgtagtgccaatgcattcaaagcaataccaataagaccttccatcacaaaagcatatggaagagttgatcttgatggttctaggtatcttcttggtgaccatgccggactgattcacctgcttgttataacccatgagaaagaaaaggtcactggcctcaaaattgagcttttgggtgaaacctctattgcatcttccatctcgtatctggacaatgctgtcgtctttgtcggttcaagctatggagattcacagcttattaagctaaacctgcaaccggatgcaaaagggtcatatgtagaaattttagaaaagtatgtcaacttggggcctattgtcgatttttgtgtagttgaccttgagagacaggggcaaggtcaggttgtaacttgctctggagcatacaaggatggttctcttcgcatagttcgcaatgggataggaataaatgaacaggcgtccgtggaacttcaaggcatcaaaggaatgtggtcgttgaaatcgtcaattgatgaagcctttgatacattccttgtagttagttttatcagtgaaactcgtatactagccatgaatatagaggatgaactggaagaaacagagattgagggttttttgtctgaagttcagactttattttgccatgatgctgtctacaaccaacttgtacaggttacctcaaattctgttagattagttagttctacaactagagagttgcggaataaatgggatgccccagctggattctctgttaatgttgcaactgcaaatgcgagccaggttcttttggccactggaggtgggcatttggtctatctagaaattggggatgggacattgacggaagtgaaacatgtcctgttggagtacgaggtttcttgtcttgacataaaccccattggtgataatcctaattacagtcagctagctgccgtcgggatgtggactgatataagtgtgaggatttttgtgctaccagacttgactcttattactaaggaggaactaggaggagagatcattccccgatctgttcttctttgtgcatttgaagggatatcttacttgctctgtgctcttggagacggtcatctcttaaacttccagttggatacaagttgcgggaaattaagagatcggaaaaaagtatcactggggactcgacctataactctgcgtactttttcatctaaaagtgcaacgcatgtcttcgctgcatcagatagaccagctgttatatatagcaacaacaagaagctattatacagcaacgtgaatctgaaagaagttagtcatatgtgtcccttcaactctgctgcttttccagacagtctagcaattgcaagggagggcgaacttacaattggtaccatcgatgacattcagaagcttcacatacgcaccattcccattggagagcatgctcgtcggatatgtcatcaggaacaaacacgaacatttgctatctcctgtttgagaaacgaaccaagtgcagaagaatctgaatcgcattttgtccgtctgctggatgcccaaagtttcgagttcttgtcaagttaccctttggatgcctttgaatgtggttgctccatattgagctgctcgtttacagacgacaaaaatgtctattattgtgttggtacagcatatgttttgcccgaggaaaatgaaccaactaagggaaggatacttgtgtttatagttgaagaaggaagattgcagcttatcacagagaaggaaaccaagggagctgtttattctctcaatgccttcaatggcaaacttcttgcttctattaatcaaaagattcagttgtataagtggatgctgcgggatgatggcactcgcgagctgcaatctgaatgtggacatcacggtcacatactagctctctacgtgcagacccgtggagacttcatcgctgttggtgatctcatgaaatcaatctctttattgatctacaagcacgaggaaggtgcgatcgaggagagagctcgggactataatgcaaactggatgacggcagttgagatactcaatgatgacatctacctcggtactgataattgcttcaacatattcaccgtaaagaagaacaacgaaggtgctacagatgaagaacgtgctcgtatggaggtggttggtgagtatcacataggggaatttgtgaaccgattccgccatggctctcttgtcatgaagctgcctgattcagatattggtcagataccgacagtcatatttggcactgtcagtgggatgattggagtgatagcgtctctgcctcaagaacagtatgcgtttctagagaaactgcagacgagtctgaggaaagtgattaaaggagttggtggtctaagccacgagcagtggagatcgttcaacaacgagaaaagaactgcggaagcaaagggttacttggatggagaccttattgaatcgttcttggatttgagcagaggtaagatggaggagatctccaaaggtatggatgttcaagtggaagagttgtgcaagagagttgaagaactcactaggcttcactgaagcaaatccaagctctcctcttcccctttcgtttgttactttctcgacaatctttttggttttgaggagttgtcttttttcttttcttgatttgatagacaatttgtataacaatgcgattttgaggattatattaataagagtttcattgtgtg

SEQ ID NO: 3280 - DNA, 3279 bp, Chrysanthemum coronarium
cattcatgtgtcggcaatttcaccgcttccaacgaactcaatctcattattgcgaaatgtacccgtatagagattcatttacttacttcttcgggcttgcagcctatgctggatgtgccaatatacggacgaattgcaactctcgaactgttccgtcctcatggtgaaacccaagaccttctgttcattgccacagaaagatacaagttttgtgttcttcagtgggatgccgatgccaatgaggttattacaagagcgatgggtgatgtctcagatcgcataggtagacctacagacaacggccagattggaataattgaccctgattgtagacttattgggctccatctgtatgatggactatttaaggttattccattcgataacaaaggacaacttaaagaagcatttaacatcaggctagaagaactccaagttttagacatcaagtttctatacggctgcccgaagcctacaattgttgttctttatcaggataataaagatgctcgccatgtgaaaacgtacgaggtctctttaaaggataaagactttgttgaaggtccatggtctcagaataatctcgataacggggctgacttgctaataccggttccaccacctttctgtggtgtattaatcataggggaggagacaattgtgtattgtagtgcctcagcatttaaagctataccaataagaccttctattactagagcatatggaagggtggatgcggatggttccagatatctgcttggtgaccatagtgggctacttcacttgcttgttatagctcatgagagagaaaaagtcacgggactcaaaattgaacttctaggggaaacatcagtagcatctacgatatcatatcttgataatgcatttgtatatgttggctcgagcttcggagattctcagcttgttaagttgaatgtccagccagatgcaaaaggttcttatgtcgaagtgctagaaagatatgtcaacttgggtccgatagttgacttctgcgtggttgacttagaaaggcaaggtcaaggccaggttgtaacatgctcaggagcttataaagacggttcccttcgcattgttagaaacggaattgggataaatgaacaggcatctgtggaactgcaaggtatcaaaggaatgtggtcgcttagatcagcaacagatgatatatatgacactttcttggttgttagcttcattagcgagactcgaatattggcaatgaatttagaggacgagctagaagaaactgaaattgagggctttaattcgcaagtgcagactctattctgtcatgacgctgtgcataatcagcttgttcaggttacttcaagctcggtgagattggtgagttcgataacaagagagcttaaaaacgaatggtttgcacctgctgattactctataaatgttgcaacagctaacactactcaggtactattggctactagaggtgggcatctagtttacctcgaaattgctgatggacaattagtggagaaaaagcatgctcagttggagtatgatatttcatgccttgatataagtccaattgttgataacccaaattatagtaatcttgccgcggttggtatgtggacggatataagtgtcaaaatattttcactccctgatctgactcttaagaccgaggaacatttaggtggtgaaatcataccgcgatctgttcttctttgtgccttcgaagggataccttacttgttgtgtgcacttggagatggtcatcttttaaactttttactgaacacgacaacgggccaattaacagacaggaaaaaggtgtcacttgggacccaaccgataacactaagaacattttcatcaaagagtaccacacatgtttttgcagcttctgataggccaacagtgatatacagcagtaacaagaaattactctacagcaacgtgaaccttaaagaagtcagttacatgtgccctttcaattctgctgcttttcccgatagtcttgccattgcaaaagaaggtgagttgacaattgggacaattgatgatattcagaagcttcatatccgttctattcctcttggtgaacatgcaagacgtatctgccatcaagaacagactcgtacttttgcaatatgcagtttaaagtacaaccagtcaagcacagaagattctgaaatgcacttcattcgcttgttagatgaccagacattcgactttatatcctcttattcattggaccagtttgagtatggttgttccatactcagttgctctttctcagatgataataatgcatattactgtgtcgggacggcctatgtcatgcctgaggagaatgaaccaacaaaggggcgtattttgattttcatggttgaagatgggaagctacagctagtggctgagaaagaaaccaagggtgctgtttactctttgaacgcctttaacggtaaactccttgctgctataaatcagaaaattcagttgtacaagtggatgcttcgtgacgatggtacgcgagaactgcaatctgaatgtggacatcatgggcacatacttgctttatatgttcaaactcgtggggatttcattgttgttggtgacttgatgaaatccatttcgttgttgatatataagcatgaggaaggtgctatcgaggagagagctcgtgattacaatgccaattggatgtcagctgttgagatactcgatgacgatatataccttggagctgagaacaacttcaaccttttcacagtccgtaagaacagtgaaggtgccactgatgaagaacgtggtcgtctagaagtagttggtgaataccatcttggagaatttgtgaaccgtttccgccatggttcactcgtgatgcggttacctgattctgatgtgggacaaatcccaaccgtaatatttggaaccgttaacggtgttattggtgtcattgcttcacttccccaagaccaatatcttttcatggaaaaacttcaaacaaacttgagaaaggttataaaaggtgttggagggttgagtcatgagcaatggagatcgttttatagtgagaagaaaactgttgactcgagaaatttcttggatggtgatttaatcgagtcgtttcttgatcttggaaggagcagaatggaagaaatctcaaaaacgatgaatgtttcagttgaggaacttatgaagagagtagaagagttaacaaggttgcattagttagctctcaaggtttttctagttcctgaaaaaactttcgtttaaaacttttgacgtgtg

SEQ ID NO: 3281 - DNA, 3765 bp, Mimulus guttatus
ctccttggcccttgtatgcatattactccatccacagtctattagaggttgaacgccacgacgccgttttctggtcactccctttctataaactgatatacgcgcccgtgtgtggcagcttctctctactcgcgagcaatttctgctgatccttcgtccctctcccttcagtcacgtatatatacacaccaagtgggagtttagggtttttattcatttcttcatttcgcagaagccaaggcttatagacacagtagtttagtaggtaaaaatgagtatatggaattatgtggtgacggctcacaaaccgacgaacgttactcattcctgcgtcggcaatttcaccggccctcaggagctcaatctcatcgttgcgaaatgcactcgaatagagatccatgtactctcgcctcaaggcttacagccgatgttggatgtgccaatttatgggagaattgcaacgcttgagctcttccgtccacatggagaagctcaagatcttcttttcgtagccacagaaagatataaattctgtgttttgcaatgggatgcagagacctctgaggttattacaagggccatgggggatgtttcagatcgaattggtcgtcctacggacaacggacagattggtatagtggatccagattgcagattaatcggacttcacctgtatgatggattattcaaggtcatcccatttgataacaaaggccagctcaaagaagcatttaatattaggcttgaggagcttcaagttttggatatcaagtttttgtacggttgtccgaaaccaacaattgttgtactttatcaggataataaggaagctcgtcatgtgaaaacgtatgaggtcgctttgaaggataaagattttgttgagggtccatggtctcagaacaatcttgataatggggcagagttattgatcccagttccgccgcctctttgtggtgtcctaattattggcgaagaaactatagtgtattgcagtgcctcagctttcaaagcaatcccagtcagaccttctatcacaagggcttatggaagggttgatgccgatggttcacgctacttactaggcgatcataatgggattttgcacctgcttgtcataacccatgaaaaggagaaggtcactggactcaaaattgagctcctgggcgaaacatctgttgcatcgtcgatttcatatcttgataatgctgttgtttttgtggggtcaagttatggagattcacagctcataaagattaaccttcatccggatgcaaaaggttcttatgtggaagttcttgaaaggtttgtaaatttggggccaattgtggacttctgtgtggttgacttagagaggcaaggtcaaggtcaggttgtaacttgctcaggagcctataaagatggttctctacgcattgtgcgcaatggtattggaataaatgagcaggcatctgtagagcttcaaggaatcaaaggaatgtggtcgttaagatcagctactgatgatccgtatgacactttcttagttgttagctttattagcgagacacgtattttggcgatgaatcttgaggatgaattggaggaaactgagatagaaggattttcttcagatgtccagacattattttgtcatgatgctattcatgaccagcttgtgcaggtatggaaaaataccatgaatgttttattggctattggtggtggccatttggtctatctggaaattggtgatggtgtattgacagaagtaaaacatattcagttggagtatgacatctcttgcctggacataaatccaattggtgataatacaaaccatagtcaactagcagctgttggaatgtggacggatatcagtgttaggatattttctcttcccgacttgaatcttattacaaaggaacttttgggtggggagataattcctcgctctgtacttctgtgttcttttgaagggatatcgtacttgttatgtgctcttggggatggacatcttctgaatttcgtgttgaatacgagtaatggtcagctggcggacaggaagaaagtatctttagggacccagcccattacacttcgtactttctcttcaaagaatgctacacacgtgtttgctgcttctgatagaccaaccgtcatttacagcagtaacaagaaattgctttacagcaacgtaaatctgaaagaagtcagtcatatgtgccctttcaattctgctgctttccctgacagccttgcaattgctaaagaaggcgaattaaccattgggaccatagatgacattcaaaagcttcatatacgatctatcccactcggggagcacgctcgacgtatatgtcatcaggaacagacccggaccttcgccatatgcagtttaaaatataaccagtcaagtgcagaagactctgaaatgcactttatccgcttgttagatgatcagacttttgatttcatatcaacttattcactggatcagtttgagtgtggttgctctattcttagttgttcgttctccgatgataataatgtgtactactgcatcgggactgcatatgttatgccagaagagaacgaacctaccaagggtcggatattagtctttgccgtagaagatggaaaactccagctgattgctgagaaggaaacgaaaggggctgtttactctctgaatgcgttcaacggaagactccttgctgccattaaccagaagattcagctgtataagtggatgctccgtgacgatggctctcgtgagttgcaatccgaatctggtcatcatggccacatacttgccctttatgtacaaactagaggagatttcattgttgtcggtgacttgatgaaatcaatttctctgcttatttacaagcacgaggagggtgctatagaagagcgagctcgagactacaatgcaaattggatgtcagctgttgagattcttgacgatgacatttatgttggtgccgagaataatttcaacctcttcactgtccggaaaaacagtgaaggggcaactgacgaggagagagggcgtcttgaggtggtcggagaataccacctaggcgaattcgtcaatcggttcagacacggttcgcttgtaatgcgattgcccgattctgatgttgggcagattccaacagttatattcggtacagtgaacggggttataggggtaattgcttctctcccgcacgagcagtatgtgttcctggagaagctccaaacgaatatgaggaaagtgatcaaaggtgtgggaggactgagccatgaacagtggagatctttctacaacgaaaagaaaacggttgatgctaaaaatttcttggacggtgatttaatagaatcgtttctcgatctcaacaggaatcagatggaagaggtttcgaaggcgataaatgtaccggtggaggaactgatgaagagagtagaagaactgactaggttacattgatctcattccttgttcctcctctatgatggctgttatatctaaactgttgtttttgtaagagtagcagtattaccttctcttgcttcctttgttccttatgatagcatatgggactactgcttctacttttagaatgttcataagattaatatttttgcatttgtcggttgtgagatccttttttttttcttttgagtgacaccttgtggattgattactctatttctcaattttatgctttttattcaaattttctcaagtattaattctaaggcggcggttatatgcaagcccatttttttattagtttaaaa

SEQ ID NO: 3282 - DNA, 3406 bp, Phalaenopsis aphrodite
tatgcttgacgttcctatatatggaagaatgcactctagaactcttccgacctcatggtgaatctcaggatcttctctttattgctaccgaacgatacaaattttgtgtgcttcaatgggatggagaagcatccgagctcattacaagagcaatgggggatgtttctgatcgaataggtcgaccaacagataatgggcagattggaataattgatcctgattgtagattgattggtctccatttatatgatggtttgttcaaggttatacccttcgacaacaaagggcaactgaaggaagcattcaatatccgactcgaagagcttcaagtcttggatatcaagtttctgtatgggtgttcaaaacctacaattgcagtcctgtaccaggataacaaagatgcccgccaccttaagacatatgaggttgcactcaaggataaggattttatcgagggtccatggtcgcagaataatcttgataatggtgctggtctgttaatacccgttccattgcctttaggtggtgttgttattattggggaggagactattgtgtattgcaatggttcttcattcaaggctatccctattcgaccatcaattaccagagcatatggtagggttgatcctgatggttctcgatttttgcttggtgataattctggacttttgcatttactcgtcatctctcatgaaagagaaaggatcaccggcctaaaaattgagcaccttggagagacctctgttgcatcatcaatttcatatcttgataacgcagttgtatatgttggttctaagtatggggattcacagcttatcaaacttaatctgcaaccagatgaaaaaggatcgtatgttgaagttattgaaaaatatgtcaatcttggcccaattgttgacttctgcgttgtggatcttgagaggcaagggcaaggtcaggtggtcacttgctcgggtgcttacaaagatggttcacttcgtgttgttcgaaatggcataggcataaatgaacaggcgtcagtagaacttcaaggtatcaaagggctatggtctttaagatcttctacttctgatccaaatgacacctttttggttgtaagctttattagtgagacacgtatcctagctatgaatatggaggatgagttagaagaaactgagatagatggcttctatgcacaagcacagactttgttttgccaaaacgccttgcatgatcagcttgttcaggttaccgcaagttctgttcggcttgtaagctgtacatctcgtgagctgcaggatcaatggaatgcacctgctgggttttcggttaatgttgccactgctaatgctactcaggttttgttggctattggaggtggtcatcttgtttatcttgaaattggggacggaaagctgactgaagtaaagcatatacagttggaatatgagatatcttgtctggacataaatccaattggtgaaaaagctacttctagttcgctggctgcggttggtatgtggactgatataagcgtcagaatcttttctctaccaagcctggatcttattacgaaagagagtcttggtggagaaataataccacgttctgtcttaatttgctcttttgaagggatctcatatttgctatgtgcccttggagacgggcatcttttcaacttcttgttgaatttagctaccggtgagttgtctgataggaagaaggtatctcttggaacacagccaatcactctacgaacattttcgtcaaaggataccacacatgtgtttgctgcttctgataggccaacggttatttacagcagtaacaaaaagttgctctatagtaatgtaaatcttaaagaagttagtcacatgtgtccgttcaattcggctgcctttccagacagtctcgcaattgcaaaagaaggcgaactttccatcggaactattgatgatattcaaaagcttcacattcgctcaatcccactgggtgaacatgctcggcgtatctgccatcaggaacagtctcgaacttttgctatatgtagtttaaaaaactgcctcatcaacaatgaggagacagagattcattttgttcgtttattagatgatcaaacatttgagttcatatcaacttatcaattagacacctttgagtatggttgctctataattagttgctccttctcggatgacaacaatgtttactattctgttggtacagcatacgttttacctgaggaaaatgagcctactaagggacgcatcctagtatttgtagttgaagatgggaagctacaactaattgctgaaaaggaaaccaaaggagctgtgtactcgctcaatgcattcaatgggaaattgttagctgcgatcaatcaaaagattcaattgtacaagttgatgcttcgtgaggatggaacacgggaattgcaatctgaatgcggacatcatggtcacatattggctttatatgtccaaacccgaggtgatttcattgtggttggtgacttgatgaaatctatatctttacttctatataagcatgaggagggtgctattgaagaacgagcccgggactacaatgcaaactggatgactgcagttgaaatccttgatgatgatgtttaccttggcgccgagaacaacttcaacctcttcacagtgaggaagaacagcgacggagccacagatgaggagcgtggccgtctcgaagttgtgggggagtaccacctgggcgagttcgtgaaccgtttctgccacggatcacttgtaatgcgtcttccagactccgaagcgggcaacatccccaccgtaatcttcggcaccgtcaatggtgtgattggtatcgtcgcctctctcccccacgatcactatgtgttccttgagaagcttcagtcaaatctcgtcaaagtcataaaaggtgtcggcgggctcagccacgagcaatggagatccttcaacaacgaaaagaagacggtggatgctcggaatttcttagatggagacttgatcgagtcctttctagatctcagccgaagtagaatggaggaaatttctagaacaatcggcgtacccgtagaagagctttgcaagagagttgaagagctgacaagattgcattgaggaaaatatattgatcacaggttgcaacaatagccctttttatgatttatgatgtctttttggtgtaggtaatttggaaattgttcaaatgaaagtggtttatccatcagcttttggagttgaggttgggcttagttgttcgatgtaaagtaaatttattcttttgttagggtgttatttgatcgtaacttgccagcaaaaattgtgggggtttgtgtggcccttaaatcatatgtttatgtggggagtaattgtatgcttttgaatatttcaatcctgtacccttctcaaat

SEQ ID NO: 3283 - DNA, 3320 bp, Eutrema halophilum
atgagcgtatggaactacgtcgttacggctcacaaacccacctgtgtcagtcactcttgcgtgggaaacttcaccagtcctcaggaactcaatctcattgttgcgaaatgcactcgaatcgagatccatctgcttactccacagggacttcagactatgctggatgttcctctatatggtagaatctcaactttggacttgttccgtccccatggtgaaacacaagattttttgttcattgcaactgagagacataaattctgtgtactccaatgggattctgagtcctctgagcttattacaagggcaatggaggatgtttccgatcgtattggccgaccaacagacaatggtcagattggtataattgatcctgattgcagattgataggtctccatctttatgacggcttgtttaaggtcattccatttgacaataaaggacagcttaaggaagcttttaacataaggctggaggagttgcaggtcctagatatcaagtttctgtatggatgcgcaaagccaacaatcgcagtactttatcaggacaacaaagatgctcggcatgtaaaaacatatgaaattgctacaaaggataaagacaaggtctttgttgaagggccatggtcacagaacaatcttgacaatggtgctgacctattgatccctgtaccttcacccctgtgtggcgttcttatcattggggaagaaactattgtctactgtagtgtcaatgcattcagagcaataccaataagaccttgcatcacaaaagcatatggaagagttgatgttgatggctctaggtatcttcttggtgaccatgccggactgatccacctccttgttataacccacgagaaagaaaaggtcactggcctcaaatttgagcttttgggtgaaacctctatagcatctaccatctcctatcttgacaatgctgtcgtctttgttggctcaagctatggagactcacagcttataaagttaaacaggaagccggatgcagatggttcatatgtagaaattttagaaaagtatgtcaacttgggtcctattgtcgacttttgtgtagttgaccttgagagacaggggcaaggccagattgtgacttgctctggagcatataaggatggttctcttcgcatagttcgcaatgggataggcataaacgaacaggcgtccgtggaacttcaaggtatcaaaggaatgtggtcgttgaaagcttcaattgatgaagcgtttgatagattcctcgtagtgagttttatcaatgaaactcgtatattagccatgaatatggaggatgaactggaagaaacagagattgagggtttcttgtctcaagtccagactttattttgccattatgctgtctacgaccaacttgtacaggttacttcaaattctgttagattagtaagttctacaactagagaattgcggaataaatgggaagccccagttggatttactgttaatgttgcaactgcaaatgccagccaggttcttttggcaactggaggtgggcatttggtctatatagaaattggagatgggacattgacggaagtcaaacatgtccagttggagtacgaggtctcttgtctcgatataaaccccattggggataatcctaattacagtcagctagctgcagtggggatgtggacagatataagtgtgaggattttcctgctgccggacttgactcttattactaaggagcaactaggaggagagattattccccgatctgttcttctttgtgcattcgaagggatatcttacttactttgtgctcttggagatggtcatctcttgagcttccagttggatacgagtagtggggagttaagagatcggaaaaaagtattactggggactcagcctataactctgcgtacattttcatctaaaagtgctacacatgtctttgctgcatcagatagacctgctgtaatatatagcaacaacaagaagctgttatacagcaatgtgaatctgaaagaagttagtcatatgtgtcctttcagctctgctgcttttccagacagcctagcaataaccagggaaggcgagcttactattggcaccatcgatgatattcagaagcttcacatacggactatccccattggagagcacgctcgtcgtatctgccatcaggaacaaacgcgaacactggctgtctgcagtttgagaaatcaactgagtgcacaagaatctgaaatgcattttgtccgtctgttggatagccaatctttcgaattcttgtcagcttaccctttggatgcctttgaatatggttgctccatactgagctgctcgtttacagatgataaaaaggtctattactgtgtcggtacatcatatgttttgcctgaggaaaatgaacctactaagggaaggatacttgtgtttgtagttgaagaaagaaagttgcagctgatcgcagagaaggaaactaagggatctgtgtattctcttaatgccttcaatggcaaacttctcgctgctattaatcagaaaattcagttgtataaatggatgttgcgggatgatggcactcgtgagctccagtctgaatgtggacatcacggtcacatactagctctctacgtgcagacccgtggagacttcattgtcgttggcgacctcatgaaatcaatcgccttgttgatctacaagcatgaggaaggttcgatagaggagataggtcgggactataatgcaagctggatgacggcagttgagatattagatgatgacacctatctcggtgctgacaattgctctaacctattcacagtaaagaagaacaacgaagctgctacagatgaagaacgggctcgtatggaggtggttggtgagtatcacattggggaatttgtgaaccgattccgccatggctctcttgtgatgaggctgcctgatacagaaattggtcagataccgacaatgatatttggcactgttaatggggtgattggagtgatagcttcactgcctcaagaagagtatctgtttctagagaaactgcagacgagtctgaggaaagtgataaaaggagtaggcggtctgaaccatgagcaatggagatcgtttagcaacgagaagagaactgcggaagcaaagggtttcttagatggagatcttattgaatcgttcttggatctgagcaggagtaagatggatgagatctctaaaggcatggatgttcaagtggaagagttgtgcaagagagttgaggaactcactaggcttcactgagaaaatgcaaagctctctctccctctctctttaccttctctcctttg

SEQ ID NO: 3284 - DNA, 3403 bp, Eutrema parvulum
atgagcgtatggaactacgtcgtcacggctcaaaaacccacctgtgtcactcactcttgcgtgggaaacttcaccagtccccaggaactcaatctcattgttgcgaaatgcactcgaatcgagatccatctgcttactccacagggacttcagactatgctggatgttcctctatatgggagaatcgcaactttggaattgttccgtccccatggtgaggcacaagatttgttgttcattgcaactgagagatataaattctgtgttcttcaatgggagtctgagtcctccgagcttattacaagggcaatgggggatgtttcagatcgtataggccgaccgacagacaatggtcagattggtataattgatcctgattgcagattagttggtctccatctgtatgacggcttgtttaaggttattccattggacaataaaggacagctcaaggaagcttttaacataaggctggaggagttgcaggtcctggatatcaagtttctttatggatgtgcaaagccaacaatcgcagtactttatcaggacaacaaagatgctcgtcatgtaaaaacatatgaagtttctcataaggagaaaggctttgtcgaaggaccatggtcacagaacaatctcgactatggtgctgacctattgatccctgtaccttcacctctgtgtggcgtccttatcattggcgaagaaacaattgtctattgtagtgccaatgcattcaaagctataccaataagaccttcaatcacaaaagcatatggaagagtggatattgatggctctaggtatcttcttggtgaccatgctggactaatccacctccttgttataacccacgagaaagaaaaggtcactggcctcaaaattgagcttttgggtgaaacttctattgcatctaccatctcctatcttgacaatgctgtcgtctttgtcggctcaagctatggagactcacagcttataaagttaaacatggagccggatgcaaaaggttcatatgtagaaattatagagaagtatgtcaacttggggcctattgtcgacttttgtgtagttgaccttgagagacaggggcaaggtcaggttgtaacttgctctggagcatataaggatggttctcttcgcatagttcgcaatgggataggaataaatgaacaggcgtctgtggaacttcaaggtatcaaaggaatgtggtctctgaaatcttcaattgatgaagcctttgatacattccttgtagttagttttatcagtgaaactcgtatattagctatgaatatagaggatgaactggaagaaacagagattgagggtttcttgtctgaggtccagactttattttgccatgatgctgtctacaaccaacttgtacagattacttcaacttctgttagattagtcagttctacaactagagaactgcggaataaatgggatgccccagctggattcactgttaatgttgcaactgcaaatgctagccaggttcttttggcgactggaggtgggcatttggtctatatagaaattggagatgggacattgacggaagtcaaacatgcccagttggagtacgaggtctcttgtcttgatataaaccccgttggggaaaatcctaattacagtcagctagctgcagtggggatgtggaccgatataagtgtaaggatttttgtgctgccggacttgactcttattactaaggaacaactaggaggagagataattccccgatctgttcttctttgtgcatttgaagggatatcttacttgctttgtgctcttggagatggccatctcttaaacttccagttggatacgagtagtggggagttaagagttcggaaaaaagtatcacttgggactcagcctataactctgcgtacattttcatctaaaagtgcaacgcatgtctttgctgcatcagatagaccggctgttatgtatagcaacaacaagaagctgttatacagcaacgtgaatctgaaagaagttagtcatatgtgtcctttcaactctgctgcttttccagacagcctagcaattgccagggaaggcgaacttactattggcaccatcgatgatattcagaagcttcacatacgtactatccccattggagagcacgctcatcgtatctgccatcaggaacaaacacgaacatgtgctatctgcactttgaaaaaccaaccgagtgcagaagaatctgaaatgcattttgtccgtctgttggatgcccaaaatttcgaattcttgtcaacttaccctttggatgcctttgaatacggttgctccgtactgagctgctcgtttacagatgataaaaatgtctactattgtgtcggtacgtcatatgttttgcctgaggaaaatgaaccaactaagggaaggatacttgtatttgtagttgaagaaggaaagttgcagctgatagcggagaaggaaactaagggatctgtttattctcttaatgccttcaatggcaaacttcttgctgctattaatcagaaaatgcagttgtataaatggatgttgcgggatgatggaactcgtgagctccagtctgaatgtggacatcacggtcacattctagctctctatgtgaagacccgtggagacttcatcgttgttggtgacctcatgaaatcaatctccttattgatctacaagcacgaggaaggtgcgatcgaggagatagctcgggactataatgcaagctggatgacggcagttgagatacttgatgatgacacctacctcggtgctgacaattgctacaacctattcacagtaaagaagaacagtgaagctgctacagatgaagaacggtgtcgtatggaggtggttggtgagtatcacactggggaatttgtgaaccgattccgccatggctctcttgttatgaggctgcctgattcagaaattggtcagataccgactcttatctttggtactgtcaatggtgtgatcggagtgatagcttcactgcctcaagaacagtatgcttttctggagaaactgcagacgagtctgaggaaagtgattaaaggagttggcggtttgagccacgagcaatggagatcattcaacaacgagaaaagaactggtgatgcaaggaatttcttggacggagatttgatcgaatcgttcttggatttgagcaggagtaagatggaagagatctctcaaggcatggatattcaagtggaagagttgtgtaagagaattgaggaactcactacgcttcactgagcaaatccatagctttctctttactctatctctatcctcgtttgtttgtttctcaacaatcgttttggttctaaagagtcgttctctgtgaaaacttgagtggtttcttagaggaggcgagagtgtctttttggtt

SEQ ID NO: 3285 - DNA, 3289 bp, Chrysanthemum coronarium
catgtgtcggcaatttcaccgcttccaacgaactcaatctcattattgcgaaatgtacccgtatagagattcatttacttacttcttcgggcttgcagcctatgctggatgtgccaatatacggacggattgcaactctcgaactgttccgtcctcatggtgaaacccaagaccttctgttcattgccacagaaagatacaagttttgtgttcttcagtgggatgccgatgccaatgaggttattacaagagcgatgggtgatgtctcagatcgcataggtagacctacagacaacggccagattggaataattgaccctgattgcagacttattgggctccatctgtatgatggactatttaaggttattccattcgataacaaaggacaacttaaagaagcatttaacatcaggctagaagaactccaagttttagatatcaagtttctatacggctgcccgaagcctacaattgttgttctttatcaggataataaagatgctcgccatgtgaaaacgtacgaggtctctttaaaggataaagactttgttgaaggtccatggtctcagaataatctcgataacggggctgacttgctaataccggttccaccacctttttgtggtgtattaatcataggggaggagacaattgtgtattgtagtgcctcagcatttaaagctataccaataagaccttctattactagagcctatggaagggtggatgcggatggttccagatacttgcttggtgaccatagtgggctacttcacttgcttgtgatagctcatgagagagaaaaagtcacaggactcaaaattgagcttctaggggaaacatcaattgcctctactatatcgtatcttgataatgcatttgtatatgttggctcgagctatggagattctcagctagttaagttgaatgtccagccagatgcaaaaggttcttatgtggaagtgctagaaagatatgtcaacttgggaccgatagttgacttctgcgtggttgacttagaaaggcaaggtcaaggccaggtcgtaacatgctcaggagcttataaagatggttcccttcgcattgttagaaacggaattgggataaatgaacaggcatctgtggaactgcaaggtatcaaaggaatgtggtcgcttagatcagcaacagatgatctgtatgacactttcttggttgttagcttcattagtgagactcggatattggcaatgaatttagaggaagagctagaggaaactgaaattgagggctttaattctcaagtgcagactctattctgtcatgatgctgtacataatcagcttgttcaggttacttcaagctcggtgagattggtgagttcgataacaagagagctaaaacacgaatggtttgcacctgctgattactctataaatgttgcaacagctaacactactcaggtactattggctactagaggtgggcatctagtttatcttgaaattactgatggactattagtggaaaaaaggcatgctcagctagagtatgatgtttcatgccttgatataaacccaattggtgataacccaaattatagtaatcttgctgcggttggtatgtggacgggtataagtgtcagaatattttcactccctgacctgactcttaagactgaggaacacttaggtggtgaaatcatacctcgatctgttcttctttgtgccttcgaagggataccttacttgttgtgtgcacttggagatggtcatcttttaaactttttactgaacacgacaacgggccaattaacagacaggaaaaaggtgtcacttgggacccaaccgataacactaagaacattttcatcaaagagtaccacacatgtttttgcagcttctgataggccaacagtgatatacagcagtaacaagaaattactctacagcaacgtgaaccttaaagaagtcagttacatgtgccctttcaattctgctgcttttcccgatagtcttgccattgcaaaagaaggcgagttgacaattgggacaattgatgatattcagaagcttcatatccgttctattcctcttggtgaacatgcaagacgtatctgccatcaagaacagtctcgtacttttgcaatatgcagtttaaaatacaaccagtcaagcacagaagattctgaaatgcattttattcgcttgttagatgaccagactttcgactttatatcctcttattcactggaccagtttgagtatggttgttccatactcagttgctctttctcagatgatactaatgcatattactgtgttgggacggcctatgttatgcctgaggagaatgaaccaacaaaggggcgtattttgattttcatggtcgaagatgggaagctacagctagtggctgagaaagaaaccaagggtgctgtttactctttgaatgcctttaacggtaaactccttgctgctataaatcagaaaattcagttgtacaagtggatgcttcgtgatgatggtacacgagaattgcaatctgaatgtggacatcatgggcacatacttgctctatatgtacaaactcgtggagatttcatcgttgttggtgatttgatgaaatccatttcattgttgatgtataagcatgaagaaggtgctattgaggaaagagctcgtgattacaatgccaattggatgtcagctgttgagatactcgatgacgatatataccttggagctgagaacaacttcaaccttttcacagtccgtaagaacagtgaaggcgccaccgatgaagaacgtggtcgtctagaagtagttggtgaataccatcttggagaattcgtgaaccgtttccgccatggttcactcgtgatgcggttacctgattctgatgtgggacagatcccaactataatattcggaaccgttaacggtgttattggtgtcattgcttcacttccccaagaccaataccttttcatgggaaaaacttcaaacaaatttgagaaaggttataaaaggtgttggagggttgagtcatgagcaatggagatcgttttatagtgagaagaaaactgttgactcgagaaatttcttggatggtgatttaatcgagtcgtttcttgatcttggaaggagcagaatggacgaaatctcaaaaacgatgaatgtttcagtcgaggaacttatgaagagagtagaagagctaacaaggttgcattagttaagctctcgaaggttttctagttcctgaaaagctttctttcgagacttttgacgtgtgaaactttgtaccg

SEQ ID NO: 3286 - DNA, 2254 bp, Brachypodium distachyon
cccacctcgctcctccgcgaccgtgcacccagcaacaattcccacctcctctcttacccccacatacgccgtgcgccgaggttaactgcagctcagcagccagcagcagcagcaacgggcaccttccatcccgactagagcagcgcggccgggaggaaggcggcgaatgcgataggaggcaccgagggacagaggagattatggggtcgaggacgcgggggtgctgcgggtggctgatcgtggcgctcgtgctggcgctggtggccacggcggcggtggtcgccatcatgaagaggaagcccgggggaggagggcgcgggcgcgaacccaagccgctccccgtcccgggcccgccgggggccatcgactccaagtacggcgacgcgctcgggatcgcgctccagttcttccaggtccagaaggcggggaagttggagaacaacgagatcccgtggcgaggggactctgcgctggatgatgggaaagaagccaagctggatctttccaagggactgtacgatgctggggatcatatgaagttcagcttcccaatggcgttcacggcaacggtgcttgcgtggtctgtgcttgaatacggggatcagatgaacgccgcgaagcagctagaccccgcgctagatgcgctccgctggatcacggatttcctcatcgcagcacatccttctgacaatgtgttctacattcaggttggtgatcctgatcttgatcacaactgctgggaaaggccagaaacgatgaccgagaagaggccgctcacacagattaacccaaagtcccctggatcagatattgctgctgaggcggcagcagccatggcggcagcatcaatggttttcaaaaccagtgatactacatattctgattcacttcttcagcatgctcagaagttatttacttttgctgatacttatagaggcatatccagtgagacctatccaaagcttcagaagtactataattccactggttatgttgatgagcttctgtgggcagcgagttggctctatcatgccacaggagaccagacatatctcagttatgttaccgtggagaatgggaaagcttacgctgattggggaaggccgacatggttcagctgggatgacaagctccctgggacacaggttctcttgtcaagagtaaatttctttggatccaaaaagatttctaatgctgaaaatgggggactcaaaatgtacagagacaccgctgaagctgtaatttgtgggcttctaccagattccccatcagccactggtagcaggactagcggaggcttggtgtggataagcgggtggaattctatccagcacggcacaaattcgggattccttgcttctgtttacagcgattacatgctgacatcacagacagcggctgtgcagtgcagtggaaagtactttagtcctacagatatacgcaattttgctatatcacaggcgaactacatattgggtgataatccaatgaagcttagctacctcgtgggatatgggagcagctatccacagcaggtacaccacaggggggcgtcaattcctgcagatgcaaaaacaggctgcaaaggattcgagtacctccactcatcaagtcccaacccgaatgtcgccatgggagcccttgtgggtgggccatttcagaatgactcttttgtggactctcgcgacaacgcggtgcagacagagtccagcacatacaacagcggcaccttggtcggacttctcgccggtctggtcaccacctcatccgtcgcatcgtcattcacctagacctccttctgaagcccccactatggctttgatcaacccggtgacgcatgcacagtcaggaggttttttttggcgtggatgattataatgcgcaaccagtgagacaccttgcagctttcttcatcggccatgagttagttgggtgattagcagtagttgtcagtgccatgttacaacaactaccgtactgctgtcgacctgtcagtttgtataaccggtgtcactgctgctgcagctatgattttagctgtgtgatcctatctggtttgctgggggtacccgtaggctgaatgtagttgcatgtattgtatttttagaacattattcctttgttgatttctgaggtggttcttggtagcttaagcttgtaccgatgcttgatctgtaatgccttggtgccttttaacagtgaaaattgcatgacatgtacatgagtacatccatatggtccacatgctttcaac

SEQ ID NO: 3287 - DNA, 2231 bp, Pennisetum glaucum
gcaggtccgcacacgacgcctaccaaccaacccggccaacccacgagccaagcgaagagcagccagccccatccgccaaaacgccccctgccgtctcccgagctgccggaacgcggcgccggcggcggcgggagccgaggtctcgactccaccccccgggcagcggggcattttggggaggcggccggccggcgaatgcgataggaggcgcggcggcggggatggggtccaagtacacgcgcgggtgctgcgggtggctgatcgtggcgctgattgcggcgctggtggccacggcggcgatgttcgccatcatgaagcgcaagcccgggggaggagggggcaagcgcctcaagccgctccccgtgccggggccgccgggggccatcgactccaagtacggcgacgcgctcggggtcgcgctccagttcttccaggtccagaagtcggggaagctggagaacaaccagatcccgtggcgtggggactcggcgctgaccgatgggaaggaagcggggctggatctttccaagggaatgtatgatgctggggatcatatgaagttcaccttcccaatggcgttcactgcaactgtccttgcctggtcggttttggagtatggggatcagatgagcgcggcaaagcaactggaccctgcacttgatgcgctcaagtggattacagattttcttatcgctgcacatccttctgacaatgtgttatatattcaggttggagatcctgatctggaccacaattgctgggaaaggccggaaacaatgactgagaaaagaccactcacacagattaacaagaaatctcctggatcagatgttgctgctgaggccgcagctgctatggcagcagcttcaatggtcttcaaatccagtgatactacatattctgatgtgcttcttcaacatgcccagaagctatttacttttgctgatacttatagaggcctttcaagtgacagctatccaaagctccaagacttctataattccactagttatgttgatgaacttttatgggcagcaagttggctctatcatgccacaggagaccagacatatctcagttatgtaactgtgcagaatggaaaaacttatgctgattggggaaggccaacatggttcagttgggatgacaaaaatccagggacacaggtccttctgtctaggctaaatttctttggctccaaacagatatctaatgctgaaaatgaggggttaaagtcgtatagagatactgcagaatctgtcatttgtggtctgattccagattccccgcaagccactgctagtagaactggaggagggttgatctggattagcgggtggaattctctccagcatgccacgaatgctgcatttctagctcttgtttacagtgactacatgctttcaacacagactgcagcagtgcagtgcagtggaaagtactacagccctactgatatacgcaattttgctgcatcacaggcaaattacatcttgggagacaaccctatgaagcttagctaccttgttggatatgggagcagctatccacagcaagtacatcacagaggagcgtcaatccccgcagatgcaaaaactggctgcaaaggattccagtatctccattcacccgatccaaacccaaatgttgcaatgggcgccctggtgggtgggccattccagaatgacacttatgtcgactctcgggacaatgctgtacagacggagtccagcacttacaacagtggcactcttgttggtctgctctctgggctggtcaccacttcctctgtggcacagtcattcacctagaggcctcatgtatgcttccgcaatggctttgatcaacatggaggggtgatgtgtacaatcacagttttttttggcgaggggcggagggcgatggtgattcgcgaacagtgacaagcatggtttgccatcgtgtggatggatggttagcacttagcagtggtggtagttagtgccacatttcttctgtttgtataattgatggtactgttcctggcctcctgcagctataatttttcaccgtgtgctcctatctggtttgctagtgtaccaccaaggctgtaactacgagtaatgtacttctaggacacatttcatttgttgattctgtggtgaggtggttcttcatgtttgtacgatgaattgttgtaactcgtcgcaactgaaatgtgcactgagggtgtgtgaattcacagttgaaga

SEQ ID NO: 3288 - DNA, 2198 bp, Sorghum bicolor
caaacccacccggccagcccacgagcccatccgccgcgcggcgagctgctgctgcgcctgcaggaaccgaaagctgctgccgaaacgcaacgcggcggcgcgagcagctagcggcactgcggcaggcagcagcggggaggccctcggaaacgcggcggaatacacgagggaggctactttcccggcgaatgcgttaggaggagacgaggcgcgcgcgcgcgggcggagatggggaagtacacgcgggggtgctgcggctggctcatcgtcgcgctgattgcggcgctggtggccacggcggcgatgttcgccatcatgaagcgcaagcccggggggcgacacatcaagccgctcccggtgccgggcccccccggggccatcgactccaagtacggcgacgcgctcggggtcgcgctccagttcttccaggtccagaaggcggggaagcttgagaacaaccagatcccgtggcgtggggactcggcgctgaccgacgggaaggaagcggggctggatctttccaagggaatgtatgatgctggggatcatatgaagttcaccttcccgatggcattcacggcgacggtgctctcgtggtcggtgctggagtacggggatcagatgagcgcagcaaagcaactggaccctgccctcgatgcgctgaagtggattacagatttccttatcgctgcacatccgtctgacaatgtgttgtatattcaggttggtgatcctgatctggaccacaattgctgggaaaggccggaaacaatgactgagaagagacctctcacacagattaacaagaagtctcccggatcagatgttgctgctgaggcagcagcagccatggcagctgcttcaatggtcttcaaatccagagatactacgtattctgatgtgcttcttcaacatgcccagaagctatttacttttgccgatacttatagaggcctctcaagtgagagctatcccaagctccaagatttctataattccactagttatgttgatgaacttctgtgggcagcaagttggctctatcatgccacaggcgaccagacatatctcagttatgtaactgtacagaatgggaaaacttatgctgattggggaaggccaacatggttcagttgggatgacaaaaatccaggcacacaggttcttttgtccagactaaatttctttggctccaaacagatatctaatgctgaaaacgaggggttaaaatcgtatagagatactgcagaagctgtcatttgtggtctgattccagattcccctcaagccactgctagcagaactggaggagggttggtgtggataagcgggtggaattctctccagcatgcgaccaatgctgcattcctagctgttgtgtacagtgactacatgctctccacacggacagcggcagtgcagtgcagtggaaagtactacagccctaccgatatacgcaattttgctgcttcacaggctaattatatcttgggagacaatccaatgaagcttagctaccttgttggatatggaagcagctatccacagcaagtacatcacagaggagcgtcgatcccagcagatgcaaaaacaggctgcaaaggattccagtatctccattcatccgatccaaacccaaatgttgcagtgggtgccctggtgggtgggccattccagaatgacactttcgttgattctcgtgacaatgctgtacagacggagtccagcacctacaacagcggcaccctagtcggtctgctctctggtctcgtcaccacttcctccgtggtacagtcattcacctagagtgctcctatgttttggcggtgcctacacaacctggagcaatgcatgcacaatcgcagttttttgacgaggctgatgctgatgcacgatctgtgagagaagcttggttggccatcgttcagatggatggcatgcagcagtagttagtgctcttctgtgtgtacaatgatggtgcagctcctgcagctgactgtgtgctcctatctggtttgctggtgtacctttaagctgtaactacgagtaatgtattgagtaggacgtatttcatttgttgattctgtggtgaggtagttcagcaaagcttgtaccaatgaattgtagcgcccctcaactgaaatgtgccctgaacatgtgaattcacaattggagatgaatggcaagtattcttgcgg

SEQ ID NO: 3289 - DNA, 2254 bp, Saccharum officinarum
cccacgcgtccgaccaaccaacccaacccggccagcccacgagcccatccgccgcgcggcgagcagcgcgcgagctgctgctgcaggaaccaaccgaagctgccgaaacgcggcggcgcgggcagcggcagcagcggggaggcctcggaaacgcggaggaatacacgaggaggtcactttcccggcgaatgcgttaggagagacgaggcgcggcggagatggggaagtacacgcgggggtgctgcggctggctcatcgtggcgctgattgcggcgctggtggccacggcggccatgttcgccatcatgaagcgcaagcccgggggccgccacatcaagccgctcccggtgccggggccgccgggggccatcgactccaagtacggcgacgcgctcggggtcgcgctccagttcttccaggtccagaaagcggggaagctggagaacaaccagatcccttggcgtggggactcggcgctgaccgatgggaaggaagcgggactggatctttccaagggaatgtatgatgctggggatcatatgaagttcaccttcccgatggcattcacggcgacggtgctcgcgtggtcggtgctggagtacggggatcagatgagcgcggcaaagcaactggaccctgccctcgatgcactgaagtggattactgatttccttatcgctgcacatccctctgacaatgtgttgtatattcaggttggtgatcctgatctggaccacaattgctgggaaaggccggaaacaatgactgagaaaagacctctcacacagattaacaagaagtctccgggatcagatgttgctgctgaggcagcagcagccatggcagctgcttcaatggtcttcaaatccagagatactacgtattctgatgtgcttcttcaacatgcccagaagctatttacttttgctgatacttatagaggcctctctagtgagagctatcccaagctccaagatttctataattccaccagttatgttgatgaacttctatgggcagcaagttggctctatcatgccacaggtgaccagacatatctcagttatgtaactgtacagaatgggaaaacttatgctgattggggaaggccaacatggttcagttgggatgacaaaaatccaggcacacaggtccttttgtccagactaaatttctttggctccaaacagatatctaatgctgaaaatgaggggttaaaaagttatagagatactgcagaagctgtgatttgtggtctgattccagattcccctcaagccactgctagcagaactggaggagggttggtgtggataagcgggtggaattctctccagcatgccaccaatgctgcattcctagctgttgtgtacagtgactacatgctctccacgcggacagcagcagtgcagtgcagtggaaagtactacagccctaccgatatacgcaattttgctgcatcacaggctaattatatcttgggagacaacccaatgaagcttagctaccttgttggatatgggagcagctatccacagcaagtacatcacagaggagcatcgatccccgcagatgcgaaaacaggctgcaaaggattccagtatctccattcaccagatccaaacccaaatgttgcaatgggtgccctggtgggcgggccattccagaatgacacttttgtcgattctcgtgacaatgctgtacagacggagtccagcacctacaacagtggcaccctagtcggtctgctctccggtctcgtcaccacttcctccgtggtacagtcattcacctagagtgctcctatgttttggcggtgcctacacaacctggagcgatgcatgtacgatcgcagttttttggcgtggctgatggtgatgcacgatctgtgagagaagcctggttggcaatcgtttagatggatggcatgcagcagtagttagtgcccacatttcttctgtgtgtacaatgatggtgcggctcctgcagctataatttttcactgtgtgctcctatctggtttgctggtgtacctgtatggctgtaactacgggtaatgtattgagtaggacgtattgcatttgttgattctgtggaggtagttcagcaaagcttgtaccaatgaattgtagcgcccctcaactgaaatgtgccctgaacatgtgaattcacaagtggagatgaatggcacgtatgcgtgcggttttgcggctcttcactcattctgaaaaatagggaagagaaacgtttttgt

SEQ ID NO: 3290 - DNA, 2118 bp, Setaria italica
accaaccaacccgcccagcccacgagccaagcgacgagcagcccatccgccgaaacgccctgccgtctcccgagctgccggaacgcggcggcggcggcgggctgctgcagcgggagccgaggtctcgactccaccccccaggcagcgggacacttgggggaggcggccggccggcgaatgcgataggaggcggcggggatggggtccaagtacacgcgcgggtgctgcgggtggctgatcgtggcgctgattgcggcgctggtggccacggcggcgatgttcgccatcatgaagcgcaagcccgggggagggggcaaacacctcaagccgctccccgtgccggggccgccgggggccatcgactccaagtacggcgacgcgctcggggtcgcgctccagttcttccaggtccagaagtcggggaagctggagaacaaccagatcccgtggcgtggggactcggcgctgaccgatgggaaggaagcggggctggatctttccaagggaatgtatgatgctggggatcatatgaagttcaccttcccgatggcgttcactgcgactgtgcttgcctggtcggttctggaatatggggatcagatgagcgcggcgaagcaactggaccctgcactcgatgcgctcaagtggattacagatttccttatcgctgcacatccttctgacaatgtgttatatattcaggttggcgatcctgatctggaccacaattgctgggaaaggccggaaacaatgactgagaaaagaccactcacacagattaacaagaaatctcctggatcagacgttgctgctgaggccgcagctgctatggcggcagcttcaatggtcttcaaatccagtgatactacatattctgatgtgcttcttcaacatgcccagaagctatttacttttgctgatacttatagaggcctttcaagtgacagctatccaaagctccaagacttctataattccactagttatgttgatgaacttctatgggcagcaagttggctctatcatgccacaggagaccagacatacctcagttatgtaactgtacagaatggaaaaacttatgctgattggggaaggccaacatggttcagttgggatgacaaaaatccaggcacacaggtccttctgtctagactaaatttctttggctccaaacagatatctaatgctgaaaatgaggggttaaagtcgtatagagatactgcagaatctgtcatttgtggtctaattccagattccccgcaagccactgctagtagaactggaggagggttgatctggattagtgggtggaattctctccagcatgccacaaatgctgcatttctagctattgtttacagtgactacatgctctcaacacagactgcggcggtgcagtgcagtggaaagtactacagccctactgatatacgcaattttgctgcatcacaggccaattacatcttgggagacaaccctatgaagcttagctaccttgttggatatgggagcgtctatccacagcaagtacatcacagaggagcgtcgatccccgcagatgcgaaaacaggctgcaaaggattccagtatctccattcacccgatccaaacccaaatgttgcaatgggcgccctggtgggtggaccattccagaatgacactttcgtcgactctcgggacaatgctctacagacggagtccagcacttacaacagtggcactcttgtcggtctgctctctggtctggtcaccacttcctccgtggcacagtcattcacctagaggcctcatgtatgtttcggcaatggctttgatcaacatggagggatggtgcatgtacaatcgcagttttttggcgaggccgatggtgattcgcgaacagtgacaaaagcatgatttgccatcatttagatggatggttagcacttagcagtagttgttagtgccgcatttcttctgtttgtataattgatggtgctgctcctgcagctataatttttcactgtgtgctcctatctggtttgctggtataccactaaggctgtaactacgagtaatgtatttttaggacagatttcatttgttgattctgtggcgaggtggttctgttggaac

SEQ ID NO: 3291 - DNA, 2218 bp, Zea mays
gcgccacacccacacccacaccgcaccaaccaaccccggccggccagccagcccacgagccccatcccgccatccgcccgcgcggcgagcgcagagccgagccgagctgccggaacgcaggcagcggccaccgggaggcctccgaaacgcagcggaacacctgaggaggcggcttcccggcgaatgctctaggaggaggcgcggcgccggcggagatggggtccaagtacacgcgcgggtgctgcggctggctgatcgtggcgctgattgcggcgctggtggccacggccgcgatgttcgccatcatgaagcgcaagcccgggggccgccacatcaagccgctgccggtgccggggccgccgggggccatcgactccaagtacggcgacgcgctcggggtcgcgctccagttcttccaggtccagaaggcggggaagctggagaacaaccagatcccgtggcgtggggactcggcgttgaccgacgggaaggaagcggggctggatctttccaagggaatgtatgatgctggggatcacatgaagttcaccttcccgatggcattcacggcgacggtgctctcgtggtcggtgctggagtacggggatcagatgagcgcggcaaagcaactggaccctgccctcgatgcactgaagtggattacagatttccttattgctgcacatccttctgacaatgtgctgtatatccaggtcggtgatcctgatctggaccacaattgttgggaaaggccagaaacaatgaccgagaaaagacctctcacacagatcaacaagaagactcccggatcagatgttgctgctgaggcagcagcagccatggcagctgcttcaatggtcttcaaatccagagataccacgtattctgatgtgcttcttcagcatgctcagaaactattcacttttgctgacacttatagaggcctctcaagcgagagctatcccaagctccaggatttctataactccaccagttacgttgatgagcttctatgggcagcgagttggctctaccacgccacaggcgaccagacgtatctcagctatgtaactgtacagaacgggaaaagttatgctgattggggaaggccaacatggttcagttgggatgacaaaaatccaggcacacaggtgcttttgtccagactaaatttcttcgggtccaaacagatatctaatgccgaaaatgaggggttgaaaatgtatagagatactgcagaagctgtcatttgtggtctgattccagattcgcctcaagccactgccagcagaactggaggaggcttggtgtggataagcgggtggaattctctccagcatgccaccaacgctgcgttcctatctgttgtgtacagcgactacatgctctcgacgcggacagcggcagtgcagtgcagcgggaagtactacagccctaccgatatacgcaactttgctgcatcacaggctaactatatcctgggagacaacccgatgaagcttagctaccttgtgggatatgggagcagctacccaaagcaagtacaccacagaggggcgtcgatccccgcggatgcgaaaacaggctgcaaagggttcgagtatctccactcacccagcccgaacccaaacgtggctacgggcgccctggtgggtgggccattccagaacgacaccttcgtggactcccgtgacaacgccgtgcagacggagtccagcacctacaacagtggcaccctggtcggtctcctctccggcctcgtcaccacttcctccgtggtacagtcgttcacctagagggctcctcctatgttctggcctggagcgatgcgtgtacgagtacgattgcagtttttttgcttggcgtggctgatggtgatgcgcgatctgtgactgtgagagagaaagcttggttgccaaccgttcagttcagacggatggcatatgcaggatgcagcagtagtttagtagtgcccacgcgtttcttctgttgtgtgtgtacaatgacggtgctgctcctgcagtgcagctatagtttttcaccgcgtgctcctatctggtttgctggtgtgcctgtaaggctgtagctacgagtaatgtattagactatttgtaggtcgtatttcatttgttcattctgtggtgaggtagttcagcagagctttgtactgtaccgatgaattgcaccgtctcccaactgaaatgtgccttgtggattc

SEQ ID NO: 3292 - DNA, 2042 bp, Echinochloa colona
caacccggccagcccacgagcccatccgcctcgcggcgagcgccccatacccaagctgctacctgtaggaaacgcccctgcccgtgccgagccgagctgcccgagacgcggcggcggcgggagcgggaggtctttgcccaccccccacgcggcgggaagcttgaggaggcggcttggccggcgaatgcgataggaggcggcggcggggatggggtccaagtacacgcgcgggtgctgcggctggctgatcgtggcgctgattgcggcgctggtggccacggcggcgatgttcgccatcatgaagcgcaagcccgggggagggggccgccacctcaagccgctccccgtgccggggccgccgggggccatcgactccaagtacggcgacgcgctcggggtcgtgctccagttcttccaggtccagaagtcggggaagctggagaacaaccagatcccgtggcggggggactcagcgctgactgatgggaaggaagcagggctcgatctttccaagggaatgtatgatgctggggatcatataaagttcaccttcccgatggcgttcactgctactgtgcttgcctggtcggttctggagtacggggatcagatgagcgccgcgaagcaactggaccctgcactcgatgcgcttaagtggattacagattttcttatcgctgcacatccttctgacaatgtgttatatattcaggttggcgatcctgatctggaccacaattgctgggaaaggccggaaacaatggctgagaaaagaccactcacccagattaacaagaaatctcctggatcagatgttgctgctgaggcagcagctgcgatggcagcagcttcaatggtcttcaaatccagtgatactgcgtattctgatgtgcttcttcaacatgcccagaagctatttacttttgctgatatttacagaggcctctcaagtgacagctatccgaagctccaagacttctataattccactggttatgttgatgaacttctatgggcagcaagttggctctatcatgccacaggagaccagacatatctcagttatgtaactgtacagtatggaaaagcttatgctgattggggaagaccaacatggttcagttgggatgacaaaaatccaggcacacaggtccttctgtctagactaaacttctttggctccaaacagatatctaatgctgaaaatgagggcttaaaatcgtatagagatactgcagaatctgtcatttgtggtctgattccagattccccgcaagccactgctagtagaactggaggagggttgatctggataagtgggtggaattctctgcagcatgccacgaatgctgcatttctatctattgtttacagcgactacatgttctcgacacggacagcagcagtgcagtgcagtggaaagtactacagccctactgatatacgcaattttgctgcatcacaggctaattacatcttgggagacaacccgatgaagcttagctaccttgttggttatgggagcagctatccacagcaagtacaccacagaggagcgtcaatccccgcagatgcgaaaacaggctgcaaaggatttgagtatctccattcacccaatccaaacccaaatgttgcaatgggcgccctggtgggtgggccattccagaatgacacttttgtcgactctcgggataatgctctacaaacggaatctagcacttacaacagtggcactcttgtcggtctgctttctggtctggtcaccacttcttccgtagcacagtcattcacctagatgcctcacatatatatgtttgggtgatggctttgatcaacatggagggatgcatgtaatcgcagtttttttttgggcgaagccgatgataattcgtgatcaatgacagaagcttgctttgccatcgtttagatggatgattagcacttagcagtagtagttagcgacacttttcttctgtttgtataattgattggtactgctcgtgctagctattaattttcaattgtgtgtctcctatctggtt

SEQ ID NO: 3293 - DNA, 2087 bp, Avena sativa
agcaccgggctagcctccctccccttcccctcccgcgccgaccccgaccagagcagcctccgcctcagccgcccgcgcgcgccggggaatgcgctaggagagaaagagagcgagggcgagcggagatggggtccaggagaggcgggtgctgcgggtggctgatcgtggcgctggtgctggcgctcgtggccacggcggcggtggtggccatcatgaagcggaagccggggggcggaggagggtccagccgccgccccaagccgctccccgtcccgggcccgcccggcgccgtcgactccaagtacggcgactccctcggggtcgcgctccagttcttccaggtccagaaggcggggaagttggtggacaaccagatcccgtggcggggtgactccgcgctgaacgacgggaaagaagcgaagctggatctatccaaggggctgtacgatgctggggatcatatgaagttcaccttccccatggcgttcacggccacggtgctcgcctggtccatcctcgagtacggggatcagatgaccgcggccaagcagctggatcctgccctcgacgggctccggtggatcacggatttcctcatcgcggcgcatccgtctgacaatgtgctctacattcaggttggtgatcctgatctagaccacaactgctgggaaaggccagaaacaatgactgagaaaagaccgctcacacagattaacgcgaagtcccctggatcagatatcgctgccgaggcagcagcagccatggcagcagcatcaatggttttcaaatccactgatactacatattctgatacacttctccaacatgcacagaagttgtttacctttgctgatacttatagaggaatctctagtgacacttatccaaagctccagaactactataactcaactggttatgctgatgagctcctgtgggcagcaagttggctctatcatgccacaggagatcagacgtatctcagttacgcgactgtagagaatgggaaagcttatgctgattggggacggccaacatggttcagctgggatgacaagctccccgggacacaggttcttttgtcaagagtaaatttctttggatccaataaggcatccaatgctgaaaactcgggactcaaatcgtacagagacactgctgaagctgtcatttgtgggcttctaccagattctccatcagccactggtagcaggactagcggagggttggtgtggataagtgggtggaattctctccagcatgccacaaatgcagcattccttgctgttgtttatagcgactacatgctgacgtcacagacagcagctgtggagtgcagtggaaagtattttagtccaacagatatacgcaatttcgctatatcacaggcgaactacatattgggtgacaacccaatgaagcttagctacctcgtgggatacgggagcaactatccacagcaggtgcaccacaggggggcatcgattccctcagatgtgaaaacaggctgcaaaggattcgactacctccactcgaccagtccgaacccaaatatcgccatgggagcccttgtaggcgggccattccagaacgactcttttgtggacttgcgcgacaacgcggtgcagacagagtcaagcacatacaacagcggcaccttggtaggcctgctcgctggtctggtgaccacttcgtccattgcgaagacattcacatagagctggctctttcatcaacccaggaagcatatacgagatttttgtggctctgacgatgataatgctcagtcagcgagatgtcttgcagctttattcgttggacatcacttagacggatgattagcagtagttattagtgtcgtattcttcagtttgcgtttggtttgtgggtgtacctgtggtgtagctacggatatatattgtttgtagggcagattgcattcgttgattgtgaagtggttcttggtggcttttagccaatctgtaatggcttcccagtgagacttgcactggaaatgtacattcatatgtatgctcaatctttttacagtatgttccattcacagggaacacgtggcaagtatatgc

SEQ ID NO: 3294 - DNA, 1831 bp, Hordeum vulgare
ccgccagcgacccggacctcccaccccgctcctccccgaccgtgcacccagccgttcgttccccagtccctgccaccccaccccaccaacccgcgccgcgcggcgagcgagcctagttaaccgcagctccagcagcaggccccgacgcgcgcgagcagccggaggaaggaggttctgagcgggcggcgaatgcgataggaggaagggaggggagggcgagatggggtccaagaccaaggggtgctgcgggtggctgatcgtggcgctggtgctggcgctggtcgccacggcggcggtggtggccatcatgaagcggaagcccggaggaggcggagggggccggagccggccgcccaagccgctccccgtccccggcccgcccggggacgtcgactccaagtacggcgacgcgctcggggtcgcgctccagttcttccaggtccagaaggcggggaagttggtggacaaccagatcccgtggcggggggactctgcgctgaccgatgggaaggaagccaagctggatctctccaaggggctgtacgatgccggggatcatatgaagttcaccttccccatggccttcacggcgacggtgctcgcgtggtcggtgctcgagtacggggatcagatgaccgccgccaagcagctggacccagcgcttgatgcgctccggtgggtcaccgatttcctcatcgccgcacatccttcggacaacgtgttctacattcaggttggtgatcctgatctagatcacgactgctggcaaaggccagaaacaatgactgagaaaaggccgctcacacagattaacccaaagaaccctgggtcagatatcgctgctgaggcagcagcagccctggcggcagcatcgatggttttcaaatccagtgacactacatattctgattcacttcttcaacatgcccagaagttatttacttttgctgatacttataaaggcatcgccagcgacacctatccaaagcttcagaagtactataattctactggttatgtcgatgagctcctctgggcagcaagttggctctatcatgccacaggagatcagacatatctcagttatgtgactgtacagaacgggaaagattatgctgattggggaaggcccacatggttcagctgggatgacaagctcccagggacacagatccttttgtccagagttaatttctttggatccaaagagatatctaatgctgaaaacagtggactcaaaatgtacagagacactgctgaggccgtcatttgtgggcttctaccagattctccatcagccactggtagcaggactagcggagggctggtatggataagtgggtggaattctctgcagcatggcataaatgcagcattccttgctgttgtttacagcgactacatgctgacatcacaaacagccgcagtggagtgcagtggaaagtattttagcccgacagatattcgcaatttcgctatatcacaggcaaattacgtactgggtgacaacacaatgaagcttagctacctggtgggatatgggagcaactatccacagcaggtacaccataggggggcatccatccccgcggatgcgaaaacgggctgcaaggggttcgagtacctccactcatccagcccgaacccgaatgtcgccatgggggccgttgttggcgggccatttcagaatgacactttcgtggacttgcgcgacaatgcggtgcagacagagtccagcacttacaacagcggcaccttcgtcggcctactggctggcctggtcaccacctcgtccgtcgcaaagacattcacctagagctctttctcaagc

SEQ ID NO: 3295 - DNA, 2392 bp, Hordeum vulgare
acgcgcccgctgccagcggcggcccacgcacccaaccaaaccctcccggccccgccgccagcgacccggacctcccaccccgctcctccccgaccgtgcacccagccgttcgttccccagtccctgccaccccaccccaccaacccgcgccgcgcggcgagcgagcctagttaaccgcagctccagcagcaggccccgacgcgcgcgagcagccggaggaaggaggttctgagcgggcggcgaatgcgataggaggaagggaggggagggcgagatggggtccaagaccaaggggtgctgcgggtggctgatcgtggcgctggtgctggcgctggtcgccacggcggcggtggtggccatcatgaagcggaagcccggaggaggcggagggggccggagccggccgcccaagccgctccccgtccccggcccgcccggggacgtcgactccaagtacggcgacgcgctcggggtcgcgctccagttcttccaggtccagaaggcggggaagttggtggacaaccagatcccgtggcggggggactctgcgctgaccgatgggaaggaagccaagctggatctctccaaggggctgtacgatgccggggatcatatgaagttcaccttccccatggccttcacggcgacggtgctcgcgtggtcggtgctcgagtacggggatcagatgaccgccgccaagcagctggacccagcgcttgatgcgctccggtgggtcaccgatttcctcatcgccgcacatccttcggacaacgtgttctacattcaggttggtgatcctgatctagatcacgactgctggcaaaggccagaaacaatgactgagaaaaggccgctcacacagattaacccaaagaaccctgggtcagatatcgctgctgaggcagcagcagccctggcggcagcatcgatggttttcaaatccagtgacactacatattctgattcacttcttcaacatgcccagaagttatttacttttgctgatacttataaaggcatcgccagcgacacctatccaaagcttcagaagtactataattctactggttatgtcgatgagctcctctgggcagcaagttggctctatcatgccacaggagatcagacatatctcagttatgtgactgtacagaacgggaaagattatgctgattggggaaggcccacatggttcagctgggatgacaagctcccagggacacagatccttttgtccagagttaatttctttggatccaaagagatatctaatgctgaaaacagtggactcaaaatgtacagagacactgctgaggccgtcatttgtgggcttctaccagattctccatcagccactggtagcaggactagcggagggctggtatggataagtgggtggaattctctgcagcatggcataaatgcagcattccttgctgttgtttacagcgactacatgctgacatcacaaacagccgcagtggagtgcagtggaaagtattttagcccgacagatattcgcaatttcgctatatcacaggcaaattacgtactgggtgacaacacaatgaagcttagctacctggtgggatatgggagcaactatccacagcaggtacaccataggggggcatccatccccgcggatgcgaaaacgggctgcaaggggttcgagtacctccactcatccagcccgaacccgaatgtcgccatgggggccgttgttggcgggccatttcagaatgacactttcgtggacttgcgcgacaatgcggtgcagacagagtccagcacttacaacagcggcaccttcgtcggcctactggctggcctggtcaccacctcgtccgtcgcaaagacattcacctagagctctttctcaagcaacgacaatggtggcttttatcaacccgggaagcatatacaattagaggaatgtttttttttttttggttccaagtgacggtaatgcgcaatccagtgagacctgtttcagatttgttcattggccgtcacttaggtgggtgattagcagtagtcattagtgccacattactcttgcttgtataatacatatatggtaatttttaccatgtggtcaactcctatctggtttgctggtgtacctgttgtagctatgggtattgtatttgtagggcagatatcatttgttcattcagaggtggtttttggtacgtagccctgatgattgttctgtaatgccttaccaatggaacaagcatatattcacgtgcgtgtgtaattttcttacactatgttccatgcacacagggaacacctgtcaacttctgcagggaaaaaatatggttcatcaggatctcatgtacagcgtgatgactagtattgtgtgattagtgttggaaaagccaca

SEQ ID NO: 3296 - DNA, 2100 bp, Avena sativa
agcaccgggctagcctccctccccttcccctcccgcgccgaccccgaccagagcagcctccgcctcagccgcccgcgcgcgccggggaatgcgctaggagagaaagagagcgagggcgagcggagatggggtccaggagaggcgggtgctgcgggtggctgatcgtggcgctggtgctggcgctcgtggccacggcggcggtggtggccatcatgaagcggaagccggggggcggaggagggtccagccgccgccccaagccgctccccgtcccgggtccgcccggggccgtcgactccaagtacggcgactccctcggggtcgcgctccagttcttccaggtccagaaggcggggaagttggtggacaaccagatcccgtggcggggtgactccgcgctgaacgacgggaaagaagagaagctggatctatccaaggggctgtacgatgctggggatcatatgaagttcaccttccccatggcgttcacggccacggtgctcgcctggtccatcctcgagtacggggatcagatgaccgcggccaagcagctggaccctgccctcgacgggctccggtggatcacggatttcctcatcgcggcgcatccatctgacaatgtgctctacattcaggttggtgatcctgatctagatcataactgctgggaaaggccagaaacaatgacagagaaaaggccgctcacacagattaacgccaagtcccctggatcagatatcgctgccgaggcagcagcagccatggcagcagcatcaatggttttcaaatccactgatactacatattctgatacacttctccaacatgcacagaagttgtttacctttgctgatacttatagaggaatctctagtgacacttatccaaagctccagaactactataactcaactggttatgctgatgagctcctgtggggagcaagttggctctatcatgccacaggagatcagacgtatctcagttacgcgactgtagagaatgggaaagcttatgctgattggggacggccaacatggttcagctgggatgacaagctccccgggacacaggttcttttgtcaagagtaaatttctttggatccaataaggcatctaatgctgaaaactcgggactcaaatcgtacagagacactgctgaagctgtcatttgtgggcttctaccagattctccatcagccactggtagcaggactagcggaggattggtgtggataagtgggtggaattctctccagcatgccacaaatgcagcattccttgctgttgtttatagcgactacatgctgacgtcacagacagcagctgtggagtgcagtgggaagtattttagtccaacagatatacgcaatttcgctatatcacaggcgaactacatattgggtgacaacccaatgaagcttagctacctcgtgggatacgggagcaactatccacagcaggtgcaccacaggggggcgtcgattccctcagatgtgaaaacaggctgcaaaggattcgactacctccactcgaccagtccgaacccaaatatcgccatgggagcccttgtaggcgggccattccagaacgactcttttgtggacttgcgcgacaacgcggtgcagacagagtcaagcacatacaacagcggcaccttggtaggcctgctcgctggtctggtgaccacttcgtccattgcgaagacattcacatagagctggcaacggctttcatcaacccaggaagcatatacgagatttttgtggctctgacgatgataatgctcagtcagcgagatgtcttgcagctttattcgttggacatcacttagacggatgattagcagtagttattagtgtcgtattcttcagtttgcgtttggtttgtgggtgtacctgtggtgtagctacggatatatattgtatttgtagggcagattccattcgttgattgtgaggtggttcttggtggctttgtgccaatctgtaatggcttcccagtgagacttgcattggaaatgtacattcatatgtatgctcaatctttttacagtatgttccattcacagggaacacgtggcaagtatatgcagggaaa

SEQ ID NO: 3297 - DNA, 2111 bp, Secale cereale
gactctccccgagagcagagcagcagcctctccgtccgtgtccccgacgcgcgcgcgggccggcgaatgcgataggagggagggagggcgggggagagatggggtcgaggaccaagggctgctgcgggtggctgatcgtggcgctggtgctggcgctggtggccacggcggccgtggtggccatcatgaagcgcaagcccgggggaggcggaggggccggagccggccgcccaagccgctccccgtcccgggcccgcccggggacatcgactccaagtacggcgacgcgctcggggtcgccctccagttcttccaggtccagaaggccgggaagttggtggacaaccagatcccgtggcggggggactctgcgctggacgatgggaaggaagccaagctggatctctccaagggcctgtacgacgccggggatcatatgaagttcaccttccccatggccttcacggcgacggtgctcgcgtggtccgtgctcgagtacggggaccagatgaccgccgccaagcagctagacccagcgctcgacgcgctccggtggaccacggatttcctcatcgcggctcatccttctgacaacgtgttctacattcaggttggtgatcctgatcttgatcacgactgctggcaaaggccagaaacaatgactgagaaaaggccgctcacacagattaacgcaaagaaccctgggtcagatatcgctgctgaggcagcagcagccatggcggcagcatcaatggttttcaaatccagtgacaccacatattctgattcacttcttcaacatgcccagaagttatttacttttgctgatacttataaaggcatcgccagcgacgcctatccaaagcttcagaagtactataattctactggttatgttgatgagctcctctgggcagcgagttggctctatcatgctacaggagaccagacatatctcagttatgtgactgtgcagaacgggaaagattacgctgattggggaaggccaacatggttcagctgggatgacaagctcccagggacgcagatccttttgtcaagagtaaatttctttggatccaaagagatctctaatgctgaaaacagtgggctcaaaatgtacagagacactgctgaggctgttatttgtgggcttctaccagattctccatcagccactggtagtaggactagcggagggctggtgtggataagtgggtggaattctctgcagcatggcataaacgcggcattccttgctgttgtttacagcgactacatgctgacatcacaaacggccgcagtggagtgcagtggaaaatattttagtccgacagatattcgcaatttcgctatatcacaggcaaattacgtgctgggtgacaacccaatgaagcttagctacctggtgggctacgggagcagctatccacagcaggtgcaccacaggggtgcatccatccccgcggacgcgaaaacgggctgcaagggattcgagtacctccattcagccagcccgaacccgaatgtagccacgggagccgttgtgggcgggccatttcagaatgactctttcgtggacttgcgcgacaatgccgtgcagacagagtccagcacttacaacagcggcacattcgtcggtctgctggctggcctggtcaccacctcgtccatcgcaaagacattcacctagagctctctctcaagcaacgacaatggtgggttttatcaacccgggaagcatatacaattagaggattttcttttatcagagtgacggtaataatgcgcaatccagtgagacctgttgcagatttgttcattggccgtctcttattaggtgggtgattagcagtagtcgttagtgtcatactacccttgcttgtatcatagtatatgctatttttcaccgtgtgtcaacccctatctggtttgctggtgtaccgtacctgttgtagctatgggtattgtatttgtagggcagatttcatttgttcattctcaggtggtttttggtagctgccatgattggcctgtgtaatgtcttgccaatggaacatgcatacattcacttgtatgtgcaattcttttatatactactccctccgtta

SEQ ID NO: 3298 - DNA, 2085 bp, Secale cereale
gacgaaggaacaaagaaggacaaaaagactactccaactactgaatgctttcgtatataatactccctcctcaactcggactcgacctctcccaactcgccctccccgacgagcagagcagcagcctctccgtccgtgtccccgacgcgcgcgcgggccggcgaatgcgataggagggagggagggcgggggagagatggggtcgaggaccaagggctgctgcgggtggctgatcgtggcgctggtgctggcgctggtggccacggcggccgtggtggccatcatgaagcgcaagtccggggaggcggaggggccggagccgcccgcccaagccgctgcccgtccccggcccgcccggggacatcgactccaagtacggcgacgcgctcggggtcgcgctccagttcttccaggtccagaaggccgggaagttggtggacaaccagatcccgtggcgaggggactctgcgctggacgatgggaaggaggcgaagctggatctctccaaggggctgtacgacgccggggatcatatgaagttcaccttccccatggccttcacggccacggtgctcgcgtggtccgtgctcgagtacggggaccagatgaccgcctccaagcagctagacccagcgcttgacgcgctccgctggaccacggatttcctcatcgcggctcatccttctgacaacgtgttctacattcaggttggtgatcctgatcttgatcacgactgctggcaaaggccagaaacaatgactgagaaaaggccgctcacacagattaacgcaaagaaccctgggtcagatatcgctgctgaggcagcagcagccatggcggcagcatcaatggttttcaaatccagtgacaccacatattctgattcacttcttcaacatgcccagaagttatttacttttgctgatacttataaaggcatcgccagcgacgcctatccaaagcttcagaagtactataattctactggctatgttgatgagctcctctgggcagcgagttggctctaccatgctacaggagatcagacatatctcagttatgtgactgtgcagaacgggaaagattacgctgattggggaaggccaacatggttcagctgggatgacaagctcccagggacacagatccttttgtcaagagtaaatttctttggatccaaagagatatctaatgctgaaaacagtggactcaaaatgtacagagacactgctgaggcagtcatttgtgggcttctaccagattctccatcagccactggtagtaggactagcggagggctggtgtggataagtgggtggaactctctgcagcatggcataaacgcagcattccttgctgttgtttacagcgactacatgctgacgtcacaaacggctgcagtggagtgcagtggaaaatattttagtccgacagatattcgcaatttcgctatatcacaggcaaattacgtgctgggtgacaacccaatgaagcttagctacctggtgggatacgggagcagctatccgcagcaggtgcaccacaggggggcatccatccccgcggacgcgaaaacgggctgcaagggattcgagtacctccattcggccagcccgaacccgaatgtcgccatgggagccgttgtgggcgggccatttcagaatgactctttcgtggacttgcgcgacaacgcggtgcagacagagtccagcacttacaacagcggcacattcgttggtctgctcgcgggcctggtcaccacctcgtccatcgcaaagacattcacctagagctctctctcaagcaacgacaatggtgggttttatcaacccgggaagcatatacaattagaggattttcttttatcagagtgacggtaatgcgcaatcgagtgagacctgttgcagatttgttcattggccgtctcttactaggtgggtgattagcagtagtcgttagtgtcatactactcttgcttgtatcatagttatatgcgatgtttcaccgtgtggtcaactcctatctggtttgctgttgtaccgtacctgttgtagctatgggtattgtatttgcagggcagattcc

SEQ ID NO: 3299 - DNA, 2119 bp, Secale cereale
gactccctcccctccccgagagcagagcagcagcctctccgtccgtgtcccgacgcgcgcgcgggccggcgaatgcgataggagggagggagggcgggggagagatggggtcgaggaccaagggctgctgcgggtggctgatcgtggcgctggtgctggcgctggtggccacggcggccgtggtggccatcatgaagcgcaagtccgggggaggcggaggggccggagccgcccgcccaagccgctgcccgtcccggcccgcccggggacatcgactccaagtacggcgacgcgctcggggtcgcgctccagttcttccaggtccagaaggccgggaagttggtggacaaccagatcccgtggcgaggggactctgcgctggacgatgggaaggaggcgaagctggatctctccaaggggctgtacgacgccggggatcatatgaagttcaccttccccatggccttcacggccacggtgctcgcgtggtccgtgctcgagtacggggaccagatgaccgcctccaagcagctagacccagcgcttgacgcgctccgctggaccacggatttcctcatcgcggctcatccttctgacaacgtgttctacattcaggttggtgatcctgatcttgatcacgactgctggcaaaggccagaaacaatgactgagaaaaggccgctcacacagattaacgcaaagaaccctgggtcagatatcgctgctgaggcagcagcagccatggcggcagcatcaatggttttcaaatccagtgacaccacatattctgattcacttcttcaacatgcccagaagttatttacttttgctgatacttataaaggcatcgccagcgacgcctatccaaagcttcagaagtactataattctactggctatgttgatgagctcctctgggcagcgagttggctctaccatgctacaggagatcagacatatctcagttatgtgactgtgcagaacgggaaagattacgctgattggggaaggccaacatggttcagctgggatgacaagctcccagggacacagatccttttgtcaagagtaaatttctttggatccaaagagatatctaatgctgaaaacagtggactcaaaatgtacagagacactgctgaggcagtcatttgtgggcttctaccagattctccatcagccactggtagtaggactagcggagggctggtgtggataagtgggtggaactctctgcagcatggcataaacgcagcattccttgctgttgtttacagcgactacatgctgacgtcacaaacggctgcagtggagtgcagtggaaaatattttagtccgacagatattcgcaatttcgctatatcacaggcaaattacgtgctgggtgacaacccaatgaagcttagctacctggtgggatacgggagcagctatccgcagcaggtgcaccacaggggggcatccatccccgcggacgcgaaaacgggctgcaagggattcgagtacctccattcggccagcccgaacccgaatgtcgccatgggagccgttgtgggcgggccatttcagaatgactctttcgtggacttgcgcgacaacgcggtgcagacagagtccagcacttacaacagcggcacattcgttggtctgctcgcgggcctggtcaccacctcatccattgcaaagacattcacctagagctctttctcaagcaacgacaatggtggattttatcaacccgggaagcatatacagttagaggattttctttatcagagtgacggtaatgcgcaacccagtgagacctgttgcagatttcttcattggccgtctcttattaggtgggtgattagcagtagtcgttagtgtcatactactcttgcttgtatcatagtatatgcgatgtttcgccgtgtggtcaactcctatctggtttgctggtgtaccgtacctgttgtagctatgggtattgtattggtagggcagattccatttgttcattctcaggtggtttttggtagctgccatgattggcctgtgtaatgtcttgctaatggaacatgcatacattcacttgtatgtgcaattcttttatatactactccctaccgttaaaccc

SEQ ID NO: 3300 - DNA, 2086 bp, Secale cereale
gagcagagcagcagcccctccgtccgtctccccgacgcgcgcgcgggccggcgaatgcgataggagggagggcgggggagagatgggggtcgaggaccaagggctgctgcgggtggctgatcgtggcgctggtgctggcgctcgtggccacggcggccgtggtggccatcatgaagcgcaagcccggggagcggaggggccggagccgcccgcccaagccgctccccgtcccgggcccgcccggggacatcgactccaagtacggcgacgcgctcggggtcgccctccagttcttccaggtccagaaggccgggaagttggtggacaaccagatcccgtggcggggggactctgcgctggacgacgggaaggaagccaagctggatctctccaaggggctgtacgacgccggggatcatatgaagttcaccttccccatcggccttcacggccacggtgctcgcgtggtccgtgctcgagtacggggaccagatgaccgccgccaagcagctagacccagcgctcgacgcgctccggtggaccacggatttcctcatcgcggctcatccttctgacaacgtgttctacattcaggttggtgatcctgatcttgatcacgactgctggcaaaggccagaaacaatgactgagaaaaggccgctcacacagattaacgcaaagaaccctgggtcagatatcgctgctgaggcagcagcagccatggcggcagcatcaatggttttcaaatccagtgacaccacatattctgattcacttcttcaacatgcccaaaagttatttacttttgctgatacttataaaggcatcgccagcgacgcctatccaaagcttcagaagtactataattctactggctatgttgatgagctcctctgggcagcgagttggctctaccatgctacaggagatcagacatatctcagttatgtgactgtgcagaacgggaaagattacgctgattggggaaggccaacatggttcagctgggatgacaagctcccagggacacagatccttttgtcgagagtaaatttctttggatccaaagagatatctaatgctgaaaacagtggactcaaaatgtacagagacactgctgaggcagtcatttgtgggcttctaccagattctccgtcagccactggtagtaggactagcggagggctggtgtggataagtgggtggaattctctgcagcatggcataaacgcagcattccttgctgttgtttacagcgactacatgctgacatcacaaacggccgcagtggagtgcagtggaaaatattttagtccgacagacattcgcaatttcgctgtatcacaggcaaattatgtgctgggtgacaacccaatgaagcttagctacctggtgggctacgggagcagctatccgcagcaggtacaccacaggggggcatccatccccgcggacgcgaaaacaggctgcaagggattcgagtacctccattcggccagcccgaacccgaatgtcgccatgggagccgttgtgggcgggccatttcagaatgactctttcgtggacttgcgcgacaacgcggtgcagacagagtccagcacttacaacagcggcacattcgttggtctgctcgcgggcctggtcaccacctcgtccatcgcaaagacattcacctagagctctttctcaagcaacgacaatggtgtgttttatcaacccgggaagcatatacaattagaggattttcttttatcaaagtgacggtaatgcgcaacccagtgagacctgttgcagatttgttcattggccgtctcttactaggtgggtgattagcagtagtcgttagtgtcatactacccttgcttgtatcatagtatatgctatttttcaccgtgtggtcaacccctatctggtttgctggtgtacgtacctgttgtagctatgggtattgtattgtagggcagatttcatttgttcattctcaggtggtttttggttagctgccatgattggcctgtgtaatgtcttgccaatggaacatgcatacattcacttgtatgtgcaattcttttatatactactccct

SEQ ID NO: 3301 - DNA, 1813 bp, Secale cereale
ggagggagggagggtgagatggggtcgaggaccaagggctgctgcgggtggctgatcgtggcgctggtgctggcgctggtggccacggcggccgtggtggccatcatgaagcgcaagcccgggggagcggaggggccggagccgcccgcccaagccgctccccgtccgggcccgcccggggacatcgactccaagtacggcgacgcgctcggggtcgccctccagttcttccaggtccagaaggccgggaagttggtggacaaccagatcccgtggcggggggactctgcgctggacgacgggaaggaggcgaagctggatctctccaaggggctgtacgacgccggggatcatatgaagttcaccttccccatggccttcacggccacggtgctcgcgtggtccgtgctcgagtacggggaccagatgaccgccgccaagcagctagacccagcgctcgacgcgctccggtggaccacggatttcctcatcgcggctcatccttctgacaacgtgttctacattcaggttggtgatcctgatcttgatcacgactgctggcaaaggccagaaacaatgactgagaaaaggccgctcacacagattaacgcaaagaaccctgggtcagatatcgctgctgaggcagcagcagccatggcggcagcatcaatggttttcaaatccagtgacaccacatattctgattcacttcttcaacatgcccagaagttatttacttttgctgatacttataaaggcatcgccagcgacgcctatccaaagcttcagaagtactataattctactggttatgttgatgagctcctctgggcagcgagttggctctatcatgctacaggagaccagacatatctcagttatgtgactgtgcagaacgggaaagattacgctgattggggaaggccaacatggttcagctgggatgacaagctcccagggacgcagatccttttgtcaagagtaaatttctttggatccaaagagatctctaatgctgaaaacagtgggctcaaaatgtacagagacactgctgaggctgttatttgtgggcttctaccagattctccatcagccactggtagtaggactagcggagggctggtgtggataagtgggtggaattctctgcagcatggcataaacgcggcattccttgctgttgtttacagcgactacatgctgacatcacaaacggccgcagtggagtgcagtggaaaatattttagtccgacagatattcgcaatttcgctatatcacaggcaaattacgtgctgggtgacaacccaatgaagcttagctacctggtgggctacgggagcagctatccacagcaggtgcaccacaggggtgcatccatccccgcggacgcgaaaacgggctgcaagggattcgagtacctccattcagccagcccgaacccgaatgtagccacgggagccgttgtgggcgggccatttcagaatgactctttcgtggacttgcgcgacaatgccgtgcagacagagtccagcacttacaacagcggcacattcgtcggtctgctggctggcctggtcaccacctcgtccatcgcaaagacattcacctagagctctctctcaagcaacgacaatggtgggttttatcaacccgggaagcatatacaattagaggattttcttttatcagagtgacggtaataatgcgcaatccagtgagacctgttgcagatttgttcattggccgtctcttattaggtgggtgattagcagtagtcgttagtgtcatactacccttgcttgtatcatagta

SEQ ID NO: 3302 - DNA, 2052 bp, Panicum virgatum
ggccacggcggcgatgttcgccatcatgaagcgcaagcccggggggaaggggcaccacaagaagccgctccccgtgccggggccgccgggggccatcgactccaagtacggcgacgcgctcggggtcgcgctccagttcttccaggtccagaagtcggggaagctggagaacaaccagatcccgtggcggggggactcggcacttactgatgggaaggaagcggggctggatctttccaagggaatgtatgatgctggggatcatataaagttcaccttcccaatggcattcactgcgactgtgcttgcctggtcggttctggagtatggggatcagatgagcgcggcgaagcaactggacccagcactcgatgcactcaagtggattacagatttccttatcgctgcacatccgtctgacaatgtgttatatattcaggttggtgatcctgatctggaccacaattgctgggaaaggccggaaacaatgactgagaaaagaccactcacacagattaacaagaagtctcctggatcagatgttgctgctgaggcagcagctgctatggcagcagcttcaatggtcttcaaatccagtgatactacgtattctgatgtgcttcttcaacatgcccagaagctatttacttttgctgatacttatagaggcctctcaagtgaaacctatccaaagctccaagacttctataattccactggttatgttgatgaacttctatgggcagcaagttggctctatcattccacaggagaccagacatatctcagttatgtaactgtgcagaatggaaaaacttatgctgagtggggaaggccaacatggttcagttgggatgacaaaaatccaggcacacaggtccttctgtctagattaaatttctttggctccaaacagatatctaatgctgaaaatgaggggttaaaatcgtatagagatactgcagaagctgtcatttgtggtctgattccagattccccgcaagccactgctagcagaactggaggagggttgatctggataagcgggtggaattctctccagcatgccacgaattctgcatttctagctcttgtttacagcgactacatgctctcaacacggacagcggaagtgcagtgcagtggaaagtactacagccctactgatatacgcaattttgctgcatcacaggctaattacatcttgggagacaaccctatgaagcttagctaccttgttggatatgggagcaactatccacagcaagtacaccacagaggagcgtcaatccccgcagatgcaaaaacaggctgcaaaggatttcagtacctccattcacccaatccaaacccaaatgttgcaatgggcgccctggtaggtggtccattccagaatgacactttcgtcgactctcgggataatgctgtacagacagagtccagcacttacaacagtggcactcttgtcggtctgctttccggtctggtcaccacttcctctgtagcacagtcattcacctagactcttagaggcctctcatatatatgttttggcaatggctttgatcgacatggatgtatgcatgtaaaattgcagttttttggcgaggccgatggtaattcacgattagtgacagaagcttgtctgccgttgtttagatggatggttagcacttagcagtagtagttagtgccacatttcttctgtttgtataattgatggtactgctcctgcagtttttttgctgtgtgctcctatctggtttgctggtgtacctctaaggttgttactacaagtaatgtatttctaggacagatttcatttgtttattcggtggtgaggtggttcttcaaggtttgtactatgaatggttgtaaactcctctgcactctcaactgaaatgtgcgttgagcatgtgaattcacagttgtagatgaagggcacctgttcgtgctgtttttacagcttgatcactttattctaataaactcttgtacataaaataggggaagaagcatgtgtggcaatggcctgccaatgcatgattgcta

SEQ ID NO: 3303 - DNA, 1868 bp, Echinochloa colona
ccgccacctcaagccgctccccgtgccggggccgccgggggccatcgactccaagtacggcgacgcgctcggggtcgtgctccagttcttccaggtccagaagtcggggaagctggagaacaaccagatcccgtggcggggggactcagcgctgactgatgggaaggaagcagggctcgatctttccaagggaatgtatgatgctggggatcatataaagttcaccttcccgatggcgttcactgctactgtgcttgcctggtcggttctggagtacggggatcagatgagcgccgcgaagcagctggaccctgcactcgatgcgcttaagtggattacagattttcttgtcgctgcacatccttctgacaatgtgttatatattcaggttggcgatcctgatctggaccacaattgctgggaaaggccggaaacaatgactgagaaaagaccactcacccagattaacaagaagtctcctggatcagatgttgctgctgaggcagcagctgcgatggcagcagcttcaatggtcttcaaatccagtgatactgcgtattctgatgtgcttcttcaacatgcccagaagctatttacttttgctgatatttacagaggcctctcgagtgacagctatccgaagctccaagacttctataattccactggttatgttgatgaacttctatgggcagcaagttggctctatcatgccacaggagaccagacatatctcagttatgtaactgtacagtatggaaaagcttatgctgattggggaagaccaacatggttcagttgggatgacaaaaatccaggcacacaggtccttctgtctagactaaacttctttggctccaaacagatatctaatgctgaaaatgagggcttaaaatcgtatagagatactgcagaatctgtcatttgtggtctgattccagattccccgcaagccactgctagtagaactggaggagggttgatctggataagtgggtggaattctctgcagcatgccacgaatgctgcatttctatctattgtttacagcgactacatgttctcgacacggacagcagcagtgcagtgcagtggaaagtactacagccctactgatatacgcaattttgctgcatcacaggctaactacatcttgggagacaatccgatgaagcttagctaccttgttggttatgggagcagctatccacagcaagtacaccacagaggagcgtctatccccgcagacgcgaaaacaggctgcaaaggatttgagtatctccattcacccaatccaaacccaaatgttgcaatgggcgccctggtgggtgggccattccagaatgacacttttgtcgactctcgggataatgctgtacagacagaatctagcacttacaacagtggcactcttgtcggtctgctttccggtctggtcaccacttcttccgtggcacagtcattcacctagatgcctcacatatatatgtttcggtgatggctttgatcaacatggagggatgcatgccctaatcgcagttctttttggtgaagccgatggtaattcgtgatcaatgacagaagcttgctttgccatcggttagatggatggttagcacttagcagttggtagttagcgacactttttttctgtttgtataattgatggtactgctcgtgcagctataatttttcaatgtgtgctcctatctggtttgctgtagctacgagtaatgtattttaggacagatttcatttgttgattatgtggtgaggtggttcttcaaggcttgtacaatgaattgctgtaactgctctcaactcaaatactcgttgagcatgtgaattcacagttggagatgaagggt

SEQ ID NO: 3304 - DNA, 1902 bp, Triticum aestivum
cccgcccggggacatcgactccaagtacggcgacgcgctcggggtcgcgctccagttcttccaggtccagaaggcggggaagctggtcgacaaccagatcccgtggcgaggcgactctgcgctcaacgatgggaaagaagccaagctggatctctccaaggggctgtacgacgccggggatcatatgaagttcaccttccccatggccttcacggccacggtgctcgcgtggtccgtgctcgagtacggggatcagatgaccgccgccaagcagctagacccagcgcttgacgcgctccggtgggtcacggatttcctcatcgcggctcatcctactgacaacgtgttctacattcaggttggtgatcctgatctagatcacgactgctggcaaaggccagaaacaatgaccgagaaaaggccgctcacacagattaacccaaagaaccctgggtcagatatcgctgctgaggcagcagcagccatggcggcagcatcaatggttttcaaatccagtgatactacatattctgattcacttcttcaacatgcccagaagttatttacttttgctgatacttataaaggcatcgccagcgacacctatccaaatcttcagaagtactataattctactggctatgtcgatgagctcctctgggcagcgagttggctctatcatgctacaggagatcagacatatctcagttatgtgactgtgcagaacgggaaagattatgctgattggggaaggccaacatggttcagctgggatgacaagctcccagggacacagatccttttgtcaagagtaaatttctttggatccaaagagatatctaatgctgaaaacagtggactcaaaatgtacagagacactgctgaggcagtcatttgtgggcttctaccagattctccgtcagccactggtagtaggactagcggaggactggtgtggataagtgggtggaattctctgcagcatggcataaatgcagcattccttgctgttgtttacagcgactacatgctgacatcacaaacagctgcggtggagtgcagtggaaagtattttagtccgacagatattcgcaatttcgctatatcacaggcaaattacgtgctgggtgacaacccaatgaagcttagctacctggtgggatatgggagcagctacccgcagcaggtgcaccacaggggggcatccatccccgcggatgcgaaaacgggctgcaagggattcgagtacctccattcgtccagcccgaacccgaatgtcgccacgggagccgttgtgggcgggccatttcagaatgactctttcgtggacttgcgcgacaatgcggtgcagacagagtccagcacttacaacagcggcaccttcgtcggtctgctcgcgggcctggtgaccacctcgtccatcgccaagacattcacctagagctctttctcaagcaacgacaatggtggctttcatcaacccgggaagcatatacaactagaggaattttactttttgctcgagtgacggtgaatgcgcaacccggtgagacctgttgcagatttgttcattggccgtctaatattaggtgggtaattagcagtagtcattagtgccacattactcttgcttgtataatacagtatatggtgattgtcaccgtgtggtcaaactcctatctggtttgctggtgtaccgtacctgttgtagctatgggtattgtatttgtagggcagatttcatttgttcattctcaggtggtttttggtagctgcgatgattggtctgtgtaatggcttgccagtggaacatgaacatgcatacattcactttgtatgcgcaattcttttacagtagtacaatatgttccatgcacacagggaacacctgtcgagtgtgca

SEQ ID NO: 3305 - DNA, 2374 bp, Zea mays
cagcaaccaagtacagcagacatccgtcctatcccactcctagtcccaccgccaccttccctcccaccgccaccattcgggccgccctctctcccagtcggccagtcccagcaaatcccacttcaccaggcctcagctccagctcgcctatcccggtatcccccctcaccagcgccgccggaagatcgcgctgcgcccgtcgtctcacgaggaggcatcgaccggcgcggtggcatttaggaggaggaaggggaggctgtaccttgttgacagggtcttagttaggcggggaggggcgagatgagcatgtacgggagggacccctggggcgggccgctggagatatgccacgactcggccacggacgacgaccgcagccggaacctggacatcgaccggggcgcgctgtcgcggacgctcgacgagacgcagcagagctggctgctggcggggcccggggacccgggccgcaagaagaagaagtacgtcgacatcggttgcctcgtcgtcagccgcaagctcttcgtctggacgctcggggtgctcctcgccgccgccgtattcgcgggggtcgtggccgggatcgccaaggccatccccaggcgccaccgcccgccgccgccgcccgacgactacaccgtcgcgctgcacaaggcgctcatgttcttcaatgcccagagatccgggaagcttccgaagcacaacaatataccatggcgtggtaactcttgcatgaaggacggactttctgatcctgcagttcggcgaagcctggtcggcgggtactatgatgctggcgacgctgtcaaattcaatttcccagctgccttctccatgaccctcctcagctggagcgtcattgagtacagtgctaagtacgatgctgctggggaacttggccatgtccgtgacattatcaagtggggttcagattacttcttgaagacctttaattccacagccgatagcattgatcgtgtcgttgcacaggtgggaagtactgcaacatcgcccggttcaacgcagcccaatgatcgttattgttggatgaggccagaggacattgactacccacgtccagtggttgagtgccacgcttgttcagatcttgctgcagaaatggctgcagcattagctgcagcgtcgattgtattcaaggacaataaggcttactcacagaagcttgtacatggtgcaaccactcttttccagtttgcaagggaacgacgtgggaggtatagtgcaggtggctcagatgctgcaaaattctacaattcaaccagttactgggatgagtttgtgtggggtagttcatggatgtaccttgcaactggcaattcgtcatacttgactctagccacacaccctaaacttgcaaagcatgctggcgctttctggggtggaccagattatggtgtgttcagctgggataataagctcactggggcacaggttcttctaagccggttgaggcttttcttgagtcctggatatccatatgaagagaccttgagtacattccacaaccaaactagcattatcatgtgttcctaccttccaatatttaaatctttcaacagaacaagaggtggtttgattcagttaaatcatgggaagccacagccccttcagtatgtggtcaacgctgcattccttgcttctgtgttcagtgactatcttgaggctgcggatactcctgggtggtattgtggcccacatttctactctatcgaggttctccgcagttttgcaaggactcagatcgagtacatcttagggaaaaatccattgaagatgagctatgtggttgggttcggaaaccattaccccaagcatgttcaccaccggggcgcctcaatccctaagaacggtgttcactatggatgcaaaggagggtggaagtggagggacaccaagaagccaaaccccaatatcatagtaggggccatggttgctggccccgatcgccatgacgggttcaaagatgtccgcaagaattataactacactgaagcaacgctggcgggcaatgctggtctagtcgcagcgttggtagctttgtcgggtgaaggccatggggtggacaagaacaccatgttctctgcagtgccacccatgttcccttcgcctccgccgccaccagccccatggaaaccgtaatgcctgtgggtgtctgattcttctgtatactgcgtatttagattagtgctcctctcgctataactagttaactactaccatcactatcttgcatatttaacaagatgtagcatcgatttttcttgtttctttcattgttgtgtatttgccgtgcaatgtaaggattgattatgtttgtgtatgcatctctgttctttttagataatggagaaaa

SEQ ID NO: 3306 - DNA, 2358 bp, Setaria italica
tccaaacgcgctccgttgcccaacccgccggcagccaaagtacagcaggcatgcgtccctacccctgatatcccacccccaccaccactccggccgcctctcccccagcaaaccccagtatcccactgccccatagcccacagctcttccccagttccctttccatccatcgcccttgcgtcgccggaagaacgccggaaaatcgccccgcggccgccgtgccagaggcgtcaatcggcgcggcggcatttgttgctagctagtaggcggggaggggggcaggatgagcatgtacgggagggacccgtggggcgggccgctggagatatgccccgactcggccacggacgacgaccgcagccggaacctggacatcgaccggggcgcgctgtcgcggacgctcgacgagacgcagcagagctggctgctggcggggcccggggaccagggccgcaaaaagaagaagtacgtcgacatcggctgcctcgtcgtcagccgcaagctcttcgtctggacgctcggggtgctcctcgccgccgccgtcttcgcgggggtcgtggcggggatcgccaaggccatcccaaggaggcaccgcccgccgccgccgccagacgactacaccgtcgcgctgcacaaggcgctcatgttcttcaacgcgcagagatctggcaagcttccgaagcacaacaatgtaccttggcgtggtaactcttgcatgaaggatgggctctcggacccggcagtacggagaagcctggtcggcgggtactacgacgctggcaatgccgtcaagttcaacttcccagctgccttctccatgaccctcctcagctggagtgtcattgagtacagtgctaagtacgaggctgttggagaacttggccatgtccgtgacattatcaagtggggagcagactacttcttgaagacctttaactccacagccaatagcattgatcgtgtcattgcgcaggtgggaagtgctgcaacgtcacctggttctacacagcccaatgatcattattgttggatgaggccagaggacatcgactacccacgtccagtggtcgagtgccacgcttgttcggatcttgctgctgaaatggctgcagcattagctgcagcttctattgtattcagggacaataaggcttactcacagaagcttgtacatggtgctaccactctcttccaatttgcacgggatcggcgtggcaggtatagtgcaggtggttcagatgctgcaaagttctacaattcaaccagctactgggatgagtttgtgtggggtagttcatggatgtaccttgcgactggcaattcgtcatacttgactctggccacacaccccaagcttgcaaagcatgctggtgctttctggggtggtccggattatggtgtgttcagctgggataataagctcactggtgcacaggttcttctaagccggttaaggcttttcttgagccctggatatccgtatgaagagatgttgaggacattccacaaccaaactagcattatcatgtgttcctaccttcccatctttaagtctttcaacagaacaaaaggtggtttgattcagttaaatcacgggaagccacagcctcttcaatatgtggccaacgctgcattccttgcttctgtgttcagtgactatcttgaggctgcagatacccctgggtggtattgcggcccccatttctactctattgaggttcttcgcggttttgcaaggactcagattgagtacatcttaggaaagaatcctttgaagatgagctatgtggtagggttcggaaaacattaccccaagcatgttcaccaccggggtgcttcgatccccaaaaacggtgttcactatggctgcaaaggagggtggaagtggagggacaccaagaagccaaaccccaacatcatagttggagctatggtcgctggccccgatcgccatgatggattcaaagatgcccgcaagaactacaactacactgaagcaacgctggcgggcaatgctggtctagtcgcagcattggtagctttgtccggtgaaagccatggggtggacaagaacacgatgttctctgcagtgccgcccatgttcccatcacctccaccgccatcagcaccatggaaaccataatggctgcgagtatctgattcttttgtatactacgtattttagactagagttttctttgttgtaacactactgtggagatctaacaagtgaagatgtagccattgccttgttttggtttctttttcagtgttgtataatcgccgtgctgtgtgctatggactaagttgtgtatgaatctctatgttctactaattcagtgacagattccaaggcaa

SEQ ID NO: 3307 - DNA, 2600 bp, Sorghum bicolor
aaacaggtgagcacaaaacacgcgtgaatcgtcccggacgaggaagaccgggcgtctcacggcagcaagaaaacaaaaggttatcccgtaagcaaaggctagcatccatcgccatccccacacccaacaccacactactagtttcaaaaaaaaaaaaaaaacaccacactactccaaaatctctccgttaacaaacaagccggcagccaagtacagcagacatgcgtccccatccgtgattctccgtctcaccactagaacgtactcaaccctcctccccaccgccacagttccggccgcctctctcccagcaaatcccacttcccccagcccacagctccagctcgcttctggtctctccctcttaccctcccccgcgccgcccggacgccgtctcgcgaggaggcatcgaccggcgcgcgcggtggcatttaggaggagggaagccaggaaggggaggttgtagctggttgacagggttttttagctaggcggcggggaggggcgagatgagcatgtacgggagggacccgtggggcgggccgctggagatatgccacccggactcggccacggacgacgaccgcagccggaacctggacatcgaccggggcgcgatgtcgcggacgctcgacgagacgcagcagagctggctgctggcggggcccggggaccaggcccgcaagaagaagaagtacgtcgacatcggctgcctcgtcgtcagccgcaagctcttcgtctggacgctcggggtgctcctcgccgctgccgtcttcgcgggggtcgtcgccgggatcgccaaggccatccccaggcgccaccgcccgccgccgccacccgacgactacaccgtcgcgctgcacaaggcgctcatgttcttcaatgcccagagatctgggaagcttccgaagcacaacaatataccatggcgaggtaactcttgcatgaaggacggactttctgaccctgcagtcaggcgaagcctggtcggcgggtattatgatgctggcggcgctgtcaagttcaatttcccagctgccttctcaatgaccctcctcagctggagtgttattgagtacagtgctaagtacgatgctgttggggaacttggccatgtccgtgacattatcaagtgggggtcagactacttcttgaagacctttaattccacagccgatagcattgatcgtgtcattgcacaggtgggaagtgctgcaatgtcacctggttcgacgcagcccaatgatcaatattgttggatgagaccagaggacatcgactacccacggccagtggttgagtgccacgcttgttcagatcttgctgctgaaatggctgcagcattagctgcagcatctattgtattcaaggacaataaggcttactcacagaagcttgtacatggtgctaccactctcttccagtttgcaagggagcggcgtgggaggtatagtgcaggtggctcagatgctacaaagttctacaattcaaccagttactgggatgagtttgtgtggggtagttcatggatgtaccttgcaactggcaattcatcatacttgactctagccacacaccctaaacttgcaaagcatgctggcgctttctggggtggaccagattatggtgtgttcagctgggataataagctcactggtgcacaggttcttctaagccggttgaggcttttcttgagtcctggatatccatatgaagagatgttgagggcattccacaaccaaactagcattatcatgtgttcctaccttccaatctttaaatctttcaacagaacaagaggtggtttgattcagttaaatcacgggaagccacaaccccttcagtatgtggtcaatgctgcattccttgcttctgtgttcagtgattatcttgaggctgcggatactcctgggtggtactgtggcccccatttctactctattgaggttcttcgcagttttgcaaggactcagattgaatacatcttaggaaagaatcctttgaagatgagctatgtggttgggtttggaaaccattaccccaagcatgttcaccaccggggcgcctcaatccctaagaatggtgttcactatggttgcaaaggagggtggaagtggagggacaccaagaagccaaaccctaatatcatagtaggggccatggttgctggccctgatcgccatgacaggttcaaagatgcccgcaagaattataactacactgaagcaacactggtaggcaatgctggtctagtcgcagcattggtagctttgtctggtgaaggccacggggtggacaagaatgctatgttctctgcagtaccgcccatgttcccttcccctccgccgccaccggccccatggaaaccataatggctgtgggtatcagattcttttgtatactgcgtatttagattagtgttgctctcgccttactagtaccatcactatcgtggagttctgacaagatgtagcctcgatcttttcttgtttctttcattgttgtatatttgccgtacaatgtaaggactaattcattgtgtatgaatctcggttctaattaagtatcagattccctgaggatttgtggtaactaagccc

SEQ ID NO: 3308 - DNA, 2410 bp, Panicum virgatum
ccatccctgatatcccacccccaccactccagccgcctctcgcccagcgaatcccactctccagtctccactctccacccagcccgcagctccagcctccagctcgcgttcccctccctccctcaccccgcgtcgccggacgaacgccggggcatcgccctgcggccgccgtgccagaggcgtcgatcggcgcggcgggcattgggtgggagagggtgttcgttgtcgtctaggcggggagggggcaggatgagcatgtacgggagggacccgtggggcgggccgctggagatatgccacgactcggccacggacgacgaccgcagccggaacctggacatcgaccgcggcgcgctgtcgcggacgctcgacgagacgcagcagagctggctgctggcggggcccggggaccagggccgcaggaggaagaagtacctcgacatcggctgcctcgtcgtcagccgcaagttcttcgtctggacgctcggggtgctcctcgccgccgccgtcttcgcgggggtcgtggccgggatcgccaaggccatacccaggcgccaccgcccgccgccgccgcccgacgactacaccgtcgcgctgcacaaggcgctcatgttcttcaacgcccagagatctggcaagcttccgaagcacaacaatgtaccatggcgtggcaactcttgcatgaaggacggactctctgacccggcagtccggcgaagcctagtcggcgggtactatgacgctggtgacgccgtcaagctcaacttcccagctgcattctccatgaccctcctcagctggagtgtcattgagtacagtgctaagtacgaggctgttggggaacttgaccatgtccgtgacattatcaagtggggagcagactacttcttgaagacatttaactccacagcggatagcattgatcgtgtcgttgtgcaggtgggaagtgctgcaacgtcgcctggttctacacagcccaatgatcactattgttggatgaggccagaggacattgactacccacgtccagtggttgagtgccacgcttgttcggatcttgctgctgaaatggctgcagcattagctgcagcttctattgttttcaaggacaataaggcttactcacagaaacttgtacatggtgctgccactctcttccaatttgcaagggatcggcgtgggaggtatagtgcaggcagttcagatgctgcaaagttatacaattcaaccggttactgggatgagtttgtgtggggtagttcatggatgtaccttgcgactggcaattcgtcatacttgactctagccacaaatcccaagcttgcgaagcatgctggtgctttctggggtggtccggattatggtgtgttcagttgggataataaactcgcaggtgcacaggttcttctaagccggttgaggcttttcttgagtcctggatatccgtatgaagagatgctgaggacattccacaaccaaactagcattatcatgtgttcctatcttcccatcttcaagtctttcaacagaacaaaaggtggtttgattcagttaaatcacgggaagccacgatcccttcaatatgtggtcaacgctgcattccttgcttctgtgttcagtgactatcttgaggctgcggatacccctggatggtattgcggcccccatttctactctattgaggttcttcgcagctttgcaaggacgcagattgagtacatcctgggaaagaatcctttgaagatgagctatgtggttgggtttggaaagcattaccccaagcatgttcaccaccgcggtgcgtcgatccccaagaacggtgttcactatggctgcaaaggagggtggaagtggagggacaccaagaagccaaaccctaacatcatagttggagccatggttgctggcccggatcgccatgatggattcaaagatgcccgcaagaactccaactacactgaagcaacgctggcgggcaatgctggtctagtcgcagcattggtagctctgtcaggtgaaggccatggggtggacaagaacacgatgttctctgccgtgccacccatgttcccttcgcctccaccaccaccggcgccatggaaaccatagtgcgtgcgagtatctgattcttttgtatgctacgtattttagattagttttttcttatatcctgccgcaataccgctgtggagttctaacaagtgaagatgtagcatcgccatttggtctctttttcagtgttgtataatcgccgtgctgtgtatggactaagttgtgtatgaatctgtacgttctaatttagtaatatactccctccatccaaatagatatattttcatatggcataatgaccaagggcatcaagtgtgcttataaatctcataaatgcaatatatatcttttattggtc

SEQ ID NO: 3309 - DNA, 2230 bp, Zea mays
actactccggccgcctctcttccagcaaatccctcccacctcctccccgccgtctcacgaggagctagaggaaggggaggctctgtaccagcctgttggaagggggcgagatgagcatgtacgggagggatccctggggcggcccgctggagatatgccacgactcggccacggacgacgaccgcagccgcaacctggacatcgaccgggccgcgctgtcgcggacgctcgacgagacgcagcagagctggctgctggcggggaccgccgaccagccccgcaagaagaacaagtacgtcgacatcggctgcctcctcgtcagccgcaagctcttcgtctggacgctcggcgtgctcctcgccgccgccgtgttcgcgggggccgtggccgggatcgccaaggccatccccaggcggcaccgcccgctgccaccgcccgacgactacaccgtcgcgctgcacaaggcgctcatgttcttccatgcccagagatctgggaagcttccgaagcacaacaatatacattggcgcggtaactcttgcatgaaggacgggctttctgaccctgcagtcaggcgaagcctggttggcgggtattatgacgccggcgacgccgtcaagttcaatttccctgctgccttctccatgaccctcctcagctggagcgtcattgagtacagtgccaagtacgacgctgttggggaacttggccatgtccgtgacattatcaagtgggggtcagactacttcttgaagacctttaattccacagccgatagcattgatcgtgtcattgcgcaggtgggaggtggtgcgacgtcgcctggttcgacacagcccaatgatcggtattgttggatgaggccagaggacattgactacccacgtccagtggttgagtgccacgcttgttcagatcttgctgctgaaatggctgcagcattagctgcagcgtcgattgtattcaaggacaacaaggcttactcacagaagcttgtacatggtgctaccactctcttccagttcgcaagggaccggcgtgggaggtatagcgcaggtggatcgtatgctgcaaagttctacaattcaactagttactgggatgagtttctgtggggtagctcatggatgtaccttgcaactggcaattcatcatacttgactctagccacaaaccctaaacttgcgaagcatgctggcgctttctggggtggaccggattatggtgtgttcagctgggataataagctcactggtgcacaggttcttctaagtcggttgaggcttttcttaagtcctggatatccatacgaagagatcttgaggacgttccacaatcaaactagcattatcatgtgttcctaccttccagtctttaaatccttcaacagaacaagaggtggtctgatccagctaaatcacgggaaaccacggcccctccagtatgtggtgaacgctgcattccttgcttctgtgttcagtgactatcttgaggctgcggatactcctgggtggtattgtggcccccatttctactctgttgaggttcttcgcagttttgcaaggactcagatcgattacatcttaggaaagaatcctttgaagatgagctacgtggttgggttcggaaagcgttaccccaggcatgttcaccaccggggcgcctcgatccctaagaacggtgttcactatggctgcaaaggagggtggaagtggagggacgccaagaagccaaaccctaataccatagcaggtgccatggttgctggccccgaccgccatgacgggttcaaagatgcccgcaggaactacaactacactgaagcaacgctggcgggcaacgctggtctagtcgccgcattggtagctttgtcgggtgaaggccacggcggggtggacaagaacaccatgttctctgcagtaccgcccatgttcccttcgcctccgccgccgccggctccatggaaaccgtgacggcctgtgggggtatggtatggtatggtatctgattcttttgtatactgctttatttatttagattagtgttccctctcgccgtactgctaccatcacaatcatggagatctaacagtatgtagctccggtcttttttttcattgtttttatattttgccgtgcaatgtaaaggactagtactacgttttgcatggatctcggggtcagtaactgatttcctggggatttgtggtaactaaagcccatctctgtgc

SEQ ID NO: 3310 - DNA, 2484 bp, Brachypodium distachyon
ccgcacgccaaaagccccctctcctattctccttcgtctcttccattccaagaaccctcgaggcggcgccgcgcctttgccattgcaggattctctatagattttgagattggagtgcagtaggggatttgtgggaggggagcggtgggatcaggtgggtcgccgggggaggggcggcggggcgagatgagcatgtacgggagggacccgtggggcgggccgctggagatatgccacgactcggcgacggacgacgaccggagccggaacctggacctggacaggggcgcgctctcgcggacgctcgacgagacgcagcagagctggctgctggcggggcccggggaccaggcgcgcaagaagaagtacgtcgacctcgggtgcctcgtcgtcagccgcaagctcttcgtctggacggtaggggtgctcgtcgccgccgcggcgtttgcggggattgtggccggaatcgcccaggccatccccaagcaccacccccagccgccgccgccagacgagtacaccgtcgcgctgcgcaaggcgctcatgttcttcaatgcccagaaatccggtaaactgccgaagcacaacaatgtaccatggcgtggcgactcgtgtttgaaggatgggagctcggaccaagcattccggcgagatctctctggtgggtattatgatggcggcgaagctacaaagtacaactttccagctgccttctccatgaccctcctcagctggagcgtcattgagtacagtgctaagtacgaggctgctggggaacttggccatgtccgtgacaccattaagtggggggccgactacttacttaagaccttcaactccacggctgataccatagatcgcttggttgcacaggtgggtagtggtgcagtttcacccgggtcgactcaacccaatgaccgttattgttggatgaggccagaagacattgactacccacgcccagtggtcgaatgccgtgcttgccctgatcttgctgctgagatggctgcagcattggctgctgcatccattgtattcaaggataataaggcttactcacacaaactggtacatggtgctaccaccctctggaaatttgcaagggatagaggtaaacgcgggatgtataatgcaggcatttcagacgctacaaagttctacaattcaaccaactactttgatgaaatcgtgtggggtggttcatggatgtaccttgcgactgggaatacatcataccttgagctcgcaacgaatcccacgcttgcaaagaatgctggcgcgtacaagcttgatcagcacactggtgtcttcagctgggaaaataagctccctggtgcacaggttcttctaagccggttaaggctcttcttgagtcccgggtatccatatgaagagatgttgaggacgttccacaatcaaacttgcattatgatgtgctcttaccttccagtttttaaatctttcaatagaacaaagggtggtttgatacaattgaatcatgggaatcccaaacctctccagtatgtggtaaatgctgcattccttgcttctgtgttcagtgactatcttgatgctgcagatacacctgggtggtattgcggcccccatttctactcggttgaggtccttcgaagttttgcaagaactcagatcgagtacatcttaggcaaaaatcctttgaagatgagctatgtggttgggtatggaaaccattaccccaagcatgttcatcaccgtggtgcgtcgatcccaaagaagaaaggcgttcattatggctgcaaagaagggtggaagtggagggactccaagaagcccaaccctcacatcgttgttggagctatggttgccggcccagatcgccatgaccgcttcaaagatgtccgcaagaactacaactacacagaagcaaccctagcaggcaatgccggtctggttacagcattggtagcgctgtcaggtgaagctcacgggttggacaagaacactatgttctctgctgttcctccgatgttcccttcgcccccgccacctccagcaccatggaaaccatgattgctgcgagtatctagttagaccagtattctagctcttcctttcttggatactgttgtgttaatctagcggtgaagaagaccacatgccgtttactattttcatttttttagtgtagtatatttgtgtagtataatcaccgtgctatattgctataggagaccatctatgttgggagtgtccatttctcaatcgcctaagaaatagttatttctcagtcaacaatcgtagccatttaagcaagattttcttatccatcggacctacattaattttatacgaatcaatgattaaatcaaatgttgttatcattgactattagttatttctcattcgcctaagaaatagcaaaatcgatctatgtttgctgtagaaggaccatttatggcctaaattcgtacaccctctgtccaaattattgagacgtcttgg

SEQ ID NO: 3311 - DNA, 2191 bp, Hordeum vulgare
cattccaaggcggcggcggcattgcaggaaccgctcgctcacaggcgtttcgaggtggtgggggatctgtgggatcgggtgggccgagatgagcatgtacgggagggacccgtggggcggcccgctcgagatatgccacgactcggccacggacgacgaccggagccggaacctcgacctcgaccgggcggcgctctcgcggacgctcgacgagacgcagcagagctggctgctcgcggggcccggggaccagggccgcaagaagaagcgctacgtcgacctcggatgcctcctcgtcagccgcaagctcttcctctggacgctcggcttgctcctcgccgccgccgccctcgcggggatcgccgcggggatagccaaggccgtccccaggcaccacgccccgcccacgccgccggaccaattcaccctcgcgctgcgcaaggcgctcatgttcttcaatgcccagaaatccgggaagctaccgaagcacaacaatgtaccatggcgcggtgactcgtgcctcaaggacggacgctcggacgaagcattccggcgagacctctcgggtggctactatgacggcgggggcgctgtgaaattcaacttcccatctgccttctccatgaccctcctcagctggagcgtcatcgagtacagtactaagtacgaggctgctggggaacttggccatgtccgtgacacaattaagtggggggccgactacttattgaagaccttcaactccacggcacattctattgatcgcttggttgcgcaggtgggtagtgctgcaatatcacctggttcgagtcagcccaatgatcattattgttggatgaggccagaggacatcgactacccacgtccagtcaccgagtgccacacttgccctgatcttggtgctgagatggctgcagcattggccgcagcatccattgtgttcaaggataatagggcttactcccacaagctgttacatggtgctaccaccgtctgggagtttgcaaggaagggaggtagtcgttcagcatatagtgcactcaggtcagatgctgcaaagttctacaattcaaccggttactgggatgaatatatgtggggtggttcgtggatgtacctcgcaactggcaattcatcgtacctgcagttcgcaacgagtgtcgagcttgcaaagaatgttcatgttttctctcgccccccgaactatggggtgttcagctgggataataagctccctggtgcacaggttcttctgagccggttaaggctcttcttgagtcctgggtatccatatgaagagatgttaaggacataccacaatcaaaccagcaccatcatgtgctcttaccttccagattttagatcttttaacagaacaaaaggtggtttgatacagttgaatcacgggcagccacaaccgctccagtatgtagtcaatgctgcattccttgcttctctgttcagtgactatcttgaggctgcagatacccctgggtggtattgtgggccccatttctactccatcgaggttcttcgcagttttgcaaggactcagatggagtacatcttgggcaaaaatcctttgaagatgagttatgtggtcgggcacggaaagcattaccccaagcgtgttcatcaccgtggtgcgtcgatcccgaagaagaaaggtattcaccctggctgcaaaggggggtggacgtggagggacaccaagaagcccaaccctcacatcattgttggagctatggtggctggccctgatcgccatgacgggttcaaagacatccgaaagaaccgcaactacacagaaccaaccctagcgggcaatgctggtctagttgctgcgttggtagctttatcgggtgaaggccatggcgtggacaagaacaccatgttctctgctgtgccgccaatgttcccttcgcccccgccgcctccagcaccatggaagccataatggctgggtgattggaccagtggagatgacggtgtaaccgtttttttagcgtagtatcatcaccatgccatgttgtttgcgatgcaaggactatgctgaacgaaatgtataatggcctaagttagtactagtagtttccctcgtgtacctgtgggaagtgggtactttgtagacataaaaaaattggcatcatatcacaaagtaaatttgcccaaggcaagttcagttttaaaa

SEQ ID NO: 3312 - DNA, 2107 bp, Hordeum vulgare
atgagcatgtacgggagggacccgtggggcggcccgctcgagatatgccacgactcggccacggacgacgaccggagccggaacctcgacctcgaccgggcggcgctctcgcggacgctcgacgagacgcagcagagctggctgctcgcggggcccggggaccagggccgcaagaagaagcgctacgtcgacctcggatgcctcctcgtcagccgcaagctcttcctctggacgctcggcttgctcctcgccgccgccgccctcgcggggatcgccgcggggatagccaaggccgtccccaggcaccacgccccgcccacgccgccggaccaattcaccctcgcgctgcgcaaggcgctcatgttcttcaatgcccagaaatccgggaagctaccgaagcacaacaatgtaccatggcgcggtgactcgtgcctcaaggacggacgctcggacgaagcattccggcgagacctctcgggtggctactatgacggcgggggcgctgtgaaattcaacttcccatctgccttctccatgaccctcctcagctggagcgtcatcgagtacagtactaagtacgaggctgctggggaacttggccatgtccgtgacacaattaagtggggggccgactacttattgaagaccttcaactccacggcacattctattgatcgcttggttgcgcaggtgggtagtgctgcaatatcacctggttcgagtcagcccaatgatcattattgttggatgaggccagaggacatcgactacccacgtccagtcaccgagtgccacacttgccctgatcttggtgctgagatggctgcagcattggccgcagcatccattgtgttcaaggataatagggcttactcccacaagctgttacatggtgctaccaccgtctgggagtttgcaaggaagggaggtagtcgttcagcatatagtgcactcaggtcagatgctgcaaagttctacaattcaaccggttactgggatgaatatatgtggggtggttcgtggatgtacctcgcaactggcaattcatcgtacctgcagttcgcaacgagtgtcgagcttgcaaagaatgttcatgttttctctcgccccccgaactatggggtgttcagctgggataataagctccctggtgcacaggttcttctgagccggttaaggctcttcttgagtcctgggtatccatatgaagagatgttaaggacataccacaatcaaaccagcaccatcatgtgctcttaccttccagattttagatcttttaacagaacaaaaggtggtttgatacagttgaatcacgggcagccacaaccgctccagtatgtagtcaatgctgcattccttgcttctctgttcagtgactatcttgaggctgcagatacccctgggtggtattgtgggccccatttctactccatcgaggttcttcgcagttttgcaaggactcagatggagtacatcttgggcaaaaatcctttgaagatgagttatgtggtcgggcacggaaagcattaccccaagcgtgttcatcaccgtggtgcgtcgatcccgaagaagaaaggtattcaccctggctgcaaaggggggtggacgtggagggacaccaagaagcccaaccctcacatcattgttggagctatggtggctggccctgatcgccatgacgggttcaaagacatccgaaagaaccgcaactacacagaaccaaccctagcgggcaatgctggtctagttgctgcgttggtagctttatcgggtgaaggccatggcgtggacaagaacaccatgttctctgctgtgccgccaatgttcccttcgcccccgccgcctccagcaccatggaagccataatggctgggtgattggaccagtggagatgacggtgtaaccgtttttttagcgtagtatcatcaccatgccatgttgtttgcgatgcaaggactatgctgaacgaaatgtataatggcctaagttagtactagtagtttccctcgtgtacctgtgggaagtgggtactttgtagacataaaaaaattggcatcatatcacaaagtaaatttgcccaaggcaagttcagttttaaaaccac

SEQ ID NO: 3313 - DNA, 2262 bp, Secale cereale
gactctcatcccccacttcacctccttcccggcgcacgccaaaaaacccacccttgacccttcccttcccattccaaggcggcggcggcgcggcggcggaggcgtgcctgtggcattgcgggagccgctcatagacgttcgaggtggtggtgggatctgcgggatcgggcgggcgggcaggcgggaggcgagatgagcatgtacgggagggacccgtggggcggcccgctcgagatatgccacgactcggccacagacgacgaccggagccggaacctcgacctcgaccgggcggcgctctcgcggactctcgacgagacgcagcagagctggctgctcgcggggcccggcgaccagggccgcaagaagaagaggtacgtcgacctcggatgcctcctcgtcagccgcaagctcttcctctggacgctcggcctgctcctcgccgccgccgcgctcgcggggatcgccgcggggatagccaaggccgttcccaggcaccagaccccgcccacgccgccggaccagttcacactcgcgctgcgtaaggcgctcatgttcttcaatgcccagaaatctgggaagctgccgaagcacaacaatgtaccatggcgcggtgactcgtgcctcaaggacggacgctccggcgaaacagtccggcgagacctctctggtggctactatgatggcggaagcgctatgaaattcaacttcccatctgctttctccatgaccctcctcagctggagcgtcatcgagtacaatgctaagtacgaggctgctggggaacttggccatgtccgtgacacaattaagtggggggccgactacctattgaagaccttcaactccacggcacattcaattgatcgcttggttgcgcaggtgggtagtgctgcaatgtcacccggttcaagtctgcccaatgatcattattgttggatgaggccagaggacatcgactacccacgtccagtcaccgagtgccacacttgccctgatcttggtgctgagatggctgcagcattggccgcagcatccattgttttcaaggataacagggcttactcccacaagctgttacacggtgctaccaccgtctgggactttgcaaggaagggaggtagtcgtacagtatatagcctacccgggtcagatgctgcaaagttctacaattcaaccggttactgggatgaatatatgtggggtggttcgtggatgtacctcgcaactggcaattcatcatacctgcagttcgcaacgagtgccgagcttgcaaatcatgctcacgtttattctcgtcccgcaaactatggggtgttcagctgggataataagctccctggtgcacaggttcttctgagccggttaaggctcttcttgagtcctgggtatccatatgaagagatgttaaggacataccacaatcaaaccagcatcatcatgtgctcttaccttccaaattttagatctttcaacagaacaaaaggtggtttgatacagttgaatcacgggcagccacaaccactccagtatgtagtcaatgctgcattccttgcttctctgttcagtgactatcttgaggctgcagatacccctgggtggtattgtggcccccatttctattccatcgaggttcttcgcagttttgcaaggactcagatggagtacatcttgggcaaaaatcctttgaagatgagctatgtggttgggcacggaaagcattaccctaagcatgttcatcaccgtggtgcgtcgatcccgaagaagaaaggtgttcaccctggctgcaaagggggttggacgtggagggacaccaagaagcccaaccctcacatccttgttggagccatggtggccggccctgatcgccatgacggcttcaaagacgtccggaagaaccgcaactacacagaaccaaccctagcgggcaacgctggtctagtcgcagcattggtagctttgtcgggtgaaggccatggagtggacaagaacaccatgttctctgctgtgccgccaatgttcccttcgccgccgcctcctccagcaccatggaagccataatggctgggtgttttagagcagtggagacgatgacgtaaccgtttatttttatttattttagtgtagtatcatcaccatgccatgttgtttgctatgcaaggactactatgttgaacgaaatgcataatggcctaagttagtactagtagtttctctcgtgtgcctgtagtagctgtgggaagtgggtacatatatatgtct

SEQ ID NO: 3314 - DNA, 2459 bp, Musa acuminata
caaagccaaagcagagcaaaaggcgacgcctttttctgccttggcagcctgctaacttcactactcccatccattaattgatgttggttggcatcaccagctgttgcttcgcccgctgttcccgtccccctcactgcctaactgtgaagcaaaaaagcagcaccaccagcgcaagaaaccttagtaacccgctccctcaccagaaattggtataaaaatcccacctttcggctcactttcccttgtttcccaccttcctcgcttggcttcacagttcactctcggattgtggtggtggtcttggccaggagggagaaaggagtggaggacagagaggaaggtctcattttgaggcgtgggagagcgaggagaaaggagacggggaaaggatgagcatctacggccgcgatccctggggagggccgctggagatccacgccgactccgccaccgatgatgaccgcagccgcaacctcgatctggaccgcgcggcgctgtcgatgacttcccggcagctggacgagactcagcagagctggctcctcgccgggcccggggacaagggcaagaagaagaagaagtacgtggatttgggttgcctcatcgtcagccgcaagatcttcttgtggaccgttggcgccgtcgtcgccgctgcggcgctcgccggcctgatcaccctcatcgtcaagaccgtcccccaccatcatcggcctcggccgccgccggataactacactctcgcgctccacaaggctcttatgttcttcaacgcccagcgatcggggcggattccaaagcacaacaatgtgtcctggagggggaactccggaatgaaggatggcttctccgatccgtcatatgggagaagcctcgtcgggggattctacgacgccggcgacgccatcaagttcaacttccctgcctccttcgccatgacgatgctcagctggagcgtgatagagtacagtgccaaatatgaagccgccggagagctcgtccatgtcaaggagatcataaagtggggcgtcgattacctactcaagactttcaattcctcggctgacacaatcgacagagtcgccgcccaggttgggcaaggggccacttcaggaggaacaaatccaaatgaccactactgttggacgaggccagaggacatcgactacccgcgaccggtctatgtttgccacagttgctcagatctcacggctgagatggctgcatctttggcttcggcttccattgtgttcaaggacaacaaggcctactctcagaagctggtccatggcgctgccacactttggaagtttgcgagggaacagagggggcggtacagtgagggaggatccgatgcctccgtcttttacaattcgactagttactgggatgaatttgtttggggtggagcatggatgtatcttgcaacaggcaattcatcttaccttcagttgtctactcatcccaaacttgccaagcatgccggtgcgttttggggtggtccagattatggagttctaagctgggacaacaagctcactggtgctcaagtacttcttagtagattaaggctgttcctaagtccagggtacccatatgaagaaatgcttagaactttccataaccagactggcatcatcatgtgctcatatctaccagtttttaactctttcaaccggacaaaaggtggtttgattcaactaaatcatgggcgaccacagccgcttcagtatgtagtcaatgcagctttccttgcatcattgtacagtgactatcttgaagcagctgatactccaggatggtactgtggtcctaatttcttccctactggtgctctacgtgattttgcgcggactcagatcgattatattttaggtaaaaatccaaaaaagatgagctatgttgtgggatttggtcagcgataccctaagcatgttcatcatcgaggtgcatcaattcccaagaatggggtaaagtacaactgcaaaggaggatggaagtggagggacactaaaaagccgaatccaaacacgatcattggtgcgatggttgccggccctgataagcacgatgggttccacgatattcggaccaactacaattacaccgagccaacacttgcaggcaatgccggtttagttgccgcactggtggccttgtccggtgagagcactggagtagacaagaacactatattctctgcggttccgccgatgtttccgtctcctccgccaccgccggccccatggagaccatgagagatcaggcaccgatgccattgattcaggattgaccagaagtggtagtgttctttcatcccaattattggagatctgacaagatatgtaaagcctttggaaacaatttgaagctgagtcctgcatctttgttctctcttttttctgttatcgtgactgtgttgtacagatgagatactgagtgagactttaattgaagtattg

SEQ ID NO: 3315 - DNA, 2326 bp, Triticum aestivum
ccccacttcacctcgccccccacgcacgccaaaaaccaacccttccgttcccattccaagccggcggcggcggcggaggcgcgcccgcggcattgcaggtggtaggggatctgtgggatcgggcgggccggcggggggcgagatgagcatgtacgggagggacccgtggggcggcccgctcgagatatgccacgactcggccacggacgacgaccggagccggaacctcgacctcgaccgggcggcgctctcgcggacgctcgacgagacgcagcagagctggctgctcgcggggcccggcgaccagggccgcaagaagaagaggtacgtcgacctcggatgcctcctcgtcagccgcaagctcttcctctggacgctcggcctgctcctcgccgctgccgcgctcgcggggatcgccgcggggattgccaaggccgtccccaggcaccaagccccgcccgcgccgctggaccagttcaccctcgcgctgcgcaaggcgctcatgttcttcaatgcccagaaatccgggaagctgccgaagcacaacaatgtaccatggcgcggcgactcgtgcctcaaggacggacgctcggaccaaacatcccggcgagacctctctggtggctactatgacggcggaagcgctgtgaaattcaacttcgcatctgccttctccatgaccctcctcagctggagcgtcatcgagtacaatgctaagtacgaggctgctggggaacttggccatgtccgtgacactattaagtggggggccgactacctattgaagaccttcaactccacggcacattccattgatcgcttggttgcgcaggtgggtggtgctgcaatgtcagacggtccgagtcagcccaatgatcattattgttggatgaggccagaggacatcgactacccacgtccagtcaccgagtgccacacttgccctgatcttggtgctgagatggccgcagcattggccgcagcatccattgtgttcaaggataacagggtttactcccacaagctgttacacggtgctaccaccgtctgggactttgcaaggaagggaggtagtcgtcaaacatatagtctaccccggtcagatgctgcaaagttctacaattcaaccgcttattgggatgaatatatttggggcggttcgtggatgtacctcgcaactggcaattcatcatacctgcagttcgcaacggatgccaagcttgcaaagaatgctcacatttactctcgtccccccaactatggggtgttcagctgggataataagctccctggtgcacaggttcttctgagccggttaaggctcttcttgagtcctgggtatccgtatgaagagatgttaaggacataccacaaccaaaccagcaccatcatgtgctcttatcttccagattttagatcttttaacagaacaaaaggtggtttgatacagttgaatcacgggcagccacaaccactccagtatgtagtcaatgctgcattccttgcttctctgttcagtgactatcttgaggctgcagatacccctgggtggtattgtggcccccatttctactccatcgaggttcttcgcagttttgcaaggactcagatggagtacatcttgggcaaaaatcctttgaagatgagctatgtggtcgggcacggaaagcattaccccaagcgtgttcatcaccgtggtgcgtcgatcccgaagaagaaaggtgttcaccctggctgcaaagggggttggacatggagggacaccaagaagcccaaccctcacatcattgttggagccatggtggccggccctgatcgccatgacggcttcaaagacgtccggaagaaccgcaactacacagaaccaaccctagcgggcaacgctggtctagtcgcagcattggtagctttatcgggtgaaggccatggagtggacaagaacaccatgttctctgctgtgccgccaatgttcccttcgcccccgccgcctccagcaccatggaagccataatggctgggtgtttagaatagaacagtggagacgacgacgtaaccgtttatttttatttattttagtgtagtatcatcaccatgccatgttgtttgctatgcaaggactatgttgaacgaaatgcataatgacctaagttagtactagtagttttccctcgtgtacctgtagctgtgggaagtgggtacatatatatgtctgacaccattgtcgtcttgaagcagcgagaggatgcacaactattgcctccgatctactccctctgtttccaaatatttgtcttcctagacatttcaaatggactactacatatgg

SEQ ID NO: 3316 - DNA, 2592 bp, Musa acuminata
agcattcaatgttgtcgttccacgacatgccctccccagcgtccgccatctccctcctcttctcccgccgccatgtccacagaccactgtccccagctggcgaactctggcgtcggaccccagcgccatcctggcgtcacgagaagagagagagaaggctttactcgcttcccctttcttcctactgctctcgcttctcccatccgatcacgtaaccggcaccagctgttggctttgcccaccgtccccatcgctgcctgactgtgaagcgaaagagacctttgtagcggcgccctgcctttttagctcgcttttgcgttgcttctgttcttcgtcacctcaccggagtagagcttgtggtggtctcggccgggaaggagaaaaggtggggagggagtagagaaaggtctcatttttagaggagggagaacggcgacagaggaaacagtggaaggatgagtatgtacgggcgggatccctggggcgggccgctggagatccacgcggactccgccaccgatgacgatcggagccgcaacctggatttggatcgtgcggcgctgtcgatgacgtcccggcagctggacgagacccagcagagctggctgctcgccgggccgggggaccagggaaagaagaagaagtacgtggacctgggctgcctcatcgttagccgcaagctcttcctgtggtccctgggcgccgtcgtcgccgcggccgcgctcgctgggctgattaccctcatcgtgaaaaccgtcccccgccaccatcgcccccggccgccgccggacaactacaccctcgccctccacaaggcccttatgttcttcaacgcccagcgatccgggccgatccccaagcacaacaacgtgtcctggagggggaactccgggatgaaggatggcatatccgatccgtcctacgggaagagccttgtcgggggattctatgacgccggcgacgccatcaagttcaacttccccgcctccttcgccatgaccatgctcagctggagcgtgatcgagtacagcgccaagtatgacgccgccggagagctcggccatgtcaaggagatcatcaagtggggtgtcgattaccttctcaagaccttcaattcctcagccgatacgatcgataggatcgccacgcaggtcgggcaaggtgccacttcaggtggagcaaacccaaatgaccactactgttggacgagaccagaggacatcgactaccctcggccggtctatgagtgccacagttgctcggatcttgcggcagagatggctgcagcattggctgcagcttccatcgtgttcaaggacaacaaggcctactcccagaagcttgtccatggcgcggccacgctctggaagttttcaaggaaccagagggggcggtacagcgagggcggatccgatgcctccatattctacaattcgaccagttactgggatgagtttgtgtggggtggagcatggatgtaccttgcaacgggcaatgcctcctacctccagttatctactcatcccaagctcgcgaaacatgctggtgctttttggggcggtccagattatggagttctaagctgggataacaaactcactggtgctcaagtacttcttagtagattaaggctgttcctgagtcctgggtacccatatgaagaaatgctgagaactttccataaccagaccggcattgtcatgtgctcatatctacctgtttttaactccttcaatcggacaaaaggtggtctgattcaactcaatcatggaagaccacagccccttcagtatgtagtcaatgtggcttttcttgcgtcagtctacagcgactatcttgaagcatctgatactccaggatggtattgtggccctaatttcttccctgctggtgttttacgtgatttcgccaggactcagattgattatattttaggtaaaaatccacaaaagatgagctatgtcgttggatttggcaaacgttatcctaagcatgtccatcatcggggtgcatcgattccaaagaatggggtgaagtatagctgcaaaggaggatggaagtggagggacaccaaaaagccaaacccaaacaccatttttggcgcaatggtcgccggccctgatagacaagacgggttcagggatgttcgaacgaactacaactacaccgagccaacactggcaggcaatgctggattagttgctgccctggtgtctttgtctggtgagagcactggagtggacaagaacactatgttctctgcggttccaccgatgtctccaactcccccaccacccccagcgccatggagaccatgagagatcaggcaatgattcttttgcttcaggttattcattcatctcagttgtgagatctaacacgaaaaaccatgaagaagagacttgtggacgcaacttataatgtggacctcagtgttgaagcttgattcttttgtcattgtgtcgtatacaatggttgtattgcatcaagaactttctgcaagcaacatataatctagagctcaactctctgctgcacctttaggatgtattatcgtatcagtttgtctggatcgataagaaatctttgtgt

SEQ ID NO: 3317 - DNA, 2387 bp, Elaeis guineensis
tgtcaccacccactctcactacaaaggtccccaaaaactctctagattgtcttgaactcggatcgatctcacctcattctcttaacagcaaaggatttgtataatagactgctccaccagatcacttgctttgcttccaatcttctaccatctctgttctttttttaccatctaaaaagaggaaaggagggagcaaaaaagaggcaaaaggtggcggttttgaggctgtgaggggagaggcggagagagaaggggaaagatgagtatgtacgggagggatccgtggggcgggccgctggagatatcgaacgcggactcggcgacggacgacgaccggagccggaatctggatttggaccgagcggcgctgtcgacgtcgtcgcggccgctggatgagacgcagcagagctggctcctggccgggccaggggaccaggggaagaagaagaagaagtatgtcgaccttgggtgtctcatcgtcagccggaagctcttcatctggaccgtgggcaccatcgtcgccaccgccgcactcgccgggttcatcactctcattgttaagactgtcccccgccaccaccaccccaagccgccgccggacaactacacccttgccctccacaaggccctcatgttcttcaacgcccagcgatctgggcggcttcccaagcacaacaatgtgtcatggagaggtaattccgggatgaaggacggcatctccgacacgtcctacgggaggagcctcgtcggaggcttctacgacgccggagatgctatcaagttcaacttcccggcctccttcgccatgactatgctaagctggagcgtaatcgagtacagcgccaagtatgaggccgccggcgagctcaaccatgtcaaggagatcatcaagtggggcaccgattacctcctcaagaccttcaacaactccgccgataccatcgatcggatagctgcccaggttggagtgggcgacacttcgggaggaaccactccaaatgaccattactgctggatgagacctgaggacattgactacccgagaccagtctatgtgtgccacagctgttcagatctcgctgccgagatggcggcagctctggctgctgcatccattgtgttcaaggacaataaggcctactcccagaagttggtccatggtgcggcgacggtctggaagtttgcaagggaacagagggggaggtacagccctcagggttccgacccctcgctcttctacaattctactagttactgggatgagtttgtgtggggtggggcatggatgtatttggcaacaggaaattcatcttacctttatttatctactcatcccactctcgcaaagcatgctggtgccttctggggcggtcctgattatggggtcttcagctgggacaacaagctcattggtgctcaagttcttcttagcagattgaggctcttcttgagtccaggctacccatatgaagaaattttgagaactttccacaaccagaccagcattgtcatgtgctcttatctacctattttcacctctttcaaccgaacaaaaggtggtttgatagaactaaaccatggaagaccacagcctcttcagtacgtagtcagtgcggcttttcttgcagctgtctacagtgactatcttgatgctgcagatactccaggatggtattgtggtcccaacttctactctactggcgtccttcgtaattttgcccagacccagattgattatgtactgggtaaaaatccccggaagatgagctatgttgtggggtttggaaaccgctatcctaagcatgttcatcatcgagctgcatcaattcctaagaacggtgtcaagtatagctgtaaaggaggatggaagtggagggacactaagaagccaaaccctcacaccattgttggagctatggttgctggtcctgatagacgtgatggattccgagatgttcgtaccaactacaactataccgagccaactcttgcaggcaatgctggtctagttgcagcactagtggctttgtctggtgaaaagagtggagtggataagaacactatattctctgcagttccaccaatgtttccaactcccccgccaccccctgcaccgtggaagccttgagataaggaagacctgttgttctgtgcctcgtgatcaaaactttatgacgatttttttcatcccagctatgaagatctagcatctatgaggatgagatgaaaaccttgttcaagcgactaacgatgtgaagcctagtgctgcaccactttttgtatattagtgttctattatggcttgtgttgtatacaggatgtatgatattcatgagttttccaaaataatggagaccctttattgctggaatgatctacacaacagt

SEQ ID NO: 3318 - DNA, 2013 bp, Cocos nucifera
ttcctcttttttaccatctaaaaaggggaaagggggagcaaaaaagaggctaaaggtggtggttttgaggctgtgaggggagaggaggagagagaaggggaaagatgagcatgtacggaagagatccgtggggcgggccgctggagatatccaatgcggactcggcaacggacgacgaccggagccggaatttggatttggaccgggcggcgctgtcgacgtcgtcgcggccgctggatgagacgcagcagagctggctcctggccgggccaggggaccaggggaagaagaaaaagaagtatgtcgaccttgggtgtctcatcgttagccggaagctcttcatctggaccgtgggtaccatcgtcgccaccgccgcactcgccgggttcatcactctcattgttaagactgtcccccgccaccatcaccccaagccgccgccggacaactacaccctcgccctccacaaggccctcatgttcttcaacgcccagcgatctgggaggcttcccaagcacaacaacgtgtcttggagaggtaattccgggatgaaggacggcatctccgacacgtcctacgggaggagcctcgtcggaggcttctacgacgctggagatgctatcaagttcaacttcccggcctccttcgccatgaccatgctaagctggagtgtaatcgaatacagcgccaagtatgaggccgccggcgagctcaaccatgtcaaggagatcatcaaatggggcaccgattaccttctcaagaccttcaacaactccgccgataccatcgatcggatagccgcccaggttggagtaggagatacctcgggaggaaccaccccaaatgaccattactgctggatgagaccggaggacattgactacccgaggccagtctatgtgtgccacagctgttcagacctcgccgccgagatggccgcggctctggcttctgcatccattgtgttcaaggacaataaggcctactcccagaagctggtccatggtgcggcgacggtctggaagtttgcaagggaccagagggggaggtacagccccccgggctccgacccctcgctcttctacaattctaccagttactgggatgagtttgtgtggggtggggcatggatgtatctggcaacaggcaattcatcttacctttatttatctactcatcccactctcgcaaagcatgctggtgccttctggggtggtccggattatggggtcttcagctgggacaacaagctcattggtgctcaagttcttcttagcagattaaggctcttcttgagtccaggctacccatatgaagaaattttgagaactttccacaaccagaccagcattgtcatgtgctcatatctacctattttcacctcattcaacagaacaaaaggtggtttaatagaactgaaccatggaagaccacagcctcttcagtacgtagtcagtgcagcatttcttgcagctgtctacagtgactatcttgatgctgcagatactccaggatggtattgtggtcccaacttctactctgccggtgtccttcgtaattttgcccagacccagattgattatgtactgggtaaaaatccccggaagatgagctatgttgtggggtttggaaaccgctaccctaagcatgttcatcatcgagctgcatcaattcctaagaacggtgtcaagtatagctgtaaaggaggatggaagtggagggacaccaagaagccaaaccctcacaccattgttggagctatggttgctggtcctgatagacgtgatgggttccgagatgttcgtaccaactacaactataccgagccaactcttgcaggcaatgctggtctggttgcagcactagtggctttgtctggtgaaaagagtggagtggataagaacaccatcttctctgcagttccaccaatgtttccaactcccccgccaccccctgcaccatggaagccttgagataaggaagacctgtttttctgtgccttgtgatcacgat

SEQ ID NO: 3319 - DNA, 2415 bp, Platanus occidentalis
aacgccaccatccagcaccatctccgtctgaaaaacagagcgagttgcggcagcggctgtatttttcgatccatctatctctctgttcgttcgttgttggtttatccagtagcgtgtggaatctgtcttgtatttggtggattaattgagaggaggagaaagaggaaggagatcaggaggtaacaaagagagaaggagaggaaggaagggaaaaaaggaaagatgagcatgtacgggcgtgacccgtggggtggtcctctggagataaatgcggcggactcggcgactgatgacgaccggagccgaaacctgcaggacttcgaccgggcggctctatcgtcacggccgctggacgagacccaacagagctggctgttgggcccgggcgagcagaagaagaagaaatacgtggatctgggttgcatcatcgtcagccgcaagatcttcgtctggaccgttggcacactcctcgccgctggcttcctcgccggcctcatcaccctcatcgtcaagaccgtaccccgccaccaccgtccccaccctcctcctgacaactacaccctcgccctccacaaggccctcatgttcttcaatgcccagcgctctggaccgcttccaaagcataataacgtttcatggaggggaaattccggtatgaaagacggcctctctgataactctgtgaataagaatttggtcggtggttattatgacgccggagatgccatcaagttcaacttcccttcgtctttcgccatgaccatgttgagttggagtgtgattgagtacagtgcaaaatatgaagcagccggagagctcaaccacatcaaagagacaatcaagtggggcactgattacctcctcaagaccttcaattcctctgccgacaccattgacaaggtcgctgcacaggttgggattggtgatacttcaggagggagtactagtcccaatgatcattattgttgggtgcggcccgaggacattgattatccacggccggtctatgaatgccatgcctgctctgatcttgctgctgagatggctgctgctttagctgctgcatccatcgtattcaaagacagcaagacctactcgcagaaacttgtccatggtgccaaaacattatttaagttttcaagggagcaacgaagtagatacagtccgggaggctcagatccttcaattttctataattccacaagttactgggatgagtttgtgtggggtggagcgtggttgtattatgctactggaaattcctcataccttcaattggctactaccccgggtctggccaaacacgcaggtgctttctgggggggcccagattatggtgtgcttagctgggacaacaaacttgctggtgctcaagtgcttctgagtaggttgaggcttttcttgagtcctgggtatccatatgaggagattttaaggactttccacaatcagaccagcataatcatgtgctcatacttgccagttttcaccagcttcaaccgaacaaaagggggcttgatacaattaaaccatggaaggcctcagcctcttcaatacgtagtcaatgcggccttcctggctaccttgtacagcgattatcttgaggctgcagatacgccgggatggtattgtggacccaatttctattcaactgaagtcctgcgtgattttgctaagacccagatcgattacatccttggcaagaatcctcggaagatgagctatgttgtgggcttcggtaatcactttccaaaacacgtgcaccatagaggtgcatcaatccctaagaacaggattaggtataattgtaaaggaggatggaaatggagggacagtccgaggccaaatcccaatacaattgttggagccatggttgctggccctgacaagcatgatgggttccgggatgtccgcaccaactataattacacagaaccaacccttgcgggtaatgcaggtttagttgctgctctggtggcgctgtcgggtgacaagactgggattgacaagaacaccatattttcggcggttccaccaatgtttccaactcctccgccacctccagcaccatggaagccttgagagggtgttcgtgggtagccttatcttgttctggaaaatcctctttcggattgttatgaagggaggtagatgatgatgatgagtgatacgattgtatgagggggagggatgcctagtatgggtgatggtgtgaagaagcttcatgtttgttgtttgcatttcattatacgcataatatggatgtttgagaacgaaaatgtattcttttgcatcactgtaatttcataattctaattttgtaagaaaatttcatgcaaagccaagtgttctgctttcgatttgggaaaactttaagccttgggacttatggatttcggatcggtttagtttaac

SEQ ID NO: 3320 - DNA, 2194 bp, Elaeis guineensis
gcggccaaaggtggcagctttgagagagagggggaggagaggaggggaaaggagtgaggtggggaggatgagtatgtacgggagagatccgtggggcgggccgctggagatatcgaacgcggactcggcgacggacgatgaccggagccggaatatggatttggaccgggcggcgctgtcgacgtcgtcgcggccgctggatgagacccagcaaagctggctcttggccggtccgggagatcaggggaagacgaagaagaagtacgtcgacctcgggtgcctcatcgtcagccggaagctcttcatctggaccgtgggcatcatcgtcgccgtcgccgccctcgccgggttcattactctcatcgtcaagaccgtaccccgacaccaccacccccagccgccgccggacaactacaccctcgccctccgcaaggccctcatgttcttcaatgcccagcgatctgggcggcttcccaagcataacaacgtgtcctggagaggtaattccgggatgaaggacggcatctccgacccgtcctacgggaggagcctcgtcggaggcttctacgatgccggagatgcaattaagttcaacttcccggcctctttcgccatgaccatgctgagctggagtgtgatcgagtacagtgccaagtatgaggccgccggcgagctcaaccacgtcaaggagatcatcaagtggggcaccgattacctcctcaagaccttcaacaactccgccgacaccattgatcggatcgccgcccaggttgggataggagacacttcaggaggaacgactccaaatgaccattactgctggatgaagccggaggacatcgactacccgagaccagtctatgtgtgccacagctgctcggatctcgctgcagagatggctgcagctctggctgcagcatccattgtgttcaaggacaacaaggcctattcccagaagctcgtccacggtgcagcgacagtctggaagtttgcaagggagcagagggggaggtacagccccagaggatcggacccctcactcttctacaattcaactagttactgggatgagtttgtgtggggtgggtcatggatgtatctagcaacgggcaattcttcttacctttatttgtctactcatcccactttggcaaagcatgctggtgccttctggggtggtccagattatggggtgttcagctgggacaacaagctccctggtgctcaaattcttcttagcagattgaggctattcttgagtccagggtatccttatgaagaaatattgagaactttccacaaccagaccagcataatcatgtgctcgtatctacctgttttcacctctttcaaccgaacaaaaggtggtttcatagagctgaaccatggaagaccccagccccttcagtacatagtcaatgcagcttttcttgcagctgtctacagtgactatctcgatgctgcagatactccaggatggtattgtggtcccaatttctactctactggggtccttcgtgattttgcccggacccagattgactatatactgggcaaaaatccccataagatgagctatgttgtgggatttggaaaccactaccctaagcatgttcatcatcgaggtgcgtccattcccaagaatggtgttaggtttagctgtaaaggaggatggaagtggagggacactaagaagccaaatcctcacacaattgctggagctatggttgctggtcctgatagacatgatgggtttcgagatgtacgtaccaactacaactatactgagcctactcttgcaggcaatgctggtctagttgcagcactagtagctttatctggtgagaagaatggagtggataagaacactatattctctgcagttccaccaatgtttccaactcccccgccaccccctgcaccatggaaaccttgaggtaggggacatcagtttttctgtgcctggtgatcaatgaaatatgatgatcttttcatcccagatatggagacctaatgtttatgatggtgatgtgaaaaccttgttcaagcaactaacaatgtgaagctcagtgcttcacctctttttgtatccaagtgttgcatcatggctttgtgttatatatacaggatgtatgatattcatgatagagacccattattccagtttcttaaataatggagactttttattcca

SEQ ID NO: 3321 - DNA, 2210 bp, Cocos nucifera
atgagtatgtacgggagagatccgtggggcgggccgctggagatattgaacgcggactcggcgacggacgacgaccggagccggaatctggatttggaccgggcggcgctgtcgacctcgtcgcggccgctggacgagacccagcagagctggctcctggccggtcctggagatcaggcaaagacgaagaagaagtacgtcgacctcgggtgcctcatcgtcagccggaagctcttcatgtggaccgtgggcaccatcgtcgccgtcgccgccctcgccgccctcgccgggtttattactctcatcgtcaagaccgtcccccgacaccaccgcccccagccgccgccggacaactacaccctcgccctccacaaggccctcatgttcttcaatgcccagcgatctgggcggcttcccaaacttaacaacgtgtcctggagaggtaattccgggatgaaggacggcatctccgacccgtcctacgggaggagcctcgtcggaggcttctacgatgccggagatgccatcaagttcaacttcccggcctctttcgccatgaccatgctgagctggagtgtgatcgagtacagtgccaagtatgaagcggccggcgagctcaaccacgtcaaggagatcatcaagtggggcaccgattacctcctcaagaccttcaacaactccgccgacaccattgatcggatcgccgcccaggttgggacaggagacacttcaggcggaacgactccaaatgaccattactgctggatgaaaccggaggacatcgactacccgaggcccgtgtatgtgtgccacagctgctcggatctcgctgcggagatggctgcagctctggctgcggcatccattgtgttcaaggacaataaggcctactcccagaagctcgtccacggtgcagcgacggtgtggaagtttgcgagggagcagagggggaggtacagccccaggggatccgacccctcgctcttctacaattcaactagttactgggatgagtttgtgtggggcggggcatggatgtatctagcaacgggcaattcttcttacctttatttgtctactcatcccactctggcaaagcatgctggtgccttctggggtggtccagattatggggtgttcagctgggacaacaagctccctggtgctcaagttcttcttagcagattgaggctattcttgagtccggggtatccttatgaagaaatattgagaactttccacaaccagaccagcataatcatgtgctcatatctgcctattttcacctctttcaaccgaacaaaaggtggtttcatagagctgaaccatggaagaccccagccccttcagtacatagtcaatgctgcttttcttgcagctgtctacggtgactatctcgatgctgcagatactccaggttggtattgtggtcccaatttctactctactggggtccttcgtgattttgcccggacccagattgactatatactgggcaaaaatccccataagatgagctatgttgtgggatttggaaaccactaccctaagcatgttcatcatcgaggtgcgtccattcccaagaatggtgttaggtatagctgtaaaggaggatggaagtggagggacactaagaagccaaatcctcacacaatcactggagctatggttgctggtcctgatagacatgatgggtttcgagatgttcgtaccaactacaactataccgagcctactcttgcagggaatgctggtcttgttgcagcactagtagctttatctggtgagaagaatggagtggataagaacactatattctctgcagttccaccgaagtttcccactcccccgccgccccctgcacaatggaaaccttaaggtagggaacaccagtttttctgtgcctggtgatcaatgaattatgatgaacttgtcatcccagatatggagacctaatgtttatgatggtgatgtgaaacccttgttctagcaactaacaatgtgaagctcagtgcttcatctctttttgtatccaagtgctgtatcatggctttgtgttatatatacaggatgtatgatattcatgaattctaaaataatagagacccattattccagtttcttaaatattgtagactttttattccagcggccaaactggttttatgctggcatgatctgtacggtgaaagaaaggtctaattgtcttg

SEQ ID NO: 3322 - DNA, 2472 bp, Gossypium hirsutum
agcacccactgcctacttatacacattttatttatcaaacacaccttccgcttcgtcttggtagatcagatctgtcggtgctcctgcattttccgcccactactcttccaaatcctcatcatgtacggcagagatccgtggggaggtcccctggagataaacgccactgattctgccactgacgacgacaggagcaggaatctgcaggacctggatagggctgcactctctcgccccttggacgagactcagcaaagctggctgcttggccccggggagcaaaagaagaagaagaagtacgtcgatctcggatgtatcattgtgagccgcaagatctttgtatggaccgtggggaccctgctcgtctccgccctcctggccggactcatcaccctcatcgtcaagactgtcccacgtcatcaccaccgccactctccgcccgataactacactctggctcttcacaaggcgctcatgttctttaatgctcagcgttctggaaagctgcccaagcataataatgtgtcgtggagagggaactcgggcctccaagatggcaaatccgatccctccgttttgatgaaagatctggtcggcggatattacgatgctggagatgctatcaagtttaactttcctgcatccttttcaatgactatgttgagctggagtgtcatcgaatacagtgctaaatacgaggctgccggtgagctcaatcatgttaaagagatcatcaaatggggtactgattatcttctcaagaccttcaacaatactgctgataccattgacaggattgctgcgcaggtagggataggagatacatctggaggaagttcagccccaaatgatcattattgctggatgcgccctgaggacattgattacccccgtcctgtatatgaatgtcatagttgctccgatcttgctgctgaaatggctgctgctttggcttctgcttccatcgttttcaaagacaacaaagcatactctcaaaagcttgtccatggtgcccgaacactctttaagtttgctagggatcaaagaggcagatatagtgctggtggttctgaccctgccctcttttataattcctcaagttactgggatgagtttgtttggggtggagcctggttatactatgccactgggaattcatcctatcttcagttagctactcatcctaaacttgccaagcatgctggtgctttctggggcggcccagattatggtgttcttagctgggataataagcttgccggtgctcaggtgcttctgagccgattgagattgtttttgagtcctgggtatccatatgaggaaatattgagtacgtttcataatcaaaccagcataattatgtgctcattccttccagttttcactagctttaatagaacaaaaggaggtttgattcagttaaaccatggaaggcctcagccactgcaatacgtagtcaatgcagccttcttagccgccctatatagtgattatcttgatgctgctgatacacctggatggtattgtggtcccaatttctattcaactgatgtcctgcgtgaatttgccaaaacccagattgattatatccttggcaaaaatcctcgaaaaatgagctatgttgtgggctttggtaaccattatccaaagcatgttcaccatagaggtgcatctatccctaagaataagatcaaatataactgtaaagggggatggaaatggagggatacgtcaaaaccaaaccccaacacacttgtgggagccatggtagctggacctgacaagcatgatgggtttcgtgatgttcgcaccaactacaactacacggagccaactctagcaggcaacgcagggttggttgctgcactcgtggcattgtctggtgacaaggcaaccgggattgacaagaataccattttttctgcagttccaccaatgtttcccacaccaccaccacctccggcaccttggaaaccatgaaaactttttgatctttcttctgtccatgtgtgacttacagtctgatgattttggaattagtttttggtacgtaaatgaccttggaagtgtaagtaacgcaaaaaggcaagacaggagatgagtgatgagacaacctgcacaaaactggtggtggttcgtctgtcagattggggagtcagacaagcattcaaacattgataatttgtatatgaagtctatttggattttgtggtatacagacagacggagtgcatgtatgatattaatgttgtattatttgaaacacaccaatatccattgacaataaatttgtgtttaattgttgcagaaatctggcctttgctattacctctttcatggctttccttatttctttgttctttcatgggttttgctttttatagcaaagaaagtagagttagagttgtaaatgtttgttctccgcttgaattttaaatgtaaatgatgagttatttgatttaatgtgaaaaa

SEQ ID NO: 3323 - DNA, 2442 bp, Gossypium raimondii
caaacacaccttccgcttcgtcttggtagatcagatctgtcggtgctcctgcattttccgcccactactcttccaaatcctcatcatgtacggcagagatccgtggggaggtcccctggagataaacgccactgattctgccactgacgacgacaggagcaggaatctgcaggacctggatagggctgcactctctcgccccttggacgagactcagcaaagctggctgcttggccccggggagcaaaagaagaagaagaagtacgttgatctcggatgtatcattgtgagccgcaagatctttgtatggaccgtggggaccctgctagtctccgccctcctggccggactcatcaccctcatcgtcaagactgtcccacgtcatcaccaccgccactctccgcccgataactacactctggctcttcacaaggcgctcatgttctttaatgctcagcgttctggaaagctgcccaagcataataatgtgtcgtggagagggaactcgggcctccaagatggcaaatccgatccctccgttttgatgaaagatctggtcggcggatattacgatgctggagatgctatcaagtttaactttcctgcatctttttcaatgactatgttgagctggagtgtcatcgaatacagtgctaaatacgaggctgccggcgagctcaatcatgttaaagagatcatcaaatggggtactgattatcttctgaagaccttcaacaatactgctgataccattgacaggattgcagcgcaggtagggataggagatacatctggaggagtttcagccccaaatgatcattattgctggatgcgccctgaggacattgattacccccgtcctgtatatgaatgtcatagttgctccgatcttgctgctgaaatggctgctgctttggcttctgcttccatcgttttcaaagacaacaaagcatactctcaaaagcttgtccatggtgcccgaacactctttaagtttgctagggatcaaagaggcagatatagtgctggtggttctgaccctgccctcttttataattcctcaagttactgggatgagtttgtttggggtggagcctggttatactatgccactgggaattcatcctatcttcagttagctactcatcctaaacttgccaagcatgctggtgctttctggggtggcccagattatggtgttcttagctgggataataagcttgctggtgctcaggtgcttctgagccgattgagattgtttttgagtcctgggtatccatatgaggaaatattgagtacgtttcataatcaaaccagcataattatgtgctcattccttccggttttcactagctttaatagaacaaaaggaggtttgattcagttaaaccatggaaggcctcagccactgcaatacgtagtcaatgcagccttcttagccgccctatatagtgattatcttgatgctgctgatacacctggatggtattgtggtcccaatttctattcaactgatgtcctgcgtgaatttgccaaaacccagattgattatatccttggcaaaaatcctcgaaaaatgagctatgttgtgggctttggtaaccattatccaaagcatgttcaccatagaggtgcatctatccctaagaataagatcaaatataactgtaaagggggatggaaatggagggatacgtcaaaaccaaaccccaacacacttgtgggagccatggtagctggacctgacaagcatgatgggtttcgtgatgttcgcaccaactacaactacacggagccaactctagcaggcaacgcagggttggttgctgcactcgtggcattgtctggtgacaaggcaaccgggattgacaagaataccattttttctgcagttccaccaatgtttcccacaccaccaccacctccggcaccttggaaaccatgaaaactttttgatctttcttctgtccatgtgtgacttacagtctgatgattttggaattagtttttggtacgtaaatgaccttggaagtgtaagtaacgcaaaaaggcaagacaggagatgagtgatgagacaacctgcacaaaactggtggtggttcgtctgtcagattggggagtcagacaagcattcaaacattgataatttgtatatgaagtctatttggattttgtggtatacagacagacggagtgcatgtatgatattaatgttgtattatttgaaacacaccaatatccattgacaataaatttgtgtttaattgttgcagaaatctggcctttgctattacctctttcatggctttccttatttctttgttctttcatgggttttgctttttatagcaaagaaagtagagttagtgttgtaaatgtttgttttccgcttgaattttaaatgtaaatgatgagttatttgatttaatgtgaaaaagcttt

SEQ ID NO: 3324 - DNA, 2432 bp, Gossypium hirsutum
caacttcctcttcgtcttggtagatcagatctgtcggtgctcctgcattttccgcccactactcttccaaatcctcatcatgtacggcagagatccgtggggaggtcccctggagataaacgccactgattctgccactgacgacgacaggagcaggaatctgcaggacctggatagggctgcactctctcgccccttggacgagactcagcaaagctggctgcttggccccggggagcaaaagaagaagaagaagtacgttgatctcggatgtatcattgtgagccgcaagatctttgtatggaccgtggggaccctgctagtctccgccctcctggccggactcatcaccctcatcgtcaagactgtcccacgtcatcaccaccgccactctccgcccgataactacactctggctcttcacaaggcgctcatgttctttaatgctcagcgttctggaaagctgcccaagcataataatgtgtcgtggagagggaactcgggcctccaagatggcaaatccgatccctccgttttgatgaaagatctggtcggcggatattacgatgctggagatgctatcaagtttaactttcctgcatctttttcaatgactatgttgagctggagtgtcatcgaatacagtgctaaatacgaggctgccggcgagctcaatcatgttaaagagatcatcaaatggggtactgattatcttctgaagaccttcaacaatactgctgataccattgacaggattgcagcgcaggtagggataggagatacatctggaggagtttcagccccaaatgatcattattgctggatgcgccctgaggacattgattacccccgtcctgtatatgaatgtcatagttgctccgatcttgctgctgaaatggctgctgctttggcttcggcttccatcgttttcaaagacaacaaagcatactctcaaaagcttgtccatggtgcccgaacactctttaagtttgctagggatcaaagaggcagatatagtgctggtggttctgaccctgccctcttttataattcctcaagttactgggatgagtttgtttggggtggagcctggttatactatgccactgggaattcatcctatcttcagttagctactcatcctaaacttgccaagcatgctggtgctttctggggtggcccagattatggtgttcttagctgggataataagcttgctggtgctcaggtgcttctgagccgattgagattgtttttgagtcctgggtatccatatgaggaaatattgagtacgtttcataatcaaaccagcataattatgtgctcattccttccggttttcactagctttaatagaacaaaaggaggtttgattcagttaaaccatggaaggcctcagccactgcaatacgtagtcaatgcagccttcttagccgccctatatagtgattatcttgatgctgctgatacacctggatggtattgtggtcccaatttctattcaactgatgtcctgcgtgaatttgccaaaacccagattgattatatccttggcaaaaatcctcgaaaaatgagctatgttgtgggctttggtaaccattatccaaagcatgttcaccatagaggggcatctatccctaagaataagatcaaatataactgtaaagggggatggaaatggagggatacgtcaaaaccaaaccccaacacacttgtgggagccatggtagcaggacctgacaagcatgatgggtttcgtgatgttcgcaccaactacaactatacggagccaactctagcaggcaacgcagggttggttgctgcactcgtggcattgtctggtgacaaggcaaccgtgattgacaagaatactattttttctgcagttccaccaatgtttcctacaccaccaccacctccggcaccttggaaaccatgaaaacgttttgatctttcttctgtccatgtgtgacttacagtctgatgattttggaattagtttttggtacgtaaatgaccttggaagtgtaagtaacgcaaaaaggcaagacaggagatgagtgatatgagacaacctggacaaaactcgtggtgtttggctgtcagattggagagtcagagaagcattcaaacattgataatttgtatatgaagtctatttggattttgtggtatacagacagacggagtgcatgtatgatattaatgttgtattatttgaaacacaccaatatccattgacaataaatttgtgtttaattgttgcagaaatctggcctttgctattacctctttcatggctttccttatttctttgttctttcatgggttttgctttttatagcaaagaaagtagagttagtgttgtaaatgtttgttttccgcttgaattgtaagtgtaaatgatgagttatttgatttaatgtgaaaaa

SEQ ID NO: 3325 - DNA, 4667 bp, Theobroma cacao
caagcaccgtcagcgtgagcagtgcagtccacccaccaaatctgcaaggtcaatattacccccttccttaagtccatctcctcactggcaaaagctaataaagaaaacagccactgcctacttaaacacatttccatccgcttcacatctgtcggtggtggtggtggtgctgctgctgtgctgctactgcaacctctctaatcttgtcctgtgttgattattcttgggccagagctgaaattactccaaatgagcatgttcggcagagatccatgggggggtccgctggagataaacgcggctgactccgccacagatgacgaccggagcaggaatctccaggacttggacagggctgcgctgtctcgccccttggatgagacccagcagagctggctgctcggccccggcgagcagaagaagaagaagtacgttgatctgggatgcatcattgtgagccgcaagatctttgtatggacagtggggaccctgctggtctcaggcttgcttgccggattcataaccctaatcgtgaaaacggttcctcgtcatcaccacgcgcacggtccgcccgataactacactcgcgcccttcataaggccctcatgtttttcaatgctcagcgttccgggaaaatgcccaagcataataatgtgtcgtggagagggaactcgtgcctccaagatggcaaatcggatccctcaactttgatgaaggatctggtcggcggttactacgacgctggagatgccatcaagttcaactttcctgcatcttttgccatgaccatgttgagctggagcgtaattgagtacagtgctaaatatgaggctgccggggagctcaatcatgttaaagagatcatcaaatggggtactgattattttctcaagaccttcaacaattctgctgataccatagacagggttgcagcgcaggttggggtgggagatacatccggaggcagtacaaacccaaatgatcattattgctggatgcgccctgaggacattgattaccctcgtcctgtctatgaatgtcacagctgctccgatcttgctgctgaaatggctgctgctttggcttctgcttccatcgttttcaaagacaacaaggcatactcccaaaagcttgtccatggtgcccggaccctctttgagtttgcaagggatcagcgaggcagatacagtgctggtggttctgatgccgccatcttttataattcctccagttactgggatgagttcgtttggggtggagcctggttatactatgccaccgggaactcttcctatcttcagttagctactcatcctaaacttgccaagcatgctggtgctttctggggaggcccagattatggtgttcttagctgggataacaagctagctggtgctcaggtgcttctgagccggttgagattgtttttgagtcctggatatccatatgaggaaatattgagaacattccacaatcagaccagcatagttatgtgctcattccttccagttttcactagctttaacagaacaaaaggaggtttgatccagctaaaccatggaaggcctcagcctctacaatatgttgtcaatgcagccttcttagccaccctatacagtgattatcttgatgctgccgatacacctggatggtattgtggtcccaatttctattcaactgatgtcttgcgggactttgccaaaacccagattgattacatcctaggaaaaaatccacggaaaatgagctatattgtgggttttggtaaccattacccaagacatgttcaccatagaggtgcttctatccctaagaataagatcaaatataactgtaaagggggatggaaatggagagataccacaaagccaaaccctaatacacttgttggagccatggttgctggacctgacaagcatgatggatttcatgacgttcgcaccaactacaactacacagaaccaactcttgcaggcaacgcgggtttggttgctgcactcgtggcattgtctggtgacaagtcaactgggattgacaagaataccattttttctgcagttccaccaatgtttcccacaccgccaccacctccagcaccttggaagccataaagatattttagatctttcctcgtttacgctttgttgtgtgacctacaggatgattttggaagtagtttttggtaccctgatggccttgagagggaaggtaatgcaaaaggcaagaaaggggagacaagaaagggaacaacctacaggcagaacttatgtttggttgtcaggttgcagaatcggcccagcattcagaactgatagttggaatatgaagtctctttggatttcgtggtatacagtgtatatgtatgatatcaatattgtattctttgaaacacgagttaaaaactccagaattggttaacaataaatctgtgtttaatttctaattcctgcagtttttcggggataaggatcttgcaatagttgttggcatttatgtgattttcgtcttaagttagtatttcatacaaactgaattggaagtgtcctggaatcgagaagccatccatcttgtcaggttatcgtgtatatattttctttaatgcttttctctttttaaatgacatttaaatgacacggcaattattaatagttgcaagagttgatgtttgtaaagtttctttcccacttggattgtaagtgtataacggttatatatttcatttgatgtaaagaaaggatgcggtaaagcttgaaaaactatgacagtcgataacagcagtgcggattgcgttagtagcagaatctagtgtagctgttctgcaaagaaaaagaaacatgagaggtccagctcaagtgattcctatcaacaatgagagttcatctgacctttatgcctttcttttgtctcttggttgattcgtcggcacgttacttgttttttccgtttcacttatgctcagttaaattcttttcccttacctttgtatatgcttattctttgtcaccttcacttctttccctttcatatactcatgaaaacaaccatcaaacaaggcgacatttgggtttttattgtttcttatttgttggggtctcatcaccggactgaagcacattgacttgtatcaagacatggcagaagaagagtccagctctctgcagtattcaccaacctgggtggttgcttctgtgtgttttctcattgtcctcatatctcttattgctgaacgaggtcttcatcgccttggaaagtttttgaagcataacaaacaagatgcactatttgaagctttacaaaaattaaaagaagagctgatgctcttaggattcatctcccttctattaacagtctctcaaggtctagtaagtcgaatgtgcatcccagatgacttggtatccaatatgcttccatgcaagagggacagtgaaaaaaaaggccatgaagaatattctcctcaacttataaacaatagacggcgcctgttttccacagaaagtagctcagggcaatgttcgcatgagggtcaggtccccttattgtcattggaagcattgcatcagctgcacattttcatctttgtattggcagttgttcacgtgatattctgcgtcactacaatggttcttggaggagcaaggatacgtgaatggaagaaatgggaaaaatgggtttctgaaggtagaagagaggaaacccatcgtcaccgtaagttatttcaacaacatgcacaaggattttggagaaaggcagcagttgtgagctggacaatctcatttttcaaacagttttatggctctgttaccatgtcagactacatagcacttcgagaaggcttcatcatggcccattgccctggacatagtaaattcaattttcacaagtacatgatgcgaacacttgaagcggacttcaaaaaggttgttggcataaggatggcatacgtatttctggttatcgtttctcccagtagttcttctacttctagtgggtgccaagttagagcacataatcattcgcttagctcaggatgtaattgagaagagggaacggggcgaaggagcccaagttaaaccttctgatgaacatttttggtttgtgcacatatggtttccgttcatgcatcatggaaaaagtgggctatatcatccctaggcttataatgggtgtaatggttcaagttctctgcagttacatcaccttgcctctatgggcagcaaattcaaggaaggcatgttcgatgactttgtagtagaatctttggggaaatggaggcagggacgtagaggtgagacaagcatggggggctcctctagtgcacatgttggacaggttcataggatcaccaaagaatcatgtcaaagcatacaaattgaagagaaacaaacgatgaatatcgaagaaaatataaaatcaataactgagctgtcggtgagtggacaaaacccataaactatcaacttaagttcctcgcagcggtgtttttcggcagttgatttggcctaggagtagcgagttctatgttgttggcaccatttccaaaaatgatgccaaataggacactgtaaaatgcaaaaaatagctgttgtaagtgcagcaaaccgaacaagaataatacaaacaagaagcagaagaaactgataattctttattgaattctctcattgac

SEQ ID NO: 3326 - DNA, 2346 bp, Gossypium hirsutum
gaaaacaacagccactgctcacttaccccattttcttatcacaccactttcttcctcttcctctcatctcatctgtcggtgctgccattgcggtttatactttataatttttctttacttttgtctattcctcttttaatcaagatgagcatgtatgggagagatccctggggagggccgctggagataaacgcggctgattccgccactgatgatgacaggagtaggaatctgcaagacctggacagggctgcgctctctcgccctttggacgagacgcagcagagctggctgcttggccccagcgagcagaagaagaagaagaagtacgttgatctcgggtgcatcattgtcagccgcaagatctttgtctggacggttgggaccttggtcgtctcagccgtccttgccggattaatcaccttaatcgtcaagaccgttccacgtcatcaccacggcaagcctcctcctgataactacactctcgcacttcacaaagccctcatgttcttcaatgctcagcgttccgggaagttacccaagcataataacgtgtcctggagaggaaactcgtgcctccgagatggaaagtccgatcccggcactacaatgaaggatctggtcggcggttactacgacgctggagatgctatcaagttcaacttccctgcatcttttgccatgaccatgttgagctggagcgtcgttgagtacagtgctaaatacgaggctgccggtgaacttaatcatgttaaggagattatcaaatggggtactgattatctgctcaagaccttcaacaattcagctgataccatagataatattgcagcgcaggttggagtaggagatacatccggaggcagtactacacccaatgatcattattgctggatgcgccctgaggacattgattacccgcgccctgtctatgaatgtcacagctgctccgatcttgctgctgaaatggctgctgctttggctgctgcttccattgttttcaaagacaacaaggcgtactctcaaaagcttgtccatggtgcacggacagtctttcagtttgccagggatcaaagaggcagatatagtgctggtggttctgaccctgccctcttttataactcctccagttactgggatgagtttgtttggggtggagcttggttatactacgccactgggaattcttcctaccttcagttggctactcatcctaaacttgccaagcatgctggtgcattctggggaggcccagattatggcgttctgagctgggacaacaagcttgctggtgctcaggtgcttctgagccggttgagattgtttttaagtcctgggtatccatatgaggaaatattgagaacgtttcacaatcaaaccagcatagttatgtgctcattccttccagtttttactagctttaatagaactaaaggcggtttgattcagttaaaccatggtaggcctcagcctctgcagtatgttgtcaatgcagccttcttagccgcattatacagtgattatcttgatgctgctgatacacctggatggtattgtggtcccaatttctattcaactgatgtcttgcgtgaatttgccaaaacccagatggattacatccttggcaaaaatcctcggaaaatgagctatgttgtgggttttggtaaccattacccaaaacatgttcaccatagaggtgcatctatccctaagaataagatcagatataactgtaaggggggatggaaatggagggattcaaaaaagccaaacccgaatacgctggtgggagccatggttgctggacctgacaagcatgatggatttcacgatgttcgcaccaactacaactacactgaaccaactcttgcaggcaatgctggtttggttgctgcacttgtggcattgtctggtgacaagtcaactggaattgacaagaataccatattttctgcagttccaccaatgtttcccacaccgccaccacctccagcaccttggaagccataaatatgcttttagatcctttaaatgtttcctttttgtgtgacttagtcttatgattttgtaagtgttttttggcaccttgatgaccttgaaagtgaaagtagtgcaaagggcaaggaaggagatgtgcaatggaaaaaagctgcagtaaactgatggtggtttggctattagattggagaataggactagcattcaggatctgataatttgaatatgaagtccatttggatttcacggtatacatggtgtatatgtatgatatcaatactgtattctttgaaacacgagtttaaacacttaaattgatttaacaataaatttgtgtctaatatctaa

SEQ ID NO: 3327 - DNA, 2558 bp, Pteridium aquilinum
tgcatcattgagcaagcacgtcagcgtgagcagtgccaatcccacccaccaaatactgcaaggtcaatattaccccttcccttaagtcccatctcctcactaggcaaaagctataaagaaaacagccacctgcctacttaaacacatttccatccgcttcacatctgtcggtggtggtggtggtgctgctgctgtgctgctactgcaacctctctaatcttgtcctgtgttgattattcttgggccagagctgaaattactccaatgagcatgttcggcagagatccatgggggggtccgctggagataaacgcggctgactccgccacagatgacgaccggagcaggaatctccaggacttggacagggctgcgctgtctcgccccttggatgagacccagcagagctggctgctcggccccggcgagcagaagaagaagaagtacgttgatctgggatgcatcattgtgagccgcaagatctttgtatggacagtggggaccctgctggtctcaggcttgcttgccggattcataaccctaatcgtgaaaacggttcctcgtcatcaccacgcgcacggtccgcccgataactacactcgcgcccttcataaggccctcatgtttttcaatgctcagcgttccgggaaaatgcccaagcataataatgtgtcgtggagagggaactcgtgcctccaagatggcaaatcggatccctcaactttgatgaaggatctggtcggcggttactacgacgctggagatgccatcaagttcaactttcctgcatcttttgccatgaccatgttgagctggagcgtaattgagtacagtgctaaatatgaggctgccggggagctcaatcatgttaaagagatcatcaaatggggtactgattattttctcaagaccttcaacaattctgctgataccatagacagggttgcagcgcaggttggggtgggagatacatccggaggcagtacaaacccaaatgatcattattgctggatgcgccctgaggacattgattaccctcgtcctgtctatgaatgtcacagctgctccgatcttgctgctgaaatggctgctgctttggcttctgcttccatcgttttcaaagacaacaaggcatactcccaaaagcttgtccatggtgcccggaccctctttgagtttgcaagggatcagcgaggcagatacagtgctggtggttctgatgccgccatcttttataattcctccagttactgggatgagttcgtttggggtggagcctggttatactatgccaccgggaactcttcctatcttcagttagctactcatcctaaacttgccaagcatgctggtgctttctggggaggcccagattatggtgttcttagctgggataacaagctagctggtgctcaggtgcttctgagccggttgagattgtttttgagtcctggatatccatatgaggaaatattgagaacattccacaatcagaccagcatagttatgtgctcattccttccagttttcactagctttaacagaacaaaaggaggtttgatccagctaaaccatggaaggcctcagcctctacaatatgttgtcaatgcagccttcttagccaccctatacagtgattatcttgatgctgccgatacacctggatggtattgtggtcccaatttctattcaactgatgtcttgcgggactttgccaaaacccagattgattacatcctaggaaaaaatccacggaaaatgagctatattgtgggttttggtaaccattacccaagacatgttcaccatagaggtgcttctatccctaagaataagatcaaatataactgtaaagggggatggaaatggagagataccacaaagccaaaccctaatacacttgttggagccatggttgctggacctgacaagcatgatggatttcatgacgttcgcaccaactacaactacacagaaccaactcttgcaggcaacgcgggtttggttgctgcactcgtggcattgtctggtgacaagtcaactgggattgacaagaataccattttttctgcagttccaccaatgtttcccacaccgccaccacctccagcaccttggaagccataaagatattttagatctttcctcgtttacgctttgttgtgtgacctacaggatgattttggaagtagtttttggtaccctgatggccttgagagggaaggtaatgcaaaaggcaagaaaggggagacaagaaagggaacaacctacaggcagaacttatgtttggttgtcaggttgcagaatcggcccagcattcagaactgatagttggaatatgaagtctctttggatttcgtggtatacagtgtatatgtatgatatcaatattgtattctttgaaacacgagttaaaaactccagaattggttaacaataaatctgtgtttaatttctaattcctgcagtttttcggggataaggatcttgcaatagttgttggcatttatgtgattttcgtcttaagtgagtatttcatacaaactgaacccgcgcgg

SEQ ID NO: 3328 - DNA, 2411 bp, Gossypium raimondii
caagaacagaaaacaacagccactgctcacttaccccattttcttatcacaccactttcttcctcttcctctcatctcatctgtcggtgctgccattgcggtttatactttataatttttctttacttttgtctattcctcttttaatcaagatgagcatgtacgggagagatccctggggagggccgctggagataaacgcggctgattccgccactgatgatgacaggagtaggaatctgcaagacctggacagggctgcgctctctcgccctttggacgagacgcagcagagctggctgcttggccccagcgagcagaagaagaagaagaagtacgttgatctcgggtgcatcattgtcagccgcaagatctttgtctggacggttgggaccttggtcgtctcagccgtccttgccggattaatcaccttaatcgtcaagaccgttccacgtcatcaccacggcaagcctcctcctgataactacactctcgcacttcacaaagccctcatgttcttcaatgctcagcgttccgggaagttacccaagcataataacgtgtcctggagaggaaactcgtgcctccgagatggaaagtccgatcccggcactacaatgaaggatctggtcggcggttactacgacgctggagatgctatcaagttcaacttccctgcatcttttgccatgaccatgttgagctggagcgtcattgagtacagtgctaaatacgaggctgccggtgaacttaatcatgttaaggagattatcaaatggggtactgattatctgctcaagaccttcaacaattcagctgataccatagataagattgcagcgcaggttggagtaggagatacatccggaggcagtactacacccaatgatcattattgctggatgcgccctgaggacattgattacccgcgccctgtctatgaatgtcacagctgctccgatcttgctgctgaaatggctgctgctttggctgctgcttccattgttttcaaagacaacaaggcgtactctcaaaagcttgtccatggtgcacggacagtctttcagtttgccagggatcaaagaggcagatatagtgctggtggttctgaccctgccctcttttataactcctccagttactgggatgagtttgtttggggtggagcttggttatactacgccactgggaattcttcctaccttcagttggctactcatcctaaacttgccaagcatgctggtgcattctggggaggcccagattatggcgttcttagctgggacaacaagcttgctggtgctcaggtgcttctgagccggttgagattgtttttaagtcctgggtatccatatgaggaaatattgagaacgtttcacaatcaaaccagcatagttatgtgctcattccttccagtttttactagctttaatagaactaaaggcggtttgattcagttaaaccatggtaggcctcagcctctgcagtatgttgtcaatgcagccttcttagccgcattatacagtgattatcttgatgctgctgatacacctggatggtattgtggtcccaatttctattcaactgatgtcttgcgtgaatttgccaaaacccagatggattacatccttggcaaaaatcctcggaaaatgagctatgttgtgggttttggtaaccattacccaaaacatgttcaccatagaggtgcatctatccctaagaataagatcagatataactgtaaggggggatggaaatggagggattcaaaaaagccaaacccgaatacgcttgtgggagccatggttgctggacctgacaagcatgatggatttcacgatgttcgcaccaactacaactacactgaaccaactcttgcaggcaatgctggtttggttgctgcacttgtggcattgtctggtgacaagtcaactggaattgacaagaataccatattttctgcagttccaccaatgtttcccacaccgccaccacctccagcaccttggaagccataaatatgcttttagatcctttaaatgtttcctttttgtgtgacttagtcttatgattttgtaagtgttttttggcaccttgatgaccttgaaagtgaaagtagtgcaaagggcaaggaaggagatgtgcaatggaacaaagctgcagtaaactgatggtggtttggctattagattggagaataggactagcattcaggatctgataatttgaatatgaagtccatttggatttcacggtatacatagtgtatatgtatgatatcaatactgtattctttgaaacacgagtttaaacacttaaattgatttaacaataaatttgtgtctaatatctaatggttgccgttttcagagcatagaaatctcgccttagcagttcactgttgttctttt

SEQ ID NO: 3329 - DNA, 1901 bp, Oryza sativa
tggaaggaaggaaggaaggatgctggagacgaagccgccgtcgccggggacggcgggggcggcgggggtggcagggggtgggtaccatcggaggtgggcggcgccgctgctggcgtccgtgctgctctcgtcgctcctcatcgcggcgtccctcttcttctcttcgtcgcgggcgctcctcctctccttctccccgctcccctccgcggcatccgccgagccgctcttcgtcgaggccaagctgcgccagcagcagcagatgcgcggcgcggcggcgtcgggcgggcgcggccgcggcgccgtgccgaggatcgcctacctcgtgtccggctccgccggcgacggcgccgcgctgcgccgcacgctcagggcgctctaccacccgtcgaacatgtacgtcgtccacctcgacctcgaggcccccgccaccgagcgcgccgagctcgccgccgcggtgcgcgccgacccggtctactcgcggttccgcaacgtcaaggtggtcacccgcgccaacctcgtcacctaccggggcccgaccatggtggccaacacgctccacgccgccgccatcctcctccgcgagggcggcgagtgggactggttcatcaacctctccgcctccgactaccccctcgtcacgcaggacgatctgttgtatgttctatctgacttgccaaggcaacttaactttattgagcataccagtgacatcggatggaaggagtatcagagggcaaagccggtgataattgaccctgggctatacagcctgcagaaatctgatgttttctggattacagagaaaagaagtgttccaaccgcattcaagctcttcactggctcggcgtggatgatgcttactcatcaatttattgaatactgcatatggggttgggacaatcttcccaggacggtcctgatgtattatgccaattttctttcttcaccagagggttacttccacacagtcatttgcaatgtcccagagttccgcaacaccactgtgaatcatgatctacatttcatttcttgggacaacccaccaaagcaacaccctcactacctcaccctcaatgactttgacggtatggttaacagcaatgctccctttgcaagaaagtttggaagagaagatcctgtactagacaagatcgaccaggaattattgggccgccaacctgacgggttcgtggcaggtgggtggatggatctgttgaacacgacaacagtgaaaggatcgttcactgttgagcgtgtacaagatctccgcccagggcctggtgcagacaggctaaagaaacttgtcacaggcttgctcacccaggaaggctttgatgacaagcattgcttgtgaaacttgcagtaatatgattctggggtaggttacactatcaaaattcgaggatgttgcgccattagctagtcatctactagctgaagaagcagcagcacatagcatcaattccacatggatggaatggtcagataggtgatctttttacacaaaccacttgagttgaatcaccgtacaggagaccacggccgtagcacacggagattatacagcactaatagctcattaggttatgttagaggattatatcagcccccaaccattaataatctcttcttgatctctctgcgctgcgggttgtccaagatggtccattattcgttcagaaaatcacagcactgaccagatcaatttgccaacctgcagcgcttgagatttcgttgtattaacttggattcttctgggcaaactggcacattttgattacatacatgtattctttgatttcttctcccttttcccattgctgagcatagcgaattacttgctcccttttcttgcccctctggtgggtatgcatactatatatattttgttttatgtgcaa

SEQ ID NO: 3330 - DNA, 2047 bp, Setaria italica
cgtggtgcgagccccaaccgtcgccggcccgccccaaattaagccgcccccgcggagcgatccggtggccaccgcctggtccgctgccgccccgccggagccgaggaggaaggggggagcgcagggggggatgctagaggcgaagccgccgtcgccgggctccggcgcggccggggcggcggcgcacatccacggccaccggcggtgggcggcgccgctgctcgcgtcggtcctgctctcctcgctcctcatctccgcgtcgctcttcttctcctcatcccgcgcgctgctcctctccttctcgccgctcccctccgcggcctccgccgagccgctcttcgtcgaggccaagctccgccagcagatgcgggccgaggaccgcccgccgcggggagccgtgcccaggatcgcctacctcgtctccggctccgccggggacggcgccgcgctgcgaaggacgctcagggcgctctaccacccggccaacacctacgtcgtgcacctcgacctagaggcccccgccgccgagcgcgccgagctcgccgcagccatccggtccgaccccgtctacgccaggttccgcaacgtcaaggtcgtcacacgcgcgaacctcgtcacctaccggggcccgaccatggtggccaacacgctgcacgcggcggccattttgctgcgggaggggggcgattgggactggttcatcaacctctccgcatccgactacccgctcgtcacccaggacgatctgttacatgtgctctctgagttgccaaggcagcttaacttcatcgagcacacaagtgacatcggatggaaggagtaccagagggcaaaaccagtgatcatcgaccctgggctatacagcctgcagaagtctgacgttttctggattacagagaaaaggagtgtcccaactgcattcaagctctttactggctcagcatggatgatgcttactcatcagtttattgaatactgcatatggggatgggacaatctaccaaggacagtcctgatgtattatgccaattttctttcttcaccagagggttacttccacacagtcatctgcaatgtcccggagttccgcaacaccacagtcaaccatgatctacatttcatttcttgggacaacccaccaaagcaacatcctcattatctcacactcgatgattttgatggtatggttaacagtaatgctccctttgcacggaagtttggaagagaagatcccgtgctggacaagattgatcaggaactattgggccgccaacctgatggatttgtgcctggtggatggacagatttgttgaatacaactgagaaaggaggacccttcactgttgaacatgtccaagatctccgcccagggcctggtgttgacagattaaagaaactcgtcacaggcttgctcacccaagaaggttttgatgacaagcattgcttgtgaaactcccagtaagatgattccagggcagtagatttacacggtcaagtttgagggcattgagccaattgctagtaatgtctactagcgaacaagcagcacataactcatgtccgcgtggatgcaacgataagataggtgctcttatagacaaccgcttgagttgagttacggtacagcaggagatcatggatgtagcaggcggagaatatacagaactagtagcttattaggttatggtagaggattatatcagaccccaaccatcaataatcttggaaattttgacatctctgcgctgcgtgttgtgcaaggtggtccattgcttgtccggaagccatggcaccgggtatttatcaactggtagcgcgtgagactttgttgtattgaccagcagatatttctgggcaaactgatacatttgattgcatacatgtattcttttatttcttctcctttttgatgagtatagcaaattggttgtgctgttgtcttgcctgcatttcgtaagcgcgtgcgtctctgtttatcccttgcggttttggttgggagaggattagaaatgctgttgagatttgattacctgtttttgtattgttg

SEQ ID NO: 3331 - DNA, 2167 bp, Saccharum officinarum
tagttccgggtcgacccacgcgttcgcgcgctctcctgcccgtgcccacctccccttccccttcaccctccaggcctccaccttcatccaccttcgcagcgcccgcggtaacctcaccacgccacgccacatcgcgtgcgagccccaaccgtcgccggccccgcccaattaagccgcccgcgcggcgcgatccggtggccaccgctgccccgctgccccgccggaggaggaaaggtaggggggagcacagggggatgctagaggcgaagccgccgtcgccgggctccggcgcggccggggcggcggcgcacatccacggtcaccggcggtgggcggcgccgctgctggcctcggtcctgctctcgtcgctcctcatctccgcgtcgctcttcttctcctcctcccgcgcgctgctcctctccttctcgccgctcccctccgcggcctccgccgagcctctcttcgtcgaggccaagctccgccagcagatgcgcgccgaggagcgcccggcgcggggcgccgtgcccaggatcgcctacctcatctccggctccgcgggggacggagccgcgctgcgccggacgctcagggcgctctaccacccggcgaacacgtacgtcgtgcacctcgacctcgaggcccccgccgccgagcgcgccaagctcgcctctgccgtccgcgcggaccccgtctacgccaggttccgtaacgtcaaggtcgtcacacgggcgaacctcgtcacctaccgtggcccgaccatggtggccaacacgctgcacgcggctgccatcctgctgcgcgagggcggtgattgggactggttcatcaacctctccgcctccgattatccgctcgtcacccaggacgatctgttgcatgtgctctccgagttgcccaggcagcttaacttcattgagcataccagtgacatcggatggaaggagtaccagagggcgaagccagtgatcatcgaccctgggctatacagcctgcagaagtctgacgttttctggataacagagaaaaggagtgtcccaactgcgttcaagctcttcactggctcagcatggatgatgcttacccatcagtttatagaatactgcatatggggatgggacaatctccccaggacagtcctgatgtattacgccaattttctttcttcaccagagggttacttccacacagtcatctgcaatgtcccggagttccgcaacaccacagtcaaccatgatctacatttcatttcttgggacaacccaccaaagcaacaccctcattatctcacacttgctgactttgatggtatggttaacagtaacgcaccctttgcaaggaagtttggaagagaagatcctgtgctggacaagattgaccaggaactattgggccgccaaccggatggatttgtgcctggtggatggacagatctactgaatacaactgagaaagggaaacccttcactgttgagcgtgtgcaagatctccgcccagggcctggtgtggacagattaaagaaacttgtcacaggcttgctcacacaagaaggttttgatgacaagcattgcttgtgaaactcccagtaagacgattctggggcagtagattacacggccaaatttgagggcattgagccatttgctaggaatgcctactagctgaagcagcagcacatagcgtcatgtacgcgtggatgcaacgataagataggtgctcttatagacaaccgcttgagttgagttaccgtacagcaggagaccacggatgtagcaggcggagattatacagaactactagctcactaggttatgttagatgattatatcagcccccaaccatcaataatgttggaatttttgacatctctgcgctgcgggttgtgcaaggtagtccattctttgtatggaagccatggcacctggtataccaactggtagcgtgcgagacttcgttgtattgactagtggatatttctgggcaaactgatacatttgattgcacacatgtattcatttatttcttttcctctttgatgagtatatagcaaaatgcttgtgctgttttcttacctgcatcgggtacgcccgtgcggctctgccgtactgtttaggttgagagagttagaaatgctgttgcaatttgaatatctgtatttgcattaccaccg

SEQ ID NO: 3332 - DNA, 2411 bp, Sorghum bicolor
ccgatcttctccatctccacggcaggacgaggctttcggtccgtcgcccatccccatctccatccccatccccatccgtggcacgcaagagacgaggccacgactgactgtggaggcaggcccacccgacgcgaccggcaggcagcggcgcaccaacgcaaaggttaacccacccgcccaccgcaccgcacccagcagcagcgcccactcacgagaccgtccaccgcgacgcgctctcctgcccctgcccctgcctctgcccgtgcccacctccccttcccctcctccccctccacctccgcagcgcccgcggtaacctcaccacgccacgccacatcgcgtgcgagcgagcccccaaccgtcgccggccctcccacccccaattaagccgcccccgcggcgcgatccggtgtgtcctccaccgctgccctgccgccggagggaagggaggtgggggagcacaggcccggggggatgctagaggcgaagccgccgtcgccgggctccggcgcggccggggcggcggcggcgcacatccacagtcaccggcggtgggcggcgccgctgctggcctcggtcctgctctcgtcgctcctcatctccgcgtcgctcttcttctcctcctcccgcgcgctgctcctctccttctcgccgctcccttccgcggcctccgccgagcctctcttcgtcgaggccaagctccgccagcagatgcgcgccgaggagcgccccgcgaggggcgccgtgcccaggatcgcctacctcatctccggctccgcgggggacggagccgcgctgcgccggacgctcagggcgctctaccacccggccaacacgtacgtcgtgcacctcgacctcgaggcccccgccgccgagcgcgccgagctcgccgcggccgtccgcgcggacaccgtctacgcaaggttccgcaacgtcaaggtcgtcacacgggccaacctcgtcacctaccgtggcccgaccatggtggccaacacgctgcacgcggctgccatcctgctgcgcgagggcggtgattgggactggttcatcaacctctccgcctccgactatccgctcgtcacccaggacgatctgttgcatgtgctctccgagttgcccaggcagcttaacttcattgagcataccagtgacatcggatggaaggagtaccagagggcgaagccagtgatcatcgaccctgggctatacagcctgcagaagtctgacgttttctggataacagagaaaaggagtgtaccaactgcgttcaagctattcactggctcagcatggatgatgcttacccatcagtttattgaatactgcatatggggatgggacaatctcccaaggacagtcttgatgtattacgccaattttctttcttcaccagaaggttacttccacacagtcatctgcaatgtccccgagttccggaacaccacagtcaaccatgatctacatttcatttcttgggacaacccaccaaagcaacaccctcattatctcacacttgctgactatgatggtatggttaacagtaacgcaccctttgcaaggaagtttggaagagaagatcctgtgctggacaagattgaccaggaactattgggccgccaacctgatggatttgtgcctggtggatggacagatgtactgaatacaactgagaaaggtaaacccttcactgttgagcgtgtgcaagatctccgccccgggcctggtgtggacagattaaagaaacttgtcacaggcttgctcacacaagaaggttttgatgacaagcattgcttgtgaaactcccagtaagacaattctggggcagtagtttacacggtcaaatttgagggcattgagccatttgctaggaatgcctactagctgaagcagcagcacatagcatcatgtacgcgtggatgcaatgataagataggtgctcttatagacaaccgcttgagttgagttaccgtacagcaggagaccacggatgtagcaggcggagattatacagaactagtagctcactaggttatgttagatgattatatcagcccccaaccatcaataatgttggaatttttgacatctctgcgctgcgggttgtgcaaggtagtccattctttgttcggaagccaatggcacctggtgtaccaactggtagcgtgtgagacttcgttgtattgactagtggatatttctgggcaaactgatacatttgattgcacacatgtattcatttatttctctttctctttgatgagtatagcaaaatgatcgtgctgttttcttacctgcatctggttacagtttcggttgagagagttagaaattctgttgcaatttgaatatctgtatttacattgctgtttggagtctggattgaagtgagttttctctgtcggtgaatctgc

SEQ ID NO: 3333 - DNA, 2023 bp, Zea mays
actcacgagaccgtccaggcgtccaccgcgacgcgctctcctgcccgtgcccacctccacgactccacctccgcagcgcccgcggtaacctccccacgccacgccacatcgcgtgcgagccccaaccgtcgccggcctcccaattaagccgcccccgcggcgcgatccggtgtccaccgctgctccgccggaggagggggaaggggaagaaaagggagggggggagcacagggggatgctagaggcgaagccgccgtcgccgggctccggcgcggccggggcggcggcgcacatccacggtcaccggcggtgggcggcgccgctgctggcctcggttctgctctcgtcgctcctcatcaccgcgtcgctcttcttttcctcctcccgcgcgctgctactctccttctcgccgctcccctccgcggcctccgccgagcctctcttcgtcgaggccaagctccgccagcagatgcgggccgaggagcgccccacgcggggcgccgtgcccaggatcgcctacctcatctccggctccgcgggggacggagccgcgctgcgccggacgctcagggcgctctaccacccggtaaacacatacgtcgtgcacctcgacctcgaggcccccgccgccgagcgcgccgaactcgcctctgccatccacgcggaccccgtctacgctaggttccgcaacgtcaaggtcgtcacacgggccaacttggtcacctaccgtggcccgaccatggtggccaacacgctgcacgcggctgccatcctgctgcgcgagggcggtaattgggactggttcatcaacctctccgcctccgactatccgctcgtcacccaggacgatctattgcatgtgctttctgagttgcccaggcagcttaacttcattgagcataccagtgacatcggatggaaggagtaccagagggcgaagccagtgatcatcgaccctgggctatacagcctgcagaagtctgacgttttctggataacagagaaaaggagtgtcccaactgcattcaagctcttcaccggctcagcatggatgatgcttactcatcagttcattgaatattgtatatggggatgggacaatctcccaaggacagtcctgatgtattacgcaaattttctttcttcaccagagggttacttccacactgtcatctgcaatgtccccgagttccgcaacaccacagtcaaccatgatctacatttcatttcttgggacaacccaccaaagcaacaccctcattatctcacactcgctgacttcgatggtatggttaacagcaacgcaccctttgcaaggaagtttggaagagaggatcctgtgctggacaagattgaccaggaactgttggcccgccgacctgatggatttgtgcctggtggatggacagacctactgaacacaactgagaaagggaaacccttcacggttgagcgcgtgcaagatctccgcccaggtcctggtgtggacagattaaagaaactcgtcacaggattgctcacccaagaaggttttgatgacaagcattgcctgtgaaactcccagtaagatgattctggggcagtaggttacacgctcaaatttgaaggcatcgggccatttgctaggaatgcccctactagctgaggcagcagcacattagcgtcatgtacgcgaggatgcaacgataaggaaggtgctcttacagacaactgcttgagttgagttaccgtacagcaggagaccacggatgtagcagtcggagatgattatacagaactagtagctcattagtttattagatgattataatcagccccccaaccatgaataatgttggaatttttgacatttctgcgcccgagggttgtgcaaggtagcccattctttgtttcgaagccatggcacctggtgcaccagctggtagcgtgagacttcgttgtattgactagtggatgtttctgggtaaactgatacatttgattgcacacatgtattgatttgtttcttttctctttgatgagt

SEQ ID NO: 3334 - DNA, 2083 bp, Zea mays
actcacgagaccgtccaccgcgacgcgctctcttgcccgtgcccccgtcctccccttccccctccacctccgcggcgcccgcggtaacctcgccacgccacatcgcgtgcgagcaccaaccgtcgccggccctctaattaagctgcccgcgcggcgcgatccggtgtccaccgctgccccgccggaggaggaggaggaaggggggcggggggtggagcacagggggatgctagaggcgaagccgccgtcgccgggctcctccggcgcggccggggcggcggcacacatccacgctcaccggcggtgggcggcgccgctgctggcctcggtcctgctctcgtcgatcctcatctccgcgtcgctcttcttctcctcctcccgcgcgctgctcctctccttctcgccgctcccctccgcggcctccgccgagcccctcttcgtcgaggccaagctccgccagcagatgcgggccgaggagcgccccgcgcgcggcgccgtgcccaggatcgcctacctcgtctccggctccgcgggggacggagccgcgctgcgccggacgctcagggcgctctaccacccggcaaacacgtacgtcgtgcacctcgacctcgaggctcccgccgccgagcgcgccgagctcgccgctgccgtccgcgccgaccccgtctacgccaggttccgcaacgtcaaggtcgtcacacgggcgaacctggtcacctaccgtggcccgaccatggtggccaatacgctgcacgcggctgccatcctgctgcgcgagggcggtgattgggactggttcatcaacctctccgcctccgactatccactcgtcacccaggacgacctgttgcatgtgctctccgagttgcccaggcagcttaacttcattgagcataccagtgacatcggatggaaggagtaccagagggcgaaaccggtgatcatcgaccctgggctatacagcctgcagaagtctgacgttttctggataacagagaaacggagtgtcccaactgcgttcaagctcttcactggctcggcatggatggtgctcacccaccagtttatcgaatactgcatatggggatgggacaatctcccaaggacagtcctgatgtactacgccaatttcctttcctcgccagagggctacttccacacggtcatctgcaacgtgccggagttccgcaacaccacagtcaaccatgacctgcatttcatttcctgggacaacccaccgaagcagcaccctcactacctcacgctcgctgacttcgacggcatggttaacagcaacgcgccctttgcaaggaagttcgggagagaagaccccgtgctggacaagatcgaccaggagctactgggccgccggcctgatgggtttgtgcccggtggatggacgtatctactgaatgcgacgactgaggaagggagacccttcgccgttgagcgcgtgcaggatctccgcccagggcctggtgtggacagattgaagaaactcgtcacgggcttgctcacacaagaaggctttgatgacaagcactgcctgtgagactgccccccagtaagatgattctggctgggggcggtagattacacggtcaaatcttgagggcattgaagccattttctgggaatatgcctactggctgaagaagcagcacatagtatcatgtgatgtacgcgtggatgcgagcaacggtaagataggtgctcttacagacagccgcctgagttgagctactaccgtacagcaggaggccacggacgtagccggcggagattatacaggaatagtagctcattaggttatgttagatgactatatcagccccttcccaaccgtcaataatgttgggaattttgacatctccgcggcgctgcgggttgtgcaaggcaggcaggcagtccattctttgcttggatgccatggcgcctggtgtaatcaactggtagcgtgtgaggaggcttcgttgtattgactagtgcatatttctgggcaaaacagatgcgtttggttgcacacatgtattcttttatcccttttcctctttgatgatgagtatagcagaaatgatggtgc

SEQ ID NO: 3335 - DNA, 2182 bp, Pennisetum glaucum
cccgcccgccgcgacgcgctcctgcccgtgcccacctccctccctcctccacctccgcagcgcccgcgcggtaacctcaccacgccacgccgcatcgcgtgtgcgagccccaaccgtcgccggcccgcccccaattaaggcgcccccgcggcgcgatccggtggccaccgcccggtccgctgccgccccgccaccgccggagccgaggaggaggaagggggcagcgcagggggggatatgctagaggcgaagccgccgtcgccgggctccggcgcggcggcgcacatccacggccaccggcggtgggcggcgccgctgctcgcgtcggtcctgctctcctcgctcctcatctccgcgtcgctcttcttctcctcctcccgcgcgctgctcctctccttctcgccgctcccgtccgcggcctccgccgagccgctcttcgtcgaggccaagctccgccagcagatgcgggccgaggaccgcccgccccggggcgccgtgcccaggatcgcctacctcgtctccggctccgccggggacggcgccgcgctgcgccggacgctcagggcgctctaccacccggccaacacctacgtcgtgcacctcgacctcgaggcccccgccgccgagcgcgccgagctcgccgcggccatcaggtccgaccccgtctacgccaggttccgcaacgtcaaggtcgtcacacgcgcgaacctcgtcacctaccggggcccgaccatggtggccaacacgctgcacgcggcggccatcctgctacgtgaggggggcgactgggattggttcatcaacctctccgcatccgactacccgctcgtcacccaggacgatctgttacatgtgctctctgagttgcccaggcagcttaacttcatcgagcacaccagtgacatcggatggaaggagtaccagagggcaaaaccagtgatcatcgacccagggctatacagcctgcagaagtctgacgttttctggattacagagaaaaggagtgtcccaactgcattcaaactctttactggctcagcatggatgatgcttactcatcagtttattgaatactgcatatggggatgggacaatctaccacggacagtcctgatgtattatgccaattttctttcttcaccagagggttacttccacacagtcatctgcaatgtcccagagttccgtaacaccacagtcaaccatgatctgcacttcatttcttgggacaacccaccaaagcaacatcctcattatctcacacttgatgattttgatggtatgataaacagtaatgctccctttgcaaggaagtttggaagggaagatcccgtgctggacaagattgaccaggacctattgggccgccaacctgatggatttgtgcctggtggatggacagatgtattaaatacaacagagaaaggaaaacccttcactgttgagcgtgtgcaagatctccgcccagggcctggtgtcgacagactaaagaaacttgtcacaggcttgctcacccaagaaggttttgatgacaagcattgcttgtgaaactcccagttagatgattacgggtcagtagatttacacggtcaaatttgagggcattgagccaattgctagtaatgtctactagctgaaccagccgcacataactcatgtctgcgtggatgcaacgataagataggtgctcttatagacaaccgcttgagtcgagttaccgtacagcaggagatcacggatgtagcaggcggagattatacagaactagtagctcattaggttatggtagaggattatatcagaccccgaccatcaataatcttggaaattttgacatctctgcgctgcgggttgtgcaaggtggcccattgcttgtccggaagccatggcaccgggtatctatcaactggtagcgtgtgagactttgttgtattgaccagcagatatttctgggcaaactgatacatttgattgcatacatgtattcttttatttcttctcctttttgatgagtatagcaaattggttgtgctgttgtcttgcctgcatttggtgtgtgtgcctctgtttatccctcattgttttggttgagagggttgagagggttggaaatgctgttgagatttgattactacctgtttttgttttgttgcttggagttcgtttaatctgagttgctact

SEQ ID NO: 3336 - DNA, 2135 bp, Secale cereale
tcagcgtgacccgccagcgcccctggagagagggaagagaggggagcgagcgagcggtagtctcaccaccaccatcaccaccccaccccacaccaccacccacgacacgccacaacaccaacaccaaccgtcgccggccacatttaatcccgcaccaccaccaccgccgccgcgcgccccggcgactgatccccacggacggagcgcgatcccgccggacgccaggccggaggaggaggaggaagacggatagacacatagattgagaaggggcggggcgcggggcgcgatgatggagaccaagccgccgtcgccggggagcgggggcgcatcgggggcgctgcaccaccacaggcggtgggcggcgccgctgctggcgtccgtgctgctctcgtcgctcctcatctcggcctcccttttcttctcctcctcgcgggcgctactcctctccttctccccgctcccgtccgcggccgcagcggagccgctcttcgtcgaggccaagctgcggcagcagcagcaggaggcgcacgcccgcccgcaccgcgccgtgcccaggatcgcctacctcgtgtccggctccgccggggacggggtcgcgctgcgccggacgctcagggcgctctaccacccggccaaccgctacgtcctgcacctcgacctcgaggcgcccgccgccgagcgcgccgacctggccgccgccgtgcgcgccgaccccgtctactcccgcttccgcaacgtcaaggtcgtcacgcgcgccaacctcgtcacctaccggggcccgaccatggtggccaacacgctgcacgccgccgccatcctcctgcgcgacggcggcgattgggactggttcatcaacctctccgcctccgactaccccctcgtttcgcaggacgatctgttgtttgtgctctctggcttgccaagggagcttaacttcatcgagcataccagtgacatcggatggaaggagtatcagagggcaaagcctgtgatcgtcgacccgggcctatatagcctgcagaagtctgatgttttctggatcacagagaaaagaagtgtgccaaccgcattcaagctcttcactggctctgcatggatgatgcttactcatcggttcattgaatactgcatatggggatgggacaatcttccgaggactgtcctgatgtattatgccaatttcctctcttcgccggagggttacttccacacagtcatctgcaatgtcccagagttccgcaacaccacagtcaaccatgatctacatttcatttcctgggataacccaccaaagcaacatcctcattacctcaccctcaatgactttgacggtatgcttaacagcaatgctccctttgcaaggaagtttggaagagaggatcctgtcctagacaagattgatcaggaaatactgggccgtcaacccgatgggtttgtgcccggtggatggttggatctgttgaatacaacagtgaaaggggaacacttcagcgttgagcgtgtacaagatctccgcccggggcctggtgcggacaggataaagaaacttgtcacaggcctgctcaacgaggaaggcttcgacgacaagcattgcgtataaaaagcttgatgattccaggttaggttacttggtcaaaatctgaggggttgagccactagctagtcattctgctagctgaagaagcggcacatagtgtcgacgatccgcacggatggagtgatctgatgataggtgttccttatagacaaccactttgagttgagttaccgtacagcaggagaccacggccgccgtagcaggcagagattatacaccactaatagctcattaggttatgttagaagattatatcagcccaaccattattaataatatcggaatttttcggtctctcggcgctgctggctgttgtcgaaggtggtccgttcctcctgtagaaaccacagggcccgagccatcagcgcatgagatttcgttgtattaattgtggattcctccgggcaaactgctacgttttggttgcgtacatgtattctttgatttctttttccttctcccagggctgagtatacaaaattgtcttatgcactgtttcctctcttcctttggtaaatatgcatactaagttttt

SEQ ID NO: 3337 - DNA, 2171 bp, Triticum aestivum
cggtagtctcaccaccaccagcaccacccccaccccaccccaccccaccccccacgacacgccacaacaccaacaccaaccgtcgccggccacatttaatcccgcaccaccaccgccgccgcgcgccccggcgactgatccccacggacgcagcgcgatcccgccggacgccaggccggacgaggaggaggagggggcggacaggtggacacgcagattgagaagggggacggggcgggcatcgcgatgatggagaccaagccgccgtcgccggggagcgggggcggatcggcgccgggggtgcaccaccacaggcggtgggcggcgccgctgctggcgtccgtgctgctctcatcgctcctcatctcggcctccctcttcttctcctcgtcgcgggcgctgctcctctccttctccccgctcccctccgcggcccccggggagccgctcttcgtcgaggccaagctgcggcagcagcagcaggaggcgcgcgcccgcccgcaccgcgccgtgcccaggatcgcctacctcgtgtccggctccgccggggacggggtcgcgctgcgccggacgctcagggcgctctaccacccggccaaccgctacgtcctgcacctcgacctcgaggcgcccgccgccgagcgcgccgagctggccgccgccgtgcgcgcagaccccgtctactcccgcttccgcaacgtcaaggtcgtcacgcgcgccaacctcgtcacctaccggggcccgaccatggtggccaacacgctgcacgccgccgccatcctcctgcgcgacggcggcgactgggactggttcatcaacctctccgcctccgactaccccctcgtctcgcaggacgatctgttgtatgtgctctctggcctgccaagggagcttaacttcatcgagcataccagtgacatcggatggaaggagtatcagagggcaaagcccgtgatcgtcgacccaggcctatatagcctgcagaagtccgatgttttctggatcacagagaaaagaagtgtgccgaccgcattcaagctcttcactggctctgcatggatgatgcttactcatcggtttattgaatactgcatatggggatgggacaatcttccaaggacagtcctgatgtattatgccaattttctctcttctccggagggttacttccacacagtcatctgcaatgtcccagagttccgcaacaccacagtcaaccatgacctgcatttcatttcctgggataacccaccaaagcagcatcctcattacctcaccctcaatgactttgacggtatgcttagcagcaatgctccctttgcaaggaagtttggaagagaagaccctgtcctagacaagattgatcaggaaatactgggccgtcaacccgatggattcgtgcccggtggatggttggatctgttgaatacaacagtgaaagggaaacagttcagcgtcgagcgtgtacaagatctccgcccggggcctggtgcggacaggataaagaaactcgtcacaggcctgctcaccgaggaaggctttgatgacaagcattgcgtataaaaacttgatggttcgagggtaggtttcttttgtcaaaatctgagcggttgagccactagctagtcattctactagctgaagaaacggcacacagtgtcgacagtccgcacggatggagtgatctgataggtgttccttatagacaaccacttctgagttgagttaccgtacagcaggattccacgaccgccgtagcaggcagagattatacaccactaatagctcattaggttatgttagaagaatatatcatattaataatattggaattttccggtctctcagcgctgcgggctgttgtccaaggtggtccattcttcttgtagaaaccgtttgggctcgatctaccttaggaaggagcctacaagtgcatgagatttcgttgtattaattgtggattcctccaggcaaactgctacgttttggttgcgtacatgtattctttgattatttttctttctcccacggctgagtatacaaaattatcttatgcactgtttcttcttattctttctttggtaaagatgcatactccaaaatatttgtcgtgattttagttcaaatgtgatatgtgctgttgacaactggaatatctgatgtttgcattg

SEQ ID NO: 3338 - DNA, 1738 bp, Echinochloa colona
cgcgtcggtcctgctctcctcgctcctcatctccgcctcgctcttcttctcctcctcccgcgcgctgctcctctccttctcgccgctcccctccgcggcctccgccgagccgctcttcgtcgaggccaagctccgccagcagatgcgcgccgacgaccgccctccccggggcgccgtgcccaggatcgcctacctcgtctccggctccgccggggacggcgccgccctgcgccggacgctcagggcgctctaccacccggccaacacctacgtcgtgcacctcgacctcgaggcacccgccgccgagcgcgccgacctcgccgccgccatccgggccgaccccgtctacgccaagttccgcaacgtcagggtcgtcacacgcgcgaacctcgtcacctaccggggcccgaccatggtggccaacacgctgcacgcggcggccatcctgctgcgggagggaggcgattgggattggttcatcaacctctccgcatccgactacccgctcgtcacccaggacgatctgttgcatgtgctatctgagttgcccaggcagcttaacttcatcgagcataccagtgacatcggatggaaggagtaccagagggcaaaaccagtgatcatcgaccctgggctatacagcctgcagaagtctgatgttttctggatcacagagaaaaggagtgtcccaactgcattcaagctctttactggctcagcatggatgatgcttactcatcaatttattgaatactgcatatggggatgggacaatttaccaaggactgtcctgatgtattatgccaattttctttcttcaccagagggttacttccacacagtcatatgcaatgttccggagttccgcaacaccacagtcaaccatgacctacatttcatttcttgggacaacccaccaaagcaacatcctcattatctcacactcgatgactttgatggtatggttaacagtaatgctccctttgcaaggaagtttggaagagaagatcctgtgcttgacaagatcgaccaggaactattgggccgccgacctgatggatttgtgcctggtggatggacagatctgttgaatacaactgagaaaggaagacccttcactgttgagcgtgtgcaagatctccgcccagggcctggtgtggacagattaaagaaactcgtcacaggcttgatcacccaagaaggttttgatgacaagcattgcttgtgaaactcccagtaagatgattctggggcagtagatttacacggtcagatttgagggcattgagccatttgctagtaatgtctactagctgaagaagcagcacataactcatgtccgtgtggatggaaccataagataggtgctcttatagacaaccgcttgagttgagttaccgtacagcaggagaccacggatgtagcaggcggagattatacagaactagtagctcattaggttatggtagatgattatatcagccccaaccatcaataatcttggaatttttgacatctctgcgctgcgggttgtgcaaggtggcccattgcttgttcggaagccatggcaccgggtatttaccaactggtagcgcatgagacttcgttgtattgactagcggatatttctgggcaaactgatacatttgattgcacacatgtattcttttatttcttctccttttttgatgagtatagaaaaatgcttgtgatgttgtcttgcctgcatttggtgcac

SEQ ID NO: 3339 - DNA, 1808 bp, Triticum aestivum
ctcatctcggcctccctcttcttctcctcgtcgcgggcgctgctcctctccttctccccgctcccgaccgcggcctccgcggagccgctcttcgtcgaggccaagctgcggcagcagcagcaggaggcgcacgcccgcccgcaccgcgccgtgcccaggatcgcctacctcgtgtccggctccgccggggacggggtcgcgctgcgccggacgctcagggcgctctaccacccggccaaccgctacgtcctgcacctcgacctcgaggcgcccgccgccgagcgcgccgagctggccgccgccgtgcgcgccgaccccgtctactcccgcttccgcaacgtcaaggtcgtcacgcgcgccaacctcgtcacctaccggggcccgaccatggtggccaacacgctgcacgccgccgccatcctcctgcgcgacggcggcgattgggactggttcatcaacctctccgcctccgactaccccctcgtctcgcaggacgatctcttgtatgtgctctctggcttgccaagggagcttaacttcatcgagcataccagtgacatcggatggaaggagtatcagagggcaaagcctgtgatcgtcgacccgggcctatatagcctgcagaagtctgatgttttctggattacggagaaaagaagtgtgccaaccgcattcaagctcttcactggctctgcatggatgatgcttactcatcggtttattgaatactgcatatggggatgggacaatcttccgaggactgtcctgatgtattatgccaatttcctctcttcgccggagggttacttccacacagtcatctgcaatgtcccagagttccgcaacaccacagtcaaccatgatctacatttcatttcctgggataacccaccaaagcaacatcctcattacctcaccctcaatgactttgacggtatgcttaacagcaatgctccctttgcaaggaagtttggaagagaggatcctgtcctagacaagattgatcaggaaatactgggccgtcaacccgatgggtttgtgcccggtggatggttggatctgttgaatacaacagtgaaagggaaacacttcagcgtcgagcgtgtacaagatctccgcccggggcctggtgcggacaggataaagaaactcgtcacaggcctgctcaccgaggaaggcttcgacgacaagcattgcgtataaaaagcttgatgattccagggtaggttactttggtcaaaatctgaggtgttgagccactagctagtcattctgctagctgaagaagcggcacatagtgtcgacgatccgcacggatggagtgatctgataggtgttccttatagactaccactttgagttgagttaccgtacagcaggagaccacggccgccgtagcatgcagagtttatacaccactaatagctcattaggttatgttagaagattatatcagcccaaccattattaataatatcggaatttttcggtctctcggcgctgctggctgtcgtcgaaggtggtccgttcttcctgtagaaaccacagggcccgagccatcagcgcatgagatttcgttgtattaattgtggattcctcggggcaaacttctacgttttggttgcgtacatgtattctttgatttcttttccttctcccacggctgagtatacaaaattgtcttatgcactgtttcctctcttcctttggtaaatatgcacactaagtttttgttggagcttaaatggtactctgtctgttcacaattataagatgttctactcccacggctgagtagcttttttctt

SEQ ID NO: 3340 - DNA, 1720 bp, Saccharum officinarum
ccagccatggagacggcttccttcctctcggtggcgctggccctggcggccctcgtccccgtctcgctgctcctcctgaaccggctcctctacggcaagctgccaccggggccgcggcgccggcccgtggtgggcaacctgttcgacgtgcagcccgtgcggtgccggtgctaccaggagtgggcgcggcggtacgggcccatcatgacggtgtggctcggcacgtcgcccacggtggtggtgtccacgtcggagctggccaaggaggtgctcaagacccacgaccagcagctcgccgaccgctgccgggaccgctccacggagagcttcagccgcggcggacaagacctcatctgggccgactacggccctcactacatcaaggtccgcaagctctgcaacctcgagctcttcacgcagcgccgcctcgaggcgctcaggcccatccgcgaggacgaggtcactgccatggtcgagtccgtctacaaggccgtcacctcgcctggcaatgaagggaagccgttggtggtaaagaaccacctgtcgatggtggccttcaacaacatcacgcggctggcgttcgggaagcggttcgtgaacgcggccggcgagctggacgagcaagggcgcgagttcaaggggatcgttcacaacggcatcaagatcggcgcgtccctctccatcgcgcagcacatcccgtggctgcggtggctggcccccgtcgacgagcaggtcttcaaagcccacggcgaacggcgcgaccgcctcaccgtgaagatcatggaggagcacgccaaggccctcaagcagcgcggcgcccagcagcatttcgtcgacgcgctcttcactctcagggacaagtacgacctcagcgacgacacggtcataggcctcctctgggacatgatcaccgccggcacagacacgacggtgatctcggtggagtgggcaatggcggagctgctgaggaaccccagggtgcaggagaagctgcaggaggagctggaccacgtcgtcggccgcgaccgggtcctgtcagagacggacttcccgaacctgccctacctgcaggccgtcgtcaaggagtccctccgcctgcacccgccgacgccgctgatgctgccccacagggccagcgccagcgtcaagatcgccggctacgacatccccaagggcgccaacgtcgtcgtcaacgtgtgggcggtggcacgcgaccccgcggtgtgggacagcccgctcgagttccggccggagcggttcctccgggagaacatcgacatcaagggcgccgacttccgcgtgctgccgttcggcgccggccggcgggtgtgccccggcgcgcagctcgggatcaacctcgtggcctccatgatcggccacatgctgcaccacttcaggtggacgctgccggaggggacccggcccgaggacgtgagcatgatggagtcccccggtctcgtcaccttcatggccacgccgctgcaggccgttgccacgccgcgcctggacaaggaggagctgtacaggcgtgtcccttcggagatctgagccgtctgcgtcttggcatctgcattatgttcccggttgtggaagctgatgccggtgcaaatttgcccgcacccaccattatctcttttctggcacggtgctgtgcgtgtacgagcgttttgttcatctgtactgcagcccgtgctcgctggacaaacgctttcgctgttgc

SEQ ID NO: 3341 - DNA, 1992 bp, Zea mays
gatgacccctccgctgcgccaaccaacccaccctggtccacgggcgtcacggcactgctacagtgctacaaaccaactacctaccaccactccggcagtccggctagctccataaaggcgcagccggccggctggccggtagcagtcagccagccagccagccatggagacggcctccttcctctcagtggcgctggccctggcggccctcgtccccgtctcgctgctccttgtgaaccggctcctctacggcaaactgcccccggggccgcggcggcgtcccgtggtgggtaacctgttcgacgtgcagcccgtgcggtgccggtgctaccaggagtgggcgcgccggtacgggcccatcatgacggtgtggctgggcacgtcgcccacggtggtggtgtccacgtcggagctggccaaggaggtgctcaagacccacgaccagcagctcgccgaccgctgccgggaccgctccaccgagagcttcagccgaggcggccaggacctcatctgggccgactacggcccccactacatcaaggtgcgcaagctctgcaacctcgagctcttcacgcagcgccgcctcgaggcgctcaggcccatccgcgaggacgaggtcaccgccatggtcgagtccgtctacaaagccgtcaccgcgcctggcagtgcagggaagccgttggttgtaaagaaccacctctcgatggtggccttcaacaacatcacgcggctggccttcgggaagcggttcgtggacgcggccggcgagctggacgagcaagggcgcgagttcaaggggatcgtccacaacggcatcaagatcggtgcgtccctctccatcgcgcagcacatcccgtggctacgctggctggccccggtcgacgagcaggccttcaaagcccacggcgaacggcgcgaccgcctcaccgtgaagatcatggaggagcacgccagggccctcaagcagcgcggcgcccagcagcacttcgtcgacgcgctcttcactctcagggacaagtacgacctcagcgatgacaccgtcataggcctcctctgggacatgatcaccgccggcacggacacgacggtgatctcggtggagtgggcgatggcggagctgctgaggaaccccagagtgcaggagaagctgcaggaggagctggaccgtgtcgtcggccgcgaccgggtcctgtcggagacggacttcccgaacctgccttacctgcaggccgtcgtcaaggagtccctgcgcctgcacccgccgacgccgctgatgctcccccacagggccagcgccagcgtcaagatcgccggctacgacatccccaagggcgccaacgtcgtcgtcaacgtgtgggcggtggcgcgcgaccccgaggtgtgggacagcccgctcgagttccggccggagcggttcctccgggagaacatcgacatcaagggcgccgacttccgcgtgctgccgttcggcgccggccgccgggtgtgccccggcgcgcagctcgggatcaacctcgtggcgtccatgatcggccacatgctgcaccacttcacgtggacgctgccgagcgggacctgtcccgaggacgtgagcatgatggagtcccccgggctcgtcaccttcatggccacgccgctgcaggccgtcgccacgccgcgcctggacaaggaggaactgtacaggcgtgtcccttcggacgtgtgagccgtcggcgtcctggcatctgctgcgttccctgttttgaaacctgctgctgctgttgcgaatttgtgtaccattaactattcgctggtgatgtacgtgtcatagtcgtgtacgagcattttgtgtactgcagaacttgatcgctgagcatacacttttgcccggtagtaatttacaatttcagcattgcaaattactattagtacgtcgcagaaaacagtgtaaagctcgaaattgagacctcgcgaatatgcaccagcctcctcgaaattgagacctcacgaata

SEQ ID NO: 3342 - DNA, 1877 bp, Leymus cinereus x Leymus triticoides
tcgctcccgtacctaccaccactccgcgaacagtcagccatggacacggccaccttgctcccggtggctctggccctcctggccatccccgtcacggcgctcctcctcaaccggctccgcttcggcaagctgcccccggggccgcggccgtggccggtgctcggcaacctgttccaaatccagcccgtgcggtgccggtgcttcgccgagtgggcggggcggtacgggcccatcatgacggtgtggttcggctcgtcgccgatggtggtggtgtcgacgtcggagctggcgcaggaggtgctcaagacccacgaccagcagctggccgaccgctcgcggaaccgctcgtcggagcgcttcagccgcggcggcatggacctcatctgggccgactacggcccgcactacatcaaggtgcgcaagttctgcaacctcgagctcttcacgccgcggcggctcgaggcgctccgccccatccgcgaggacgaggtcaccgccatggtcgagtccgtgtacagagccggcaaggaagggaagccagtggcggtgcgggagttcctggccatggtgggcttcaacaacatcacacggttggccttcgggaagcggttcctgaacgcggcgggcgagctggacgagcaaggacgcgagttcaaggagatcgtcaataacgggatcaagatcggcgcgtcgctgtccatcgccgagcacatccggtggctccggtggctgacgccggtcgacgaggtggcctatcaagcccacggcgacaggcgcgaccggctcaccgtcaagatcatggaggagcacgccagggccctggagcggagcggcaccagcaagcagcatttcgtcgacgcgctcttcactctccgggagaagtacgacctcagcgacgacaccgtcattggcctcctttgggacatgatcaccgccggcacggacacgacggtgataaccgtggagtgggcggtaggggagctggtgaggaaccccatggtgcagcagaaggtgcaggaggagctggaccgggtggtcggccgcgaccgggtcctgtcggagacggacttcccgaacctgccgtacctgcaggccgtcgtgaaggagtcgctccggctgcacccgccgacgccgctgatgctcccgcacagggccagcgccgccgtgaaggtcgccggctacgacatccccaagggagccagcgtcacggtgaacgtgtgggcaattgcgcgcgaccccaaggtgtgggacagcccgctcgagttccggcccgagcgcttcctccacgagaacatcgacatcaagggctgcgactaccgcgtgctgccgttcggcgccggccgccgggtgtgccccggcgcgcagctcgggatcaacctcgtggcgtccatgatcgggcacctcctgcaccacttcacctgggcgctgccggacgggacccggacggaggacctcgacatgatggagtcccccgggctcatcacgttcatgcgcacgccgctgcaggtcgtcgccacgccgcgcctcgaaaaggaggagctgtacaaacgggtgcccgtcgagatgtgagcgacctgcgagtgcgccctcatgcgtcccggccggtggttcagagctcaggcttcaaattaaagtgctgttgacatgtgtttttttttcgagttcttcgtggctactacacctatgcatttattttgtacttcatccatatactcgtgggacagtatgaattttttttctatacagggaccagactgcactatgcgtcagcactattgttttgttttgtttgggcatattcgaatctgacaatgctatttttcctggcctaaattgcaaggaatttcttataaaggaatctgactttgttgattgga

SEQ ID NO: 3343 - DNA, 1582 bp, Echinochloa colona
gctaccaggagtgggcgcgccggtacgggcccatcatgacggtgtggctgggcacgggcccgacggtggtggtgtccacgtcggagctggcccgggaggtgctcaagacccacgaccagcagctcgccgaccgccaccgcgaccgctcctcggagcgcttcagccgcggcggcaaggacctcatctgggccgactacggcccgcactacatcaaggtccgcaagctctgcaacctcgagctcttcacgccgcgccgcctcgaggcgctcaggcccatccgagaggacgaggtcaccgccatggtcgagtccgtccacagggccgtcaccgcgcctggcaacgcagggaagccgttggtggtgaggacccacctgtcgatggtggccttcaacaacatcacgaggctggccttcgggaagcggttcgtgaatgcggccggcgagctcgacgagcaaggccgcgagttcaaggcgatcgtcaccgaggggatcaagatcggcgggtccctctccatcgcgaagcacatcccgtggctgcggtggctggccccggtcgacgaccagctcttcaaggcccacggcgaccggcgcgaccgcctcaccgtcaagatcatggaggagcacgccaggtccctcaagcagcgcggcgcccagcaccacttcgtcgacgccctcttcaccctcagggaccagtacgatctcagcgacgacaccgtcatcggcctcctctgggacatgatcaccgccggcgccgacacgacggtgatctcggtggagtgggcgatggcggagctggtgcggaacccccgggtgcaggagaagctgcaggaggagctggaccgcgtcgtgggccgcgaccgtgtcctgcaggagacggacttcccgagcctcccctacctgcaggccgtcgtcaaggagtcgctccggctgcacccgccgacgccgctgatgctcccgcacaaggccagcgccgccgtcaagatcgccggctacaccatccccaagggcgccaacgtgatcgtcaacgtctgggcggtggcgcgggaccccgcggtctgggacagcccgctcgagttccggccggagcgcttcctcacggagagcatcgacatcaagggcgccgacttccgggtgctcccgttcggcgccggccgtcgggtgtgccccggcgcgcagctcgggatcaacctggtggcgaccatgatcgggcacatgctgcaccacttcagctggtcgctgccggaggggacgcgccccgaggacgtggagatgatggagacgcctgggctcgtcacgttcatggccacgccgctcaaggccgtcgccacgccgcgcctcgacaaggaggagctctacaggcgtgtgccgtccgagatatgagggcgagctggcggcgtctgcctgcattccccgctttggacgtttatttggaagccgacgtccgtattaccattgtctctgttcgatctgggtgtcacgagcacttgtgtacttcagaacttgcacgctggttgccactttgtcaggcagtaatttataattttggcaccaagaaatcttcttatatacaccatattacgttc

SEQ ID NO: 3344 - DNA, 2033 bp, Triticum aestivum
caccactcccactccgggcgagaagagcccaagagtcaggcatggacacggccaccttgctcccggtggcgctggccctcctggccatccccgtcacggcgctcctcctcaaccggctccgcttcggcaggctgccaccggggccgcgcccgtggccggtgctgggcaacctcttccaaatccagcccgtgcgctgccggtgcttcgccgagtgggcggcccggtacgggcccatcatgacggtctggttcggctcgacgccgatggtggtggtgtccacgccggagctggcgcaggaggtgctcaggacccacgaccagcacctggccgaccgctcgcggaaccgctcctcggagcgcttcagccgcggcggcatggacctcatctgggccgactacggcccgcactacatcaaggtgcgcaagctctgtaacctcgagctcttcacgccccgccgcctcgaggcgctccgccccgtccgcgaggacgaggtcaccgccatggtcgagtccgtgcacgcggccggcaagggaggcaggcccgtggcggtgcgggagttcctcgctatggtcggcttcaacaacatcacgcggctcgccttcgggaagcggttcctgaccgcggccggcgagctggacgagcaagggcgcgagttcaaggagatcgtcaacaacgggatcaagatcggcgcgtcgctgtccatcgccgagcacatccggtggctccggtggctcacgcccgtcgacgaggtggcctatcaagcccacggcgacaggcgcgaccggctcaccgtcaagatcatggaggagcacgccagggccctcgagcggagcggcgccagcaagcagcatttcgtcgacgcgctcttcacgctccgggacaagtacgacctcagtgacgacaccgtcattggcctcctctgggacatgatcaccgccggcacggacacgacggtgataaccgtggagtgggcggtagcggagctggtgaggaacccgatggtgcagcagaaggtgcaggaggagctggaccgggtggtcggccgcgaccgggtgctgtcggagacggacttccccaacctgccctacctgcaggccgtcgtgaaggagtcgctccggctgcacccgccgacgccgctgatgctgccgcacagggccagcgccgccgtgaaggtcgccggctacgacatccccaagggagccagcgtcacggtgaacgtgtgggcgatcgcgcgcgaccccaaggcgtgggacagcccgctcgagttccggcccgagcgcttcctccacgacaacatcgacatcaagggctgcgactaccgcgtgctgccgttcggcgccggccgccgggtgtgccccggcgcgcagctcgggatcaacctcgtggcgtccatgatcggccacctcctgcaccacttcacctgggcgctgccggacgggacccggacggaggacctcgacatgatggagtcccccgggctcatcaccttcatgcgcacgccgctgcaggtcgtcgccacgccgcgcctcgaaaaggaagagctctacaagcgggtggccgccgagatgtgagcgacctgggactcctggtggttcagagttcatgcttcaaattaagtgttgacgtgtcttttttcgagttcttcgtagctactatcggtacctatgcatttattttgttgttaatccatgaatatactcgtggtacaatatgatttcttttttgcgatagaacttgtattactcaatcaccaggattacaatcagggagacacaagttctcaacgtcctcaggaccagagcatatagccaaacaacactacgattgccatgtctccagaaaggtcttgcctcttcttcttcttccacgcattcaccatctccaaacaatccacttcaaggtgaatagggccatcgcaccaattcagggatagatccataccttccctagctgcaatcaactcagcttctagagcactcaaacatcgattcaaattctgtcagggaagtcgtggaatataagagaaagaagaa

SEQ ID NO: 3345 - DNA, 2663 bp, Setaria italica
gcaccgttgcttagatgataaaggcaagcaaacaagggatggtccaaataaagcttgggccgcgctgccacctcgcctaaataaaacactctcccacgcacaaccaccacggcgccctgctcctcctcctcttcctccaccagctgctcagtccagtccctcctcactagctgagtgaattagactgctcactagctcagctcagctcagcccagctgtgaagagtcggagtggtggtcgccggggagagtagagactagagagcggtgttcagctcatcagctgagctgagcttgggagggagagagggagcttgaaagaggaggagagaggcggcgaagatgattacgggggcggacttctaccacgtgatgacggccatggtgccgctgtacgtggcgatgatcctggcgtacgggtcggtgcggtggtggcgcatcttctcgccggaccagtgttccgggatcaaccgcttcgtggcgctcttcgccgtgccgttgctgtccttccacttcatctccaccaacaacccctacaccatgaacctgcgcttcatcgccgccgacacgctgcagaagctcatggtgctcgccatgctcaccgcatggagccacctcagccgccggggcagcctcgagtggaccatcacgctcttctccctctccacgctgcccaacacgctcgtcatgggcatcccgctgctcaagggcatgtatggcgacttctccggcagcctcatggtgcagatcgtcgtgctccagtgcatcatctggtacacgctcatgctcttcatgttcgagtaccgcggcgcgcggatgctcatcaccgagcagttcccggacaccgcgggggccatcgcctccatcgtcgtcgacccggacgtcgtctcgctcgacggccggagggacgccatcgagaccgaggcagaggtcaaggaggacggcaagatacacgtcaccgtgcgccgctccaacgcctcccgctccgacatctactcgcgccgctccatgggcttctccagcaccacgccgcgccccagcaacctcaccaacgccgagatctactcgctccagtcgtcgcgcaaccccacgccgcggggctccagcttcaaccacaacgacttctactccatggtcggccgcagctccaacttcggcgccgccgacgccttcggcatccgcaccggcgccacgccgcgcccctcaaactacgaggacgacgcctccaagcccaagtaccctctccccgtcgtgaatgcggctcccggggccggccactaccccgcgcccaacccggcggtggccgcggcgcccaagggcgccaagaaggccgccaccaacggccaggccaagggcgaggacctccacatgttcgtctggagctccagcgcctcgccggtctccgacgtcttcggcggcggcgcgccggactacaacgacgccgcggccgccaagtccccccgtaaaatggatggagcgaaggagcgggacgactacgtggagcgcgacgagttcagcttcgggaacaggggcgccatggacagggacgccgaggcaggggacgagaaggccgcggtggcgggcggcggcgaccccaacgcggtggcggcgccgacggcgatgccgcccacgagcgtgatgacccggctgatcctgatcatggtgtggcgcaagctcatccgcaaccccaacacctactccagcctcatcggcctcatctggtcgctcgtctgcttcaggtggaacttcgagatgccggccatcgtcctgaaatccatctccatcctgtcggacgcggggctcgggatggccatgttcagtctcgggctgttcatggcgctgcagccgcggatcatcgcgtgcggcaacaaggtggcgacgttcgccatggccgtgcgcttcctgaccgggccggccgtgatggcggccgcgtccttcgccgtgggcctccgcggcacgcttctgcacgtcgccatcgtccaggcagcgctgccccagggcattgtccccttcgtcttcgcaaaggagtacaacgtgcaccctgacattctcagcaccgcagtcatttttggcatgctcatcgcgctgccgatcacgctcgtctactacatcctgcttgggctgtgagtgccacgccgccattgctgtaaaaaggctaccaccaccgaagatcaggggaggagcaaaaggaggacagagctagctacaacgacactgcttggcttggcgcttgcaaaatgagtgacttgtttctttctttctttcttttcttcttctttcttttttctagaagtaggtatgggggattgggaggatggaaaggggaaggtggacaagacgttagctagctaggacgacaatggtgaggcaaaaggcaccaaaagcaggtacaagtacaaagcttgaagggaacaggagatcatccagtttcagcaggtcacgagttgtggggtttcggtgaggtgaggtctctcaacgggttgttttggggattctggttggccgcctgaccgctgtaaaatggacgccattctgacaagagatcaatcttgctttgctcatctcatgagtttgatgaattgagatggtactgtcagttttcttggtaactatatttgatcaaatggatccaatcgccaagctagatcgtgcatgtctagttcc

SEQ ID NO: 3346 - DNA, 2630 bp, Zea mays
aaataaatcactcccacgcacacccaccaccgcgccgagcacctcctccttcccttccttctctctcccaccctcctcactagctctatctagctgagtgaactgaacagcccactggctcgtcttagctaagctcagctgtaaagctaaggttcggagtagctagcgtggtggccggagagtgtagcgagcggcgttcagctcaccgggggctgctgggtgagtgagggagccagcgtcgtgagagcgctccaagatgattacggggacggacttctaccacgtcatgacggccgtggtgccgctgtacgtggcgatgatcctggcctacgggtcggtgcggtggtggcgcatcttctcgccggaccagtgctccgggatcaaccgcttcgtggcgctcttcgcggtgccgctgctgtccttccacttcatctccaccaacaacccctacaccatgaacctgcgcttcatcgccgccgacacgctgcagaagctcatggtgctggccatgctcaccgcgtggagccacctcagccgccggggcagcctggagtggaccatcacgctcttctccctctccacgctgcccaacacgctcgtcatgggcatccccctgctcaagggcatgtacggcgacttctccggcagcctcatggtgcagatcgtcgtgctccagtgcatcatctggtacacgctcatgctcttcatgttcgagtaccgcggcgcgcggatgctcatcaccgagcagttcccggacaacgccggggccatcgcctccatcgtcgtcgacccggacgtggtctccctcgacggccgcagggacgccatcgagacggaggccgaggtcaaggaggacggcaggatacacgtcaccgtgcgccgctccaacgcctcgcgctccgacatctactcgcgccgctccatgggcttctccagcaccacgccgcgccccagcaacctgaccaacgccgagatctactcgctgcagtcgtcgcgcaacccgaccccgcggggctccagcttcaaccacaacgacttctactccatggtcggccgcagctccaacttcggcgcggccgacgcgttcggcatccgcaccggcgccacgccgcgcccgtccaactacgaggacgacgcgtccaagcccaagtaccctctccccgtggtgaatgcgacgtccggggcgggggcggctcactaccccgcgccgaacccggccgtggccgcggcgcccaagggcgccaggaaggcggcgacgaacgggcaggccaagggcgaggacctccacatgttcgtctggagctccagcgcgtcgcccgtgtcggacgtcttcggcggtggcgccccggactacaacgaggccgcggccgccaagtccccccgcaaaatggatggaggcaaggacagggacgactacgtggagcgcgacgagttcagcttcgggaacaggggcgcgatggacagggacgcggaggcgggggacgggaaagccgcggcggcgggcggggaccccagcacggtggccgcgccgacggcgatgccgccgacgagcgtcatgacccggctgatcctgatcatggtgtggcgcaagctcatccgcaacccaaacacctactccagcctcatcggcgtcatctggtcgctcgtctgcttcaggtggaacttccagatgccggccatcgtcctgcagtccatctccatcctgtcggacgcggggctcgggatggccatgttcagtctcgggctgttcatggcgctgcagccgcggatcatcgcgtgcgggaacaaggtggcgacgttcgccatggcggtgcgcttcctgaccggtccggcggttatggcggccgcgtccttcgccgtgggcctccgcggcacgcttctgcacgtcgccatcgtccaggcagctctgcctcagggcattgtccccttcgtcttcgcaaaggagtacaacgtgcaccctgacattctcagcaccgcagtcatttttggcatgctcatcgccctgccgatcacgctcgtctactacatcctgctcggcctgtgaccgacccgtgggtgatggcaatggcatgccccgcattgctgtaactgtaaagaccgctgctgccactttccgttcaagggaggcaagtgaggagactgtctgctacgacatttgcttggcgcttcaaaaatgagtggcttgtttctctctctcttctatctattttttattttttctctagaagtaggtgtgaggattgtatggatggaaagtgtgggaggtggacaagtcgcggtagctaggtaggacgacaatggtgaggcaaaacggaccaaaaggaggtgcaagtacaaaagcttgaagggaacaggagatccagtttaagcacgtcacgggatgggttggatatttcaacgggttcagggtattttggttggctgcgctgaccgatgtaaaatcagcgcgccattgtgacaggagatcgatcttgcttgagataaacagctcacctccggagtttgatggcttgagataagggctcaactcaaaatagacagaaatatataccgtatttgtcactgaaacaaatcagtcttttatacacttggtattttaaaaaaaattgaactttcttattcgacttgga

SEQ ID NO: 3347 - DNA, 2396 bp, Oryza sativa
gcacgcgcacacacccaatcaaatgctcctcctccgccgcctcctctcgctgagctgagctgagctgtgaaatagtgccaccgagtgagcgctgagctgagctcgaagcaagagaggaagaggaggaggagggaagagggggggcgaagatgattacggcggcggacttctaccacgtgatgacggcgatggtgccgttgtacgtggcgatgatactggcgtacgggtcggtgaagtggtggcgcatcttcacgccggaccagtgctccgggatcaaccgcttcgtggcgctcttcgccgtgccgctgctgtcgttccacttcatctccaccaacaacccgtacacgatgaacctccggttcatcgccgccgacacgctgcagaagctgatggtgctggccatgctcacggcgtggagccacctcagccgccgggggagcctcgagtggaccatcacgctcttctccctctccacgctgcccaacacgctcgtcatggggatccctttgctcaagggcatgtacggggagttctccggcagcctcatggtgcagatcgtcgtgctgcagtgcatcatctggtacacgctcatgctcttcatgttcgagtaccgcggcgcccggatgctcatcaccgagcagttcccggacaccgccgccaacatcgcctccatcgtcgtcgacccggacgtcgtgtcgctggacggcaggagggacgccatcgagacggagacggaggtgaaggaggacggcaggatacacgtcaccgtgcgccgctccaacgcgtctcgctcggacatctactcccgccgctccatgggcttctccagcaccacgccgcggccgagcaacctcaccaacgccgagatctactcgctgcagtcgtcgcggaacccgacgccgaggggttcaagcttcaaccacaccgacttctactccatggtgggccgcagctccaacttcggcgcggccgacgcgttcggcgtccgcaccggcgccacgccgcgcccgtccaactacgaggacgacgcgtccaagcccaagtacccgctcccggcgtcgaatgcggcgcccatggcgggccactacccggcgccgaacccggccgtgtcgtcggcgcccaagggcgccaagaaggcggccacgaacgggcaggccaagggcgaggacctccacatgttcgtctggagctccagcgcgtcgcccgtgtccgacgtcttcggcggcggcgcgccagactacaacgacgccgcggcagtcaagtccccccgcaaaatggatggagcgaaggacagggaggactacgtggagcgggacgatttcagcttcgggaacaggggcgtcatggacagggacgcggaggcaggggacgagaaggcggcggcggcggcgggcgccgaccccagcaaggccatggcggcgccgacggcgatgccgccgacgagcgtgatgacccgcctcatcctgatcatggtgtggcgcaagctcatccgcaacccgaacacctactccagcctcatcggcctcatctggtccctcgtctgcttcaggtggaacttcgagatgccggccatcgtcctgaaatccatctcgatcctgtcggacgcggggctcggcatggccatgttcagtctcggtctgttcatggcgctgcagccgcacatcatcgcgtgcgggaacaaggtggcgacgtacgccatggcggtgcggttcctggccgggccggccgtgatggcggcggcgtccttcgccgtcggactccgtggcacgctcctgcacgtcgccattgtccaggcagctctgccccagggcattgtccccttcgtcttcgccaaggagtacagcgtgcaccctagcattctcagcacagctgtcatctttggcatgctcatcgccttgcctatcaccctcgtctactacatcttgcttgggctgtaatcgagttgcatgcatgtaaattcctgctcctgacaaccagccatgttaagaagaggggagaagaagacagagctggtacactgtttgcaaagtcaggactctttgatttttcttttcttttctgtatttcttgaagtagaatttgggaggagggggattggaagggagtcaaacgagtcaaggggaggacaggatggtagctagcttagctaggacaatggtgagtcacaaaagagcaccaaaagcaagtacaagtacaaagcttggggggacacaggatccagttcaggtcacagaaacggttcggttttgggaggggattgtgggagttttggttggctgcgctgcgctgacccttgtaaaacggacgccgattctgacaagagatcgaccttgttttgttcgtgtcgtggtattgctgactactactttggaatgattaatctcctactactaatt

SEQ ID NO: 3348 - DNA, 2466 bp, Oryza sativa
gagctcgggccgcgctgccatctcgcctaaataaaaccgcgctacccatcgaccgatcctactcgcacgcgcacacacccaatcaaatgctcctcctccgccgcctcctctcgctgagctgagctgagctgtgaaatagtgccaccgagtgagcgctgagctgagctcgaagcaagagaggaagaggaggaggagggaagagggggggcgaagatgattacggcggcggacttctaccacgtgatgacggcgatggtgccgttgtacgtggcgatgatactggcgtacgggtcggtgaagtggtggcgcatcttcacgccggaccagtgctccgggatcaaccgctttgtggcgctcttcgccgtgccgctgctgtcgttccacttcatctccaccaacaacccgtacacgatgaacctccggttcatcgccgccgacacgctgcagaagctgatggtgctggccatgctcacggcgtggagccacctcagccgccgggggagcctcgagtggaccatcacgctcttctccctctccacgctgcccaacacgctcgtcatggggatccctttgctcaagggcatgtacggggagttctccggcagcctcatggtgcagatcgtcgtgctgcagtgcatcatctggtacacgctcatgctcttcatgttcgagtaccgcggcgcccggatgctcatcaccgagcagttcccggacaccgccgccaacatcgcctccatcgtcgtcgacccggacgtcgtgtcgctggacggcaggagggacgccatcgagacggagacggaggtgaaggaggacggcaggatacacgtcaccgtgcgccgctccaacgcatctcgctcggacatctactcccgccgctccatgggcttctccagcaccacgccgcggccgagcaacctcaccaacgccgagatctactcgctgcagtcgtcgcggaacccgacgccgaggggttcaagcttcaaccacaccgacttctactccatggtgggccgcagctccaacttcggcgcggccgacgcgttcggcgtccgcaccggcgccacgccgcgcccgtccaactacgaggacgacgcgtccaagcccaagtacccgctcccggcgtcgaatgcggcgcccatggcgggccactacccggcgccgaacccggccgtgtcgtcggcgcccaagggcgccaagaaggcggccacgaacgggcaggccaagggcgaggacctccacatgttcgtctggagctccagcgcgtcgcccgtgtccgacgtcttcggcggcggcgcgccagactacaacgacgccgcggcagtcaagtccccccgcaaaatggatggagcgaaggacagggaggactacgtggagcgggacgatttcagcttcgggaacaggggcgtcatggacagggacgcggaggcaggggacgagaaggcggcggcggcggcgggcgccgaccccagcaaggccatggcggcgccgacggcgatgccgccgacgagcgtgatgacccgcctcatcctgatcatggtgtggcgcaagctcatccgcaacccgaacacctactccagcctcatcggcctcatctggtccctcgtctgcttcaggtggaacttcgagatgccggccatcgtcctgaaatccatctcgatcctgtcggacgcggggctcggcatggccatgttcagtctcggtctgttcatggcgctgcagccgcacatcatcgcgtgcgggaacaaggtggcgacgtacgccatggcggtgcggttcctggccgggccggccgtgatggcggcggcgtccttcgccgtcggactccgtggcacgctcctgcacgtcgccattgtccaggcagctctgccccagggcattgtccccttcgtcttcgccaaggagtacagcgtgcaccctagcattctcagcacagctgtcatctttggcatgctcatcgccttgcctatcaccctcgtctactacatcttgcttgggctgtaatcgagttgcatgcatgtaaattcctgctcctgacaaccagccatgttaagaagaggggagaagaagacagagctggtacactgtttgcaaagtcaggactctttgatttttcttttcttttctttatttcttgaagtagaatttgggaggagggggattggaagggagtcaaacgagtcaaggggaggacaggatggtagctagcttagctaggacaatggtgagtcacaaaagagcaccaaaagcaagtacaagtacaaagcttggggggacacaggatccagttcaggtcacagaaacggttcggttttgggaggggattgtgggagttttggttggctgcgctgcgctgacccttgtaaaacggacgccgattctgacaagagatcgaccttgttttgttcgtgtcgtggtattgctgactactactttgaaatgattaatctcctactactaattactcca

SEQ ID NO: 3349 - DNA, 2699 bp, Hordeum vulgare
tctcactcgctcgtctcctcctcctcttgtgagcctgagatgcaggggaaggagggcagcgcggcgtcggataaaagcaagggaacaagggatggtccaaagaaagcttggcccgcgctgccatctcgcctaaataaaactctcccccactccaccacacacccccgccaccagccgaacgcccctccccctccctcctcactcgctcgcctgtaaagactgagctgagcccgagagctcgaggatccattcctccattggcgagcgagagaggtcgagaggagcaaggaaacacagggcaagatgatcacgggcacggacttctaccacgtgatgactgcggtggtgccgctgtacgtggccatgatcctcgcctacggctccgtcaagtggtggggcatcttcacgccggaccagtgctccgggatcaaccgcttcgtcgcgctcttcgccgtcccgctcctctccttccacttcatctccaccaacaacccctacaccatgaacctccgcttcatcgccgccgacacgctgcagaagctcatgatgctcgccatgctcaccgcctggagccacctctcccgccgcggcagcctcgagtggaccatcaccctcttctccctctccacgctccccaacacgctcgtcatgggcatcccgctgctcaagggcatgtacggcgacttctccggcagcctcatggtgcagatcgtcgtgctccagtgcatcatctggtacaccctcatgctcttcatgttcgagtaccgcggcgcccgcatgctcatcaccgagcagttccccgacacggctggcgccatcgcctccatcgtcgtcgacccggacgtcgtctcgctcgacggccgcagcaacgccatcgagaccgaggccgaggtcaaggaggacggcaagattcacgtcactgtccgccgctccagcgcgtcgcgctccgacatctactcgcgccgctccatgggattctccagcaccacgccgcgccccagcaacctcaccaacgccgagatctactcgctgcagtcgtcgcggaaccccacgcccaggggctccagcttcaaccacaccgacttctactccatggtcggccggagctccaacttcggcgccgccgacgcgtacggcatccggaccggcgccacgccgcgcccgtccaactacgaggaggacgcgcccaagcccaagcacccggcgcccggggcggggcactaccccgcgccgaacccggcggtggccgcggcgcccaaggggcccaagaagccggccgcgaacgggcaggccaagggcgaggacctccacatgttcgtctggagctccagcgcatcgccggtgtcggacgtcttcggcggcggcgcaccggactacaacgacgccgcggccgctaagtccccccgcaaaatggacggagccaaggagagggaagactacaacgtggagcgagacgacttcagcttcgggaacaggggcgcgctggacagggacgcggaggccggcgacgagaaggccatgacggcggacccgaacaatgcgatgagcgcggggccgacggcgatgccgccgacgagcgtgatgacgcggctgatcctgatcatggtgtggcgcaagctcatccgcaacccaaacacctactccagcctcatcggcctcatctggtcgctcgtctgcttcaggtggaacttcacgatgccggcaatcgtcctgggatccatctccatcctgtcggatgcggggctaggaatggccatgttcagcctcggtctgttcatggcgctgcagccgcggatcatcgcgtgcgggaacaaggtggcgacgtacgccatggcggtgcggttcctcgccggcccggccgtcatgaccgccgcctccttcgccgtgggcctccgcggcacgctcctgcacgtcgccatcgtccaggccgcgctgccgcagggcattgtccccttcgtcttcgccaaggagtacagcgtgcaccctgacatcctcagcacggcggtcatattcggcatgctcatcgccctgcccatcacgctcgtctactacatcctgctcggcctgtgagcccgactcccttgtaaaggtccatggcttcgctgctgcgggctcaggagcagcatgcttggagtgaccaccagggggctcttcatttttcctcccctctctctctctctcagggtctctctagagcagcaagataatggtggcgctcctagctaggtaggacaatggcgagagtcagtcaacaacagtcagaagggcaggggaagaagcaagtgcaagtacagagcttgggcggggggactggggtcgcagaattggttcggttctgaaaggggcttgcgagttttggttggctacgccgacccctgtaaaatggatgccgttctggtataactgaccttgattgtcttgttcattaattccatggcactcctgacccgagagatcgaagatgctccggcttcgtttctctgatgattgtgacggaattcatctcactgtcgtgctgtgacgttccatgtatgctttcgtttcttacaagtgtgcatcacggaagtacgcacagcgccaaatcgttgtaacagtgatgagcggctggcatggctgcgcttgattaagtcgagctgttcgaggccacagaaacgcatgggcgaggccggccgttcaaatcagtgatcgctggtttgata

SEQ ID NO: 3350 - DNA, 2527 bp, Hordeum vulgare
tcttgtgagcctgagatgcaggggaaggagggcagcgcggcgtcggataaaagcaagggaacaagggatggtccaaagaaagcttggcccgcgctgccatctcgcctaaataaaactctcccccactccaccacacacccccgccaccagccgaacgcccctccccctccctcctcactcgctcgcctgtaaagactgagctgagcccgagagctcgaggatccattcctccattggcgagcgagagaggtcgagaggagcaaggaaacacagggcaagatgatcacgggcacggacttctaccacgtgatgactgcggtggtgccgctgtacgtggccatgatcctcgcctacggctccgtcaagtggtggggcatcttcacgccggaccagtgctccgggatcaaccgcttcgtcgcgctcttcgccgtcccgctcctctccttccacttcatctccaccaacaacccctacaccatgaacctccgcttcatcgccgccgacacgctgcagaagctcatgatgctcgccatgctcaccgcctggagccacctctcccgccgcggcagcctcgagtggaccatcaccctcttctccctctccacgctccccaacacgctcgtcatgggcatcccgctgctcaagggcatgtacggcgacttctccggcagcctcatggtgcagatcgtcgtgctccagtgcatcatctggtacaccctcatgctcttcatgttcgagtaccgcggcgcccgcatgctcatcaccgagcagttccccgacacggctggcgccatcgcctccatcgtcgtcgacccggacgtcgtctcgctcgacggccgcagcaacgccatcgagaccgaggccgaggtcaaggaggacggcaagattcacgtcactgtccgccgctccagcgcgtcgcgctccgacatctactcgcgccgctccatgggattctccagcaccacgccgcgccccagcaacctcaccaacgccgagatctactcgctgcagtcgtcgcggaaccccacgcccaggggctccagcttcaaccacaccgacttctactccatggtcggccggagctccaacttcggcgccgccgacgcgtacggcatccggaccggcgccacgccgcgcccgtccaactacgaggaggacgcgcccaagcccaagcacccggcgcccggggcggggcactaccccgcgccgaacccggcggtggccgcggcgcccaaggggcccaagaagccggccgcgaacgggcaggccaagggcgaggacctccacatgttcgtctggagctccagcgcatcgccggtgtcggacgtcttcggcggcggcgcaccggactacaacgacgccgcggccgctaagtccccccgcaaaatggacggagccaaggagagggaagactacaacgtggagcgagacgacttcagcttcgggaacaggggcgcgctggacagggacgcggaggccggcgacgagaaggccatgacggcggacccgaacaatgcgatgagcgcggggccgacggcgatgccgccgacgagcgtgatgacgcggctgatcctgatcatggtgtggcgcaagctcatccgcaacccaaacacctactccagcctcatcggcctcatctggtcgctcgtctgcttcaggtggaacttcacgatgccggcaatcgtcctgggatccatctccatcctgtcggatgcggggctaggaatggccatgttcagcctcggtctgttcatggcgctgcagccgcggatcatcgcgtgcgggaacaaggtggcgacgtacgccatggcggtgcggttcctcgccggcccggccgtcatgaccgccgcctccttcgccgtgggcctccgcggcacgctcctgcacgtcgccatcgtccaggccgcgctgccgcagggcattgtccccttcgtcttcgccaaggagtacagcgtgcaccctgacatcctcagcacggcggtcatattcggcatgctcatcgccctgcccatcacgctcgtctactacatcctgctcggcctgtgagcccgactcccttgtaaaggtccatggcttcgctgctgcgggctcaggagcagcatgcttggagtgaccaccagggggctcttcatttttcctcccctctctctctctctcagggtctctctagagcagcaagataatggtggcgctcctagctaggtaggacaatggcgagagtcagtcaacaacagtcagaagggcaggggaagaagcaagtgcaagtacagagcttgggcggggggactggggtcgcagaattggttcggttctgaaaggggcttgcgagttttggttggctacgccgacccctgtaaaatggatgccgttctggtataactgaccttgattgtcttgttcattaattccatggcactcctgacccgagagatcgaagatgctccggcttcgtttctctgatgattgtgacggaattcatctcactgtcgtgctgtgacgttccatgtatgctttcgtttcttacaag

SEQ ID NO: 3351 - DNA, 2487 bp, Triticum aestivum
cgcccggcgcatgcactgcatctgctcctcaccaactcgcccgcatcgcagtcgcagcctcctcctccgagccgcgatgcaggggagggcgtcggataaaagcaagggaacaagggatggtccaaacaaagcttgggccgcgctgccctctcgcctaaataaacctctcccccacgcactcccccactccaccacacaccctcaccagctcgcccgcagagtgagccgaggccgagagccggagcgcgagaggaagaagcagaggaggtcgggcaagatgatcacgggcacggacttctaccacgtgatgacggcggtggtgccgctgtacgtggccatgatcctcgcctacggctccgtcaagtggtggggcatcttcacgccggaccagtgctccgggatcaaccgcttcgtcgcgctcttcgccgtcccgctcctctccttccacttcatctccaccaacaacccctacaccatgaacctgcgcttcatcgccgccgacacgctgcagaagctcatgatgctcgccatgctcaccgcctggagccacctctcccgccgcggcagcctcgagtggaccatcaccctcttctccctctccacgctccccaacacgctcgtcatgggcatcccgctgctcaagggcatgtacggcgacttctccggcagcctcatggtgcagatcgtcgtgctccagtgcatcatctggtacaccctcatgctcttcatgttcgagtaccgcggcgcccgcatgctcatcaccgagcagttccccgacaccgccggcgccatcgcctccatcgtcgtcgacccggacgtcgtctcgctcgacggccggagcaacgccatcgagacggaggctgaggtcaaggaggacggcaagattcacgtcaccgtccgccgctccagcgcctcccgctccgacatctactccaggcgctccatgggcttctccagcaccacgccgcgccccagcaacctcaccaacgccgagatctactcgctgcagtcgtcgcggaaccccacgcccaggggctccagcttcaaccacaccgacttctactccatggtcggccgcagctccaacttcggcgccgccgacgcgtacggcatccgcaccggcgccacgccgcgcccgtccaactacgaggaggacgcgcccaagcccaagcatccggcgcccggggcggggcactaccccgcgccgaacccggcggtggccgcggcgcccaagggaccaaagaagccggccacgaacggacaggccaagggcgaggacctccacatgttcgtctggagctccagcgcgtcgccggtgtcggacgtcttcggcggcggcgcgccggactacaacgacgcggcggccgccaagtccccccgcaaaatggacggagccaaggagagggacgactacaacgtggagcgagacgacttcagcttcgggaacaggggcgcgctggaccgggacacggaggccggcgacgagaaggccatgacggcggacccgaacaatgcgatgagcgcggggcagacggcgatgccgccgacgagcgtgatgacgcggctgatcctgatcatggtgtggcgcaagctcatccgcaaccccaacacctactccagcctcatcggcctcatctggtcgctcgtctgcttcaggtggaacttcacgatgccggcaatcgtcctgggatccatctccatcctgtcggatgcggggctaggaatggccatgttcagcctcggtctgttcatggcgctgcagccgcggatcatcgcgtgcgggaacaaggtggcgacgtacgccatggcggtgcggttcctcgccgggccggccgtcatgaccgccgcctccttcgccgtgggcctccgcggcacgctcctgcacgtcgccatcgtccaggccgcgctgccgcagggcattgtccccttcgtcttcgccaaggagtacagtgtgcaccccgacatcctcagcacagcggtcatattcggcatgctcatcgccctgcccatcacgctcgtctactacatcctgctcggcctgtgagcgagcgccacatgtaaagatccatcgcttcgctaccgcaggctcaggagcggcagaggaggaggatgcgtgcttggagcacgaggggggctcttcatttttcgttccctctctctagagcagcaagataatggtggtgctcctagctaggtaggacaatggcgagagttgatcaacaacactcagaagggctggggaagaagcaagtgcaagtacaaagaagcttgggcgggggacaggggtcgggttcaggtcgcggaatggttgggttctgaaaggggtttgcgagttttggttggctgcgctgacccctgtaaaatggatgccattctgatagtaactgaccttgattgtgttgttcattaatttcatggcgttcctgacctgagatcaaagatgctccgggcttcattgctctgatgattgcgatggaattcatctca

SEQ ID NO: 3352 - DNA, 2593 bp, Brachypodium distachyon
aagcaagggaacaagggatggtccaaagaaagctttggccgcgctgccatctcgcctaaataaaactctcccccacgctcaccccactcctccaccaccagccaaatgctcctctcctcttcctcctccttcctcactggctcagctccactgtaaagaagaactcatcagcagagctccctgtacacactgcggcgctcagctcagctgctgagctgagcttagtacgtgagtgaggttcaagccgccgattgatcaagtaaagcaagaaacagaggaagagagagctcggagaagatgattacggcggcggacttctaccacgtgatgacggcggtggtgccgctgtacgtggccatgatcctggcctacgggtccgtcaagtggtggcgcatcttcacgcccgaccagtgctccgggatcaaccgcttcgtggcgctcttcgccgtgccgctcctctccttccacttcatctccagcaacaacccgtacaccatgaacctccgcttcatcgccgccgacacgctgcagaagctcatggtgctcgccatgctcacggcctggagccacctctcccgcagcggctccctcgagtggaccatcacgctcttctccctctccacgctccccaacacgctcgtcatggggatccccttgctcaagggcatgtacggggacttctccgggtccctcatggtccagatcgtcgtgctccagtgcatcatctggtacaccttgatgctcttcatgttcgagtaccgtggcgccaggatgctcatcacggagcagttcccggatactgctggagccatcgcgtccattgttgttgacccggatgtggtttcgcttgatggacggagggacgccattgagacggaggcagaggtgaaggaggacgggaagatccatgtcaccgtgcgccggtcgaacgcgtccaggtcggatgtttactcgaggagatccatggggttctcgagcacgacgccgcggccgagtaatttgaccaacgccgagatctactcgctgcagtcgtccaggaaccccacgcccagagggtcgagcttcaaccacacggatttttactccatggtggggaggagctcgaactttggtgcggcggatgctttcggggtaaggacgggcgccacgccgaggccgtccaactacgaggacgacgcgccgccgaagcagccggcgcagggcaagtaccagatcccgggtgccgcgattaatggcgcggcggcggggcagtacccggcgccgaacccggcggtggcggcgcccaagaggaaggtggccacggcgaacgggcagggcaagggcggcggcgaggacttgcacatgttcgtgtggagctccagcgcgtcgcccgtgtcggacgtcttcggcggcggcggcggtccggactacaacgacgcggcggcagccaaatctccccgcaaaatggatggaggagccaaggagagggaggactacgtggagcgcgacgagttcagcttcgggaacaggggcggcgcgatggagagggacgcggaggccggcgacgagaaggccgctgtgggcggcggtaatggcggtgcagcggcggcggcgatgcctccgacgagcgtgatgacgcggctgatcctgatcatggtgtggcgcaagctcatccgcaaccccaacacctactccagcctcatcggcctcatctggtcgctcgtctgcttcaggtggaacttcgagatgccggcaatcgtcctcaagtccatctcgatcctgtcggatgcagggctcggaatggccatgttcagtctcgggctgttcatggcgctgcagccccggatcatcgcgtgcgggaacaaggtggcgacgtacgccatggccgtgcgcttcttcgccggcccggccgtcatgctcgccgcctccttcgccgtcgggctccgcggcacgctcctgcacgtcgccctcgtccaggcagcgctgcctcagggcattgtccccttcgtcttcgcaaaggagtacagcgtgcaccctgacattctcagcacagcggtcatatttggcatgctcatcgccttgcccatcacgctcgtctactacatcgtgctcgggctcttctgagcatcgccgctccgcgtcgatcggcggcgtgtaaaggatcgatcgctgccgctgcagcaagtccaggagcagcggcagcgtccagcagaagaggaggcgccacaggaggaattcgtagagctataaacgaggggggcttcatttcttcttcctctgattctctctttctctagaacaacacgaacggtagcttaggtaggacaatggcgagtcaagactcgaaagggcaggtgcaagtacaaaagctttggggggcgggggacaggggatcgatccggttcaaggttgtcgcaggcagaatgggttcggtgctgaaattaaggggttggttagcgagttttggttggctactctgaccctctgtaaactggatgatgatgctattctgattgataaccgagagatatcatcatcggccttgtgtttgctcgttcgtcgtctcgtggtctcgctgagctgacacgatgcttcagttcattccatccaagta

SEQ ID NO: 3353 - DNA, 2710 bp, Zea mays
cgctcacagcgcaccgttaaaagattcagggcttcacgggttcttgagactgttcttgggccgcgctgccacacctcgcccgcctaaataaaacacactccttccttccttccttctttctcagtcactcctcgctagctctatctgagtgaattaaactgctcagggctcactggctcctctcagcgctaagcccagctgtaaagctaaggttccgacttccaagcagtgtggtcgccggaagagcgtagcgagcggcgttcagctcaccagcgttgcattggaaggaagggcgagaggagcgtgagatcgatcgagcttcaaggagggcaagatgatttcggcggcggacttgtaccacgtgatgacggccgtggtgccgttgtacgtggcgatgatcctggcgtacgggtcggtgcggtggtggcgcatcttctcgccggaccagtgctccgggatcaaccgcttcgtggcgctcttcgcggtgccgctgctgtccttccacttcatctccaccaacaacccctacaccatgaacctgcgcttcatcgccgccgacacgctgcagaagctcatggtgctggccatgctcaccgcgtggggccacctcagccgccgggggcggggcagcctcgacctggactggaccatcacgctcttctccctctccacgctgcccaacacgctcgtcatgggcatcccgctgctcaggggcatgtacggcgacttctcgggaagcctcatggtgcagatcgtcgtgctccagtgcatcatctggtacacgctcatgctcttcatgttcgagtaccgcgccgcgcggctgctcatcgccgagcagttcccgggcaacgccgccggggccatcgcctccatcgccgtcgacccggacgtggtctccctcgtcgaccacggccgcggggacgccatcgagacggaggccgaggtcagggaggacggcaggatacacgtcaccgtgcgccgctccagcgcgtcgcgctccgacgtcgtctactcgcgccgctccgtgggcggcttctccggcgccaccccgcgccccagcaacctcaccaacgccgagatctactccctgcagtcgtcgcgcaacccgacgccgcggggatccagcttcaaccacaccgacttctactccatggtcggccgcagctccaacttcggcgcggccgacgcgttcggcgccgtccgcaccggcgccggcaccacgccgcgcccgtccaactacgaggacgacgcgtccaggcccaagtacccgctgcccgtggtgagtgcggcgcccggggtggcaggccactacccggcgccctggagcgccaggaaggcggcgacgaacgggcatgccaagggcgaggacctccacatgttcgtctggagctccagcgcgtcacccgtatcggacttcttcggcggcggcgcgccggactacaacgaccacgccgcggccgccaagtctccccgcaaaatggacggaggagccagggacagggacgactacgtggagcgcgacgagttcagcttcgggaacaggggcgcgatggaggacagggacgcggaggacccggcggcggcgggcggggaccctaacgcggtggccgcggcgacggcgatgccgccgacgagcgtgatgacccggctgatcctgatcatggtgtggcgcaagctgatccgcaacccgaacacctactccagcctcatcggcgtcgtctggtcgctcgtctgcttcaggtggaacttccagatgccggacatcgtcctgcactccatctccatcctgtcggacgcggggctcggaatggccatgttcagcctcgggctgttcatggcgctgcagccgcggatcatcgcgtgcgggaacaaggtggccacgttcgccatggcggtgcgcttcctgaccggcccggccgtcatggcggccgcgtccttcgccgtgggcctccgcggcacgctgctgcacgtcgccatcgtccaggcagctctgccccagggcattgtccccttcgtcttcgcaaaggagtacagcgtgcaccctgacattctcagcaccgcagtcatttttggcatgctcatcgccctgccgatcacgctcgtctactacatcctgctcggcctgtgaccgtctcatccccatggagtcgaggatgccaccccctgcagtgctgcaactgtaaagaccactgctgctgtcacatcccgttcatgggagagggagataaggccaggaaggacgggagatagagctgctacgacattgtttggcgcttgcaaaagagtggcgtgttttctctctctctatctatctagaagtaggtatggggattgggtctgggtggatcctcgcaaaaaaaagggtgggaggtggacaagatgcggtggcaaaacggaccaaaagcaggcaggcgcaagtacaaaggagatccagtttgagcaggtcacgagatcgagatggcttggttttttttcgacgggtttagggaattttggtaggccgcgctgattgatgtgaaatcaacgccattctgagttatgacaggagagatttgatctagcttgagataaagagctcacctcatgagtttggtggattgagacacgggcacgggatttggctggttgatctttcgtttaattgtaaaaaaatgaattgattcctatataagatacttaaatgatttctataaagttccaaatggtaacg

SEQ ID NO: 3354 - DNA, 1807 bp, Saccharum officinarum
gcagcgagcacctcctcctttccttccttatttctcagtccctcctcctcctcactagctctagctgagtgaattgaactgctcactggctcctctcagctgtagtgtggtcgccggacggagagtgtagcgagcggcgtgagagagcttcaacctttcaaggaggaggaggaggaggaggaagaagaggagaggagggcaagatgattacggcgacggacttctaccacgtcatgacggccgtggtgccgctgtacgtggcgatgatcctcgcgtacgggtcggtgcggtggtggcgcatcttctcccccgaccagtgctccgggatcaaccgcttcgtcgcgctcttcgccgtgccgctgctgtccttccacttcatctccaccaacaacccctacaccatgaacctgcgcttcatcgccgccgacacgctgcagaagctcatggtgctggccatgctcaccgcctggagccacctcagccgccggggcagcctcgagtggaccatcacgctcttctccctctccacgctgcccaacacgctggtcatgggcatcccgctgctcaagggcatgtacggcgatttctcggggagcctcatggtgcagatcgtcgtgctccagtgcatcatctggtatacgctcatgctcttcatgttcgagtaccgcggcgcgcggctgctcatcacggagcagttcccggacaacgcgggcgccatcgcctccatcgtcgtcgacccggacgtcgtctccctcgacggccggagggacgccatcgagacggaggccgaggtcaaggaggacggcaagatacacgtcaccgtgcgccgctccaacgcgtcgcgctccgacatctactcgcggcggtccatgggattctccagcaccacgccgcggcccagcaacctgaccaacgccgagatctactcgctgcagtcgtcgcgcaacccgacgccccggggctccagcttcaaccacaacgacttctactccatggtgggccgcagctccaacttcggcgcggccgacgcgttcggcgtccgcacgggcgccacgccgcggccgtccaactacgaggacgacgcgtccaagcccggcaacaagtacccgctccccgtggtgaatgcggcgtccgttcccggggcggcgggacactaccccgcgcccaacccgacggtggccgcggcgcccaagaagaaggcggccggcaccaacgggcaggccaagggcgaggacctccacatgttcgtctggagctccagcgcgtcgcccgtgtcggacgtcttcggcggcggcgcgccggactacaacgacgccgcggccgtcaagtccccccgcaaaatggacggcggcggagccaaggacagggacgactacgtagagcgcgacgagttcagcttcgggaacaggggcgcgatggacagggacgcggaggcaggggacgagaaggccgcagcggcgggtggggaccccagcgcggtggccgcgccgacggcgatgccgccgacgagcgtgatgacccggctcatcctgatcatggtgtggcgcaagctcatccgcaacccaaacacctactccagcctcatcggcgtcatctggtcgctcgtctgcttcaggtggaacttccagatgccggccatcgtcctgcagtccatctccatcctgtcggacgcggggctcggaatggccatgttcagtctcgggctattcatggcgctgcagccccggatcatcgcgtgcgggaacaaggtggcgacgttcgccatggcggtgcgcttcctgaccggtccggccgttatggcggccgc

SEQ ID NO: 3355 - DNA, 2320 bp, Zea mays
ttcctccactccacggctcccccaccccactcatcacactctcccaccgcacctcgccgccgcggggcaccgcgccataaagtgcgttcccggctgcacggacgtcgaggagcagctcgcaagtgtttcttggtgcgtcgatcggcaagatgatcaccggcacggacttctaccacgtcatgacggccatggtgccgttgtacgttgccatgatcctggcgtacggatccgtcaggtggtggcgcatcttcacgccggaccagtgctcggggatcaaccgcttcgtggcgctcttcgccgtgccgctgctgtccttccacttcatctccaccaacaacccctacaccatgaacatccggttcatcgccgccgacacgctgcagaagctgatcgtcctggcgctgctcactgcatggagctacctctcccgccggggctgcctcgagtggaccatcacgctcttctccctgtcgacgctgcccaacacgctggtgatgggcatcccgctgctcaagggcatgtacggcgacttctccggcagcctcatggtgcagatcgtggtgctccagtgcatcatctggtacacgctgatgctgttcatgttcgagtaccgcggcgccaggatcctcatcaccgagcagttccccgacacggcgggcgccatcgcctccatcgtggtggaccccgacgtggtgtcgctggacgggcgcaacgacgccatcgagacggaggccgaggtgaaggaggacggcaagatacacgtcaccgtgcggcgctccaacgcgtcgcgctcggacatctactcccggcggtccatggggttctccagcaccacgccgcggcccagcaacctgaccaacgccgagatctactcgctgcagtcgtcgaggaaccccacgccgcggggctccagcttcaaccacaccgacttctactccatggtcggccgcagctccaacttcgccgccggggacgcgttcggcctgcgcacgggcgccacgcccaggccgtccaactacgaggaggacccgcagggcaaggcgaacaagtacggccagtacccggcgcccaacccggccatggcggcgcagcccgccaagggcctcaagaaggcggccaatgggcaggccaagggcgaggacggcaaggacctacacatgttcgtgtggagctccagcgcgtcgcccgtgtccgacgtgttcggcaatggcgccgccgagtacaacgacgcggccgccgtcaaggaggtccgcatggccgtcgcctccccgcgcaaagttgcggcggacgggaggaaggagcggggcgaggacttcgcggagcgggacgacttcagcttcgggaacaggggcgcggcggagagggacgcggaagccggcgacgagaaggcggcggcggcggctgcggctgcgcaggggaatgcaggcgccgtggcggcgcccgcggcgatgccaccgacgagcgtgatgacgcggctgatcctcatcatggtgtggcgcaaactcatccgtaaccccaacacctactccagcctcatcggcctcatctggtcgctcgtctgcttcaggtggaacttcgagatgccggcgatcatcctcaagtccatctcgatcctctccgacgccgggctcggcatggccatgttcagcctcgggctgttcatggcgctgcagccacggataatcgcgtgcgggaacaaggtggccacgttcgccatggccgtgcggttcctgaccggcccggccgtcatggccgccgcctcctttgccgtcggcctccgcggcacgctcctccacgtcgccatcgtccaggccgcgctgccgcagggcattgtccccttcgtgttcgccaaggagtacggcgtgcaccctgacatcctcagcacggcagtcatcttcggcatgctcatcgcgctgcccatcacgctggtgtactacatcctgatggggctgtgaaaaagccagacaagctgctcgttcccgcaggccaacagcgatgccggatggggatgtggagcaggaggagacagactaggggggacaagacaactgcgcaggggcaggggcgggggcggggggcggcaggttaattcgtaggagtatgcttttaggtgtagacatcatggaacgcgattagagagcaaacaaaaaatgtttttaggacaaacccaacgtcatatgcaaaaatccttgggggtgacagtttgcgttgcaaagcatccggtcatgagttttgatttgggtgtgttagggacttttcatgcgcatggctttccatgccctatataaaatggatgcgtgtcacttcgatggaatgctag

SEQ ID NO: 3356 - DNA, 2470 bp, Oryza sativa
caccttccccaccctcattggctcccccgcctgcctccccttctccatccaccaactcgccgcacactcaaccccgcctcgccgccgcacaccacccaccggcgaagagaagaagtcgtggtttttcttggctgcaagatgataacgggggcggacttctaccacgtgatgacggcgatggtgccgctgtacgtggcgatgatcctggcgtacgggtcggtgaagtggtggcgcatcttcacgcccgaccagtgctccgggatcaaccgcttcgtggcgctcttcgccgtcccgctcctctccttccacttcatctccaccaacaacccctacaccatgaacctccgcttcatcgccgccgacaccctgcagaagctcatcgtcctcgcgctcctcaccctgtggagccacctctcccgccgcggctccctcgagtggaccatcaccctcttctccctctccacgctgcccaacacgctcgtcatggggatcccgctgctgaaggggatgtacggggagttctccggtagcctcatggtgcagatcgtggtgctccagtgcatcatctggtacacgctgatgctcttcatgttcgagtaccgcggcgccaggatcctcatcaccgagcagttcccggacaccgcgggcgccatcgcgtccatcgtcgtggacgccgacgtcgtgtcgctcgacgggcggagggacatgatcgagacggaggccgaggtgaaggaggacggcaagatacacgtcaccgtgcgccgctccaacgcgtcgcgctccgacgtctactcgcggcgctccatggggttctccagcaccacgccgcggccgagcaacctcaccaacgccgagatctactcgctgcagtcgtcgcgcaacccgacgccgcggggctccagcttcaaccacaccgacttctactccatggtcgggcgcagctccaacttcgccgccggggacgcgttcggggtgcgcaccggcgccacgccgcggccgtccaactacgaggaggacgcggcggcgcccaacaaggccggcagcaagtacgggcagtacccggcgcccaacccggccatggcggcgccgcccaagcccaagaaggcggccaacggccaggccaagggcgaggacggcaaagacctccacatgttcgtctggagctccagcgcgtcgcccgtgtccgacgtcttcggcaacggcgccgagtacaacgacgccgccgccgtcaaggaggtccgcatggccgtcgcctcgccgcgcaaagcggacggcgtggagagggacgacttcagcttcgggaacagaggcgtcgccgagagggacgcggaggccggcgacgagaagagcgtggcggcggcggtgtcgggtgagcatggcaagcctggcttgacgccggcgccgacggcgatgccgccgacgagcgtgatgacgcggctcatcctgatcatggtgtggcgcaagctcatccgcaaccccaacacctactccagcctcatcggcctcatctggtcgctcgtctgcttccggtggaacttcgagatgccggcgatcatcctgaaatccatctccatcctctccgacgccggcctcggcatggccatgttcagcctcgggctgttcatggcgctgcagccgcggatcatcgcgtgcgggaacaaggtggcgacgttcgccatggcggtgcggttcctgaccggcccggccgtcatggccgccgcctccatcgccgtcggcctccgcggcacgctcctccacgtcgccatcgtgcaggcagcgttgccacagggcattgtccccttcgtcttcgccaaggagtacagcgtgcaccccgacattctcagcacggcggtcatctttggcatgctcatcgcgctgcccatcacgctggtgtactacatcctgctggggctgtgactgtgaacaaccaccaccaagaacagcatgtttttgcaggtgagggtcgtcatgtttgcagcgagtgccgggacagaggagaagacaaagggctgcatgcatgcatcacgctgcagtcacccaccagttcaccatggaggaggaggagcaagaagccaagcaaccaagcagcaatgcagtgcagcagctgggttttcattagagtttttttaggtgtagagatcgatggatgggagtatggataattgttttagggcagagagttccaaaaattgcaggcatgtgcaaaggctttggagggaggggagggggaggggacagggttcaggtttttagtacagggcctgggggtttataggggagtgagaatgtgagatgcatcgcttggctgggttggctggccttgtggtgaaatgggtgtgtgtcactttggtggaaaaaaaacaaatggtttagtagagctcttgttcatcctacggtatagtagtactttggcatggcacaatgcttcggctttgattagcaagattaatcaataatactagtaatagct

SEQ ID NO: 3357 - DNA, 2531 bp, Setaria italica
ccccctccctcattggctcccccgcctgcctgcctccactccacggcggcgccaggcctccacaatccacatctactcatcacacacactctcccaccgcaccaccaccaagcgcctccccgtccgcacgcacaccggggttctgtgcagctcgatcgcaagcgtctctctgcaaggcgtggcggcggcggcggcgaacgcgccggcaagatgatcacgggcacggacttctaccacgtcatgacggccatggtgccgctctacgtcgccatgatcctggcgtacggctccgtccggtggtggcgcatcttcaccccggaccagtgctccgggatcaaccgcttcgtggcgctcttcgccgtgccgctgctctccttccacttcatctccaccaacaacccctacaccatgaacctccgcttcatcgccgccgacacgctccagaagctcatcgtcctcgcgctgctcaccgcctggagctacctctcccgccggggctgcctcgagtggaccatcacgctcttctccctctccacgctgcccaacacgctcgtcatgggcatcccgctgctcaagggcatgtacggcgacttctccggcagcctcatggtgcagatcgtcgtgctccagtgcatcatctggtacacgctcatgcttttcatgttcgagtaccgcggcgccaggatcctcatcaccgagcagttccccgacaccgccggcgccatcgcctccatcgtcgtcgatccggacgtcgtctcgctcgacggccggaacgacgccatcgagacggaggccgaggtcaaggaggacggcaagatacacgtcaccgtgcgccgctccaacgcctcgcgctccgacatctactcccgccgctccatgggcttctccagcaccacgccgcgccccagcaacctcaccaacgccgagatctactcgctgcagtcgtcgcggaaccccacgccgcggggctccagcttcaaccacaccgacttctactccatggtcggccgcagctccaacttcgccgccggggacgccttcggggtgcgcaccggcgccacgcccaggccgtccaactacgaggaggacgcgcagggcaaggccaacaagtacggccagtacccggcgcccaacccggccatggcggcgccggccaaggggcagcccaagaaggcggccaacgggcaggccaagggcgaggacggcaaggacctccacatgtttgtctggagctccagcgcgtcgcccgtctccgacgtgttcggcaacggcaacgccgagtacaacgacgccgccgccgtcaaggaggtccgcatggccgttgcctccccgcgcaaagttgcagcggacgggaggaaggagaggggcgaggacttcgcggagcgcgacgacttcagcttcgggaacaggggcggcgcggagagggacgcggaggccggcgacgagaaggcggcggtggccgggcaggggaatgccggcgtaggggcgcccgcggcgatgccgccgacgagcgtcatgacccggctcatcctgatcatggtgtggcgcaagctcatccgcaaccccaacacctactccagcctcatcggcctcatctggtcgctcgtgtgcttccggtggaacttcgagatgccggcgatcatcctcaagtccatttcgatcctctccgacgccgggctcggcatggccatgttcagcctcgggctgttcatggcgctgcagccgcggatcatcgcgtgcgggaacaaggtggcaacgttcgccatggccgtgcggttcctgaccggcccggccgtcatggccgccgcctccttcgccgtcggcctccgcggcacgctcctccacgtcgccatcgtccaggccgcgctgccgcagggcattgtccccttcgtcttcgccaaggagtacggcgtgcaccctgacatcctcagcacggcagtcatcttcggcatgctcatcgcgctgcccatcacgctggtgtactacatcctgctggggctgtgaaaaagcaagacaagggtggtgtcgttgcaggaagtcacagctcagcgatgccgggtggatggagtaggagacagaggaggggacaagggatgctgcagcgactgcgcgtgcgtgcaggggacatgcttaatttgtaggagtattcttagctgtagagattagaggccacaaaaaaaaatgtttaggacaagggttgggttgaaggagggcgccaagaacaacacgtgcaaggctttagggtgacaatttggaaagcatccggttgatcaggttacggggttgatctgggttgaaggggggcttgtgatgggaagggttttccatggatggttgggctgatcttgcattgtaaaatggatgcatatgtcactttgatggaatgctagagctcttgttcatcttagggcatactacttcgagtggcagcttgtttctgtttcagatgagcgaatttggtctctaacccttgtttcgcattggattaggatatgctcagggctggagaataaagccgttgggtggggaga

SEQ ID NO: 3358 - DNA, 2212 bp, Saccharum officinarum
ggcaagatgatcacgggcacggatttctaccacgtgatgacggccatggtgccgctgtacgtcgccatgatcctggcgtacggctcggtgaggtggtggcgcatcttcacgccggaccagtgctcggggatcaaccgcttcgtggcgctcttcgcggtgccgctgctctccttccacttcatctccaccaacaacccctacaccatgaacctccggttcatcgccgccgacacgctgcagaagctgatcgtcctggcgctgctcaccgcctggagctacctctcccggcggggctgcctggagtggaccatcacgctcttctccctgtccacgctgcccaacacgctggtgatgggcatcccgctgctcaagggcatgtacggcgacttctccggcagcctgatggtgcagatcgtggtgctccagtgcatcatctggtacacgctgatgctcttcatgttcgagtaccgcggcgccaggatcctcatcacggagcagttcccggacacggcgggcgccatcgcgtccatcgtcgtggacccggacgtagtgtcgctcgacggccggaacgacgccatcgagacggaggccgaggtgaaggaggacggcaagatacacgtgacggtgcgccgctccaacgcgtcgcgctccgacatctactcccggcggtccatggggttctccggcaccacgccgcggcccagcaacctgaccaacgccgagatctactcgctgcagtcgtcgcggaaccccacgccgcggggctccagcttcaaccacaccgacttctactccatggtcggccgcagctccaacttcggcgccggggacgcgttcgggctgcgcaccggcgccacgcccaggccgtccaactacgaggaggaagcgcagggcggcaaggcggcgaacaagtacggcggccagtacccggctcccaacccggccatggcggcgcagcccatgcccacaaagggtctcaagaaggcggcggccaatgggcaggccaaaggcgaggacggcaaggacctgcacatgttcgtctggagctccagcgcgtcgcccgtgtccgacgtgttcggcaatggcgccgccgagtacaacgacgccgccgccgtcaaggaggcccgcatggccgtcgcctccccgcgcaaagttgcggcggacgggaggaaggaaaggggcgaggacttcacagagcgggacgacttcagcttcgggaacaggggcgcggcggatagggacgcggaggccggcgacaagaaggcggcgaccgtgcaggggaatgccggcggcgtggcggcgcccgcggcgatgccaccgacgagcgtgatgacgcggctcatcctcatcatggtgtggcgcaagctgatccgcaaccccaacacctactccagcctcatcggcctcatctggtcgctcgtctgcttcaggtggaacttcgagatgccggcgatcatcctcaagtccatctcgatcctctccgacgccgggctcggcatggccatgttcagtctcgggctgttcatggcgctgcagccacggatcatcgcgtgcgggaacaaggtggccacgttcgccatggccgtgcggttcctgaccggcccggccgtcatggccgccgcctccctggccgtcggcctccgcggcacgctcctccacgtcgccatcgtccaggccgcgctgccgcagggcattgtccccttcgtcttcgccaaggagtacggcgtgcaccctgacatcctcagcacggcagtcatcttcggcatgctcatcgcgctgcccatcacgctggtgtactacatcctcatggggctgtgaaaaagccagacaagctgttggttctcgcaggccagccaactcagcgatgccggatggatggagcaggaaggagacagacgaggggacaagcgaactgcagcgactgcgcgtacgtgcaggggagggcaggcaagaggttaattcgtaggagtattagttcttaggtgtagagatcatgcatggaaggcgattagagcaaacaaaatgttttaggacacgagtttgaaggaggccatatgcaaaagccttgggatgacagtttgcaaagcatccggttgctaaggttatgaggttggtttgggtgtgttagggagttgttaatcatgtggagggctttccatggatagttgggctagccatgccttatgaaatggatgcattgtcactttgattg

SEQ ID NO: 3359 - DNA, 3051 bp, Oryza sativa
taagaattgattttgagaggccgctggtgatattcttagtgagagaaccttttcgatttcgatctccatcgatcatttcggttcaggttttcgttctactgtgccgagttgccgacccctccccaggaggagaaaattgagtcccgaatttcttttcaatcacaaaccatttttttttccgtttccttggatacatgctcatgtcggggtgcgtgcagcgtccacatgatgtgtataaataatcacccgcacatatgcccactccctcccaccttccccaccctcattggctcccccgcctgcctccccttctccatccaccaactcgccgcacactcaaccccgcctcgccgccgcacaccacccaccggcgaagagaagaagtcgtggtttttcttggctgcaagatgataacgggggcggacttctaccacgtgatgacggcgatggtgccgctgtacgtggcgatgatcctggcgtacgggtcggtgaagtggtggcgcatcttcacgcccgaccagtgctccgggatcaaccgcttcgtggcgctcttcgccgtcccgctcctctccttccacttcatctccaccaacaacccctacaccatgaacctccgcttcatcgccgccgacaccctgcagaagctcatcgtcctcgcgctcctcaccctgtggagccacctctcccgccgcggctccctcgagtggaccatcaccctcttctccctctccacgctgcccaacacgctcgtcatggggatcccgctgctgaaggggatgtacggggagttctccggtagcctcatggtgcagatcgtggtgctccagtgcatcatctggtacacgctgatgctcttcatgttcgagtaccgcggcgccaggatcctcatcaccgagcagttcccggacaccgcgggcgccatcgcgtccatcgtcgtggacgccgacgtcgtgtcgctcgacgggcggagggacatgatcgagacggaggccgaggtgaaggaggacggcaagatacacgtcaccgtgcgccgctccaacgcgtcgcgctccgacgtctactcgcggcgctccatggggttctccagcaccacgccgcggccgagcaacctcaccaacgccgagatctactcgctgcagtcgtcgcgcaacccgacgccgcggggctccagcttcaaccacactgacttctactccatggtcgggcgcagctccaacttcgccgccggggacgcgttcggggtgcgcaccggcgccacgccgcggccgtccaactacgaggaggacgcggcggcgcccaacaaggccggcagcaagtacgggcagtacccggcgcccaacccggccatggcggcgccgcccaagcccaagaaggcggccaacggccaggccaagggcgaggacggcaaagacctccacatgttcgtctggagctccagcgcgtcgcccgtgtccgacgtcttcggcaacggcgccgagtacaacgacgccgccgccgtcaaggaggtccgcatggccgtcgcctcgccgcgcaaagcggacggcgtggagagggacgacttcagcttcgggaacagaggcgtcgccgagagggacgcggaggccggcgacgagaagagcgtggcggcggcggtgtcgggtgagcatggcaagcctggcttgacgccggcgccgacggcgatgccgccgacgagcgtgatgacgcggctcatcctgatcatggtgtggcgcaagctcatccgcaaccccaacacctactccagcctcatcggcctcatctggtcgctcgtctgcttccggtggaacttcgagatgccggcgatcatcctgaaatccatctccatcctctccgacgccggcctcggcatggccatgttcagcctcgggctgttcatggcgctgcagccgcggatcatcgcgtgcgggaacaaggtggcgacgttcgccatggcggtgcggttcctgaccggcccggccgtcatggccgccgcctccatcgccgtcggcctccgcggcacgctcctccacgtcgccatcgtgcaggcagcgttgccacagggcattgtccccttcgtcttcgccaaggagtacagcgtgcaccccgacattctcagcacggcggtcatctttggcatgctcatcgcgctgcccatcacgctggtgtactacatcctgctggggctgtgactgtgaacaaccaccaccaagaacagcatgtttttgcaggtgagggtcgtcatgtttgcagcgagtgccgggacagaggagaagacaaagggctgcatgcatgcatcacgctgcagtcacccaccagttcaccatggaggaggaggagcaagaagccaagcaaccaagcagcaatgcagtgcagcagctgggttttcattagagtttttttaggtgtagagatcgatggatgggagtatggataattgttttagggcagagagttccaaaaattgcaggcatgtgcaaaggctttggagggaggggagggggaggggacagggttcaggtttttagtacagggcctgggggtttataggggagtgagaatgtgagatgcatcgcttggctgggttggctggccttgtggtgaaatgggtgtgtgtcactttggtggaaaaaaaacaaatggtttagtagagctcttgttcatcctacggtatagtagtactttggcatggcacaatgcttcggctttgattagcaagattaatcaataatactagtaatagctaagtgacatggttctaagcaatgctttacaaatgacttgtttcctccgtcccattataaatcgaagcaatggatagggtccaaaaatttcacagaaataagttcacttcatcttaggaatcagataaaaatacccacttttttaaaggagccctcgagtgtgctccatcataatatactcacattagacagtagtgactgttaaccttcttcactaattcgttttctgcgtcatcttcaggggcccaagtaggcgactgtgcttgaatattttgtggatagtgaaagaaagcgaactagaacatgatatgtg

SEQ ID NO: 3360 - DNA, 2654 bp, Sorghum bicolor
ctacgcccactccccccctccctcccgcgtgcctccacactccacggctccaccccactcatcacacacactctcccaccgcaccattaccggcgccataaagtgcgttcccggccggctgcacgcacgtcgaggagcagagcagctagctcgcaagtgtttctttcttgtcgcggcggcggcggcggcggcggcgacgcgtcggcaagatgatcacgggcacggacttctaccacgtgatgacggccatggtgccgctgtacgtcgccatgatcctggcgtacggctccgtccggtggtggcgcatcttcacgccggatcagtgctccgggatcaaccgcttcgtggcgctcttcgccgtgccgctgctctccttccacttcatctccaccaacaacccctacaccatgaacctccggttcatcgccgccgacacgctgcagaagctcatcgtcctggcgctgctcaccgcctggagctacctctcccggcggggctgcctggagtggaccatcacgctcttctccctgtccacgctgcccaacacgctggtgatgggcatcccgctgctcaagggcatgtacggcgacttctccggcagcctgatggtgcagatcgtggtgctccagtgcatcatctggtacacgctgatgctcttcatgttcgagtaccgcggcgccaggatcctcatcaccgagcagttcccggacacggcgggcgccatcgcgtccatcgtcgtcgaccccgacgtggtgtcgctggacggccggaacgacgccatcgagacggaggccgaggtgaaggaggacggcaagatacacgtgacggtgcgccgctccaacgcgtcccggtcggacatctactcccggcggtccatggggttctccagcaccacgccgcggcccagcaacctgaccaacgccgagatctactcgctgcagtcgtcgcggaacccgacgccgcgggggtccagcttcaaccacaccgacttctactccatggtggggcgcagctccaacttcgccgccggggacgccttcgggctgcgcaccggcgccacgcccaggccgtccaactacgaggaggaagcgcagggcggcaaggcggcgaacaagtacggcggccagtacccggcgcccaacccggccatggcggcgcagcccatgcccaccaagcagggtctcaagaaggcggcggccaatgggcaggccaagggcgaggacggcaaggacctgcacatgttcgtctggagctccagcgcgtcgcccgtgtccgacgtgttcggcaatggcgccgccgagtacaacgacgccgccgccgtcaaggaggtccgcatggccgtcgcctccccgcgcaaagttgcggcggacgggaggaaggagaggggcgaggacttcacagagcgggacgacttcagcttcggcaacaagggcgcggcggagagggacgcggaagccggcgacgagaaggcggcggctctgcaggtggggaatgcctgcggcgtggcggcggcgcccgcggcgatgccaccgacgagcgtgatgacgcggctcatcctcatcatggtgtggcgcaagctcatccgcaacccgaacacctactccagcctcatcggcctcgtctggtcgctcgtctgcttcaggtggaacttcgagatgccggcgatcatcctcaagtccatctcgatcctctccgacgccgggctcggcatggccatgttcagtctgggtctgttcatggcgctgcagccacggatcatcgcgtgcggtaacaaggtggccacgttcgccatggccgtgcggttcctcaccggccccgccgtcatggccgccgcctccctggccgtcggcctccgcggcacgctcctccacgtcgccatcgtccaggccgcgctgccgcagggcattgtccccttcgtcttcgccaaggagtacggcgtgcaccctgacatcctcagcacggcagtgatcttcggcatgctcatcgcgctgcccatcacgctggtgtactacatcctgatggggctgtgaaaaaggccagacaagctgttggttctcgcccggccaggcacagctcacagctcgctcagcgatgccggatgcatggatggagcgggcacgaggggacaagagaactgcagcgaacgtacgtgcaggggagcaggcctgaggaggttaatttgtaggagtattagttcttaggtgtagagaatcatgcatgggaggcgattggggagagcaaacaaaatgtttaggacaagagtttggaggaaggagggctcgctttactagctactctaatgcaaaaggccttggggatgacagtttgcaaagcatccggttgctaaggttatggggttggtttgggtgtgttattagggaggagttgttaatcgtgcatgtggagggctttccatggatagttgggctagctagccatgccttatgaaatggatgcatttgtcactttgatggaatgatacggctcttgttcatcatctagggtatactactacttggattggcaacatatgtcctgcttcagtgcttctttaagagtatctgacatcaaacccttgtgttctgcaattgtacaaggctattcttaggatttgagaataaaaccagcggatggggagaaaaataaactgaaaa

SEQ ID NO: 3361 - DNA, 2430 bp, Secale cereale
tcagtggctcccccgcctgcctcccccccgatcgccacactcccctgccccgccgcgcggccaccgcgccataaatcaagctagcgctgcttcacttgaacgccgcacctcacctcaccacacacctcccctgccgcgccgccgtgacaacgtaggaaggaagagcgagtgtttgttggcccagcggcggcggccggcacggcaagatgatcacgggcacggacttctaccacgtcatgacggcgatggtgccgctgtacgtggcgatgatgctcgcgtacggctccgtcaagtggtggcgcatcttcacgccggaccagtgctccgggatcaaccgcttcgtggcgctcttcgccgtgccgctgctctccttccacttcatctccaccaacaacccctacaccatgaacctccgcttcatcgccgccgacacgctgcagaagctcatcgtgctcgcgctcctcaccctctggagccacctctcccgcaacggctccctcgagtggaccatcacgctcttctccctctccacgctgcccaacaccctcgtcatgggcatcccgctcctcaagggcatgtacggcgacgagtccggcagcctcatggtgcagatcgtcgtgctccagtgcatcatctggtacacgctcatgctcttcatgttcgagtaccgcggcgccaggatcctcatcaccgagcagttccccgacaccgccggcgccatcgcctccatcgccgtcgaccccgacgtcatgtcgctcgacggcaggagggacatgatcgagacggaggcggaggtcaaggaggacggcaagattcacgtcaccgtgcgccgctccaacgcctcccgctccgacatctactcgcgccgctccatggggttctccagcaccacgccgcgccccagcaacctcaccaacgccgagatctactcgctgcagtcgtcgcggaaccccacgccccggggctccagcttcaaccacaccgacttctactccatggtgggccgcagctccaacttcgccgccggggacgcgttcggcccggtggtgcgcaccggggccacgccgcgcccgtccaactacgaggaggacaaggctggcaacaacaacaacaccaagtacgggcagtacccggcgcccaaccccgcgatggcggcgccgcagaagccggccaagaaacccgcgaacgggcaggccaagggcgaggacggcaaggacctgcacatgttcgtgtggagctccagcgcgtcgcccgtgtccgacgtgttcggcaacggcactgaggcgtacaacgacgccgccgccaaggacgtccgcgtggccgccgcctcgccgcgcaaagcggacggcgtggagcgtgacgagttcagcttcgggaacaaggagagggacgcggaggccggcgacgagaaggccgcggcggagcagggcaccgcgggcctggtggcggcgcccacggcgatgccgccgaccagcgtgatgacgcggctcatcctcatcatggtgtggcgcaagctcatccgcaaccccaacacctactccagcctcatcggcctcatctggtccctcgtctgcttccggtggaacttcgttatgccggcgatcatcatgaagtccatcgccatcctgtccgacgccggcctcggcatggccatgttcagcctcgggctgttcatggcgctgcagccgcggatcatcgcgtgcgggaacaagcgggcgacgttcgccatggcggtgcggttcctgacgggcccggccgtgatggccgccgcctccatcgccgtcggcctccgcggcaccctcctccacatcgccatcgtgcaggcagcgctgccccagggcattgtccccttcgtcttcgccaaggagtacagcgtgcaccccgacatcctcagcacagctgtcatcttcggcatgctcatcgcgctgcccatcacgctggtctactacatcctgctggggctgtgagctagcggagacacggccgggctgcgaccatgccggcgcggcgtaggaggcagacaggggaggggacaaggggggctgcagcggctccatgcgcctgccggggacatgatgcgtgctcctgcatgcacgcgggtggctaattactaggattcttaattaggtgtaggggatcagatggggtgaggggaggaatgtttagggtaagagtttcagttgttggtaaattaaaggactgccaaaatcaaaggttggggaggcagaggatcaatcctgtttgggggtttttagaagatgtatgtactccatgtgtgtgttggcagaggtttctttccctggagggaggatggctgggctcctgtgggttggcctgtaaatggatgtcaaattgataaaagtaatgctagagctctttgttccaccttaccactacctaaaaaaaaactagtagactacgtcaaccgga

SEQ ID NO: 3362 - DNA, 2218 bp, Secale cereale
caagctagcgctgcttcacttgaacgccgcacctcacctcaccacacacttcccctgccgcgccgccgtgacaacgtaggaaggaagagcgagtgtttgttggcccagcggcggcggccggcacggcaagatgatcacgggcacggacttctaccacgtcatgacggcgatggtgccgctgtacgtggcgatgatgctcgcgtacggctccgtcaagtggtggcgcatcttcacgccggaccagtgctccgggatcaaccgcttcgtggcgctctttgccgtgccgctgctctccttccacttcatctccaccaacaacccctacaccatgaacctccgcttcatcgccgccgacacgctgcagaagctcatcgtgctcgcgctcctcaccctctggagccacctctcccgcaacggctccctcgagtggaccatcacgctcttctccctctccacgctgcccaacaccctcgtcatgggcatcccgctcctcaagggcatgtacggcgacgagtccggcagcctcatggtgcagatcgtggtgctccagtgcatcatctggtacacgctcatgctcttcatgttcgagtaccgcggcgccaggatcctcatcaccgagcagttccccgacaccgccggcgccatcgcctccatcgccgtcgaccccgacgtcatgtcgctcgacggcaggagggacatgatcgagacggaggcggaggtcaaggaggacggcaagattcacgtcaccgtgcgccgctccaacgcctcccgctccgacatctactcgcgccgctccatggggttctccagcaccacgccgcgccccagcaacctcaccaacgcggagatctactcgctgcagtcgtcgcggaaccccacgccccggggctccagcttcaaccacaccgacttctactccatggtgggccgcagctccaacttcgccgccggggacgcgttcggcccggtggtgcgcaccggggccacgccgcgcccgtccaactacgaggaggacaaggctggcaacaacaacaacaccaagtacgggcagtacccggcgcccaaccccgcgatggcggcgccgcagaagccggccaagaaacccgcgaacgggcaggccaagggcgaggacggcaaggacctgcacatgttcgtgtggagctccagcgcgtcgcccgtgtccgacgtgttcggcaacggcactgaggcgtacaacgacgccgccgccaaggacgtccgcgtggccgccgcctcgccgcgcaaagcggacggcgtggagcgtgacgagttcagcttcgggaacaaggagagggacgcggaggccggcgacgagaaggccgcggcggagcagggaaccgcgggcctggtggcggcgcccacggcgatgccgccgaccagcgtgatgacgcggctcatcctcatcatggtgtggcgcaagctcatccgcaaccccaacacctactccagcctcatcggcctcatctggtccctcgtctgcttccggtggaacttcgttatgccggcgatcatcatgaagtccatcgccatcctgtccgacgccggcctcggcatggccatgttcagcctcgggctgttcatggcgctgcagccgcggatcatcgcgtgcgggaacaagcgggcgacgttcgccatggccgtgcggttcctgacgggcccggccgtgatggccgccgcctccatcgccgtcggcctccgcggcaccctcctccacatcgccatcgtgcaggcagcgctgccccagggcattgtccccttcgtcttcgccaaggagtacagcgtgcaccccgacatcctcagcacggctgtcatcttcggcatgctcatcgcgctgcccatcacgctggtctactacatcctgctggggctgtgagctagcggagacacggccgggctgcgaccatgccggcgcggcgtaggaggcagacaggggaggggacaaggggggctgcagcggctccatgcgcctgccggggacatgatgcgtgctcctgcacgcacgcgtgaggctaattactaggattcttaattaggtgtaggggatcagatggggtgaggggaggaatgtttagggcaagagtttcagttgttggtaaattaaaggactgccaaaatcaaaggttggggaggcagaggatcaatcctgtttgggggtttttagaagatgtatgtactccatgtgtgtgttggcagaggtttc

SEQ ID NO: 3363 - DNA, 2544 bp, Brachypodium distachyon
cccacctcccctcataggctccccctcctccacgctccacctaccgactcgcccgcccgcaacactctcccgtcgcccggccaccgcgccataaagcaagcagcacttgcacaccccaactctcctcacttggttatacgcttctgctcggctagctggtggtacgtaaccggtaactcgccgtgcgcgtgcggacgtcgaaaagctagcagcagcaaaacaagcgtttcttgctttgctttgctcgcggccggaggcgaagatgatcacggggacggacttctaccacgtgatgacggcgatggtgcctctgtacgtggccatgatgctggcctacgggtccgtcaagtggtggcgcatcttcaccccggaccagtgctccgggatcaaccgcttcgtggcgctcttcgccgtcccgctgctctccttccacttcatctccaccaacaacccttacgccatgaacctccgcttcatcgccgccgacacgctccagaagctcatcgtcctcgccctcctcaccctctggagccacctctcccgcaacggctccctcgagtggaccatcacgctcttctccctctccacgctccccaacacgctcgtcatggggatcccgctcctcaagggcatgtacggcgacgagtccgggtcgctcatggtccagatcgtcgtcctgcagtgcatcatctggtacacgctcatgctcttcatgttcgagtaccggggcgccaggatcctcatcacggagcagttcccggacacggcgggcgccatcgcctccatcgtggtcgacccggacgtggtgtccttggacgggcggagggacatgatcgagacggaggccgaggtgaaggaggatgggaagatacacgtcaccgtgcgccgctctaacgcgtcccggtcggacatctactcccggcggtccatgggcttctccagcaccacgccgcggcccagcaacctgaccaacgccgagatctactcgctgcagtcgtcccggaacccgacgccccgggggtccagcttcaaccatacggacttctactccatggtgggccggagctcgaacttcgctgccggggacgtgttcggcgggccggggcccgtggtacgcacgggggccacgccgcgcccgtccaactacgaggaggacaaggcggccgctgccggggggaacaagtacccggcgcccaaccctgccatggccgcggcgccgccgaagccggggaagaagcagcagcagcagggcaagggcgaggacggcaaggacctgcacatgttcgtgtggagctccagcgcgtcccccgtgtccgacgtcttcggcaacggcgccgagtacaacgtcgacgccgccgccgtcaaggacgtccgcgtcgccgtcgcctcgccgcgcaaaggggacgggaggaaggagaagggggaggactacgtggagcgggacgagttcagcttcgggaacaaggggatggctggagagagggacgcggaggccggcgacgagaaggatcaggggaacgcgggcggcgtggtggcggccacggcgatgccgccgacgagcgtgatgacgcgcctcatcctcatcatggtctggcgcaagctcatccgcaacccaaacacctactccagcctcatcggcctcgtctggtcgctcgtctgcttccggtggaactttgagatgccggcgatcatcatgaagtcaatcgccatcctgtccgacgccggtctcggcatggccatgttcagcctcgggctgttcatggcgctgcagccgcggatcatcgcgtgcgggaacaagagggcgtcgttcgccatggccgtgcgcttcctgaccgggccggcagtcatggccgccgcatccatcgccgtcggcctccgcggcaagctcctccacgtcgccatcgtgcaggcagcactgccccagggcattgtccccttcgtcttcgccaaggagtacagcgtgcaccccgacatcctcagcacggcggttatctttggcatgctcatcgcgctgcccatcacgctggtgtactacatcctgctggggctgtagatcgagcaacaagaaaacaagctagctagctgcatgttacggcttacaaccatgccggagtaggagacaggggaggggacaccgggacagacaagggatcgagcttgcagcggtcatgcatggagggggggcaattagccaattaggactcttaggtgtagagatggaggagggggtgcatggcggaaatgtttagagcaagagctcgggttcggctaaaggggacggaatcaggatccagtttgggttttaggagggtttctctcaagggcgttatggctgcttggactggccttgtaaaatgggtttcaaattgatgaaatgctatagctcttgttcatcttaggctataatactttgcattggcccgatttgaaaaatgatgtttcagcgtcatctagtagtcatatggctgtgtgcaatatcagtcgatgcagatgcccggggttatcctccttttcgaaagaaaaaaaaagtgatctagtcatggc

SEQ ID NO: 3364 - DNA, 2466 bp, Hordeum vulgare
cctcattggctcccccgcccccgcctgcctcccccatatcgccaccgcgcccgcgccataaatcaagcgagcgcagctccacttgaacgccgcacctcaccgcaccgcacgcctcccctgccacgccgccgtgtcagcgtaggaaggaagagcgagcgtttgttgtcgcagcggcggcggcggcggcggccggcacggcaagatgatcacgggcacggacttctaccacgtcatgacggcgatggtgccgctgtacgtggcgatgatgctcgcgtacgggtccgtcaagtggtggcggatcttcacgccggaccagtgctccgggatcaaccgcttcgtggcgctcttcgccgtgccgctgctgtccttccacttcatctccagcaacaacccctacaccatgaacctccgcttcatcgccgccgacaccctgcagaagctcatcgtgctcgcgctgctcaccctctggagccacctctcccgcaacggctccctcgagtggaccatcaccctcttctccctctccacgctgcccaacaccctcgtcatgggcatcccgctcctcaagggcatgtacggcgacgagtccggcagcctcatggtgcagatcgtggtgctgcagtgcatcatctggtacacgctcatgctcttcatgttcgagtaccgcggcgccaggatcctcatcaccgagcagttccccgacaccgccggcgccatcgcctccatcgccgtcgaccccgacgtcatgtcgctcgacggcaggagggacatgatcgagacggaggcggaggtcaaggaggacggcaagattcacgtcaccgtccgccgctccaacgcctcacgctccgacatctactcgcgccggtccatggggttctccagcaccacgccgcgacccagcaacctcaccaacgccgagatctactcgctgcagtcgtcgcggaaccccacgccccggggctccagcttcaaacacaccgacttctaccccacgccccggggctccagcttcaaccacaccgacttctactccatggtgggacgcagctccaacttcgccgccggggacgcgttcggcccggtggtgcgcaccggggccacgccgcgcccgtccaactacgaggaggacaaggccggcaacaacaacaacagcagcaacaacaaatacgggcagtacccggcgcccaaccccgcgatggcggcgccgcagaagccggccaagaaggcggccaacgggcaggccaagggcgaggacggcaaggacctgcacatgttcgtgtggagctccagcgcgtcgcccgtgtccgacgtgttcggcaacggcaccgaggcgtacaacgaggccgccgccaaggacgtccgcgtcgccgccgcctcgccgcgcaaagcggacggcgtggagcgtgacgagttcagcttcgggaacaaggagagggacgcggaggccggcgacgagaaggccgcggcggagcagggcaccgcgggcctggtgccggcgccgacggcgatgccgccgacgagcgtgatgacgcggctcatcctcatcatggtgtggcgcaagctcatccgcaaccccaacacctactctagcctcatcggcctcatctggtccctcgtctgcttccggtggaacttcgtgatgccggcgatcatcatgaagtccatcgccatcctgtccgacgccggcctcggcatggccatgttcagcctcgggctgttcatggcgctgcagccgcggatcatcgcgtgcgggaacaagagggcgacgttcgccatggccgtgcggttcctgacgggcccggccgtcatggccgccgcctccatcgccgtcggcctccgcggcacgctcctccacatcgccatcgtgcaggcagcgctgccccagggcattgtccccttcgtcttcgccaaggagtacagcgtgcaccccgacatcctcagcacggctgtcatcttcggcatgctcatcgcgctgcccatcacgctggtctactacatcctgctggggctgtgagctgacggagacatgcgcggccgggctgcaacaccatgccggcgtggcgtcggagacagacagaggaggcgacaagggagctgcagcggctccatgcgcctgccggggacatgatgcgtgctcctgcacgccggaggctaattactaggattcttaattaggtgtaggggtcagatggggtgaggggaggaatgtttagggcaagagtttgggttggtaaatcaatcaaaggttggggaggcagaggatcaatccggtttggggatttagaaggggtactcctgccatgtgtgcgttgggagaggtttctttccctggagggagggtggctgggctgtaaaatgggtgtcaatttgatgaaattaatgctaagagctcttgttcaccttactatatgccaccagtacaattttttcccatgtgaattagggctgtaatgttttatcaacact

SEQ ID NO: 3365 - DNA, 2431 bp, Hordeum vulgare
cctcattggctcccccgcccccgcctgcctcccccatatcgccaccgcgcccgcgccataaatcaagcgagcgcagctccacttgaacgccgcacctcaccgcaccgcacgcctcccctgccacgccgccgtgtcagcgtaggaaggaagagcgagcgtttgttgtcgcagcggcggcggcggcggcggccggcacggcaagatgatcacgggcacggacttctaccacgtcatgacggcgatggtgccgctgtacgtggcgatgatgctcgcgtacgggtccgtcaagtggtggcggatcttcacgccggaccagtgctccgggatcaaccgcttcgtggcgctcttcgccgtgccgctgctgtccttccacttcatctccagcaacaacccctacaccatgaacctccgcttcatcgccgccgacaccctgcagaagctcatcgtgctcgcgctgctcaccctctggagccacctctcccgcaacggctccctcgagtggaccatcaccctcttctccctctccacgctgcccaacaccctcgtcatgggcatcccgctcctcaagggcatgtacggcgacgagtccggcagcctcatggtgcagatcgtggtgctgcagtgcatcatctggtacacgctcatgctcttcatgttcgagtaccgcggcgccaggatcctcatcaccgagcagttccccgacaccgccggcgccatcgcctccatcgccgtcgaccccgacgtcatgtcgctcgacggcaggagggacatgatcgagacggaggcggaggtcaaggaggacggcaagattcacgtcaccgtccgccgctccaacgcctcacgctccgacatctactcgcgccggtccatggggttctccagcaccacgccgcgacccagcaacctcaccaacgccgagatctactcgctgcagtcgtcgcggaaccccacgccccggggctccagcttcaaacacaccgacttctaccccacgccccggggctccagcttcaaccacaccgacttctactccatggtgggacgcagctccaacttcgccgccggggacgcgttcggcccggtggtgcgcaccggggccacgccgcgcccgtccaactacgaggaggacaaggccggcaacaacaacaacagcagcaacaacaaatacgggcagtacccggcgcccaaccccgcgatggcggcgccgcagaagccggccaagaaggcggccaacgggcaggccaagggcgaggacggcaaggacctgcacatgttcgtgtggagctccagcgcgtcgcccgtgtccgacgtgttcggcaacggcaccgaggcgtacaacgaggccgccgccaaggacgtccgcgtcgccgccgcctcgccgcgcaaagcggacggcgtggagcgtgacgagttcagcttcgggaacaaggagagggacgcggaggccggcgacgagaaggccgcggcggagcagggcaccgcgggcctggtgccggcgccgacggcgatgccgccgacgagcgtgatgacgcggctcatcctcatcatggtgtggcgcaagctcatccgcaaccccaacacctactctagcctcatcggcctcatctggtccctcgtctgcttccggtggaacttcgtgatgccggcgatcatcatgaagtccatcgccatcctgtccgacgccggcctcggcatggccatgttcagcctcgggctgttcatggcgctgcagccgcggatcatcgcgtgcgggaacaagagggcgacgttcgccatggccgtgcggttcctgacgggcccggccgtcatggccgccgcctccatcgccgtcggcctccgcggcacgctcctccacatcgccatcgtgcaggcagcgctgccccagggcattgtccccttcgtcttcgccaaggagtacagcgtgcaccccgacatcctcagcacggctgtcatcttcggcatgctcatcgcgctgcccatcacgctggtctactacatcctgctggggctgtgagctgacggagacatgcgcggccgggctgcaacaccatgccggcgtggcgtcggagacagacagaggaggcgacaagggagctgcagcggctccatgcgcctgccggggacatgatgcgtgctcctgcacgccggaggctaattactaggattcttaattaggtgtaggggtcagatggggtgaggggaggaatgtttagggcaagagtttgggttggtaaatcaatcaaaggttggggaggcagaggatcaatccggtttggggatttagaaggggtactcctgccatgtgtgcgttgggagaggtttctttccctggagggagggtggctgggctgtaaaatgggtgtcaatttgatgaaattaatgctaagagctcttgttcaccttactatatgccaccagtacaattttttcc

SEQ ID NO: 3366 - DNA, 2673 bp, Panicum virgatum
gccggggcagcctcgagtggaccatcacgctcttctccctctccacgctgcccaacacgctcgtcatgggcatcccgctgctcaagggcatgtacggcgacttctccggcagcctcatggtgcagatcgtcgtgctccagtgcatcatctggtacacgctcatgctcttcatgttcgagtaccgcggcgcgcggatgctcatcaccgagcagttcccggacaacgccggggccatcgcctccatcgtcgtcgacccggacgtcgtctccctcgacggccggcgggacgccatcgagaccgaggccgaggtcaaggaggacggcaagatacacgtcaccgtgcgccgctccaacgcctcgcgctccgacatctactcgcgccgctccatgggcttctccagcaccacgccgcgccccagcaacctcaccaacgccgagatctactcgctgcagtcgtcgcgcaacccgacgccgcggggctccagcttcaaccacaacgacttctactccatggtcggccgcagctccaacttcggcgccgccgacgccttcggcgtccgcaccggcgccacgccgcgcccgtccaactacgaggacgacgcgtccaagaccaagtacccgctgcccgtcgtgaatgcagcgcccgggccgggccactaccccgcgcccaacccggcggtggccgcggcgcccaagggcgccaagaaggccgccaccaacgggcaggccaagggcgaggacctccacatgttcgtctggagctccagcgcgtcgccggtctcggacgtcttcgccggcggcgcgccggactacaacgacgccgccgcggccgtcaagtccccccgcaaaatggatggagcgaaggacagggacgactacgtggagcgcgacgagttcagcttcgggaacaggggcgcgatggaccgggacgcggaggcaggggacgagaaggccgcgtcggcggcggcgggggtgggcgccgaccccaacgcggtggccgcgccgacggcgatgccgcccacgagcgtgatgacccggctgatcctgatcatggtgtggcgcaagctcatccgcaaccccaacacctactccagcctcatcggcctcatctggtcgctcgtctgcttcaggtggaacttcgagatgccggccatcgtcctgaaatccatctccatcctgtcggacgccggactcgggatggccatgttcagtctcgggctgttcatggcgctgcagccgcggatcatcgcgtgcgggaacaaggtggcgacgttcgccatggccgtgcgcttcctgaccgggccggccgtgatggcggccgcgtccttcgccgtgggcctccggggcacgcttctgcacgtcgccatcgtccaggcagctctgccccagggcattgtccccttcgtcttcgcaaaggagtacaacgtgcaccctgacattctcagcactgcagtcatttttggcatgctcatcgccctgcccatcacgctcgtctactacatcctgctcgggttgtgagcgccgaccgccattgctgtaaaaaagactagcaccacccaatatcagatcaggggaggcaaagggaggacagagctgcaacgacactgcttggcgcttgcaaaatgagtgacttgtttctttttttttcttgttctctttttcttttttttcttttttttctactagaagtaggtgtggggattgggagaagggaaagggtggaggtggacaagacgttagctagctaggacgacaatggtgaggcaaaaggcaccaaaagcaggtacaagtacaaagcttgaagggaagaggggatcatcctgtttcagcaggtcacgggacttgggggatcggtgagttttcgcaacgggttcttttggggattttggatggccgcgctgaccgctgtaaaatggacgccatttctgacaagaggtcgatcgatcatgctttgctcatctcatgagtttgatggactgagatggtatttgtcatcagttttccgggtaactatactccaatcccaaaaaaacaacctgcgggggtgagaccgcccccacggcattgtttgagaggtagaataaccttctcacagcaggccaagaaaacccccgaactcctgccccacccgtacacggggtccgtcgctttattagttaggccgggctccacagtgctttggacgtgagacaagcgagggagttttttttaaccccagagctgaaattcgcccccgatggggatcgaacccaggacctctggggagtgcctccagcgatgctaccactacgatagcaggcctttggcagtggattcaatccccaaagctagattgtgcagaatgtctatttccttggttcctcttcatccgatttttcgaatgttttcacaaccgttttacgttcccatggttcagtgagtaaaacagctggtcagcgcaagtcaaagccagcaaatggataactcgtggtcgttgatcctggataagtagggttttgtgcggcatgacttgagttgcattacgtggagcaagtaatcatggcgttttttttcccctttggcgcttttgggtgagcaaaatcaggtgaagcctaacttccggatgattaggggagattattggatcaaaacatgccttcaactaaaaaattgtgccccacttcagtattattag

SEQ ID NO: 3367 - DNA, 3081 bp, Zea mays
gtaaaaatgaaattggcttgaaatctcattttcggtgacctccaaaaattaaaaaacgaaaactttaaccctgaaatgaacccacgcaataccggatcctattgtgctggaaccggacaaaaggaaaactgtactttataccggactgcatgctaatgctaatctattaaccgcactccactccaccccctcccgccctgtccacaccaaccacgctcggaggctcccctttcattttcacctcgctccggggccaagtcgccagttcaccaccttcacttcacttcgcaccggaccaccggccgtattcattcctcctccctccctcctcgccatacggctgcagcatcttcccctcaccctcctcattaccccgcgtctctccctcaaaactactcattgctctcaccgttccattgcccccgcggccccgccgtacgctcattcccggctagctcctcctccgcacggccatgatcttgagttcttggcattgatgacgttctagtaccgagcgagccagcccctctttaacccaccttaacaataaacacagcctgcccccaccggccacctcttcttcccccgtgcagctcgagctgattcggcgggctctgccccaacatccacccaccttcgtccaatcccgatccaagaccgtgccgtgatccggcagcagcttccgcgcggccatgggcacgggcgcggtggcggtggcggcgccggaccgggccaagcagcggcgggccggcggccacctgtggaagaaggcactgctccacttctccctctgcttcgtcatgggcttcttcacgggcttcgcgccttcctcctcctcctcctggaagtccgccgccgccaccccccagcaccacccgccgcaccgtcccggggaccgcctcgccgcctcccgcgtggccgtcgacgcgcgcgccaccctgtcgccgcccgcggaggccgccgatgcgctctccgccggcgccacggtggacttgggcgacgacgaggaggacgccgcccagcgccgcctcctgatcgtggtcaccaccacgcgctccggccccggggagcgccgccgccgccggggcgagctgctgcgcctcgcccacacgctgcgcctcgtgcgcccgcccgtcgtctgggtcgtcgtcgagcccgccgccgacgcgcccgccaccgctgaggtgctccgcggcaccggcgtcatgtacaggcacctcgccttcaagcccgaggacaacttcaccaccgccgacgccgaggctcacgtgcagcggaacgccgcgctcgcgcatgtcgagaagcaccgactcgccggcgtcctgcacttcgccgacgccgccggcgtctacgacgtcggcttcttcgaacagatccgccagatcgaggcgtttggtacatggcctgtggcaacaatgtcggcgggcgagaagaaagtggtagtggagggtccactgtgcagtgcctcaaaggtcgtcggttggttctcaagggacttcaacgacgggaccacccgttcagtgacgtataacacggaagctgacctgaatcctgctggtgccgctggtacacgagcccacacgatcgacgtctcaggttttgcgttcaatagctctattttgtgggatcctgagcggtggggacggccaacgtcattaccagacacttcacaggactcgatcaagttcgtgcaagaagtgctacttgaagaccgagctaagctgaaggggatcccctccgactgctcccagatcatggtgtggcagtacagcgtgcccagctcgcgatagagggcagccgagaggacgcacaagaggcgtcgcaacctcgcaggcaggggaagaactgcagggggttggatcggagtcgctgtaaatgtggtgggcgatggtaacggcaaggaaagcaagaaggctgattactaagggttctttttctctctctctcctttttgtgttccctttttctttcccctcagttttagttttcaggtttgggaggggggccatgaatgatgaactgtccgtgggagcaaaagaattgcgatagtatttattcagattcatttgtgattctttagcctggtcggttggtcctgttgtgtttgggttaaaaaaaatggcagtggcgtgaggaatggagaaagtttttattgtgttatggcatgaaatcccagcaaggcagcagcaattaacatctggagaacataaaaatcatgtgcaaagggaaagaaaaaaaagagagaagagactgaatctgcgctcaggtcttgctgtcatcgtccctggtgtttccttgcgggacagtgtttatttgcttttgaaaaaggtctgtgctttgcttgtaagtagagatggcaatgggtacccgaaacccgatgggtaaaaaccctattagggtacgggtatggcgaattttgatacccatgggtattttattgggtcatttgttatgcccatcgggtacggtgggcgtgagtatgttctctgttgccccatacccgctacccgatggggaacccgctaacatatgacacgtgggtcggatttatatgtcccatataaaatgaatttgctctcgttatttgataaccctaagaccctaacgcggccaccagggcaccacgcaccaggcaccaggccagccgccagacggaccatccagaagtcttgtatattcaaatattaagtattgtgtattgaacaattagatttgaaggcatgattttgtccacggttttgtagaatcaatgctatgttttgtgtgatttgaagtcatggtgttgccatttaatgttgaatattgttgaacctgtgataaaattatgttgggttcgatacatttgttatgctggtacttatttttgcgattcaaatgattatgtctatcgtaatgttaatgggtatgggtacccgatgggtacccgctacccatggtgggtatgggtatggcgtaattttgtacccatgataggtagtgggtatgagtatgggtcaaatttttcctagtgggtatgggtatgacttcgtgtgcccactgagtaccttacccactgccatccctacttgtaagaagagaaga

SEQ ID NO: 3368 - DNA, 2054 bp, Saccharum officinarum
cccccaggtcgccagttcaccaccaccttcacttcgcaccgggccaccggccgtattcattcctcctccacctcccttcctccatcctcgcccaacggctgcaacatcttcccatcaccctcctcattgccccgcgtctctccctcaatctcaccattccattcccccggccgtacgcgcattcccggccagctcctccgatctcagcacggccatgatcttgagttcttgggcattgatggcgttctggtagcgagccttctttaactcatcttaacaataactgcgcctgcgccctcacctctcctctcatctcaccctgcagcccgagctgagcggagctgattcggcgggctctgctccacatccacccgccgccttcgcccaatcctgatccagaaccctgtcggcggcgcgccgtgatccagcagcagcagcagcttccgcgcggggctccggcggcgcggccatgggcacgggcgcgcttgcggtggcggcgccggcgccggaccgggccaacaagcagcgccgggccggcggcgcccacctgtggaagaaggcgctgctccacttctccctctgcttcgtcatgggcttcttcacgggcttcgcgccctcctcctcctcctcctggaaagccgccaccacccacccgccgcaccgccccggggaccgcctcgccgcctcccgcgttgccgtcgacgcgcgggccaccctgcttccatcgccgcccacgaccgccggcgacgcgctctccgccgccgttgccgccggcggcggggccacggtggacgtgggcgacgacgacgaggatggcgctgccggccagagccggctcctgatcgtggtcaccacgacgccggcgggccccggggagcgccggcgcccccccgtgctgcgcctcgcccacacgctgcgcctcgtgcgcccgcccgtcgtctggaccgtcgtcgagcccgccgccgacgcgcccgccaccgctgaggtgctccgcggcaccggcgtcatgtacaggcacctcgccttcaagcccgaggacaacttcaccaccgccgacgccgaggctcacgtgcagcggaacgccgcgctcgcgcatgtcgagaagcaccgactcgccggcgtcctgcacttcgccgacgccgccggcgtctacgacgtcggattcttcgaccagatccgccagatcgaggcgtttggcacatggcctgtggcaacaatgtcggcaggcgagaagaaagtggtagtggaaggtccactatgcagtgcctcaaaggtagtcggttggttctcaagggactttaacgatgggaccacccgttcagtgacgtataacacagaagttgacttgaatcctgctggtgctgctggtacacgagcccacacgattgacgtctcaggcttcgcgttcaacagttcaattttgtgggatcctgagcggtggggacggccaacgtctttaccagatacttcacaggactccatcaagtttgtgcaagaagtggtacttgaagaccgagctaagctgaaggggatcccctctgattgctcccagatcatggtgtggcagtatagcatgcccagctcacaatagagggcagtcaagaggatgtacaagagccgtcgcagcctcgcaggaaggagaagaactgcagggattggaccgggagtcaatgtaaatgtggtgggcgataacaaaaaggaaaggaagaaggttgattactaagggttcttttttttcacattctccttttgggttccctttttctctttctctcagttttggttttcaagtttgggggccatgaatgatgaactgcccgtgggagaagttcgcccccaagcgggaaaatatgtgatagtatttattcagattcatttgtgattctttagcttggtcctcttgtgtttgcgaggcgggggcggggccacctagcgaatgcccctcttgtgggttgcaataataccatatgtgtaggaaggaatgaacttgtggagaaaatgccgtggcttagggatgtagaaaaaatcttcatacatcaatcattaagcataat

SEQ ID NO: 3369 - DNA, 2010 bp, Setaria italica
ctcttcattttcacctcgcccattcaccaccatattctttcattcccctcgccccacctccttccctccctccccactctactcctgccgccgctgcatcttgattcaccttcctctctcctcctcattgcccccatctccctccaaactactacttcgtctccattccccatacgccttcctgtggttcctcctccgatcttggttggagctcggcgatgatccaccgatcttgagttcgtcacattaatggcctctaggtagccagcctttctccaatcctcattaactctcccacctcttctctcacggcaacttgagccgagctccagctccgctccgcattgaccatcgcccctcgtcggctcggttcttgccgcgtccaatcctgatctggaagcttcgtgtgccgtgatctgagaggttcgtgggggcatggggaccggggcggtggcggtggcggcgccggaccgggccaagcagcgccggggcggccacctctggaagaaggcgctgctccacttctcgctctgcttcgtcatgggcttcttcacggggttcgcgccctcctcctcgtcgtcctggaaggccgccacccagcacctgccgcaccgggccggggaccaactcgccgcctcccgcgtcgccgtcgacgcgcgcgtcaacatggtgccgtcgccgcccgacgcggctggcgaggtggggctcgccggcgctgccgccgccggcggcggggcgatggtggatgtgggcgacgacgacgaggaggccggcccgcggcggctgctgattgtggtcaccaccacgcggtcaggcgccggcgagcggcggcggcgcagggccgagctgctgcgcctggcgcacaccctgcggctcgtgcgcccgcccgtcgtctgggtggtcgtggagcccgccgccgacgcgcccgccacggccgaggtgctgcggggcacgggcgtcatgtacaggcacatcgcgttcaagcccgaggagaacttcaccacggccgccgccgaggcgcacgcgcagcggaacgccgcgctcgcccacgtcgagaagcaccgcctcgcaggcgtcctccacttcgccgacgccgccggcgtctacgacaccggcttcttcgaccagatccgccagatcgaggcgtttggcacatggcctgtggcaacaatgtcggcaggcgagaagaaagtggtagtggaaggtccactatgcagtgcctcaatggtcgtgggctggttctcaagggacttcaacgatgggactacccgtgcagtgacatataacacagaagctgactcgaatcctgctggtgctgctggtacacgagcccacacaattgatgtctcagggttcgcattcaacagttctattttgtgggatcctgagcggtggggacggccaacatcattaccagatacttcacaggattcgatcaagtttgtgcaagaagtggtactggaagaccgagctaagctgaaggggattccctctgattgctcccagatcatggtgtggcagtatagcgtgcccagctcacaatagaaggtagtaagaggatggcattttcagaaaggggaaattggcggaatcggagtcgatgtaaatgtggcgataacaaaaggaaaggaagaaggtccattactaagttttcttgtttcttttggggttcccttttttctctctctatctcatttttgggtcttcaagtttggagttgggggccaatgatgaattgtccgtgggagatctgcccccgaccggaaaaaagaaaaaaaaagcgatagtatttattcagatttatttgtgattcttttaactcggtgctgttgtgcttggggattcctctggtggaattgcaataaaaccatgtgtaggaggaaggaatgtacttggggaagaaaaaatggcaatggcatgaggaggaagagtgcgttgtgttagttgtggcatgaattccagcaattaccatgtcaagaaaaagaatcatatatatgcacaaaaaagccc

SEQ ID NO: 3370 - DNA, 2084 bp, Brachypodium distachyon
caccgcacacacagaagcaagcaagcagtcattcctcccgccctctttaaacgcacgctgctctccgtcgccaacaaccgccccccaaaaaacgccattttcacttcaccctcaaagctccaagaagcagaagaattcaccacaagaccttccattccagctgccctgatcttcttcttcttcgctgaggagaaccccaccactaggcacaaatcttggttctgatctaggaggaggaggaggactgcctccacatttatgcctgccccatcttgaattcttgctcgctttgcttgctccatccacattgattgattcggcctcgttcgtcctggcgtctggagcttcttcgtcggtggagctccggctgtttgtgaggggcttgatttgatttgaggaggttggttggttggtttgatctggatttggatccttgggcttgatatggggacgggggcggcggcggcggcggagcggccgaagcaggcgcagcggcggggcgggcacctgtggaagagggcgctgctccacttctcgctctgcttcgtcatgggcttcttcaccggcttcgcgccctcctcttcttcctcctggagatccagcgccggcggcgggggcggcctgcacccgcacggcgaccagctcgcggcttcccgcgtcgccgtcaacagcgaccagcacctccgcctgccgccgccctcgcccgagggctccgcggcggcgggcggcgggggcgcgacggtggacctggacgacgacgaggaggaagggcgcgggccgaggaggatgctgatagtggtgaccacgacgcggggaggtggggaggagcggcggcggcggcggccggagctgctgcggctggcccacacgctgcggctggtgcgcccgccggtggtgtgggtggtggtggagccggcggcggacgcgccggccacggcggaggtgctgcggggcacgggggtcatgtaccggcacctggcgttccggcccgaggagaacttcacgacggccgccgccgaggcccacgcgcagcgcaacgccgcgctcgcccacgtcgagaagcaccgcctctccggcgtcctccacttcgccgacgccgccggcgtctacgacgcccgcttcttcgacgagatccgccagatcgaggcgtttggcacatggccagtggcaacgatgtctgcgggcgagaagaaagtagtggtggaggggccactgtgcagtgcgtcgaaggtagtcggttggttctcgaggaacttcaatgacggaaccacccgtacagtgacatataacacagaggctgacctgaatcctgccggggctgctggcacgcgagcacacaccattgatgtatcagggttcgcgttcaacagttctattttgtgggaccctgagcgatggggccgaccaacatcattaccggacacttcacaggattccatcaagtttgtgcaagaggtggtgctagaagacaggaataaactgaagggtatcccctctgactgctcccagatcatggtgtggcaatatactgttcctagccccattcctctaaaaaaatcgcccccgaaaactcaccatagaaggtagggagggagtgagaggaaacaagaggaaatcttctgcagaaagacgatgcgagaaacaagaagaaatcttctgcagaaagacgacgtgagttgatgtaaatgtggcgaaaacaagagataagggagagaagattgcttacaccgaattccttttttttcttttcttttcatttttgttcttttgggaggggtcatgaattatcctcggaaaatcttccccgccccaagcaatagtatttattcagatttacatttatgattctttaactcgcgaccgctcctctcttccaggtaaaatcttttcagaacccctcccccctttgtggagtgcaataataagctgtgtacaagtgtggtaaaaagaaaactggcaaaatgccaaacacgatgctttccagaaatctgagcccgctcccagaagaacacacgttcagaaaacagctccctttgtgattctggcactgtccatgccaagcaaatttaaggatcggaattact

SEQ ID NO: 3371 - DNA, 1879 bp, Secale cereale
actacgaccttccgtcctcatctccttcttcttcttccccaccccttccccaggcacattcctccacccccaaatcttgggtgctgatctagcgccgcctgccccccgcattaattgccctccccccatcttgctccgtccgcattgattcaagggcaagcaggcagggtggcttctagctctcgtcagccccgcagagcccaatcctctggtctttgggcctcgttggttcttgatctgggaggggagaggaggtgctctgtggcgggccttgatttgatctgaaaggcgtgattttttgcgggaggtcggaggatttgtgtgtcgggccgtcatggggacgggggcggtggcgccggagcggccgaagcagcggcggggcgggcacctgtggaagcgcgcggtgctccacttctcgctctgcttcgtcatgggcttcttcaccggcttcgcgccctcctcctcctcttcctggaggcccggcggcggggcaggcacgccgccgccggtcctcgcggcggagcagctcgctgcttcccgtgtcgctgccaacagggaccagcacatcagcctggcgccgccctcgccggagggcgcggcggcggccggcgggggcggcgcggtggtggacctggacgacgacgaggagagcggcccgcgccggatgctgatagtggtcaccacgacgcggtccggggcaggggagcggcggcggaggcggccggagctgctgcggctggcccacacgctgcgcctggtgcgcccgccggtcgtctgggtggtggtggagccggcggcggacgcgcccgccacggccgaggtgctccggggcaccggggtcatgtaccggcacctggccttccgcccggaggagaacttcaccaccgccgccgccgaggcccacgcgcagcgcaacgccgcgctcgcgcacgtcgagaagcaccgcctctccggcgtcgtccacttcgccgacgccgccggcgtctacgacacccacttcttcgacgagatccgccagatcgaggcgtttgggacatggccagtggcaacaatgtccgcgggcgagaagaaagtagtggtcgagggcccactgtgcagcgcctcgaaggtagtcggctggttctcgaggaacttcaatgatggtaccacccgttcagtgacatataacacggaggttgacttgaatcctgccggtgctgctggcacgcgagcccacacgatcgatgtatcagggtttgcgttcaacagttctattttgtgggaccctgagcggtggggacgaccaacgtcattaccggacacttcacaggactcgatcaagtttgtgcaagaggtggtgctggaggacaggacaaagctgaaggggatcccctccgactgctcccagatcatggtgtggcagtatgatgtgcccagcagccccaacactcccaaaaccaaaaccaaaaccgccaccccgaaaacccaccatagaagaaggtagggaggaggagggggatgagactgaacagtagcgaaaatcttccgcggagaagaagaagagtgttgggagtggagttgatgtaagtaaatgtggcgaaagcataaaaggagaaaggaagaaggttgctgcttacactgagtttttctttttctttttttcctctttctctcaattttgtccctttttcccttgggggtcatgaatttgtcctctggaaatggaaatcgaccccggggcaatagtattatttattcagattattttaccctgtgattctttaactcggccgccccctcctcgctccctcctccgggtgatctccagcggatttccccgtttgtggagtgcaagcgagcaataataagctgtgtagaaagtgtgggagatctggcagat

SEQ ID NO: 3372 - DNA, 1753 bp, Secale cereale
ggcagggtggcttctagctctcgtcagccccgcagagcccaatcctctggtctttgggtcctcgttggttcttgatctgggaggggagaggaggtgctctgtggcgggccttgatttgatctgaaaggcgtgattttttgcgggaggtcggaggatttgtgtgtcgggccgtcatggggacgggggcggtggcgccggagcggccgaagcagcggcggggcgggcacctgtggaagcgggcggtgctccacttctcgctctgcttcgtcatgggcttcttcaccggcttcgcgccctcctcctcctcttcctggaggcccggcggcggggccggcacgccgccgccggtcctcgcggcggagcagctcgctgcttcccgtgttgctggcaacagggaccagcacatcagcctggcgccaccctcgccggagggcgcggcggcggccgcgggggcggcgcggtggtggacctggacgacgacgacggagagcgggccgcgccggatgctgattgtggtcaccacgacgcggtccggggcaggggagcggcggcggaggcggccggagctgctgcggctcgcgcacacgctgcgcctggtgcgcccgccggtcgtctgggtggtggtggagcccgcggcggacgcgcccgccacggccgaggtgctccggggcaccggggtcatgtaccggcacctggccttccgcccggaggagaacttcaccaccgccgccgccgaggcccacgcgcagcgcaacgccgcgctcgcgcacgtcgagaagcaccgcctctccggcgtcgtccacttcgccgacgccgccggcgtctacgacacccacttcttcgacgagatccgccagatcgaggcgtttggcacatggccggtggcaacgatgtctgcgggcgagaagaaagtagtggttgagggcccactgtgcagcgcctcgaaggtagtcggctggttctcgaggaacttcaatgatggtaccacccgttcagtgacatataacactgaggttgacttgaatcctgctggtgctgctggcacgcgagcccacacgatcgacgtatcaggatttgcgttcaacagttctattttgtgggatcctgagcgatggggacggccaacgtcattaccggacacttcacaggactcgatcaagtttgtgcaagaggtggtgctggaggacaggacaaagctgaaggggatcccctccgactgctcccagatcatggtgtggcagtatgatgtgcccagcagccccaacactcccaaaaccaaaaccaaaaccgccaccccgaaaacccaccatagaagaaggtagggaggaggagggggatgagactgaacaggagcgaaaatcttccgcggagaagaagaagagtgttgggagtggagttgatgtaagtaaatgtggcgaaagcataaaaggagaaaggaagaaggttgctgcttacactgagtttttctttttcttttttcctctttctctcaattttgtccctttttcccttgggggtcatgaatttgtcctctggaaatggaaatcgaccccggggcaatagtattatttattcagattattttacctgtgattctttaactcggccgccccctcctcgctcgctcctccgggtgatctccagcggatttccccgtttgtggagtgcaagcgagcaataataagctgtgtagaaagtgtgggagatctggcagatgaaatgatgatgaattcacagcatgggtttccagcaa

SEQ ID NO: 3373 - DNA, 1960 bp, Secale cereale
cccgttttactaccccccaccaccacgctccacccgagccaacgattcaccaccccctcccccccctccctcctacccctactacgaccttccgtcctcatctccttcttcttcttccccacccccttccccaggcacattcctccactcccaaatcttgggtgctgatctagcgccgctgcccgccgcattaattgccctccccccatcttgctccatccgcattgattcaagggcaagcaggcagggcggcttccagctctcgtcagccccgcagagcccaatcctctggtctttgggcctcgttggttcttgatctgggaggggagaggaggtgctctgtggcgggccttgatttgatctgaaaggcgtgattttttgcggggaggggtcggaggatttgtgtgtcgggccgtcatggggacgggggcggtggcgccggagcggccgaagcagcggcggggcgggcacctgtggaagcgcgcggtgctccacttctcgctctgcttcgtcatgggcttcttcaccggcttcgcgccctcctcctcctcttcctggaggcccggcggcggggccggcacgccgccgccggtcctcgcggcggagcagctcgctgcttcccgtgtcgctggcaacagggaccagcacatcagcctggcgccgccctcgccggagggcgcggcggcggccgcgggggcggcgcggtggtggacctggacgacgacgaggagagcggcccgcgccggatgctgatagtggtcaccacgacgcggtccggggcaggggagcggcggcggaggcggccggagctgctgcggctggcccacacgctgcgcctggtgcgcccgccggtcgtctgggtggtggtggagccggcggcggacgcgcccgccacggccgaggtgctccggggcaccggggtcatgtaccggcacctggccttccgcccggaggagaacttcaccaccgccgccgccgaggcccacgcgcagcgcaacgccgcgctcgcgcacgtcgagaagcaccgcctctccggcgtcgtccacttcgccgacgccgccggcgtctacgacacccacttcttcgacgagatccgccagatcgaggcgtttggcacatggccggtggcaacgatgtctgcgggcgagaagaaagtagtggttgaggggccactgtgcagcgcctcgaaggtagtcggctggttctcgaggaacttcaatgatggtaccacccgttcagtgacatacaacactgaggttgacgttgaatcctgccggtgctgctggcacgcgagcccacacgatcgatgtatcagggtttgcgttcaacagttctattttgtgggatcctgagcgatggggacggccaacgtcattaccggacacttcacaggactcgatcaagtttgtgcaagaggtggtgctggaggacaggacaaagctgaagggcatcccctccgactgctcccagatcatggtgtggcagtatgatgtgcccagcagccccaacactccccaaaaccaaaaccaaaaccgtcaccccgaaaacccaccatagaagaaggtagggaggaggagggggacgagactgaacaggagcgaaaatcttccgcggagaagaagaacagtgttgggagtggagttgatgtaagtaaatgtggcgaaaacataaaggaaaaggaggaaggttgctgcttacactgtagttttttttactttctctcaattttgtccttttttcccttgggggtcatgaatttgtcctctggaaatggaaatcgaccccccgggcaatagtattatttattcagattattttacctgtgattctttaactcggccgccccctcctcgctcgctcctccgggtgatctccagcggatttccccgtttgtggagtgcaagcgagcaataataagctgtgtagaaagtgtgggagatctggcagatgaaatgatgat

SEQ ID NO: 3374 - DNA, 1505 bp, Avena sativa
tccccaattactactacttcttgttctgctccatccacattgattcagctccctcccctctcctgcatttccccctccccgcttctccaatccttgagcgccgtctgctcttgctcgccctgatctgggtggaaggcccggctcgcggctcttgatctggggaggagggattcgttgatttctgccggtcttgatctaaaaaagcttgagttttgggaggacttcttggtagccccccggattcgtgtcgggcttcatggggacgacgggggcggtggcgccggagcggctcccgaagcagcggcgggggggccacctctggaagaaggcgctgctccacttctccctctgcttcgtcatgggcttcttcaccggcttcgcgccctcctcctcctcttcctggagggccaacggcgctggcggcgacacggtgccgcaccgcgcggccgaccagcaggcagcatcccgcgtcgccgtcggcgctaacccacacatcaacctggcgccgccctcgccggaggggggaggcgcgacggtggacgtggacgacgacggcgaggacggggccgggccgcgccggatgctcatagtggtcaccaccacgcggtccggagcaggggagcggcggcggcgcaggccggagctgctgcggctggcccacacgctccggctcgtgcgcccgccggttgtctgggtcgtggtggagccggcggcggacgcgcccgccacggccgaggtgctgcggggcaccggggtcatgtaccgccacctggccttccgccccgaggagaacttcacctccgccgacgccgaggcccacgcgcagcgcaacgccgcgctggcccacgtcgagaagcaccgcctctccggcgtcgtccacttcgccgacgccgccggggtctacgacgcacgcttcttcgacgagatccgccagatcgaggcgtttggcacatggccagtggcaacgatgtccgcgggcgagaagaaagtagtggtggagggcccactgtgcagtgcctcgaaggtagtcggttggttctcgagaaacttcaatgatggcaccacccgatcagtgacatataacacagaggctgacttgaatcctgctggtgctgctggcacgcgagcccacacgattgacgtatcagggtttgcgtttaacagttctattttgtgggaccctgagcggtggggacgaccaacgtcattaccggacacttcacaggattcgatcaagtttgtgcaggaggtggtgctggaggaccggacgaagctgaaggggatcccctcggactgcgcccagatcatggtgtggcagtacaccatgccgagccccctggctcccctcaagacctcaactcaccatagaaggtaggcacgacatggagaagaggaagaaaatctctctccagaaatgaacgaacaatgttggttgggaggtcgatgtaaatgtggcgaaaacaaaaagggaaaaagggaggaggtcgcttgcttacactgagttc

SEQ ID NO: 3375 - DNA, 1691 bp, Triticum aestivum
cctttggtctttgggcctcgttggttttgatctgggaggggaggctcggtgatctgtggcgggtcgtgatttgatctgaaagttgtgattttttggggggaggggtcggaggatttgtttgttggtccgtcatggggacgggggcggtggcgccggagcggccgaagcagcggcggggcgggcacctgtggaagcgggcggtgctccacttctcgctctgcttcgtcatgggcttcttcaccggcttcgcgccctcctcctcctcctcctggaggcctggcggcgggggcggcacgccgccgccgattctcgcggcggagcagctcgccgcgtcccgcgtcgcgggtaatagggaccagcatatcagcctggcgccgccctcgccggagggcgcggcggcggccggcgggggcggcgcggtggtggacctggacgacgacgaggagagcgggccgcgccggatgctgattgtggtcaccacgacgcggtccggggcaggggagcggaggcgcaggcggccggagctgctgcggctcgcccacacgctgcggctggtgcgcccgccggtcgtctgggtggtggtggagccggcggccgacgcgcccgccacggccgaggtgctgcggggcaccggggtcatgtaccgccacctggccttccgcccggaggagaacttcaccaccgccgccgccgaggcccacgcgcagcgcaacgccgcgctcgcccacgtcgagaagcaccgcctctccggcgtcgtccacttcgccgacgccgccggcgtctacgacacccacttcttcgaggagatccgccagatcgaggcgtttgggacatggccagtggcaacaatgtccgcgggcgagaagaaagtagtggttgagggcccactgtgcagcgcctcgaaggtagtcggctggttctcgaggaacttcaatgatggcaccacccgttcagtgacatataacactgaggttgacttgaatcctgccggtgctgctggcacgcgagcccacacgatcgatgtatcagggtttgcgttcaacagttctattttgtgggaccctgagcgatggggacgaccgacgtcattaccggacacttcacaggactcgatcaagtttgtgcaagaggtggtgctggaggacaggacaaagctgaaggggatcccctccgactgctcccagatcatggtgtggcagtatgatgtgcctagtagccccaacacccccataaccaaaaccaaaaccgccaccccgaaaacccaccatagaagaaggtagggaggagggcgatgggactgaacaggagcaaaatcatccgcggagaagaacagtgtcggaaatggagtttatgtaagtaaatgtggcgaaaacaaaaaggaaaaggaggaaggttgctgcttacactgagttttttttttctttctctcaattttgtccttttttcccttggggggtcatgaattgtcctctggaaatggaaatcgacccccgggcaatagtattatttattcagattattttacctgtgattctttaaccccgaccgcccctcctcgctcctccgggtgatctctcgcggattctccgtctgtggagtgcaagcgtgcaaataagctgtgtagaaagtttgagaaatcttgcagatgaaatgatgaattcacagcatgggcttccagcaaatttcagcat

SEQ ID NO: 3376 - DNA, 4615 bp, Zea mays
cccaaatccgcgtccctcgctcgtgtccgcgtcttgctcctctctctcacgccactcacgcgagctcgcttgctgcttcctgtggacttgttcgtcttccaactcctgcttcctgtctgtccccaactcggagcggcgacgccgagctcaccaaccctcccgtccggccaccccgtccccacccacggctactactactagtacccggcgctcccccttcctcgttccattcatttgccaccgccgtcccctcctctcctctgccccttcgcttctctctgtccttcctaccgcttctattttagttcattcaactcaggttccattcgtcgttcaaagaagagcaaggagcttcacagatccggccgccgccgctacctcactctacttcctgctgtggcccctggcttcctcccctccctccctgcttctcccccatctgaatctgcgtgcgcgccgctgcttcttgctttgaatcctgtcccggggttccgccctgatttctcggtctttgtcggatttgctttccgttcgcaattcgcaaggaggaccaaaaaaaaaaaaagttgccatcttttttctgtccttccgcagcgaaatctgccggttttgattggtatacacacacttgcttcagtcgatagatgcccctccattgcatccgtctctgacgcttccgcttccgcttccgcttccgtcttgcagatcagccaccgccactgaccgatccgtacctgcatcctccagtacccgggccgcccgccatggcctccaccggcggcggcggcggcctccgccacagcaacagcagccgcctctcgcgcatgtccttctccggcggcggaagcgacgacgcccgcgcgcaggcggccgccgccccgggcggcgaccgccccatggtcaccttcgcccgccgcacccgctcgggacgctacgtcagctactcccgcgacgacctcgacagcgagctcggcgccgccggcgtcgacatgtcccccgaccgcgacgagcagttcgccagctaccacgtccacatcccggccacgcccgacaaccagcccatggacccggccatctccgcccgcgtggaggagcagtacgtctccaactccctcttcacgggcggcttcaacagtgtcacgcgcgcgcacctcatggacaaggtcatcgactcggaggccagccacccgcagatggcgggggccaggggctcctcctgcgccgtcaacggctgcgacgccaacgtcatgagcgacgagcgcggcgacgacatcctcccctgtgagtgcgacttcaagatctgcgccgagtgcttcgccgacgccgtcaagaacgccggtgccatctgccccgggtgcaaggagccatacaagaacacggagcttgacgacgtcgttggcgctgccgctgatgccacagccgggggcaggcctacgctctcgctgcccccgccgcctggcgccgctgcttccaggatggagaggaggctctccatcatgcgctcccagaaggccatgaccaggagccagaccggagactgggaccacaaccgctggctcttcgagaccaaggggacgtatgggtatggcaatgctatctggcccaaggagaatgaggtggacgctgcaggcggcttgggtggaggtggagctgatggacagccggccgagttcaccaccaagccatggaggccgctcactcggaagctttccatccctgctggagtactcagcccatacaggcttctcattcttatccgcatggccgtccttggtctgttccttacttggagaattaagcacaagaatgaggatgccatttggctctggggcatgtctgttgtctgcgaactctggtttggtttttcatggctgctcgaccagctgccaaagctgtgccctgtgaaccgggccaccgaccttgccgtcctgaaagacaagtttgagaccccaacgccgtccaaccctactggacggtcggatttaccagggcttgatatatttgtgtctactgctgatccggagaaagaacctccactggtcacagcaaacactatcctgtccatccttgctgctgactaccctgtggagaagctttcttgctatgtttctgatgatggaggggctctcctgacttttgaagccatggctgaagctgctagctttgctaatatgtgggttcctttctgtcgcaagcacaacattgagcctcgcaatcctgacagctacttcaatcttaagaaggacccatacaagaacaaggttcgccaggattttgtcaaggacaggaggagggtcaagagggagtatgacgagttcaaggtcaggatcaatggtctgcctgactcgatacgccgacgctctgatgcgtaccatgccagagaggaaatcaaggctatgaagaggcagcgtgaggccgctcttgatgatgcagtggagcctgttaagatccctaaagctacatggatggctgatggcactcactggcctggtacttggattcaaccttctgctgagcatacccgtggtgatcatgctggaattattcaggtgatgctgaaacctcccagtgacgatcccttgtacggcagcaccggtgatgaaggcagacctcttgatttcaccgaggtcgacatccgtttgccaatgctggtgtatgtgtcccgagagaagcggcctggttatgatcacaacaagaaggctggagcgatgaatgctctggtccgttcatctgctgtcatgtcaaatggccccttcatcctcaacctcgactgtgatcactatgtctacaactcgcaagctttccgcgaagggatgtgcttcatgatggaccgtggtggcgaccgcattggttatgtccagttcccgcagcggtttgagggcatcgatccatcagatcgctatgccaaccacaacaccgtcttcttcgacgtcaacatgcgcgcgctggatggtctcatgggaccagtctatgttggcactggctgccttttccgccgtgttgccctatatggatttgaccctccgcgctccaaggagcacggtggctgctgcagctgttgcttcccccagagacgcaagatcaaagcttcagccgctgcaccggaggagacccgggctctaaggatggcagacttcgacgaggatgaaatgaacatgtcgtcgttccccaagaagtttggtaactcgagcttcctcatcgactccattccgattgctgagttccaagggcgcccgcttgctgatcaccctggtgtcaagaacggccgccctcccggtgctctcactgtcccccgtgaccttctggatgcatccacagtcgctgaggccgtcagtgtcatctcatgctggtacgaagacaagaccgagtggggccaccgtgttggttggatctatggctcggtgacggaggatgtggtcactgggtaccggatgcacaaccggggttggaagtcggtgtactgtgtcaccaagcgtgacgccttccgcggcaccgcgcccatcaacctgaccgaccgtctccaccaggtgctccggtgggctactggatcagtggagatcttcttctcccgcaacaacgcgctgctggcgagccgcagaatgaagttcttgcagaggatcgcgtacctgaacgtgggtatctacccgttcacgtccatcttcctgatcgtctactgcttcctgccggcgctgtcgctgttctcggggcagttcatcgtgaagacgctgaacgtgacgttcctgacgtacctgctggtgatcacgctgacgctgtgcctgctggcggtgctggagatcaagtggtcggggatcagcctggaggagtggtggcggaacgagcagttctggctgatcggcggcacgagcgcgcacctggcggccgtgctgcagggcctgctgaaggtggtggcgggcatcgagatctccttcacgctgacgtccaagtcgggcggcgacgacgtggacgacgagttcgcggacctgtacatcgtcaagtggacgtcgctgatgatcccgcccatcgtgatcatgatggtgaacctgatcggcatcgcggtcgggttcagccgcaccatctacagcgagatcccgcagtggagcaagctgctgggcggcgtcttcttcagcttctgggtgctggcgcacctgtacccgttcgccaagggcctgatggggcggaggggccgcacgccgaccatcgtcttcgtctgggcgggcctcctctccatcaccatctcgctgctgtgggtggccatcaacccgccgtcccagaaccagcagattggtgggtcgttcacattcccctgaaagctctctgggccaatggcggattcatgcatgcttcgtcgcagtgggatccttgcgttgctctgcatcagttcctggttgcagcggttcactatctgaggacgaagctgctggggggaatgtgggatcctgactgtcgaactggctacttttttgttgtcgaagctgataatactcttatgatgagctatagtagtagttcttttgttcttttgtttttgctatatataaaatacatgttctggtcccataatttggttatgttggacaattaaacgtggagccccaaatttccagtcttttgttgg

SEQ ID NO: 3377 - DNA, 4436 bp, Setaria italica
tccatgtgatgcaagcggttggatgcgtgtttcccccattttcctccgcgtccttgctcgtgcgtgtctgctacccgttcttcctcctgcctgctccttcctgcggacttcgtctcctcttccccactcggagctaccaaatcccaccccttcccatccccactactactagtactccccctcccccttccccttcgctccgttctccattgccaccgccggcttgtcccctcctcgccccttcagctccttcagacttgttcatccaagagaggaggaggaggactggaggaggcatccgccgccattactctcacctcacctgcttgcgcgtttgactcgtcctcgactcggagtcgaatgatcaaccactgaccgatacgagctccacttcccccatggcctccaacggcggcggcggcggcgtcctccgccacagcaacagcagccgcctctcgcgcatgtcctactccggcgaggacggccgcggcgcccaggcccccgccggcgaccgccccatggtcaccttcgcccgccgcacccactccggacgctacgtcagctactcccgcgacgacctcgacagcgaggtcggcggcatcggcgacttctcccccgagcaccaggagttcctcagctaccacgtccacatcccggccacccccgacaaccagcccatggatcccgccatctccgcccgcgtcgaggagcagtacgtctccaactccctcttcaccggcggcttcaacagcgtcacgcgcgcccacctcatggacaaggtcatcgagtccgaggccagccacccgcagatggccggcgccaagggatcctcctgcgccatcaacggatgcgacgccaaggtcatgagcgacgagcgcggcgaggacatcctcccctgcgaatgcgacttcaagatctgcgccgagtgcttcggcgacgccgtcaagaacggtggtggcgtctgccctgggtgcaaggagccgtacaagaacacggagctggaggatgtggtcggcggcgcggctggggcgagggccacgctgtcgctgccaccaccacccggtgctggtggtgctgccgcgtccaggatggagaggcggctgtcgataatgcggtcgcagaaggccttgaccaggagccagactggggactgggatcacaaccggtggctctttgagacaaaagggacatatgggtatggcaatgccatatggcccaaggagaatgaggtggagagcggtggtggtggtggaggcggcctaggtggagccgacggccagccagccgagttcaccaccaagccatggaggccgctcacccggaagctttccatccctgctggcatccttagcccatacaggcttctcattctaatccgtatggccgtgctcggtctgttccttacatggagaattaggcacaagaatgaggatgcaatttggctgtggggcatgtctgttgtttgtgaactctggtttggcttttcatggctgcttgatcagttgccaaagctgtgccctgtgaaccgagcaaccgaccttgctgtcctcaaagacaagtttgagaccccaacaccgtcgaaccctactggacgatcagatctaccagggcttgatatattcgtgtccactgctgatccagagaaagaaccgccattggtcacagcaaacactatcctttccatccttgctgctgactaccctgtggagaagctttcttgctatgtttctgatgatggaggggctctcctgacatttgaagccatggctgaagctgctagttttgccaacatgtgggttcctttctgtcgcaagcacaacattgagcctcgcaatcctgagagctacttcaatctgaagagggatccatacaagaataaggttcgtcaggattttgtcaaggataggaggagggttaagagggagtatgatgagttcaaggtcaggatcaatgggctgcctgagtcaatccgccgtcgctccgatgcttaccatgccagggaggaaattaaggcgatgaagaggcagcgagagactgctcttgatgatgctgtggagcctgttaagatccctaaagctacctggatggctgatggcacgcactggcctggtacctggatccagccttctgctgagcacacacgtggtgaccatgctggaataattcaggtgatgctgaaacctcctagtgatgatcccttgtatggcagcactggtgaagaaggcagacctcttgatttcactgaggttgacatccgtttgccaatgttggtctacgtgtcccgagagaagcgccctggttatgaccacaacaagaaggctggtgcgatgaatgccctagtccgttcatctgctgtgatgtcaaatggccccttcatcctcaacctcgactgtgaccactatgtttacaactcccaagctttccgtgaaggcatgtgcttcatgatggatcgtggcggtgaccgtattggctatgtccagttcccacagcggttcgagggcattgatccatcagatcggtatgctaaccacaacactgtcttctttgatgtcaacatgcgtgcactggatggtctcatgggaccagtctatgtgggcactggctgtctcttccgccgtgttgcgctatatggatttgaccctccacgcgacaaggaacatggtggctgctgcagctgttgcttcccccagagacgcaaggtcaagacttcagctgctgcaccggaagaaacccgggcactgcgtatggcagactttgatgaggatgaaatgaacatgtcatcattccccaagaagtttggtaactcgaacttcctcatcaactctattccaattgctgaattccaagggcgcccgctagctgatcaccctggtgtcaagaacggccgccctccgggtgctctcactgtcccccgggaccttcttgatgcctccacagttgctgaggccatcagtgtcatctcatgctggtatgaagacaagactgagtggggccaccgtgtcggttggatctatggttcagtcacagaggatgtggtcactggataccggatgcacaaccgtggatggaagtcagtgtactgtgtaaccaagcgcgatgccttccgtggcactgcacccatcaatctcactgaccgtctccaccaggtgctccgatgggctactggttcagtggaaatcttcttctcccgcaacaatgcgctgctcgcaagccgcaagatgaagttccttcagaggattgcatacctgaacgttggcatctacccgttcacatcaatcttcctcattgtctactgcttcctgccggcgctctccctcttctcggggcagttcatcgtgaagacactcaacgtggccttcctgacctacctgctggtgatcaccctgacgctgtgccttctggcagtgttggagatcaagtggtcagggatcagcctggaagagtggtggcgtaacgagcagttctggctgatcggaggtacaagcgcccaccttgctgcggtgctccaggggcttttgaaggtgattgcgggcattgagatctccttcacgctgacatccaagtcgggcggcgacgacgagaacgacgagtttgcggacctgtacatcgtgaagtggacctcgctgatgatcccgccaatcgtgatcatgatggtgaacctgatcgccatcgcggtggggttcagccggaccatctacagcgagatcccacagtggagcaagctcctgggtggtgtgttcttcagcttctgggtgctggcccacctgtacccgttcgccaaggggctgatggggaggaggggccggacgccgaccatcgtcttcgtctgggcaggcctcctgtccatcaccatctcgctgctgtgggtggccatcaacccgccgtcgcagaactcccagatcggtggatcattcacgttcccgtgagcgatcactcttgcatgaatttcttgcgctggtgggaagggaagttctgactgttgaaatgattaggtgcttttgttggaattgatagtactatatatatcatgagttaccatagttcttttgttctttaatttttgccgtgtaccaatatgagaattggttctgttggaccatgaaacgagtacaaatttccatgttcctggctagctgtgtgtgttctgggtattgggatgccgcttgtgcttcattggctactctgagttggcatgtaccatgtcaagtcatcagcaaggacagtgaaagctcggcacctactctaccagacttgtggcgttgctgggtctgcaagaccaggcaattggctgtcgccagcaaccacgccacttccacacggatttgtctgaccgcgtgctgcaccggcatgaagaagaggtcagagctcttgctaacaccttttgtgacccatgaagaattggcatgtacgagcgagagagattgatagagaggttt

SEQ ID NO: 3378 - DNA, 4253 bp, Oryza sativa
tgcctttttccatttcctctgcctacaactcctcctcctactcatttcttcctcgctgcagcagccgcttgcttcctgtgagacttcgtcgtcgtcttctccgagcttagctttcaccaaaccactagtacttgtactcactcttcgcttcccaaatcttcctcatcaattgctaacacgagtagtctatcatcattaactcgcatcccttccccttccattgctcattgtctttccattcatacggtgttgtgttgttgtggcccaagaagaagaacaagtacaccacacgccattactcccatctctcttactcctcctcgagtttgattgattcgagtggtcgcatcgcatgatcagaaagtgaggcgatcgatccatggcttccagcggcggcggcggcctgcgtcacagcaacagcagccgcctctcgcgcatgtcctactccggcgaggacggccgcgctcaggcccccggcggcggcggcgaccggccgatggtgacgttcgcccgccgcacccactcggggcgctacgtgagctactcccgcgacgacctcgacagcgagctcggcaacagcggcgacatgtcgccggagtctgggcaggagttcctcaactaccacgtgacgatcccggcgacgccggacaaccagccgatggacccggccatctcggcgcgcgtggaggagcagtacgtctccaactcgctcttcaccggcggcttcaacagcgtcacgcgggcgcacctcatggacaaggtgatcgagtcggaggccagccacccgcagatggccggcgccaagggctcctcctgcgccatcaacggctgcgacgccaaggtcatgagcgacgagcgcggcgacgacatcctcccctgcgagtgcgacttcaagatctgcgccgactgcttcgccgacgccgtcaagaacggcggcgcctgccccggctgcaaggacccctacaaggccaccgagctcgacgacgtggtcggtgcgaggccgacgctgtcgctgcctccgccgcccggtggcttgccggcgtcgaggatggagaggcggctgtcgataatgcggtcgcagaaggccatgaccaggagccagaccggcgattgggatcacaatcggtggctgttcgagaccaaggggacatacgggtatggcaatgccatttggcccaaggagaacgaggtcgacaatggcggtggcggtggcggaggcggcgggctgggtggaggcgacggccagccggcagagttcacgagcaagccatggaggccgctcactcgcaagctcaagattcctgcgggtgtccttagcccatacaggcttcttattcttattcgtatggctgttcttggtctattccttgcatggagaattaagcacaagaatgaggatgcaatgtggctatggggcatgtctgttgtttgcgaactctggtttggcctctcttggctcttggatcagctgccaaagttgtgccctgttaaccgagcaactgaccttgctgtcctgaaagataagtttgagaccccgacgccatcaaatcctaacggaagatctgacctgccggggctcgatatatttgtgtctactgctgatccagaaaaagaacccccattggtcacagcaaatactattctgtccatccttgctgctgattatcctgttgagaagctttcttgctatgtttctgatgatggaggcgctctcctgacatttgaagcaatggctgaagccgctagctttgcaaacatgtgggttcctttctgtcgcaaacatgacattgagcctcgcaacccagagagctactttaatctgaagagggacccatacaagaacaaggtccgttctgattttgtcaaggacagaagaagggtgaagagggagtacgacgagttcaaggtcaggatcaatagcttgcctgattcaatccgtcgccgctccgatgcatatcatgccagggaggaaatcaaggccatgaagcggcaacgagaggctgctctcgatgacgtggtggaggctgttaaaatccctaaagctacctggatggctgatggcacgcattggcctggtacctggattcagccctctgctgagcatgctcggggtgaccatgctggaataattcaggtaatgctgaaacctcctagtgatgatcccttgtatggaaccagcggtgaagaaggcagacctcttgatttcactgaggttgacatccgtttgccaatgttggtctatgtgtcccgagagaagcgtcctggttatgatcacaacaagaaggctggtgcgatgaatgcgttggtccgctcatctgctgtcatgtcaaatggacctttcatcctcaaccttgattgtgatcactatgtttacaactcacaagctttccgtgaaggcatgtgcttcatgatggatcgtggtggtgaccgtattggctatgtccagttccctcaacggtttgagggcattgatccatcagatcgatatgctaaccacaacactgtcttcttcgatgtcaacatgcgtgcacttgatggtatcatgggaccagtctacgtcggcactggatgtcttttccgtcgcatcgctttgtatggatttgacccaccgcgctccaaggaacatagtggttgctgcagctgttgcttcccccagaggcgcaaggttaaaacttccacagttgcatctgaagagaggcaggctttgagaatggcagattttgatgatgaggaaatgaacatgtcacaatttcccaagaagttcggtaattcaaacttcctcatcaactctatcccaattgctgaattccaagggcgacctcttgctgaccatcctggagtcaaaaatggacgtcctcctggtgctctcaccgtccctcgcgaccttctcgatgcttccacagttgctgaggctatcagtgtcatctcatgctggtatgaagataagactgagtggggtcagcgtgttggatggatctatggttcagtcacagaggatgtggtcactggttacaggatgcacaaccgtggatggaaatcagtttactgtgtcaccaaacgtgatgctttccgtggcactgcaccaatcaaccttactgaccgtcttcatcaggtgctccggtgggctactggttcagtggaaatcttcttctcccgcaacaatgcactacttgcaagccgaaagatgaagtttcttcagaggattgcatacctgaacgttggcatttaccccttcacatcaatcttcctcattgtctactgcttcctgccagccctgtccctcttctcgggacagttcattgtgcggacgctaaatgtgaccttcctgacctatctgctcgttatcactctgacaatgtgcatgcttgcggtgctcgagatcaagtggtcaggcatcagcttggaggaatggtggaggaatgagcagttctggctaatcggaggaactagcgcccaccttgctgctgttcttcagggtcttctcaaggtgattgctggtatcgagatctccttcacgctgacatccaaatctggaggagatgaagcagacgacgagtttgctgatctctacatcgtcaagtggacatcactcatgatcccaccgatcgtcatcatgatggttaacctgatcgccatcgctgtcgggttcagcaggacaatatacagtgaaatccctcagtggagcaagctcctcggcggcgtgttcttcagcttctgggtgctggctcacctttaccccttcgccaaggggctaatgggaaggagaggacgaacaccgaccatcgtcttcgtctggtctggcctccttgccatcaccatctcattgctgtgggttgccatcaatccgccgtcacagaactcgcagataggcggctccttcacattcccctgagcttcctcatgaacatgaaccttttgtatgatgaattataagagtggtcccagtagcagttgtccttgctgttggacaagtaaattctttacctatgtttacttaggtttttcttttttttttgggtcgaagatgatactattatgaatcatgcatgatactagttcttttgttcgtttttgtgccaaaatgagaagaggttctgtttggacctgaacatcaatcaattgcaaaaattcggagactaggaagttcagagttgcactcctgcacttctttggagctcttccattctgcataactgcgctgtctacttgtattgcatttgcctactcttaatccttcactttgcagtagtact

SEQ ID NO: 3379 - DNA, 4228 bp, Oryza sativa
caactcctcctcctactcatttcttcctcgctgcagcagccgcttgcttcctgtgagacttcgtcgtcgtcttctccgagcttagctttcaccaaaccactagtacttgtactcactcttcgcttcccaaatcttcctcatcaattgctaacacgagtagtctatcatcattaactcgcatcccttccccttccattgctcattgtctttccattcatacggtgttgtgttgttgtggcccaagaagaagaacaagtacaccacacgccattactcccatctctcttactcctcctcgagtttgattgattcgagtggtcgcatcgcatgatcagaaagtgaggcgatcgatccatggcttccagcggcggcggcggcctgcgtcacagcaacagcagccgcctctcgcgcatgtcctactccggcgaggacggccgcgctcaggcccccggcggcggcggcgaccggccgatggtgacgttcgcccgccgcacccactcggggcgctacgtgagctactcccgcgacgacctcgacagcgagctcggcaacagcggcgacatgtcgccggagtctgggcaggagttcctcaactaccacgtgacgatcccggcgacgccggacaaccagccgatggacccggccatctcggcgcgcgtggaggagcagtacgtctccaactcgctcttcaccggcggcttcaacagcgtcacgcgggcgcacctcatggacaaggtgatcgagtcggaggccagccacccgcagatggccggcgccaagggctcctcctgcgccatcaacggctgcgacgccaaggtcatgagcgacgagcgcggcgacgacatcctcccctgcgagtgcgacttcaagatctgcgccgactgcttcgccgacgccgtcaagaacggcggcgcctgccccggctgcaaggacccctacaaggccaccgagctcgacgacgtggtcggtgcgaggccgacgctgtcgctgcctccgccgcccggtggcttgccggcgtcgaggatggagaggcggctgtcgataatgcggtcgcagaaggccatgaccaggagccagaccggcgattgggatcacaatcggtggctgttcgagaccaaggggacatacgggtatggcaatgccatttggcccaaggagaacgaggtcgacaatggcggtggcggtggcggaggcggcgggctgggtggaggcgacggccagccggcagagttcacgagcaagccatggaggccgctcactcgcaagctcaagattcctgcgggtgtccttagcccatacaggcttcttattcttattcgtatggctgttcttggtctattccttgcatggagaattaagcacaagaatgaggatgcaatgtggctatggggcatgtctgttgtttgcgaactctggtttggcctctcttggctcttggatcagctgccaaagttgtgccctgttaaccgagcaactgaccttgctgtcctgaaagataagtttgagaccccgacgccatcaaatcctaacggaagatctgacctgccggggctcgatatatttgtgtctactgctgatccagaaaaagaacccccattggtcacagcaaatactattctgtccatccttgctgctgattatcctgttgagaagctttcttgctatgtttctgatgatggaggcgctctcctgacatttgaagcaatggctgaagccgctagctttgcaaacatgtgggttcctttctgtcgcaaacatgacattgagcctcgcaacccagagagctactttaatctgaagagggacccatacaagaacaaggtccgttctgattttgtcaaggacagaagaagggtgaagagggagtacgacgagttcaaggtcaggatcaatagcttgcctgattcaatccgtcgccgctccgatgcatatcatgccagggaggaaatcaaggccatgaagcggcaacgagaggctgctctcgatgacgtggtggaggctgttaaaatccctaaagctacctggatggctgatggcacgcattggcctggtacctggattcagccctctgctgagcatgctcggggtgaccatgctggaataattcaggtaatgctgaaacctcctagtgatgatcccttgtatggaaccagcggtgaagaaggcagacctcttgatttcactgaggttgacatccgtttgccaatgttggtctatgtgtcccgagagaagcgtcctggttatgatcacaacaagaaggctggtgcgatgaatgcgttggtccgctcatctgctgtcatgtcaaatggacctttcatcctcaaccttgattgtgatcactatgtttacaactcacaagctttccgtgaaggcatgtgcttcatgatggatcgtggtggtgaccgtattggctatgtccagttccctcaacggtttgagggcattgatccatcagatcgatatgctaaccacaacactgtcttcttcgatgtcaacatgcgtgcacttgatggtatcatgggaccagtctacgtcggcactggatgtcttttccgtcgcatcgctttgtatggatttgacccaccgcgctccaaggaacatagtggttgctgcagctgttgcttcccccagaggcgcaaggttaaaacttccacagttgcatctgaagagaggcaggctttgagaatggcagattttgatgatgaggaaatgaacatgtcacaatttcccaagaagttcggtaattcaaacttcctcatcaactctatcccaattgctgaattccaagggcgacctcttgctgaccatcctggagtcaaaaatggacgtcctcctggtgctctcaccgtccctcgcgaccttctcgatgcttccacagttgctgaggctatcagtgtcatctcatgctggtatgaagataagactgagtggggtcagcgtgttggatggatctatggttcagtcacagaggatgtggtcactggttacaggatgcacaaccgtggatggaaatcagtttactgtgtcaccaaacgtgatgctttccgtggcactgcaccaatcaaccttactgaccgtcttcatcaggtgctccggtgggctactggttcagtggaaatcttcttctcccgcaacaatgcactacttgcaagccgaaagatgaagtttcttcagaggattgcatacctgaacgttggcatttaccccttcacatcaatcttcctcattgtctactgcttcctgccagccctgtccctcttctcgggacagttcattgtgcggacgctaaatgtgaccttcctgacctatctgctcgttatcactctgacaatgtgcatgcttgcggtgctcgagatcaagtggtcaggcatcagcttggaggaatggtggaggaatgagcagttctggctaatcggaggaactagcgcccaccttgctgctgttcttcagggtcttctcaaggtgattgctggtatcgagatctccttcacgctgacatccaaatctggaggagatgaagcagacgacgagtttgctgatctctacatcgtcaagtggacatcactcatgatcccaccgatcgtcatcatgatggttaacctgatcgccatcgctgtcgggttcagcaggacaatatacagtgaaatccctcagtggagcaagctcctcggcggcgtgttcttcagcttctgggtgctggctcacctttaccccttcgccaaggggctaatgggaaggagaggacgaacaccgaccatcgtcttcgtctggtctggcctccttgccatcaccatctcattgctgtgggttgccatcaatccgccgtcacagaactcgcagataggcggctccttcacattcccctgagcttcctcatgaacatgaaccttttgtatgatgaattataagagtggtcccagtagcagttgtccttgctgttggacaagtaaattctttacctatgtttacttaggtttttcttttttttttgggtcgaagatgatactattatgaatcatgcatgatactagttcttttgttcgtttttgtgccaaaatgagaagaggttctgtttggacctgaacatcaatcaattgcaaaaattcggagactaggaagttcagagttgcactcctgcacttctttggagctcttccattctgcataactgcgctgtctacttgtattgcatttgcctactcttaatccttcactttgcagtagtact

SEQ ID NO: 3380 - DNA, 4440 bp, Brachypodium distachyon
ttcctctcgcactctactactctgctgctaccagttcttcgctctcttgcgccggaggcaggcagctgcttccttccttcctgcggacttcgtcttccccaatccgacctcaccaaatccccctctactagtactcccctcacccccagcaatccaccccgccccattattcattcctcgctccccctaatttcttccctccacgccagcaccaagtacccaggcacgccattactccgtccgtccgtccgaccgagctccccttctttccttcctgggcactgtttgactgaatcgtccttgaatccctctggaatgatcagccagtaatctgccgatccatagctcggatataacacaacgcgctatggcttccaacggcggcggcggcgtgctaagacacagcaacagcagccgcctctcgcggatgtccttctccggcgaggatggccgcgggcagccccctggagcaggcggcggcggcggcgctgaccggccgatggtgaccttcgcccggcgcacccactccggccgctacgtcagctactcccgcgacgacctcgacagcgagctcggcggcagcgaggcggccggcttctcgccggaccgggaggagttcctcagctaccacgtccacatcccggccacccccgacaaccagcccatggacccggccatctctgcgcgcgtcgaggagcagtacgtctccaactcgctcttcaccggcggcttcaacagcgtcacccgcgcccacctcatggacaaggtcatcgagtccgaggccagccacccgcagatggctggctccaagggctcctcctgcgccatcaacggctgcgatggcaaggtcatgagtgacgagcgcggcgaggacatactgccctgcgagtgcgatttcaagatctgcgctgagtgcttcggcgatgccgtgaagaacggcggggcactgtgccctggatgcaaggagccgtacaaggccacggagatggaggacttggtcggtggcgccgagggtggcgcgaggccgactctgtcgctgcctccgccgcctggcggtgcggccgcctcgaggatggagaggcggctgtcgatagtgcggtcacagaaggccatgaccaggagccagactggtgactgggatcacaacaggtggttgtttgagaccaagggaacatatgggtatggaaatgccatctggccaaaggagaatgaggtggacaatggtggcggtggtggtggtggaggtgggctcagtggagccgatggacagccagcagaattcaccagcaagccatggcggccgctcactcggaagctgaagatccctgctggcatccttagcccatacaggcttcttgttcttatccgaatggttgttcttggtctgttccttacatggagaattaaacacaagaacgaggatgcaatgtggttgtggggcatgtctgttgtttgtgaactctggtttggcttttcgtggatcttggaccagctgccaaagttgtgcccagttaaccgagcaacggaccttgttgttctgaaagacaagtttgaaaccccaacaccatcaaaccccaatggaagatctgacttgccagggctcgatatatttgtgtccactgctgatccagagaaagaacctccattggtcacagcaaacacaattctttccatccttgctgctgactatccagttgaaaaactttcttgctatgtttctgatgatggaggtgctctcctgacatttgaagcaatggctgaagctgctagtttcgctaacatgtgggttcctttttgccgcaaacacggcattgagcctcgcaatcctgagagctactttagtctgaagaaagacccatacaagaataaagtccgctccgattttgtcaaggacaggaggaggatcaagagggagtatgatgagttcaaggtcaggatcaatgggttgcctgactctatccgccgtcgctcggatgcataccatgccagagaagaaatcaaggccatgaagaggcagcgtgaggctgctcttgacgatgcggtggaagctgttaaaattgctaaagctacctggatggctgatggcacacattggcctggtacctggatccaaccctctgcagagcatactcgtggtgaccatgctggaataattcaggtaatgctgaaaccacctagcgatgatccattgtatggcagcaacggtgaagaaggcaggccccttgacttcactgatattgacatccgtttgccaatgttggtctatgtgtcccgtgaaaagcgcccaggctatgaccacaacaagaaggctggtgcaatgaatgctctagtccgttcatctgctgtcatgtcaaatgggcctttcatcctcaacctggattgtgatcattatgtttacaactcccaagctttccgtgaaggcatgtgcttcatgatggaccggggtggtgaccgtattggctatgttcagttccctcaacggtttgagggcattgatccatcagatcgctatgccaaccacaacactgtcttctttgatgtcaacatgcgtgcattggatggcctcatgggaccagtctatgtcggcacaggctgtctattccgccgcattgctctatacggatttgaccctccacgctccacagaacatggtggctgctgcagctgttgtttcctgaagaagcgcaagatcaagatctcttcatctgcatccgaagagacacgggctttgcgaatggcagactttgatgaggaagaaatgaacatgtcaacattccccaagaagtttggtaactcaaacttcctcatcaactctatcccaattgctgagttccaagggcgtccgcttgctgatcaccctggtgtcaagaatgggcgtcctcctggtgctcttaccgtccctcgggaccttcttgatgcctcgacagtcgctgaagctatcagtgtcatctcatgctggtatgaagacaagacggagtggggccagcgtgtcggatggatttatggttcagtcacagaggatgttgtcacaggttaccgcatgcacaaccgtggatggaagtcagtctactgtgtcaccaagcgtgacgctttccgcggcaccgcgcccatcaacctcaccgaccgtctccaccaggtgctccggtgggctacaggctcagtggagatcttcttctcccgcaacaacgcgctgctcgcgagccggaggatgaagttcctccagaggatcgcgtacctgaacgtcggtatctaccccttcacgtcaatcttcctcatcgtctactgcttcctgccggcactgtcgctcttctccgggcagttcatcgtgcggacgctagacgtgaccttcctcacctacctgctggtgatcactctaacactgtgcatgctcgcggtgctggagatcaagtggtcagggatcaacctggaggaatggtggcgtaacgagcagttctggctcatcggaggcaccagcgcccaccttgctgccgtgctgcaaggcctcctgaaggtgattgccggcattgagatctccttcacgctcacgtccaagtcgggcggtgacgacgagaacgacgactacgcagacctctacatcgtcaagtggacctcgctgatgatcccgcccatcgtgatcatgatggtgaacctgatcgccattgctgtgggcttcagccggaccatctacagcgagatcccgcaatggagcaagctgctgggcggcgtgttcttcagcttctgggtgctggctcacctgtacccgtttgccaaggggctgatgggacggcggggccggacgccgaccatcgtcttcgtctggtcggggctcctcgccatcaccatctccctgctgtgggtcgccatcaacccgccatcccagaactcgcagattggcggctccttcacgttcccttgatggccagagcttatatatcaatatgaaactatataccattggttccaattcagcagcagcggcggcagcagcaggatccctcctggggagcttagctgactgggagtacattctgactattgttaattaggcgttttattctctcttttttgtcggggaaagatgatggtggatcatactagttcatttgttggtttgtcagatgattgtgcatcatctgacaagtgtaaaagaaggttttaggaatttgatcggagtttccttcttgcattgcaccttgttcagatatctttgcattgtttacttgtctgaatcctgaagcaaatgctgcatacttcgtatctgcaaccatgaccactgcaggccggaataattcccagttgagatctgcaaccacagcttgcagataaacccgagactaaattgaagctttgtttatctattccctttgattctaatttgttgtcgaaatattacatgtatctacacccattttaagaataaatacattcatatttggacaa

SEQ ID NO: 3381 - DNA, 4047 bp, Secale cereale
tccccgatccccaccagtactagtactcccctcccccaccattccattcattgccccgtcccagctccccttccttcctgggatcgatcgattggttgcccggtgctcctttgactggctcgccagccgggttggttggttgaccccgagtggaatgatcgcccagtgattgtgatccatccatccatccacagctcaagaaaaggcatcggcacggacggacgctatggataacatcggcggcggcggcgtgctgcggcacagcaacagcagccgcctctcgcgcatgtccttctccggcgaggacggccgcggcgcgcaggcccgtcccgcccccggagccggcaacggcggaggagcggaccggccgatggtcaccttcgcccggcgcacccactcgggccgctacgtcagctactcgcgcgacgacctggacagcgagctggccaacagcgacctcgcgggtggcggcggcggcttctcgccggaccgggaggagttcctcagttaccacgtgcacatcccggccacgcccgacaaccagcccatggacccggccatctcggcgcgggtggaggagcagtacgtctccaactcgctcttcaccggcggcttcaacagcgtcacccgcgcccacctcatggacaaggtcatcgactccgaggccagccacccgcagatggccggctccaagggctcctcctgcgccgtcaacggctgcgacggcaaggtcatgagcgacgagcgcggccaggacatcctgccctgcgagtgcgacttcaagatctgcgccgactgcttcggggacgccgtcaagaacgccggcgccctctgccccggctgcaaggagccctacaaggccaccgagatggaggacctggtcggcgccgccgacggcggggccaggcccacgctctccctgcccccgccgcccggcggcgctccagcgtccaggatggagaggcggctgtccattgtgcgctcgcagaaggccatgacaaggagccagaccggcgactgggatcacaaccgctggctgtttgagaccaaggggacctatgggtatgggaatgccatctggccaaaggagaatgatgccgacaatggcggcggtggcggtggcggcggtggagccgggctcggtggaaccgacgggcagccggcggagttcaccagcaagccatggaggccgctcactcggaagctcaagatccctgctggcatcctcagcccatacaggcttcttgttctcatccgcttggctgttcttggtctgttccttacatggagaattaagcataagaatgaagatgcaatgtggctatggggcatgtctgttgtctgtgaactctggtttggattttcttggatcttggaccagctgccaaagctgtgccctgttaaccgagcaactgaccttgctgtcctgaaagacaagtttgagaccccaacaccgtcaaatccgaatggaagatccgatctgccggggcttgatatatatgtgtccactgctgatccagagaaagaacctccattaactacagcaaacaccattttgtccatccttgctgcagactatcctgtcgagaagctttcctgctacgtttctgatgacggaggcgctctccttacatttgaagcaatggctgaagctgctagctttgcaaacatgtgggttcctttctgtcgcaagcacgtcattgagcctcgcaatcctgatagctacttcagtctgaagagggacccttacaagaacaaggtacgctcagactttgtcaaggacaggaggaggatcaagagggagtatgacgagttcaaggtcaggatcaatgggctgcctgactcgatacgtcgccgctccgatgcttaccatgccagagaagaaatcaaggccatgaagaggcagcgtgaagctgctcttgatgatgccgtggagactgttaaaattgctaaagctacctggatggctgatggcacacattggcctggtacctggattcaaccctctgcggagcatactcgcggagaccatgctggaataattcaggtgatgctcaaacctcctagtgacgatcccctgtatggtggcgacggtgaagaaggcagaccccttgacttcactgacatcgacatccgtctgccaatgttggtctatgtgtcccgagaaaagcgcccaggctatgaccacaacaagaaggctggagcaatgaacgctctagtccgttcctctgctgtcatgtcaaatggaccgttcatcctcaacctggactgtgatcattatgtttacaactcccaagctttccgcgaaggcatgtgcttcatgatggaccgtggtggtgaccgcattgcctatgtccagttcccccaacggtttgagggcattgatccatcagatcgctacgccaaccacaacactgtcttctttgatgtcaacatgcgtgcattggatggtctcatgggaccagtctatgtcggcactggctgtctgttccgccgtgttgcactctatggatttgaccctccgcgctccacagagcacggtggctgctgcagctgttgcttcccgaagaagcgcaagatcaagagcactgtttcctcagctacatctgaagagacgcgcgctctgcgcatggcagactttgatgatgaggagatgaacatgtcaacatttcccaagaggttcggtaactcaaacttcctcatcaactctatcccgattgccgagttccaagggcgcccgcttgctgatcaccctggtgtcaagaatggccgtcctcctggtgctctcaccgtccctcgcgaccttctcgatgcctcaacggtcgccgaggctattagtgtcatctcatgctggtatgaagacaagacagagtggggtcagcgtgtcggatggatttacggttcagtcacagaggatgttgtcacgggctacaggatgcacaaccgtgggtggaagtcagtctactgtgtcaccaagcgcgacgccttccgcggcactgcacccatcaacctgactgaccgtctccaccaggtgctccggtgggccacgggctcagtggagatcttcttctcgcgcaacaacgcgctgctggcgagccggaggatgaagtgtcttcagaggatcgcgtacctgaacgtgggcatctacccgttcacgtccatcttcctcatcgtctactgcttcctgccggcgctgtcgctcttctcggggcagttcatcgtgaaggagctggacgtgacgttcctgacctacctgctggtgatcaccctgacgctgtgcatgctggcggtgctggagatcaagtggtcgggcatcaacctggaggagtggtggaggaacgagcagttctggctcatcggcggcacgagcgcgcacctggcggcggtgctgcagggcctcctcaaggtgatcgccggcatcgagatctccttcacgctcacgtccaagtcgggcgcggacgacgagaacgacgagttcgccgacctgtacatcgtcaagtggacgtcgctgatgatcccgcccatcgtgatcatgatggtgaacctgatcgccatcgccgtgggcttcagccgcaccatctacagcgagatcccgcagtggagcaagctgctgggcggcgtcttcttcagcttctgggtgctggcgcacctgtacccgttcgccaagggcctcatggggcgccggggccgcacgcccaccatcgtcttcgtctggtcgggcctcctcgccatcaccatctccctgctgtgggtggccatcaacccgccgtcgcagaactcgcagatcggaggctccttccagttcccctgatcctacatatcgcacaccatttgttccaccaccagcagcggtggggggtaaagtgaagtaaattctgaccgttccctgtggttaagttaattaggtgcttttttcgtgttgtcggagaacgttggatcatcatcatgaattcatcatactagtagttcatttgttcttttgattctgttcctgagatgtttggacctggacaacatcaagtacaaaaattcagaagtcttggcaaa

SEQ ID NO: 3382 - DNA, 4132 bp, Secale cereale
gactcctcacactcttcccttcgccagtactactcctactcccaccactaccagttcctcgccaggccagctgcttcccttcccttccgccgcctccttcctgcggacttcgtcctccctcccggatccccaccaccaccagtactagtactcccctgccccagcaatcttccccacaagcaacccccacctgaggctccaagcgccattcattgcagcccccgttcttgggatcgattcatcgattgcccggtgcttctttgactggctcgccagccgggttggttgaccccgagtggaatgatcggccagtgattgtgatccatccatccatccatccacagctcaagaaaaggcatctggacggacgggcgccatggataacatcggcggtggcggcgtgctgcggcacagcaacagcagccgcctctcgcgcatgtccttctccggcgacgacgcccgcggcgcgcaggcccgggccgcgccggggggcggcaacggcggaggagcggacaggccgatggtcaccttcgcgcgccgcacccactcgggccgctacgtcagctactcgcgcgacgacctggacagcgagctggccaacagcgacctggcgggtggcggcggcggcttctcgccggaccgggaggagttcctcagctaccacgtgcacatcccggccacgcccgacaaccagcccatggacccggccatctcggcgcgggtggaggagcagtacgtctccaactcgctcttcaccggcggcttcaacagcgtcacccgcgcccacctcatggacaaggtcatcgactccgaggccagccacccgcagatggccggctccaagggctcctcctgcgccgtcaacggctgcgacggcaaggtcatgagcgacgagcgcggccaggccatcctgccctgcagtgcgacttcagatctcgccgactgcttcggggacgccgtcaagaacgccggcgccctctgccccggctgcaaggagccctacaaggccaccgagatggaggacctgtcggcgcgccgacgcggggccaggcccacgctctccctgccccgccgcccggcggcgctcccgcgtccaggatggagaggcggctgtccattgtgcgctcgcagaaggccatgacaaggagccagaccggcgactgggatcacaaccgctggctgtttgagaccaaggggacctatgggtatgggaatgccatctggccaaaggagaatgatgccgacaatggcggcggtggcggtggcggcggtggagccgggctcggtggaaccgacgggcagccggcggagttcaccagcaagccatggaggccgctcactcggaagctcaagatccctgctggcatcctcagcccatacaggcttcttgttctcatccgcttggctgttcttggtctgttccttacatggagaattaagcataagaacgaagatgcaatgtggctatggggcatgtctgttgtctgtgaactctggtttggattttcttggatcttggaccagctgccaaagctgtgccctgttaaccgagcaactgaccttgctgtcctgaaagacaagtttgagaccccaacaccgtcaaatccgaacgggagatctgatctgccagggcttgatatatatgtgtccacagctgatccagagaaagaacctccattaactacagcaaacaccattctgtccatccttgctgccgactatcccgtcgagaagctttcctgctacgtctctgatgacggaggcgctctccttacatttgaagcaatggctgaagctgccagctttgccaacatgtgggttcctttttgtcgcaagcacggcatcgagcctcgcaatcctgacagctacttcagtctgaagagggacccttacaagaacaaggtacgctcagactttgtcaaggacaggaggaggatcaagagggagtatgacgagttcaaggtcaggatcaatgggctgcctgactcaatacgtcgccgctccgatgcttaccatgccagagaagaaatcaaggccatgaagaggcagcgtgaagctgctcttgatgatgccgtggagactgttaaaattgctaaagctacctggatggctgatggcacacattggcctggtacctggatccaaccctctgcggagcatactcggggagaccatgccggaataattcaggtgatgctcaaacctcctagtgacgatcccctgtatggtggcgacggtgaagaaggcagaccccttgacttcactgacatcgacatccgtctgccaatgttggtctatgtgtcccgagaaaagcgcccaggctatgaccacaacaagaaggctggagcaatgaacgctctagtccgttcctctgctgtcatgtcaaatggaccgttcatcctcaacctggactgtgatcattatgtttacaactcccaagctttccgcgaaggcatgtgcttcatgatggaccgtggtggtgaccgcattgcctatgtccagttcccccaacggtttgagggcattgatccatcagatcgctacgccaaccacaacactgtcttctttgatgtcaacatgcgtgcattggatggtctcatgggaccagtctatgtcggcactggctgtctgttccgccgtgttgcactctatggatttgaccctccgcgctccacagaacacggtggctgctgcagctgttgcttcccgaagaagcgcaagatcaagagcactgtttcctcagctacatctgaagagacgcgggctctgcgcatggcagactttgatgatgaggagatgaacatgtcaacatttcccaagaggttcggtaactcgaacttcctcatcaactctatcccgattgccgagttccaagggcgcccgcttgctgatcaccctggtgtcaagaatggccgtcctcctggtgctctcactgtccctcgcgaccttctcgatgcctccacggtcgccgaggctattagtgtcatctcatgctggtatgaggacaagacagagtggggtcagcgtgtgggatggatttatggttcagtcacagaggatgttgtcacaggctaccggatgcacaaccgtgggtggaagtcggtctactgtgtcaccaagcgcgacgccttccgcggcaccgcacccatcaacctgactgaccgtctccaccaggtgctccggtgggccacgggctcagtggagatcttcttctcgcgcaacaacgcgctgctggcgagccggaggatgaagtgtctccagaggatcgcgtacctgaacgtgggcatctacccgttcacgtccatcttcctcatcgtctactgcttcctgccggcgctgtcgctcttctcggggcagttcatcgtgaaggagctggacgtgaccttcctcacctacctgctggtgatcaccctgacgctgtgcatgctggcggtgctggagatcaagtggtcgggcatcaacctggaggagtggtggaggaacgagcagttctggctcatcggcggcacgagcgcgcacctggcggcggtgctgcagggcctcctcaaggtgatcgccggcatcgagatctccttcacgctcacgtccaagtcgggcgcggacgacgagaacgacgagttcgccgacctctacatcgtcaagtggacgtcgctgatgatcccgcccatcgtgatcatgatggtgaacctgatcgccatcgccgtgggcttcagccgcaccatctacagcgagatcccgcagtggagcaagctgctgggcggcgtcttcttcagcttctgggtgctggctcacctgtacccgttcgccaagggcctcatggggcgccggggccgcacgccgaccatcgtcttcgtctggtcgggcctcctcgccatcaccatctccctgctgtgggtggccatcaacccgccgtcgcagaactcgcagatcggaggctccttccagttcccctgatcctacatatcgcacaccatttgttccaccaccagcagcggtggggggtaaagtgaagtaaattctgaccgttccctgtggttaagttaattaggtgcttttttcgtgttgtcggagaacgttggatcatcatcatgaattcatcatactagtagttcatttgttcttttgattctgt

SEQ ID NO: 3383 - DNA, 3975 bp, Hordeum vulgare
cccgcccccgcggccggcgccggcggcgaccggccgatggtcaccttcgcgcgccgcacccactcgggccgctacgtcagctactcccgcgacgacctcgacagcgagctggccaacaccgacctcgcgggcgggttctcgccggaccgggaggagttcctcagctaccacgtgcacatcccggccacgcccgacaaccagcccatggacccggccatctcggcgcgggtcgaggagcagtacgtctccaactcgctcttcaccggcggcttcaacagcgtcacccgcgcccacctcatggacaaggtcatcgactccgaggccagccacccgcagatggccggctccaagggctcctcctgcgccgtcaacggctgcgacgccaaggtcatgagcgacgagcgcggccaggacatcctgccctgcgagtgcgacttcaagatctgcgccgagtgcttcggcgacgccgtcaagaacgccggcgccctctgccccggctgcaaggagccctacaaggccaccgagatggacgacctggtcggcgccgccgacggcggtgccaggcccacgctctccctgcccccgccgcccggcggcgctcccgcgtccaggatggagaggcggctgtccattgtgcggtcgcagaaggccatgacaaggagccagaccggcgaccgggatcacaaccgctggctgtttgagaccaaagggacctatgggtatgggaatgccatctggccaaaggagaacgatgccgacaatggcggaggaggcggcggcggcggtggagccgggctcggtggacacgacgggcagccggcggagttcaccagcaagccatggaggccgctcactcggaagctcaagatccctgctggcatcctcagcccatacaggcttcttgttctcatccgattggctgttcttggcctgttcctcacatggagaattaagcataagaatgaagacgcgatgtggctatggggcatgtctgttgtttgtgaactctggtttggcttttcttggatcttggaccagctgccgaagctgtgccctgtgaaccgagcaactgaccttgctgtcctgaaagacaagtttgagagcccaacaccgtcgaatcctaatggaagatctgatctgccggggcttgatatatatgtgtccactgctgatccagagaaagaacctccattaactacagcaaacaccatcctgtccatccttgctgctgattatcccgtcgagaagctttcttgctatgtttctgatgacggaggcgctctccttacatttgaagcaatggctgaagctgctagctttgctaacatgtgggttcccttttgtcgcaagcacggcatcgagcctcgcaatcctgagagttacttcagtctgaagagggacccctacaagaacaaggtacgctcagactttgtcaaggacaggaggaggatcaagagggagtatgacgagttcaaggtcagaattaatggtttgcctgactcgatccgtcgccgctctgatgcttaccatgccagagaagaaatcaaggccatgaagaggcagcgtgaagctgctcttgatgatgttgtggagactgttaaaattgctaaagctacctggatggctgatggcacacattggcccggtacctggattcaaccctctgcagagcatactcggggagaccatgctggaataattcaggtgatgctcaaacctccaagtgatgatcccctgtatggtggtgacggtgaagaaggcagaccccttgacttcactgacatagatatccgtctgccaatgttggtctatgtgtcccgagaaaagcgcccaggctatgaccacaacaagaaggcaggtgcaatgaatgctctagtccgctcatctgctgtcatgtcaaatggacccttcatactcaacctggactgtgatcattatgtttacaactctcaagctttccgtgaaggcatgtgcttcatgatggaccgtggtggtgaccgtattgcctatgtccagttcccccaacggttcgagggcattgatccatcagatcgctacgccaaccacaacactgtcttctttgatgtcaacatgcgtgcattggatggtctcatgggaccagtctatgtcggcactggctgtctgttccgccgtgttgcactctatggatttgaccctccacgctccacagagcacggtggctgctgcagctgttgcttcccgaagaagcgcaagatcaagagcactgtttcctcagctacatctgaagagacacgggctctgcggatggcagattttgatgatgaggagatgaacatgtcaacatttcccaagaggttcggtaactcaaacttcctcatcaactctataccgattgccgagttccaagggcgcccgcttgctgatcaccctggtgtgaagaatggccgtcctcctggtgccctcactgtccctcgtgaccttctcgacgcctccacggtcgccgaggctattagtgtcatctcatgctggtatgaggacaagacagagtggggtcagcgtgtcggatggatttatggttcagtcacagaggatgtcgtcacagggtaccggatgcacaaccgtgggtggaagtctgtctactgtgtcaccaagcgtgatgccttccgcggcactgcacctatcaacctgactgaccgtctccaccaggtgctccggtgggctactggctcagtggagatcttcttctcccgcaacaatgcgctgctcgcgagccgaaggatgaagtgtcttcagaggattgcgtacctcaatgtgggcatctacccgttcacgtccatcttcctcattgtctactgcttcctgccggcgctgtcgctcttctccggtcagttcatcgtcaaggagctggacgtgaccttcctcacctacctgctggtcatcaccctgacgctgtgcatgctggcggtgctggagatcaagtggtctggcatcaacctggaggagtggtggaggaatgagcagttctggctcatcggcgggaccagcgctcacctcgccgctgtgctgcagggcctcctcaaggtcattgctggcattgagatctccttcacgctcacatccaagtccggcgcagacgacgaaaacgacgagttcgccgacctctacatcgtcaagtggacgtccctcatgatcccacccattgtcatcatgatggtcaacctcatcgccatagctgtcggcttcagccgcaccatctacagcgagatcccgcagtggagcaagctcctgggcggtgtcttcttcagcttctgggtactggctcacctgtacccgttcgccaagggcctcatggggcgccgcgggcgcacgccgaccatcgtcttcgtctggtccggcctcctcgccatcaccatctccctgctgtgggtcgccatcaacccgccgtcccagaactcgcagatcggaggctccttccagttcccctgatcgttgaagctagcttcatcttatatgagttacataccatttgttccagcagcagcaggtagctggtggggagtaaaagtaaattctgaccgttccctgtggttaaattaggtgttttttcgtgttgtcggaaaacggtggtgggtcatggatcatactagttcatttgttctcttgattctgttcattagatgtttggacctggacaacatctagtacaaaaattcagaagtcttattagcaagtcttttcaaagtccccacatccgtcttgcattgcagctggttgagtggcatgtgttgaatattctcaaagcttgtgttacctgtagccatcgtgctcggtcctgataaagaagatcctgatcttttttggcaaagtgtagttctcggaccaggtaggatttttttttttatataatcttaaattggtctgacccttccctggacgctgcacaaacggcagctacatgtaccgggctgcccaagatcatgtacagaaattcat

SEQ ID NO: 3384 - DNA, 4091 bp, Hordeum vulgare
cccgcccccgcggccggcgccggcggcgaccggccgatggtcaccttcgcgcgccgcacccactcgggccgctacgtcagctactcccgcgacgacctcgacagcgagctggccaacaccgacctcgcgggcgggttctcgccggaccgggaggagttcctcagctaccacgtgcacatcccggccacgcccgacaaccagcccatggacccggccatctcggcgcgggtcgaggagcagtacgtctccaactcgctcttcaccggcggcttcaacagcgtcacccgcgcccacctcatggacaaggtcatcgactccgaggccagccacccgcagatggccggctccaagggctcctcctgcgccgtcaacggctgcgacgccaaggtcatgagcgacgagcgcggccaggacatcctgccctgcgagtgcgacttcaagatctgcgccgagtgcttcggcgacgccgtcaagaacgccggcgccctctgccccggctgcaaggagccctacaaggccaccgagatggacgacctggtcggcgccgccgacggcggtgccaggcccacgctctccctgcccccgccgcccggcggcgctcccgcgtccaggatggagaggcggctgtccattgtgcggtcgcagaaggccatgacaaggagccagaccggcgactgggatcacaaccgctggctgtttgagaccaaagggacctatgggtatgggaatgccatctggccaaaggagaacgatgccgacaatggcggaggaggcggcggcggcggtggagccgggctcggtggacacgacgggcagccggcggagttcaccagcaagccatggaggccgctcactcggaagctcaagatccctgctggcatcctcagcccatacaggcttcttgttctcatccgattggctgttcttggcctgttcctcacatggagaattaagcataagaatgaagacgcaatgtggctatggggcatgtctgttgtttgtgaactctggtttggcttttcttggatcttggaccagctgccgaagctgtgccctgtgaaccgagcaactgaccttgctgtcctgaaagacaagtttgagagcccaacaccgtcgaatcctaatggaagatctgatctgccggggcttgatatatatgtgtccactgctgatccagagaaagaacctccattaactacagcaaacaccattctgtccatccttgctgctgactatcccgtcgagaagctttcttgctatgtttctgatgacggaggcgctctccttacatttgaagcaatggctgaagccgctagctttgctaacatgtgggttcccttttgtcgcaagcacggcatcgagcctcgcaatcctgagagttacttcagtctgaagagggacccctacaagaacaaggtacgctcagactttgtcaaggacaggaggaggatcaagagggagtatgacgagttcaaggtcagaattaatggtttgcctgactcgatccgtcgccgctctgatgcttaccatgccagagaagaaatcaaggccatgaagaggcagcgtgaagctgctcttgatgatgttgtggagactgttaaagttgctaaagctacctggatggctgatggcacacattggcccggtacctggattcaaccctctgcagagcatactcggggagaccatgctggaataattcaggtgatgctcaaacctccaagtgatgatcctctgtatggtggtgacggtgaagaaggcagaccccttgacttcactgacatagatatccgtctgccaatgttggtctatgtgtcccgagaaaagcgcccaggctatgaccacaacaagaaggcaggtgcaatgaatgctctagtccgctcatctgctgtcatgtcaaatggacccttcatactcaacctggactgtgatcattatgtttacaactctcaagctttccgtgaaggcatgtgcttcatgatggaccgtggtggtgaccgtattgcctatgtccagttcccccaacggttcgagggcattgatccatcagatcgctacgccaaccacaacactgtcttctttgatgtcaacatgcgtgcattggatggtctcatgggaccagtctatgtcggcactggctgtctgttccgccgtgttgcactctatggatttgaccctccacgctccacagagcacggtggctgctgcagctgttgcttcccgaagaagcgcaagatcaagagcactgtttcctcagctacatctgaagagacacgggctctgcggatggcagattttgatgatgaggagatgaacatgtcaacatttcccaagaggttcggtaactcaaacttcctcatcaactctataccgattgccgagttccaagggcgcccgcttgctgatcaccctggtgtgaagaatggccgtcctcctggtgccctcactgtccctcgtgaccttctcgacgcctccacggtcgccgaggctattagtgtcatctcatgctggtatgaggacaagacagagtggggtcagcgtgtcggatggatttatggttcagtcacagaggatgtcgtcacagggtaccggatgcacaaccgtgggtggaagtctgtctactgtgtcaccaagcgtgatgccttccgcggcactgcacctatcaacctgactgaccgtctccaccaggtgctccggtgggctactggctcagtggagatcttcttctcccgcaacaatgcgctgctcgcgagccgaaggatgaagtgtcttcagaggattgcgtacctgaacgtgggcatctacccgttcacgtccatcttcctcatcgtctactgcttcctgccggcgctgtcgctcttctccggacagttcatcgtcaaggagctggacgtgaccttcctcacctacctgctggtcatcaccctgacgctgtgcatgctggcggtgctggagatcaagtggtctggcatcaacctggaggagtggtggaggaatgagcagttctggctcatcggcgggaccagcgctcacctcgccgctgtgctgcagggcctcctcaaggtcattgctggcatcgagatctccttcacgctcacatccaagtccggcgcagacgacgaaaacgatgagttcgccgacctctacatcgtcaagtggacgtccctcatgatcccacccattgtcatcatgatggtcaacctcatcgccatagctgtcggcttcagccgcaccatctacagcgagatcccgcagtggagcaagctcctgggcggtgtcttcttcagcttctgggtactggctcacctgtacccgttcgccaagggcctcatggggcgccgcgggcgcacgccgaccatcgtcttcgtctggtccggcctcctcgccatcaccatctccctgctgtgggtcgccatcaacccgccatcccagaactcgcagatcggaggctccttccagttcccctgatcgttgaagctagcttcatcttatatgagttacataccatttgttccagcagcagcagctagctggtggggggtaaaaagtaaattctgaccgttccctgtggttaaattaggtgctttttcgtgttgtcggaaaacggtggtgggtcatggatcatactagttcatttgttctcttgattctgttcattagatgtttggacctggacaacatctagtacaaaaattcagaagtcttattagcaagtcttttcaaagtccccacatccgtcttgcattgcagctggttgagtggcatgtgttgaatattctcaaagcttgtgttacctgcagccatcgtgctcggtcctgataaagaagatcctgatcttttttggcaaagtgtagttctcggaccaggttggatttttttttttatataatcttaaattggtctgacccttccctggacgctgcacaaacggcagctacatgtaccgggctgcccaagatcatgtacagaaattcatgtcttagcatacttcttgcattgcagcaaatcttgcctttgtgtgttgcatttcgttgtcgagcttggtctgtaaagaactggtgaaaaaggtttgatatttttgttggcacgtg

SEQ ID NO: 3385 - DNA, 4314 bp, Ananas comosus
aagaaaccctagtttctttggttcccatttccttgtactagtttttctccaataaactattcaccgatcttggactattctacttgtccttggacttattctcagccccgctccccacctgaccaaacccatctggatccccctcaactccgcgtttgaacgcttcttcctttgagcaagagctcggcaacaataagaagaagcagtagtagaagaagcggaagaggaagagagcggtggagttgaatcggtcgtgtgatgatctggtgaggccgtgtagtagatcaaaagagtagcaccatggcatcgaacagcgcgcttcgaaatagccgatcggcccgcatggccgcatcggccgccgatccgcttcagggcggcggacgccccgctgcggcccctccggcccccactgtaaaatttgcgcgtcggacccaatccggtcgctacgtgagctactcccgcgacgatctcgatagcgaaattggtagtggagagttctcccaggagtttacgaactaccatgtccatattcctgccactcccgataaccagccgatggaggtctcgatcgacccgtcgatctccgctaaagtcgaagaacaatatgtgtccaactccctcttcaccggcggctttaacagtgtaactcgtgcgcatttgatggacaaagtgattgagtcggaggccagccacccgcaaatggcgggggccaagggctcctcttgctcgatccagggctgcgattccaaagtgatgagcgacgagcgaggaatcgatatactcccttgcgagtgcgactttaagatctgcgccgagtgcttcggcgatgctgtgaaggcgggcgggatttgcccggggtgcaaggagccgtacaagaccacggagttggaggacattgtaaatgatagtagcatggggggccagccgcacctctcgttgcctccgccgcccgcgggtgtttcaaggatggagagacggctgtcgataatgaggtcgcagaagatgatgagccggagccagacgggggattgggatcataacaggtggctgtttgagacgaagggcacttacgggtatgggaatgcgatatggcccaaggagaatggaggggatgatggaaatggaggagatgggcagccgtcagagctgtcgagcaagccgtggaggccgctcacccgcaagctgaagatcccggcggccattctgagcccatataggcttcttatcgccattcgcatgattgccctcgtcctcttccttatgtggagagtgaagcacaagaacaaggacgctatgtggctgtggggaatgtcggtcgtctgcgaactatggttcgccttctcctggcttttggatcagctcccgaaactttgccctgtgaaccgcgccactgaccttgccgtcctaaaagaaaaattcgaaacacccactcccaacaaccccaccggaaaatcggatcttccaggcctcgacatcttcgtctccaccgccgacccggaaaaggaaccccctcttgtaacggcaaacaccattctctcaattctcgcagccgattaccccgtcgagaagctctcttgctatgtttcagacgatggtggggcccttcttactttcgaggccatggctgaggctgccagctttgctaatttgtgggtcccattttgtcgcaagcatgatatcgagccacgaaaccctgagagctactttaatctgaagaaggatccatataagaacaaggttaaatcggattttgtgaaggatcgtagacgggtgaagagagagtacgatgagttcaaggttcggataaacgggttgcccgattcgatccgcaggaggtcggacgcgtaccacgctcgcgaggagatcaaggccatgaagaggcagagggagatggcgggtgatgatcccatcgaacaggtgaagatcccgaaagctacgtggatggcggatggtacacattggcccgggacttggattaacccgggctccgagcatagtcgcggtgaccatgctggagtcattcaggtaatgctgaaaccgccgagtgacgagcccttgtacgggaacaacggtgacgaaggccggcccctcgacttcactgatgtggatatccgcctaccgttgctggtctatgtctctcgtgagaagcggcctggctacgaccacaacaagaaggcgggggcaatgaacgcgctcgtccgcgcctctgccatcatgtcgaacggccctttcatcctcaaccttgactgcgaccactacgtgtacaactcccaggccttccgcgagggcatgtgcttcatgatggaccgtggcggggaccgcctttgctacgtccagttcccccagcggttcgagggaatcgacccctccgaccgctatgctaacaacaatactgtcttcttcgacgtcaacatgcgcgccctcgacggcctccaaggcccagtgtatgtggggaccggttgtctcttccgccgcattgctctttatggcttcgaccctccccgggcgaaggaacacggcgcaggttgctgcagctgctgcttccctggacggcggaaaaatgtttctgccgtcgcatcggaggagacgagggcgctccgaatgggagactttgatgaggaggagatgaacctttcgacttttccgaagaagttcgggaactcgagcttcttgattgactcgatccccattgcggagttccagggccggcccctcgccgaccatcccgctgtcaagaacggcaggccgcccggcgccctcaccatcccccgtgaccttctagacgcgtcgaccgtcgcggaggccatcagcgtgatctcgtgctggtacgaggacaagacggagtggggtcatcgtgttgggtggatctacggatccgtgactgaggacgtcgtcacgggctacagaatgcacaacaggggatggaagtctgtttattgcgtgaccaagcgcgacgcattccgagggaccgcgccaatcaacctcactgaccggctccaccaggtgctccggtgggcgacgggctcagtcgagatcttcttctcccgcaacaacgcccttctcgcaagccctagaatgaagtttttacagaggatcgcgtacctcaacgtcggtatctaccccttcacctctatcttcctcatcgtctactgcttcctcccggccctctctctcttctcggggcagttcatcgtccaaaccctcaacgttgcattcctcacatacctcctcaccatcaccgtgacgctctctgcgctcgcggttcttgaaatcaagtggtcgggaatcaatctcgaagagtggtggagaaacgagcaattctggcttattggagggacaagtgcccaccttgccgctgtgatccaagggctgctgaaggtgattgccggtatcgaaatctccttcacgctcacctcgaaatcgggaggcgacgacgtcgacgacgagttcgctgatctgtacatcgtgaagtggtcgtcgctgatgattccgcccatcaccatcatgatggtgaacctgatcgcgatcgctgtcgggttcagcaggacaatatacagcgtgatcccgcagtggagcaagctgctgggcggggtgttcttcagtttctgggtgctggctcatctctatccctttgcgaaggggctcatgggccgaagagggagaactccgacgatcgtcttcgtgtggtcggggcttatcgccatcaccatttcgctactctgggtcgcgatcaatcccccgtcagcaaattctcagatcggcggttccttcacattcccttaaacatttacactctattatcgactatctaatgaattcatggaatggtgaagtaaaataggtatgtcaaagactcagaaacccccccccccccccccccccccccccccccccccccccccccccccccccccccccccccctcttgaattggagcaaacttttcttctttgaaacagtcgagatagaagtgatgaggcctctgtacggcgaaaaggtttgtttagatcatgttatgttttacatatatatagatgtcccccccccccccccccccccccccccccccccccccccccccccccccccccccccccccccccccccccccccccccccccccccccccccctcgatattctgtagtcatattcattcatataatttgcgaaatctatcgaggtggactcgcagttcttttgtttgttttgttctttctttgttaaacagatactggttctatgctgaatcatttgcggattcaaaattttgattcccttttaatttcgttcttggttcaaatttgcatgaagg

SEQ ID NO: 3386 - DNA, 1451 bp, Saccharum officinarum
cccactctgtcagtctcactccccgcgcgcgcgcgcgctctccctccctctctcctcgcctcgccgccggcgacgagcttgagctcgagctggttcctcgtatagaagacggccgccgcggtatggagcccatgaacgtagacaacggcggctgcggcggcctggacgcgcagatcgagcagctgatgcagtgtcgtccgctcgccgagcaggaggttaaggcactgtgcgagaaggccaaggagatattgatggaggaaagcaacgttcagcctgtcaagagtccagtgacaatatgtggtgatatacatggacaattccatgatcttgtagagcttttccgaattggcgggaagtgtccagacaccaattacttatttatgggggattatgtagatcgtggctactattctgttgagactgtcactctgctagtagcactaaaagtgaggtacccacatcgaattacgatccttcgtggaaaccacgagagtcgacagatcacacaggtgtatggattctatgacgaatgcctacgaaagtatggcaatgcaaatgtttggaagacatttacggatctttttgattattttcctctgacagctctggtggaatctgagattttctgccttcatggtggtttatctccgtcaattgaaaatcttgatagtgtgcgcagcttagatcgagtccaagaggttcctcatgagggacctatgtgcgatcttttatggtcagatccagacgatcgatgtggttggggcatatcccctcgtggtgctggctacacttttggccaggacatatcggagcagtttaatcacacgaacaatctcaaacttgtagctcgggctcatcaattagttatggagggatataactgggctcatgaacaaaaggttgtcaccatattcagtgctccaaactattgctatcgatgcggcaatatggcatccattttggaagttgacgactgcaacagtcacacattcatccagtttgaaccagcccctaggagaggtgagccagatgtgacgcgaagaacaccagattatttcctttgagctggatgttaccatttcccagcttatgccgttataatcgatgtcaacatctgctggatcaagggccagaaagaaataactggtgaatatcaaagcgctatgcaaaacttgaggtccccattgccattggtcagtgcaagagatgctgcaatcctgagacacagcaattgtgccaaaccacgcccgagtttcagccttttcaggtgatatatcgaagggcagccatccacttacaactcttgccgccctcccttttatgcactttttagaggcgtggaattggcaaaaaagactgaacttccatttgtacttgtgtagcgtaagcttgtaccaataggcgtgtactaatttgtatcatcattcatcaatggcaaggcactgttaaac

SEQ ID NO: 3387 - DNA, 1381 bp, Echinochloa colona
ctctttctctctcgccccgccgccggcgacgagctcgagcttgagctgcttcctcgtctcgccgacggcggcggcggtatggagcccatgaacgtcgacaacggcggctgcggcggccttgacgcgcagatcgagcagctgatgcagtgccgcccgctcgccgagcaggaggttaagtcactgtgcgagaaggccaaagaaatattgatggaggaaagtaacgttcagcctgtcaagagtccagtgacaatatgtggtgatatacacggacaattccatgatcttgtagagctttttcgaattggtggaaagtgcccagataccaattacttgtttatgggggattatgttgatcgtggctactattctgttgagaccgtcactctgctggtagcactgaaagtgcgccacccacatcgaattacaatccttcgtggaaaccacgagagtcgacagatcacacaggtgtacggattctacgatgaatgcctacgaaagtatggcaatgcaaatgtatggaagacattcacagacctttttgattattttcctctgacagctctggtggaatctgagattttctgccttcatggtggtttatctccatcaattgaaaatcttgacagtgtgcgtagcttagatcgtgtccaagaggttcctcatgagggacctatgtgtgatcttttatggtcagatccagatgatcgatgtggttggggcatatctcctcgtggtgctggttacacttttggccaggacatttcagagcagtttaatcacacgaacaatctcaaacttgtagctcgggctcatcaattagttatggagggatataactgggctcatgaacaaaaggttgtcaccatatttagtgctccgaactattgctaccgatgtggcaatatggcatccattttggaagttgatgactgcaacagtcacacatttatccagtttgaaccggcccctaggagaggtgagccagatgtgacccgaagaacaccagattatttcctttaagttatcgatgttaacatttcccagcatgatgtggtaatcgatgtcaacatctgctggatcgagggccagccagaaataacaagggaataccggagcactatgcagaacttgtggcccccattggtcaatgcaagagatgctgctatcctgaaagaaagcaagtgtgcgatgtaaagccatgcctcagtttgaagcctttcaggtgagtgaagggtcatccacttcaactcttgccctcccttttaggcattttttttacagaggcatggagttggcaaaagactgaacatcaatttgtacttctgtagcgtaagcttgtactaataggcctgtactaatttgtatcatcattcatcagtgg

SEQ ID NO: 3388 - DNA, 1468 bp, Setaria italica
cactccccgctctctctccctctcgcctcgccgccggcgacgagctcgagctcgagcttcttcctcgtctcgccgacggcggcggtgctatggagcctatgaacgttgacaacggcggctgcggtggcctcgacgcgcagatcgagcagcttatgcagtgccgcccgttggccgagcaggaggttaagtcactgtgcgagaaggccaaggagatattgatggaggaaagcaacgttcagcctgtcaagagtccagtgacgatatgtggtgatatacatggacaattccatgatcttgtagagcttttccgaattggcggaaagtgtccagacaccaattacttatttatgggggattatgtggatcgtggctactattctgttgagactgtcactctgctagtagcactgaaagtgcgccacccacatcgaattacgatccttcgtggaaaccacgagagtcggcagatcacacaggtgtatggattctacgatgaatgcctacgaaagtacggcaatgcaaatgtatggaagacatttacggatctttttgattattttcctctgacagctctggtggaatcagagattttctgccttcatggtggtttatctccatcaattgaaaatcttgatagcgtgcgtagcttagaccgtgtccaagaggttcctcacgagggacctatgtgtgatcttttatggtcagatccagacgaccgatgtggttggggcatatctcctcgtggtgctggctacacttttggacaggatatatcagagcagttcaatcacacgaacaatctcaaacttgtagctcgggctcatcaattagttatggagggatataactgggctcatgaacaaaaggttgtcaccatattcagtgctccaaactattgctaccgatgtggcaatatggcatccattttggaagttgacgactgcaacagtcacacctttatccagtttgaaccagccccaaggagaggtgagccagatgtgacgcgaagaacaccggattatttcctttaagttatcgatgttacctattcccagcctatgctgtgacgatcgacgccagcatctgctggatcaagggccagccagaaataacaagcgaatgcgaaagcactatacaaaacctgaggtccccattggccaatgcaagagatgctgctatcctgaaagaaagcaggtgtgccatgtaaagccatgcctgagttttgaagcctttcaggtgatcgaagggccgtccacttcaactcttgccctcccttttaggcatatttttacagaggcatggaattggcaaaagactgaacatcaatttgtacgtttgtagcgtaagcgtgtaccgataggcctgtactgatttgtatcatcattcatcaatggcaaggcacagttaaaccccttttcagtaatctaaattttggtaaagatgtgccatagtacatgcacatgactct

SEQ ID NO: 3389 - DNA, 1428 bp, Zea mays
ctctcggctctcctctccccgatttccttccccacccgctgtcagtctcactccccgcgcgcgcgctctctctttcctcgccttcgccgccggcgacgagcttgagctcgagctggttcctcgtatagaagacgacggccgcggtatggagcccatgaacgtagacaacggcggcagcggtggccttgacgcgcagatcgaacagctgatgcagtgccgcccgctcgccgagcaagaggttaaggcactgtgcgagaaggccaaggagatattgatggaggaaagcaacgttcagcctgtcaagagtccagtgacaatatgtggtgatatacatggacaattccatgatcttgtagagcttttccgaattggcgggaagtgtccagacaccaattacttatttatgggagattatgtagatcgtggctactattctgttgagactgtcactatgctagtagcactaaaagtgaggtatccacatcgaattacaatccttcgtggaaaccacgagagtcggcagatcacacaggtgtatggattctacgacgaatgcctacgaaagtatggcaatgcaaatgtatggaagacatttacggatctttttgattattttcctctgacagctctggtggaatctgagattttctgccttcatggtggtctatctccatcaattgaaaatcttgatagtgtgcgcagcttagatcgagtccaagaggttccccatgagggacctatgtgcgatctcttatggtcagatccagacgaccgatgtggttggggcatctcccctcgcggtgctggctacactttcgggcaggacatatcagagcagtttaatcacacaaacaatctcaaactcgtagctcgggctcatcaattagttatggagggatataactgggctcatgagcaaaaggttgtcaccatattcagtgctccaaattactgctatcgatgcggcaatatggcatccattttggaagttgacgactgcaacagccacacattcatccagtttgaaccagcccctaggagaggtgagccagatgtgacgcgaagaacaccggattatttcctttgagctgtcgatgttaccgtttcccagcctgtgtcgtgataatcgatgtcaacgtctgctggatcaagggccagacagaaataacaggggaatgccgaagcactatgcccagagtttcacccttttcaggcgacagagaagggcggccatccacctacaactctggccgccctctgttttatgcagtttttacagagtcgtggaactggccaaaaagaccggagtaccatttgcacctgtgtagcgtaagcttgtactacaaataggcgtgtgctaatctgtatcaccattcatcaattgcaaggaactgttgaactccttccatcagtaaagtaaattttggt

SEQ ID NO: 3390 - DNA, 2144 bp, Panicum virgatum
cggctgcccagcgttccattcccagcccagcgccgtctttttagctcagccgaacgggcccacgtcgcctgacgcccacagtattcccccaactgacatcatggacccacacaccgaccaacctgtcagccacggacgcgtagtttcccaaccacttgccactgcgcacgtggcatggagcggcgggtccatgtgcggagcaggaggacccacctggcaggtggccttccgtccagtactctccctccctctctctccgattttctcccccgctgtcagtctcactcctcgctctctctctctcgcctcgcctcgccgccggcgacgagctcgagctcgagcttcttcctcgtctcgccgacgacggcggcgttatggagcccatgaacgtagacaacggcggctgcggcggccttgacgcgcagatcgagcagctgatgcagtgccgcccgctcgccgagcaggaggttaagtcactgtgcgagaaggccaaggagatattgatggaggaaagcaatgttcagcctgtcaagagtccagtgacgatatgtggtgatatacatggacaatttcatgatcttgtagagctttttcggatcggcggaaagtgtccagataccaattacttatttatgggggattacgtggaccgtggctactattctgttgagactgtcactctgctagtagcactgaaagtgcgccacccacatcgaattacgatcctccgtgggaaccatgaaagtcggcagatcacacaggtgtatggattctacgacgaatgcctgcgaaagtacggcaatgcaaatgtatggaagacatttacagacctctttgattgttttcctcttacagctctggtggaatctgagattttctgccttcatggtggtttatctccatcaattgaaaatcttgatagcgtacgtagcctagatcgtgtccaagaggttcctcatgagggacctatgtgcgatcttttatggtcagatccggacgatcgatgtggttggggcatatctcctcgtggtgctggctacacttttggccaggacacatcagagcagtttaatcacacgaacaatctcaaacttgtagctcgagcccatcaattagttatggaaggatataactgggctcatgaacaaaaagttgtcaccatattcagtgctccaaactattgttaccgatgtggcaatatggcatccattttggaagttgacgactgcaacggtcacacttttatacagtttgaaccagcccctaggagaggtgagccagatgtgacccgaagaacaccagattatttcctttaagttatcgatgttaccgttttccagcatgtgctgtgagaatcgatgtcaagatctgctggatcaagggccagccagaaataacaagtgaataccaaagcgctatgcaaaactcgtggtccccattggtcagtgcaagagatatgctctatcctggaagagagcaagtgttgccatgtaaagccatgcccgagttttgaagcctttcaggtgatcgaagggccatccactttctactctcgccctcccttttaggcatatttttacagaggcgtgggattggcaaaagactggacatcaatttgtacttttgtagcgtaagcttgtaccaataggcctgtactaatttgtatcatcattcatcaatggcaaggcacaatcaaactcctttcatcagtaatctaaatattggtaaagatgtgcttatagtacatgagcatgactcctttccctattaggacttgtatactgttgattaccacagccattgttttttggaactacacgataatacaagaatcaacaagtcaacatgcatggaagagatgaacagtcgtgtggtggcgtaacaagatcgagtctgtactctgtacacgccgtcgcgcatccctttgccggccggccggcgaggtcacacggaggtgctggcgagcagctggttggtggcgacgcccctgcccttcatgacgtgcttccggaggcccgggatgtggacgttggtgatgtagtccgtccagtccacgctgcgcacgtcgaagtggaagcgcgcctgctccgccgccgacatggccgcgaagagcgcctccgtgttgccgttgtcgaagcggccgc

SEQ ID NO: 3391 - DNA, 1550 bp, Oryza sativa
agtctcactctcccaatccgcctcggcccgagcgcgcgcgcgctttccccccctcgccgccggcgacgagctcgaggcggcggtgcgctcgcctacctccggagggcggagcggggggatggagcccatgagcgtggacggcggcgggggatgcggcggcctggacacgcagatcgagcagctgatgcagtgtcgcccgctcgccgagcaggaggttaaagcactgtgcgagaaggccaaggagatattgatggaggaaagcaatgttcagcctgtcaaaagcccagtaacgatttgtggtgatattcacggacaattccatgatcttgtagaactttttcggatcggtgggaagtgcccagatactaattatttatttatgggggattatgtggatcgtggctattactctgttgagactgttactcttttggtagcgctgaaggtgcgtcacccacatcggattacaatccttcgcggaaatcacgagagccggcagatcacacaggtttatggattctacgacgaatgtttacgaaagtatggcaatgcaaatgtatggaagatattcacggatttatttgactattttccactgacagcactggtggaatctgaaattttctgcctgcatggtggtttatctccatcaattgagaaccttgatagtgtgcgtagcttagatcgtgtccaagaggttccgcatgagggaccaatgtgtgatcttctatggtctgatccagatgaccgctgtggttggggcatatctcctcgtggtgctggctacacttttgggcaggatatatccgagcaattcaatcacaccaacaatctcaaacttgtagctcgggctcatcaactagttatggaaggatataattgggctcatgaacaaaaagttgttactatattcagtgctccaaattattgttaccgatgtgggaatatggcatccattttggaagttgatgactgcaacagccatacttttattcagttcgaaccagctcctaggagaggtgagcctgacgtgacacggaggacgcccgattatttcctttgagttaatggtgctaccatttgtcaccttgtactgcgaatttgcgatagtcaaatgctggtcagtgatactttgctggactgtgaaacctgcgcataggccaaccaacaataacaagggaacatcagatcccttcgtaaaacttgaccctccattggtcaatgcaagagatgctgctatcctgaaacaaagtgtcatgctcatgcagcgatgcctgagtttttcaggtgataaaaaaggcccatccatcctcaccctctcctttttaggcatttttacagaggaaatctagtggcaagactgaacttctatttgtattttgtagcgtaagcttgtatcgatagtcttgtaatttgtatcatcaatggcaaggcaacctaatcatctttcggtgtagtattccgaattttgggggtggttaccctgatgtgctacagtgcagtgttccatggcacctttttctctagttggatgtttttcttcgcatgta

SEQ ID NO: 3392 - DNA, 1403 bp, Hordeum vulgare
cggaggaggccggcggcagagggcatggagcctatgagcgtggacagcagcggctgcggcggcctggacgcgcagatcgagcagctgctgcagtgccgcccgctcgccgagcaagaggttaaagcactatgcgagaaggctaaggagatcttgatggaggaaagcaatgttcagccagtcaaaagcccagtgacaatctgtggtgatattcacggacaattccatgatcttgttgagcttttccggattggtgggaagtgtccagatactaattatttgtttatgggggattatgtggatcgtggatactactctgtcgagactgtttctctcttggtagcactgaaggttcgccatccacatcggattacaatcctccgtggaaaccatgagagtcgacagatcacacaagtatatggattctatgatgaatgcctacgaaagtacggcaatgcaaatgtatggaagatattcacagatctttttgattatttcccattaacagcgctggtggaatctgaaattttctgcctgcatggtggtttatctccatcaattgagaatcttgatagtgtccgtagcttagatcgtgtccaagaggttccacatgagggacctatgtgtgatctcttatggtctgatccggatgatagatgtggatggggcatctctcctcgtggtgctggctacacctttgggcaggacatatccgaacaattcaatcacaccaacaatctcaaacttgtagcgcgggctcatcagttagttatggagggatacaactgggctcatgaacaaaaagttgttaccatattcagtgctccaaactattgttaccgatgtggcaacatggcatccatcttggaagttgatgactgcaacgctcacacctttatccagtttgagccagcccctcggagaggcgagccggacgtgacacggagaacgcctgattatttcctttgagtaaactggctgcaccatttctcagcttgtattgcgaatatccgcaccaatcagtgagattcctgctggatccaaatctgcacatgagccaacaaacaataacaaaggggtgtacgagagccccatgtaaaattgacccccattggtcaatccgaaagattgctgccatcctgaaacaaaagaagcttcatgcagccacctgccctgagttccaggtgaagaaagggctatccatgcaccctctccctcagtactttggcaatttcatagaggcatggcattttacattggcaaagactgaactcctatatgtagcttaagcttgtatcactaggcttgtaatctgtattatcagactgtaagataacagttaattaaatcatatttcagtatttccaatccttgttttcccataaattacatgataagaaatacaa

SEQ ID NO: 3393 - DNA, 1435 bp, Pseudoroegneria spicata
gcggcctcgaccgagcgctcccctccccccctctcgccctccttaccgccggcgacgagctcgagctcaagctgctttttcctacggtcggcggaggaggaggcgggcggcagaggacatggagcctatgagcgtggacagcagcggctgcggcggcctggacgcccagatcgagcagctcttgcagtgccgcccgctcgccgagcaagaggttaaagcactatgcgagaaggctaaggagatattgatggaggaaagcaatgttcagccagtcaaaagcccagtgacaatctgcggtgatattcacggacaattccatgatcttgttgagcttttccggattggcgggaagtgtccagatactaattatttgtttatgggggattatgtggatcgtggatactactccgttgagactgtttctctcttggtagcactgaaggttcgccacccacaccggattacaatcctccgtggaaaccatgagagtcggcagatcacacaagtatatggattctacgatgaatgcctacgaaagtacggcaatgcaaatgtatggaagatattcacagatctttttgattatttcccgttaacggcgctggtggaatctgaaattttctgcctccatggtggtttgtctccatcgattgagaatctcgatagtgtgcgtagtttagatcgtgttcaagaggttccacatgaggggcctatgtgtgatcttttatggtctgatccggacgaccggtgtggttggggcatttctcctcgtggtgctggctacacttttgggcaggacatatctgagcaattcaatcacaccaacaatctcaaacttgtagcccgggctcatcagttagttatggagggatataactgggctcatgaacaaaaggtcgttaccatattcagtgctccaaactattgttaccgatgtggcaacatggcatccattttggaagttgatgactgcaatgctcacacctttatccagtttgagccagcccctcggagaggtgagccagacgtgacacggagaacgcctgattatttcctttgagtaaactggccgcaccatttctcagcttgtattgcgataatccgcaccgatcagtgagattctgctggatccaaatctgcacatgagccaacaaacaataacaaggggtgtaccagagccctgtgtaaaattgacccccattggtcaatccaaaagactgctgccatcctgaaacaaaagaagcttcatgcagccacctgccctgagttccaggtgaagaaagggccatccctccacactttggcaatttcatagaatcatggcattttacattggcaaagactgaactcctatatgtagcttaagcttgtatcactaggcttgtaatctgtattatcgacggcaagattcagttaattaaatcatatttcagca

SEQ ID NO: 3394 - DNA, 2091 bp, Oryza sativa
ggcttccttcctctccagtacgcgtcgccccgccacgtcagcgactggcacgtggggcccacgcgccggccaacctgtcagcgacggacagcgcagtcctcctcccctccaaccacacgcagcgaggggagaggggatgggcccacgtgtcaggttgccctcccgtccagtactctgatactctctctctctctctccctccctcccgtgtccacagtttctctctcttctcttctcttctctctctcagtctcactctcccaatccgcctcggcccgagcgcgcgcgcgctttccccccctcgccgccggcgacgagctcgaggcggcggtgcgctcgcctacctccggagggcggagcggggggatggagcccatgagcgtggacggcggcgggggatgcggcggcctggacacgcagatcgagcagctgatgcagtgtcgcccgctcgccgagcaggaggttaaagcactgtgcgagaaggccaaggagatattgatggaggaaagcaatgttcagcctgtcaaaagcccagtaacgatttgtggtgatattcacggacaattccatgatcttgtagaactttttcggatcggtgggaagtgcccagatactaattatttatttatgggggattatgtggatcgtggctattactctgttgagactgttactcttttggtagcgctgaaggtgcgtcacccacatcggattacaatccttcgcggaaatcacgagagccggcagatcacacaggtttatggattctacgacgaatgtttacgaaagtatggcaatgcaaatgtatggaagatattcacggatttatttgactattttccactgacagcactggtggaatctgaaattttctgcctgcatggtggtttatctccatcaattgagaaccttgatagtgtgcgtagcttagatcgtgtccaagaggttccgcatgagggaccaatgtgtgatcttctatggtctgatccagatgaccgctgtggttggggcatatctcctcgtggtgctggctacacttttgggcaggatatatccgagcaattcaatcacaccaacaatctcaaacttgtagctcgggctcatcaactagttatggaaggatataattgggctcatgaacaaaaagttgttactatattcagtgctccaaattattgttaccgatgtgggaatatggcatccattttggaagttgatgactgcaacagccatacttttattcagttcgaaccagctcctaggagaggtgagcctgacgtgacacggaggacgcccgattatttcctttgagttaatggtgctaccatttgtcaccttgtattgcgaatttgcgatagtcaaatgctggtcagtgatactttgctggactgtgaaacctgcgcataggccaacgaacaataacaagggaacatcagatcccttcgtaaaacttgaccctccattggtcaatgcaagagatgctgctatcctgaaacaaagtgtcatgctcatgcagcgatgcctgagtttttcaggtgataaaaaaggcccatccatcctcaccctctcctttttaggcatttttacagaggaaatctagtggcaagactgaacttctatttgtattttgtagcgtaagcttgtatcgatagtcttgtaatttgtatcatcaatggcaaggcaacctaatcatctttcggtgtagtattccgaattttgggggtggttaccctgatgtgctacagtgcagtgttccatggcacctttttctctagttggatgtttttcttcgcatgtatctgacattctggttttcaaatttcgcactactctactagtactccatactgttctagacatgtacttgatcaaagccaaaaacttggtcaaccgatgttctctctgctaaattatattctgaattatgtgcatcttttgtaaattctgttaaattgattgccaatttttgctctgattacatagtgatagagataacatactatcaaccttaattactgcagcacaaagatcatctgtcagactgccacggcagaacaagttaacaacaatctagcctagtgtacacgccgc

SEQ ID NO: 3395 - DNA, 1531 bp, Hordeum vulgare
ccccactctcctgttccgcggcccctccccccgctccccccctctcgccccgcctcgccgccggcgacgagctccagctcagcctgcctttcccccacggtcggcggaggaggccggcggcagagggcatggagcctatgagcgtggacagcagcggctgcggcggcctggacgcgcagatcgagcagctgctgcagtgccgcccgctcgccgagcaagaggttaaagcactatgcgagaaggctaaggagatcttgatggaggaaagcaatgttcagccagtcaaaagcccagtgacaatctgtggtgatattcacggacaattccatgatcttgttgagcttttccggattggtgggaagtgtccagatactaattatttgtttatgggggattatgtggatcgtggatactactctgtcgagactgtttctctcttggtagcactgaaggttcgccatccacatcggattacaatcctccgtggaaaccatgagagtcgacagatcacacaagtatatggattctatgatgaatgcctacgaaagtacggcaatgcaaatgtatggaagatattcacagatctttttgattatttcccattaacagcgctggtggaatctgaaattttctgcctgcatggtggtttatctccatcaattgagaatcttgatagtgtccgtagcttagatcgtgtccaagaggttccacatgagggacctatgtgtgatctcttatggtctgatccggatgatagatgtggatggggcatctctcctcgtggtgctggctacacctttgggcaggacatatccgaacaattcaatcacaccaacaatctcaaacttgtagcgcgggctcatcagttagttatggagggatacaactgggctcatgaacaaaaagttgttaccatattcagtgctccaaactattgttaccgatgtggcaacatggcatccatcttggaagttgatgactgcaacgctcacacctttatccagtttgagccagcccctcggagaggcgagccggacgtgacacggagaacgcctgattatttcctttgagtaaactggctgcaccatttctcagcttgtattgcgaatatccgcaccaatcagtgagattcctgctggatccaaatctgcacatgagccaacaaacaataacaaaggggtgtacgagagccccatgtaaaattgacccccattggtcaatccgaaagattgctgccatcctgaaacaaaagaagcttcatgcagccacctgccctgagttccaggtgaagaaagggctatccatgcaccctctccctcagtactttggcaatttcatagaggcatggcattttacattggcaaagactgaactcctatatgtagcttaagcttgtatcactaggcttgtaatctgtattatcagactgtaagataacagttaattaaatcatatttcagtatttccaatccttgttttcccataaattacatgataagaaatacaacatgtagagagaaagagggagaac

SEQ ID NO: 3396 - DNA, 2620 bp, Secale cereale
tccagtccttccccgctcccccccacgcagtctcactcccactctcctgttccgcggccccgacctccctccctccttgctccctcccccctctcgccccgcctcgccgccggcgacgagctccagctcaggttgctttcccctacggtcggcggaggaggaggcgggcggcagaggacatggagcccatgagcgtggacagcagcggttgcggcggcctggacgcgcagatcgagcagctcttgcagtgccgcccgctcgccgagcaagaggttaaagcactatgtgagaaggctaaggagatattgatggaggaaagcaatgttcagccagtgaagagcccagtgacaatctgtggtgatattcacggacaattccatgatcttgttgagcttttccggattggtgggaagtgtccagacactaattatttgtttatgggggattatgtggatcgtggatactactctgttgagactgtttctctcttggtagcactgaaggttcgccacccacatcggattacaatcctccgcggaaaccatgagagtcggcagatcacacaagtatatggattctacgatgaatgcctacgaaagtacggcaatgcaaatgtatggaagatattcacagatctttttgattatttcccattaacagccctggtggaatctgagattttctgcctgcatggtggtttatctccatcaatcgagaatcttgatagtgtgcgtagcttggatcgtgtccaagaggttccacatgagggacctatgtgtgatcttttatggtctgatccggacgatcgatgtggttggggcatttctcctcgtggtgctggctacacttttgggcaggacatatctgagcaattcaatcacaccaacaatctcaaacttgttgctcgggctcatcagttagtcatggagggatataactgggctcatgaacaaaaagttgttaccatattcagtgctccaaactattgttaccgatgtggcaacatggcatccattttggaagttgatgactgcaatgctcacaccttcatccagtttgagccagcccctcggagaggtgagccagacgtgacaaggagaacacctgattacttcctttgagtaaactggctgcaccatttctcagcttgtattgcgatagcccgcaccgatcagtgagattctgctggatccaaatctgcacatgagccaacaaacaataacaaaggggtgtaccagagccctgtgtaaaattgacccccattggtcaatccaaaagactgctgccatcctgaaacaaaagaagcttcatgcagccacctgctccgagtcccaggtgaagaaagggccatctatgcaccctctccttctatactttggcaatttcatagaggcattgcattttacattggcaaagactgaactcctatatgtagcttaagcttgtatcactaggcttgtaatctgtattatcgacggtaagatacagttaattaaatcatatttcagcatttccaaagctttgtttccccccaaatgcacaataagaaattacatgcagggaggagaacaagtattttctgttgtttaggacaaacaggtctataatgcagaatcaatcggcagaatgacatcaaccttagttaagttgctgctaacacaaccaaatgtgtttcttcagtggatcacgtacttaggcacatgatacaatctaactctagtgtacacgccgcggcgcatttctgtgtttggtgtcgaggcggtgggttcacaccgtggaggtggaggtggcggtgagcaccgtggaggatggcggcgattccgcggcgatgcccctccctttcatgacgtgcttcctgagccccgggatgtggacgttggtgatgtagtccgtccagtcgatgctcctcacgtcgaagtggaacgccgccttctcctctgccgacatctccgccatgagcccctccgtgttgccattgtcgaacctgccggtgtagaaggtgtagggctggtagatgctgccgaggtggatggtctgctcgacggacttggcgcagagctcctggaggcgttgggagaggcgctcgccggcggggacgccggccctggtgctccgcagcagcgcgtccgtttcgacgtagctggcgaactgctccatggtgtcgaagaggcgcatgggcggcacggcgatgggctgccccgccgcgtcgctgtaggggctcctggtgaagtgctggaacaggaaccggctcaggtcgccgaacaccagcgggttcaccgtcgacgacgccacgtggtacacgtgcattcccccctccgccgcccgcccgtgcttcgccatcgtcgccagcgtcgcgttcaccaccatgtccgccggaaccacgtcaagaacgccggccggatcggcgaggaagccgctgagctgccctttgccgtagtagaggacgacagggtccatcatcctgttcccttccatccagccggggaaggggtccctccaggtgctctcgatcacgctcggcctgatggtcaccacggggatctcccctcgcatgctgttgatcaccatctcccccatggccttggtgaacacgtaggtgtcctgccacccatggagcttc

SEQ ID NO: 3397 - DNA, 2316 bp, Secale cereale
tcaggtttcttctacttcccactctcctgttccgcggccccgacctccctccctctcgctcccctcccccctctcgccccgcctcgccgccggcgacgagctccagctcaggttgctttcccctacggtcggcggaggaggaggcgggcggcagaggacatggagcccatgagcgtggacagcagcggctgcggcggcctggacgcgcagatcgagcagctcttgcagtgccgcccactcgccgagcaagaggttaaagcactatgtgagaaggctaaggagatattgatggaggaaagcaatgttcagccagtgaaaagcccagtgacaatctgtggtgatattcacggacaattccatgatcttgttgagcttttccggattggcgggaagtgtccagatactaattatttatttatgggagactatgtggatcgtggatactactctgttgagactgtttctctcttggtagcactgaaggttcgccacccacatcggattacaatcctccgcggaaaccatgagagtcggcagatcacacaagtatatggattctatgatgaatgcctacgaaagtacggcaatgcaaatgtatggaagatattcacagatctttttgattatttcccattaacagccctggtggaatctgaaattttctgcttgcatggtggtttatctccatcgattgagaatcttgatagtgtgcgtagcttggatcgtgtccaagaggttccacacgagggacctatgtgtgatcttttatggtctgatccggatgatcgatgtggttggggcatttctcctcgtggtgctggctacacttttgggcaggacatatctgagcagttcaatcacaccaacaatctcaaacttgttgctcgggctcatcagttagtcatggagggatataactgggctcatgaacaaaaagttgttaccatattcagtgctccaaactattgttaccgatgtggcaacatggcatccattttggaagttgatgactgcaatgctcacaccttcatccagtttgagccagcccctcggagaggtgagccagacgtgacaaggagaacacctgattacttcctttgagtaaactggctgcaccatttctcagcttgtattgcgatagcccgcaccgatcagtgagattctgctggatccaaatctgcacatgagccaacaaacaataacaaaggggtgtaccagagccctgtgtaaaattgacccccattggtcaatccaaaagactgctgccatcctgaaacaaaagaagcttcatgcagccacctgctccgagtcccaggtgaagaaagggccatctatgcaccctctccttctatactttggcaatttcatagaggcattgcattttacattggcaaagactgaactcctatatgtagcttaagcttgtatcactaggcttgtaatctgtattattgacggtaagatacagttaattaaatcatatttcagcatttccaaagctttgtttccccccaaatgcacaataagaaattacatgcagagaagagaacatgttttttctgttgtttaggacaaacaggtctataatgcagaatcagtcggcagaatgacatcaaccttagttaagttgctgctaacacaaccaaatgtgtttcttcagtgggtcacgtacttaggcacatgatacaatctaactctagtgtacacgccgcggcgcatttctgtgttcggtgtcgaggcggtgggttcacaccgtggaggtggaggtggcggcgagcaccgtggaggatggcggcgattccgcggcgatgcccctccctttcatgacgtgcttcctgagccctgggatgtggacgttggtgatgtagtccgtccagtcgatgctcctcacgtcgaagtggaacgccgccttctcctctgccgacatctccgccatgagcccctccgtgttgccattgtcgaacctgccggtgtagaaggtgtagggctggtagatgctaccgaggtggatggtctgctcgacggacttggcgcagagctcctggaggcgctgggagaggcgctccccggcggggacgccggccgtggtgctccgcagcagcgcgtccgtctcgacgtagctggcgaactgctccatggtgtcgaagaggcgcatgggcggcacggcgatgggctgccccgccgcgtcgctgtaggggctcctggtgaagtgctggaacaggaaccggctcaggtcgccgaacaccagcgggttcaccgtcgacgacgccacgtggtacacgtgcattcccccctccgccgcccgcccgtgttcgc

SEQ ID NO: 3398 - DNA, 1509 bp, Triticum aestivum
gttccgcggccccgacccagcgctcccctccctccctctcgccccgccttgccgccggcgacgagctccagctcaggttgccttttcccacggtcggcggaggaggaggcgggcggcagaggacatggagcccatgagcgtggacagcagcggctgcggcggcctggacgcgcagatcgagcagctcttgcagtgccgcccgctcgccgagcaagaggttaaagcactatgcgagaaggctaaggagatattgatggaggaaagcaatgtgcagccagtcaaaagcccagtgacaatctgcggtgatattcacggacaattccatgatcttgttgagcttttccggattggcgggaagtgtccagatactaattatttgtttatgggggattatgtggatcgtggatactactccgttgagactgtttctctcttggtagcactgaaggttcgccacccacatcggattacaatcctccgcggaaaccatgagagtcggcagatcacacaagtatatggattctacgatgaatgcctacgaaagtacggcaatgcaaatgtatggaagatattcacagatctttttgattatttcccattaacagccctggtggaatctgaaattttctgcctgcatggtggtttatctccatcgattgagaatcttgatagtgtgcgtagcttggatcgtgtccaagaggttccacatgagggacctatgtgtgatcttttatggtctgatccggacgatcgatgtggttggggcatttctcctcgtggtgctggctacacttttgggcaggacatatctgagcagttcaatcacaccaacaatctcaaacttgtagcccgggctcatcagttagtcatggagggatataactgggctcatgaacaaaaagttgttaccatattcagtgctccaaactattgttaccgatgtggcaacatggcatccattttggaagttgatgactgcaatgctcacacctttatccagtttgagccagcccctcggagaggtgagccagacgtgacaaggagaacacctgattatttcctttgagtaaactggctgcaccatttctcagcttgtattgcgatagtccgcaccgatcagtgagattctgctggatccaaatctgcacatgagccaacaaacaataacaaaggggtgtaccagagccctgtgtaaaattgacccccattggtcaatccaaaagactgctgccatcctgaaacaaaagaagcttcatgcagccacctgctctgagtcccaggtgaagaaagggccatccatgcaccctctccctctatactttggcaatttcatagaggcatggcattttacattggcaaagactgaactcctatatgtagcttaagcttgtatcactaggcttgtaatctgtattatcgacggtaagatacagttaattaaatcatatttcagtatttccaaagctttgttttcccacaaatacacgataagaaattacatgcagagag

SEQ ID NO: 3399 - DNA, 1456 bp, Brachypodium distachyon
cctcactccacactctcccgtcccgttccccctctccgaccgcgcgctctcccctccccttatctgccggcgacgaggtcgagctctagctggtgcttcgtacagcccgcggaggaggaggcggagatggagcctatgagcgttgacagcagcagcagcggctgcgggggcctggacgcgcagatcgagcagctcatgcagtgccgcccgctcgccgagcaggaggttaaagcattatgcgagaaggccaaggagatattgatggaggaaagcaatgtacagccagtaaaaagtccggtaacaatttgcggtgacattcatggacaattccatgatcttgttgagctttttcggattggtgggaagtgcccagatactaattatttgttcatgggggattatgtggatcgtggctactactcagtcgagactgtttctctcttggtagcactgaaggtccgccacccacatcggattacaatccttcgtggaaaccatgagagtcgacagatcacacaggtctatggattctatgatgagtgcttaagaaagtatggcaacgccaacgtatggaaaatattcacagatctttttgattacttcccactaacagcgctggtggaatctgaaattttctgcctccatggtggtttgtctccatcaattgagaatcttgatagtgtgcggtgcttagatcgtgtccaagaggttccgcatgagggacctatgtgtgaccttttatggtctgatcccgatgaccgatgtggctggggcatatctcctcgtggtgctggctacacatttgggcaggacatatctgaacaattcaatcacaccaacaatctcaaacttgtagctcgggctcatcagctagttatggagggatataattgggctcatgaacaaaaagttgttaccatattcagtgctccaaactattgttaccgatgtggcaacatggcatccattttggaagttgatgactgcaacagccacacatttatccagtttgagccagcccctaggcgaggtgagccagacgtgacacggagaacgcctgattatttcctttgaatgaatcggcagcaccatttctcagcttgtattgcgataacctgcaccgatcagtgagattctgctgggcccaaatatgcacatgagccgacaaacaataacaaagggggttatcaaaaccttatgtaaaacttgaacccccatcggtcaattcaaccaagggggtgctaccctgaaacaaaacaaggttgcagccactcctgcctgagttccagctgaaaaaaaggaccaatatccatcatctccctcctcactaggcaatttcatagatttctcttggcaaagactgcactcctacctgtagcgtaagcttgcatcactgggcttgtaatctgtattattatcaatgacaggattcagtttaattaaatcagatttcagt

SEQ ID NO: 3400 - DNA, 1522 bp, Festuca arundinacea
ggcacgaggcctcgtgccgaatcggcacgaggcggctccgctctcctctctctgccccctatccgccggcgacgagcttgagctcgagctcgagctgtctcttcttactgtcctcggaggaggcggtgccggcggatatggagcctatgagcgtggacagcagcggcagcgggggcctggacgcgcagatcgagcagctcatgcagtgccgcccgctccccgagcaagaggtcaaagcactatgcgagaaggctaaggagatattgatggaggaaagcaatgttcagccagtcaaaagcccagtgacaatttgcggcgacattcacggacaattccatgaccttgttgagcttttccggattggcggcaagtgtccagatactaattatttgtttatggggactatgtagatcgtggctactactctgttgagactgtttctctcttggtagcactgaaggtgcgccacccacatcggattacaatccttcgtggaaaccatgagagtcgacagatcacacaggtgtatggattctatgatgaatgcttacgaaagtatggcaatgcaagtgtatggaagatattcacagatctttttgattattttccattgacagcgctggtggaatctgaaattttctgtctccatggtggtttgtctccatcaattgagaatcttgatagtgtgcgtagcttagatcgtgtccaagaggttccacaggaggggcctatgtgcgatctcctatggtctgatccagacgatcgatgtggttggggtatatctcctcgtggtgctggctacacatttggacaggacatatccgaacaattcaatcacaccaacaatctcaaacttgtagctcgggctcatcaattagttatggagggatataactgggctcatgaacaaaaggttgttaccatattcagtgctccgaactattgttaccgatgtggcaacatggcatccattctggaagttgatgattgcaacagccactcgtttatccagtttgagccagcccctaggagaggcgagccagacgtaacccggagaacgcctgattacttcctctgagctagctggtggcaccattttgtcagcttgtattgcgataatgcgcaccgatcagtgagattctgctggatccaaatatgcacatgagccaacaaacaataacaaaggccctatgtaaaacatgacgcccattggttaatccgaaagatgctgctatcctgaaacgaaacaagcttcatgcagccacacctgcctgaattccaggtgaaaagagggccaccatgcatcctctccctccacacctgggcatttcatagaggcatgtcattacattggcaaaagactgaaactcctatatatagcttaagcttgtatcactaggcttgtaatatgtactatcaatgacgaagatacagttaattaaatcatatttcaagtaaaaaaaaaaaaaaacaaaaaaaaaacaaaaaaaaacaaaaaaaaaaaaaaaaacaaaaaacaaaa

SEQ ID NO: 3401 - DNA, 1871 bp, Lolium multiflorum
cccccgctcccattctcactcctcactcctgttccgcggctccgaccggccgctctcctctctccgccggcgacgagcttcagctccagctcgagctgtctcttcatactgtcctcggaggaggcggcgccggcgggtatggagcccatgagcgtggacagcagcggcagcggcggcctggacgcgcagatcgagcagctcatgcagtgccgcccgctccccgagcaagaggtcaaagcgctatgcgagaaggctaaggagatattgatggaggaaagcaatgttcagccagtcaaaagtccagtgacaatttgcggtgacattcacggacaattccatgaccttgtggagcttttccggattggcggcaagtgtccagataccaattatttgttcatgggggactatgtagatcgtggctactactctgttgagactgtttctctcttggtagcactgaaggtgcgccacccacaccggattacaatcctccgtggaaaccatgagagtcgacagatcacacaggtctatggattctatgatgaatgcttacgaaagtatggcaatgcaagtgtatggaagatattcacagatctttttgattattttccattgacagcgctggtggaatctgaaattttctgcctccatggtggtttgtctccatcaattgagaatcttgatagtgtgcgtagcttagatcgtgtccaagaggttccacacgaggggcctatgtgcgatctcctatggtctgatccagacgatcgatgtggttggggcatatctcctcgtggtgctggctacacttttggacaggacatatccgaacaattcaatcacaccaacaatctcaaacttgtagctcgggctcatcagttagttatggagggatataactgggctcatgaacaaaaggttgttaccatatttagtgctccgaactattgttacagatgtggaaacatggcatccattctggaagttgatgactgcaacagccactcgtttatccagtttgagccagcccctaggcgaggtgagccagatgtgacccggagaacgcctgattacttcctttgagttaattggtggcaccatttctcagcttgtattgcgataatgcgcaccgatcagtgagattctgctggatccaaatctgcacatgagccaacaaacaataacaaaggccctatgtaaaacttgacccccattggtcaatccagaagaggctgctatcttggaagaaaacaagcttcatgcagctacacctgcctgagttccaggtgaaaaaagggccatcatacatcctctcttctcacacgggtatttcatagaggcatgtcattacattcgcaaagactgaactcctatatgtagcttaagcttgtattactaggcttgtaatctgtattgtcaatgacaaagatacagttggttaaatcatattgcaacctttatggagattgatctccaagcttttgtctctgcaagtgcacaatgagaaatacaagatggaggaaaagaaaatattttcttttgtgtaggacaaacatgcttgtctataaatctgacacaatgacatcgtcaaaccttaagttaccacaaatacgaacgagctggcttctccagggtcattgcagcggcaaggatcacgcatgaaacgtgacgtgcagcaagtgacctgtcatgcacaaataatctagtctagtgtacacgccgccggcgcatctccttgttcagcttctgccaggcggcttcacaccgtggtggtggcgccggcgagcaccgcggcggaggaggacggtgaggcggcggccgaggctgaggctgtgacgcccctccccttcatgacgtgcttcctgagccctggg

SEQ ID NO: 3402 - DNA, 1509 bp, Avena sativa
ctcctcactctcctgttccgcggccccgaccgtgcgctctcctctctctctctctccctcccccctttccgccggcgacgagcttgagcttgctcgagctgtcttttcgtacagtccgcggaggaggcggcgccggcggatatggagcctatgagcgtggacagcagcggcagcgggggcctggacgcgcagatcgagcagctcatgcagtgccgcccgctccccgagcaggaggtcaaagcactatgcgagaaggctaaggagatattgatggaggaaagcaatgttcagccagtcaaaagcccagtgacaatttgcggtgacattcacggacaattccatgatcttgtagagcttttccggattggcggcaagtgtccagatactaattatttgtttatgggggactatgtagatcgtggctactactctgttgagaccgtttcactcttggtagcattaaaggtgcgccacccacatcggattacaatccttcgtggaaaccatgagagtcgacagatcacacaggtgtatggattctatgatgaatgcttacgaaagtatggcaatgcaagtgtatggaagatattcacagatctttttgattattttccgttgacggcgctggtggaatctgaaattttctgcctccatggtggtttgtctccatcaattgagaatcttgatagtgtccgcagcttagatcgtgtgcaagaggttccacatgaggggcctatgtgtgatcttctatggtctgatccagacgatcgatgtggctggggcatatctcctcgtggtgctggttacacttttggacaggacatatctgaacaattcaatcacaccaacaatctcaaacttgtagcacgggctcatcagttagttatggagggatataactgggctcatgaacaaaaggttgttaccatattcagtgctccgaactattgttaccgatgtggcaacatggcatccattctggaagttgatgactgcaacagccactcgtttatccagtttgagccagcccctaggagaggcgagccagacgtaacacggagaacgcctgattacttcctctgagttagcgggtgacaccattttctcagcttgtattgcgataatccgcaccgatcagtgagatagattctgctggatccagatctgcacatgagccaagacaataacaaaggccctatgtaaaactcgacccccattggtcagtccagaagatgctgctatcctgaaacaaaacaagcttcatgcagctgcacctgcctgagttccaggtgggaaaaaaaaggggccatgatacgtcctctccacagctgggcatttcgtagaggcatggaattacattggcaaaaagactgaactcctataaatatgtagcttaagcttgtattactaggcttgtaatctgtactatcaatgccaaagatacagataattaaatcaattagtttacagtttctatggacacttaacctccaagtcttttgtactacc

SEQ ID NO: 3403 - DNA, 1465 bp, Avena sativa
cactcctcactctcctgttccgcggccccgaccgtgcgctctcttctctccctctcccccctttccgccggcgacgagcttgagctagctcgagctgtcttttcatacagtccgcggaggaggcggcgccggcggacatggagcctatgagcgtggacagcaacggcagcgggggcctggacgcgcagatcgagcagctcatgcagtgccgcccgctccccgagcaggaggtcaaagcactatgcgagaaggctaaggagatattgatggaggaaagcaatgttcagccagtcaaaagcccagtgacaatttgtggtgacattcacgggcaattccatgatcttgttgagcttttccggattggcggcaagtgtccagatactaattatttgtttatgggggactatgtagatcgtggctactactctgttgagaccgtttctctcttggtagcattgaaggtgcgccacccacatcggattacaatccttcgtggaaaccatgagagtcgacagatcacacaggtgtatggattctatgatgaatgcttacgaaagtatggcaatgcaagtgtatggaagatattcacagatctttttgattattttccattgacagcgctggtggaatctgaaattttctgcctccatggtggtttgtctccatcaattgagaatcttgatagtgtccgtagcttagatcgtgtccaagaggttccacacgaggggcctatgtgtgatcttctatggtctgatccagacgatcgatgtggctggggcatatctcctcgtggtgccggttacacttttggacaggacatatctgaacaattcaatcacaccaacaatctcaaactcgtagctcgtgctcatcagttagttatggagggatataactgggctcatgaacaaaaggttgttaccatattcagtgctccgaactattgttaccgatgtggcaacatggcatccattctggaagttgatgactgcaacagccactcgtttatccagtttgagccagcccctaggagaggcgagcccgacgtaacacggagaacgcctgattacttcctctgagttagcgtgcggcaccattttctcagcttgtattgcgataatccgcaccgatcagtgagatagattctgctggatccagatctgcacatgagccaagaaacaataacaaaggccctatgtaaaactcgacccccattggtcagtccagaagatgctgctatcctgaaacaaaacaagcttcatgcagctgcacctgcctgagttccaggtggggaaaaaagggccatgatacgtcctctccacagctgggcatttcgtagaggcatggaattacattggcaaaaagactgaactcctatatatatgtagcttaagcttgtattactaggcttgtaatctgtactatcaatgccaaagatacagttaattaaatcatatttcagttt

SEQ ID NO: 3404 - DNA, 1279 bp, Pennisetum glaucum
cggcctcgacgcgcagatcgagcagctgatgcagtgccgcccgctcgccgagcaggaggttaaatcactctgcgagaaggccaaggagatattgatggaggaaagcaacgttcagcctgtcaagagtccagtgacgatttgtggtgatatacatggacaattccatgatcttgtagagcttttccgaattggcggaaagtgtccagacaccaattacttatttatgggggattatgtggatcgtggctactattctgttgagactgtcactcttctagtagcactgaaagtgcgccacccacatcgaattacgatccttcgtggaaaccatgagagtcggcagatcacacaggtgtatggattctatgatgaatgcctacgaaagtatggcaatgcaaatgtatggaagacatttacggatctttttgattattttcctctgacagctctggtggaatcagagattttctgccttcatggtggtttatctccatcaattgaaaatcttgatagcgtgcgtagcttagatcgtgtccaagaggttcctcatgaggggcctatgtgtgatctcttatggtcagatccagatgaccgatgtggttggggcatatctcctcgcggtgctggctacactttcggacaggatatatcagagcagttcaatcatacgaacaatctcaaacttgtagctcgggctcatcaattagttatggagggatataactgggctcatgaacaaaaggttgtcaccatattcagtgctccaaactattgctaccgatgtggcaatatggcatccattttggaagttgacgactgcaacagtcacacatttatccagtttgaaccagccccaaggagaggtgagccagatgtgacccggagaacaccagattatttcctttaggttatcgacgttaccatttctcagcctgtgctgtgacgatcaacgtcagcatctgctggatgaagggccagccagaaataacaagggaatgccaaagcaccatacagaacctgaggtccccattggccaatgcaagagatgcttctatccttaaagaatgcaagtgtgccatgtaaagccatgcccgagttttgaagcctctcaggtgatcgaagggcctgtccagttccaactcttgcccacccttttaggcatatttttacaggggcgtggaattggcaaaagactaaacatcaatttgtacgctaagtctttgtagcgtacaagtgtgtactgataggcctgtactgatttgtatcatcattcatcaat

SEQ ID NO: 3405 - DNA, 1675 bp, Sorghum bicolor
gcccgcttcctctccatcacaccctctcctccgagccgcccccgcttttctcctcccgcgcccctccgcgagctccctgcccctcgcgctcccgccggcgacaagctcccgccagagtgaggtagatcagggtgctgtgccggcacgcgtggaagggatggagggcctcgcgggttcgcgtggcggcggggggtgcggtggtcttgacgcgcagatcgagcagctcatggagtgccgcccgctcgcagagacggaggttaaaacactgtgtgagaaggccaaggagatattaatggaggaaagcaatgttcagccagttaaaagccctgtgacaatttgtggtgatattcatggccaattccatgatcttgtagaacttttccggattggtgggaagtgtccagatacgaattatttgtttatgggtgattatgtggatcgtggctattactctgttgagacagtaacgcttttggttgcacttaaggtgcggtacccacaacgcatcacaattcttcgtggaaaccatgagagtaggcagatcacacaggtgtatggcttctatgatgaatgcctacgaaaatatggcagtgcaaatgtctggaagatcttcactgatctttttgattattttccgttgacagcattggtggaatcagaaattttctgcctccatggcggtttatctccatccatagagaatcttgatagtgttcgtagtttagatcgtgtccaagaggtccctcatgagggacctatgtgtgaccttctatggtctgatccagacgatcgatgtggctggggcatatctcctcggggcgctggatacacttttggccaagacatatcggaacagtttaatcacaccaacaatcttaaacttgtagctcgggctcaccagttggttatggagggatacaactgggcacatgaacaaaaggtggtgaccatattcagcgcacctaattactgttaccggtgtggcaacatggcatccatcctcgaggttgatgattgcaggaatcacacatttattcagtttgagccagctcctaggagaggtgaaccagatgtgacacggaggacacctgattatttcctttgagttatctgccatactatttcagattttgtcaatattgcaatagtgatgctggtcagtaacatttttgttggatctatatggtaacttaaccgaccagcaacagtaagaaaatgtggaagctgcttatctgcatttgtcattgcaagaggttctatcagatcaacctacatcccaagctgtcaaaagatccgcttgtctacccagtggtgaattggcacctcccttgggctttggccccatagaccttcactgtttcgaagggcgttgggacgtcggagcttacattttcagcgtaagttgcctcagttctgtcttctgtgtcagctagttttgtggttgtgtgattgttagttgtaacttctgtgattaaatgacaacagacaagctgatcttgttgcgagaattggaaacaattcaatgattctgctagttcttcctttgtttctttatccatgcccttgatacacgagtgttagccactctcatgtagcagcaacacgttacagtcaagttcgcatgtcatttttatcatgttaatgctcatggtaaggtaattaaatgaacaatgtt

SEQ ID NO: 3406 - DNA, 1478 bp, Echinochloa colona
ctcgagctcctcccccgcccgcgctcttgccggcgagctccaaccagaggaaggtagatcagggcgctgtccctgcgggcggagaacggatggaggactccgcgggctcgcgtggcggcgggggatgcggcggcctggacgcgcagatcgagcagctcatggagtgccgcccgctcccggagacggaggttaaaacattgtgtgagaaggccaaggagatattgatggaggaaagcaatgttcagccagttaaaagcccagtgacaatctgtggtgatattcatgggcaattccatgaccttgtagaacttttccggattggtgggaagtgtccagacacaaactatttgtttatgggagattatgtagatcgtggctattactctgttgagactgtaacgcttttggttgcacttaaggtgcggtacccacagcgaattactattcttcgtggaaaccatgagagtagacagatcacacaggtgtatggcttctatgatgaatgcctacgaaaatatggcagtgcaaatgtttggaaaatcttcaccgatcttttcgactattttccattgacagcattggtggaatcagaaattttctgcctccatggtggtttatctccttccattgagaacctcgatagtgttcgtagcttagatcgtgttcaagaggtccctcatgagggacctatgtgtgaccttctatggtctgatccagatgatcgatgtggctggggcatatctcctcgaggcgctggatacacttttggccaagacatatcggaacagtttaatcacaccaacaatcttaagcttgtagcccgagctcatcagttggttatggagggttataactgggcacatgaacaaaaggtggtgaccatattcagtgcacctaattactgttaccggtgtggcaacatggcatccatccttgaggttgatgactgcaggaatcacacatttattcagtttgagccagctccgaggagaggtgaaccagatgtgactcggagaacacctgattatttcctttgagttatttgttgtatcattttgatttttgtgcaaaattgcaatagttggtgctggtcagtaacatttttgttggatcgtatgataaattaacctgaccagcaatagcaagaaattgccacagccctaatagtgtgagagttgatccccattcgtggctgcaagaggtgctatcagcccgccatccaaaccattgtgcaagaatctggtggtaaattggcgcctcccatggctctgttgactgctggcgcaacagatggagctttcgttttagcataagatgcttgggttattcctttagctttgttttgtactggtgtgcttacaacctccgtgactaaatgactagacatgctgatcctctcgttgcaagaattgtgaagaatggcatgctgctggttcttccgttctttactagtgcgatattaccagatgcacccacac

SEQ ID NO: 3407 - DNA, 1552 bp, Pennisetum glaucum
cgccccggcgccccctccacacgaggccacggagccccctaccccccgcgcgctttcgccggcgacgagcgctagctagagcaaggtagatcagggcgctgtccctgtggccgggggggcggatggaggactccgcgggatcgcgtggcggcgggggatgcggcggcctggacgcgcagatcgagcagctcatggagtgccgcccgctggcggagacggaggttagagcactctgtgagaaggccaaggagatattgatgggtgaaagcaatgttcagccagttaaaagcccggtgacaatttgtggcgacattcatgggcaattccatgaccttgtagaacttttccggattggtggaaagtgtccagacacgaactatttgtttatgggagattatgtggatcgtggttattactctgtggagactgtaacgcttttggttgcacttaaggtgcgttacccacaacgaattactattcttcgtggaaaccatgagagtagacagatcacacaggtgtatggcttctatgatgaatgcctacgaaaatatggcagtgcaaatgtctggaagatcttcactgatcttttcgactattttccattgaccgcactggtggaatccgaaattttctgcctccatggtggtttatctccttccattgaaaatctcgatagtgttcgtagcttagatcgtgttcaagaggtccctcatgagggacctatgtgtgaccttctatggtccgatccagatgatcgatgtggctggggcatatctcctcgaggagctggatacacttttggccaagacatatcggaacagtttaatcacaccaacaatcttaaacttgttgcccgggctcatcagttggttatggagggttataactgggcacatgaacaaaaggtggtgaccatattcagtgcacctaattactgttatcggtgtggcaacatggcatccatccttgaggttgatgactgcaggaatcacacatttattcagtttgagccagctccgaggagaggtgaaccagatgtgacacggagaacacctgattatttcctttgagttatttgctgccatattgatttttgtgcaagattgcaaatagtggttgctggtcagaaacatttttgttggatccatatgataaattaacctgaccagcaatagcaagaaaatgccacatccctaatagtgtgagagttgatccccatttgtggctgcaagaggtgctatcaaccgaccacccaagctgacataagaatccggcggtaaatggcacctccgttggctctgttgagccagaccgctggctcaatagagatggagcttccattttagcataagttgcttgggttgttcctttagttttgttttgtattggtgtgcttacaaacactgtgattaagaccgaagacatgctgatcctcttgttgctagaattgcgaagaatgacatgcagctagttattctgtttactacgcatatctgatctgatattaccggttgtgcacttctttcatatagaaccaacatgttacagtcca

SEQ ID NO: 3408 - DNA, 1423 bp, Setaria italica
gacgagcgccagctagagtaaggtagatcagggcgctttcgccggagaacggatggaggattccgcgggttcgcgtggcggcgggggatgcggcggcctggacgcgcagatcgagcagctcatggagtgccgcccgctcccggagacggaggttagagcattgtgtgagaaggccaaggagatattgatggatgaaagcaatgttcagccagttaaaagcccggtgacaatttgtggcgacattcatggacaattccatgaccttgtagaacttttccggattggtggaaagtgtccagacacgaactatttatttatgggagattatgtggatcgtggttattactctgttgagactgtaacgcttttggttgcacttaaggtgcggtacccacaacgaattactattcttcgtggaaaccatgagagtagacagatcacacaggtgtatggcttctatgatgaatgcctacgaaaatatggcagtgcaaatgtctggaagatcttcactgatctttttgactattttccattgacagcattggtggaatcagaaattttctgcctccatggtggtttatctccttccattgaaaatctcgatagtgttcgtagcttagatcgtgttcaagaggtccctcatgagggacctatgtgtgaccttctatggtctgatccagatgatcgatgtggctggggcatttctcctcgaggagctggatacacttttggccaagacatatcggaacagtttaatcacaccaacaatcttaaacttgttgcccgggctcatcagttggttatggagggttataactgggcacatgaacaaaaggtggtgaccatattcagtgcacctaattactgttaccggtgtggcaacatggcatccatccttgaggttgatgactgcaggaaccacacatttattcagtttgagccagctccgaggagaggtgaaccagatgtgacacggagaacaccagattatttcctttgagttatttgctgtcattttgatttttgtgcaagattgcaatagtggttgctggtcagaaacatttttgttggatccatatgataaattatcctgaccagcaatagcaagaaaatgccacatccctaatagcgtgaaagttgatccccattcgttgctgcaagaggtgctatcagcctaccacccaagctgacgtaagaatccggcggtaaattggcacctccgttggttctcaacagagatggagcttccgttttagcataagttgcttgggttcttcctttagtttcattttgtattggtgtgcttacaacctctgtgattaagacttaagacatgctgatcctcttgttgctagaattgtgaagaatggcatgcagctagttcttccgttctttactacgtatatctgatattaccagctgt

SEQ ID NO: 3409 - DNA, 1532 bp, Saccharum officinarum
gacccacgcgtccggtgccgccgcgcttttctcctcccgcgcccctccgcgagctccctgcccctcgcgctcccgccggcgacaagctcccgccagagtttggtagatcagggtgctgtgccggcacgcgtggaagggatggaggacctcgcgggttcgcgtggcggcgggggctgcggtggtcttgacgcgcagatcgagcagctcatggagtgccgcccgctctcggagacggaggttaaaacactgtgtgagaaggccaaggagatattaatggaggaaagcaatgttcagccagttaaaagccctgtgacaatttgtggtgatattcatggccagttccatgatcttgtagaacttttccagattggtgggaagtgtccagatacgaattatttgtttatgggtgattatgtggatcgtggctattactctgttgagacagtaacgcttttggttgcacttaaggtgcggtacccacaacgcatcacaattcttcgtggaaaccatgagagcaggcagatcacacaggtgtatggcttctatgatgaatgcctacgaaaatatggcagtgcaaatgtctggaagatcttcaccgatctttttgattattttccgttgacagcattggtggaatcagaaattttctgcctccatggtggtttatctccatccattgagaatcttgatagtgttcgtagtttagatcgtgtccaagaggtccctcacgagggacctatgtgtgaccttctatggtctgatccagacgatcgatgtggctggggcatatctcctcggggcgctggatacacttttggccaagacatatcggaacaatttaatcacaccaacaatcttaaacttgtagctcgggctcaccagttggttatggagggatacaactgggcacatgaacaaaaggtggtgaccatattcagcgcacctaattactgttaccggtgtggcaacatggcatccatcctcgaggttgatgattgtaggaatcacacatttattcagtttgagccagctcctaggagaggcgaaccagatgtgacacggagaacacctgactatttcctttgagttatctgccatactatttttggattttgtccaatattgcaatagtgatgctggtcagtaacatttttgttggatctatatgataaccgaccagaaacagtaagaaaatgcggaagctgcatatccgcatttgtcattgcaagaggttctatcagatcatcctacatcccaagctgtcaatagatccgcttgtctacccaagtggtgaattggcacctccctcaggctttggccccatagaccttcactgtttcgaagggcgttgggacgtcagagcttacattttcagcgtaagttgcctcagctgtgtcttctctgtcagctagttttgtggttgtgtgattgtttgttgtaacttctgtgattaaatgacaacagacaagctgatcttgttgcaagaattggaaacaattcaacgaattctgctagctcttccttcgtttctt

SEQ ID NO: 3410 - DNA, 1849 bp, Panicum virgatum
cggccccacatctcctcctgttctactgacactgggccctgcatctgaggtatctcactgacggcttgaccccacaggtagcggggcccgcgccctcccgcccgcttctgtcattccgcacctctccgtcccgttccctctcctctcctcccgcccgccccctgccctcgagctccctcccccgcgcgcgctctcgccggcgacgacctccagccagagtgaggtagatccggggcgctgtcccggctgccggataagtggatggagggctccgcgggcttgcgtggcggcgggggatgcggcggcctggacgcgcagatcgagcagctcatggagtgccgcccgctcccggagacggaggttaaaacattgtgtgagaaggccaaggagatattgatggaggaaagcaatgttcagccagttaaaagcccggtgacaatttgtggtgacattcatggacaattccatgatcttgtagaacttttccggattggcgggaagtgtccagacacaaactatttgtttatgggagattatgtggatcgtggctattactctgttgagaccgtaactcttttggttgcactgaaggtgcggtacccacaacgtattactattcttcgtggaaaccatgagagtagacagatcacacaggtgtatggcttctatgatgaatgcctacgaaaatatggcagtgccaatgtctggaagatcttcaccgatctttttgactattttcctttgacagcattggtggaatcagaaattttttgcctccatggtggtttatctccttccattgagaatctcgatagtgttagaagcttagatcgtgttcaagaggtccctcatgagggacctatgtgtgaccttctatggtctgatccagatgatcgatgtggctggggcatatctcctcgaggtgctggatacacttttggccaggacatatcggaacagtttaatcacaccaacaatcttaaacttgtagcccgggctcatcagttggttatggagggttataactgggcacatgaacaaaaggtagtgaccatattcagtgcacctaattactgttaccggtgtggcaacatggcatccatccttgaggttgatgactgcaggaatcactcatttattcagtttgagccagctccgaggagaggtgaaccagatgtgacacggagaacaccagattatttcctctgagttatttgctgtaccattttgattattgggcaagattgcaatagtggttgctggtcagtaacatttttgttggatccgtatgataaagtaacctgaccagcaatagcaagaaaatgccgctgccttaatagtgtgacaattgatctccattcgtggcttcaagaggtgctatcaacctaccacccaaaccgacgtaagaatctggtggtgaattggcgcctgtgttggctctgttgaccactggctcgacagagatagagcttttgttttagcataagttgcttgggttcttccttgttttgttttgcgttgatgtgcctacaacctcggtgattaattgactacacatgctgatcccctcgttgcaagtattgtgaaggacacgcagctagttcttccgttctttactgctcattatccgatgttacccgttgtacccacacttttttatgtagcaaccaacgtgttatagtccgtttgtttggttctaagtctttgcttcccatattgcttgtatcatcgtatgaactattctgaactagacagtacttgtgacagcatggacatgatctcatgtcagttggtttctctatttcacaatatttgtcccatggggggtaatcttccattgtgtctgaaa

SEQ ID NO: 3411 - DNA, 1451 bp, Zea mays
actacaccctttcctccgtgccgccccacttttctcctcccgcgcccctccgcgagctccctacccctcgcgctcacgccggcgacaagtttccgccagagttaggtagatcaggtgctgcgccggcagccgtggaagggatggaggacctcgcgagttcgcgtggcggcgggggatgcggtggtcttgatgcgcagatcgaacagctcatggagtgccgcccgctcccagagacggaggttaaaacactgtgtgagaaggccaaggagatattaatggaggaaagcaatgttcagccagttaaaagccctgtgacgatttgtggtgatattcatggccaattccatgatcttttagaacttttccggattggtgggaagtgtccagatacaaattatttgtttatgggtgattatgtggatcgtggctattactctgttgagacagtaacgcttttagttgcacttaaggtgcggtacccgcaacgcattacaattcttcgtggaaaccatgaaagtaggcagatcacacaggtgtatggcttctatgatgaatgcctacgaaaatatggcagtgcaaatgtctggaagatcttcactgatctttttgattattttccgttgacagcattggtggaatcagaaattttctgcctccatggtggtttatctccatccattgagaatcttgataacgttcgcagtttagaccgtgtccaagaggtccctcatgagggacctatgtgcgaccttctgtggtctgatccagacgatagatgtggctggggcatatctccacgtggtgctggatacacttttggccaagacatatcggagcagtttaatcacaccaacaatcttaaactcgtagctcgggctcaccagttggttatggagggatacaactgggcacatgaacaaaaggtggtgaccatattcagcgcacctaactactgttaccggtgcggcaacatggcgtccatcctcgaggtcgatgactgcaggaatcacacatttattcagtttgagccagctcctaggagaggtgaaccagacgtgacgcggaggacacctgattatttcctttgagttatctgccaggccatttttggattttgcccaatgttggaatagtgatgctggccagtaacaatttttgttggatctatatggtaacttaaccgaccagcaacagtaagaaaatgtggaacttaaccgaccagcaacagtaagaaaatgtggaagctgcatttgtcattgcaagaggtgctcgctaacttaaccccaagctgtcaaaagatccgcttgtctacccaacccacccagtggtgcctcccttgggctttgggacgtcgagtttacgctttcagcgtagagttgcctcagttctgtcttgtgtgtcagctagttttgtgtttgtgtcttgtgtggttgctcgttgtagcttctgtg

SEQ ID NO: 3412 - DNA, 1198 bp, Oryza sativa
caatctctctcctctctctctctctccagctcgcctccccctcgccggcgacgagctctcccccggctagggttagaccaggtgcccctcttgtctgcggcggaggaggtgggaggaaggatggaggagtccgtgggctcgcgcggcggcggcggcggcggcctggacgcccagatcgagcagctcatggagtgccgcccgctctccgagcccgaggtcaagacgttgtgcgagaaggcgaaggagatattgatggaagaaagcaacgttcagccagttaagagcccagtcacaatttgtggtgatatccatgggcaattccatgatctagtagagctctttcggattggtgggaagtgtccagatacaaattatttgtttatgggagattatgtagatcgtggctactattctgttgagactgttacacttttggttgcactgaaggtgcgctacccacagcggattacaatccttcgtggaaaccatgagagtcggcagatcacacaggtgtatggattctacgacgaatgcctacgaaagtatggaagtgcaaatgtctggaagatcttcaccgatctttttgactattttccattgacagcattggttgaatcagagattttctgcctccatggtggtttatcgccatcaatcgacaatcttgatagtgttcgcagcttagatcgtgttcaagaggtccctcatgagggaccaatgtgtgatcttctatggtctgacccggatgatcgatgcggttggggcatatctcctcgtggtgctggctacacttttggccaggacatatcggagcagtttaaccataccaataatctcaaacttgtagcccgggctcatcaattagttatggaaggatataactgggcgcacgaacaaaaggtcgtgaccatattcagtgcacctaattattgttatcgctgtggcaacatggcatccatcctggaggttgatgactgcaggaatcacacatttattcagtttgaaccagctcctaggagaggtgaaccagatgtgacacggagaacacctgattatttcctttaaattatctgttgtaatttgtattgttttgtttcttttgtttctctaagaccgcaatagtgagtgctggtcagtaaaattttgttggatccctttggtaactaaactggccagcgatagcatgagaatgccgatg

SEQ ID NO: 3413 - DNA, 1481 bp, Oryza sativa
cctccccctcgcgccccccaaccgcatctcaatctctctctcctctctccagctcgcctccctctcgccggcgacgagctctcccccggctagggctagatcaggtgcccctcttgtctgcggcggaggaggtgggaggaaggatggaggagtccgtgggctcgcgcggcggcggcggcggcggcctggacgcccagatcgagcagctcatggagtgccgcccgctctccgagaccgaggtcaagacgttgtgcgagaaggcgaaggagatattgatggaagaaagcaacgttcagccagttaagagcccagtcacaatttgtggtgatatccatgggcaattccatgatctagtagagctctttcggattggtgggaagtgtccagatacaaattatttgtttatgggagattatgtagatcgtggctactattctgttgagactgttacacttttggttgcactgaaggtgcgctacccacagcggattacaatccttcgtggaaaccatgagagtcggcagatcacacaggtgtatggattctacgacgaatgcctacgaaagtatggaagtgcaaatgtctggaagatcttcaccgatctttttgactattttccattgacagcattggttgaatcagagattttctgcctccatggtggtttatcgccatcaatcgacaatcttgatagtgttcgcagcttagatcgtgttcaagaggtccctcatgagggaccaatgtgtgatcttctatggtctgacccggatgatcgatgcggttggggcatatctcctcgtggtgctggctacacttttggccaggacatatcggagcagtttaaccatagcaataatctcaaacttgtagcccgggctcatcaattagttatggaaggatataactgggcgcacgaacaaaaggtcgtgaccatattcagtgcacctaattattgttatcgctgtggcaacatggcatccatcctggaggttgatgactgcaggaatcacacatttattcagtttgaaccagctcctaggagaggtgaaccagatgtgacacggagaacacctgattatttcctttaaattatctgttgtaatttgtattgttttgtttcttttgtttctctaagaccgcaatagtgagtgctggtcagtaaaattttgttggatccctttggtaactaaactggccagcgatagcatgagaatgccgatgcccaaaaaaatgtgaaacttatgcccctcattgatcattgtgagaatggtgctgtcatccaggatgcaacgcattgcatacgattcagtatcttacccacccttcccaagccatgtttaggtggcattgtgttgacagatatcaaaattccattttggtataagctgcttgagttatgtattggctggttttgtaactgatgtgcttggaccttctatcattaatgacagacaagctgatctctcggttgcaaatactat

SEQ ID NO: 3414 - DNA, 1359 bp, Festuca arundinacea
cagatcgagcagctcatgcagtgccgcccgctccccgagcaagaggtcaaagcactatgcgagaaggctaaggagatattgatggaggaaagcaatgtccagccagtcaaaagcccagtgacaatttgtggtgacattcacggacaattccatgaccttgttgagcttttccggattggcggcaagtgtccagataccaattatttgttcatgggggactatgtagatcgtggctactactctgttgagactgtttctctcttggtagcactgaaggtgcgccacccacaccggattacaatccttcgtggaaaccatgagagtcgacagatcacacaggtgtatggattctatgatgaatgcttacgaaagtatggcaatgcaagtgtatggaagatattcacagatctttttgattattttccattgacagcgctggtggaatctgaaattttctgcctccatggtggtttgtctccatcaattgagaatcttgatagtgtgcgtagcttagatcgtgtccaagaggttccacacgaggggcctatgtgcgatctcctatggtctgatccagacgatcgatgtggttggggcatatctcctcgtggtgctggctacacttttggacaggacatatccgaacaattcaatcacaccaacaatctcaaacttgtagctcgggctcatcagttagttatggagggatataactgggctcatgaacaaaaggttgttaccatattcagtgctccaaactattgttacagatgtggcaacatggcatccattctggaagttgatgactgcaacagccactcatttatccagtttgagccagccccgaggagaggtgagccagatgtgacccggagaacgcctgattacttcctttgagttaattggtggcaccatttctcagcttgtattgcgataatgcgaaccaatcagtgagattctgctggatccaaatctgcacatgagccaacaaacaataacaaaggccctatgtaaaacttgacccccattggtcaatccagaagaggctgctatcctgaaagaaaacaagcttcatgcagctacacctggtgaaaaaaaggccatcatacatcctctcttctcacacgggtatttcatagaggcatgtcattacattcgcaaagactgaactcctatatgtagcttaagcttgtattactaggcttgtaatctgtattgtcaatgacaaggatacagttggttaaatcatattgcaacttttatggagattgatctccaagcttttgtctctgcaagtgcacaatgagaaatacaagatggaggaaaagaaaatattttcttttggaaaaaaaaaaaaaaaaa

SEQ ID NO: 3415 - DNA, 1610 bp, Avena sativa
attgatttaatccggtcccgacacgcgctccctgttccctggtaggtcgcctcagagtcaccggccggccaccgcgacgctccacgcctccaccgcccgtgcggcgaggcaactctcggaaggaaaacagaaaccgcaacgcgaccgcctatcctactgccgtcttgcacctttcgcgtcttccttctcgcggtcgcccgtccggtagatctaggattagggttcgtggtgccggtgttcaggagggcgacggcgaggggggaggagtccacgcgcgcgaggagaggatggggagcccccacggcggactcgacgagcagatcgagcagctcatgcagtgcaagcccctcgccgagcccgaggtgcgagcactgtgcgagaaagctaaagagatattgatggaggaaagcaatgttcagcctgtgagaagtcctgttacaatatgtggtgatattcatggtcagtttcatgatcttgcagaactattccgaattggtggaaagtgccctgacacaaattacctatttatgggagattatgtggaccgtggttactattctgttgaaactgtatcgctcttggtagccttaaaagttcgttatccacatcgaattacgattcttagaggaaaccatgagagccggcagatcactcaagtttatggattttatgatgagtgcttgcggaagtatgggaatgctaatgtatggaaaacctttactgatctctttgactatttccccttgacagcattggttgagtcggaaatattttgcctgcatggtggactatcgccatccatcgagacacttgatagtgttcgtagctttgatcgtgtccaagaagttcctcatgaggggcccatgtgtgatcttctatggtctgatcctgacgatcgatgtgggtggggcatttcaccacgtggcgcaggatatacgtttggccaggatatatcagaacaatttaaccattccaataaccttaagctgatagcaagagctcatcagttagttatggagggatttaactgggcacatgaacaaaaggttgtgacaatattcagcgcccccaattattgttaccgctgcggtaacatggcctcaatcttggaggtggatgattgcagggagcataccttcatccagtttgagccagctccgaggagaggagagcctgacgtgactcgaagaacacccgactatttcttgtaatgcagcttagggtgctatgcgagcagatatttgatactccctccgactcatattacttatcggggaagtggatgcatctatacatgttatagtgctagatacatctaatctagtgacaattaatatggattggagggagtagttagatgtgcggtgggtgggggctgtgatactccttttgttttgatctgttgcattcacacctgacttttatctgttcattttgggcttaggggtgtggtgctgttcctggaaaatgcctaaacaaacaccaaatttattttggctttgttagatgagtaacatgcagcaattattctgcatccttttcttgtcaactttttagaggcaactagcctgtgcttatacagatatataataatgacaatcccaatgcaa

SEQ ID NO: 3416 - DNA, 1105 bp, Manihot esculenta
ttattccattttttttttctctctctataggaattcgaagagagtgaattctagggtttaatttatttttcttcgggagaaataatctaggtttaggtcagacaatataacgaaaaatcgaagggatctcgatctctaattaaataaagaagcaacaagaagatgagcctggattcggtcccttcgaacacacatggaaaccttgatgagcagattaatcagctcatgcagtgcaagcccttatctgagcacgaggtaagaacgttatgtgaaaaggctaaggagattttgatggaagaaagcaatgttcagcctgttaaaagtcctgttacaatatgtggtgatatccatggtcaattccatgatcttgcggagctttttcgaattggaggaaagtgtccagatacaaattatttgttcatgggagactatgttgatcgtggctattactcagttgaaactgtgactcttttggtagctctgaaggtgcgctatcctcagcgaattactattctacggggaaatcatgaaagtcgtcagattactcaagtttatgggttttacgatgaatgcctacggaaatatggcaatgccaatgtttggaagacatttacagatttgtttgactattttccactgacggcattggttgagtcagagatattttgtctccatggtggattatccccttccattgaaacccttgataatatacgtaattttgatcgtgttcaagaagttccccatgagggtcccatgtgtgatcttttgtggtctgatcctgatgaccgctgtggctggggtatctcaccaaggggtgctggatatacttttggacaagacatatctgagcaatttaatcatacaaacaacttaaagctgattgccagagctcaccagctggtcatggaagggtataactggggccatgagcaaaaggtggttactatatttagtgcgcctaactattgttatcgatgtggtaacatggcatcaatattggaagttgatgattgcaagggtcacacattcattcagtttgaacctgctccaaggagaggagagccggatgtcacccgaagaacacctgattacttcctatgat

SEQ ID NO: 3417 - DNA, 1589 bp, Catharanthus roseus
aaatacgaatcacacactctctgaccggctttgattctatcctccgaatcggagattttgatctgttttcagaagttttggtgttcattccctagttccgatcccactttattcagagaaggagatacagtgtggtgacaagaggaacagccggaagatgagtgcggatctggtggcgtcgagcacatatggaaatctggatgagcagatttcacaactcatgcagtgtaaacctttgtccgagacggaggttagagcattatgcgagaaggccaaggagatactgatggaggaaagcaacgtccagcctgtaagaagcccagtgaccatctgtggtgatattcatgggcaatttcatgatttggctgaactttttcgcattggagggaagtgtcctgatacaaattatcttttcatgggagattatgtggatcgtggatattactcggtggaaactgtaacactcttagtggctctgaaggtgcggtacccccaacgaatcaccattcttcgaggaaatcatgagagtcgtcagattacccaggtttatgggttttatgatgagtgtctgcgcaagtatggcaatgctaatgtctggaagaccttcacagacctttttgattattttccactgacagcattggttgaatctgaaatcttctgtttgcatggtggattatcaccatctattgaaacacttgataacataagaaattttgatcgtgttcaagaagttccccatgaaggacctatgtgtgatctcttgtggtccgatccagatgaccgatgtggttggggtatttctcctcgtggtgccgggtacacatttggccaggatatatctgagcaatttaaccataccaacaacttgaagttgattgctagggctcatcagctggttatggagggctataactggagccatgagcaaaaggtcgttactattttcagtgcaccaaattactgttatcgttgtggaaacatggcatctatcttggaagttgatgactgcaggcaacacacatttatccagtttgagccagctccaagaaggggagagcctgatgtgactcggagaacgcctgattatttcctgtaaagcagttgagctagctgattaattgtggtggtctagcggattgtttgtctaaggtggccggacacgtctgtcttcggaattgaaacttttttagcagcaaactactaggattctcttctagtgggtggtgtcacaaggggaccaagaggcgtgtaaaatactagccagttgggaaggtccgattgattctcgtaagttataattctaaccaagaagttggggaagctaggcactcgtcagataatactgtattgtatcatttcatgtagagaactcacaatctcgtttgtagctgtttgttttcatttagtaattttttgattgttgtattcgtctttatatttttcgctttatatatacttaaaaatactttacattctaaatgggccactgtagatgcaaagatttatttttggctgcttgtttaaaattttctggtttttctcttggagctagtccttgccattataatgatatatgcctatattcg

SEQ ID NO: 3418 - DNA, 1512 bp, Quercus alba
agacacaaaaaaaaagcagtgcctctctctctctctctctagggcgtcgttttctctctccagaaatttcttgaagaagaagaagaaggaagaagaagaaggaggaggaggaggtgaaggcctcggaagaacgaaagctatggaatcggtcccttcgaacacgcatggaggcctcgacgagcagatttcgcagctcatgcagtgcaagcccttgtccgaacaagaggtaagggtgctgtgtgataaggctaaggagatattaatggaagaaagcaatgtccagcctgttaaaagtcctgttacaatatgtggcgatattcacgggcagttccatgatcttgcagagctttttcgcattggagggaagtgtccagatacaaattacttgttcatgggagattatgttgaccgtggctactattcagttgaaactgtaactctcctggtggccttgaaagtgcgttattctcaacggattactatactgagaggaaatcatgaaagccgtcagattactcaagtttatgggttctatgatgagtgccttcggaagtatggtaatgccaatgtgtggaagatctttacagatttgtttgactattttccactgacagcattggttgaatctgaaatattttgtctgcatggtggattgtccccttccattgaaacccttgataacattcgtaactttgaccgtgttcaagaagttcctcatgaggggcccatgtgtgatcttttatggtctgacccagatgatcgctgtggttggggtatctcacccaggggtgctggatacacctttggccaggacatatctgagcagtttaaccatactaataacttaaagctgattgctagagctcatcagctggttatggaaggatataactggggtcacgaacaaaaagtggtgacgattttcagtgcaccgaattattgttatcgctgtgggaacatggcatccatcctggaagttgatgactgcaaggcccacacattcattcagtttgagcctgctccaaggaggggagagccagatgtaacccggagaacacccgattacttcctatgatgcagctgtcaattagttgctgaatttgcagccgctagtgcttactagctggtttacgtgttgagggcttctattcaaattttaaagtttatgactttgctatagtggtggttgggtggtgaaaagcatgtaaactgggcagggggaacttcaattacttatgctttcagttctcagagaggaagcagcagatctggcaatgatgtagcagcctatgtaccatttcctgcaaacgatgtggcatcttttatttcttagcactgatttccctttttttttgtcctcttttctgtaggatggtggcttttggttgggggtctgtagaggaatgatgagtaaacttttcttataatgggtgcttttataattttttgatgttagtctgaattagattttatttttattattattatttttgtaggcgcttttatttttta

SEQ ID NO: 3419 - DNA, 1638 bp, Populus trichocarpa
gccattggtatctcgaccatagcttcttcttttccctctctctctcatgagtcattttctctgtttctttctctctctagaaaaagaaaaattcaaagagaaaattgaaatctagggtttcgattttttgtaattaatttaggagatttaatctctggatcccaaattggagagaaattagtgattacacaaaaacgattattaaaaaatgagcttggactcggtggcttcaaacacacatggaaaccttgatgagcaaattagtcagcttatgcagtgcaagcccttatcagaacaagaggtaagggcattatgtgagaaagctaaggagatattgatggatgaaagtaacgttcagcctgttaaaagccctgttacaatctgtggtgatattcatggtcaatttcatgatctagctgagctttttcgcattggcgggaagtgtccagatacaaattacttgttcatgggagattatgttgaccgtggctattattcagtggaaactgtaacactcctggttgccttgaaagtgcggtatcctcaacggattacaattctaaggggaaatcacgaaagtcgtcagattactcaagtttatggtttctatgatgaatgcctacggaagtacggcaatgctaatgtttggaagatctttacagacctgtttgattattttccacttacagcattggttgagtcggaaatattttgcctccatggtggattgtcaccctccattgaaacccttgataacattcgtaattttgaccgtgttcaagaagttccccatgagggtcccatgtgtgatctgttgtggtctgaccctgatgatcgatgtggttggggcatctcacctaggggtgctggatataccttcggtcaagacatatctgagcaatttaatcatacaaacaacttaaagctgattgcaagagctcaccagctggttatggaggggtataactggggccacgaacaaaaggtggtcactatcttcagtgcacccaattattgctatcgctgtggaaacatggcatctatcttggaagttgatgactgcaagggccacacattcattcagtttgagcctgctccaaggaggggtgagccagatgtgacccggagaacaccagattacttcctatgattcaagctggttatgagatgctgaatcctcctagcgagcgcttcctggctggtttacttattgagggctatttccaagtataaatttgctatgtgggcaggtggcaagaaagcatgtataatgggcaagtggggcttccttgattcaattggcttgctgattatgcttgagtttccataagagggagcaatggagctgcaacagaatagccgcaaatgtaccatttccagcaaacaatgtggcttctttttattccttgattttgattttgttctcttattccttttttttcccttttgtagaaggatggttgtttcagggttggggatgtgtagagagacaatgagttgacttgtaatggttgctttttatattttatctccattcacgcagttctaatcaagtgttttccagtaggtgcctccttaacatctctagataatattcacttgcactttgcatccgatagtcgagccatgaattggtct

SEQ ID NO: 3420 - DNA, 1982 bp, Amborella trichopoda
ctctctcatctaagtgtattgttattatttataaaagcgcgatcgaaacaccgaacgagggtggtctcgggcgcaccaccacctccaccaccacctcctcaactcttcctccccaaaaccagacacgcatagagtagagagagagagggaagagagagagagaatttttggaggggagagggcatcacaggagtaagatgagcgtggatccggtgtccaactcccatggcaacctcgacgcccagatttcgcagctcatgcagtgcaagcctctctcagagcaagaggtaagagtgttatgtgaaaaggccaaggagatattgatggaagaaagcaatgtccagccagtgaaaagcccggtaactatatgcggtgacattcatggccagtttcatgatcttgcagaactttttcgtattggagggaagtgtccagatacaaattacctttttatgggcgattatgtggatcgtgggtattattcagtggagactgtaacgttattagtggcccttaaggtgcgttattctcatcggatcactatacttagagggaatcatgagagtcgccagattactcaagtttatggattttatgatgaatgcctaaggaagtatgggaatgcaaatgtctggaagattttcactgacctttttgactacttccctttaacagccctggttgaatctgagatattttgcttgcacggtggtttatcgccgtccattgagacccttgataacataaggaactttgatcgtgttcaagaagtgccccatgaaggccccatgtgtgatctcttatggtctgatcccgatgatcgctgtgggtggggcatctctcctcgtggagctggctatacctttggccaggatatctctgagcaattcaatcataccaacaacctgaagctgatcgccagagctcatcagcttgttatggaagggttcaattggggccatgaacaaaaggttgtaaccatatttagtgcaccaaattattgctaccgttgtgggaacatggcatccatcttggaagttgacgactgcaaggggcatacattcattcagtttgaaccagctccaaggcgtggagagccagatgtgacccggagaacgccggattacttcttatgaagaagccaggttaagggatgttggtcttgctgattttctcatagcaagtgttgttcgatgctggggaattcaggtaatatttgagataggtcatctaagtattggatttacatttatgaattctcgagccatttgttgggctttttgggtggggcgggagaaagcatgtaacatgggcagatttttagggaggctcctccatttatttgcagtcaaaactttagtcctctgggtggggagctgctgagagtaaggggtgcatcagcatgtatcatttctatgaaacttacttcttttgtgtttgtagagggaggaattatatttttttgttaaatttctgtcttctttctcttgtttctattaacaggctaattcgagtgtttatttaagtgatagcctttctcttgccttccgattcttcctgtaaccgtagattacttttaatgcttttctcatcttcaacacagtcagctgtatgtgcattggcaatattattgggattttcttaattctttggattatattaatggttaatttccgggacctgaacattgcgttttgcaaaggcttgataataaatattattatcattattttttggtagttcagctgtaggattcaaactgtggatgtaattttgcaagtccttaaccaatcgggcccaaggctgaatccttgtaagtttagatgtttgtttaatacgctgttttttttttttttttcatttgaatcctttttatgtgatcattcttggacaatgcttcatggttcatgcttgtaatggatgggacccttttagagaaataaggctgatgccacaatataatgtattttactattttgcag

SEQ ID NO: 3421 - DNA, 1651 bp, Fragaria vesca
accaccaccgtccctcccccttttttctctctctatttttcgaagaagcaaaaaaaagaagaagaagaagaaaagagggaagagcaagaaatctagggttttctggatctctccagaattagggctttctctccgatccagttagacggtgtcgttttggggggaaaagacgacgagaacatggattcggtcccttccaactcccatggcaacctcgacgagcagattgctcagctcatgcagtgcaagcctttgtccgaacaagaggtaagggggctctgtgagaaggctaaggagatattgatggaagaaagcaatgttcagcctgtgaaaagcccagtgactatttgtggtgatattcacggacaatttcatgatcttgccgagcttttccgtattggaggaaagtgtccagataccaattatttgtttatgggagattatgtggatcgtggctattactctgtcgaaaccgtaacacttttggtggccttgaaggttcgttactctcaacgtataactatccttagagggaatcatgaaagtcgtcagattactcaagtttatggtttttatgacgagtgcttacggaagtatgggaatgccaatgtttggaagaccttcacagatttatttgactattttccgttgacagccttggttgaatctgaaatcttctgcttgcatggtggactgtctccatcgattgagactctagataacatacgtaattttgaccgtgttcaagaggttcctcatgaaggtcccatgtgtgatcttctttggtctgacccggatgatcgctgtggctggggaatctctcccagaggtgctggatatacttttggccaggacatatctgagcagttcaatcataccaataacttaaagttgattgctagagcacaccagctggtcatggaaggttacaactggggtcatgaacaaaaagttgtcaccatattcagtgcacccaactactgctatcgctgtggaaatatggcatccatcctggaagtcgatgactgcaaaggtcacacattcattcagtttgagccagctccaaggaggggagagccagacgttacccgaagaacacctgattatttcctataattggatcatgaaatcagttgctgaattacctgctgctgcctcctgttagaaggtttatgtgttgaaggttctactaatttaagactataacttcacaacagtggtggtcaattggagataaacttgtaagattggaaggtgaggcttccttgaattgtgttcaagtttcagcaaaaggaagtagcagagggtggcgacactgttgcagcatatgtatcatttccagcaaacaatgtggcatcttctgtttctgatttttcattcctttcctttttctacttattttttctgtattaggatgtctttttgggggtctgtagaggaacaatgagctcacttcatataatgggtgcttttataattttcccctgggtacgaatgaatgctacatgttatccaataggttcattttattttgattacttcatagttcagttgagtagcatctttccccttttattttctccttggaaccatattctatatcagtgttctttatcccctttctacgaagatggttgcttgttttctgtag

SEQ ID NO: 3422 - DNA, 1521 bp, Oryza sativa
ttttgcccccctcctctcctccgcctcctccacacacgagcgcgtcccccgacgccgcgccgagatctagggttgggcgcgcgcgacgccccccccccgcggcgaggaggatgagcagcccccatggcggcctcgacgaccagatcgagcgcctcatgcagtgcaagcccctccccgagcccgaggtcagagcactttgcgagaaggcaaaagagatattgatggaggagagcaacgttcaacctgtaaagagtcctgttacaatatgtggtgatattcatgggcagtttcatgaccttgcagaactgttccgaatcggtggaaagtgcccagatacaaactacttgtttatgggagattacgtggatcgtggttattattctgttgaaactgtcacgcttttggtggctttaaaggttcgttatcctcagcgaattactattctcagaggaaaccacgaaagtcgacagatcactcaagtttatggattctatgacgagtgcttaaggaagtacgggaatgcaaatgtgtggaaaacttttacagatctcttcgattacttccccttgacagcattggttgagtcagaaatattttgcctgcatggtggattatcgccatccattgagacacttgataacatacgtaacttcgatcgtgtccaagaagttccccatgaagggcccatgtgtgatcttctgtggtctgatccagacgatcgatgtggttggggtatttctcctcgaggtgctggatacaccttcgggcaggatatatcagagcagttcaaccataccaataatttaagacttattgctagagctcaccagttggtcatggagggattcaattgggctcatgagcaaaaagttgttaccatatttagtgcacctaattattgctatcgctgtgggaacatggcatcaatcttggaagttgatgattgcagggagcatacattcatccagtttgagccagccccaagaaggggagagccagatgtaactcgtagaacacctgactatttcctgtgatgtaaaagtggtggactgtctctgcagcaaatgtttgatagctaggtgaagttccctggttgcagatatttttttcccctcgaatctcctgtgtgttattcttactacctttgcccgtggcgcttggctatcgcgagctgctttgctgcatcatgattcaagtgtatacctacagctgggaggattcatcgtgttctcacttatctctaattggctgatgcttggcttgggggctgcagtggtgactcgaagcatcaagtagcaaatttgtattatgaaaggaaaactattctctttgtattcattttgttcgcctttcttccccacaaatttcacctaattttcttttttcttttttcatgatccttgtagagatgaacaatgtagttgtatggctccctgttgagccggtaggtctttctgagtacatcttgatttgccgtacataattgcttgaaaaacaagtattagaattctttgtgaccaa

SEQ ID NO: 3423 - DNA, 1694 bp, Rosmarinus officinalis
cggccgggggaatagtactaaaactaaatttgataatattcgaaatttcataacatctggacatgaacagtttaaaataaaatagcagatagccaagatttgatcgtctctttcctcttccctctcttcatcgttaccaccaccatcccctcctctctccctctccatgtagatacaattttttacagtaattattatcctaggatcctcaccatttccgacacaaaaaggtgacgtcgtatcggacgtcggcggatctgataccaatcagaaattgaagcaagatgagtgcggatctggtggctccgaccgcccatgggaatctggacgaacagatttctcagcttatgcagtgcaaacccttgtctgagcccgaggttagaacattatgtgagaaggctaaggagatactcatgcaggaaagcaatgtccagcctgtaaaaagtcctgtgacaatatgtggtgatattcatggacaatttcatgaccttgcagaactattccgcattggagggaagtgtccagacacaaactatctatttatgggagattatgttgatcgtggttactattcagttgaaacagttacactactagtggcgttgaaagtgcgctatcctcaacgtatcacaattcttagaggaaatcatgaaagtagacagattacacaagtgtatggattttatgatgaatgtctcaggaagtatgggagtgcgaatgtttggaagacattcacggacctatttgactattttcctttgaccgctttggtcgaatcagaaatcttttgtctgcatggtggattatccccatccattgaaacccttgataacattagaaactttgatcgtgttcaagaagttccacatgaaggtcccatgtgtgatctgttgtggtctgatcctgatgatcgttgtggttggggcatatccccacgtggtgctggatatacttttggccaggatatctcggagcaattcaaccacacaaacaatttaaagctaattgctagagctcatcaactggtcatggagggatataactgggcacatgaacaaaaagttgtcactatttttagtgcacctaattattgctaccgctgtggaaatatggcatccattttggaagttgatgattgcagggagcatacgtttatccagtttgagccagctccgaggagaggagaacctgatgtaactcggaggacacctgactatttcttgtagctctgatacttgtaaactcttcgtctatatgatgcgttgatttggggtgcttgcgtggtcattgcctgagattcaaggttcgagtaattcagcctatttgaaggtggtgcaagtggaaaagatgcatgcaagatgagaggctcctactcttaaaagctatattctaacctatcttagggtctagttgtcgggtagttggaataggggatgcttctgtgtatcgtgttctataattttttgatgtgatgttccccatttctactcttaatttgttttctatttgtcctttgaatccctgccatttggaggacaggtgtgtttgtggaattaatgcagaatttctgtcaatttaatctttgtcgttttgttggttgaatctccaagctattcaattcttgatatcgaccattttgtctagtaattggtatatttatcaactaaatgaaattcctaagtaggaattctgtg

SEQ ID NO: 3424 - DNA, 1159 bp, Manihot esculenta
ctctctttttctttctctctctttctccccacacactctctctctaattattttctctctctctctctctctattgtgtgtgggaattcgaagagagtgaattctagggtttcagttctttttcttcgggagaaataatctagggttatcttatacaataaaagcaaaactcgaagggatctcgactctgattagacaaaagaagcaacaagaagatgagcttggatacggtccattcgaacactcatgggaaccttgacgagcagattaatcagctcatgcagtgcaagcccttatctgagccagacgtaaggactttgtgtgaaaaggcgaaggagattttgatggaagaaagcaatgtccagcctgttaaaagtcctgttacaatatgtggtgatatacatggtcagttccatgatcttgctgaactttttcgaattggaggaaagtgtccagatacaaattatttgttcatgggagattatgttgaccgtggctattactctgtcgaaactgtaacgcttttggtagctctcaaggtgcggtatcctcaacgaattaccattctacgaggaaatcatgaaagtcgtcagattactcaggtttatgggttctatgatgaatgcctacggaagtatggcaatgctaatgtttggaaaacctttacagatttgtttgactattttccactgacagcattggttgaatcagagatattttgtctccatggtggattatcaccatccattgaaacacttgacaatatacgtaattttgatcgtgttcaagaagttccccatgagggtcccatgtgtgatcttttgtggtccgatcctgatgatcgatgtggctgggggatctcaccaagaggtgctggatatacatttggccaagacatttctgaacaatttaaccatacaaacaacttaaagctgattgctagagctcaccagctggtcatggaaggatataactggggtcatgaacaaaaggtggttactatatttagtgcacctaactattgttatcgttgtggaaacatggcttccattttggaagttgatgactgcaagggtcacacattcattcagtttgagcctgctccaagaaggggagagccagatgtgacccgtagaacacctgattacttcctatgatt

SEQ ID NO: 3425 - DNA, 1310 bp, Castanea mollissima
ctatggaatcggtcccttcgaacacacatggaagcctcgacgagcagatttcgcagctcatgcagtgcaagcccttgtccgaacaagaggtaagggtgctgtgtgataaggctaaggagatattaatggaagaaagcaatgtccagcctgttaaaagtcctgttacaatatgtggcgatattcacgggcagttccatgatcttgcagagctatttcgcattggagggaagtgtccagatacaaattacttgttcatgggagattatgttgaccgtggctactattcagttgaaactgtaactctcctggtggccttgaaagtgcgttattctcaacggattactattctgagaggaaatcatgaaagccgtcagattactcaagtttatgggttctatgatgagtgccttcggaagtatggtaatgccaatgtgtggaagatctttacagatttatttgactattttccactgacagcattggttgaatctgaaatattttgtctgcatggtggcttgtccccttccattgaaacccttgataacattcgtaactttgaccgtgttcaagaagttcctcatgaggggcccatgtgtgatcttttatggtctgacccagatgatcgctgcggttggggtatctcaccaaggggtgctggatacacctttggccaggacatatctgagcagtttaaccatactaataacttaaagctgattgctagagctcatcagctggttatggaaggatataactggggtcacgaacaaaaagtggtgaccattttcagtgcaccaaattattgttatcgctgtgggaacatggcatccatcctggaagttgatgactgcaaggctcacacattcattcagtttgagcctgctccaaggaggggagagccagatgtaacccggagaacacccgattacttcctatgatgcagctgtcaattagttgctgaatttgcattagctagtgcttactagctggtttacatgttgagggcttctattcaaattttaaagtttataactttgctatagcggtggttgggtggtgaaaagcatgtaaactgggcaggtggaacttcgattacttatgctttcagttctcagagaggaagtagcagatctggcaacgatgtagcagcttatgtaccatttcctgcgaacgatgtggcatcttttatttcttagcactgatttccttttttttttgtcctcttttctgtaggatggtggcttttggttgggggtctgtagaggaatgatgagcaaacttttcttataatgggtgcttttataattttt

SEQ ID NO: 3426 - DNA, 1671 bp, Gossypium hirsutum
gtgagattcgcacaaagccaactctcccggttaccactgttactttcagtacaataaaattagtttagtagtagaatgagccaccaaaaataccagcccacgcgaatcctggagtcgtctaattcacggtcacatcaaaaccctccatcacacctatcatttccattatgatggattcgttatttccactcaccgttctcgaccccgtccaaacagtttgtaaatttgtaaactcgattattattagagaggaaaaaaagtacgaaaactaaatttgttaacagaaaaagaaaactagaagtctctctcccctcgctgagcatccaccgcttctcagaaataattgtaaagggtttcctttttcccgtcaaattcaaaagtattagtttaggaaattttggtaatctagggttaagagtaaaacagaaaaaagaaagatggagtcttctgtgggttcgaactcgcatgggaacctggacgaacagatatcccagctgatgcagtgcaagcctttatcggagcaggaggttagggcattatgtgacaaggctaaggagatactgatggacgaaagcaatgttcagcctgtcaaaagccctgttacaatatgcggtgatattcatgggcagtttcatgatcttgcagagctttttcgaattggagggaagtgtccagatacaaattacttgttcatgggagattatgttgatcgtggttactattcagttgaaactgtaacactcttggtagccctcaaagtgcgttaccctcaacggataacaattctcaggggaaatcatgagagccgtcagattactcaagtgtatggcttttatgatgaatgcttaaggaagtacggaagtgctaatgtttggaagatctttactgatctgtttgactattttccgctaacggcattggttgaatctgaaattttctgtctccatggtggattgtcgccatccattgaaaccttggataacatacgtaatttcgatcgtgtccaagaagtccctcatgagggtcccatgtgtgatctattgtggtctgatccggatgatcgttgtggttggggtatttctccaaggggtgctggatataccttcggccaagacatatctgagcaatttaaccatacaaacaatttgaagcttattgctagggctcatcagttggtaatggaaggatacaattggggtcatgaacaaaaggttgttactatatttagcgcacccaattattgctatcggtgtggaaacatggcctccatcctggaagttgatgactgcaagggtcatacgtttattcagtttgagccagctcctaggagaggagagccagatgtaacccggaggacacctgattacttcctatagagcacactaactttgcgttgttgaatctcttgtggcctgtgcccgtcaatgggtttgcgctgagggcttttgcgaaatttaagatgcgatttgtttggcaatggcggcaagcttgtacatggctagtgagtgacgctgcttccttggtgagggttggttgggttgtttccttgaattgagttttggttgagtttacgcgaggcagaaaagctgggcaactctatagggccatatatatatgtaccatttccagctgactgacagacaatatggcatttactttccttttaatttt

SEQ ID NO: 3427 - DNA, 1031 bp, Echinochloa colona
gcgcgcgcccccgcccagatctagggttcctcccgcggccaacatgagcagcccccatggcggcctcgacgaccagatcgagcggctcatgcagtgcaagccgctccccgagcccgaggtcagagctctgtgtgagaaggcaaaggagattctgatggaggagagcaatgttcagcctgtaaagagtcctgttacaatttgtggtgatattcatggacagtttcatgatcttgctgaactcttccgaattggtggaaagtgtccagatacaaactacttgtttatgggagattatgttgaccgtggctactattctgttgaaactgtcacgctgttggtggctttaaaagttcgctatcctcagaggatcaccattctcaggggaaaccatgaaagccgacagatcactcaagtttatggattctatgatgagtgcttaaggaagtatggaaatgcaaacgtctggaaaaccttcacggacctatttgattacttccccttgacggcattggttgagtcagaaatattttgcttgcatggtggattatcaccatccatcgagacccttgacaatatccgcaacttcgatcgcgttcaagaagtacctcatgaaggtccaatgtgtgatcttctgtggtctgatccagacgatcgatgtggttggggtatttctccacgtggtgctggatataccttcggacaggatatatcagagcagttcaaccataccaataacttaaggcttattgctagagctcaccaattggtcatggagggattcaattgggctcatgagcaaaaagttgtgaccatatttagcgcacctaattattgctatcgctgtgggaacatggcatcaatcttggaagtggatgattgcagggagcatactttcattcagtttgagccagccccaagaaggggagagccagatgtaactcgtaggacacctgactatttcctgtgattcaaaatgatgtggatctgcagcaaaggtttgatagataggtgaagtttactggttgcagata

SEQ ID NO: 3428 - DNA, 1913 bp, Gossypium raimondii
tcccggttgccactgttactctcagtacaataaaattaccattagtttagtagtagaaggagccaacaaaaataccagcccacgcgaatcctggaatcgtctaattcacggtcatatcaaaaccctccatcacacctatcttttccattacgatggattcgttatttccactcaccgttctcgaccccgtccaaacaatttgtaaattgtaaactcgattattattagagagaaaaaaaagtaagaaaactaaatttgttaactgaaaaagaaaactagaaatctctctcccctcgctgagcatccaccgcttctcagaaataattgtaaagggtttcctttttcctgtcaaattcaaaagtattagtttaggaaattttggtaatctagggttaagagtaaaacagaaaaaagaaagatggagtcttctgtgggttcgaactcgcatgggaacctggacgaacagatatcgcagctgatgcagtgcaagcctttatcggagcaggaggttagggcattatgtgacaaggctaaggagatactgatggacgaaagcaatgttcagcctgtcaaaagccctgttacaatatgcggtgatattcatgggcagtttcatgatcttgcagagctttttcgaattggagggaagtgtccagatacaaattacttgttcatgggagattatgttgatcgtggttactattcagttgaaactgtaacactcttggtagccctcaaagtgcgttaccctcaacggataacaattctcaggggaaatcatgagagccgtcagattactcaagtgtatggcttttatgatgaatgcttaaggaagtacggaagtgctaatgtttggaagatctttactgatctgtttgactattttccgctaacggcattggttgaatctgaaattttctgtctccatggtggattgtcgccatccattgaaaccttggataacatacgtaatttcgatcgtgtccaagaagtccctcatgagggtcccatgtgtgatctattgtggtctgatccggatgatcgttgtggttggggtatttctccaaggggtgctggatataccttcggccaagacatatctgagcaatttaaccatacaaacaatttgaagcttattgctagggctcatcagttggtaatggaaggatacaattggggtcatgaacaaaaggttgttactatatttagcgcacccaattattgctatcgatgtggaaacatggcctccatcctggaagttgatgactgcaagggtcatacgtttattcagtttgagccagctcctaggagaggagagccagatgtaacccggaggacacctgattacttcctatagagcacactaactttgcgttgttgaatctcttgtggcctgtgcccgtcaatgggtttgcgctgagggcttttgcgaaatttaagatgcgatttgtttggcaatggcggcaagcttgtacatggctagtgagtgacgctgcttccttggtgagggttggttgggttgtttccttgaattgagttttggttggtttacgcgaggcagaaaagctgggcaactctatagggccatatatatatgtaccatttccagctgactgacagacaatatggcatttactttccttttaatttttgtttttaaaagaagggctgtttgaggattggggttggggatctgtagagatactgacaacattttccttgtatgtttgtgaatgactttgtggggctcaagttgttcaaaattccaaatgtgaatgactaattttattggcaacgtacccctatgtataccgagaagcttcacttttgttttcagttaaaattttgagatatcttttggccgtgtcggtatgaattaccgttttggctctgttacacttgaagggtatttg

SEQ ID NO: 3429 - DNA, 1276 bp, Leymus cinereus x Leymus triticoides
ggacgggggagcggagacgtgcggggggaggggtccccgcgtgcctggtgggcgtaggggaggatggggaatccgcgtggcggcctcgacgagcagatcgagcagctcctgcagtgcaagcccctcgtcgagcccgagttgaaagcactgtgtgagaaagctaaagagattttgatggaggaaagcaatgttcagcctgtgagaagccctgttacgatatgtggtgatattcatggtcagtttcatgatcttgcggaactattcagaattggtgggaagtgtccggatacaaattacctatttatgggagattatgtggaccgtggctactattctgttgaaactgtatcgcttctggtggctttgaaagttcgttatccgcatcgaattacaattcttagaggaaaccacgagagccggcagatcactcaagtttatggattttatgatgagtgcctacggaagtatggaagtgctaatgtatggaaaaccttcacggatctttttgactatctaccgttgacagcattggttgagtcggaaatattttgcctgcatggtggactatcaccatccatcgagacacttgataacgtccgtagctttgaccgtgtccaagaagtccctcacgaggggccgatgtgtgaccttctatggtctgatcctgatgatcgatgtggttggggcatttcaccacgtggtgccggatatacatttggccaggatatttcagaacaatttaaccataccaatagcctcaagctaatagcaagagctcatcagttagttatggagggattcaactgggcacatgagcaaaaggttgtgacaatttttagtgcacctaactactgttaccggtgcggtaacatggcctcgatcttggaggtggatgactgcagggagcatactttcatccagtttgagcctgccccgaggagaggggagcctgacgtgacccgaaggacgcccgactatttcttgtaaatgtagcttaggctattcgttttttgtttttattacgggatagcttaggttattccgacagcaaacaaaaaaagcgcgtgatagctagatccgttttgcttcactccttttgttgtaatctatctgctcatgctgggctcagtcaggggtgtgaatgtgatggatgatgctggtaaatgaaaggcctcgcgtagtagtaattttattgactctcaagttggctgtgtagtgtaacatgcgacgatggcattggtgattttatggatgcagctggactcgtacacttgta

SEQ ID NO: 3430 - DNA, 1509 bp, Zea mays
aacttttgtccccctccctcctccacacctctcgttctctccccctccgcctgctccctctcaggagcgcgcgcgcgcgcgcccagatctagggtttcgtccgcggcaagatgagcagcccgcatggcggtctcgacgaccagatcgagcggctcatgcagtgcaagccgctcgctgagcctgaggttagagctctttgtgagaaggcaaaggagattctgatggaggaaagcaatgttcagcctgtaaagagtcctgttactatatgcggtgatattcatggacaatttcatgatcttgctgaactcttccgaatcggtggaaagtgtccagatacgaactacttgtttatgggagattatgttgaccgtggttactactctgtcgaaactgtcacacttttggtggctttaaaagttcgatatcctcagaggatcaccattctcagaggaaaccatgaaagccggcagattactcaagtgtatgggttctatgacgaatgcttaaggaagtatggaaatgcaaatgtctggaaaacctttacagatctatttgattacttccccttgactgcattggtcgagtcagaaatattttgcttgcatggtggattatcgccatccattgagaccctcgacaacatccgcaactttgaccgcgtccaagaagttcctcacgaaggtccaatgtgtgatcttctgtggtctgatccagatgatcggtgtggctggggtatttctcctcgtggtgctggttataccttcggacaggatatatcagagcagttcaaccataccaatagtctaaggctaattgctagagctcaccagttggttatggagggattcaattgggctcatgagcaaaaagtcgtgactatatttagtgcacctaattattgctaccgctgtgggaacatggcatcaatcttagaagtggatgattgcagagagcatactttcatccagtttgagccagccccaagaaggggagagccagatgtaactcgtaggacacctgactatttcctgtgacgcaaaagtgatgtggatcatgcagagcgaaggtttgatagataggcgcagtttcctggttgcagatatatatatttatatatgtttttgctgggacccctccgtgtgctattcttattatttttgccctggctcgccggccgctctgccgcgtcgtgattcaagtgtatacctacagcctgctacagctggaaggactggactgtgttctcaccttttctcaaactggttggtgcttttggctcggtgtggggccgcagtggtgtggggggttgaagcatcaagcagcgatttgtgttatgggaggaaactgttcccgctgtattgttcattttattccccttctctttctcaccgcctgattttcttcccctttgttccctccttgctgtgattcttgtagagttctgcacttgtatggttctatgttgttgggccattagttttttttccctttctgtttttgactacctcg

SEQ ID NO: 3431 - DNA, 1667 bp, Populus trichocarpa
accgctcccttcttccctacactctctctctggaattattttttctgtttttccctagaaaaaaagaaaaattctaagagaaaattgaaatctaaggttacaatttttttatataaatttgggagatttaatctctggatctctaattggaaagtaattagtggttaaacctaaaaagattaataaaaaatgagcttggattcggtggctacaaacgcacatggaaaccttgatgaggaaattagtcagctcatgcagtgcaagcccttatcagaacaagaggtaagggcattatgcgagaaagctaaggagattttgatggatgaaagcaatgttcagcctgttaaaagccctgttacaatctgtggtgatatccatggtcaatttcatgatctagctgagctttttcgcattggcgggaagtgtccagatacaaattacttgttcatgggagattatgttgaccgtggctattattcagtagaaaccgtaacactcctggttgccttgaaagtgcgttatcctcaacggattactattctaaggggaaatcatgaaagtcgtcagattactcaagtttatggtttctatgatgaatgcctgcggaagtatggcaatgctaatgtttggaagatctttacagatctgtttgattattttccactgacagcattggttgagtcggaaatattttgcctccatggtggattatcaccctccattgaaacccttgataacattcgtaattttgatcgtgttcaagaagttccccatgagggtcccatgtgtgatcttttgtggtctgaccctgatgatcgctgtggttggggcatctcacctaggggtgctggatatacctttggtcaagacatatctgagcaatttaaccatacaaacaacttaaagctgattgctagagctcaccagctggttatggaaggatacaactggggccatgaacaaaaggtggttactatctttagtgcacccaactattgctaccgctgtggtaacatggcttctattttggaagttgatgactgcaagggtcacacattcattcagtttgagcctgctccaaggaggggtgagccagatgtgacccggagaacaccagattatttcctatgattgaagctggtctggagatgccgaatccttacagccagtgcttcctggctggttcacttattgagggcatttttcaaatctaagagtataaattcacaatgatggtgggtggggtgggtggcagaaagcatgtataacaggcaggtggagcttccttgattcaattggtttgctgattatgctagagtttccataagaggaagcagtggagctggtgaccaaatagccgcaaatgtaccatttccagcaaacaatgcggcatcttttattcctttgccttgattctgtttttgttatcttattcctttttgtagaaggatggttgtttcagggttgggtatgtgtagagagacaatgagttgacttataatgggtgcttttatattttttctaaccaagtgttccagtaggtgccttaacatttctagataatttttgattgcacattgcatacgaaagctgaacctgaattgaatttaaaccccctctttaagtttcccatgacagttcattccaagctttggttgtgattttcc

SEQ ID NO: 3432 - DNA, 1579 bp, Oryza sativa
agaccttttgcccccctcctctcctccgcctcctccacacacgagcgcgtcccccgacgccgcgccgagatctagggttgggcgcgcgcgacgccccccccccgcggcgaggaggatgagcagcccccatggcggcctcgacgaccagatcgagcgcctcatgcagtgcaagcccctccccgagcccgaggtcagagcactttgcgagaaggcaaaagagatattgatggaggagagcaacgttcaacctgtaaagagtcctgttacaatatgtggtgatattcatgggcagtttcatgaccttgcagaactgttccgaatcggtggaaagtgcccagatacaaactacttgtttatgggagattacgtggatcgtggttattattctgttgaaactgtcacgcttttggtggctttaaaggttcgttatcctcagcgaattactattctcagaggaaaccacgaaagtcgacagatcactcaagtttatggattctatgacgagtgcttaaggaagtacgggaatgcaaatgtgtggaaaacttttacagatctcttcgattacttccccttgacagcattggttgagtcagaaatattttgcctgcatggtggattatcgccatccattgagacacttgataacatacgtaacttcgatcgtgtccaagaagttccccatgaagggcccatgtgtgatcttctgtggtctgatccagacgatcgatgtggttggggtatttctcctcgaggtgctggatacaccttcgggcaggatatatcagagcagttcaaccataccaataatttaagacttattgctagagctcaccagttggtcatggagggattcaattgggctcatgagcaaaaagttgttaccatatttagtgcacctaattattgctatcgctgtgggaacatggcatcaatcttggaagttgatgattgcagggagcatacattcatccagtttgagccagccccaagaaggggagagccagatgtaactcgtagaacacctgactatttcctgtgatgtaaaagtggtggactgtctctgcagcaaatgtttgatagctaggtgaagttccctggttgcagatatttttttcccctcgaatctcctgtgtgttattcttactacctttgcccgtggcgcttggctatcgcgagctgctttgctgcatcatgattcaagtgtatacctacagctgggaggattcatcgtgttctcacttatctctaattggctgatgcttggcttgggggctgcagtggtgactcgaagcatcaagtagcaaatttgtattatgaaaggaaaactattctctttgtattcattttgttcgcctttcttccccacaaatttcacctaattttcttttttcttttttcatgatccttgtagagatgaacaatgtagttgtatggctccctgttgagccggtaggtctttctgagtacatcttgatttgccgtacataattgcttgaaaaacaagtattagaattctttgtgaccaacacttgagctccgatttttctttccttgaagatgtgatgatttttgcccccca

SEQ ID NO: 3433 - DNA, 1515 bp, Sorghum bicolor
ccccacctctcgttctcttctccctcctccgcctcccccccctctcacgagcgcgcgcgcccgcccagatctagggttccatccgcggcaagatgagcagtccccatggcggcctcgacgaccagatcgagcggctcatgcagtgcaagccgctcgctgagcccgaggtcagagctctgtgtgagaaggcaaaggagattctgatggaggaaagcaatgttcagcctgtaaagagtcctgttactatatgcggtgatattcatggacaatttcacgatcttgctgaactcttccgaattggtggaaagtgtccagatacgaactacctgtttatgggagattatgttgaccgtggttactactctgtcgaaactgtcacacttttggtggctttaaaagttcgatatcctcagaggatcaccattctcagaggaaaccatgaaagccgacagattactcaagtttatggattctatgatgaatgcttaaggaagtatggaaacgcaaatgtctggaaaacctttacagatctatttgattacttccccttgactgcattggtcgagtcagaaatattttgcttgcatggtggattatcgccatccattgagaccctcgacaacatccgcaacttcgatcgcgtccaggaagttcctcatgaaggtccaatgtgtgatcttctgtggtctgatccagatgatcgatgtggttggggtatttctccacgtggtgctgggtataccttcggacaggatatatcagagcagttcaaccataccaatagcctaaggctaattgctagagctcaccaattggttatggagggattcaattgggctcatgagcaaaaagttgtgactatatttagtgcacctaattattgctaccgctgtgggaacatggcatcaatcctagaagtggatgattgcagggagcatactttcatccagtttgagccagccccaagaaggggagagccagatgtaactcgtaggacacctgactatttcctgtgatgcaaaagtgatgtggatctgcagcaaaggtttgatagataggtgcagtttcctggttgcagataattttttttgctggaatccctccgtgtgctattcttattatttttgcccatggcgctttggctgtcgcgggctgctttgccgcatcatgattcaagtgtatacctactacagctggaaggactggattgtgttctcacttatctctaactggttgatgcttttggcttggtgggggctgcagtggtggggtttcaagcatcaagcagcaatctgtattatgggaggaaacttttcccgttgtattcattttgttcccctttcttcctcacctgattttcttctctttcttcttttttccttttttgtgattcttgtagaggtgaacactttgtatggttctatgttgggccattagttttttctgactaccttgatttgccgtatagaattactttttaagcgcaactagtcaacctgtagcattctttgccac

SEQ ID NO: 3434 - DNA, 1573 bp, Saccharum officinarum
ctctcgttctgtcctccctcctccgcctgccccctctcacgagagcgagcgcgcgcccagatctagggttccatccgcggcaagatgagcagcccccatggcggcctcgacgaccagatcgagcggctcatgcagtgcaagccgctcgctgagcccgaggtcagagctctgtgtgagaaggcaaaggagattctgatggaggaaagcaatgttcagcctgtaaagagtcctgttactatatgcggtgatattcatggacaatttcatgatcttgctgaactcttccgaattggaggaaagtgtccagatacgaactacctgtttatgggagattatgttgaccgtggttactactctgtcgaaactgtcacacttctggtggctctaaaagttcgatatcctcagaggatcaccattctcagaggaaaccatgaaagccgacagattactcaagtttatgggttttatgacgaatgcttaaggaagtatggaaacgcaaatgtctggaaaacctttacagatctatttgattacttccccttgactgcattggtcgagtcagaaatattttgcttgcatggtggattatcaccatccattgagactcttgacaacatccgcaactttgaccgcgtccaagaagttcctcatgaaggtccaatgtgtgatcttctgtggtctgatccagatgatcgatgtggttggggtatttctccacgtggtgctgggtataccttcggacaggatatatcagagcagttcaaccataccaatagcctaaggcttattgctagagctcaccaattggttatggagggattcaattgggctcatgagcaaaaagtcgtgactatatttagtgcacctaattattgctaccgctgtgggaacatggcatcaatcttagaagtggatgattgcagggagcatactttcatccagtttgagccagccccaagaaggggagagccagatgtaactcgtaggacacctgactatttcctgtgatgcaaaagtgatgtggatctgcagcaaaggtttgatagataggtgcagtttcctggttgcagatatttttttgctggaatccctccgtgtgctattcttattatttttgcccatggcgctttggctgtcgcgggctgctttgccgcatcatgattcaagtgtatacctactacagctggaaggactggattgtgttctcagtttctcacttatctctaactggttgatgcttctggcttggtgggggctgcagtggtgggggttcaagcatcaagcagcaatctgtattatgggaggaaacttttcccgttgtattcattttgttcccctttcttcctcacctgattttcttctttcttttttgtgattcttgtagaggtgaacacttgtatggttctatgttgggccattagttttttctgactaccttgatttgccgtatagaattactttttaagcgcagctagtcaacctgtagcattctttgccaccagcatttgagggcaggtttagttgcaaattttttttgcaaaatgacactatcaaatttcgttgttatttggcc

SEQ ID NO: 3435 - DNA, 1965 bp, Panicum virgatum
cctccacgacaacgacgacccgttcagcaatacccacggcgcccgctccggccggccgtccgtccgttggctcccctcctcctcagagcagaggtagcctccaaactcgcaattatataaccaccgtcccttgcaactttccagaccttttgccccactccctcctccccacctctcgttctctcctccctctccctctccctctcgcgcgcgcccgcccgcccagatctagggtcccccccccgcggcgaagatgagcagcccccatggcggcctcgacgaccagatcgagcggctcatgcagtgcaagccgctccccgagcccgaggtcagagcgctgtgtgagaaggcgaaggagattctgatggaggaaagcaatgttcagcctgtaaagagtcctgttacaatttgtggtgatattcatggacaatttcatgatcttgctgaactcttccggattggtggaaagtgtccagatacaaactacttgtttatgggagattatgttgatcggggctactattctgttgaaaccgtcacgcttttggtggctttaaaagttcgctatcctcagaggatcaccattcttagaggaaaccacgaaagccgacagatcactcaagtttatggattctatgatgagtgcttaaggaagtatggaaatgcaaatgtctggaaaaccttcacggacctctttgactacttccccttgacagcgttggttgagtcagaaatattttgcttgcatggtggattatcaccatctatcgaaaccctcgataacatccgcaacttcgatcgtgtccaagaagttcctcatgaaggtccaatgtgtgatcttctgtggtctgatccagatgatcgatgtggttggggtatttctccacgtggtgctggatatacctttggacaggatatttcagagcagttcaaccataccaataatttaaggcttattgctagagctcaccaactggtcatggagggattcaattgggctcatgagcaaaaagttgtgaccatatttagcgcacctaattattgctatcgctgtgggaacatggcgtcaatcttagaagtggatgattgcagggagcatactttcatccagtttgagccagccccaagaaggggagagccagatgtaactcgtaggacacctgactatttcctgtgatgcaaaagtgatgtggatctgcagcaaaggtttgatagataggtgaagtttcctggttgcagatattttttttgctcgaaaccccccgtgtgctattcttattatttttgcccatggctcctcggctgtcgcgggctgctcagtcacatctcgattcaagtgtatacctacctactacagctggaaggaccggattgtgttctcacttatctctaactggttgatgcttttggcttggtgggggtgctgcagtggtgggttcaggcatcaagcagcaatctgtatgatgagaggaaactgttcccgttgtattcattttgttcccctttcttcctcacttgtttctccttatctttttttcgtgattcctgtagaggtgaacaattgtatggttctgtgttgggccattagtcttttttctgactgcctcgatttgccgtatagaattaccatttaagcacaagtagtctaagttgtagcattttttgcaaccagcatttcaattgagccctggtttcgctgttgattttgctttggacaaaatgaggcgagttgcaccacccgaagaccagtggaacgaatgatttgtacgtgtggtctgtaacattgtatttatcattcccttttgaaatactatcatgtaccctagccctgggctagtctcgcctgaagatgcagcagtctgttgggcggttgtgctctctggatctggataggagccaaccaaacatgaaacatgttacttttaaaaaaaacacatgaaaaatggctcaaggtattgatgttcg

SEQ ID NO: 3436 - DNA, 1607 bp, Cephalotaxus harringtonia
tctgggagggcataagcataaccataagcattatatttgaattaacaggacaaaatgagcgtggagcccgtatcgtccaatggcggctttgggcagctcgacctgcacattgaacaactcatgcagtgcaagcccctctcggagcaagaggtccgaggattatgcgagaaggctaaggaaatcctgatggaagaaagtaatgtgcagccagtcaagtgtcctgttacaatctgtggtgatattcatggtcaatttcatgatcttgcagagctcttccgtattggtggaaagtgtccagataccaattacttgttcatgggcgactatgttgatcgtggatactattcggttgaaactgtcactcttctggtagcattgaaggtacgatatcctcaacgaatcaccattttacgaggaaaccacgagagtcggcagattactcaagtatatggattctatgacgagtgcttgcggaagtatggaaacgcaaatgtctggaagatatttacagacctttttgactactttccattgacagcactggtggaatcagaaattttctgcctacatggtggtttgtcgccttcgatagatacccttgataatataaggaattttgaccgcgttcaagaagttcctcatgaaggccctatgtgtgatcttctatggtctgatccagatgatagatgcggatggggtatttctccacgtggtgcaggatatacatttggacaagatatttctgaacaatttaatcacaccaataacctaaaactgatagctagagcacatcaactagtcatggaaggctacaactgggggcatgagcaaaaggttgtcacgatatttagtgcacctaactattgctatcggtgcggtaatatggcgtctattctggaagttgatgattataaaggacatacatttattcagtttgagccagccccaaggcgtggagagccagatgttacacggaggacaccagattattttttgtgattctctctcccagatgtctgctgcttgcttttttgccagcaaccctttggctgctgtttgatcgtcggatctgttcttttatgaacacgtgagtgtagttgatctcaaagcttttcagagtttctagtggattccattgtctttaaattatgcttcaaattgaatgaaagaagcatgtaatatgatcaggtatatcctgtaagggcctgtgttattttagtttgaaactttatttgtagggagtgcacgtgcactgccaagtgtaccaaattaaatgttcctttggtcaaggtataagcaatttatttccaagaaatttaattaatttcatcacttcgtattgggcattgctgctgattgagtactttgccctatttcaatctctttgatctgtagtttggggcaattgctggttccagcactagtgagcagctgcaatttcatggtgcttctaaccaattcatagatttcagaatgtttttacttctgaaaatatgtatcttggtaggcctcacctttcaatgtgatgacattgaggattattacaaacacactaaaggcagtcgagatcaggatgttaatagatgccatccatttgcaaaggacat

SEQ ID NO: 3437 - DNA, 1780 bp, Distylium racemosum
gcacatggcgaggaagaatcatcctctgaggcagtagtggggaatccatccaccacacaggagaggagaggggttcgattctcgaggaggggcggggcaacaggaattcagggaaattattcagaaagaacaaaatgagcgtggagccggtggtctcgtccaacggctacggccagctcgatgcccagattgaacagctcatgcagtgcaagcccctcttggagcaagaggttcgagggttatgtgataaggccaaggagattttgatggaagaaagtaatgtgcagccagtgaagtgccctgttacaatctgtggtgatattcatggtcaatttcatgatctcgcagagctgtttcgcattggtggaaagtgtccagataccaattatttgttcatgggcgactatgttgatcgtggatactattcagttgagactgtcactcttctagtagcattgaaggtacgatatcctcaacggatcacaattttacgaggaaaccatgagagtcgccagattactcaagtatacggattctatgacgagtgtttgcggaagtatggaaatgcaaacgtctggaagatatttacagatctttttgactatttcccattgacagcgcttgtagagtctgaaattttctgcctgcatggtggtttgtcaccttccattgatacccttgataacataaggaattttgaccgtgtacaagaagttcctcatgaaggccccatgtgtgatcttttatggtctgatccagatgatagatgtggatggggtatttctccacgtggtgcaggatacacatttggacaagatatttctgagcaatttaatcatacaaacaacttaaaactgatagctagagcacatcaactagtcatggaaggatataactgggggcatgagcaaaaggttgtcaccatatttagtgcaccaaattattgttatcgatgtggtaacatggcatctattctggaagttgatgactataaaggacatacgtttattcagtttgagccagctccaaggcgtggagaaccagatgtgacacggaggacacctgattattttctatgagtcactgtcttggatgtctgctgcttgctgtttttcttccagcaagtctttggctgttgtttgatctttggatctgctgtttaggatgagaaggttgttgacctcaaagcttttcggagtttctattggattacattatcttcaaattatgcttcacagtgatttgtagaagcatgtaatatgatcgaatatttcctgtaagggtctggtatttttagcttgaaacttaatttgtagggagtgcacgtgcactgccaagtgtaccaaattaagatgttgctttggtctagggagaggcaatttattttgaagttgtttatttaattttaacacttgtaaacgtaaactgggcattactgctaattgagtggtttgcccatttcgatctctttagttggtagtttggggcaatggctcatgccaacactagtgagcagcttcaatttcatggtgttcctaaccaatttgtagatttcagaatatatttacatctgaaaccatgtattgtggtaggcctcatatttcattgtgctgaatattgaggactatttcaaacagggtatgacaggcgagttctttttcccttttaatagatgccaaccatttgcaaggacatcagaagggcaaaaattcgggcgctgataattgcaaagaggcaaatttgtgtttgtgcttttcctgttttctgatttacatttccc

SEQ ID NO: 3438 - DNA, 1456 bp, Echinacea purpurea
cggccggggggagaggagtgtaaataaacaatacccaaacgaaacaataatctcgacgatttacgagggtttcctttttctgtatcttcatttctgtttctgtatccacatttcaatcgattcatcgatctgattatatatgttgtatatcacaagatgagtgtggatctagcttccaatacccatggcaacctcgacgaacagatttctcagctcatggagtgcaaacccttaaccgaacctgaggttaagacattatgtgagaaggcaaaagagatacttatggctgaaagcaatgttcagccagttaaaagccctgtgacaatctgtggtgatattcatgggcagtttcatgatcttgctgaactttttcgaataggagggaagtgcccagatactaattacttgtttatgggggattatgtggatcgaggatattattctgttgaaactgtcacgctcttggtggctctgaaagtgaggtatcctcagcgaattacaattctaagaggaaatcatgaaagtcgccagatcactcaagtctatgggttttatgatgaatgccttcgaaagtacggcaatgctaatgtttggaaaacttttacagatctctttgactattttccattgactgcgttggttgagtcagaaatattttgccttcatggtgggctgtcaccttcaattgaaacccttgacagcataagaaactttgatcgtgtacaagaagtcccgcatgagggtccaatgtgtgatctcttatggtctgacccagatgaccgttgtggttgggggatttcaccacgtggggctggatacacttttggacaagatatttctgagcaatttaatcataccaacaacctaaagcttattgccagagctcatcagctggtcatggagggatacaactggggacatgagcaaaaagttgtcactatctttagtgcgccgaattattgctatcgatgtgggaacatggcgtctatcttggaagttgatgattgcaagggccacacatttatccagtttgatcctgctcctaggagaggagaacctgacgtaaccagacgaacgccggattatttcctctgaatggttcagttaaagcgattcatggtcatttgtcaagattcagggcttttgatacaatggtatgggccaaaatacgtcaggtgaagtgcaagaaaaagaccaaatagtttgcaatatggacttgtatgattcatttgttgaagtaatgggcttttatagttttatgtatctgcaaagggaatgattaaggtgtttttgactagttctaaacttttaatcaaatttaacatttgtattaaagtaattgattcctttgagaggtttgttggtttggtttaggggttcagtttgttttcatatgttcattttctttcagggtcacattcacactcaaaacaatctgggtttatatcgaaccagc

SEQ ID NO: 3439 - DNA, 1682 bp, Sciadopitys verticillata
gggcaactgaccacaacaagaagaacgagatcaggggttcgattctcggggaggggcagagcagggcatatttgttgaaagaaaagaagatttatttagaaaggaaggaaaaatcaaaatgagcgtggagccggtgtcctccaatggcggttacggccagctcgacgtccagattgaacagctcatgcagtgcaagcccctctcagagcaagaggtccgaggattgtgtgagaaggctaaggagattctgatggaagaaagcaatgtccagccagtcaagtgccctgttacaatctgtggtgacattcatggtcaatttcatgatcttgcagagctcttccgaattggtggaaagtgtccagatacgaattatttgttcatgggagactatgtggatcgtggatactattcagttgagactgtcacccttctagtagcattgaaggtgcgatattctcaacgaatcaccattttacgaggaaaccatgagagtcgtcagattactcaagtatatggattctatgatgagtgcttgcggaagtatggaaatgcaaatgtctggaagatatttacagacctttttgactacttcccattgacagccttggtggaatcagaaattttctgcctccatggtggtttgtcaccttccattgataccctcgataacataaggaattttgaccgtgttcaagaagttcctcatgaaggccccatgtgtgatcttttatggtctgatccagatgatagatgtggatggggtatttctccacgtggtgcaggatatacatttggacaagatatttctgagcagtttaatcatacaaacaatttaaaactcatagctagagcacatcaactagtcatggaaggctacaactgggggcatgagcaaaaggttgtcaccatctttagtgcacctaactactgctatcggtgtggcaatatggcatctattctggaagttgatgattataaaggacacacatttattcagtttgagccagctccaaggcgtggagaaccggatgtgacacggaggacaccggactattttttatgattcactctcttggatgtctgttgcttgtggtttttctgccagcaagcctttggctgctttggctgctgtttgatctttggatctgctgttttatcatcatgcgattgttgttaatctcaacttttcggagtctcttggattacattttcttcaaattatgcttcaaagtgaatgggagaagcatgtaatatgatcaggtattttctgtaagggtctttgttatttttagtcagaaactttaattgtagggagtgcatgtgcactacctagtgtaccaaattaaaaagttgctttggtctagggagaggcaatttatctctgagtttatttaattttaacacttgtaaacttatattgggcattgctgctgattgagtggtctgcccatttcgatctctttagtcggtagttgggggcaataccggttccaacacctgtgagcaactgcaattgcatggtgcttctaaccaattcatagatttcagagtatatttacatctgaaaccatgtaacttggtaggcctcacctttcattgtggtgaacattgagtaccattacaaacacgcaaaggcagccaagttctttaacccttctaatagatgccatccatgtgcaaag

SEQ ID NO: 3440 - DNA, 1601 bp, Rosmarinus officinalis
cggccgggggatagcaagtttaaacaaaaactggggaagaggttaaaaccaagcttttgaaaacaaacaaaagttcgtactttatcgaaagcaaaattcaaaattattagaaaaacagtattagatcgacccattttttaattttctctccctcggttccactactccgtccgcttactcctcctctcctacttctttctctctctagattcactgaatcttgtatatctttctccaatcactttttcggttcccaaaattgtgccctagggtgaagtcatatcttcccgaggcaccaatttttggtggtggggaggaggcggtgactgaattacggtggatctgaaactagaaggaggaagaagcaagatgagcgcggatctggtggcggagagcacacatgggaatctggacgagcagattgctcagctcaatcagtgcaagcctttatcagagcctgaggttagggccttgtgcgagaaggctaaggagatactaatggaggaaagtaatgttcagccagtgaagagccctgtgacaatttgtggtgatattcacggtcaatttcatgatcttgccgaactattccgcattggagggaagtgtccagacacaaactatctattcatgggagattatgttgatcgtgggtactattcggtggaaactgtaactctattagtggctctgaaagtgcgctatccacaacgtatcactattctcagaggaaaccatgaaagtagacagattactcaagtatatgggttttatgatgaatgtctgcgcaagtatggaaatgctaatgtttggaagatattcaccgatctgtttgattattttcccctgaccgcattggttgaatccgaaatattttgtctgcacggaggtttgtccccgtctgttgagacccttgacaatataagaaacttcgaccgtgttcaagaagttccacatgaaggtccgatgtgcgatcttttgtggtctgatcctgatgatcgttgtggttggggtatatctcctcgtggtgctggatacacttttgggcaggacatatcagagcaattcaaccacagcaacaatttaaaattaattgctagagctcatcaactggttatggaaggatataactgggcccatgaacaaaaggttgtcactatatttagtgcaccaaattattgttatcgctgtggaaatatggcatccattttggaagttgatgattgcagggagcatacgtttatccagtttgagccagctccgaggagaggagaacctgatgtaactcggaggacacctgactatttcttgtagctctgatacttgtaaactcttcgtctatatgatgtgttgatttggggtgcttgcgtggtcattgcctgagattcaaggttcgagtaattcagcctatttgaaggtggtgcaagtggaaaagatgcatgcaagatgagaggctcctactcttaaaagttatattctaacctatcttagggtctaaaggtcgagaagttggaataggggatgcttcaagttggaataggggatgcttctgtgtatcatgttctataattttttgatgtgatgttccccatttctactcttaa

SEQ ID NO: 3441 - DNA, 1707 bp, Rosmarinus officinalis
gtactttatcgaaagcaaaattcaaaattattagaaaaacagtattagatcgacccattttttaattttctctccctcggttccaccactccatccgcttactcctctcctacttctttctctctctagattcactgaatcttgtatatctttctccaatcactttttcggttcccaaaattgtgccctagggtgaagtcatatcttcccgaggcaccaatttttggtggtggggaggcggcggtgactgaattacggtggatctgaaactagaaggaggaagaagcaagatgagcgcggatctggtggcggagagcacacatgggaatctggacgagcagattgctcagctcaaccagtgcaagcctttatcagagcctgaggttagggccttgtgcgagaaggctaaggagatactaatggaggaaagtaatgttcagccagtgaagagccctgtgacaatttgtggtgatattcacggtcaatttcatgatcttgccgaactattccgcattggagggaagtgtccagacacaaactatctattcatgggagattatgttgatcgtgggtactattcggtggaaactgtaactctattagtggctctgaaagtgcgctatccacaacgtatcactattctcagaggaaaccatgaaagtagacagattactcaagtatatgggttttatgatgaatgtctgcgcaagtatggaaatgctaatgtttggaagatattcacggatctctttgattatttccccctgactgcattggttgaatccgaaatattttgtctgcatggtggtttgtccccgtctgttgagacccttgacaatataagaaactttgatcgtgttcaagaagttccacatgaaggtccaatgtgcgatcttctgtggtctgatcctgatgatcgttgtggttggggtatatctcctcgtggtgctggatacacttttgggcaggacatatcagagcaattcaaccacagcaacaatttgaaattaattgctagagcccatcaactggttatggaaggatataactgggcccatgagcaaaaggttgtcactatatttagtgcaccaaattattgttatcgctgtggaaatatggcatccattttggaagttgatgattgcagggagcatacgtttatccagtttgagccagctccaaggagaggagaacctgatgtcactcggaggacacccgactatttcttgtagctctgatactgtaaactcttcatctatatgatgtgtcgatttggggtgcttgcatggtcattgcctgagattcaaggttcaagtaattcagcctatttgaaggtggtgcaagtgggaaaagatgcatgcaagatgagaggctcctagtctgaaaagttatattctaacctatcttagggtctagttgtcgggaagttggaataggggatgcttctgtgtatcatgttctataattttttgatgtgatgttccccatttctactcttaattatcttttgtttttctgtttgtcctttgaatcactgccatttggaggacaggtgtgtttgtggaatcaatgcagaatttctgtcaatttaatctttgtcgttttgttggttgaatctccaagctattcaattcttgatatcgaccattttgtctagtaattggtatatttatcaactaaatgaaattcctaagtaggaattctgtg

SEQ ID NO: 3442 - DNA, 1686 bp, Amsonia hubrichtii
gagacgtaatctcggagagtggagagcggtcttttccatttaaatacgaatcacacactctcggagggcttcgatttttatcttccgaatcggagattttcatctgctcttaggcgtcgtcgtgttcgaattccgaagtctcgatcccacttttttgagagaaggagacagagggaggtggcaagaggaagagaaagatgagtgcggatctggtggcgtcgagcacacatggcaatctggatgagcagatttctcagctcatgcagtgtaaacctctgtccgagacggaggttagaacattatgcgagaaggcgaaagagatactaatggaggaaagtaacgtccagcctgtaagaagcccagtgaccatttgtggtgatattcacgggcaatttcatgatttggcagaactttttcgcattggagggaagtgcccagatacaaattatcttttcatgggagattatgtggatcgcggatattactcagtagaaactgtaacactattagtggctctgaaggtgcgctatccacaacgaatcacaattcttcgaggaaatcacgagagtcgtcagattacgcaggtctatgggttttatgatgagtgtctgcgcaaatatggcaatgctaatgtctggaagatattcacagatctttttgattattttccactgacagcattggttgaatcggaaattttctgtttgcatggtggattatcgccatcaattgaaacacttgataacataagaaattttgatcgtgttcaagaagttccccatgaaggtcctatgtgtgatctcttgtggtctgatcccgatgaccgctgtggttggggtatttctcctcgtggtgctggatacacatttggccaggatatatctgagcaattcaaccataccaataacttaaagctgattgctcgagctcatcagctggttatggagggctataattggagccatgaacaaaaagttgttacaattttcagtgcaccaaattattgctatcgttgtggaaacatggcatctatcttggaagtcgatgactgcaggcaacacaccttcatccagtttgagccagctccaaggaggggagaacctgatgtgacccgtagaacgcctgattatttcctgtaaagcagttgagagttactgattagtggtgtctagctaatggttcatctaagctgccaatggaattgaagctcttcaccacaaactactaggattttctactagtggtgtcacagggaccaagaggcgtgtaaaatgatagctgaggtccaatagattgtcaagttatattctaacaaaaaggttggggagcgaggcacatctcagataatactgtattgtatcatttcatgtagagaacttaatctcgtcctttgtagttctgtgttttcattttaacatttttttttggttgcatctgtctttattttttggtttattcttaatttccaaatggatcagtttgtagatgcaaagattcagatttggctgctcttttaaaattttcccatgttctattggagctgctcttttgcatttggatgatatgcctgcatattcatgatgatcttcatctagcaaccgagatgaaacttactagtttagagtgaaattatgtgctgtgaaagagatatttagagtgaattatgtatgtcttgtcctgtgaagc

SEQ ID NO: 3443 - DNA, 1585 bp, Malus domestica
aaaaagaaaaattcaaaagaactgaaaggcctttggtttctccaccaccgctctctctccctactctctctctgagtggctcgaagaaaacgaagaagacgaagagggaaatctacgattgcctacagatctagggtcagggtttcggaggggcatcttgatctgtgaaaacggtgcgttttgggggaagaggaagaagaggatggattcagtcccttcgaactcacatgggaacctggatgaacagattgctcagctcatgcaatgcaagcccttgtccgaacaagaggtaagagtgctctgcgagaaggccaaggaaatattaatggaagaaagcaatgtccagcctgtaaaaagccctgtaactatctgtggggatattcatggacaattccatgatctggcggagctcttccgcattggaggaaagtgcccagatacaaattatttgtttatgggagattatgtggaccgtggctattattcagttgaaacagtgacactcctagtggccttgaaggtgcgttatcatcagcgtattactatcctaagaggaaaccatgaaagccgtcagattactcaagtttatggtttttatgacgagtgcctacggaagtatggtaatgccaatgtttggaagatctttacagatttatttgactattttccactgacagcattggttgaaagtgaaatattctgtctgcatggagggctgtctccatctattgaaacccttgataacatacgtaattttgaccgtgtacaagaggttcctcatgagggtcccatgtgtgatcttttatggtctgaccctgatgatcgctgtggttggggtatctctcccaggggtgctggatatacgtttggtcaggacatatccgagcagtttaatcacacaaataacttaaagttgattgctagagcacatcagctggtcatggaaggatacaactggggtcatgaacaaaaagtggtcactatatttagcgcacccaactattgttatcgctgtggaaatatggcatccatcctggaagttgatgactgcaaaggtcacacatttattcagtttgagccagctccaaggaggggagaaccagatgtgacccgaagaacacctgattacttcctataatgagggtgtcaaatcagttgctgctgctgcctgcaaggtctacgtattgaggggtattcttaaatttaagattatgaattacacaacagtggtggtgttcggtttgggaaagaaatcgtgtatgattggcaggttaggcttccttggatggcgcacgagtctgcaaaaaggaagtagcggaggtggcgacactgttgcagcatatgtaccatttccagcaaacaatgtggcatcttctgttctgatttttcatattttttttcttattttatttaatttttctgtagaaggatatggtatttttgggggggttggtgatctgtagagggatgatgagcttgcttcctatgatgggtgctattttatttttttaaaattttccccttagtattgaattctaaatgttccaataggtttattttatctcaattttgtttcatagtccaa

SEQ ID NO: 3444 - DNA, 1641 bp, Malus domestica
aaacaaaacaaaagaaaaaagaaaaattcaaaagaactaaaaagcctctgatttctccaccaccgccctctctctctctctctctctctctgagtggctcgaagaaaacgaagaagaagaagaggaggagaaatctagggtttcctgcagatctagggtttgggtttcggaggggcatcttgatctgcgaaacacggtgcgttttgggggaagaggaagaggaagaggaagaggatggattcggtcccttcgaactcccatgggaatctggatgagcagattgctcaactcatgcagtgcaagcccttgtccgagcaagaggtaagggtgctctgcgagaaggccaaggaaatattaatggaagaaagcaatgtccagcctgtaaaaagccctgtaactatctgtggtgatattcatggacaattccatgatctggcggagcttttccgcattggaggaaagtgcccagatacaaactatttgtttatgggagattatgtggaccgtggctattattcagttgaaacagtaactctccttgtggccttgaaggtgcgttatcatcagcgtattactatcctaagaggaaaccatgaaagccgtcagattactcaagtttatggtttttatgatgagtgcctacggaagtatggtaatgccaatgtttggaagatctttacagatttatttgactatttcccgctcacagcattggttgaatctgaaatattctgcttgcatggagggctgtctccatccattgaaaccctcgataacatacgtaattttgaccgtgtacaagaggttcctcatgagggtcccatgtgtgatcttttatggtctgaccctgatgatcgctgtggttggggtatctctccgaggggtgctggatatacgtttggccaggacatatctgagcagtttaatcatacaaataacttaaagttgattgctagagcacatcagctggtcatggaaggatacaactggggtcatgaacaaaaagtggtcactatatttagtgcacccaattattgttatcgctgtggaaatatggcatccatcttggaagtcgatgactgcaaaggtcacacattcattcagtttgagccagctccgaggaggggagaaccagatgtgacccgaagaacacctgattacttcctataatgaaactgacgaatcagttgctgaagtacctgctgctgctgctgcctgcaaggtctccgtatcgagggctcttctttaaatttaagattatgaattacacaacagtggtggtggtcggtttgggaaaaaaatcatgtaggattggcaggtgaggcttccttggatggcgcacgagtctctgtgaaaggaagccgcggaagtggcgacactgttgcagcatatgtaccatttccagcaaacaatgtggcatcttctgttctgatttttcaatctttttttttttttttaatttaacttttctgcagaaggatggtatttttggggggttggtgatttgtagagggatgatcagctcgcttcctacgatgggtgcttttttaatttttaatttttcataagttttccccttaattaatgaattctcaatgttccaataggtttattttaaattttgtttttgtcatagtccaa

SEQ ID NO: 3445 - DNA, 1658 bp, Citrus clementina
ccttttgttaaaactttctttcaaaatgtttgttattttagcccatttctctctctctctctaatcactgaagccttctctcttttttttttaaaattttttttgttgagatacaaaattgaattttgattatagggtttcgaaaaaattagggtttgtttgttgaaatttagggttagggttagattaaaaagaggaaagtgaagggatctgagtctgcaaattaagaagaagaaggacaagaaaatgagcttggattcggtcccttcaaattcacatggaaatctcgacgagcagattgctcagcttatgcagtgcaagcccttatcggaacaagaggttagagtgttatgcgaaaaggccaaggagatattgatggatgaaagtaatgtccagcctgtaaaaagtcctgttacaatttgtggtgatattcatggacaatttcatgatcttgcagagcttttccgcattggaggaaagtgtccagatacaaactacttgttcatgggagattatgttgaccgtggttactattcagtagaaactgttacgctattggtatctctgaaagtgcgttatcctcaaaggattactattctaagggggaatcatgaaagtcgtcagattactcaggtctatggattctatgatgagtgccttaggaagtacggcaatgcaaatgtttggaagatattcacagatttatttgactattttccactgacagcattggttgaatcagaaatattttgtctccatggtggattgtctccgtccattgagactctcgataacattcgtaattttgaccgtgttcaagaagttccccatgagggtcccatgtgtgatcttttatggtctgatccagatgatcgttgtggttggggtatatcaccaaggggtgctggatatacctttggccaagacatatcagagcaatttaatcatacaaataacttaaagctgattgctagggctcaccagctggttatggaaggatacaactggggtcatgaacaaaaggtggttaccatatttagtgcacccaattactgttatcgctgtgggaacatggcgtccatcttggaagttgacgactgcaagggccacacattcattcagtttgagcctgccccaagaagaggagagccagatgttacccggagaacacctgattactttctataatgcaagccgtcacaaacttggtatgttaccagcagccactgcctatcagctggtgtatgtgttcagggcgtttctcaaatttaagatttatgcttatgattatggtggtggacggaaggcaaaatcatgtaaaatggacgggtgaggcttccttgaattgattgtttacttggattatgattgagtttcaagaggaagcagtggagccggcattgctctaatcgacgtatgtaccatttcctgcaaacaaacaatatggccttttttttttccttctcttgctttcaatttttttgtttctttttggttctttcttctgtagaaggatgatgctgggagttggggatctgtagagggacgatgagttaaaaacatttttcttataatgggtgtttctataatttttttcaatcattatctgttgtgctttcaaatattgcaagccttatattgttcaaattattttttgt

SEQ ID NO: 3446 - DNA, 1535 bp, Setaria italica
cacctctcgttctctcccccctcctgtctctctcacgcgcgcccgcgcgcccagatctagggttccttcccgcggcgaagatgagcagcccccatggcggcctcgacgaccagatcgagcggctcatgcagtgcaagccgctccccgagcccgaggtcagagcgctgtgtgacaaggcgaaggagattctgatggaggaaagcaatgttcagcctgtaaagagtccggttacaatttgtggtgatattcatggacaatttcacgatcttgctgaactcttccgaattggtggaaagtgtccagatacaaactacttgtttatgggagattatgttgaccgtggctactattctgttgaaactgttacgcttttggtggctttaaaagttcgctatcctcagaggatcaccattctcagaggaaaccacgaaagccgacagatcactcaagtttatggattctatgatgagtgcttaaggaagtatggaaacgcaaacgtctggaaaacctttacggacctatttgactacttccccttgacggcattggtcgagtcagaaatattctgcttgcatggtggattatcaccatctatcgagacccttgataacatccgcaacttcgatcgtgttcaagaagttcctcatgaaggtccaatgtgcgatcttctgtggtctgatccagatgatcgatgtggttggggtatttctccacgtggtgctggatatacctttggacaggatatatcggagcagttcaaccataccaataacttaaggcttattgctagagctcaccaattggtcatggagggattcaattgggctcatgagcaaaaggtcgtgactatatttagcgcacctaattattgctaccgctgtgggaacatggcgtctatcttagaagtggatgattgcagggagcacactttcatccagtttgagccagccccaagaaggggagagccagatgtaactcgtaggacacctgactatttcctgtgatgcggaagtgatgtggatctgcagcaaaggtttgatagataggtgaagtttcctggttgcagatattttttgctcgaatccccccgtgtgctattcttattattttgcccatggctctttggctgtcgcgggcagctctgccacatcgtgattcaagtgtatacctactacagctggaaggaccccgattgtgttctcacttatctctaactggttgatgcttttggcttggtggggggtgctgcagtggtgggttcaagcatcaagcagcaatctgtattatgagaggaatctgttcccgttgtattcattttgttcccctttcttcctcacttgtttctttttctttttttcttttctgtgtttcctgtagaggtgaacaattgtatggttctgtgttgggccattagtctccttttctgactaccttgatttgccgtatagaattaccttttaagcacaagtagtcttgagctgtagcattctttgcaaccagcatttgaattgagcactggtttcgcttttggattt

SEQ ID NO: 3447 - DNA, 1581 bp, Liriodendron tulipifera
atagatccgttgccttcttcaaactctcatggaaacctcgacgagcagatttcgcagctcatgcagtgcaaacctctgtccgagcaagaggttagagcattatgtgagaaggcgaaggagatattaatggaagaaagtaatgtccagcctgtgaaaagtcctgtgacgatatgtggtgatattcatgggcaatttcatgatcttgcagaactttttcgaattggtgggaagtgtccagataccaattacctgtttatgggagactatgtggaccgtggatattattcagttgaaaccgtaacgctcctggtggccctgaaggtgcgttatcctcaacgaattaccattcttagaggaaatcatgaaagtcgccagattacacaagtttatggattttatgatgaatgtctacgcaagcatggtaatgcaagtgtatggaagatctttactgacctttttgactacttcccattgacagctttggttgaatcagaaatattttgtctgcatggtggcctgtctccatccattgagacccttgataacatacggaatttcgatcgtgttcaagaagtcccccacgaagggccaatgtgtgatctcttgtggtctgatccagatgatcgctgtggttggggtatttctccacgaggagctggatatacatttggccaagatatatcagagcaattcaaccataccaacaacctcaagctaatagccagagctcatcaattggtcatggagggattcaactggggacatgaacaaaaggtggtaaccatatttagtgcacctaattattgctatcggtgtgggaacatggcatctatccttgaagttgatgactgcaaaggacacacattcatccagtttgagccagctcctaggagaggagagcctgatgtgacccgcagaacaccggactacttcctatgatgcagctgtctgagttatttgctgatttgctggcagcaagaggctatgcttgctggttgacgctgggagtttgaagatgttgagaactcttattattggatggcatttataaattcaagctgctatgcttggtgggggtggaatgcatgtaaaaaaagtgagcaggtaagggtccccattaatttcttagcatttggaactgtgccgatttccttggaaggaggcagtggagcaggcgacgctgcagcagcatgtatcatttccaagaaaacatgggtattttttttttttttttgggcattttggtgttctgtagagggaagggattctattttcatagggtgcttttctcatctcttagtttccatcctaactgatcaaattcgcttgttatttggatagctgcctcttgattcgtctttggttggggctctggtgatttcctagatgtgtgtgtaaaaactctagagagaagataatatgcatacacagtgggatattcgcctcaaaaggcctaggtgagttttattacgattggcaaggctatttgatttaatggcatgtgggaagaatgtcctagcatggatgttgtgaggcaacactgaattcattaactttatttagttttgactggttctttta

SEQ ID NO: 3448 - DNA, 1562 bp, Zea mays
accttttgcccccctgcttcctccgcctgcaccctctcacgagcgcccgctcgcccagatctagggttccatccgcgggcaagatgagcagcccccatggcggcctcgacgaccagatcgagcggctcatgcagtgcaagccgctcgctgagcccgaggtaagggctctgtgtgagaaggcaaaggagattctgatggaggaaagcaatgttcagcctgtaaagagtcctgttactatatgcggtgatattcatggacaatttcatgatcttgctgaactcttccgaattggtggaaagtgtccagatacgaactacctgtttatgggagattatgttgaccgtggttactactctgtcgaaactgtcacacttttggtgtctttaaaagttcgatatcctcagaggatcaccattctcagaggaaaccatgaaagccgacagattactcaagtttatgggttctatgacgaatgcttaaggaagtatggaaacgcaaatgtctggaaaacatttacagatctatttgattacttccccttgactgcattggtcgagtcagaaatattttgtttgcatggtggattatcgccatccattgagaccctcgacaacatccgcaacttcgaccgtgtccaagaagttcctcatgaaggtccaatgtgtgatcttctgtggtctgatccagatgatcgatgtggttggggtatttctccacgtggtgctgggtatacctttggacaggatatatcagagcagttcaaccataccaatagcctaaggcttattgctagagctcaccaattggttatggagggtttcaattgggctcatgagcaaaaggtcgtgactatatttagtgcacctaattattgctaccgctgtgggaacatggcatcaatcctagaagtggatgattgcagggaacatactttcatccagttcgagccagccccgagaaggggagagccagatgtaacccgtaggacacctgactattttctgtgatgcaaaagtgacgtggatctgcagcaaaggtttgatagataggcgcagtttcctggttgcagatatatatatatctatatatattggctggagttcctccgcgtgctattcttatattatttctcgcccatggcgctcttggctgtcgccggctgctttgctgcatcgtggttcaagtgtataccctactacagctggaaggactggatcgtgctcttacggtcttacctgtctctaactggttgattggcttagggtgggctgcggtggtgtgtgtgtgggttcaagcatcaggcagccatctgtattatgggaggaagtgttcccgttgtattcattttgttcccctttcttcctcatctgattttcttctcttttttttatttcttccttctctgtgattcttgtagagttcagcacttgtatggttctatgttgggccattagttttttttaactctctttctctgactgcctcgatttgccgtatagaattacatttctaagcgcaactagccaacctgtagcattttctgtcatcagcatttgaagttt

SEQ ID NO: 3449 - DNA, 1435 bp, Pennisetum glaucum
cccctccgctctctctctctccctctctctctatccgcgcgcccagatctagggttccctcccgcggcgaagatgagcagcccgcatggcggcctcgacgaacagatcgagcggctcatgcagtgcaagccgctccccgagcccgaggtcagagcgctgtgtgagaaggcgaaggagatcctgatggaggaaagcaatgttcagcctgtgaagagtccagttacaatttgtggtgatattcatggacaatttcacgatcttgctgaactcttccgaattggtggaaagtgcccagatacaaactacttgtttatgggagattatgttgaccgtggctactattctgttgaaactgtcacgctcttggtggctttaaaagttcgctatcctcagaggatcaccattcttagaggaaaccacgaaagccgacagatcactcaagtttatggattctatgatgagtgcttaaggaagtatggaaatgcaaatgtttggaaaacctttacggacctatttgactacttccccttgacggcactggtcgagtcagaaatattctgcttgcatggtggactatcaccatctatcgagacccttgataacatccgcaacttcgatcgtgtccaagaagttcctcatgaaggtccaatgtgtgatcttctgtggtctgatccagacgaccgatgtggttggggtatttctccacgtggtgctggatatacctttggacaggacatatcagagcagttcaaccataccaatagcttaaggcttattgctagagctcaccaattggtcatggagggattcaattgggctcatgagcaaaaagtcgtgaccatatttagcgcacctaattattgctatcgctgtgggaacatggcatctatcttagaagtggatgattgcagggagcatactttcatccagtttgagccagccccaagaaggggagagccagatgtaactcgtaggacacctgactatttcctgtgatgcaatagtgatgtggatctgcagcaaaggtttgatagataggtgaagtttcctggttgcagatattttttgctcgaatcccccgtgtgctattcttattatttttgcccatggcgctttggctgtcgcgggcagctctgccgcatcgtgattcaagtgtatacctaccacagccgaaaggaccctgattgttctcacttatctctaactggttgatgcttttggtttggtgggggtgctgcagtggtgggttcaagcatcaagcagcaatctgtattatgagaggaatctgttcccgttgtattcattttcttcccctttcttcctcgcttattttttttcctttttccttttcttttctgtggttcctgtagaggtgaacaattgtatggttctgtgttgggcccattagtccctctttctgactaccttgatttgc

SEQ ID NO: 3450 - DNA, 1908 bp, Mimulus guttatus
gatcgatatttgcatttgattctctctctctctctctcccctcggttccaccatcttcctccgctcgcactcttcgcgagttttctctctctattctttttctctctctctacttttacatctacagtcccgtgaatcttggtctaggttttaaggtgtatctggctgaggcgccggactcaacaacggtggatctgatacaagagaataaagcaagatgagcgcggatctggtggctgagagcactaatgggaatctcgacgagcagattgctcagcttatgcagtgcaagccattgccggagtctgaggttaggactttgtgcgagaaggctaaagaaatactaatggaggaaagtaacgttcagccggtaaaaagtcctgtgacaatttgtggtgatattcatggccaatttcatgatcttgcagaactttttcgcattggagggaagtgtcccgacacaaattatctatttatgggagattatgttgatcgtgggtactattctgttgaaaccgtcactcttttagtgtcattgaaagtgcgctatccacaacgtatcacaattcttagaggaaatcatgaaagtcgacagatcactcaagtatacggtttctatgacgaatgtctgcggaagtatggaaatgccaatgtttggaagatattcaccgatctgtttgactatttccctttgactgcattggttgaatcggaaatattttgtctgcacggtggattatccccctcggtggaaacccttgacaacataagaaacttcgatcgtgttcaagaagttccacacgagggtccgatgtgcgatttgttgtggtctgatcccgatgaccgttgtggttggggtatttccccccgtggtgctggatacactttcggccaggacatatcggagcagttcaaccacacaaacaaccttaaactaattgctagagctcatcaacttgttatggaaggatataactgggcccatgagcaaaaggttgtcactatttttagtgcgccgaattattgctatcgctgtggaaatatggcatctattctggaagtggatgattgcagggagcatacctttatccagtttgagccagctccaaggagaggagaaccagatgtgactcggaggacacccgactatttcttgtagagctgaagacagtgtaagagactgtttttgtctgcaaggtgtcgatttacatgtcttctcgtgaaatttgattttccaagttaccgagcatccctttatgaaggtgtgtgtgggaagagatgcatgtagaatagcgataaaaggtctttttaagttattatcctaacctgtgtcctagggtttagagtcggggaagttgggttaggagatgcgtttgtgtatcatttgtcttatattttctttttttgatgtttttttttcttctttctcgtctactaataattttctttaatttttttttctttcttgattttcctttcaatcgctgccgttttgtggacagggattttgtggaagtgatcccgaacttgtatccattaattgatctttattattcttgttgttgcttttctgaactagtagtcgaatgctgattttcaatcttttggtcgtggttggctttattgcttaagatcgtctcgtttggtagttttataattttcgtactgtagttttgatacaaaccgagattgttttgtgacttttatagggtttaattaaatatgccactcttctattttatgaagtatatattttgttcaaaaatgtaattttcgaacagtataggttaattcgtcagtgttgtcgaatcgaacttacgaaacaagattaagacgacgattgcttaagtcagctgtttaaggttagtttgatactgttgtaataaatcaagaaaaagattgatacaa

SEQ ID NO: 3451 - DNA, 1493 bp, Tropaeolum majus
gaaagaagaggtgaaatctagggttcctttcgggaaaatttcaagggcgtgttattgtgtttcggatcagtcttttgaatcaggtaaaggtaaatcgaagggatctaagaatctgattgaaggtgaagcttgagagagagtatggattcggtcccttcgaactctcatggaaacctcgatgaggagattagtcagctcatgcagtgcaagcctttatctgaacaggaggtgagggttttatgtgagaaggccaaggagatattgatggatgagagcaatgtccagcctgtgaaaagccctgtcacaatctgtggtgatatacatgggcagtttcacgatcttgcagagctttttcggattggggggaagtgtccagatacaaattatttattcatgggagattatgttgatcgtggctattattcagttgaaactgtaacactcttggtagcactgaaggtacgttatccacagcggattactattcttaggggcaaccatgaaagtcgtcagattactcaagtttatgggttttatgatgaatgcctaaggaagtatggcaatgctaatgtttggaaaacatttacagacctgtttgactattttccacttacggcattggttgaatcagaaatattttgtctccatggtggactgtctccatccatcgaaacactcgataacatacgtaattttgatcgtgttcaagaagttccacatgaggggcctatgtgtgatcttttatggtccgacccagatgatcgatgtggctggggcatctcaccaaggggtgctggatacacttttggccaagacatatctgagcaatttaaccacacaaacaacctgaagctgattgctagagctcaccagcttgttatggaaggatacaactggggtcatgagcaaaaagttgttactatatttagtgcacctaattattgttatcggtgcggtaatatggcttctatcctggaagttgatgactgcaagggtcacacatttattcagtttgagcctgctccaagaaggggagagccggacgtgacccgaagaacacctgactacttcctatgatgcaagttagtaccgtgttgataactttccagtggcacattcttgtcacctggttttacataagttgaggcatttgaaatttaagaatggaagatttataattttggtatggtcgttgttgggtgggggaagaacatgtaagatgagatgaatgaggggttgaggcttccttggttcggtttttaatcttgaattatgcttagagtttctacaggaggaagcaagttgctggcaggctgtagcagctaaatgtaccatttccagcaaacgatgtcgtatttttttctggattttgatttttgtttctgtagaaggattgactgttttaaggttcaggttggttctgtagaggaatgataaagttaattttttctctctcttctatctaatctttaatatgctgttatatcttttct

SEQ ID NO: 3452 - DNA, 1654 bp, Citrus sinensis
ccttttgttaaaactttctttcaaaatgtttgttattttagcccatttctctctctctctctaaacactgaagccttctctcttttttttttaaaatttttttttgagatacaaaattgaattttgattatagggtttcgaaaaaattagggtttgtttgttgaaatttagggttagggttagattaaaaagaggaaagtgaagggatctgagtctgcaaattaagaagaagaaggacaagaaaatgagcttggattcggtcccttcaaattcacatggaaatctcgacgagcagattgctcagcttatgcagtgcaagcccttatcggaacaagaggttagagtgttatgcgaaaaggccaaggagatattgatggatgaaagtaatgtccagcctgtaaaaagtcctgttacaatttgtggtgatattcatggacaatttcatgatcttgcagagcttttccgcattggaggaaagtgtccagatacaaactacttgttcatgggagattatgttgaccgtggttactattcagtagaaactgttacgcttttggtatctctgaaagtgcgttatcctcaaaggattactattctaagggggaatcatgaaagtcgtcagattactcaggtctatggattctatgatgagtgccttaggaagtacggcaatgcaaatgtttggaagatattcacagatttatttgactattttccactgacagcattggttgaatcagaaatattttgtctccatggtggattgtctccgtccattgagactctcgataacattcgtaattttgaccgtgttcaagaagttccccatgagggtcccatgtgtgatcttttatggtctgatccagatgatcgttgtggttggggtatatcgccaaggggtgctggatatacctttggccaagacatatcagagcaatttaatcatacaaataacttaaagctgattgctagggctcaccagctggttatggaaggatacaactggggtcatgaacaaaaggtggttaccatatttagtgcacccaattactgttatcgctgtgggaacatggcgtccatcttggaagttgacgactgcaagggccacacattcattcagtttgagcctgccccaagaagaggagagccagatgttacccggagaacacctgattactttctataatgcaagccgtcacaaacttggtatgttaccagcagccactgcctatcagctggtgtatgtgttcagggcgtttctcaaatttaagatttatgcttatgattatggtggtggacggaaggcaaaatcatgtaaaatggacgggtgaggcttccttgaattgattgtttacttggattatgattgagtttcaagaggaagcagtggagccggcattgctctaatcgacgtatgtaccatttcctgcaaacaaacaatatggccttttttttttccttctcttgctttcaatttttttgtttctttttggttctttcttctgtagaaggatgatgctgggagttggggatctgtagagggacgatgagttaaaaacatttttcttataatgggtgtttctataatttttttcaatcattatctgttgtgctttcaaatattgcaagccttatattgttcaaattattttgt

SEQ ID NO: 3453 - DNA, 1567 bp, Ananas comosus
aacgctgcaatgctgttcgtagccgcacaccctgacacagcaaggatcattttcattttttcgtcgaacaaatcaaatccctcaatcgctcacacagggcgagcaaaaaagaagtacaaaaatttatatagagcccatcgaagggcgcccgagggtttccctttacttccctcctcttccgaagcatattattggagagagagagagagagagagagagagaggaagttaggggttcgagatctagagttagggtttcgcgggcgtcgcactggtttgggaggaagaagatgagcagcgcgaattcgacggccgcgagctcccatggcaacctcgatgagcagatctcgcagctcatgcagtgcaagcctctctctgagccagaggttagagtgttgtgtgagaaggcaaaagagatactgatggaagagagcaatgtccaacctgtcaaaagccctgtgacaatatgtggtgatattcatggtcaatttcatgatctagcagaattatttcgaatcggtgggaagtgtccagacacaaactacctattcatgggagattatgtagaccgtgggtactattcagttgaaactgtcacgcttctggtggctttgaaggtccgctatcctcagcgaattacgattcttagaggaaaccatgagagtcgtcagatcactcaagtttatgggttttatgatgagtgcttacggaaatatggcaatgcaaatgtttggaagatctttacagatctttttgattattttcctctgacggcattggttgagtcagaaatattttgcttgcacggaggtttatcaccgtcaattgagacccttgataacatacgcaactttgaccgtgtccaagaagttcctcatgaaggccccatgtgtgaccttttatggtctgaccctgatgaccgatgtggctggggtatttctcctcgtggtgctgggtataccttcggacaagatatttcggagcagttcaaccatacaaataaccttaagttgatagccagagctcatcagttagtgatggaagggtacaactggggacatgagcaaaaggtggtgaccatatttagtgcacctaattattgctaccgatgtgggaatatggcctccatcttagaagttgacgattgcaaggggcatacatttattcagttcgagcctgccccaagaagaggggagccggatgtaactcgtagaacgcctgattatttcctgtgaaagcacagcttatggaggaagaggtgtgctcatttgtcgcagcaattgtatgcttaattgagcttgtgattgcagatatttctgtgagatcctatcggtctgattgacgactatgggatgatgcttatgcttggtggtttggttgggaattttttctttaatttcataatttagtaggaatgatcgtctatttttatacttacgaaccttgtgattgtttccatttcgagtcagaggcggtaggactggtatgaatgaagaatcagcagcaacatgtatcatctcggaggggattgattattggttttccacctttctgttctttttctcctt

SEQ ID NO: 3454 - DNA, 1791 bp, Prunus mume
aaaaaagaaaaagaaataaaaattcaaaagaactaaaaagccttggtttctacaccaccgctctctctctctctctctctctctctctatctctgcgaagttcgaagaagaaaacgaagaagaagaagaggaggagaaatctagggttttctgcagatccagggtttgggcttcggagggcatcttgatctgtgaaaaacggtgcgtttccgggaagaggaagtgaaggaggaacaggatggatgcggtcccttcgaactcacatgggaacctggatgagcagattgctcagctcatgcagtgcaagcccttgtccgaaccagaggtaagggggctctgtgagaaggccaaggagatattaatggaagaaagcaatgtccagcctgtgaaaagccctgtaactatttgtggtgatattcatggacaattccatgatcttgccgagcttttccgcattggaggaaagtgtccggatacgaattatttgtttatgggagattatgtggatcgtggctattattcagttgaaacagtgacactcttggttgccttgaaggtgcgttatcctcaacgtattactatcctaagaggaaatcatgaaagccgtcagattactcaagtttatggtttttatgatgagtgcctacggaagtatggtaatgccaatgtttggaagatctttacagatttatttgactatttccctctgacagcattggttgaatctgaaattttctgcctgcatggtggactgtctccatccattgaaacccttgataatatacgtaattttgaccgtgtacaagaggttcctcatgagggtcccatgtgcgatcttctatggtctgaccctgatgatcgctgtggttggggtatctctcccaggggtgctggatatacttttggtcaggacatatctgagcagttcaatcatacaaataacttaaagttgattgctagagcacatcagctggtcatggaaggatataactggggtcatgaacaaaaagtcgtcactatatttagtgcacccaactattgttatcgctgtggaaatatggcttccatccttgaagtcgatgactgcaaaggtcacacattcattcagtttgagccagctcccaggaggggagagccagatgtgacccgaagaacacctgattacttcctataatgaaaccgccaaatcagttgctgaattacctgctgtggttgcctgctagaaggtttatgtatccagggctctacttaactctaaggttatagtttcacaatagtggtcggttgtggaaaatcgtgtaagattggcaggtgagggttccttggattgtactcgagtctctgcaaaaggaagcatccgaggtggcgacactgttgcagcatatgtaccatttccagcaaacaatgtggcatcttctgttctgattttacttctctctacctttttttaaaaaaaatttaatttttctgtagaaggatggtttttttgggggttggcgatctgtagagggatgatgagctcacttcctataatgggtgcttttattattttttccccttagtaatgaatacaatgttatccaataggtttattttttaattttaatttttttcccatagtctaattcaatttatagtctggcagttctccctttttactccttcacacaaaccattacatttcacttttctcaacttcaattgcatgtggcagtttgttgttccactttcagtattgtatcataccaacaccgtgtactttttaagccagtccggccttctccattttaa

SEQ ID NO: 3455 - DNA, 1604 bp, Prunus persica
aaaagaaaaagaaggaaaaattcaaaacaactaaaaagccttggtttctccaccaccgctctctctctctctctctctctctctctctctgtgagaagttcgaagaagaaaacgaagaagaagaagaggaggagaaatctagggttttctacagatccagggtttgggcttcggagggcatcttgatctgtgaaaaacggtgcggttccgggaagaggaagtgaaggaggaacaggatggatgcggtcccttcgaactcacatgggaacctggatgagcagattgctcagctcatgcagtgcaagcccttgtccgaaccagaggtaagggggctctgtgagaaggccaaggagatattaatggaagaaagcaatgtccagcctgtgaaaagccctgtgactatttgtggtgatattcatggacaattccatgatcttgccgagcttttccgcattggaggaaagtgtccggatacgaattatttgtttatgggagattatgtggatcgtggctattattcagttgaaacagtgacactcttggttgccttgaaggtgcgttatcctcaacgtattactatcctaagaggaaatcatgaaagccgtcagattactcaagtttatggtttttatgatgagtgcctacggaagtatggtaatgccaatgtttggaagatctttacagatttatttgactatttccctctgacagcattggttgaatctgaaattttctgcctgcatggtggactgtctccatccattgaaacccttgataatatacgtaattttgaccgtgtacaagaggttcctcacgagggccccatgtgcgatcttctatggtctgatcctgatgatcgctgtggttggggtatctctcccaggggtgctggatatacttttggccaggacatatctgagcagttcaatcatacaaataacttaaagttgattgctagagcacatcagctggtcatggaaggatataactggggtcatgaacaaaaagtcgtcactatatttagtgcacccaactattgttatcgctgtggaaatatggcatccatccttgaagtcgatgactgcaaaggtcacacattcattcagtttgagccagctccaaggaggggagagccagatgtgacccgaagaacacctgattacttcctataatgatactgccaaatcagttgctgaattacctgctgtggttgcctgctagaaggtttatgtatcgagggctctacttaactctaaggttatagtttcacaatagtggtcggttgtggaaaatcgtgtaagattggcaggtgagggttccttggattgtactcgagtctctgcaaaaggaagcatccgaggtggcgacacagttgcagcatatgtaccatttccagcaaacaatgtggcatcttctgttctgattttttttttttttaaatttaatttttctgtagaaggatggtttttttgggggttggtgatctgtagagggatgatgagctcacttcctataatgggtgcttttattattttttccccttagtaatgaatacaatgttctccaataggtttattatttaattttaatttttttttcccata

SEQ ID NO: 3456 - DNA, 1409 bp, Secale cereale
tcgcggtcgcctctcccgatagatctggtgccagggttcgcggcgccggcggacgggggagcggagacgtgcggggggaggggtcgacgcctgcctggtgggcggaggggagcatggggaatccgcgtggcggcctcgacgagcagatcgagcagctgctgcagtgcaagcccctcgtcgagcctgagttgaaagcactgtgtgagaaagctaaagagattttgatggaggagagcaatgttcagcctgtgagaagccctgtcacgatatgtggtgatattcatggtcagtttcatgatcttgcggaactattcagaattggtgggaagtgtcctgatacaaactacctatttatgggagattatgtggaccgtggttactattctgttgaaactgtatcgcttctggtagctttgaaagttcgttatcctcatcgacttacaattcttagaggaaaccacgagagccggcagatcactcaagtttatggattttatgatgagtgcctacggaagtatgggagtgctaatgtatggaaaaccttcacggatctttttgactatttaccgttgacggcattggttgagtcagaaatattttgcctgcatggcggactatcaccatccatcgagacacttgataatgtccgtagcttcgaccgtgtccaagaagtccctcacgaggggccaatgtgtgaccttctatggtctgatcctgatgatcgatgtggttggggcatttcaccgcgtggtgccggatacacatttggccaggatatttcagaacagtttaaccataccaatagccttaagctaatagcaagagctcatcagttagttatggagggattcaactgggcacatgagcaaaaggtcgtgacaatatttagtgcacctaactactgttaccggtgtggtaacatggcctcgatcttggaggtggatgactgcagggagcatactttcatccagtttgagcctgccccgaggagaggggagcctgacgtgacccgaaggacgcccgactatttcttgtaaatgtagcctaggccattcgttttttgtttttgttttacgggatagcttaggttattccgacagcaaacaaaagaaagcgcgtgatagctagatgcgccgtgtcgcgtcgtgccgtgtggtcatattttttgttgtttgggtctggctcccgttttgcttcactccttttgttgtaatctgtctgctcatgctgggctcagtcaggggtgtgggtgtgaatgtgatggatgacgctggtaaatcaaaggcctcgcgtggtggtaattttgttggctctcaagttgggtgtgtagtgtaacatgagatgagacgatggcattggtggttttataattacagctggacccgtacgcttgtaataacttgtgcagc

SEQ ID NO: 3457 - DNA, 1438 bp, Secale cereale
actcgcggtcgcctctcccgatagatctggtgccagggttcgcggcgccggcggacgggggagcggagacgtgcggggggagaggtcgacgcctgcctggtgggcggaggggagcatggggaatccgcgtggcggcctcgacgagcagatcgagcagctgctgcagtgcaagcccctcgtcgagcccgagttgaaagcactgtgtgagaaagctaaagagattttgatggaggagagcaatgttcagcctgtgagaagccctgtcacgatatgtggtgatattcatggtcagtttcatgatcttgcggaactattcagaattggtgggaagtgtcctgatacaaactacctatttatgggagattatgtggaccgtggttactattctgttgaaactgtatcgcttctggtagctttgaaagttcgttatcctcatcgacttacaattcttagaggaaaccacgagagccggcagatcactcaagtttatggattttatgatgagtgcctacggaagtatgggagtgctaatgtatggaaaaccttcacggatctttttgactatttaccgttgacggcattggttgagtcagaaatattttgcctgcatggtggactatcaccatccatcgagacacttgataatgtccgtagcttcgaccgtgtccaagaagtccctcacgaggggccaatgtgtgaccttctatggtctgatcctgatgatcgatgtggttggggcatttcaccgcgtggtgccggatacacatttggccaggatatttcagaacagtttaaccataccaatagccttaagctaatagcaagagctcatcagttagttatggagggattcaactgggcacatgagcaaaaggttgtgacaatatttagtgcacctaactactgttaccggtgcggtaacatggcctcgatcttggaggtggatgactgcagggagcatactttcatccagtttgagcctgccccgaggagaggggagcctgacgtgacccgaaggacgcccgactatttcttgtaaatgtagcctaggccattcgttttttgtttttgttttacgggatagcttaggttattccgacagcaaacaaaagaaagcgcgtgatagctagatgcgccgtgtcgcgtcgtgccgtgtggtcgtattttttgttgttcgggtctggctccgttttgcttcactccttttgttgtaatctgtctgctcatgctgggctcagtcaggggtgtgaatgtgatggatgacgctggtaaatcaaaggcctcgcgtggtggtaattttgttggctctcaagttgggtgtgtagtgtaacatgagatgcgacgatggcattggtggtttcatggatacagctggactctgtaataacttgtgcagcagttgttgtcaacattgtgcacagattaaccaagtttggat

SEQ ID NO: 3458 - DNA, 1443 bp, Secale cereale
tccgcgcttcctcctccctccccccactcgcggtcgcctctcccgatagatctggtgccagggttcgcggcgccggcggacgggggagcggagacgtgcggggggagaggtcgacgcctgcctggtgggcggaggggagcatggggaatccgcgtggcggcctcgacgagcagatcgagcagctgctgcagtgcaagcccctcgtcgagcccgagttgaaagcgctatgtgagaaagctaaagagattttgatggaggagagcaatgttcagcctgtgagaagccctgtcacgatatgtggtgatattcatggtcagtttcatgatcttgcagaactattcagaattggtgggaagtgtcctgatacaaactacctatttatgggagattacgtggaccgtggttactattctgttgaaactgtatcgcttctggtagctttgaaagttcgttatcctcatcgacttacaattcttagaggaaaccacgagagccggcagatcactcaagtttatggattttatgatgagtgcctacggaagtatgggagtgctaatgtatggaaaaccttcacggatctttttgactatttaccgttgacagcattggttgagtcggaaatattttgcctgcatggtggactatcaccatccatcgagacacttgataatgtccgtagcttcgaccgtgtccaagaagtccctcacgaggggccaatgtgtgaccttctatggtctgatcctgatgatcgatgtggttggggcatttcaccacgtggtgccggatacacatttggccaggatatttcagaacagtttaaccataccaatagccttaagctaatagcaagagctcatcagttagttatggagggattcaactgggcacatgagcaaaaggttgtgacaatatttagtgcaccgaactactgttaccggtgcggtaacatggcctcaatcttggaggtggatgactgcagggagcatactttcatccagtttgagcctgccccgaggagaggggagcctgacgtgacccgaaggacgcccgactatttcttgtaaatgtagcctaggccattcgttttttgtttttgttttacgggatagcttaggttattccgacagcaaacaaaagaaagcgcgtgatagctagatgcgccgtgtcgcgtcgtgccgtgtggtcgtattttttgttgttcgggtctggctccgttttgcttcactccttttgttgtaatctgtctgctcatgctgggctcagtcaggggtgtgaatgtgatggatgacgctggtaaatcaaaggcctcgcgtggtggtaattttgttggctctcaagttgggtgtgtagtgtaacatgagatgcgacgatggcattggtggtttcatggatacagctggactctgtaataacttgtgcagcagttgttgtcaacattgtgca

SEQ ID NO: 3459 - DNA, 1242 bp, Selaginella moellendorffii
ggggattccgttaaaccagacgggcttttaaaggcgagaatctgttaggagcccccattttgtggatcgatataggtagataggcgccacggcccgatccgagggctcgctggatgcgcatcggacggcgtcgcgctctacgtgcttggcaaacgcctcgccctgcctagatccgcccagggttagaagaatcattgtttagggttttgtttgcggggcatcgctcgctaggatgaacgtggcgccagtgtcgtcaaatggctacggtcagctggatgcacagatcgcgcagctgatgcagtgcaagccgctggtagaacacgaggtgcaggccctctgtgagaaggccaaagaaattttgatggaagagaacaatgtgcagccagtcaaatgtcctgtcacaatttgtggagacatacacggccagttccacgacctcgcagagctctttagaatcggtggcaagtgtccagatacaaactacttgtttatgggcgattatgtggatcgtgggtactactccgtcgagactgcaactcttttggtcgcgttgaaggtccggtatccagatcgaatcaccattttacgagggaatcacgaaagtcggcagattacgcaagtttacggtttttatgacgagtgcttgcgaaagtatgggaatgcgaatgtttggaagatcttcacagatctttttgactactttcctttgacggcattggtagagtcggaaatcttttgcttgcacggagggctttccccttcgatagatacactagatcacgtgaggcagcttgaccgggttcaagaagttccccatgaaggcccgatgtgcgacttactatggtcggacccggatgaccgttgcggctggggaatttctcctcgtggcgcgggatatacttttggacatgatatctcagaacaattcaaccatactaacaacttaaaattggttgcaagggcccatcaactagtgatggaaggttacaactggggtcatgagcacaaagtagtcactattttcagtgcgccaaattattgctatcgctgcggaaatatggcgtcgattttggaagtggatgacaacatgggccatacatttattcagtttgagcctgctccaaggcggggtgaaccagacgtgacgagaagaacgccagactatttcttgtaactggagctctaagattcaccttagaattctttttgctgagaggcccagcgattcccgacacctcgaca

SEQ ID NO: 3460 - DNA, 1200 bp, Selaginella moellendorffii
tgttaggagcccccattttgtggatcgatataggtagataggcgccacggcccgatccgagggctcgctggatgcgcatcggacggcgtcgcgccctacgtgcttggcaaacgcctcgccctgcctagatccgcccagggttagaagaatcattgtttagggttttgtttgcggggcatcgctcgctaggatgaacgtggcgccagtgtcgtcaaatggctacggtcagctggatgcacagatcgcgcagctgatgcagtgcaagccgctggtagaacacgaggtgcaggccctctgtgagaaggccaaagaaattttgatggaagagaacaatgtgcagccagtcaaatgtcctgtcacaatttgtggagacatacacggccagttccacgacctcgcagagctctttagaatcggtggcaagtgtccagatacaaactacttgtttatgggcgattatgtggatcgtgggtactactccgtcgagactgcaactcttttggtcgcgttgaaggtccggtatccagaccgaatcaccattttacgagggaatcacgaaagtcggcagattacgcaagtttacggtttttatgacgagtgcctgcgaaagtatgggaatgcgaatgtttggaagatcttcacagatctttttgactactttcctttgacggcattggtagagtcggaaatcttttgtttgcacggagggctttccccttcgatagatacactagatcacgtgaggcagcttgaccgggttcaagaagttccccatgaaggcccgatgtgcgacttactatggtcggacccggatgaccgttgcggctggggaatttctcctcgtggcgcgggatatacttttggacatgatatctcagaacaattcaaccatactaacaacttaaaattggttgcaagggcccatcaactagtgatggaaggttacaactggggtcatgagcacaaagtagtcactattttcagtgcgccaaattattgctatcgttgcggaaatatggcgtcgattttggaagtagatgacaacatgggccatacatttattcagtttgagcctgctccaaggcggggtgaaccagacgtgacgagaagaacgccagactatttcttgtaactggagctctaagattcaccttagaattctttttgctgagaggcccagcgattcccgacacctcgaca

SEQ ID NO: 3461 - DNA, 1696 bp, Tabernaemontana elegans
gcactcacccacgcacagagagagtcttggagagtggagagcggtctttcccatttaaatacgaatcgcccactctcagagggacttcgattttatcttccgaatcggagatttttatctgcattcagaagtcatcgtgttcgaattcctaagttccgatcgctctttttattgagagaaggagagaggtggaggtaacaagagcaagaggaagatgagtgcggatctggtggcgccgagcacacatggaaatctggacgagcagatttcgcagctcatgcaatgtaaacctttgtccgagacggaggttaggacattatgcgagaaggccaaagagatcctaatggaggaaagtaatgtccagcctgttagaagcccagtgaccatttgtggtgatattcatgggcaatttcatgatttggctgaactttttcgcattggagggaagtgcccagatacaaattatctttttatgggagattatgtggatcgtggatattactcggtggaaactgtaactctattagtggctctgaaggtgcggtatccccaacgaatcaccattcttcgaggaaatcatgagagccgtcagattacccaggtctatgggttttatgatgagtgtctgcgcaagtatggcaatgctaatgtctggaagattttcacagatctttttgattattttccgctgacagcattggttgaatctgaaatcttctgtttgcatggtggattatcaccatctattgaaacacttgataacataagaaattttgatcgtgttcaagaagttccccatgaaggtcccatgtgcgatctcttgtggtctgatccagatgatcgctgtggttggggtatttctcctcgtggtgctggatacacatttggtcaggacatatcagaacaattcaaccataccaacaacttaaagctgattgctagagctcatcagcttgttatggagggctataattggagccatgaacaaaaagttgttactattttcagtgcaccgaattattgctaccgatgtggaaatatggcatctatcttggaagttgatgactgcaggcaacacacgttcatccagtttgagccagctccgaggaggggagagcctgatgtgacccggagaacgcctgattatttcctgtaaagcagttgggagttgctgattagtggggtctagtagatggtttttccaaggtggttgacatgtctgtcattggaattgaagcttctccgccacaaactactaggattttcttctagtggagtcacaagtaccaagaggtgcgtaaattgatagctgagccagttgattcgtaagttatattctaaccaaaaagttggggaacgtggcacttctcaagatagtactgtattgtatcatttcatgtagggagcttacaaagctcgtccttggtagttctttggtttcatttcaatgattttttgttgttgtattcgtcctttatttttgtcccaattcttaatttcctaaaatgggttggtctgtagatgcaaagattctagatttggtctgctcttttaaaaattttccctactggtctcttggagatggtctttttgtcatttttggtatggcatgcctatttcattattgtattctttttgtcctgctacaagcaatcagagacgaaaaccctgctagtctgaagtgcagaatgagatc

SEQ ID NO: 3462 - DNA, 1454 bp, Utricularia gibba
ttgagacacagtagcttcttttacgattctttgtggggtgcaaaccaggtgcgtgaatttgagctcttaggttcaccttcgcctgaatcttgagctaggtctttttaatcaaggggagatgagcgcagatctggtggcttcgagcgcccatgggagcctggatgagcagattgcgcagctcatgcagtgcaagcccttgtccgagcctgaggtgcgggccttgtgtgagaaggcaaaggagatactaaaggaggagagtaatgttcagcccgtgaaaagcccagtgacaatttgtggtgatattcatggccaatttcacgatcttgctgaactttttcgcattggagggaagtgcccggatactaactacctgttcatgggtgattatgttgatcgtggctactattcagttgaaactgttacgcttttagttgccttaaaagtacggtattcacagaggatcactattcttcgaggcaatcatgagagtagacagataacacaagtttatgggttctatgatgaatgcctgcggaagtatggaaatgcaaatgtctggaaaatattcaccgatctctttgactattttcccttgaccgcattggttgaatcagaaatattttgtctccacggtggattgtctccctctgttgaaaccctcgataacattagaaactttgatcgagtacaagaagtccctcatgaaggcccaatgtgtgatttactatggtcagatccggatgatcgttgtggttggggcatttcacctcgtggtgctggatacacatttggccaggatatatctgagcaattcaatcacaccaacaacttgaaactaattgctagagctcatcagctggttatggaaggatacaactgggctcatgagcaaaaggttgtcaccatcttcagtgccccaaattattgctatcgttgtgggaacatggcgtcaatcctcgaggtagatgactgtggagaccacacctttattcagtttgagccagccccaagaaggggagaaccagatgtgactcgaaggacacccgattacttcctttagagcaatccatcactgagttatctgggttttatgtcgtcaagggctccgcaatcaggtttgtatcaggcgagtggtaccataagagacgaacctgcccacatgattttggagccatattctctgactcagaggtaggatggcttggaaaacagcatccctggtgtgtaacttgtcatctcttcctcaccccagatttctcgtacaataatgactgtctttttttttaatctctttttgtcaacatttcccctgatgttctttctttccatgtgtaatccccccattccaaagcctgctgtgttatttactacagggtttgtcatgtttgaaacacaggacgacttccttacagtatgattattatcattaatcaaactaaaaaaaaaaaaaaaac

SEQ ID NO: 3463 - DNA, 1333 bp, Vinca minor
cactttattaagatataacgatacggcggaggctggtggtggcgccgacgaagatgagtgcggcggatctggtggcgcctagcagcaatggaaatctggacgagcagatttctcagctcatgcagtgtaaacctttgtccgagaccgaggttagagcattatgtgagaaggccaaggagatactgatggaggaaagcaacgtccagccagtaagaagcccagtgacaatttgtggtgatattcacgggcaatttcatgatttggctgaactttttcgcattggagggaagtgtccagatacaaattatctttttatgggagattatgtggatcgtggatattattcagtggaaactgtaactctattagtggctctgaaggtgcgctactctcaaaggatcaccattcttagaggaaatcatgagagtcgtcagattacccaggtttatgggttttatgatgagtgtctgcgcaaatatggcaatgctaatgtctggaagacattcacagatctttttgattattttccactgacagcactggttgaatctgaaatcttctgtttgcatggtggattatcaccatctattgaaacacttgataacataagaaattttgatcgtgttcaagaagttccacatgaaggtcctatgtgcgatctcttgtggtctgatccagatgatcgctgtggttggggtatttctcctcgtggtgctggatacacatttggccaggatatatctgagcaattcaaccacaccaacaacttaaagctgattgctagagctcatcagctggttatggagggctataattggagccatgaacaaaaagtcgttactatctttagtgcaccaaattattgctatcgttgtggaaacatggcgtctatcttggaagtcgatgactgcaggcaacacacattcatccagtttgagccagctccaaggaggggggaacctgatgtgacccggagaacgcctgattatttcctgtaaagcacttgaggttgttgattaggtgttttttgtgtctggctgttggtttgtgtaaggcagtcgacgcgtctgtcattggaatggaagcttcttcacaacaaggtactgggattctcttctagtggtatcacaaggaccaaaaagcgtgtaaaaaatattcagcccattggaggtccaattttaaggtatattctaactgagaagttggggaagctaggcatatatctcagataatactgtattgtatcatttcatgtagaaaacttaagatctcgtcctcgttagttttcgtttcattttattaatttttttggttgtagtttgttttattctta

SEQ ID NO: 3464 - DNA, 1633 bp, Amorphophallus konjac
ttttggcaactatcgcaacagaggagaagacagagccagggggagaggatacggggggagcgagctcactctagggttcgggtttgccgggcgcgcgaagttgcgcttgcctccccccctcggcgaagaagatgagcgtggcagatccggtgccttccaactcgaatggcaacctcgacgagcagatttcgcagttgatgcaatgcaagcccctctccgagcaggaggttagagtcttatgcgataaggctaaggagatattgatggaagaaagcaatgtacagcctgtcaagagtcctgtgacaatatgtggtgacattcatggacaatttcatgaccttgcagaactattccgaattggtggcaagtgtcctgataccaattacctattcatgggggattatgtagatcgtggatattattcagtcgaaacagttacgcttctggttgcacttaaggtgcggtatccccagcgtattacaatccttcggggaaatcatgagagtagacagataacacaggtttatgggttttatgatgaatgcttacgaaaatatggtaacgcaaatgtatggaaggttttcaccgatctatttgattattttcctctgacagcactggttgaatcagagatattctgtctgcatggtggtttgtccccatcaattgagaccctggacaatgtaagaaacttagatcgtgttcaagaagttccacacgaggggcctatgtgtgacttactatggtctgatcctgatgatcgttgtggttggggtatctcccctcggggtgctgggtatacatttggccaagatatatcggagcaattcaatcataccaacaatctgaagctgattgctagagctcatcaattggtcatggatggatacaactggggacatgaacaaaaggtagtaactatatttagtgcaccaaattactgctatcgttgtggaaatatggcatccatattggaagtcgatgactgcaagggtcacacgttcatccagtttgagcctgctcctcgaaggggtgagcccgacgttacacgtagaacaccggattacttcttatgattcaactttgaaaaaggttttcctgatttccagcggcaaacaattacttgctgaatgatttggatggtagccagatattttcctgtgtttgccagatgacatctataatttggagctgctgttcttggttgttcggggggtggaatcatcattcttgatgggagatcggccgtaagttatggaatagggtttcatctgttagaagcagtgaatgaagctggcaatgcaacagcaggagcagcggcagcagcttgtattattcaagagaactcttcttttcccactctctctgctctgtttcttccttattcctattttgttttttgtcgaggaaatgactcctgttaggggtggtgcttttattaattcataattctggcttagttgatcgattttgcattcctttttactgttggtccttccccaaactcaactcactctggatgctcgcagttatctgcgacgttttcgctacggcgactcgatttttccttctcttctttcacaatgcgcattgtaacgcctaatgatttcaacgtgaatgtcgacactcgggg

SEQ ID NO: 3465 - DNA, 1700 bp, Aquilegia formosa
attttcgataaaaaggcgatcagaaaaactagatttttcttctttggttaaatcagcatcaccgctctctcgctctctctctctctctcgctagttatcgggcgcgctttctctctcttcgaggaaagacgacgtcgacgacggcttaacttatagaagaaaatttatcaaattagggttagggtttgatcttcatttgttccaattgatttgattctaaaacgattgagaagaagatgaatgtggatctagtttcttctaactctaatggcgatctcgatgagcagatttcacagctcatgcagtgtaaacctttgtccgaacaagaggtcaggacattatgcgataaggccaaggagatattaatggaagaaagtaatgtccagccagtgaaaagccctgtcacaatatgcggtgatattcacgggcaattccatgatctagcagaactttttagaattggtggaaagtgtccagatacaaactatttgtttatgggtgactatgtggatcgtggttattactcagttgaaactgtaacgcttctggtggccttgaaagttcgttactctcagcgaattacaattctcagaggaaaccatgaaagtcgtcagattacacaagtttatgggttttatgatgaatgcttacggaaatatggcaatgccaatgtgtggaaaacctttactgatctttttgactattttcctttgactgccttggtggaatccgaaattttttgtctgcatggtggattatctccttctattgagacccttgacaatatacgcaattttgaccgagttcaagaagttcctcatgaagggcccatgtgtgatttactttggtcagatccagatgaccgctgcggttggggtatttctccccgtggagctgggtacacattcggccaagacatatctgagcaatttaatcataccaacaacttgaagctgatagccagagctcatcaactagtcatggagggattcaattggggacatgaacaaaaggtggtgaccatatttagtgcacctaattattgctatcgatgcggaaacatggcatctattttggaagttgatgactgcagagggcacaccttcatccagtttgagccagctccacggaggggagagccagacgtgacacgtagaactcccgactatttcttataatagagctgcatttgagttgttgctaactttacactagacaatgtcctgcctgttgacgatcatctgttgaagatttttgttcggagctattattggtttgacattgatgatttcaaacttctatgctttgttggtggtgatggcagaggccgaaaacatgtaaaaaatggggctgtaagatccataatttggttattaggaatgtcttttgcgagaggctgtcattgcccaatccagctaaacgtactatttatttccccccttgtctttgttgtttatgtaagttttgttttgggtctgtagatgtaagctttgacaatattcagctttctttttccttgtccgcattggtgagattaaaagtcgtacgtactgagtagatgtttgtcgtgcagtgcagtttcttccctgagatgatctggagaaattatttcatggggtagatctagttggctaaagttgattcctgttttttttttttaaatagtctttttaacaagttgatttctgttacttagaatg

SEQ ID NO: 3466 - DNA, 1394 bp, Cirsium arvense
catatcaataatttcagatttctggattcaatccatttcgatcgatagaagaacgatttccttttgaaattgaaaccctagatcgaatctttgttatatgtatacacacagataacatacaaagagagaagatgagtgtggatctagcttcgaacacccatggaaacctggacgaacagatttcacagctcatgcagtgcaagcccttaatcgagcctgaggttagggcattatgtgagaaggcgaaagagatactaatgggtgaaagcaacgtccagccggtaaaaagccctgtgaccatctgtggtgacattcacggacaatttcatgatcttgctgaactttttcgcataggagggaagtgcccagatacaaattacttatttatgggcgattacgtggatcgagggtattattctgttgaaactgtcacgctcttggtggctctgaaagtgcgttatcctcagcgactcacaattctaaggggaaatcatgaaagtcgtcagatcactcaagtttatgggttttatgatgaatgtcttcgaaagtatggcaatgctaatgtttggaagacttttacagatctctttgattattttccattgactgcattggttgaatcagaaatattttgccttcatggcgggttgtcaccttcaatagaaacccttgatagcataagaagttttgaccgcgttcaagaggttccacacgaaggtccaatgtgcgatcttttatggtctgacccagatgaccgttgtggttggggaatttcaccccgtggagctggatacacctttggccaagatatatctgaacaatttaaccataccaacaacctaaagctgattgctagagctcatcaactggtcatggagggattcaactggggacatgatcaaaaggttgtgaccatctttagcgcaccaaactactgctatcgatgtgggaatatggcttctattttggaagtcgatgattgcaaggggcatacgtttattcagtttgatcctgctcctagaagaggagagcctgatgtaacgagacgaacgcctgattatttcctgtaagcaacggaaattgataacgattgctttgcttggtggtccatgatggtccttgccgggattgcgcttttgtttggtataatggtattggccaatggatatgtggttaaagttgatgaggagtgcaatgcaagggaaggaccaaatggcttgtaaaatggtttcatttttcaaattcatggttgaagggttactcatagtttgaattaagatgcatatttaaacatctgtatgctgcaattagcctttgatattttgttcattaattgtggtttatcgattaagtttgtttcataaagagaagggaccgatagatggtttattatc

SEQ ID NO: 3467 - DNA, 1348 bp, Taraxacum officinale
tcggccgggggctttcatcatcatcgtcatcactccctctataatatcaattatctgaattaatccagatccaggtaatctcaatcgatcgaaggattctttaattagaatccctgttcgtgtgtgtgtgtatatatgcataaaaatatatatacacatacagcaagatgaatgtggagctggcttcgaacacccatgggaatctggacgagcagatttcacagctcatggagtgcaaacccttaaccgaacctgaggttaggacattatgtgagaaggcgaaagagatactaatggatgaaagcaacgtacagccagtaagaagtcccgttacaatctgtggtgacattcatgggcaattccatgatcttgctgaacttttccgtattggaggaaagtgtccagatacaaattacctgttcatgggggattatgtggatcgagggtactattctgttgaaactgtcactctcttggtggccttgaaagtacgctaccctcaaagaattacaattttaagaggaaaccatgaaagtcgccagattactcaagtgtatgggttttatgatgaatgccttcgaaagtatggaaatgctaatgtttggaaaacattcaccgatcttttcgattatttcccactgactgcattggttgaatcagaaatattctgccttcatggaggattgtcaccttcaattgaaaccctagacagcataagaaactttgaccgtgttcaagaggtcccacatgaaggtccaatgtgtgaccttctttggtctgaccctgatgaccgctgcggttggggcatttcacctcgtggggccggttacacctttggtcaggatatctcagagcaattcaaccataccaacaacctaaagcttatagctcgagcacatcaacttgtcatggagggatacaattggggacatgagcaaaaggtggtgacgatttttagtgcgccaaattattgttataggtgtgggaatatggcttctattttggaggttgatgattgcaaggggcatacatttatccagtttgaacctgcgcctaggagaggggaacctgatgtaacgagaaggacaccggattattttctgtaaaagtcaagtgggagtggagtggagtgatgatacttgtgtattgtatatcagacaatgttttgagggctttttttgtcgactttctaacctaggaggattattatgtaatctatcattctcttgttttttagggttttgtgtgtgtgtgtgtgtgtgtgtgtattgaatcaatcttgttttgtgttctcgttctactttcttgaagatggttggtattgctcttccaaaaaaaaaaaaaaaaa

SEQ ID NO: 3468 - DNA, 1438 bp, Flaveria ramosissima
cacttgggggtttcattttatctccgatttcgtattcaatcgagaagcatttcgatcgattgaacgattcatcgaagtcgatctgatcattatatgcataataaagacgcataatttacatcaaatatgagtgtggatctagcttctaacacccatggaaacctcgaccaacagatctcacagctcatggagtgcaagcccttaacggagcctgaggttaagacattatgtgagaaggcaaaagagatacttatggctgaaagcaatgttcagccagtaaaaagccctgtgacgatctgtggtgatattcatgggcagtttcatgatcttgctgaacttttccgaataggagggaagtgcccagatactaactacttgttcatgggggattacgtggatcgaggatattattctgttgaaactgtcacgctcttggtggccttgaaagtgaggtatccacagcgaattacaattctaagaggaaatcatgaaagtcgtcagatcactcaagtctatgggttttatgatgaatgccttcgaaagtacggcaatgctaatgtttggaagactttcactgatctctttgactattttcctttgactgcattggttgaatcagaaatattttgccttcatggtggtttgtcaccttcaattgaaactcttgatagtataagaaactttgaccgtgtgcaagaggttccacacgagggtccaatgtgtgatcttctatggtctgacccagatgaccgttgtggttgggggatttcaccacgtggggccggatacacctttggccaagatatctctgagcaatttaatcataccaacaaccttaagcttattgctagagctcatcagcttgtcatggagggattcaactggggacatgagcaaaaagttgtcacaatcttcagcgccccaaattattgctatcgatgcggaaacatggcttctatcctggaagttgatgattgcaagggccacacttttatccagtttgatccggctcctaggagaggagaacctgatgtaaccagacgaacccctgattacttcctctaaacgtttcacttatatcgattcatggtcctctggcaagattcgggcttttgatacaatgatatgggccaaaggtcatcagggtaagcacaagaaaaggatcagatggtttgtaaaatggacattgtatgattctaggtgattggtttgttaccattctctatttcgggcctttccaaatcgtaacgggcttttatatatctgcaaagggaatgatctagaagtaattgcactcttgaaagggtttttgactagttttaatcaagatacataaattaacatttgtattaagcagtaattgcactcttgaaaggtttgttgatttgttttatgggtttagtttgttttctccagggtaagtttttcacacatagaa

SEQ ID NO: 3469 - DNA, 1144 bp, Flaveria ramosissima
tctccgatttcttattcaatcgagaagcatttcgatcgattgaacgattcatcgaaatcgatctgattattatatgcataaagacgcataatttacatcacaagatgagtgtggatctagcttctaacacccatggaaacctcgacgaacagatctcacagctcatggagtgcaagccattaacggagcctgaggttaagacattatgtgagaaggcaaaagagatacttatggctgaaagcaatgttcagccagtaaaaagccctgtgacgatctgtggtgacattcatgggcagtttcatgatcttgctgaacttttccgaataggagggaagtgcccagatactaactacttgttcatgggggattacgtggatcgaggatattattctgttgaaactgtcacgctcttggtggccttgaaagtgaggtatccacagcgaattacaattctaagaggaaatcatgaaagtcgtcagatcactcaagtctatgggttttatgatgagtgccttcgaaagtatggcaatgctaatgtttggaagacttttactgatctctttgactattttccattgactgcattggttgaatcagaaatattttgccttcatggtgggttgtcaccttcaattgaaactcttgacagtataaggaactttgatcgtgtgcaagaggtcccacatgagggtccaatgtgtgatctgttatggtctgacccagatgaccgttgtggttgggggatctcaccacgtggggcaggatacacctttggccaagatatttctgaacaatttaatcataccaacaacctcaagcttattgctagagctcatcagctggtcatggagggattcaactggggacatgagcaaaaagttgtcacaatcttcagcgccccaaattattgctatcgatgcgggaacatggcttctatcctggaagttgatgattgcaagggccacacttttatccagtttgatcccgctcctaggagaggagaacctgatgtaaccagacgaacccctgattacttcctgtgaacggttcacttatactgattcatggtcctctggcaagattcaggcttttgatacaatgatatgggccaaaggtcatcaggggaagcgcaagaaaaggataa

SEQ ID NO: 3470 - DNA, 1277 bp, Flaveria ramosissima
gggtttcattttatctccgatttcgtattcaatcgagaagcatttcgatcgattgaacgattcatcgaaatcgatctgattattatatgcataaagacgcataatttgcatcaaagatgagtgtggatcttgcttctaacacccatggaaacctcgacgaacagatctcacagctcatggagtgcaagcccttaacggagcctgaggttaagacattatgtgagaaggcaaaagagatacttatggctgaaagcaatgttcagcctgtaaaaagccctgtgacgatttgtggtgacattcatgggcagtttcatgatctcgcggaactttttcggataggagggaagtgccctgatactaactacttgtttatgggggattacgtggatcgaggatattattctgttgaaactgtcacgctcttggtggccctgaaagtgaggtatccacagcgaattacaattctaagaggaaatcatgaaagtcgtcagatcactcaagtctatgggttttatgatgagtgccttcgaaagtatggcaatgctaatgtttggaagacctttactgatctctttgactattttccattgactgcattggttgaatcagaaatattttgccttcatggtgggctgtcaccttcaattgaaactcttgacagtataaggaactttgaccgcgtgcaagaggttccacatgagggaccgatgtgtgatcttctatggtctgacccagatgaccgttgtggttgggggatctcaccacgtggggccggatacacctttggccaagatatttctgaacaatttaatcataccaacaacctcaagcttattgctagagctcatcagctggtcatggagggattcaactggggacatgagcaaaaagttgtcacaatcttcagtgccccaaattattgctatcgatgtgggaacatggcttctatccttgaagttgatgattgcaagggccacacttttattcagtttgatcccgctcctaggagaggagaacctgatgtaaccagacgaacccctgattatttcctctgaacggtctacttatactgattcgtggtcctatggaaagattcgggcttttgatacaatgatatgggccaaaattcatcaggcgaagtgcaagaaaaggataagatggtttgtaaaatggacattgtatgattctaggtgatttgtttgttatcattctctattccgggcctttccaaatcgtatcaggcttttatatatctgcaaagagaatgatttagaagt

SEQ ID NO: 3471 - DNA, 1244 bp, Vitis vinifera
ggagatctcgatctctggatctggaagaggaggaaggatgagcttcgatccggttccctcgtcgaacaatcatggcaacctcgacgagcagatatcgcagctgatgcagtgcaagccgttgtcggagcaggaggttaggatgctttgtgagaaggctaaggagatattaatggaagaaagcaatgtccagcctgtgaaaagccctgtgacaatctgtggtgatatccatggccagtttcatgatctagcggagcttttccgaattggaggaaagtgtccagatacaaattacttgtttatgggagattatgtcgaccgtggttattattctgttgaaactgtcacgctcctggtggccctaaaagtgcgctatcctcaacggattactattctaagaggaaatcatgaaagccgacagatcactcaagtttatgggttttacgatgaatgcctacgaaagtatggcaatgctaatgtttggaagatctttacagatttatttgattatttcccactgacagcattggttgaatctgaaatattttgcctgcatggtgggttgtccccatctatcgagacccttgataacatacgcaattttgaccgtgttcaagaagttcctcatgaggggcccatgtgtgatcttttatggtctgacccagatgatcgctgtggttggggtatctcgcctaggggtgctggatatacttttggccaggacatatctgaacaatttaatcacacaaacaacttgaagctgatcgctagagctcaccaactggttatggagggattcaactggggccatgagcaaaaggtggttactatatttagtgcaccaaattattgttatcgctgtgggaacatggcttccatcctggaagttgatgattgcaagggccacacattcattcagtttgagccagcaccaaggaggggagagcctgatgtaactcggagaacacctgattacttcctatgatgcatctgccactgagacctggctaactttccagtggcgactgcgctggtttaggggttgggtgctgttttcaaactttgacttattcgccatggtggtggttgtgggtggccataaaaaaagtagcggagaatgtaaaatcagcaggtaaggcttcctttgattcaattatttcccgaaactgtactgagtttcggcataaggaggcagtggagctggagaagctgtatcgcagatgtaccatttccagcagacaatgtgg

SEQ ID NO: 3472 - DNA, 1715 bp, Actinidia deliciosa
ctcccactccctcttcactctctctcccgtctctctctctcaacacactgcagcctttcgctctagactcgttcctctctccaaaggccgacgacgacggagcagcagcaggaggagaaatcgtttgttccaagaatctagggcttccgaaggatctccgatctgtgaagatgaccttcgatccggtcccttccagcactcatggcaacctcgacgagcagatctctcagcttatgcagtgcaaacctctctccgagcaagaggttagggtgttatgtgagaaggccaaggagattctaatggaagaaagcaatgttcagcctgtgaaaagccctgtaacaatatgtggtgatattcatgggcaattccatgatcttgctgagctttttcgaattggagggaagtgtccagatacaaattatttgttcatgggagattatgtcgatcgtggctattattcagtcgaaaccgtaacccttctggtggccctgaaagtccgctatccccaacgaattactattttaagaggaaatcatgagagtcgacagatcactcaagtttatgggttttatgacgaatgcctacgaaaatatggtaatgcgaatgtttggaaaatctttacagatttgttcgactattttcctcttacagcgttggttgaatcagaaatattttgtctccacggtggactttccccctccattgaaacccttgataacatacgcaactttgaccgtgttcaagaagttcctcatgaggggcctatgtgtgatcttttatggtccgaccctgatgatcgttgcggttggggtatctcacccaggggtgctggatatacttttggccaagacatatctgagcagtttaaccataccaataacttaaagctaattgctagagcacaccaactggttatggagggatttaactggggacatgagcaaaaggttgtaaccatatttagtgcacctaattattgttaccgctgtggcaacatggcttccatcctggaagttgatgactgcagaggccacacttttattcagtttgagcccgctcccaggaggggagagccagatgtaacacggagaacaccagattacttcttataatgcagttttgacttgaattattactggattcaagtggcaattgtctacctgctgggtgctattttccaaacttcagaatcacatgattttgcaaggatagtggtgggttgttacagaatgtataatcagctgataaggcttacttcgatgttcagttattacctgaaattttagcggtgaagatgctgcggcgctgttggcacattagcagcatacgtaccgtttcatggaacaatccggtattctgttctgtttcttattgtttcttgcttgttttttccttttcacccaccccgaattttttcctcctttcttgtagcagtatggttactttgggggtggggttgtgtagatgacaggagtatttattttctctctttctttcctcttcttagggatggttgcataatttttgtcccatttgaaccaactcttttctagtttggtgctttgattctagctgactcccacagtagccctcttgaacttgatgagtttagtggttctctctctttcagttacctggatgtaaaataggttcttccaaattaacatctgttcatcgaagtaactgtaaggaagtttatagtacgacttttgcat

SEQ ID NO: 3473 - DNA, 1527 bp, Plantago ovata
gggtatatgcacatttcttcatatccaatctccatttacagttctctctctttctctctctagggttacgccccatctctccgatcatttccgttttaccgaggaggaaacggcgtcgtacagacgctacaccggtggatctagtgcagctcctcgattaatttcaagatgactacggatctggtctcggcgagctcaggcgggaacctggacgagcagatttctcagctcatgcagtgcaagcctttatctgaacctgaggttagaggattatgtgagaaggcgaaagagatactgatggaagaaagtaatgtccagcctgtaaaaagcccagtaacaatctgtggtgatatccatggccaatttcatgatctcgcagaactctttcgcattggagggaagtgcccagacacaaactatctttttatgggagattatgttgatcgtggttactattcggttgagacagtcacgcttttagtggctctgaaggtgcggtatccccaacgtatcacgattctaagaggaaaccatgaaagtagacagattacgcaagtctatgggttttatgatgaatgcctgcgaaagtatggaaatgctaatgtctggaagatattcactgatctgtttgactatttccctctgactgcattggttgaatcagagatcttctgtctgcatggtggattgtccccttctattgaaacccttgataatataagaaacttcgaccgtgttcaagaagttccacatgaaggtccaatgtgtgatctcctgtggtctgatcccgatgatcgttgtggttggggcatctcccctcgtggtgctggatacacctttggccaggacatttcagaacagttcaaccactcaaacaatttgaagctaattgctagagcacaccagctggttatggaaggatataactgggcccatgaacaaaaggttgtcactatctttagtgcaccaaattattgttaccgttgtggaaatatggcatctatcctggaagttgatgattgcagagagcatacatttatccagtttgagccagcacccaggagaggtgaacctgatgtaactaggagaacaccagactatttcttgtagagagctgtcggtcgttgacccatgtccagatgtggtcagtttgaggtgcttacgtgtcattctcaagatattattgcctgcagttactagccttttccggggttggtccatattgtggagaaaggcgtgtagagttagacaaggtggacttgtcttaagttaaattctgccctattgtgagagtcaatttaggtgggaaagttggtttagagaaatctcttggtgtatgttgattttgttgccctttttcttttaatcttttgttatttcgtgttgaggaccttcattattttgacacttctatccagtgaagatgtgttctatagacccatatgaactttgtattagttgcttgatccaaattttcacctttcagtgtagtaatcctactctgatgctaatatcgtcaatattcaa

SEQ ID NO: 3474 - DNA, 1263 bp, Helianthus annuus
gcgggggtatcatccacatttcgatcatcgaaatcgatctgattattgttattatatgtatatcacaacatgagtgtggatctagcttccaacacccatggcaatctcgacgaacaaatctcacagcttatggagtgcaaacccttaaccgaaccagaggttaagacattatgtgagaaagcaaaagagatacttatgggcgaaagcaatgttcagccagtaaaaagccccgtgacaatatgtggtgacattcacgggcagtttcatgatcttgctgaacttttccgtataggcgggaagtgcccagatactaactacttgttcatgggggattacgtggatcgaggatattattctgtcgaaaccgtcacgctcttggtggctctgaaagtaaggtatcctcagcgaattacaattctaagaggcaatcatgaaagtcgtcagatcactcaagtctatgggttttatgatgaatgccttcgaaagtacggcaatgctaatgtttggaagacttttacagatctctttgactattttccgttgactgcattggttgagtcagaaatattttgccttcatggtgggttgtcaccgtcaatcgaaactcttgacagcataagaaactttgaccgtgtgcaagaggtcccgcacgagggtccaatgtgtgatcttctatggtctgacccagatgaccgttgcggttgggggatttcgccacgtggggccggatacacctttggacaggatatttctgagcaatttaatcataccaacaacctgaagcttattgctagagctcatcaactggtcatggaaggattcaactggggacatgaacaaaaagttgtgactatctttagcgcaccgaattattgctatcgatgtggaaacatggcttctatcttggaagttgatgattgcaagggccacacatttatccagtttgatcctgctcctaggagaggagaaccggatgtaaccagacgaacgcccgattattttctctgaatgattcatggtcatctgtcaagattcgggcttctgatacaactgtatgggccaaaattcatgaggtgaagtgcaagaaaaggaggaccaaatggtttgtatgtttcatttgttgaagtaatgggctttttatgtatctgcaaagggaatgaatgatttagaaggagtttttgactagtttaaactaaatttaacatttgtattaaagccatttccctctttgagaggtttgttgatttggtttatgtgtttagt

SEQ ID NO: 3475 - DNA, 1195 bp, Helianthus annuus
atcgaaatcgatctgattattgttattatatgttgtatatcacaacatgagtgtggatctagcttccaacacccatggcaatctcgacgaacaaatctcacagctcatggagtgcaaacccttaaccgaaccagaggttaagacattatgtgagaaagcaaaagagatacttatgggcgaaagcaatgttcagccagtaaaaagccccgtgacaatatgtggtgacattcacgggcagtttcatgatcttgctgaacttttccgtataggcgggaagtgcccagatactaactacttgttcatgggggattacgtggatcgaggatattattctgtcgaaaccgtcacgctcttggtggctctgaaagtaaggtatcctcagcgaattacaattctaagaggcaatcatgaaagtcgtcagatcactcaagtctatgggttttatgatgaatgccttcgaaagtacggcaatgctaatgtttggaagacttttacagatctctttgactattttccgttgactgcattggttgagtcagaaatattttgccttcatggtgggttgtcaccgtcaatcgaaactctcgacagcataagaaactttgaccgtgtgcaagaggtcccacacgagggtccaatgtgtgatcttctatggtctgacccagatgaccgttgcggttgggggatttcgccacgtggggccggatacacctttggacaggatatttctgagcaatttaatcataccaacaacctgaagcttattgctagagctcatcaactggtcatggaaggattcaactggggacatgaacaaaaagttgtgactatctttagcgcaccgaattattgctaccgatgtggaaacatggcttctatcttggaagttgatgattgcaagggccacacatttatccagtttgatcctgctcctaggagaggagaaccggatgtaaccagacgaacgcccgattattttctctgaaagattcatggtcggtcatctgtcaagattcgggcttctgatacaactgtatgggccaaaattcatgaggtgaagtgcaagaaaaggaggaccatatggtttgtatgtttcatttgttgaagtaatgggctttttatgtatctgcaaagggaatgaatgatttacaaggagtttttgactagtttaaactaaatttaacatttgtattaa

SEQ ID NO: 3476 - DNA, 2142 bp, Taxus baccata
gggggaacgcaccacgacgacgagaaggacgtcaggagttcaattctcggggagagcagagcatacgcagaagcgtagtaagcttaatatttcaattcacaggggaaaatgagcgtggagcctgtatcctctcatggcggcttcggccagctcgacctccacattgagcagcttatgcagtgcaagcccctctcggagcaagaggtccgaggattatgtgagaaggctaaggagattctgatggaagaaagtaacgtgcagccagtgaagtgtcctgttacaatctgtggtgacattcatggtcaatttcatgatcttgcagagctattccgaattggtggaaagtgtccagataccaattacttgttcatgggcgactatgtggatcgtggatactattcagttgaaactgtcactcttttagtagcattgaaggtacgatatcctcaacgaatcaccattttgcgaggaaaccatgagagtcggcagattactcaagtttatggattctatgacgagtgcttgcggaagtatggaaatgcaaatgtctggaagatatttacagacctttttgactacttcccattgacagcactggtggaatcagaaattttctgcctacacggtggtttgtcgccttccattgatacccttgataacataaggaattttgaccgtgttcaagaagttcctcatgaaggtcctatgtgtgatcttctatggtctgatccagatgacagatgcggatggggtatttctccacgtggtgcaggatatacatttggacaagatatttctgaacaatttaatcacaccaataacttaaaactgatagctagagcacatcaactagtcatggaaggctacaactgggggcatgagcaaaaggttgtcaccatatttagtgcacccaactattgctatcggtgtggtaatatggcgtctattctggaagttgatgattataaaggacacacatttattcagtttgaaccagctccaaggcgtggagagccagatgtaacacgaaggacaccggattattttttatgattctctctcacggatgtcccctgcttgcttttttttgccagcaagcctttggctgctgtttgatctttcggatctgctcttttatgaacatgtgagtgttgttgatctcaaagcttttctgagtttctagtggattacattatcttcaaattgtgctttgatcgaatgaaagaagcatgtaatatgatcaggtatattctgtagttggctgttattctagttgaaactttatttgtagggagtgcatgtgcacttccaagtgtaccaaattaaatgttgctttggtctagggaggcaatttatttccaagaaatttatttaatttaaacatttgtactgggcattgctgctgattgagtactttgccccatttcctctttggtcggtacttggggcaattgttggttccagcactaatgaacagctgcagtttcatggtgcttctaacatattcatagatttcagaatatatttacgtctgaaaacatgtatcttggtcggcctcaccttccgttgtgatgacattgaggattattacaaacacgctaaggcagttgagctcttttcccttttaatagatgccgtccatttgcaaaggacatcaaaggggaaagaatcaggacgttgacaaatgctaaactgcagatttgtgtttgtgcttttcctgttttgtgaattatatatctcaatgtttgtattttatactattctgcaaacttgtgtatgaaagcaatatcttggccttctgagccggatgggaaacaaaatggaacacaagatgtcttaatcataggaaatatttgaggttttaaattttaggaactgaaccatttctctaaaccatgcaacacaaatattgaagtcatgtatccaactactaattaacagcaagtgcatatacttctgaaatctggataatctgttgtcgaatctcccttcgtggaacctctactaaaagtgataagaccggctctttttatatttgaagtctattgtcgtgtcttgttgattgacctcatttgctaatgtaaggccaaaattattagttattatttaataccttcatgttctccaagatactgtatcttg

SEQ ID NO: 3477 - DNA, 1282 bp, Flaveria ramosissima
gggtttcattttatctccgatttcgtattcaatcgagaagcatttcgatcgattgaccgattcatcgaaatcgatctgattattatatgcataaagacgtataatttgcatcaaagatgagtgtggatctagcttctaacacccatggaaacctcgacgaacagatctcacagctcatggagtgcaagcccttaacggagcctgaggttaagacattatgtgagaaggcaaaagagatacttatggctgaaagcaatgttcagcctgtaaaaagccctgtgacgatttgtggtgacattcatgggcagtttcatgatctcgcggaactttttcgaataggagggaagtgccctgatactaactacttgtttatgggggattacgtggatcgaggatattattctgttgaaactgtcacgctcttggtggctctgaaagtgaggtatccacagcgaattacaattctaagaggaaatcatgaaagtcgtcagatcactcaagtctatgggttttatgatgagtgccttcgaaagtatggcaatgctaatgtttggaagacttttactgatctctttgactattttccattgactgcattggttgaatcagaaatatttttgccttcatggtgggctgtcaccttcaattgaaactcttgacagtataaggaactttgaccgcgtgcaagaggttccacatgagggtccgatgtgtgatcttctatggtctgacccagatgaccgttgtggttgggggatctcaccacgtggggccggatacacctttggccaagatatttctgaacaatttaatcataccaacaacctcaagcttattgctagagctcatcagctggtcatggagggattcaactggggacatgagcaaaaagttgtcacaatcttcagcgccccaaattattgctatcgatgcgggaacatggcttctatcctggaagttgatgattgcaagggccacacttttatccagtttgatcccgcacctaggagaggagaacctgatgtaaccagacgaacccctgattacttcctgtgaacggttcacttatactgactgattcatggtcctttggcaagattcgggcttttgatacaacgatatgggccaagattcatcaggtgaagtgcaagaaaaggatcagatggtttgtaaaatggacattgtatgattctaggtgatttgtttgttaccattctctatttcgggcctttccaaatcgtaacgggcttttatatatctgcaaagggaatgatctagaagt

SEQ ID NO: 3478 - DNA, 1474 bp, Rosmarinus officinalis
ccccctcccaaccatactcacgcacagagagacgtgtagtcttggagaggggagagcggtcttttccatttaaatacgaatcacacactctcagacggacttcgattttatcttcggagtcggagatttccatctgcttccagaagtcgtcgtgttcgaattcccaagttccgatcccactttattgagagaaggagagagagggtggtggccagaggaagaggaagatgagtgcggatctggtggccccgagcacacatggaaatctggacgaccagatttctcagctcatgcagtgtaaacctttgtccgagacggaggttagaacattatgcgagaaggccaaagagattctaatggaagaaagcaacgttcagcctgtaagaagtccagtgaccatttgtggtgatattcatgggcaatttcatgatttggctgaactttttcgcattggagggaagtgtccagatacaaattatctttttatgggagattacgtggatcgtggatattattcagtggaaactgtaacactattagtggctctgaaggtgcgctaccctcaacgaattaccattctgcgaggaaatcacgagagtcgtcagattacccaggtttatgggttttatgatgagtgtctgcgcaagtatggcaatgctaatgtctggaagatattcacagatctttttgattattttccactgacggcattggttgaatctgaaatcttctgtttgcatggtggattatcaccatctattgaaacactcgataacataagaaattttgatcgtgttcaagaagttccccatgaaggtcctatgtgtgatctcttgtggtctgatccagatgatcgctgtggttggggcatctctcctcgtggtgctggatacacatttggccaagacatatctgagcaattcaaccataccaacaacctaaagctgattgctagagctcatcagctagttatggagggctataattggagccatgaacaaaaagtcgttactattttcagtgctccaaattattgttaccgttgtggaaacatggcgtcaatcttggaagtcgatgactgcaggcaacacacatttatccagtttgatccagctccaaggaggggagagcctgatgtgacgcggagaacgcctgattatttcctgtaaagcagttgagcatgctgatttattgtgtctagctgatggttttttctaaggtggttgacacgtctgtcattgaaattgaagcttcttcaccacaaactactaggattctcttctagtggtgtcacaaggaccgagaggcgtgtaaaaaatattagtcgagtggaggtccagttgattcttaagttatattctaaccgagaagttggggagctgggcacatctcagataatactctgtattgtatcattttatgtagagaactcagaatcttgtccttggtagctctttgtttccattttagtaaa

SEQ ID NO: 3479 - DNA, 1169 bp, Centaurea maculosa
acggtttttcgagggttttcttctcctccgcgcccatcgtcatcatcatcaccaccatctccactccctttgatctcatcaatctctgaatgtttttcagtttgagataataatttcaatagatcaaaaggattttaacatctgaatcctttattgttcccctgtgtgtatatatatacatatatgcacaaaagtatccatatacatatatagcaagatgagtggggagctagcttcgaacacccatgggaatctggacgagcagatttcacagctcatgcagtgcaaacccctaaccgaacccgaggttaggacattatgtgacaaggcgaaagagatattgatggatgaaagcaatgttcagccagtaaaaagtcctgtgactatctgtggtgacatccatggacaattccatgatcttgctgaactttttcgtattggaggaaagtgcccggatacaaattacttgtttatgggtgattacgtggatcgagggtattattctgttgaaactgtcacgctcttggtggctctgaaagtacggtatcctcagcgaattacaattttaagaggaaatcatgaaagtcggcagattactcaagtctatggattttatgatgaatgccttcggaagtatggcaatgctaacgtctggaagacttttacagatctgttcgactatttcccattaactgcattggttgaatcggaaatattttgcctccatggtgggttgtcaccttctatcgaaacccttgatagtataagaaactttgatcgtgtccaagaagttccacatgaaggtcccatgtgtgatcttctatggtctgacccagatgaccgttgtggatggggcatctcaccccgtggagctggttacacctttggtcaagatatctctgagcagtttaaccataccaacaacctcaaacttattgctagagctcatcaattggtcatggaaggattcaattggggacatgatcaaaaggtcgtgaccatctttagtgcgccaaattattgttataggtgtgggaatatggcgtccatcttggaggtggatgattgcaagggccacacttttattcagtttgaacctgctccgaggagaggagaacctgatgtaacgagaaggacacccgactatttcctgtaaggttgagtagcta

SEQ ID NO: 3480 - DNA, 1333 bp, Centaurea maculosa
tcatcaccaccaccaccatcttcactccctttgatctcatcaatctctgaatgtttttcagataaattttcaatagatcaaaaaggattttaacatctgaatccttttttgttcccctgtgtatatatatatgcacaaaactatccatatatatatacatatatagcaagatgagtggggagctagcttcgaacacccatgggaatctggacgagcagatttcacagctcatgcagtgcaaacccctaaccgaacccgaggttaggacgttatgtgacaaggcgaaagagatattgatggatgaaagcaatgttcagccagtaaaaagtccggtgactatctgtggtgacatccatggacaattccatgatcttgctgaactttttcgtattggaggaaagtgcccggatacaaattacttgtttatgggcgattacgtggatcgagggtattattctgttgaaactgtcacgctcttggtggctctgaaagtacggtatcctcagcgaatcacaattttaagaggaaatcatgaaagtcggcagattactcaagtctatggattttatgatgaatgccttcggaagtatggcaatgctaacgtttggaagacttttacagatctgttcgattatttcccattaactgcattggttgaatcggaaatcttttgcctccatggtgggttgtcaccttctatcgaaaccctagatagtataagaaactttgatcgtgtccaagaggttccacacgaaggtcctatgtgtgatcttctatggtctgaccctgatgaccgttgtggatggggcatctcaccccgtggagctggttacacctttggccaagatatctctgagcagtttaaccataccaacaacctcaagcttattgctcgagctcatcaattggtcatggaaggattcaattggggacatgatcaaaaggtcgtgaccatctttagtgcgccaaattattgttataggtgtgggaatatggcgtccatcttggaggtggatgattgcaagggccacacttttattcagtttgaaccagctccgaggagaggtgaacctgatgtaacgagaaggacacctgactatttcctgtaaggttgagtagcgctgctaatgggatgacttgaagtttgttagttgatagaaggaaggtaagagaagtggttggttgtattttggacatgtttttgatttgaagtgaaacatatctaactctaggaaggaaggaaatggattatgttgttgagggtgtgtgtgtgtaatctatgattattttggtctcttaggttttgtgtgtgtatgtatatcgaccgatgact

SEQ ID NO: 3481 - DNA, 1417 bp, Castanea mollissima
ctccacgcgctgttccatttcgactctactgcatctgcaggagcagagagagagagagagagagagcgagcaaggacaggacagagaatatctcaattctagggttagggttttcccttataatcttaacctggtccgatttcgaatccagaggaagatgggcgtcaattcgttgccatcggaatcgagcaacgatctcgacgagcagatcgctcagctcatggaatgcaaaccactctcagagcaacaggttagagctttgtgtgagaaggctaaggagatactaatggaagaaagcaatgtccagcctgtgaaaagccccgttacaatttgtggcgatattcatgggcagtttcatgatcttgctgaactttttcgaattggagggaagtgtccagatacaaactacctctttatgggagattatgtggaccgtgggtattattctgttgaaactgtgacgctcttggtggccctgaaagtgcgttattctcagcggattactattcttagaggaaaccatgaaagtcgtcagattactcaggtttatggattttatgatgaatgtttgcgaaagtatggcaatgctaatgtgtggaagatctttacagacctttttgactatttcccattgactgccttggttgagtcagaaattttttgtctgcatggtgggctgtcaccttcaattgaaaccctcgacaacgtaaggaattttgatcgtgttcaagaggttcctcatgaaggacccatgtgtgatttgttatggtctgacccagatgaccggtgtggttggggtatttcacctcgtggtgctgggtatacttttggacaggatatatctgaacaattcaaccatacaaacaacctaaagttgattgctagagctcatcaattggttatggatggatttaactgggcccatgaacaaaaggtggttactatatttagtgcacccaattattgttatcgctgtgggaacatggcttctatattggaagttgatgactgcagaagccacacgttcatccagtttgagccagctcctaggagaggagaaccagatgttacccgcagaacacctgattatttcctataaaacagctgtctttgtgtcataatgataactggttccttaccaaactagatattctcattactctgctctgcacccgtgtgtgggagatataaaatttatgacttcttccttgccatgcttttctggtggtggttgtgggagcccagtaagatgtattataggcaggtaaaatgctcactgattttgtcttgcactttaaaccttgctggatttcctgtcagagagattgcctagctgacagcatggagtgcgaaatgtattatttctactagaagcgtcaatatactttttgtttttgggtttccaagaatgattggc

SEQ ID NO: 3482 - DNA, 1192 bp, Cirsium arvense
tactccctttcgtatctctaaatactctgtaatgtttttctagataaattttactaatagatacaaaaaggaattttaactatctgaatcctttttgtttccccctcgtgtatatatatatatatatgcacaaaactatccatatacatatataatagcaagatgagtggggagctagcttcgaacacccatgggaatctggacgagcagatttcacagctcatgcagtgcaaacccctaaccgaacccgaggttaggacgttatgtgacaaggcgaaagagatattgatggatgaaagcaatgttcagccagtaaaaagtccggtgactatctgtggtgacatccatggacaattccatgatcttgctgaactttttcgtattggaggaaagtgcccggatacaaattacttgtttatgggcgattacgtggatcgagggtattattctgttgaaactgtcacgctcttggtggctctgaaagtacggtatcctcagcgaatcacaattttaagaggaaatcatgaaagtcggcagattactcaagtctatggattttatgatgaatgccttcggaagtatggcaatgctaacgtttggaagacttttacagatctgttcgattatttcccattaactgcattggttgaatcggaaatattttgcctccatggtgggttgtcaccttctatcgaaaccctagatagtataagaaactttgatcgtgtccaagaggttccacacgaaggtcctatgtgtgatcttctatggtctgacccagatgaccgttgtggatggggcatctcaccccgtggagctggttacacctttggccaagatatctctgagcagtttaaccataccaacaacctcaagcttattgctcgagctcatcaattggtcatggaaggattcaattggggacatgatcaaaaggtcgtgaccatctttagtgcgccaaattattgttataggtgtgggaatatggcgtccatcttggaggtggatgattgcaagggccacacttttattcagtttgaaccagctccgaggagaggagaacccgatgtaacgagaaggacacccgactatttcctgtaaggttgagtagcgctgctaatgggatgacttgaagtttgttagttgatagaaggtaagagaagtggttggttgtattttggacatgtttttg

SEQ ID NO: 3483 - DNA, 1250 bp, Cirsium arvense
ctccctttgatctcaaatctctgaatgtttttcagataaattttcaatagatcaagaaggattttaacatctgaatccttttttgttccccctgtgtatatatacatatatgcacaaaactatccatatccatacacatatatagcaagatgagtggggagctagcttcgaacacccatgggaatctggacgagcagatttcacagctcatgcagtgcaaacccctaaccgaacccgaggttaggacattatgtgacaaggcaaaagagatattgatggatgaaagcaatgttcagccagtaaaaagtcctgtgactatctgtggtgacatccatggacaattccatgatcttgctgaactttttcgtattggaggaaagtgcccggatacaaattacttgttcatgggggattacgtggatcgaggatattattctgttgaaactgtcacgctcttggtggctctgaaagtacggtatcctcagcgaattacaattttaagaggaaaccatgaaagtcggcagattacccaagtctatggattttatgatgaatgtcttcggaagtatggcaatgctaacgtctggaagacttttacagatctgttcgattattttccattaactgcattggttgaatcggaaatattttgcctccatggtggattgtcaccttctatcgaaacccttgatagtataagaaactttgatcgtgtccaagaggttccacatgaaggtcctatgtgtgatcttctatggtctgacccagatgaccgttgtggatggggcatctcaccccgtggagctggttacacctttggtcaagatatctctgagcagtttaaccataccaacaacctcaagcttattgctcgagctcatcaattggtcatggaaggattcaattggggacatgatcaaaaggtcgtgacgatctttagtgcgccaaattattgttataggtgtgggaatatggcgtccatcttggaggtggatgattgcaagggccacacttttattcagtttgaaccagctccgaggagaggagaacccgatgtaacgagaaggacacccgactatttcctgtaaggttgagtagcgttgctaatgggatgacttgaagtttgttagttgatagaaggaaggtaagagaagtggttggttgtattttggacatgtttttgatttgaagtgaaacatatctaactctaggaaggaaggaaatggattatgttgttgagggtgtgtgtg

SEQ ID NO: 3484 - DNA, 1346 bp, Gossypium hirsutum
aaactttttttctctccactaaactaaaaaatctctttgaaattttataattctgggggaaattttcgtaatctagggttaggattttaaataaaaaagagaaagaaaacatgacgtcttcggtggattcaaactcacatggaaacctagacgagcagatttcgcagttgatgcagtgcaagcccttagcggagcaagaggttagggtattatgtgataaggctaaggagatactgatggatgaaagcaatgttcagcctgtgaaaagtcctgttacaatatgtggtgatattcatgggcaatttcatgatcttgcagagctttttcgaattggggggaagtgtccagatacaaattacttgttcatgggagattatgttgatcgtggttactattcagttgaaactgtaacactcttggtagctctcaaagtgcgttacccccaacggataactattctgaggggaaatcatgagagccgtcagattactcaagtgtatgggttttatgatgagtgcctaaggaagtacggcagtgccaacgtttggaagatcttcactgatctgtttgattattttccactaacagcattggttgaatctgaaattttctgtctccatggtgggttatctccatccattgaaacactggataacatacgaaactttgaccgtgttcaagaagttcctcatgagggtcctatgtgtgatcttttgtggtctgaccctgatgatcggtgcggatggggcatttcacctaggggtgccggatatacctttggccaagacatatctgagcaatttaaccatacaaacagtttgaagctgattgctagggctcatcagctggtcatggaaggatacaattggggtcatgaacaaaaggtcgttactatatttagtgcgccaaattattgctatcgatgtggaaacatggcctccatcttggaagtagatgattgccagggtcatacattcattcagtttgagccggctccaaggagaggagagccagatgtgacccggaggacacccgactacttcctataaaaacaaactggcattgaatcaacgagtctccagcgattggtccctgtcaatgggcttttccgggcggttgggtggcagcaaagccatcgtataaggctgatcacactgatgagaatccatggcagaaaaaaggatcaccgcaagagctggtaacacaagcatatgtaccatttccagcaaacaatgagacaatttatttattttccattgattttaatttttgtttttttgaggcttgggaagatctgtagaagaaagatgccgagaacatttgccctataattaatgctttttttt

SEQ ID NO: 3485 - DNA, 1604 bp, Eucalyptus grandis
ctcacgcgcctctcgctggtcccctccccttcccttcccttcccgtgctgcgcattggttcgctcgctccctcgctcgctgcgaatcgggggggaacaaagcggagcgaaaggttagggcaccgctccccctgatccgatcccgccgtccgtccccccgcttcaccggcgcgtggatcccgggctctccccggagccgccggagccgaagagatgggcgccaactccccgtcctccgatgcgggcttcgatctcgacgggcagatcgcgcagctcatgcagtgcaagcccctctccgagcaacaggttaaagctttatgtgagaaggctaaagagatactgatggaagagagcaacgtccagcctgtaaaaagccccgtaacaatttgtggtgacatccatgggcagtttcatgatcttgctgaactttttcgaattgggggagagtgtccagataccaattacttgttcatgggtgattatgtggaccgtggatattattctgtcgaaactgtaacactattagtggccttgaaagtacgatatcctcagcgaattactatccttagagggaatcatgaaagtcgtcagattactcaagtttatggtttttatgatgaatgcttaaggaagtatggaaatgctaatgtttggaagatatttacagatctgtttgactattttccactgacagcattggttgagtcagagattttttgcctgcatggcggattatctccttcaattgaaactcttgacagcattaggaactttgatcgcgttcaagaggtacctcatgaaggaccgatgtgtgatctactatggtcagatcctgatgatcgatgtggttggggcatttcacctcggggtgctggttatacttttggccaggatatatctgaacaattcaatcacacaaacaacttaaagctgattgctagagctcatcagctggtcatggatggatttaactgggcacatgaacaaaaggttgtgactatatttagtgcacctaactattgttatcgctgtgggaacatggcttccatcttggaagttgatgacttcaagggccacacatttatacagttcgagccagctcctaggagaggagaaccagatgtcacccgcagaacacctgattacttcctctgaagtcactccactgtgtaactgattttttactcatgcctttccacggagtgtctggaggccgttgatcctgctgggagctaggtcaggttgcaaattcttaagttctcccttcgcattagcaggcgttgctcttaccatatgaactatttatgatatgataacacagcaggtttgcttaactggctatcttgggtcagtgtataaggaacaggttgaagatgtggatagtaagtgtgtaatttgttatggctttctaagttttgctcaatgcaatctattgttaagttataggattgagtgaaccctgtgaatagtaaatgtgtctcacttttgtagttcatttactagagcagtgggttgtcgtgatcaaaacatgaatttgtcgagaactcctaattttatgcagttgttttcacctttactttatttaaaatgctattttggttcttt

SEQ ID NO: 3486 - DNA, 1578 bp, Euonymus alatus
cggccgggggaagacgttacttattcacaaaaaaaaatactttggtttctccaccaccgctccttctctttctctgtttctttcactctctctctctagattacactttctacccctagagattcagagaaatctagggtttgcctttttcatctctgttggggattagtggtcgtggagtgtaggtgtaggattacgtaattcgaagagatctcgatccgtttttggagtattagcggaagatgagtttggattcggtcccttccaactctcatggaaacctggacgaacagatttcgcagctcatgcagtgcaagcccctttcggagcaagaggtcagggtgttgtgtgacaaggctaaggagattttaatggtcgaaagcaatgttcagccggtaaaaagccctgttacaatttgtggtgatattcatgggcaatttcatgatcttgctgagctttttcgcattggagggaagtgcccagatacaaactatttgttcatgggagactatgttgatcgtggctactactctgttgaaactgtaacactgttggtagcgttgaaagtgcgctatcctcatcgaattactattctgagaggaaatcatgaaagtcgtcagattactcaagtatatgggttctatgatgaatgcctgcggaagtatggcaatgccaacgtgtggaagaccttcactgatctctttgactattttccactgacagcattggttgaatcagaaatattttgtctgcacggtggattgtctccttccattgaaactcttgataacatacgtaattttgaccgcatgcaagaagtacctcatgatggtccaatgtgcgaccttctttggtccgacccagatgatcgttgtggctggggtatgtcacctagaggtgccggatatacttttggccaggatatatctgaacagtttaatcacacaaataacttaaagctgattgcgagggctcaccaattggttatggaaggatacaattggggtcatgaacaaaaggtggtaactatattcagtgcgcctaactactgttatcgatgtggaaacatggcatctatccttgaagttgatgactgcaagggacacacatttatccagtttgagcctgctcctaggaggggagagccagatgtgacccggaggactcctgattacttcctatgatgaaattgacatcggtgttaccgtattcatggcagccagtctccactagctgttttacttcttgaaaggtattttaaaactactacaacttccttctggtagtggttgggcagcaaaatacatgtaagacgggcaggtgaggcttcgttgatttgattgtttatttcaattggcgagttttccgcaaaggggaagcagcggagctggtcatgccgtagcagcatgtgtataatttttcatcgaacattatggtatcttcaatttgttgttgttttttgttcttctagagtggttgttaggccatggaatttgtagatggaggaccaacatttcttgtaatgggtaataggttcttttacgattggaataatactactcttaatcttgattcatg

SEQ ID NO: 3487 - DNA, 1541 bp, Euonymus alatus
agatttccactttctccctctagagattcagagaaatccagggtttgccgtttcatttctgctggggattagtcgtcccggagtgtaggtttagcattacggaattcgaagggatctcgatctgttgttggagtatttgcggaagatgagtttggattcggtcccttcgaactctcatggaaacctggacgagcagatttcgcagctcatgcagtgcaagcccctctcggagcaagaggttagggtgttgtgtgataaagctaaggagattttaatggaggaaagtaatgttcagcctgtgaaaagccctgttacaatttgtggtgatattcatgggcaatttcatgatcttgcggagctttttcgcataggagggaagtgccctgatacaaactatttgttcatgggagactatgttgatcgtggttactactctgttgaaactgtaacactgttggtagcattgaaagtgcgctattctcaacggattactattctgagagggaatcatgaaagtcgtcagattactcaagtatatgggttctatgatgaatgcctgaggaagtacggcaatgccaacgtgtggaagatcttcactgatctctttgactattttccactgacagcattggttgaatcagaaatattttgtctccatggtggattgtccccttccatcgaaacccttgataacatacgtaatttcgaccgtgtgcaagaagtacctcatgaaggtccaatgtgtgaccttctttggtctgacccagatgatcgttgtggctggggtatgtcacctagaggtgctggatatacttttggccaggatatatctgaacaatttaatcacacaaataacttaaagcttattgcaagggctcaccaattggttatggaaggatacaactggggtcatgaacaaaaggtggtaactatattcagtgcgcctaactactgttaccgatgtggaaacatggcatctatccttgaagttgatgactgcaagggacacacatttatccagtttgagcctgctcctaggaggggagagccagatgtgacccggaggactcctgattacttcctatgatgaaattgacaccagtgttttaccatattcatagcagctggtatccagtggctgttttacttgtcgacagttattataaatctgagaccacattctggtagtggttggacagcagaatagaagtaagatggggaggtgaggctttgttgatttgaattggttgatttttccacaaaggagaagcagcggaactggtcatgccgcagcagcatatgtacaattttcagcaaacaagatggtatctttagtttcttggttgttttttttgtccattttttgttcgttcctctaggttggctgttgggccattgaatttgtagcgggaagaccaacttttcttgtaatgggtgataaataggtgcttctgttacttttcaactctattcttgatttctgagtcttgatggtttttgctggaagattttattttctatatgatagtagaaaaactttt

SEQ ID NO: 3488 - DNA, 1505 bp, Gossypium raimondii
caaaaaggagagaaaaggcttcatctctctcttcatcaaagcattgggctcttcaccaacgcttcgttttcatttcagttcccttttttaaactttttttctctccacgaaactaaaaaatctctttgaaattttataattttgggggaaattttcgtaatctagggctaggatttttaaataaaaaagaaaaaaaaaacatgacgtcttcggtggattcaaactcacatggaaacctagacgagcagatttcgcagttgatgcagtgcaagcccttagcggagcaagaggttagggtattatgtgataaggctaaggagatactgatggatgaaagcaatgttcagcctgtgaaaagtcctgttacaatatgtggtgatattcatgggcaatttcatgatcttgcagagctttttcgaattggggggaagtgtccagatacaaattacttgttcatgggagattatgttgatcgtggttactattcagttgaaactgtaacactcttggtagctctcaaagtgcgttacccccaacggataactattctgaggggaaatcatgagagccgtcagattactcaagtgtatgggttttatgatgagtgcctaaggaagtacggcagtgccaacgtttggaagatcttcactgatctgtttgattattttccactaacagcattggttgaatctgaaattttctgtctccatggtgggttatctccatccattgaaacactggataacatacgaaactttgaccgtgttcaagaagttcctcatgagggtcctatgtgtgatcttttgtggtccgaccctgatgatcggtgcggatggggcatttcacctaggggtgccggatatacctttggccaagacatatccgagcaatttaaccatacaaacagtttgaagctgattgctagggctcatcagctggtcatggaaggatacaattggggtcatgaacaaaaggtcgttactatatttagtgcgccaaattattgctatcgatgtggaaacatggcctccatcttggaagtagatgattgccagggtcatacattcattcagtttgagccggctccaaggagaggagagccagatgtgacccggaggacacccgactacttcctataaaaacaaactggcattgaatcaacgagtctccagcgattggtccctgtcaatgggcttttccgggcggttgggtggcagcaaagccattgtataaggctgatcacactgatgagaatccatggcagaagaaaggatcaccgcaagagctggtaacacaagcatatgtaccatttccagtaaacaatgagacaatttatttattttccattgattttaatttttgtttttttgaggcttgggaagatctgtagaagaaagatgccgagaacatttgccctataattaatgctttttttttcgactattgaacagttcgtaatatcggacactaatccgagcaattgcattttatatagatgtgttttt

SEQ ID NO: 3489 - DNA, 1219 bp, Heritiera littoralis
atttgggaaattttgggaatctaggtttaggaataattgaaggaagatggagtcttctgtgggttctaactcccatggtaacctggacgaacagatttcacagctgatacaatgcaagccaatatcggagcaagaggttcgggtgttatgtgacaaggctaaggagatactgatggaggaaagcaatgttcagcctgtcaaaagtcctgttacaatatgtggtgatattcacgggcagtttcatgatcttgcagagctttttcgaattggagggaagtgtccagatacaaattacttgttcatgggagattatgtcgatcgtggttactattcagttgaaactgtaacactcttggtagctctcaaagtgcgttacccccaacggataactattcttaggggaaatcatgagagccgtcagattactcaagtgtatgggttttatgatgagtgcctaaggaagtatggcaatgccaatgtttggaagatctttactgatctgtttgattattttccactaacagcattggttgaatctgaaattttctgtctccatggagggttgtctccatccattgaaaccctggataacatacgtaattttgaccgtgttcaagaagtcccacatgagggtcccatgtgtgatcttttgtggtctgaccctgacgatcgttgtggttggggtatatctccaaggggtgctggatatacttttggccaagacgtatctgagcaatttaaccatacaaacaatttgaagctgatcgcaagggctcatcagctggtcatggagggatacaattggggtcatgaacaaaaggttgttactatatttagtgcacctaattattgctatcgatgtggaaacatggcttccattctagaagttgatgattgcaagggtcatacatttattcagtttgagcccgcaccaaggagaggagagccagatgtaacacggaggacacctgattacttcctataaaacaaactggcattgagttgatgagtctctgatggccaatgcccgatgtggatggatgggctgcggtgagggctttttcaaattcaagacaagattcctaattcacaaaggtggtggttggttggcggcaagcttgttgtatatggttgatgaggcttccttgtagaggcatatgtaccttttcagtagacaatttgacgctattacttatttaccttgattttaatttttgtt

SEQ ID NO: 3490 - DNA, 1589 bp, Cucumis melo
ggggacataaccaaatttaactttgatttttccatcttttctttttagtaaattagaggggaagaggacggggaagaagaagacggagtctttttctagggttttccgacggatcttttacggctcacgaaatcctatgaacttgaagggagcaccaccgaatcggcgggatcttgatctgtaattgccttcgctattggagtgaagaaatcaccagaaccaatctaggggaaatcatggattccgtttcttctaactcccacggaaatctggacgagcagatttcccagctcatgcagtgcaagcccttgaacgagcaggaggtaagagtattgtgtgagaaagctaaggagatacttatggacgagagcaatgttcagcctgttaaaagtccggtaacaatatgtggtgatattcacgggcaatttcatgatcttgcagaactctttcgcattggagggaagtgtccagatacaaattacttgtttatgggagattatgttgatcgtggctactactcagttgaaactgttacacttttagtggcccttaaagtccgatatcctcaacgcatcacaattcttagaggaaatcatgaaagtcgtcagataacacaagtttatgggttctatgacgaatgcttgagaaagtatggcaatgctaatgtttggaagatttttactgacctgttcgactattttccgttgacagcactggtggaatcagaaatattctgtctgcatggtggtttgtcgccatccattgaaaccctcgacaatatacggaattttgatcgtgttcaagaagttcctcatgaaggtcccatgtgtgatctcttatggtctgacccagatgatcgatgtgggtggggaatttctccaagaggtgctggatatacctttggtcaggacatatctgagcagtttaaccatagtaataatttaaagttgattgcaagagctcatcagctagtgatggaaggctataactggagtcatgaacaaaaagttgtgactatatttagtgcgcctaattattgttaccgctgtggaaatatggcatcaattttggaagttgatgactgcaaggcgcacactttcattcagttcgaaccagctccaaggaggggtgaaccggatgttactcgaagaactcctgattacttcttatgatgcgcctattgtcagacgaaaatttctagctgcaggtttatgttttggctgttttttacattggagaattttagttttccctttggtggtggggaaagacaaaagcatgtaaatttcgatagggtgctttcaggatggtggactccatccttgcaaatctcaaggttttgctgaaggaaagctatagggctggcgacctgttaactgcatacgtaacatctccagagaacaatgtattgttgcatccctttctttcttccttccttccttttctttctttttctctctttttttttatttttttttatttttagtaatttgtttcgtgcaattttcctatcctttggttcacgggttctctgtgcttttctgtttaactgttttgtaggataggaaaattgcacgaaacaaattact

SEQ ID NO: 3491 - DNA, 1439 bp, Momordica charantia
gtaattagaagaggacggggaagaagacggagtccttttctagggttttccgacggatcttttagggctcacgaaattctatgacttgaggacaccaccaccgaatcggccggatcttgatctgtgattgccttcgttattggagagaacaaccaccaccaccacacacgcgggggaaaatcatggattcgctttctttcaactcccatggaaatctggacgagcagatttcgcagctcatgcagtgcaagcccttgaacgagcaggaggtaagagggttgtgcgagaaagctaaggagatattaatggacgagagcaatgtccagcctgttaaaagtccggtaacaatatgcggtgatattcacgggcaatttcatgatctggcagagctttttcgcattggtgggaagtgtccagatacaaattacttgtttatgggagattatgttgatcgtggctactactcagttgaaactgtaacgcttttagtggcactcaaggtgcgatatcctcaacgcattacaattcttagaggaaatcatgaaagtcgccagataacacaagtttatgggttctatgatgaatgcttaagaaagtacggcaatgctaatgtttggaagatttttactgacctgtttgactatttcccgctgacagccctggtcgaatcagaaatattctgtctgcatggtggtttgtctccatccattgaaaccctcgacaacattcggaattttgatcgtgttcaagaagttcctcatgaaggtcccatgtgcgatctcctatggtctgacccagatgatcgatgtggttggggaatttctcctagaggtgctggatatacctttggtcaggacatatccgagcaatttaaccatagtaataatttaaagttgattgcaagagctcatcaactagtgatggaaggatataactggagtcatgagcaaaaagttgtgactatatttagtgcacctaattattgttatcgctgtgggaacatggcatcaattctggaagttgatgactgcaaggcgcacaccttcatccagtttgaaccagctccaaggaggggtgaaccagatgttactcgaagaactcccgactatttcttatgatgcggctattgtcaaatgaaaatttctagcagcagccgtttccaaacatatgttttggctgtttttgcattggagaatttcagtttccctatggtgggatgggtggttcgggggccaaaagcatgtaaatttcggcaggttgcttcaggagggagtgcatccttgaaacattctcaaggttttgcagaaggaagctatagggctggcgactgattaactgcatatgtaacatctccagagaacaatgtattgaacctttttatttttttagtaatttgtttcatgtaattttctttccctttcctttggttcacgagttcg

SEQ ID NO: 3492 - DNA, 1459 bp, Nicotiana benthamiana
tctcctctctcctctctctctgtagagctgagagaaaatcaaatcaaatcaaaccccctttgatttgacccccttttcctctagggtttctgcacaaatttccctccagaagcagtaaaaaagaagatcaatcagcaatggatccggtgccatcgagcgcatctcatggaaatcttgacgaacaaattgctcagcttatgcagtgcaaacccttgtctgaacaggaggtaagagggctatgtgagaaagcgaaggagattctaatggaagagagcaacgtgcagcctgtgaaaagccctgtgactatatgtggtgatattcatggtcagttccatgatcttgcggagctttttcgaattggtggaaagtgtcctgacactaattatttattcatgggagattatgtggatcgtggatactattctgttgaaacagtaacgcttttggtggctctcaaagtgcgctatccccagcgaattacaatcctaaggggtaatcatgagagtcgccagattactcaggtttatgggttttatgatgaatgcctacggaaatatggtaatgccaatgtgtggaagactttcacagatctgtttgactactttccgctgactgctttggttgagtcagagattttttgcctccatggtggtctgtctccatctattgaaactcttgataatattcgcaattttgaccgtgtacaagaagttccacatgagggtgctatgtgtgatcttttatggtctgatcctgatgatcgttgtggttggggtatctcacctaggggtgctggatatacatttggccaagatatctctgagcagtttaatcacaccaacaacttgaagctaattgctagagcacaccagctggttatggagggattcaattgggcccatgatcaaaaggtggttaccatctttagtgcacctaattattgttaccgttgtggcaatatggcatccatcttggaagttgatgattccagggagcgcacattcattcagtttgaaccagctccaaggagaggggagccagatgtaacccgaagaacacctgattatttcttatgatgcaaatgcacaaacctcttgatttttgtgcagaaggccctgctaactgctttatatgctacgagcctcttaccagttagtagtttttttcccgctatggtggggctactactatgaaatgaagcatgtgatactgaaacctcattgagatgctgtggagagatggtgaagtcagtgacagagggtgcatgtatcatttttgcgcagacaatatttttttccctttgatcctataatttttggttagatagaaaggacaatgatttgcttggtgataattcttgtccctttacaaggacaatccctgtcatataagctttgtaggggtaagatgattatttgttaaccacctttgaatgagtgctcgtgtagttttctatgag

SEQ ID NO: 3493 - DNA, 1632 bp, Quercus alba
atggggctccacgcgctttcccatttcgactctactgcatctgcaggagcagagagagaggagagagagagagagagagcgagcaaggacaggagagagaaaatctcaattctagggttagggttttcccctataatcttcacctggtccgatttcgaatccagagcaagatgggcgtcaattcgttgccatcggaatcgagcaacgatctcgacgagcagatcgctcagctcatggagtgcaagccactctcagagcaacaggttagagctttgtgtgagaaggctaaggagatactaatggaagaaagcaatgtccagcctgtgaaaagccccgttacaatttgtggcgatattcatgggcagtttcatgatcttgctgaactttttcgaattggagggaagtgtccagatacaaactacctctttatgggagattatgtggaccgtgggtattattctgttgaaactgtgacgctcttggtggccctgaaagtgcgttattctcagcggattactattcttagaggaaaccatgaaagtcgtcagattactcaggtttatggattttatgatgaatgtttgcgaaagtatggcaatgctaatgtgtggaagatctttacagaccttttcgactatttcccattgactgccttggttgagtcagaaattttttgtctgcatggtgggctgtcaccttcaattgaaaccctcgacaacgtaaggaattttgatcgtgttcaagaggttcctcatgaaggacccatgtgtgatttgttatggtctgacccagatgaccggtgtggttggggtatttcacctcgtggtgctgggtatacttttggacaggatatatctgaacaattcaaccatacaaacaacctaaagttgattgctagagctcatcaactggttatggatggatttaactgggcccatgaacaaaaggtggttactatatttagtgcacccaattattgttatcgctgtgggaacatggcttctatattggaagttgatgactgcagaagccacacgttcattcagtttgagccagctcctaggagaggagaaccagatgttacccgcagaacacctgattatttcctataaaacagctgtctttgtgtcataatgataaccggttccttaccaaactagatattctcattactctgctctgcacccttgtgtgggggatataaaatttatgacttcttccttgccatgcttttctggtggtggttgtgggagcccagtaagatgtattataggcaggtaaaatgctcactgattttgtcttgcactttaaaccttgctggatttcctgtcagagattgcctagctgacagcatggagtgcgaaatgtattatttctactagaagcgtcagtatactttttttttttggtttccaagaatgattggctgtagtggtgacaagacaattttgcttttctcaattcaaagtctactagtttccattttgataacttgttctgaatttgtaacttgggaggagaaaaaaagaaaaaaggggggggggggtggtggtattattctagcagaaatgtggtattttttttgttcttttcttatttggctaagaatgattgcattgtggtgcctggaca

SEQ ID NO: 3494 - DNA, 1338 bp, Elaeis guineensis
tttttcctagtttctctggctctgagcgatcctctcctcgtctgcctctctgcccccttcgccacttcgccttcgaagccccgagagagagaggattgagatccttaggcggcgaaatctggggttagggtttcgttctcgtggcggcgtcgggcgagctggaggcgaagatgagcgcgaatccggcaccggcgagctcacatggcaacctcgacgagcagattgcgcagctcatgcagtgcaagcccctaccagagcaagaggttagggtgttatgtgagaaggcaaaagaaattttgatggaagagagcaatgttcagcccgtgcaaagccctgtaacaatatgtggtgacattcatgggcaatttcatgatcttgcggaactatttcgaattggagggaagtgtcccgatacaaattacttatttatgggcgattatgtagaccgtgggtactattctgttgaaactgttacgctattggtggccctgaaggtgcgatatccacaacgaattaccatccttagaggaaaccatgagagtcgtcagattactcaagtttatggattttatgatgaatgcttgcgaaaatatggtaatgcaaatgtgtggaagatcttcacagacctttttgattatttcccactgacagcattggttgaatcagaaatattttgccttcatggtgggttgtctccatctatcgagacccttgataacatacgcaactttgaccgcgttcaagaagttcctcatgagggagctatgtgtgatcttctatggtctgacccagatgacagatgtgggtggggtatttctccccgtggtgctggatatacctttggccaagatatatctgagcaatttaaccataccaacaaccttaagctgatagccagagctcatcaattggtcatggagggatataactggggacatgaacaaaaagtggttaccatatttagtgctcctaattattgctaccgctgtgggaatatggcttccatcttggaagttgatgactgcaaggggcatacgtttatccagtttgagccagcccccaggagaggagagcccgacgtaactcgtagaacacctgattacttcctatgaagcaattattgaaggaggtgatttgcagatttctggaaacaggctgctgtgctcggtggtttgtggggaagggaatgtataattggtgggagggttccatttgtttctgagccacagacctgtaattggtttccattgtggtcagaggcagcagagctgatattgcagagtcggcagcagcatgtatcattttaaagagaactacagcttccctcttttgttgtgg

SEQ ID NO: 3495 - DNA, 1513 bp, Tripterygium wilfordii
agatttccactttctccctctagagattcagagaaatctggagtttgccttttgatttctcttggggattagtggtcgtggagtgtaggtttagggttacggaattcgaaggggatctcgatctgttgttggagtattagcggaagatgagtttggattcggtcccttcgaactctcatggaaacctggacgaacagatttcgcagctcatgcagtgcaagcccctttcggagcaagaggttagggtgttgtgtgacaaggctaaggagattttaatggacgaaagcaatgttcagccggtgaaaagccctgttacaatttgtggtgatattcacgggcaattccatgatcttgctgagctttttcgcatcggagggaagtgcccagatacaaactatttgttcatgggagactacgttgatcgtggctactactctgttgaaactgtaacactgttggtagcattgaaagtgcgctatcctcaacggattactattctgagaggaaatcatgaaagtcgtcagattactcaagtatatgggttttatgatgaatgcctgaggaagtatggcaatgccaatgtgtggaagatcttcactgatctctttgactattttccactaacagcattggttgaatcagaaatattttgtctccacggtggattgtctccttccattgaaacccttgataacatacgtaattttgaccgtgtgcaagaagtacctcatgaaggtccaatgtgcgaccttctttggtctgacccagatgatcgttgtggctggggtatctcacctagaggggcaggatatacttttggtcaggatatatcggaacaatttaatcactcaaataacttaaagctgattgcgagggctcaccaattggttatggaaggatacaactggggtcatgaacaaaaggtggtaactatattcagtgcgcctaactactgttatcgatgcggaaacatggcatctatccttgaagttgatgactgcaagggacacacatttatccagtttgagcctgctcctagaaggggagagccagatgtgacccggaggactcctgattacttcctatgatgcgattgacatcagtgttaccgtactggtttctggtatccactgtctgttttatttgttgacaggtattttaaaactaagagtacattctggtagtggttgggcagcaaaatacatgtaagatgggcaggtgaggcttcgttgatttgattgttcatttgagttggttgagtattccacaacagggaggcagcggagctggtcatgcagtagcagcttgtgtacaattttcagcgaacaatatggaatcttacatttcattgttgttttttctccatttgttttgttctgctagggtggctgttgggccatggaatttgtagagggacgacgaatgacgaatgatgaacttttcttgtaatgggtaataggtgctgctgttatgtttgaaataatactactctaatattgatttctgagtaact

SEQ ID NO: 3496 - DNA, 1650 bp, Citrullus lanatus
aaagagagagaaagaaggggacagaacgaaaatttaactttgatttttccatctttctttttagtaattagaagaagaggacggggaagaagaagacggagtccttttctagggttttccgacggatcttttagggctcacgaaatcctatgaacttgaggagagcaacaccgaatcgacgggatcttgatctgtaattgccttcgctattggagcgaagaaccactagaacgcacgtaggggaaatcatggattctgtatcttccaactcccatggaaatctggacgagcagatttcccagctcatgcagtgcaagcccttgaatgagcaggaggtaagagtactgtgtgagaaagctaaggagatactaatggatgagagcaatgtccagcctgttaaaagtccagtaacaatatgtggtgatattcacgggcaatttcatgatcttgcagaactctttcgcattggagggaagtgtccagatacaaattacttgtttatgggagattatgttgatcgtggctactactcagttgaaactgttacacttttagtggcccttaaagtccgataccctcaacggatcacaattcttagaggaaatcatgaaagtcgtcagataacacaagtttatggattctacgatgaatgcttaagaaagtatggcaatgctaatgtttggaagatttttaccgacctgtttgactattttcccctgacagcactggttgaatcagaaatattctgtctgcatggtggtttgtctccatccattgaaacccttgacaatatacggaattttgatcgtgttcaagaagttcctcatgaaggtcccatgtgtgatctcttatggtctgacccagatgatcgatgtgggtgggggatttctcccagaggtgctggatatacctttggtcaggacatatccgagcagttcaaccatagtaataatttaaagttgattgcgagagctcatcagctagtgatggaaggatataactggagtcatgaacaaaaagttgtgactatatttagcgcacctaattattgctatcgctgtggaaatatggcatcaattctggaagttgatgactgcaaggcgcacactttcattcagttcgaaccagctccaaggagaggtgaaccagatgttactcgaagaactcccgactacttcttatgatgcggctattgtcggaggaatttttctagcagcagctgtttccaaatatatgttttggctgtttttacattggagaatttcttgggttggaagacggaacggcgggggggggggggggggggggaaagcatgtaaattgcggcaggttgcttcaggagggaggagtacaatccttgcaaatctcaaggttttgctgaaggaagatacagggctggcgactcattaactgcatatgtaacatctccggagaacaatgtattgcatctctttcttttcttttctttttctttttttagtaatttgtttcatgtaattttcctttcttctggttcacgggttctctttgcgattctgttaactattttgtaggatgctttgttttagttttctttttgggggtttacagatggaccatcagtttaatttccttcaatgagtgtctttattattctttcccatattttcc

SEQ ID NO: 3497 - DNA, 1362 bp, Euonymus alatus
tcgtcctctcaaaaaataccgctccttctatttctctgttttttcacgtctgctgggaattagtggtcgtggagtgtaggttcaggattacggaatttgaagggatctcgatctcttgttggagtattagcggaatatgagtttggattcggtcccttcgaactctcatggaaacctggacgagcagatttcgcagctcatgcagtgcaagccactgtcggagcaagaggtcaggatgttgtgtgacaaggctaaagagattttaatggaagaaagcaatgttcagccagtgaaaagccctgttacaatttgtggtgatactcacgggcaatttcatgatcttgctgagctttttcgcattggagggaagtgcccagatacaaactatttgttcatgggagactacgttgaccgtggctactactctgttgaaactgtaacactgttggtagcgttgaaagtgcgctatcctcaacggattactattttgagaggaaatcatgaaagtcgtcagattactcaagtatatgggttctatgatgaatgcctgaggaagtatggcaatgccaacgtgtggaagatcttcaccgatctctttgactatttccactaacagcattggttgaatcagaaatattttgtctccatggtggattgtccccttccattgaaacccttgataacatacgtaattttgaccgtgtgcaagaagtacctcatgaaggtccaatgtgcgaccttctttggtctgacccagatgatcgttgtggctggggtatctcacctagaggtgccggatatacttttggccaggatatatctgaacaatttaatcacacaaataacttaaagctgattgcgagggctcaccaattggtcatggaaggatacaactggggtcatgaacaaaaggtggtaactatattcagtgcgcctaactactgttatcgatgtggaaacatggcctccatccttgaggttgatgactgcaaaggacacacattcatccagtttgagccggctcctaggaggggagagccagatgtgacccggaggactcctgactacttcctataatgaaattgacctgagcgctggtatccactggctgtttttcctgttgacaggttttttcttttttaaaaaataataatctgagactacattctggtagtggttgggcaacaaaatacacgtgagatgggcaggtgaggcttcgttgatttgattgtttatatgaactggttgagttttccacgtaggggaagcagcggagctggccatgccatagcagcatatgtacaattttcagtgaacaatgtgatatctttaaatacgttcaatgaaaatatatgaaggaaa

SEQ ID NO: 3498 - DNA, 1322 bp, Fraxinus spp
agcacagtaaacgacgacggaacgagggaaggtggatctgacataaataagcaagatgaacacggatctgtggctgcgaacacacatggaaaattggacgagcagattactcagctcatgcagtgcaaacccttgtcggagcccgaggttaggactctatgtgagaaggctaaagagattctaatggagaagtaatgtacagcctgtcaaaagccccgtgacaatttgtggggatatacatgggcaatttcacgatcttgctgaacttttccgcattggagggaagtgtccagatacaaattatctatttatgggagactatgtagatcgtgggtattattcagttgaaactgtcactcttctagtggctttgaaagtgcgctatcctcaacggattactattcttaggggaaatcatgaaagtagacagattacacaggtctatggattttatgatgaatgcctgcggaagtatggaaatgctaatgtttggaagactttcacggacttatttgactacttccctttgactgcattggttgaatcagaaatattttgtctgcatggtggactgtccccctctattgaaacccttgataatataagaaactttgaccgtgttcaagaagttccacacgaaggtcccatgtgtgatcttttatggtctgaccctgatgatcgatgtggttggggtatctccccccgtggtgcaggatacacatttggccaggacatatcagagcaattcaatcataccaacaacttaaacctaattgctagagctcatcagttggttatggagggatacaactggtcccatgaacaaaaggttgtcacaattttcagtgcaccaaattattgttatcgttgtgggaatatggcatccattctggaagttgatgataatagacagcatacatttatccagtttgagccagctccaaggagaggggaacctgatgtaactcgaagaacacctgattatttcttgtagatcaatcgacagtaactggctcgtggtttgatgcgatggtcgaattcaagtgttcacatgccgtttcagatggtgatacaaaggtgaagaagcatggaaagtttgttagccgttgaggttctcttccaacgatcaatgttatattctaaccaatgaaagggtgtgcttgggagcggaaagcgggttggtcgaatcttttatgtattgatcttgttgtttcccctttcttttaataaagacatctgtaaggcttgttctctatttttctcgtcactgcgaactattgatttggtccgcggaagtaatagagaattctattaggttgctt

SEQ ID NO: 3499 - DNA, 1602 bp, Aristolochia fimbriata
cacagagtagagacgaggaaggaaggacgtgtaagtaaagaaaaagaaaaaacaaaaaaaaaataaaactatagtgttagggttagggtagttagtcgatacttacctccctcctctctctctctctcttgcgttgttctagtgcctttcgtgaagggagaaaaatgagcgtggatccggtgccttctaactctcatggacagattgacgagcagatttcgcagctcatgcagtgcaagcctctatcagagcaagaggttagggtgttatgtgagaaggcaaaggagatattgatggaggaaagcaatgtccagcctgtgaaaagtcctgtaacaatttgcggagacatacatgggcagttccatgatcttgctgaactttttcggataggaggaaagtgtccagataccaattacctttttatgggggattatgtagatcgtggctattattcggttgaaactgtaacgctacttgttgctcttaaagtacgttatccgcagcgaattaccattcttcgtggcaatcatgagagtcgccagattacgcaagtatatggattctatgatgagtgcctgcgaaagtacggcaatgccaatgtttggaagatcttcactgacctttttgattattttcctttaactgctttggtggaatctgagatattctgtcttcacggtggtttgtctccatcaattgagacactggacaacatcaggaattttgatcgtgttcaagaggtcccacatgaagggcccatgtgtgatttgttatggtcagacccagatgatcgttgtggctggggcatttctccacgtggtgctgggtacacatttggccaggatatttcggagcaattcaatcacaccaacaatcttaagcttatagcccgtgctcatcaattagtcatggaaggattcaactggggacatgagcaaaaggttgtcaccatattcagtgcaccaaattattgctaccggtgtgggaatatggcttctattttggaggtggatgactgcaagggtcacacgtttatccagtttgagcctgctcctagaaggggggagcctgatgtgacgaggagaacccctgactatttcttatgaggctgcatttacggttcaagcacattcttggaagcaagtgctcttgtacttgtgggtaagaaggggataatgaattgcagataatctgtaatccagttgacattaaagtgtacgggctgctgaaaccctcatttgggagaatgaaaagcatgtaaaatggtgcagataaactgggtgcccccatttgccttcagaactgtgctgatttattcgctgaaggaggtgacagagcatcgacactgaagcagaatgtatcatttcggagaaacctgtgatatttttattttttggttattctgttttactattttctttttcccttttatttttatctttttgttgtttttgcttttttatggttttgtagagagaagagattctattttagagggtgtttttcttttccatatccagatttcattcacagatttatttgcttcagctgtcctagctgtgattctcctgaatgctgagaggacagcggttaatatactgt

SEQ ID NO: 3500 - DNA, 1279 bp, Daucus carota
gacagaatagaggtggaagtagaagaaagatgaatgtggatctggctgcatcaaactctcatggaaatcttgatcaacaaattgctcagcttatgcagtgcaaacccttatcagagcctgaggttagggctttatgtgacaaggctaaggagattctaatggaggaaagtaatgtacagcctgtaaaaagccctgtaaccatctgtggagacatccatgggcagtttcatgatctagctgaactcttccgcattggaggaaagtgtccagatacaaattacttgtttatgggcgattatgtggatcgtggctattattctgttgaaactgtgacgcttttagtggctctgaaagtgcgatatcaccagcgaattacaattctcagaggaaatcatgaaagccgtcagatcactcaagtgtatggtttttatgatgaatgcctccggaagtatggcaatgctaatgtttggaagatatttacggatctttttgattactttccgctgacagctctggttgaatcggagatattctgtctgcatggtggattatccccatctattgaaacacttgataacatcagaaactttgatcgtgttcaagaagtcccacatgaaggcccaatgtgtgatcttttgtggtctgacccagatgatcgctgtggttggggtatatccccgcgtggtgctggatacacttttggccaagacatatctgagcaatttaaccacaccaacagcctgaagcttattgctcgagctcatcagctggttatggagggatataactggggacatgaccaaaaagtggtgacgatctttagtgcaccaaattattgctatcggtgtggaaacatggcatctatattggaagtcgatgactgcaacggccatacgtttattcagtttgagccagctccaaggagaggagaaccagatgtgactcgaagaacaccagattatttcttatgaaacagtcacatgtgttccttgaagattgagatatacatgccagtattttcagatgcttgagataggaaaggagactataatgtgtagcttaactttttggttggtgaaaagctttgtaacatggagaagctataggataccttcagcctaattttcgatctgacgttctttagaacttcttggattgaaaaatgagatggttaggctgtaatgtatcatgtgaaccgaaggttttcagcactaattttctttcgcaatttgatagacctataaatgaatatgttttgtctattacaattcttttggcc

SEQ ID NO: 3501 - DNA, 1537 bp, Chelidonium majus
cgagagacgacgacgaccacgacggagtagggttagggtttcgaccttttactttttctttcttcttgattttgttgttcttattgttgttgatttgatcgagaagaagaagaagaagaagtatgagtgtagatgcggttgcttccaactctcatggcaacctcgatgaagagatcgcacagcttatgcagtgcaagcccttgtctgaacaagaggtcaggggattatgcgagaaggctaaggagatactaatggaagagagcaatgtacagccagtgaaaagccctgtcacaatctgcggtgatattcatgggcagtttcatgatctcgcagagcttttccgaattggaggaaagtgcccagataccaattacttattcatgggagattacgtggaccgtgggtattattccgttgaaactgtaacgcttttggtggctctgaaagtgcgttaccctcagcgaattaccattcttagaggaaaccatgaaagtcgtcagattacacaagtttatgggttttatgatgaatgcctacggaagtatggcaatgctaatgtatggaagatcttcacggatctctttgactacttcccattgacagccttggttgaatcagaaatattttgtctgcatggtggactgtctccatctattgaaacccttgataacatacggaactttgaccgtgttcaagaagttccccatgaagggcccatgtgtgatctcctttggtctgacccagatgaccgatgtggttggggtatttcaccccgtggagctggatatacttttgggcaagatatatctgaacaatttaaccataccaacaatttaaagctgattgctagagctcatcaacttgtgatggagggattcaattggggacatgaacaaaaggtggttactatatttagtgcacctaactattgctaccgttgtggaaatatggcatccatcctggaagttgatgactgcagagggcacacgttcatccagtttgagccagctccaaggagaggagagcccgatgtgactcgtagaactcctgattattttctatgagaaagctgcctatgagttattactgatttcccagcagcaaatctttcttctcactctgtctatcttgcttgctggttgacacaagacatgaatgaaggtggtggttccgtttcccaattcttgttagagctgtgtattggattttaagatctctataaattttacctgctatgcctttacttcgatggtggtggagggcggcaacttcagaaaagcatgtgatgtgggcaggtagggatctactactgtgctgtgttggtggtggtatatctttcaaaagaaggcagtggagctggctgactcttcagcagtatgtaacaatttccagcaaaaacatgtgtttttttctttttctttttgttatttatggagatctgtattctgtagagggaagaaaggggattgtgtttttgtttttgggttctagtaagtgtgttttagctttacttattagtcttatagtggacactctg

SEQ ID NO: 3502 - DNA, 1427 bp, Cynodon dactylon
ggggagggttccaccgcgccccggcggagaagatgagcagccccatggcggcctcgacgaccagatcgagcggctcatgcagtgcaagccgcttccggagcccgaggccagagcgctgtgtgagaaggcgaaggagattttgatggaggaaagcaatgttcagcccgtaaagagtcctgttacaatatgtggtgatattcatgggcaatttcatgatcttgctgaactcttccggattggtgggaagtgtccagatacaaactacttgttcatgggagattacgtggaccgtggctactactctgttgaaactgtcacgcttttggtggcgttaaaagttcgctatcctcagcgtattaccattctccgaggaaaccatgaaagccgacagattactcaagtttatggattctatgacgagtgtttaagaaagtatggaaatgcaaatgtgtggaaaacctttacagatctatttgactacttccccttgacggcattggttgagtcagaaatattttgcttgcatggtggattatcaccatccattgagacgctcgataacatccgtaacttcgaccgcgtccaagaagttcctcatgaaggtccaatgtgtgatcttctttggtctgatccagatgatcgatgtggttggggtatttctccacgtggtgctgggtataccttcggacaggatatatcagagcagttcaaccataccaataacttaagacttattgccagagctcaccagttagtcatggaggggttcaactgggctcatgagcaaaaagttgtcaccatatttagtgcacctaattattgttatcgctgtgggaacatggcatcaatcttagaagtggatgattgcagggagcatactttcatccagtttgagccggccccaagaaggggagagccagatgtaactcgtaggacacctgactatttcctgtgatgaaaaaatgatgtgggtctgcagcaaaggtttgatagataggtgaagtttcctggttgcagatattttttggtcgaatccccctgtgtgctattcttattatttttgcccatggcgctttggctattgcgagctgctttgctgcatcgtgattcaagtgtatacctacagctggaaggattcattatgctctcactttctctaactggttgatgcttttcgcttgggggctgcagtggtgagttgaagcatcaagcagcaatctgtattatgagaggaaaccattccctttgtattcatttcgttctccttcccttctcacttgtttcactttttttttcttctcttttttccttttgtgattcttgtagagatgaacaattgtatggttctgtgtcaggccattagtttttcttcctgactgcatctcgattcaccgtatagagttacatttcatgtagttaagtatcag

SEQ ID NO: 3503 - DNA, 1444 bp, Panax ginseng
tatcaacgcagagtacatggggctctctccttctctggttgcaccaccgctccagagtcgagttttctctctctacaacatacagcaaccttttttgtgaaattttatatatcgacaaacaatatctgcaaatctgtgcgtttttacataatacactaagattgaaagagaaaaggaagatgaatgtggatctggtcgcatcgaatgcacatggcaacctcgatgaacagatttcacaacttatgcagtgcaaacctttgtccgaacctgaggttagggcattgtgtgacaaggctaaagagatactaatggaagaaagcaatgttcagcctgttaaaagccctgtgaccatatgtggtgacattcatgggcaatttcacgatcttgctgaactttttcgcattggaggaaagtgtccagatacaaattacctgtttatgggagattatgtggatcgtgggtattattcagttgaaactgtcacgcttctggtggctctcaaagtgcgttatcaccagcgaatcacaattcttaggggaaatcatgaaagcagacagattactcaggtctatggattctatgatgaatgcctacggaagtatggcaatgctaatgtttggaagatatttacggatctttttgattattttccacttactgcactggttgaatcggagatattttgtctgcatggaggattgtctccttccattgaaacacttgataatataagaaactttgatcgtgttcaagaagttccccatgaaggcccaatgtgtgatcttttgtggtctgacccagatgaccgctgcggttggggaatatctccccgtggtgctggatacacttttggccaagatatatctgagcaatttaaccacaccaacaacctgaagcttattgctagagctcatcagttggttatggaaggatttaactggggacacgaacaaaaagtcgttactatttttagtgcaccaaattattgttatcgttgtggaaacatggcatcaattttggaagttgatgactgcagagggcatacatttatccagtttgaaccagctccgaggagaggagaacctgatgtaaccagaagaacaccggattatttcctataaaaccagttgatagagttcttgaagtttgatgtttgcatactggttgtgttaaagagctgtgctgagattagattgaaaattgttagtgtttcagcttcttcggttcttggttagtggcggaagggctgaaggcataatgagaagctgagggaccctttgatttattttatatcctaacctctaagctatatagctttataggattgaggcaagtggagcttgcaaagctgtaatgtatcgtttggattagaacttgttaaaggtgtatttgtgtcacttattttcttttgattatataatgatgattctattttttaatttta

SEQ ID NO: 3504 - DNA, 1442 bp, Panax ginseng
tggtatcaacgcagagtacatggggctctccctctctggttgcaccaccgctccagagtcgtgttttctctctctacaacgtacagcaaccttttttgtgaattttatatatcgacaaacaatatctgcaaatctgtgcgtttttacataatacactaagattgaaagagaaaaggaagatgaatgtggatctggtcgcatcgaatgcacatggcaacctcgatgaacagatttcacaacttatgcagtgcaaacctttgtccgaacctgaggttagggcattgtgtgacaaggctaaagagatactaatggaagaaagcaatgttcagcctgttaaaagccctgtgaccatatgtggtgacattcatgggcaatttcacgatcttgctgaactttttcgcattggaggaaagtgtccagatacaaattacctgtttatgggagattatgtggatcgtgggtattattcagttgaaactgtcacgcttctggtggctctcaaagtgcgttatcaccagcgaatcacaattcttaggggaaatcatgaaagcagacagattactcaggtctatggattctatgatgaatgcctacggaagtatggcaatgctaatgtttggaagatatttacggatctttttgattattttccacttactgcactggttgaatcggagatattttgtctgcatggaggattgtctccttccattgaaacacttgataatataagaaactttgatcgtgttcaagaagttccccatgaaggcccaatgtgtgatcttttgtggtctgacccagatgaccgctgcggttggggaatatctccccgtggtgctggatacacttttggccaagatatatctgagcaatttaaccacaccaacaacctgaagcttattgctagagctcatcagttggttatggaaggatttaactggggacacgaacaaaaagtcgttactatttttagtgcaccaaattattgttatcgttgtggaaacatggcatcaattttggaagttgatgactgcagagggcatacatttatccagtttgagccagctccgaggagaggagaacctgatgtaaccagaagaacaccggattatttcctataaaaccagttgataagagttcttgaagtttgatgtttgcatactggttgcgttaaaagagctgtgctgagattaaattgaaaattgttagtgtttcagcttcttcggttcttggttagtgccggaagagctgaaggcatgtaaaatgagaagctgagggacccctttgatctattttatatcctataaagctatatagctttataggattgaggcaagtggagcttgcaaagctgtaatgtatcgtttggattataacttgttaaggtgtatgtgtcactttttattttcttttgattatataatgatgattctattttttaa

SEQ ID NO: 3505 - DNA, 1784 bp, Papaver somniferum
aggaaaaccaaataataaaattggtgatccaagagaaaaccagggtttccattttggttgcaccaccaccgctcgctttactcccgcggtgtctctgtctctcttcctccgggagacgagaacgtttattaagaaaatcgggtcagggttatcttgattcatttattgttggttgataagaagaagaagaagaagtaagaaggaaaagatgagtatagatgtaataactcccaactctcatggaaatcttgatgaagagattgctcagcttatgcagtgtaaacccttgtctgagcaagaggtaagaggattatgtgagaaagcaaaggagatactaatggaagagagcaatgtacagccagtaaaaagccctgtcacaatttgcggtgatattcatgggcagtttcatgatcttgcagaacttttccgaattggaggaaagtgtccagataccaattacttgtttatgggagattatgtggatcgaggttattattccgttgaaactgtaacgctgctggtggctttgaaagtgcgctaccctcagcgaattaccattcttcgaggaaaccatgaaagtcgtcagattacacaggtttatgggttttatgacgaatgcctacggaagtatggcaatgctaatgtatggaaaaccttcacggatctcttcgactattttccattgacagctctggttgaatcggaaatattttgtttgcatggtggactatctccgtctattgagaccctcgataatatacgaaattttgaccgtgttcaagaagttcctcacgaagggcctatgtgtgacctcttatggtctgaccctgatgaccgatgtggatggggtatttcaccccgtggagctggatatactttcggccaagacatatctgagcaatttaaccataccaacaatttaaagctgattgctagagcgcatcaacttgtcatggagggattcaattggggacatgaacaaaaagtggttaccatatttagtgcacctaactattgctaccgttgtggaaacatggcatctatcttggaagttgatgactgcagagggcacacattcatccagtttgagccagctccaaggagaggagagcctgatgtgactcgcagaactcccgactacttcctataatataactgggcacaagtttattgctgatctcccagcggcaaatactacctacagatcttgcttgcttgttaacacattgacatcaaaatgaggtggctccattcccaattcttgtttagaggtctctgtattggatatatgatctgtaaatttttttaccctgctatgcctactttgatggtggtggagatgacttcagaaaaaaagaaaagaaaacaatagcgtatgtaatgctctgaaactagtactagtgtactactgtaatgggtatccttgcgaacagtggcagtggagctagcaacgctgcagcagcatgtaacattttgcagcaaaaagaacatgtgtttatttttgttttttgttttttcttgttatttatggaatatgtagagggaagaaaaggggatattacaattattattcttttttctttttcttgggtgttgtagtgaagtcagttgttttagggttttgttaatcgtaagttgattgtgatttgattctagtaatgatagcaggttcccttcaagctctcatatagtcatcctccaactcaagtagtctgttccaagccaactatttttcaataattttagtaactagttaacaattttttagtagtacgacaaaaaaa

SEQ ID NO: 3506 - DNA, 1719 bp, Papaver somniferum
aaccaaataataaaattggtgatccaagagaaaaccagggtttccattttggttgcaccaccaccgctcgctttactcccgcggtgtctctgtctctcttcctccgggagacgagaacgtttattaacaaaatcgggtcagggttatcttgattcatttgttggttgataagaagaagaagaagaagtaagaaggaaaagatgagtatagatgtaataactcccaactctcatggaaatcttgatgaagagattgctcagcttatgcagtgtaaacccttgtctgagcaagaggtaaggggattatgtgagaaagcaaaggagatactaatggaagagagcaatgtacagccagtaaaaagtcccgtcacaatttgcggtgatattcatgggcagtttcatgatcttgcagaacttttccgaattggaggaaagtgtccagataccaattacttgtttatgggagattatgtggatcgaggttattattccgttgaaactgtaacgctgctggtggctctgaaagtgcgctaccctcagcgaattaccattcttcgaggaaaccatgaaagtcgtcagattacacaggtttatgggttttatgacgaatgcctacggaagtacggcaatgctaatgtatggaaaaccttcacggatctcttcgactattttccattgacagctttggttgaatcggaaatattctgtctgcatggaggactatctccttctattgagaccctcgataatatacgaaattttgaccgtgttcaagaagttcctcacgaagggcctatgtgtgacctcttatggtctgaccctgatgaccgatgtggatggggtatttcaccccgtggagctggatatactttcggccaagacatatctgagcaatttaatcataccaacaatttaaagctgattgctagagcgcatcaacttgtcatggagggattcaattggggacatgaacaaaaagtggttaccatatttagcgcacctaactattgctaccgttgtggaaacatggcatctatcttggaagttgatgactgcagagggcacacgttcatccagtttgagccagctccaaggagaggagagccagacgtgactcgcagaactcccgactacttcctataatataactgggcacaagtttattgctgatctcccagcggcaaatactacctacagatcttgcttgcttgttaacacattgacatcaaaatgaggtggctccattcccgattcttgtttagaggtctctgtattggatatatgatctgtaaatttttttaccctgctatgcctactttgatggtggtggagatgacttcagaaaaaaagaaaagaaaacaatagcgtatgtaatgctctgaaactagtactagtgtactactgtaatgggtatccttgcgaacagtggcagtggagctagcaacgctgcagcagcatgtaacattttgcagcaaaagaacatgtgtttattttgttttgtttctttgttatttatggaatatgtagagggaagaaaggggaagtattacaattattattctttcttttctttgggtgttgtagtgaagtcagttgttttagggttttgttaatcgtaagttgattgtgatttgattctagtaatgatagcaggttcccttcaagctctcatatagtcatcctccaactcaagtagtctgttccaagccaactattttca

SEQ ID NO: 3507 - DNA, 1292 bp, Valeriana officinalis
atctctctccttcttcttctatctccgattacgccatttttcgctccgactgggctgcccgagctccacacagctccttccttcaattcgcctcaacgcaaattcattcaagatcttaattatgagtgcggatctagcctcttccaactcacatggaaatctcgaccaacagattgcacagctcatgcagtgcaaacccttatccgagcccgaggttaggggattatgcgaaaaggctaaagagatactaatggaagaaagtaatgttcagcctgttaaaagtcctgtgacgatctgcggggatattcatggtcaatttcatgatcttgccgaactttttcgaattggagggaagtgtccagatacaaactacttgtttatgggagattatgttgatcgtgggtattattcggttgaaacggtcacactcctagtagccctgaaggtgcgatatcatcagagaatcacaattcttagagggaatcatgaaagtcgacagattactcaagtttatggattttatgatgaatgccttcgaaagtatggaaatgctaatgtttggaagacgtttacggatctttttgattatttccccctcactgcgttggttgaatcagaaatattttgtctacatggagggctatcaccgtcaatagaaacacttgataatataagaaattttgatagagtacaagaagttccacatgaaggtcccatgtgcgaccttttatggtcagaccctgacgatcgttgcggttggggtatctctcctcgtggtgctggttacacttttggccaagatatttcggagcaattcaaccatactaacaatctaaaactgattgctagagctcatcagttggttatggagggctataactggggacatgagcaaaaagttgtcactatttttagtgctccgaattattgttaccgttgtggaaatatggcgtctattttagaagttgacgactgcagagggcacacatttatccagtttgagccagcaccgaggagaggtgaaccagacgtgacacgaagaacacctgattattttctgtaaaagaaggtactacaatgaaaaacagactcttgggtcctttcttagattttttttctcatcttgttattgttgatttttttcttcagttctttgatttgttgggattttgattaaatgaggtgttttatagagttaggcaagagacttggttattgtaatttcagttttataccgttgtttatgttcttacaatagttgtttataatgaattcatctaatggttcactca

SEQ ID NO: 3508 - DNA, 1886 bp, Platanus occidentalis
cgctcgcgcgctctctctgggtctctctgggtcccccccaatctctagttctcttttctccgagaaggagagacgacgacgacgaaatctagggttagggttttatccgattcgttctttgtctctatgtttttgattatctggttcgattaagcgggatttggaaggggtttcgatcttctgcgtcggagaaggaaaagagggaaaggaggaggaagaagaagatgagtgtggatccggtcacttcgaactcacatggcaacctcgacgaggagattgcgcagctcatgcagtgcaagcccttgtctgagcaagaggttcggacattatgcgagaaggcaaaggagattttaatggaggaaagcaatgtccagcctgtagaaaagccctgtgacaatctgtggtgatattcatgggcagtttcatgatcttgcagagctttttcgaattggagggaagtgtccagataccaattacttgtttatgggagattatgtggaccgtgggtactattcagttgaaaccgtaacgcttttggtggctctaaaagtgcgttatccgcaacgaattaccattcttagggggaatcatgaaagtcgtcagattacacaagtttatggattttatgatgagtgcctacgaaagtatggcaatgctaatgtatggaagatctttacggacctttttgattacttcccactgactgctttggttgaatctgaaatattttgtctgcatggtggattgtccccgtccatcgagactcttgataacatacggaattttgaccgtgtacaagaagttcctcatgaagggcccatgtgcgatctcttatggtctgacccagatgaccgctgtggttggggcatttctccgcggggagccggatacacttttggccaagacatatctgagcaattcaatcataccaacaacttaaagctgattgcgagagctcatcaactagttatggagggattcaattggggacatgaacaaaaggtggttacaatctttagtgcacctaattattgttatcgctgtgggaacatggcatctatcttggaagtcgatgactgcaaaggacacacattcatccagtttgagccagctccgaggagaggcgagccagatgtaacccgtagaacacctgattacttcctatgatgtggccacctttgaattgttactgattgttcagtacgatctgctgcttgttgacgatgaggtgggtgtggattcttgttcagagctgtttatcggatttcagatttatgatttcaacgtgctatgctttggtggtggtggtggtaaggggacaaaagcatgtaaaatgggaaggtatgactcccaatgatttgattgtgttctgaactgtgctgggtttcctcaacgggcggcagcggagctggcaacactggcagcatgtatcatttccaacaaaacatgtggtattttttattttctttctttttggtgtactctcttttggggtctgtagagggatgaagggaattctatttttttagtgggtgcttatctttctatagtcttcattggacttctattaattgcggtggctgctcttctctttatctacttctcactcaaatgatcttgagaatgggctttggactcctggatatcacatctaatttagctgactaatgctattttgacttgcctacaaagtctagtacgttagaaatggatggagggaggtctaactaactttgcttcactaacgtttcgcccgtaggtagttacttttaccactaaacctagaaaaacaacaacgaagtatccgtctaacctttaacccaactttatacgtaacttcctaacctttacttttagttttttaattcgtacttcttaacgttagt

SEQ ID NO: 3509 - DNA, 1397 bp, Ambrosia trifida
atttacaagggtttcattcttgtgtatgtttagtttttttattgagatcgagcgatttatccaaatcaatctgactgattatatgcagcatagtaataataataataagaatataatttagatgagaagatgagtgtggatctagcttcgaattctcatggaaacctggacgagcagatctcacagctcatggagtgcaaacctttaaccgagcctgaggttaagacattatgtgagaaggcaaaagagatacttatgggtgaaagcaatgttcagccagtaaaaagccccgtgacaatctgtggtgacattcatgggcagtttcatgatctcgccgaactttccgaataggagggaagtgcccagatactaattacttgttcatgggggattatgtggatcgaggatattattctgttgaaactgtcacgcttttggtggctctgaaggtgaggtatccgcaacgaattacaattctaagaggaaatcatgaaagtcgtcagatcactcaagtctatgggttttatgatgaatgccttcgaaagtatggcagcgctaatgtttggaagacttttacagatctctttgactattttccattgactgcattggttgaatcagaaatattttgccttcatggtgggttgtcaccttcaattgaaactcttgatagtataagaaactttgaccgtgtgcaagaggtcccgcatgagggtccaatgtgtgatcttttatggtctgacccagatgaccgttgtggttgggggatttcaccacgtggtgctgggtacacatttggccaagatatatctgagcaatttaatcataccaacagcctaaaacttattgctagagctcatcagctggtgatggagggatataactggggacatgagcaaaaagtggtcactatctttagtgcgccaaattattgctatcgatgtgggaacatggcgtctatcttggaagttgatgattgcaagggccacacatttatccagtttgatcctgctcctaggagaggagaacctgatgtaaccagaagaacgcctgattatttcctctgaatggttcaagttaagaagttgccaagatttgatgcaacaagaaaggaccaaatggtgcatgaaatcctccacatattatgtatgtttgtatgtatgattgattctagggtctttccaattcattgtttaagtaatgaggttttctgtaatctgcaaatggaatgtttcatttgggagtgtttttatcaatacatacatacatttgttatattttggttgttaatctggtttatgaatttatttagtttgtattcatatgtttattttcttgagatacatacatacatcaacatgtcttcatcaagtttattcggtttggaaaaaaagaaa

SEQ ID NO: 3510 - DNA, 1363 bp, Olea europaea
tagcaaaaccaagtaaaacgatgccgcgtggagaatcttgaagaatccaaaatctagagagtgagagtctgatggatgcatcggcgtcggcgagtggcggcggagctcatgggaacctcaacgggcaaatcgatcaactcatgcagtgcaaacctttgttggaacaagaggtgagggcactatgtgaaaaaggcaaaggagattctaatggaagagagcaatgtgcagcctgtgaagagccctgtgaccatttgtggtgatattcatggacaattccatgatcttgcggagctttttaagattggtggaaagtgtccagatacaaattatctgtttatgggagattatgttgatcgtgggtactattcagttgaaacagtaacgctcttggtggcattgaaagtgcgttatcctcaacgaattactattcttcggggaaatcatgaaagtcgccagattactcaagtttatggattttatgatgaatgcctaagaaaatatggaaatgccaatgtctggaagatctttacagatttatttgactattttcctcttaccgccttggttgagtcagaaatcttttgcctgcatggtggattgtcaccgtccattgaaactctggacaatatacgtaattttgaccgtgtgcaagaggttcctcacgagggccctatgtgtgatcttttatggtctgatcctgatgatcgttgcggttggggtatctcacccaggggtgctggatatacatttggccaggacatatcggagcagtttaaccacacaaacaatttgaagcttattgcaagagctcaccaactggttatggaaggatttaattgggctcatgaccaaaaggtggtaaccatattcagtgcaccaaattattgttatcgatgtgggaacatggcatctatccttgaggttgatgactgccaagggcacacattcattcagtttgacccggctcctagaaggggcgagccagatgtaacccgcagaacaccagattacttcctgtgatgcagctgctgctaatatagtagctgaattctgcttgacagatgcctgatagctgctttatgcgaaattgaaatatattttttctactgatgatgggaagcatgtgaaagaggccagtgatgatgagatctcgtttcttctggcatcgaagaatcatatcaaggttttaagtttctccatttttatttttatcccctgtaatttcacacgacatgtcgagaagagtatatttataatcttttttgaacgtccagatcgatttatctagatcctgcatttcagaggttgcctattttagtgttatgtatatgcagtaacgcatgcaaggtcgaaatcaaaaaat

SEQ ID NO: 3511 - DNA, 1588 bp, Pinus taeda
aaaggagagcatttcaacaccgaacaagatgagcgcggagccggtctcgtcgtccagcggttatggccaactcgatgcccagattgaacagcttatgcagtgcaagcccctctcagaacaggaggtcagaggactgtgtgaaaaggccaaggagattctcatggaagaaagtaatgtgcagcctgtcaagtgccctgttacaatctgtggtgacatacatggtcaatttcacgatcttgccgagctgttccggattggtggaaagtgtccagatacgaattatttgttcatgggtgactatgttgaccgaggatactattcagtcgagactgtcactcttctagtgtcattgaaggtgcgatatccccaacgaattaccattcttcgaggaaatcatgagagtcgtcagattactcaagtatatggattctatgatgaatgtttacggaagtatggaaatgcaaacgtctggaagatatttacagacctttttgactacttcccattgacagcactggtagaatcagaaattttctgcttacatggtggtttgtcaccttccattgacacattagataacataaggaattttgaccgtgttcaagaagtgcctcatgaaggtcccatgtgcgatcttttgtggtcagatccagatgatagatgtggatggggaatctctccacgtggtgcagggtatacatttggacaggatatatctgaacaatttaatcatacaaacaacttgaaacttattgctagagctcatcaacttgtcatggaaggcttcaactgggggcatgagcaaaaggttgtcacgatatttagtgcaccgaactactgctatcggtgtggtaatatggcatctattttggaagttgatgatactaaaggacatacttttattcagtttgagccagcgccaaggcgaggagaaccagatgtgacacggaggacaccagactattttttatgatttgttctattgtatgtctgctgcttgctgtttttctgccatcaagcctccatctgctatttgatctttggagctgccactttatgatcatacgcatactgttgatgcaaagcttttcagagtttcaaattgatacactacattcaaattatgcttcagggtggatgggggaagcatgtattatgatcaggtattacctgcaaaggtctgtgttttgttagtttggaacactttctgtaggcggtgcaactgcactgtgtatccatttaagatgctgctttaatgtagggggaggcaatttatttgccaagtgtttatttaatctttaacgttgtaaacacttatatttgggcattgtctgctgattgagtagtcagcccatttcaatctcattagctggtagtttgggacaattgctgttaccaacgctcatgagaaattgcattttattgtgcctttaacctatccatggattggagaatccctacttcacaaatcctgattctcacggaatatttcaggaaagcaggttttctgtatttaattttagcagatattatgcatttgcaagcacatcgtagggtcaaggatcggacgttggtaaatgcaaaaggg

SEQ ID NO: 3512 - DNA, 1795 bp, Abies balsamea
ggcattcgttaaaggcagcatatatcacatacataaatattttatttttgttcgatagaacgctgcagaagcagcagtgcggaccaacggacaacaaccacaaggtcgagggttcaactcggaggaactgaaagagaggcacaggacgacggggcgaaacggagacagagagaaaggagagcacttggactctgaacaagatgagtgcggagccggtctcgtcgtccagcggttatggccaactcgatgcccagattgaacaacttatgcagtgcaagcccctttcagaacaagaggtcagaggattgtgtgaaaaggccaaggagattctcatggaagaaagtaatgtgcagcctgtcaagtgccctgttacaatttgtggtgacattcatggccaatttcatgatcttgcggagctgttccggattggtggaaagtgtccagatactaattatttgttcatgggcgactatgttgaccggggatactattcggttgagactgtcactcttctagtgtcattgaaggttcgttatccccaacgaattaccattctccgaggaaatcacgagagtcgccagataactcaagtatatggattctatgatgagtgcttacggaagtatggaaatgcaaatgtctggaagatatttacagacctttttgactacttcccgttgacagcactggtggagtcagaaattttctgcttgcatggtggattgtcaccttccattgacacactagataacataaggaattttgaccgtgttcaagaagtgcctcatgaaggccccatgtgcgatctattgtggtctgatccagatgatagatgtggatggggaatctctccgcgtggtgcagggtatacatttggacaagatatttctgaacaattcaaccatacaaacaacttaaaacttattgctagagctcatcaacttgtcatggaaggcttcaactgggggcatgaacaaaaggttgtcaccatatttagtgcaccaaactactgctatcggtgtggtaatatggcatctattttggaagttgatgatactaaagaacatacttttatccagtttgagccagcaccaaggcgaggagaaccagatgtgacacggaggacaccagattattttttatgatttttgtacgtgtactgtttgccatttttctgccatcaagcctctgcctgctatttgacctttggagctgccgcgttatgatcatatacgcatactgttgatgcaaagcttttcagagtttcaaattgatacattatattcacattatgcttcagagtggatgggggaaagcatgtattatgtatgatcaggcattccctgcaagggtctgtgtttcgttagtttggaactctttctgtatgcagtgcaactgcgctgcattgtgtatcaatttaagatagttgctttagtgtagggagaggcaatcttgccaggtgtttatttaatctttaactttgtaaactcttatatttgggcattgtctgctgattgagtagtctgcccatttaaatctcattagttggtagttcgggacaattgctgttaccaactctcatgagaaactgcattttatggtgcttataacctatccatagattggagaatatgtctactttagaaaccctggttctcagaatgcatctttcaggaaaacaagttttctgtatttacttttagtaggtattatccatttgcaagcacatcgtaaggtcagggatgtggacgttggtaaatgctaaagtacacattttatttttttggatgtgaat

SEQ ID NO: 3513 - DNA, 1222 bp, Ambrosia trifida
ttcctttttctgtacctccatttccgtttctgcacccacatttggctcatcgaaacaatcgatctgttgattatatgtatataatctgaacaagatgagtatagatctagctactaacacccatggaaacctggacgaacagattgcacagctcatggagtgcaagcccttatccgagcccgaggttaagacattatgtgagaaggcaaaagagatacttatgggcgaaagcaatgttcagcctgtaaaaagccctgtaacaatatgtggtgacattcatgggcagtttcatgatcttgctgaactttttcgtataggagggaagtgcccggataccaattacttgtttatgggggattatgtggaccgaggatattattctgtcgaaactgtcacgcttttggtggctctgaaagtgaggtatcctcagcgaattacaattctaagaggcaatcatgaaagtcgtcagatcactcaagtctatggattttatgatgaatgccttcgaaagtacggcaatgctaatgtttggaagacttttacagatctctttgactattttccattaactgcattggttgagtcggaaatattttgccttcatggtgggttatcaccttcaattgaaactctggacagcataagaaacttcgaccgtgtgcaagaggtcccacacgagggtcccatgtgtgatcttctatggtccgacccagatgaccgttgcggttgggggatttcaccacgtggagctggatacacctttggccaggacatttctgagcaatttaatcataccaacaatctgaagcttattgctagagctcatcaactggtcatggagggattcaactggggtcatgagcaaaaagttgtcactatctttagcgcaccaaattattgctaccgatgtgggaacatggcttctatcttggaagttgatgattgcaagggccacacatttatccagtttgatccagctcccaggcgaggagaacccgatgtaacaagacgaacgcccgattattttctctgagtggtccagttaaagtggttcatggtcttttgtcgagattcgggcttttgatacaatggtatgggccaaaattcataaggtgaagtgacaagaaaagaaccaaatggtttagtaaaatgtatgattcatatgttagaagtaatgggtcttttatgtgtatctgacaaagggaatgaattaagatttacg

SEQ ID NO: 3514 - DNA, 1481 bp, Malus domestica
ccgtcctctccacctctgctttaagtacgatcagagagtgaggaccggaaccaatatcttaatctggggttagggtcatcccgaatccgaatacctgtaaaatccccaattcgatttttgaattcgaagccgagagaagatgggcgtgaattcggtatcgacggacacgagcagcgatctgaacgagcagatcgagcaactcatgcaatgcaagccactctcagagcaacaggtgagaatgttatgcgagaaagcaaaggaaattctaatgggagaaagcaatgttcagcctgtgaaaagcccagtgacaatttgtggcgatattcatggacagtttcacgaccttgcagagctttttcgaattggagggaagtgtcctgataccaattacttgtttatgggagattacgtggaccgtggctattactctgttgaaaccgtgacgctcttagtggccctgaaagtgcgttatcctcagcgaatcactattctcaggggaaaccatgaaagtcgtcagattacccaggtttatggattttatgatgaatgtctccgaaagtatggaaatgccaatgtttggaagatcttcactgacctttttgactactttccactgacagcattggttgagtcagaaatattttgcctgcatggtggattgtccccttcaattgaaaaccttgataacataaggaattttgaccgtgttcaagaggttccacatgaagggccgatgtgtgatctgttatggtctgacccagatgaccgatgtggttggggtatttcacctcgcggtgcaggatatacttttggccaggatatatctgaacaatttaatcatacaaacaatttaaagttgattgcaagagctcatcagttggttatggatggattcaactgggcacatgaacaaaaggtggttactatatttagtgcacctaattactgctatcgctgtgggaacatggcctctgttttagaagtcgatgactgcaggggccataccttcattcagtttgagccagctccgaggagaggagagccagatgttacgcgtagaacacccgattactttctgtgaagcaactgcattggtgtcatttcttttgtggttcttccactcttccacacttggggtagcacattgttttagcacaagatggctattgggtttgcagcccacgtcttcctgtcgggttataggattccaagaccgatgtaaaatacacaggtaaggtgcctgctgatttgtcttacattagaacgttgctggatttcccatcgaatagtttgcctagctgttgacgctccgtaattattgtatcatatccagcagaagatgtggatattctttttggttttgtatttctttttcgtccttgtacgttttgctcaccctccccccatggggatcatgggactttattattagtggatgtttttgctctttcattcgattactcaaatgttttgcgatgcga

SEQ ID NO: 3515 - DNA, 1459 bp, Malus domestica
ccgtcctctccacctctggtttaagcaggatcagagtgtgaggactggcaccaatatcctaatctggggttagggttatccctaatcctccctaatccggataccaataaaatccccaattcgattttccaattcgaagttgagagaagcaagatgggcgtgaattcggtatcgtcggacacgaacagcgatctcaacgagcagatcgagcaactcatgcagtgcaagccactctcggagcaacaggtgagaatgttatgcgaaaaagcaaaggaaattctaatgggagaaagcaatgttcagcctgtgaaaagcccagtgacaatttgtggagatattcatgggcagtttcacgaccttgcagagcttttccgaattggagggaagtgtcctgataccaattacttgtttatgggagattatgtggaccgcggctattattctgttgaaactgtgacgctcttagtggccctgaaagtgcgttatcctcagcgaatcactattctcagaggaaaccatgaaagtcgccagattactcaggtttatgggttttatgatgagtgtctccgaaagtatggcaatgccaatgtttggaagatcttcactgacctttttgactactttccactgacagcattggtcgagtcagaaatattttgcctgcatggtggattgtccccttcaattgaaaaccttgataacataaggaattttgatcgtgttcaagaggttccacatgaagggccgatgtgtgatctgttatggtctgacccagatgaccgatgtggttggggtatttcgcctcgcggtgcaggatatacttttggccaggatatatctgaacagtttaatcatacaaacaatttaaagttgattgcaagagctcatcagttggtcatggatggattcaactgggcacatgaacaaaaggtggttactatatttagtgcacctaattattgctatcgctgcgggaacatggcttctgttttagaagtcgatgactgcaggggccataccttcattcagtttgagccagctccgaggagaggagagccagatgttacccgtagaacacccgattactttctttgaaactactgcattggtgtcatttattttgtggttcttccactcttccacgattggggtagcacattgtttttgcacaagatgactattgggtttgcaatctaggtcataggattccaagaccgatgtaaaatacacaggtaaggtgcctgctgatttgtcttacactagaacgttgctggatttcccatcgaatagttcgcctagctgttgactcatcgtaattattgtatcatatccagcagcagaagatgtggatatcctttttcgtttttgtattttcgttctttttcgccttgtacgttttgctcacccttcccatgggtgcatgggactttattattagtggatgttttgctcttttctt

SEQ ID NO: 3516 - DNA, 1183 bp, Artemisia annua
gaaaatgagcgtggatctagcttccaacacccatggcaacctagaccaacagatcgcacacctcattcagtgcaaacccttaaacgaacctgaggttaagacgttatgtgacaaggccaaggagatcttgatggaagaaagcaatgttcagcctgtgaggagccctgtgactatctgtggtgacattcatggccaattccatgatcttgccgaacttttccgcattggaggaaagtgtcctgatacaaattacttgtttatgggcgattatgtggatcgagggtattattctgtcgaaacagtcacgctattggtggctctgaaagtgcgatatcctcagcgaatcaccattctaagaggaaatcatgaaagtaggcagatcacacaagtctacggattttatgatgaatgtctccggaaatatggctctgccaacgtttggaagacttttacagatctttttgactacttcccgttgactgcattggttgagtcagaaatattttgccttcatggtgggttgtcaccttcaattgaaacacttgatagtgtaagaagttttgatcgtgttcaagaggtcccgcacgaaggtccaatgtgtgatcttctatggtctgacccagatgaccgttgtggttatggtatctcaccacgtggagctggttacacctttggtcaagatatttctgagcaatttaatcatacaaacaacttgaagctcattgctagagctcatcagctggtcatggagggattcaactgggcacatgaccaaaaagttgtgaccatctttagtgcaccaaattattgttatcgatgtgggaacatggcttctatattggaggttgatgattgccaaggccacacatttatccagtttgaaccagctccaagaagaggagaacctgatgtcacgagaagaacaccggattatttcctgtgaggttgagtaatactcgcaactcgctgattggatgatgttttgatctaacaaatatcgggctaaagctcttaatttggtagaatgggtgtgtaaaattctggtcgttattctttgttttttactctcttgaagttaaagttattttctaacctatggtaggcttggtagctttttacgtataggattaatacaatgctgtaatttatcagtgttttcttgtacaatttattaattgcactt

SEQ ID NO: 3517 - DNA, 1603 bp, Musa acuminata
caaattcttaattccagaaatttctctctccgacgattaaaccggcgacagaggtcgaaaggtttcttctgcccttgccacccttctcccctctaatttttttccccccttccgccatctctcgccttcgagggaaagatctgtacgattgaaagagagggatttggatccggcaggctacgaagaaacctagggttagggctttcgttcctcgtggcgttcgtggcttgagaggagaagatgagcgtgaacgcggtgctggcgcccaactcccatgggaacctggacgagcagatcgcgcagctcatgcagtgcaagccgctctccgaacaagaggttagggttttgtgtgaaaaagccaaggaggtattgatggaagaaagcaatgtccagcctgtgaagagccctgtgacaatatgtggtgacattcatgggcaatttcatgatctagcggaactgtttcgaattggagggaagtgtccagatacaaattacttatttatgggtgattatgtggaccgtggatactattctgttgaaactgttacgcttttggtggccctcaaggtgcgttatcctcagcgaattaccattcttagaggaaaccatgagagccgtcagattacccaagtttatggattttatgatgaatgtttaagaaaatatggtaatgcaaatgtatggaagaccttcacagatttatttgattatttcccattgacagcactggttgaatctgaaatattttgcctgcatggtggattatctccatctattgaaacccttgatagtatacgtagctttgatcgtgttcaagaagttccgcatgagggccctatgtgtgatcttttatggtctgaccctgatgatcgatgtggttggggtatttctcctcgtggtgctggatatacttttggccaagatatatcagagcagtttaaccacaccaataaccttaagctgatagcaagagctcatcaattagtcatggaaggatacaactggggacatgaccaaaaggtagtgactatatttagtgcaccaaattattgctatcggtgtggtaacatggcctccatctgtgaagtcgatgactgtaaggaccatacatttatccagtttgagccagcccccaggagaggagagccggatgtgtctcgcagaactcctgactacttcctgtaaatcagctagtggaggagttgaattcttgattcctcacagcaagcactgcttgctaaatggcattgtgattggagacagttccctcccaggatcctacgatcagtttgacatttttattccaagctgcttggctttggtggtttggatggaatagatgtatattgatgttgaaagctgtacctctaatggggttccattgttgttggaggtagcaaggctgacaatgtagcagcgtgtatcatttccaagggaattctttggtatccaccccttttcccattttctggttatcttttcgtttttgctggaatcattttcatcctgcagagggaacttttaacgtatggagttgcttcgacaatatcatagatttagcccaccattctagatctgtttcttccttccgtctgtgtgttag

SEQ ID NO: 3518 - DNA, 1485 bp, Hordeum vulgare
gcgaccacttcttcaccacgaccacgagcgctctccgctcctcggcctcgccgctatgctatacagccgggctccaactccaactccaacccacaccgcaattatataaccaccgccgctcccacctttccagaacttttgaccccctccccacctctcgttcccctccccctccccacgcaggcgcgcgcgcggcggcgagatctgcccagggtggacccccggcgaggatgagcagcccccatggcggcctcgacgaccagatcgagcgcctcatgcagtgcaagcccctccccgaggccgaggtcagagcactgtgcgagaaggccaaggagattttgatggaggagagcaatgttcagcctgtaaggagtcctgttacaatctgtggtgatattcacgggcagtttcatgatcttgcggaacttttccgaattggtggaaagtgtccagatacaaactacttgtttatgggagattatgtagaccgtggctactattctgtcgaaactgtcacgctgttggtgtctttgaaagttcgttatcctcagcgaatcaccattcttagaggaaaccatgagagccgacagattactcaagtttatggattctatgacgagtgtttaaggaagtatggaaatgcaaatgtgtggaaaacctttacggatctgttcgactacttccccttgacagcattggtcgagtcagaaatattctgcttgcatggtggattatcaccatccatcgagacacttgataacatacgtaactttgaccgcacccaagaagttcctcatgaagggcccatgtgtgatcttctgtggtctgaccccgatgatcgatgcggttggggtatttctccccgaggcgctggatataccttcggacaggatatatcagagcagttcaatcataccaataacttaagacttattgctagagctcaccagttggtgatggagggattcaactgggctcatgagcaaaaagtggtcaccatatttagtgcacctaattattgctaccgctgtgggaatatggcatcaatcttggaagttgatgattgcagggagcatactttcatccagtttgagccggccccaagaaggggagaaccagacgtaactcgtagaacgccagactatttcctgtgatgtgaaatcggtttcgaccctctgcaccaaaggtttgataactagctgaagtttggtggccgcagataaatcctttttgctgaacgtcagtgttctgtgtgttattcctcttaattttttcgcccatgatgcccctggctgtctgcgagagccgcttcgtcgcatcatgatcaaagtgtatacctacagctggaaggatccatcgtgttactcacctcgctaattggtcgatgctccgcttggtggatgcgcctggtagtgaacatgagcatcgaaagcagcatttgtattgtgaaaggaaggcttcttcatttcccccctctgtattcaa

SEQ ID NO: 3519 - DNA, 1537 bp, Brachypodium distachyon
tttgccccctcccccacctctcgttccctccttcccacctgcggtcctccgccccacgcgcgcgcgcggccacgagatctagctcgctagggttggatccctgccggcgaggatgagcagcccccatggcggcctcgacgaccagatcgagcggctcatgcagtgcaagcccctccccgaggccgaggttagagcactctgtgagaaggctaaggagattttgatggaggaaagcaacgttcagcctgtaaagagcccagttacaatatgtggtgatattcatgggcagtttcatgatctcgcagaactatttcgaattggtggaaagtgcccagatacaaactacttgtttatgggagattatgtagatcgtggctactattccgtcgaaactgtcacgcttttggtgtctttaaaagttcgttatcctcagcgaatcaccattctaagaggaaaccatgaaagccggcagatcactcaagtttatggattctatgatgagtgcttaaggaagtatggaaatgcaactgtatggaaaacctttacagatctgtttgactacttccccttgaccgcattggttgagtcagaaatattttgcttgcacggtggattatcaccatccattgagacactcgataacatacgtaactttgaccgcatccaagaagttcctcatgaagggcccatgtgcgatcttctgtggtctgacccagatgatcgatgtggttggggtatttctcctagaggcgctggatataccttcggacaggatatatcagagcagttcaaccataccaataacttaagacttattgctagagctcaccagttggtcatggagggattcaactgggctcatgagcaaaaagtggtcaccatatttagtgcacctaattattgctaccgctgtggaaacatggcatcaatcttggaagttgatgattgcagggagcatactttcatccagtttgagccggccccaagaaggggagagccagatgtaactcgtagaacaccagactatttcctgtgatgcgaaattggtgtcgatctctgcaccaaaggtttaatagctagctgaagtttcctggttgcagataatctttttgctgaaatcgcctgtgtgctattcttattgtttttgcccatgacgcctatggctatcgcgagccgctttgctgcagcgtgatatacaagtgtatacctacagctggaaggattcgtcgtgttctcacctatctctaactgattgatgctctgcttgggggctgcagtagtagtttgttaaagcatcaagcagcatttgtattatgtgacaggaaactatttcccctttgtattcattttttcctttctccttcacacatttcagctaattttctttccatgattcttgtagagatgaacaatgtagtttgtatggttctgtgtctgagcccttaggtctttctggatccatcttgatttgccgtatagaatactttgaagaactagcattcttttcagctagtatgatttttttatttgcgatgaa

SEQ ID NO: 3520 - DNA, 1381 bp, Brachypodium distachyon
ctccgcacaactcgcggctctccgcctcctcctcctcgtccccccgcttgcggtggcctctctcggtagatccagggtcaggttcgcggcgccggcggccgtggggaacgaagacgaggggggcggaatccgcgggcgtgaggcggagaggatggggaacccgcatggcggcctcgacgagcagatcgagcagctcttgcagtgcaagcccctggccgagcccgagctgagagcactgtgtgggaaagctaaagaggttttgatggaggaaagcaatgttcagcctgtgagaagtcctgtcacaatatgtggtgatattcatggtcagtttcatgatcttgcggaactattccgaattggtgggaagtgtcctgatacaaattacctatttatgggagattacgtggaccgtggttactattctgttgaaactgtatcgcttctggtggctttgaaagttcgttatccacatcgaattacaattcttagaggaaatcatgagagccggcagattactcaagtttatggattttatgacgagtgcttacggaagtacggaagtgctactgtatggaaaacattcacagatcttttcgactatttcccgttgacagcattggtcgagtccgaaatattttgcctgcatggtggactatcaccatccatcgagacacttgataacgttcgtagctttgatcgtatccaagaagttcctcatgaggggcccatgtgtgatcttctatggtctgatcctgatgaccgatgtggttggggcatctcaccacgtggcgccggatatacttttggccaggatatttcagagcaatttaaccataccaataaccttaggctaatagcaagagctcatcagttagttatggagggattcaattgggcacatgagcaaaaggttgtgacaatattcagtgcacctaactactgttaccgttgtggtaacatggcctcaatcttggaggtagatgattgcagggagcatactttcatccagtttgagcctgccccaaggagaggagagcctgatgtgactcgaagaacgcctgactatttcttgtaaatatagcactaggttgctttgggcagcaaatgaaaagtgtgttatagttagatgcgtcgtgtgttgtgctaaatatttttttttggttatcactatttgcttcagttcttctgttgtattcacttggtcgtaatccgctctcgtctgttgggctcaggggtctcatgcagaaacttaattcttgtttagttagctgtgtagtaacatgcaacaatggcatttcttttgttaacggtgtcgacagttagactcgtgtaatttaaaatataatgttttgcgacaatttccatcaagtgtgaaaaggga

SEQ ID NO: 3521 - DNA, 1673 bp, Catharanthus roseus
tctagaatctctctctgtctcttacattgatttcaccaccaccgcacactctcggtctcccactactccgccctcaggtgcctccgaagtccaccgtatcgaacgacgtcgcagagggtgaagctagaataacgacgagacgaataagaacccgaccagggttccgttactccgtagagtgaatcaagaaaaattagaaaatgagctcggatccggcagtggcgtcgagcggcggtcttggaaatctcgatgagcagatttcccagcttatgcagtgcaaaccgttgtccgaacaagaggttagaggactttgtgagaaggcaaaggagatattaatgcaagagagcaatgttcaacctgtgaaaagccctgtgaccatttgtggtgatattcatggacaattccacgatcttgcagaactctttagaattggtggcaagtgcccagatacaaattatttgttcatgggagattacgttgatcggggatattattcagttgaaactgtaacgcttctggtggctctcaaagtgcggtaccctcaacgaatcactattctgagaggaaaccatgagagtcgtcagattactcaagtatatgggttttatgatgaatgcctaaggaagtatggtaatgcaaatgtgtggaagatttttacagacctatttgactacttcccgctgactgcactggttgaatccgagatattctgtctccatggtggattgtctccttcagtcgaaaccctggataacatacggaatttcgaccgtgtgcaagaagtaccccacgagggacccatgtgtgatctcttgtggtctgaccctgacgatcgttgtggttggggaatatcacccaggggtgctggatacacattcggccaagacatttcggagcagtttaaccatacaaacaacttgaagcttattgccagagcacaccagctggttatggaaggattcaattgggctcatgaccagaaggttgtcaccatttttagtgcacctaattattgctatcggtgtgggaacatggcatccatactggaagtagatgattgcagaggacacacattcattcagtttgagccagcccctcgaagaggagaaccagatgtaactcgaagaacaccggattacttcctataatgaggtgcacgagtgatgctgacttctgtatagcaggtccctttagctgcttttgtgtatcgacaactgttttggagattggctattatatagttcgtataaatatatggtcttgagactggtagaagcgcgcatatcacaacaggcttatatagatcatggtgcttcttccttaccattatcctgaaactgtatggaaatactgcaaatgcaacactggaaaccgggacactgcttggctgcatatgtattatttcctgcggcacaatcttctttcctctttctttctctctaccccttctgaatttccgagtctgaaacaaagtcctttgcgcttatatttttgttttgtagtagagtttcttttgagttctttcctcgatattgtgttccctaacttgtagaacaatgctccattggggcgggtttttgtgtagagggaagaatatttgttattaattccttatcatttccagttgatactccatattttcttgcttaattatgccttatattttgttctcc

SEQ ID NO: 3522 - DNA, 1554 bp, Centaurea maculosa
tcataatttcagatttctggattcaatccatttcgatcgatagaagaacgatttccttttgaaattgaaaccctagatcgaatctttgttatatgtatacacacagataacatacaagagagaagatgagtgtggatctagcttcgaacacccatggaaacctggacgaacagatttcacagctcatgcagtgcaagcctttaatcgagcctgaggttagggcattatgtgagaaggcgaaagagatactaatgggtgaaagcaatgtccagccagtaaaaagccctgtgaccatctgtggtgacattcacgggcaatttcatgatcttgctgaactttttcgcataggagggaagtgtccggatacaaattacttatttagtggggattacgtggatcgagggtattattctgttgaaactgtcacgctcttggtggctctgaaagtgcgttatcctcagcgactcacaattcttaggggaaatcatgaaagtcgtcagatcactcaagtttatgggttttatgatgaatgtcttcgaaagtatggcaatgctaatgtttggaagacttttacagatctctttgattattttccattgactgcattggttgaatcagaaatattttgccttcatggcgggttgtcaccttcaatagaaacccttgatagcataagaagttttgaccgagttcaagaggttccacacgaaggtccaatgtgcgatcttttatggtccgacccagatgaccgttgtggttggggcatttcaccccgtggagctggatacacctttggccaagatatatctgaacaatttaaccataccaacaacctaaagctgattgctagagctcatcaactggtcatggagggattcaactggggacatgatcaaaaggtcgtgaccatctttagcgcaccaaactactgctatcgatgtgggaatatggcttctattttggaagtcgatgattgcaaggggcatacgtttattcagtttgatcctgctcctagaagaggagagcctgatgtaacgagacgaacacctgattatttcctgtaagcaacggaaattgataacgattgctttgcttggtggtccatggtggtccttgctgggattgcgcttttgtttgatacaatggtaatggccaatggatatgtggttaaagttgatgaggagtgcaatgcaagggaaggaccaaatggcttgtaaaatggtttcatttttcaaattcatggttgaagggttactcatagtttgaattaagatgcatatttaaacatctgtatgctgcaattagcctttgatattttgttcattaattgtggtttatcgattaagtttgtttcataaagagaagggaccgatagatggtttattatctgtagaaggtgaatgaagcctcgatattcttaattccggtttttaaggcttgattagatcttgttaaggttctaaattagtatagtttgacgaacaacatgaactgattctaagtattactgttatggactttggggttgtttattaaatacttactggttaacta

SEQ ID NO: 3523 - DNA, 2541 bp, Citrus clementina
cgctctcttgtccacgcgcgctctcatttcgacttcgtcggctccgctacacaagactgaagaatcacacaaacgaaactctctgatctcactctagggttagggatatccctaatccggacaccgttatcccgattcggtttaggattcgagaatcaaagatgggcgcaaattcgttatccactgacacgaccaccgacctcgacgagcagatctcgcagctcatgcagtgcaagcctctctccgaaccacaggttaaagcattatgcgagaaggctaaggagatattgatggaagaaagcaatgtacagcctgtgaaaagtccagtgacaatttgtggcgatattcatgggcagtttcatgatcttgcagaactttttcaaattggcgggaagtgtccagataccaattacttgtttatgggagattatgtggaccgtgggtattattctgttgaaacagttacgctcttagtggccttgaaggtgcggtatcctcagcggatcactattcttagaggaaaccatgagagtcgtcagattactcaagtttatggattctatgatgaatgtctacggaagtatggcaatgctaacatttggaagatttttactgacctttttgactactttccgttgactgccttggtagagtcagaaatattctgtctgcatggtgggctgtccccttcaattgaaacacttgataatatcaggaactttgatcgtgttcaagaggttcctcatgaagggcccatgtgtgatttgttatggtctgacccagatgatagatgtggttggggtatctcacctcgtggtgctggatatacttttggccaggacatatctgaacaattcaatcatacaaacaacttaaaattgattgctagagctcatcaactggtcatggatggatttaattgggcgcatgaacaaaaggttgttactatatttagcgcacctaactattgttatcgctgtggcaacatggcttctatcttggaagttgatgactgtaggagccacacgttcattcagtttgagccagctcctaggagaggagaaccagatgttacacggagaacacctgattacttcctgtgaagctgcctttgtgtcatactgattcatttcacttgcttctcctcccctcattgtgtaccagtcgggcaactgtggatcctccattaatcctctgcgtgctttttttttttttttgggtggtaatgtgtccaaaaaagaacgtgagctacggtggttagatgcccttctatccgttttacacttgaaagcgttttcagaactctgctggggatattgcctaggtgatgaccaattgacgatgtcagaaatgtactaattatgtagatattcgtttttaattttcttttgcgttcaactgttccccccaccatccctcttcttttctcgtattttcctagccttaattctcatttgattttggttgggaaataaaagaatcccatatctattgagtgctttaaccttttttgttcttcccttaatatcattgacacgacactagtgcttgatattgttcacttttcaggcagtttctgttggtcgttccttttttttattttttatttttattcttttgttgacattaaactatttttcctttttattttttacttaccgtttattttttggctgttgtctattgatcattcaaatgctgaattctcgggctggggagctgaattatttgaaaaacttgcattaattgttcgtattcaatcttaaaaggaaaatttattcaaagattacacttgtgaatttggaaatttttagcccacaaaggaatcaaaatagtcaataaccacttgttttttgaatattttgcgcaatttctaattaatattctacaacacagacagctctaatatatacagcctctggtctcaccgtagccaatgataactatttactagaacaataatagtaactacaaatagcaaaagaatatgaccagtaaaaatggattactctaactaaacgtttgaatgtgatttacagaattaacagtatatagattacctgccagggacttagtaaatttatactcatcatgtcgtggaaccaccgtccacaagcatgcattataatctcaagtgagcgaaaactgatggagcaaggtctaccactgaccatgcaaggcctgcatattgaaggaacctaatgccggtgtcaacatcaaaaatgtcctgtccggagaaaaagaataatttttgggcataacttgattgcttaatcttatccgattcctttcccttgactggtgcattaagcatggggatgtagctggttgactttattgggatgcccaaggtgtttgatattacaggaacaatccattttgcaagagccttgctacagaacttcacaagaagtattgttggcattcccacaagaattcttcctacaaaggcagggattgacagttgtgggctaaagatgagtggagccgcttcatggtggaactggtagtacgtaaggtggactccagccacctgcacaa

SEQ ID NO: 3524 - DNA, 1432 bp, Cleome gynandra
cgctctcccattttcgatcctctttcactgcacacaaagcaagagagaggggaaaagcgaagaatacgcagaatccattcaatttagggttagggcaatccctaatctggaaaacttggtcccgatttctgatctgttttccggatcggaagagacgaagaggttggacaagaagtagcgagaatgggagcgaattcgtttccgacggactcaaccctcgatctcgatgagcagatctcgcagctcatgcagtgcaagcccctctcggagcaacaggttagagcattatgcgagaaagccaaggagatcttgatggaagaaagcaacgttcagcctgtaaaaagccctgtaactatctgcggtgacattcatggacagttccatgatctagctgagctttttcgtataggtggaaagtgcccagataccaattatctgtttatgggagactacgtggaccgtggatattattcggttgaaactgttacgctattagttgccctgaaagtacggtatcctcagcgaattactattctcagaggaaaccatgaaagtcgtcagatcactcaagtttatggattttatgacgaatgtctgcggaagtatggcaatgccaatgtatggaaaatcttcacagacctctttgattattttccactgacagccttggttgaatccgaaatattctgtcttcatggtggattgtccccttccattgaaacccttgacaacataaggaattttgaccgagtgcaagaagttccacatggaggacctatgtgtgatttgttatggtctgaccccgacgaccgatgtggttggggcatctcacctcgtggtgctggatatacctttggtcaggacatatctgaacagttcaatcacactaacaacttaaaactcatcgctcgagcccatcagctggtgatggatggattcaactgggcacatgagcaaaaggtggtaactatattcagtgcaccaaactactgctatcgttgtggaaacatggcctcgattcttgaggtcgatgactgcaggaaccacacgttcatccagtttgaaccagcaccaaggagaggagaaccagatgtgacgcgaaggacacctgactacttcctgtgatcttgcaaaagtccctcacagcaagacaatcagccattcccctttggttctacgcattgtgttcaggttgcttcttttgtttttgaaatcaatttagtctgtctccggaatagtgtatcataggcgaagaagacactcttcctttgttccttcctactgtaggcaacaatcatatccccaagccaaaatgagagagcccacaaatgaaacaccgttgagattgtttggctgttgatgatgcctgcatcacacttgtgtttttttctctttcttatgagattcctaattttatcttcacgtatttctc

SEQ ID NO: 3525 - DNA, 1287 bp, Cyclamen graecum
ccgccgtcgatgaaaaagtagatcggagagtcaggagagtttctctctatctctcccgatccccaattctagggttagggtttactgagctctcgtaatctatcgattaaccgatcaaatcctaattttgaatgcgacaaagaagaagatgagtacggatctggtgcaatcgaacgcacttggcaacctcgatgagcagatcgaacagctaatgcaatgcaagcccctttctgaacccgaggttaggggcctatgcgagaaagctaaggagattctgatggaagaaagtaatgtccagccagtcaaaagccctgttaccatctgtggcgacattcatgggcaatttcatgatcttgcggaactttttcgcattggagggaagtgccctgacacaaattacctgttcatgggagattatgttgaccgtgggtattactcagttgaaacagttacactcttggtggctttgaaagttcgttatcatcaacgaataactattcttagaggaaaccacgaaagtcgacagatcactcaagtgtatgggttctatgatgaatgcttgaggaagtatggaaatgcaaatgtttggaagatcttcacagatctcttcgattattttccacttaccgccttggtagaatcagagatattttgtctccatggaggattgtcaccatcaattgaaacactggataacatacgaagttttgatcgtgttcaagaagtcccacatgaaggtcctatgtgtgacctgttatggtctgaccctgatgaccgttgtgggtgggggatctctccacgtggtgctggatatacttttggccaggacatttctgagcaattcaaccaaaccaatagcctaaagcttattgctagggctcatcaattagttatggagggcttcaactggggacatgatcaaaaagttgtcaccatctttagcgcacctaattattgttatcgatgtggaaacatggcatctatcttagaagttgatgactgcaaaggacacaccttcatccagtttgagccagctccaaggagaggagaacctgatgtaacccgaagaacgcctgattatttcttataaagcaactgctggtcagatgcagcagtagatgtcgggttgttcgtaaagtgaaggtgctatgatagtgttctgcagctagtggagcctgaaagtgttcgatgacattgaaacccatgtcagatttcctagaactagcgtagtgaactctgattgttttgatgtggcattccttcgatacgttgccattttttaatctg

SEQ ID NO: 3526 - DNA, 1465 bp, Festuca arundinacea
accgcttcctcctccgcctctccgcacctctcgcagctccgcctcctcctcgtccacccctcctctctcggtcgcctctcccggtagatctggtgtcaggtttcgctgcgccggcggccggggggacgaagaagagggggaggagaggatggggaacccgcatggcggcctcgacgaggagatcgagcagctcttgcagtgcaagcccctcgccgagccaaagctgaaagcactgtgtgagaaagctaaagagattctcatggaggaaagcaatgttcagcctgtgagaagccctgtcactatatgcggtgatattcatggtcagtttcatgatcttgcggaactattccggatcggtgggaagtgtcctgatacaaactacctatttatgggagattatgtggaccgtggttactattctgttgaaactgtatcgcttctggtggctttgaaagttcgctatccacagcgaattacaattcttagaggaaatcacgagagccgacagatcactcaagtttatggattttatgacgagtgcttacggaagtatggaagtgccaatgtatggaaaaccttcacggatctttttgactatttaccattgacagcattggttgagtcagaaatattttgtctgcatgggggactgtcaccatccatcgagacacttgataacgttcgaagctttgatcgtgtccaagaagtccctcacgaggggccgatgtgtgaccttctatggtctgaccccgatgaccgatgtggttggggcatttcaccacgtggtgctggatacacatttggccaggatatttcagaacaatttaaccataccaatggccttaagctaatatcaagagctcatcagttggttatggagggattcaactgggcacacgagcaaaaggttgtgacaatatttagtgcacctaactattgttaccgctgcggtaacatggcgtcgatcttggaggtggatgattgcagggagcatactttcatccagttcgagcctgccccacggagaggagagcctgacgtgactcgaagaacgcctgactatttcttgtaaatgtagcttaggttattattttttttccacgggatagattaggttattccggcaacaaacaaaaaaagcgtgtgatagctagatgcgtctgtgtgttgtcataattttttgtttggatctcatcctcaagtaaagtggttcattctgttagcttaactcctgttgtaatcgcccagttgtaatctgctcatgttgggctcaggggtgtggtgttggataaaaggcgttgatcctcatcaagtaatttttattttggtataataggtagatgtgtagtgtaatttgctgcaatgacattgattttgtggatacagcgggactcctacatttttattgtttgcaacgagctccttggtaaagaatcctcgtggctatttaaaaaaaaaaaaaaaa

SEQ ID NO: 3527 - DNA, 1143 bp, Flaveria ramosissima
gagtgtggatcttgcttctaacacccatggaaacctcgacgaacagatctcacagctcatggagtgcaagcccttaacggagcctgaggttaagacattatgtgagaaggcaaaagagatacttatggctgaaagcaatgttcagcctgtaaaaagccctgtgacgatttgtggtgacattcatgggcagtttcatgatctcgcggaactttttcgaataggagggaagtgccctgatactaactacttgtttatgggggattacgtggatcgaggatattattctgttgaaactgtcacgctcttggtggctctgaaagtgaggtatccacagcgaattacaattctaagaggaaatcatgaaagtcgtcagatcactcaagtctatgggttttatgatgagtgccttcgaaagtatggcaatgctaatgtttggaagacgtttactgatctctttgactattttccattgactgcattggttgaatcagaaatattttgccttcatggtgggttgtccccttcaattgaaactcttgacagtataaggaactttgaccgtgtgcaagaggttccacacgagggtccaatgtgtgatcttctatggtctgacccagatgaccgttgtggttgggggatttcaccacgtggggccggatacacctttggccaagatatctctgagcaatttaatcataccaacaaccttaagcttattgctagagctcatcagcttgtcatggagggattcaactggggacatgagcaaaaagttgtcactatcttcagcgccccaaattattgctatcgatgcggaaacatggcttctatcctggaagttgatgattgcaagggccacacttttatccagtttgatcccgctcctaggagaggagaacctgatgtaaccagacgaacccctgattacttcctgtgaacggttcacttatactgattcatggtcctctggcaagattcaggcttttgatgcaatgatatgggccaaaggtcatcaggggaagcgcaagaaaaggataagatggtttgtaaaatggacattgtatgattctaggtgatttgtttgttaccattctcttattcgggcctttccaaatcgtaataggtcttttatatatctgtcaa

SEQ ID NO: 3528 - DNA, 1468 bp, Panax ginseng
agagagaattattagggtttgggtggttcgaagaaattacgcatggatccggtgcactcgagcgctaatggcaatcttgacgaggaaattgtccagcttatgcagtgcaaacccttatctgagcaagaggttagggtgctgtgtgagaaggctaaggagattctaatggatgaaagcaatgtgcagcctgtgaaaagcccggtgacgatttgtggtgatattcatgggcaattccatgatcttgcagagctgtttcaaattggggggaagtgtccagatactaattacttatttatgggagattatgttgatcgtggctattattcagttgaaacagtaacgctcttggcggcgctcaaagtgaggtatcctcagcgaattactattttgagaggaaaccatgagagtcgtcagattactcaagtttatggattttatgatgaatgcctaagaaaatatggtaatgccaatgtgtggaagatctttacagatctgttcgactattttccccttacagcattggtcgaatcagaaatattttgtctccatggtggattgtctccttcaattgaaaccctcgataatattcgtaattttgaccgtgttcaagaagttcctcacgagggacccatgtgtgatcttctatggtctgaccctgatgatcgttgtggttggggtatctcgcccagaggcgctggatatacttttggccaagatatatctgagcagttcaaccataccaacaacttaaagcttattgctagagcacatcagcttgttatggagggattcaactggggccatgagcaaaaggtggtaactatatttagtgcacccaattattgttatcgatgtggtaacatggcatcgatcctagaagtagatgattgtaaaggacacacattcattcagttcgaaccagctcccaggaggggagagcctgatgtaactcgaagaacaccagactatttcctatgattcagtaggataaattgctgaatttcgagctgtgagtgcctggtagctgctttatgtgttttagagctatctaaaatatttgaagtcatactatgatgaggtgggtagtgaaaaacatgtaaaatgggcagtgtaacatctactttggctcggttattatcctggaaccatatggagatactagaaacaaggcagtggagctggtgatatcatgtatgcggcgtaatgtaccatttactgcataacaatgcggcatcctctcttctcattcacttcaacctttagttctgctcattttttgtctgttgtagaaggatcgactatttgggatggggtggggttctgtagatgcaaaagtattttttccttcctttccaattgtttaaggggtgtttttagttgttgacacattttaagtttgctgattatttttccacatatcagatgcggaattgaatgattgtttcttttttcacttctctcaatgtag

SEQ ID NO: 3529 - DNA, 1816 bp, Panax ginseng
agggtttgcccattggtttcaccaccaccgctcgctcccactcccctctcttcactgtctacaacgaacaaccacaaggaggaagaagaagaaagagataattattagggtttgggtggttcgaagaaattacgcatggatccggtgcactcgagcgctaatggcaatcttgacgaggaaattgcgcagcttatgcagtgcaaacccttatctgagcaagaggttagggtgctgtgtgagaaggctaaggagattctaatggatgaaagcaatgtgcagcctgtgaaaagcccggtgacgatttgtggtgatattcatgggcaattccatgatcttgcagagctgtttcaaattggggggaagtgtccagatactaattacttatttatgggagattatgttgatcgtggctattattcagttgaaacagtaacgctcttggtggcgctcaaagtgaggtatcctcagcgaattactattttgagaggaaaccatgagagtcgtcagattactcaagtttatggattttatgatgaatgcctaagaaaatatagtaatgccaatgtgtggaagatctttacagatctgttcgactattttccccttacagcattggtcgaatcagaaatattttgtctccatggtggattgtctccttcaattgaaacccttgataatattcgtaattttgaccgtgttcaagaagttcctcacgagggacccatgtgtgatcttctatggtctgaccctgatgatcgttgtggttggggaatctcgcccagaggcgctggatatacttttggccaagatatatctgagcagttcaaccataccaacaacttaaagcttattgctagagcacatcagcttgttatggagggattcaactggggccatgagcaaaaggtggtaactatatttagtgcacccaattattgttatcgatgtggtaacatggcatcgatcctagaagtagatgattgtaaaggacacacattcattcagtttgaaccagctcccaggaggggagagcctgatgtaactcgaagaacaccagactatttcctatgattcagtaggataaattgctgaatttcgagctgtgagtgcctgctagctgctttatgtgttttaggagctatctaaaatatttgaagtcatactatgatgagttgggtagtgaaaaacatgtaaaatgggcagtgtaacatctactttggctcggttattatcctggaaccatatggagatactagaaacgaggcagtggagctggtgatatcatgtatgctgcgtaatgtaccatttactgcataacaatgcggcatcctctcttctcattcacttcaacctttagttctgctcattttgtctgttgtagaaggatcaacaatttgggatggggtggggttctgtagatgcaaaagtaattttttccttcctttccaattgttcaaggggtgttttgtttttagttgtcgacacattttaagtttgctgattattttccacacatcagatgctgaattgaatgattgtttcttttcacttctctcaatgtagaaggagtgtttgtaaagtttaaaaaaaaaaaaaaaaacaaaaaaaaaaaaacaaaaaaaaaaaaaacaaaaaaaaaaaaaacaaaaaaaaaaaacaaaaaaaaaaaacaaaaaaaaaaaaacaaaaaaaaaaaacaaaaaaaaaaataaaaaaaacaaaaaaacaaaaagtaaagaaagaagaaagaagaacaagaagaagacacaacaacacacaacacacacacacacacacacaacacacacacacaaca

SEQ ID NO: 3530 - DNA, 1502 bp, Liriodendron tulipifera
gtttcagagagagtgagagaggaagacagtagaacgagggttagggcttttttccccttcttctcgaagagagaggagagagaaggttcggttttgaagggaagaatatgagtgcggatccggtcccttcttcgaactcccatgggcagctcgacgagcagatttctcagctcatgcagtgcaagcccctctccgagcaagaggttagagcgttgtgtgagaaggccaaggaaatactgatggaagaaagcaatgtccagcctgtgaaaagtcctgtaacaatatgtggcgatattcatgggcaatttcacgatcttgcagaactttttcgaattggaggaaagtgtccagatactaattacttgtttatgggagactatgtggatcgtggatattattcagttgaaactgtaacgcttctggtggcgctaaaggtgcggtatccccaaagaattactattcttagaggaaatcatgaaagtcgccagattacccaagtttatggattttacgatgaatgcctacgaaagtatggtaatgcaaatgtatggaagatctttacagaccttttcgactattttccattgacagctttggttgaatcagaaatcttttgtctgcatggcggcttgtctccttctattgagacccttgacaacatacggaattttgatcgcgttcaagaagtcccacatgaaggtcccatgtgtgacctcttatggtctgacccagatgaccgctgtggttggggtatttctccgcgtggagctggatatacctttggccaggacatatcggagcaattcaaccataccaacaaactaaaacttatagccagggcccaccagttggtcatggaaggattcaattggggacatgaacacaaggtggtgaccatatttagtgcacctaattattgctaccggtgtgggaacatggcatcaatcttggaagtcgatgactgcaaagggcacacattcatccagtttgagccagctccaaggagaggagagcctgatgttacccgaagaacgcctgactacttcctatgatgcagctatctcggttcttgctgattttccggcggcatatgtatgcttgctggttgacgttggggttgcagataatgtcgagaaatctattatcggattaacatttataatttcaagctgctatgcttggcgggggggaattcatgtaaaatgagcaggtaaggctcccgttatttgtttctgttcagaactgtgctgaattcttcacaaggaggcagagcaggtgacgacgctgcagctgcatgtaccattttccaggaaatcttgcggtatttttattcctttgatttttcaccccgcctttttttcttttcttttttgggcatgtagagggaagtgattctatttccagaggctgccttgtcatttgcttagttttcattttagctgattgattagattggtgtttggatagctgctgctgctgctgtctttccccccaaaaaaaaa

SEQ ID NO: 3531 - DNA, 1949 bp, Pinus pinaster
ctctgccaaagaccgaccgggccaaagcaagaaaggaaggcattcgttaaaggcaccatatatcgggcacacaaatattttattttgttcgatagaaagctgcagcagcagcagtgcggaccaacggacagcaaccacaaggtcgagggttcaattctcaggaagtggccgaaagacacagggacggcggggcgacaaggggagagagagaaaggagagcatctcgacaccgaacaagatgagcgcggagccggtctcgtcgtccagcggttatggccaactcgatgcccagattgaacagcttatgcagtgcaagcccctctcagaacaggaggtcagaggattgtgtgaaaaggccaaggagattctcatggaagaaagtaatgtgcagcctgtcaagtgccctgttacaatctgtggtgacatacatggtcaatttcacgatcttgcagagctgttccggattggtggaaagtgtccagatacgaattatttgttcatgggtgactatgttgaccgaggatactattcagtcgagactgtcactcttctagtgtcattgaaggtgcgatatccccaacgaattaccattcttcgaggaaatcatgagagtcgtcagattactcaagtatatggattctatgatgaatgtttacggaagtatggaaatgcaaacgtctggaagatatttacagacctttttgactacttcccattgacagcactggtagaatcagaaattttctgcttacatggtggtttgtcaccttccattgacacattagataacataaggaattttgaccgtgttcaagaagtgcctcatgaaggtcccatgtgcgatcttttgtggtcagatccagatgatagatgtggatggggaatctctccacgtggtgcagggtatacatttggacaggatatatctgaacaatttaatcatacaaacaacttgaaacttattgctagagctcatcaacttgtcatggaaggcttcaactgggggcatgagcaaaaggttgtcacgatatttagtgcaccgaactactgctatcggtgtggtaatatggcatctattttggaagttgatgatactaaaggacatacttttattcagtttgagccagcgccaaggcgaggagaaccagatgtgacacggaggacaccagactattttttatgatttgttctattgtatgtctgctgcttgctgtttttctgccatcaagcctccgtctgctatttgatctttggagctgccactttatgatcatacgcatactgttgatgcaaaagcttttcagagtttcaaattgatacactacattcaaattatgcttcagggtggatgggggaagcatgtattatgatcaggtattacctgcaaaggtctgtgttttgttagtttggaacactttctgtaggcggtgcaagtgcactgtgtatccatttaagatgctgctttaatgtagggagaggcaatttatttgccaagtgtttatttaatctttaacgttgtaaacacttatatttgggcattgtctgctgattgagtagtctgcccatttcaatctcattagctggtagtttgggacaattgctgttaccaacgctcatgagaaattgcattttattgtgcctttaacctatccatggattggagaatccctacttcacaaatcctgattctcacggaatatttcaggaaagcaggttttctgtatttaattttagcagatattatccatttgcaagcacatcgtagggtcaaggatcggacgttggtaaatgcaaaagggcacattttttttttgtggctgtgatattatttaactcgaagtttgtaattttaaagtgaaattatcagcgttttctgctaaatttgttttggaagcatataattttgtgtttctgatccttgaggtaattggatcattttcagaataagt

SEQ ID NO: 3532 - DNA, 1198 bp, Nicotiana benthamiana
agagggctctttccaattttccctttctttggttccatcaacgccactcactcctctctctttctctctcttgagtggagccgaggaaacgatgtcgtatagcacctgaaacaagaacaacaaacaaccaaatcaaacccaccacccccatttccccttctgctgtgaattgtggtaaagttccaagctttttgtattttttgtgcttgttgtgaagaaaagattcaaacccagaagggaaaaaatgagcttagatccagtggtgtcatctcaaggaaatcttgatgagcaaattgctcagcttatgcagtgcaaacccttatccgaacaagaggtaagaggattatgcgggaaagcaaaggagatcttaatgaatgaaagcaacgtgcagccagtgaaaagccctgtgactatatgtggtgatattcacgggcaattccatgatcttgctgagcttttccgtattggtgggaagtgtcccgacactaactatctatttatgggagattatgtagatcgtggatactattctgttgaaacagtaacgcttttggtggctctcaaagttcggtatcctcagcggattacaattttgaggggaaatcatgagagccgtcagattactcaggtttatgggttttatgatgaatgtttacgaaaatatggtaatgccaatgtgtggaagacttttacagatctatttgactatttcccgctcacagctttggttgaatccgaaattttttgcctccatggtggtttgtctccatctattgaaactcttgataatattcgtaattttgaccgagtccaagaagttccacatgagggggccatgtgtgatcttttgtggtccgatcctgatgatcgatgcggctggggtatttcacccaggggtgctggatatacatttggccaagatatatctgagcagtttaaccacaccaacaacttaaaactaattgcgagagcacaccaactggttatggagggattcaattgggcacatgatcaaaaagtggttaccatatttagtgcccctaattattgctaccgctgtgggaatatggcatccatcttggaagttgacgactgcaatggccatacattcattcagtttgaaccagctcctagaagaggggaaccagatgtaacccgaagaacgccagattacttcttatgatgaagcaacagaaac

SEQ ID NO: 3533 - DNA, 1448 bp, Nicotiana benthamiana
ccggtgccatcgagcgcatctcatggaaatcttgacgaacaaattgctcagcttatgcagtgcaaacccttgtctgaacaggaggtaagaggactatgtgagaaagcaaaggagattctaatggaagagagcaacgtgcagcctgtgaaaagccctgtgactatatgtggtgatattcatggtcagttccatgatcttgctgagctttttcgaattggtggaaagtgtcctgacactaattatttgttcatgggagattatgtggatcgtggatactattctgttgaaacagtaacgcttttagtggctctcaaagtgcgatatccccagcgaattacaatcctaaggggtaatcatgagagtcgccagattactcaggtttatgggttttatgatgaatgcctgcggaaatatggtaatgccaatgtgtggaagactttcacagatctgttcgactactttcctctgactgctttggttgagtcagagattttttgcctccatggtggtctgtctccatctattgaaactcttgataatattcgcaattttgaccgtgtacaagaagttccacatgagggtgctatgtgtgatcttttatggtctgatcctgatgatcgatgtggttggggtatctcacctaggggagctggatatacatttggccaagatatctctgagcagtttaaccacaccaacaacttgaagctaattgctagagcacaccagctggttatggagggtttcaattgggcccacgatcaaaaggtggttaccatctttagtgcacctaattattgttaccgttgtggcaatatggcatccatcttggaagttgatgattccagggagcgcacattcattcagtttgaaccagctccaaggagaggggagccagatgtaacccgaagaacacctgattacttcttatgatgcaaatgcacaaacctcttgatttttgtgcagaaggccctgctaactgctttatatgctacgagcctcttaccagtttgtagtttttttcccgctatggtggcgctactactactatgaaatgaagcatgtaaatcaggcatgtgatactgaaacctcattgaaatgctgtgaagagatggtgaagccagcgacaaagggtgcatgtatcattttttggcgcagacaatattttaactcttttttccccctttgatcctatattttttggttagatagaaaggacaatgatgtgctttgtgataattcttgtccccttacaaggacaatccctgtcgtataagctttatagaggtaagatgattatttttaacaccgtttaaatgcgtgctcctgtaatgttctatttggtaatgactctattttggtttctcaaagtggttttgttcaagtttgttggtatttttcagctcatgcttgacagttgagtttgatcctcaagttatttcgcagca

SEQ ID NO: 3534 - DNA, 1248 bp, Allium cepa
cgctctctgcaaaagagggagaaataggattagtcccatttctaaattaataaattagggttagggtttcgagctagaaaaaaggtggagaagagaatgggcgtagatccagtgccttcctcgaattctcatggcaatctcgacgaagaaatcgctcagctcatgcagtgcaagcctctttccgagcaggaggttaaagtcctgtgtgagaaggcaaaggagattttaatggaagaaagcaacgtccaacctgtcagaagtcccgttacaatttgtggtgacattcatggacaattccatgatcttgctgaactttttcgaattggagggaagtgcccagatacgaattacttattcatgggggattatgtagaccgtggctattattcagttgaaactgtcacgctcctcgtggccctaaaagtgcgatatcctcagcgcattaccattctcagaggaaaccatgaaagtcgtcagatcactcaagtatatggattctatgatgaatgcttgcgaaagtatggaaatgctaatgtttggaagatatttacagatcttttcgactatttccctttaacagcactggttgaatctgaaatattctgtctgcatggtggactgtcaccatctattgatacacttgataacatacgcaacttcgaccgtgttcaagaggttcctcatgaaggccctatgtgcgacctcctatggtctgaccctgacgataggtgtggttggggtatctctcctcgtggtgctggatatacttttggtcaggatatatcagagcaattcaatcacactaacaatctcaagctgatagctagagcccatcagttagtcatggagggatacaattggggccatgaacaaaaggtggtaacaatattcagtgctcccaactactgctaccgatgtggaaatatggcttctattctggaagtcgatgactgcaaaggccacacgtttatccagtttgaacctgctcctagaagaggggaacccgacgttactcgcagaacacccgattatttcctctaatgcagtacccatttgcacatgtgtttgttagcattttctaatgagagcccagttctctctatatgagaggagcaattgcagataatttgcagatattagtttattcgttcttgttgaaaatggctgttgctttggttacctggttgtttgattgctaatcttgatatatgcaaagcaaaagctcttttcaacaagaacgaataaact

SEQ ID NO: 3535 - DNA, 1226 bp, Allium cepa
ctttgcagaaagagggagaaataggcatagtcccatttcttaattaataaattagggttagggttccgagctagaaaaaaggtggagaagagaatgggcgtagatccggtgccttcctcgaattctcatggcaatctcgatgaagaaatcgctcagctcatgcagtgcaagcctctttccgaacaggaggttaaagtcctgtgtgagaaggcaaaggagattttaatggaagaaagcaacgtccaacctgttagaagtcctgttacaatttgcggtgacattcatggacagttccatgatcttgctgaactttttcgaattggcgggaagtgtccagatacaaattacttattcatgggagattatgtggaccgaggctattattcggttgaaactgtcacgctccttgtggcactaaaagtgcgttatcctcagcgcattaccattctcagaggaaaccatgaaagccgtcagatcactcaagtctatggattctacgatgaatgcttgcggaagtatggaaatgctaatgtctggaagatatttacagatcttttcgactatttccctttaacagcactggttgaatctgaaatattctgtctgcatggtgggctgtcaccatctattgatacacttgataacatacgcaacttcgatcgtgttcaagaggttcctcatgaaggtcctatgtgcgatctcttatggtcggaccctgatgatagatgtggttggggtatctctccacgtggtgctggatatacttttggtcaggatatatcagagcaattcaaccatactaacaatctcaagctgatagccagagcccatcagttagtcatggagggatacaactggggccatgaacaaaaggtggtaaccatattcagtgctcccaactactgctatcgatgtggaaacatggcttctattctggaagtcgatgactgcaaaggccacacctttatccagtttgaacctgctcctagaagaggggaacctgacgttactcgcagaacacccgattatttcctctaatgcagtacccaatttgcacgtgtttgttagcattttctaatgagagccaagttctctcaatatgagaaaagcaattgcagataatttgcagatattagtttattcgttcttgttgatgaaaatggttgttgctttggttacctggttgtttgattgctaatcttgatatgcaaagcaaagctcttttt

SEQ ID NO: 3536 - DNA, 2541 bp, Citrus sinensis
cgctctcttgtccacgcgcgctctcatttcgacttcgtcggctccgctacacaagactgaagaatcacacaaacgaaactctctgatctcactctagggttagggatatccctaatccggacaccgttatcccgattcggtttaggattcgagaatcaaagatgggcgcaaattcgttatccactgacacgaccaccgacctcgacgagcagatctcgcagctcatgcagtgcaagcctctctccgaaccacaggttaaagcattatgcgagaaggctaaggagatattgatggaagaaagcaatgtacagcctgtgaaaagtccagtgacaatttgtggcgatattcatgggcagtttcatgatcttgcagaactttttcaaattggcgggaagtgtccagataccaattacttgtttatgggagattatgtggaccgtgggtattattctgttgaaacagttacgctcttagtggccttgaaggtgcggtatcctcagcggatcactattcttagaggaaaccatgagagtcgtcagattactcaagtttatggattctatgatgaatgtctacggaagtatggcaatgctaacatttggaagatttttactgacctttttgactactttccgttgactgccttggtagagtcagaaatattctgtctgcatggtgggctgtccccttcaattgaaactcttgataatatcaggaactttgatcgtgttcaagaggttcctcatgaagggcccatgtgtgatttgttatggtctgacccagatgatagatgtggttggggtatctcacctcgtggtgctggatatacttttggccaggacatatctgaacaattcaatcatacaaacaacttaaaattgattgctagagctcatcaactggtcatggatggatttaattgggcgcatgaacaaaaggttgttactatatttagcgcacctaactattgttatcgctgtggcaacatggcttctatcttggaagttgatgactgtaggagccacacgttcattcagtttgagccagctcctaggagaggagaaccagatgttacacgcagaacacctgattacttcctgtgaagctgcctttgtgtcatactgattcatttctcttgcttctcctcccctcattgcgtaacagtcgggcaactgtggatcctccattaatcctctgcgtgcttttttttttttttgggtggtaatgtgtccaaaaaagaacgtgagctacgggggttagatgcccttctatccgttttacacttgaaagcgttttcagacctctgctggggatattgcctaggtgatgaccaattgacgatgtcagaaatgtactaattatgtagatattcgtttttaattttcttttgcgttcaactgttccccccaccatccctcttcttttctcttattttcctagccttaattctcatttgattttggttgggaaatacaagaatcccatatctattgagtgctttaaccttttttgttcttccctttatatcattgacacgacactagtgcttgaaattgttcacttttcagacagtttatgttggtcgttccttttttttattttttatttttattcttttgttgacattaaactatttttcctttttattttttatttaccgtttattttttggctgttgtctattgatcgttcaaatgctgaattctcgggctggggagctgaattatttgaaaaacttgcattaattgttcgtattcaatcttaaaaggaaaatttattcaaagattacacttgtgaatttggaaatttttagcccacaaaggaatcaaaatagtcaataaccactgctttttcgaatattttgcgcaatttctaattaatattctacaacacagacagctctaatatatacagcctctggtctcaccgtagcaaatgataactatttattaaaacaataatagtaactacaaatagcaaaagaatatgaccagtaaaaatggattactctaactaaacgtttgaatgtgatttacagaattaacaggtatatagattacctgccagggacttagtaaatttatactcatcatgtcgtggaaccaccgtccacaagcatgcattataatctcaagtgagcgaaaactgatggagcaaggtctaccactgaccatgcaaggcctgcatattgaaggaacctaatgccggtatcaacatcaaaaatgtcctgtccggagaaaaagaataatttttgggcataacttgattgcttaatcttatccgattcctttcccttgactggtgcattaagcatggggatgtagctggttgactttattgggatgcccaaggtgtttgatattacaggaacaatccattttgcaagagccttgctacagaacttcacaagaagtattgttggcattcccacaagaattcttcctacaaaggcagggattgacagttgtgggctaaagatgactggagccgcttcatggtggaactggtagtacgtaaggtggactccagccacctgcacaa

SEQ ID NO: 3537 - DNA, 1891 bp, Pinus taeda
ggccaaagcaagaaaggaaggcattcgttaaaggcaccatatatcgcgcacacaaatattttatttttgttcgatagaaagctgcagcagcagcagtgcggaccaacggacagcaaccacaaggtcgagggttcaattctcaggaagtggccgaaagacacagggacggcggggcgagaaggggagagagagaaaggagagcatttcaacaccgaacaagatgagcgcggagccggtctcgtcgtccagcggttatggccaactcgatgcccagattgaacagcttatgcagtgcaaacccctctcagaacaggaggtcagaggactgtgtgaaaaggccaaggagattctcatggaagaaagtaatgtgcagcctgtcaagtgccctgttacaatctgtggtgacatacatggtcaatttcacgatcttgccgagctgttccggattggtggaaagtgtccagatacgaattatttgttcatgggtgactatgttgaccgaggatactattcagtcgagactgtcactcttctagtgtcattgaaggtgcgatatccccaacgaattaccattcttcgaggaaatcatgagagtcgtcagattactcaagtatatggattctatgatgaatgtttacggaagtatggaaatgcaaacgtctggaagatatttacagacctttttgactacttcccattgacagcactggtagaatcagaaattttctgcttacatggtggtttgtcaccttccattgacacattagataacataaggaattttgaccgtgttcaagaagtgcctcatgaaggtcccatgtgcgatcttttgtggtcagatccagatgatagatgtggatggggaatctctccacgtggtgcagggtatacatttggacaggatatatctgaacaatttaatcatacaaacaacttgaaacttattgctagagctcatcaacttgtcatggaaggcttcaactgggggcatgagcaaaaggttgtcacgatatttagtgcaccgaactactgctatcggtgtggtaatatggcatctattttggaagttgatgatactaaaggacatacttttattcagtttgagccagcgccaaggcgaggagaaccagatgtgacacggaggacaccagactattttttatgatttgttctattgtatgtctgctgcttgctgtttttctgccatcaagcctccatctgctatttgatctttggagctgccactttatgatcatacgcatactgttgatgcaaagcttttcagagtttcaaattgatacactacattcaaattatgcttcagggtggatgggggaagcatgtattatgatcaggtattacctgcaaaggtctgtgttttgttagtttggaacactttctgtaggcggtgcaactgcactgtgtatccatttaagatgctgctttaatgtagggggaggcaatttatttgccaagtgtttatttaatctttaacgttgtaaacacttatatttgggcattgtctgctgattgagtagtcagcccatttcaatctcattagctggtagtttgggacaattgctgttaccaacgctcatgagaaattgcattttattgtgcctttaacctatccatggagtggagaatccctacttcacaaatcctgattctcacggaatatttcaggaaagcaggttttctgtatttaattttagcagatattatgcatttgcaagcacaccgtagggtcaaggatcggacgttggtaaatgcaaaagggcacattttatttttgtggctgtgatattatttaactcgaagtttgtaattttaaagtgaaatttggtaaatgcaaaagggcacattttatttttgtggctgtgatattatt

SEQ ID NO: 3538 - DNA, 1700 bp, Podocarpus macrophillus
atttctaagggaaaatgagcgtggagcccgtctcggcaaatggctatggccagcttgacaaccagattgagcaacttatgcagtgcaagcccctctccgagcaggaggttcgaggattgtgtgaaagggcaaaggagattttgatggaagaaagtaatgtgcagccagtcaagtgccccgttacaatctgtggtgacattcatggtcaatttcatgatcttgcagagctcttccgtattggtggaaagtgtccagataccaactatttgttcatgggagactacgttgatcgtggatactattcagttgaaactgtcactcttctagtagcattgaaggtacggtatcctcaacgaatcaccattttacgaggaaaccatgagagtcgtcagattactcaagtatatggattctatgatgagtgtttacggaagtatggaaatgcaaatgtctggaagatattcacagatctttttgactacttcccattgactgcgcttgtggaatcagaaatattctgccttcatggtggtttgtcaccttctattgatacccttgataacatcaggaatttcgaccgtgtccaagaagttcctcatgaagggcccatgtgtgatcttttatggtctgatccagatgatagatgcggatggggcatttctccacgtggtgcaggatacacatttggacaagatatttccgagcaatttaatcatacaaacaatctaaaattgatagctcgagctcatcaacttgttatggaaggatataattggggacatgagcaaaaggtggttaccattttcagcgcacctaactactgctatcggtgtggtaatatggcatctattctggaagttgatgattataaaggacacacatttattcagtttgagccagccccacggcgtggagaaccagatgtcacccgtagaacaccggattactttttatgattgacgctgttggatatctgctgcttgctgtttttctgcgagcaagccttatgctgatgtttaatcttcagcacttctgttatatgaccatgcaaatgtttgttgatcacaaagcttttcagagttgctattggattacattatcttgaaattatgcttcaaagtggatggaagaagcatgtaatatgatcagatatttccctcaagggtctggtatttttcgttagaaactttatttgtagacgtgcattttgcactgccaagtgtaccaaattatgatgtgtggtctaggaagaggcaattaatttcaaggtttatttaattataacacttgtattaggcatcactgcttatttgtagtcttgcctgtttctatctctttggtcggtagtttggggtaattgctgataccaacactggtgagcagcttcggtttggtttttctaaccaattcatacatatttcagaatatatgtgcttctgaaaacttgtatcttggtaggcctcaattttcattgtgttgaaacattgaggattattacaaacatgctgctatatttggagagttcttttgctgcttttaatagatgccatcctttatcaaggaactcgaaaaggcaagaatctgaacagtgataaatgcaaaattgcagatttgtgtttgtgcttttcatattttgtgaactgtatatctcaatgcttgtatgtatatctgtgaaaattgtgtataaaagtcgatgttcg

SEQ ID NO: 3539 - DNA, 1669 bp, Papaver somniferum
gatgaggcagtgacaaacaaagctttgtacagtcgggaagggtgatagctaagagagagagttctgtaacgcaataataaaggcgatctgagaagaagatagaagaggagaattgttgtctcgtttaccaccaattcatcgctctctgtcttacttcattaattttagggttagggttttaatatacctttcttctctggtggattgtattgctgagaagtaatttattatttttggagaaaatgagtgtggatccggtttcaaccaacactcatggcaacatcgatgagcagatttcacagcttatgcagtgcaagcccttacccgaacaagaggtcaggacattgtgtgagaaggctaaagagatattaatggaagaaagcaatgtacagcctgttaaaagtccagtgacgatatgcggcgacatccatgggcaatttcatgatcttgcagaactttttcgcatcggaggaaagtgtccagataccaattatttgtttatgggagactatgtggatcgtggttattattcagtggaaacagtaactctgctggtcgccctgaaagtgcgatacccgcaaagaattaccattcttagaggaaatcatgaaagtcgccagataacacaagtctacgggttctacgatgaatgtttgcgaaagtacggcaatgcgaacgtgtggaagacttttacggacctatttgactattttccattgacagccttggtggaatcagaaattttttgtttgcatggtggattgtcaccatctattgagacccttgataacatacgcaattttgaccgtgtacaagaagttcctcatgaagggcccatgtgtgatctcctgtggtctgatcctgatgatcgatgtggctggggtatttctccccgtggtgctggttacacatttggtcaggacatatctgagcaattcaaccatacaaacaacctgaagctgattgctagagctcatcaactagtaatggagggtttcaactggggacatgaacaaaaagtggtaacaatatttagtgctcctaattattgctatcgctgtggaaacatggcatcgatcttggaagttgatgattgcaggggccacacttttatccaatttgagcccgctccaaggagaggggagccagatgtgacacggagaacgcctgattacttcttataacgtgacttttcattttcgtacgagttgttgccaattttcaagcggcaattgctgggttggtggatgacaacgatgggatggttgcgatctgtttcctagcagatgttttatcggatgtaagattcatcatgtcaacctgctgtgtttagtaggctgttggtagtgatctttgcaggttataaaagaagaaaaaagctttaaaatgaggcagtgagtactaccaaaatttggatagttttttagtcttagtgctagattccctttaaaaaggaggcagtagtactggctacgctgcaggagagcttgtaactcatccagctagactttttcttttgcatctggttctctcattctctctttcggtcttttcatttgtagactggagcagagtagcagacaatagtattttcaaagagtgcctttccatcatttcctaaacttttggctgttttgtggttccacaagatttatgtaaaacgctacag

SEQ ID NO: 3540 - DNA, 1695 bp, Papaver somniferum
cgatgatgaggcagtgaacaaaaccaaaagcttttgtacaagacaacagtcggaagggtgatagctaagagagagagagttctgtaacgcaataataaaaggcgatctgagaagaagatagaagaggacaattgttgtctcgttttaccaccaattcatcgctctctgtcttacttcccactcattaatttagggttagggtttctaatatacctttgtcgattgtattgctgaaaagtaattttattttatttttggaagaaaatgagtgtggatccggtttcaaccaacactcatggcaacatcgatgagcagatttcacagcttatgcagtgcaagcccttacccgaacaagaggtcaggacattgtgtgagaaggctaaagagatattaatggaagaaagcaacgtacagcctgttaaaagtccagtgacgatatgcggtgacatccatgggcaatttcatgatcttgcagaactttttcgcatcggaggaaagtgtccagataccaattatttgtttatgggagactatgtggatcgtggttattattcagtggaaacagtaactctactggtcgccctgaaagtgcgatacccgcaaagaattaccattcttagaggaaatcatgaaagtcgccagataacacaagtctatgggttctacgatgaatgtctgcgaaagtacggcaatgcgaacgtgtggaagacttttacagacctatttgactattttccattgacagccttggtggaatcagaaattttttgtttgcatggtggattgtcaccgtctattgagacccttgataacatacgcaattttgaccgtgtacaagaagttcctcatgaagggcccatgtgtgatctcctgtggtctgatcctgatgatcgctgtggctggggtatttctccgcgtggtgctggttacacatttggtcaggacatatctgagcaattcaaccatacgaacaacctgaagctgattgctagagctcatcaactagtaatggagggtttcaactggggacatgaacaaaaagtggtaacaatatttagtgctcctaattattgctatcgctgtggaaacatggcatcgatcttggaagttgatgattgcaagggccacacttttatccaatttgagcccgctccaaggagaggggagccagatgtgacacggagaacgcctgattacttcttataacgtgacttttcatttcagtacgagttgttgccaattttcaagcggcaattactgggttggtggatgacaacgatgggatggttgcgatctgtttcctagcagatgttttatcggatgtaagattcatcatgtcaacctgctgtgtttagtaggctgttggtagtgatctttgcaggttacaaaagaagaagaaaagcttttaaaatgaggcagtgaatactacaaaaatttggatagttttttagtcctagtgctagattccctataaaaggaggcagtagtgctggctacgctgcaggagagcttgtaactcatccagctggtacttttttttttttttgtcatctggttctctcattttctctttagtggagcagacaaaagtattttcaaagagtgcttttccatcatttcctaaacttttggctgttttgtttttccacaagttttctgtaaaacgcaacagaccaaactataatttctataata

SEQ ID NO: 3541 - DNA, 1412 bp, Primula obconica
agatcagagagtccctctcttttcgattttaccaatctctctctctttctctctctttctctccgccattggcacggatccgaattctagggttagggtttacagatcgattttcgtatctgtatgtgagagaagatgagtacggatcttgtccaatccaacgctcacggcaacctcgatgagcagatccaacagctcatgcaatgcaagcccctttccgaacccgaggttaggggactatgcgagaaagctaaagagatactaatggaagaaagtaatgttcagcctgtaaaaagccctgtgaccatttgtggcgacattcatgggcagtttcatgatcttgccgaactttttcgcatcggaggaaagtgcccagacacaaattacttgttcatgggagattatgttgaccgtgggtattactcggttgaaactgttacgcttctggtcgctttgaaagttcgatatcatcaacgaattactattcttagaggaaaccatgaaagtcgtcagatcactcaagtatatgggttctatgatgaatgcttgagaaagtatgggaatgcaaatgtctggaagattttcacagatctatttgattacttcccacttactgccttggtggaatcagaaatcttttgtctacatggtggattatcaccttccattgaaacactggataacatacgaagttttgatcgtgttcaagaagtgccacacgaaggtcctatgtgtgacctgttatggtccgaccctgatgaccgttgtggttgggggatctccccacgtggtgctggatacacttttggccaggacatttctgagcaattcaaccataccaatagccttaagcttattgcgagggctcatcagttggttatggagggcttcaactggggacatgaccaaaaagtcgtcaccatctttagtgcacctaattattgttatcgatgtggaaacatggcatctatcttggaggttgatgactgcaaaggacacactttcatccagtttgaaccagctccaaggagaggagaaccagacgtaacccggagaacacctgattatttcttataaagcaactagtgatcaaaacattggtatgaattggagctgttatgatagttttgcagctagtgtggcagcaaactcgtccgagatggtgttgatgtggcaatttcttgatatatcatcatctattgaaatctgttttgtttcttttctttgtgttgttatagggattgaggggaatgaggtttgtgtagagctaagatacaaattgacgcgttgtttgttactcctatatgttcttctcgtgttaatgattaagaatccgataattttgttcttatttcttcttctctctaacagtaaggatcaagattttatttataaagttacaaatgttatct

SEQ ID NO: 3542 - DNA, 1683 bp, Pseudotsuga menziesii
ggaccaaaggacagcaaccacaaggtcgagggttcaattctcaggtagtggctcaaagacacagggacgacgggccgagaaggggagagagaaagcagaaaagtcggattctgaacaagatgagcgcggagccggtctcgtcgtccagtggttatgggcaacttgatgcccagattgaacagcttatgcagtgcaagcctctctcagaacaggaggtcagaggattgtgtgagaaggcaaaggagattctcatggaagaaagtaatgtccagcctgtgaagtgccctgttacaatctgtggtgacatacatggtcaatttcatgatcttgcagagcttttccggattggtggaaagtgtccagatacaaattatttgttcatgggagactatgttgaccggggatactattcggttgagactgtcactcttctagtgtcattgaaggtgcgttatccccaacgaattaccattcttcgaggaaatcatgagagtcgccagattactcaagtttatggattctatgatgagtgtttacggaagtatgggaatgcaaatgtctggaagatatttacagacctttttgactacttcccattgactgcactggtggaatcagaaattttctgcttgcatggtggtttgtcaccttccattgacacattagataacataaggaattttgatcgtgttcaagaagtgcctcatgaaggtcccatgtgcgatcttttgtggtctgatccagatgatagatgtggatggggaatctctccacgtggtgcagggtatacatttggacaagatatttcggaacaatttaaccatacaaacaacttaaaacttatcgctagagctcatcaacttgtcatggaaggcttcaactggggccatgagcaaaaggttgtcaccatatttagtgcaccaaactactgctatcggtgtggtaatatggcttctattttggaagttgatgatactaaaggacatacatttattcagtttgagccagcgccaaggcgaggagaaccagatgtgacacggaggacaccagattattttttatgatttgttctattgtatgtctgcttgctgttactctgccatcaagcctccgtctgctatttgatctttggagctgctgcttcatgatcatatgcatacactgtagatgcaaagcttttcagagtttcaaattgatacattatatccaaattatgcttcagggtggatggggaaagcatgtataatgagcaggatattccctgcaagggtctgtcttttgctagttcggaacactttctgtaggcagtgcacttactgcgatgtgtatcaatttaagatgttgattagtgtaggagtggctatttgccaggtgtttatttaatctttaactttgtaaacacttatatgtgggcattgtctgctgattgagtagcctgcccatttcaatctcattagttggtagttcgggacaattgctgttaccaacgttcatgagaagttggcatttttatgtgcttttgacctatcgatggattggagaatgcctactttagaaatccaagttccctcgggccatctttcaggaaagcaggttctctgaatttacttttagtagatatttatcttctgcaagcacatcgtaaggtcaaggatctggacgttggtaaatgcgaaaggactc

SEQ ID NO: 3543 - DNA, 1413 bp, Rhizophora mangle
gggaaaaagatgagcctggattcgattccgtctaacacacatgggagcctagacgagcagattaatcagctaatgcagtgcaagcccttatcggagcatgaggtaagggtattatgtgagaaggctaaggagatattgatggaagaaaataatgttcagcctgttaaaagccccgttacaatatgtggtgatatacatggtcaattccatgaccttgctgagctttttcgcattggaggaaagtgtccagacacaaattacttgttcatgggagattatgttgaccgtggctactactctgttgaaactgtaactctactggtggccctaaaagttcgttatcatcaaaggattactattctgaggggaaatcatgaaagtcgtcagattacacaagtttatggattttatgatgagtgcctgcggaagtatggtaatgctaatgtttggaagatcttcactgatctgtttgactattttccactgacagcattggttgaatcagaaatattttgtctccatggtgggttatctccctccattgaaacccttgataacattcgaaattttgatcgtgttcaagaagttccccatgagggtcctatgtgtgatcttttgtggtctgaccccgacgatcgttgtggttggggaatctcaccaagaggtgctggatatacctttggccaagacatatcagagcaatttaaccatacaaataacttaaagttgattgcaagagctcatcagttggtcatggaaggatataactggggtcatgaacaaaaggtggttacaatctttagtgcccctaactattgttatcgctgtggcaacatggcatctattttggaagttgatgactgcaagggccacacgttcattcagtttgagcctgctccaagaaggggtgagccagatgtgacccggagaacacctgattacttcttgtgatgctagttggtgtttagttgccaaatctctgctgccactgcctcctgatgggtttactaatgaagtactctaattttaagaaatattgatatggttatgattgatattggtggtgaaaagcacagaaatgagctgctgaggcttcccaacttgattgttttgctgatggttcttgagcttctgcaagaggaagtggcaggcctgccaatgcaactgtcggatatgtatgattggtggaatctttacattttgtttctttgattttgattgtagttccttttgtttttctctttcttctgtagaagcatcttgtggttatggggatacgtagagggacaatgcattgacttataatgggtgttttcattactgctcaagggttctctatggttatatcgttgcctatacaattggcactttccggtagttcgaatggcaaaaaaacatttattcttgttaagt

SEQ ID NO: 3544 - DNA, 2036 bp, Picea glauca
gaaagcaagaaaggaaggcattcgttaaagccagcatatatcgcacacacaaatattttatttttgttctcgatagaaggctgcaatagcagcagcagtgcggaccaacggacagcaaccacaaggttgagggttcaattctcaggaagtggccgaaagacacagggacgacggagtgagaagtagagagagagaaaggaatcatttggacactcaacaagatgagcggggagccggtctcgtcgtccagcggttatggccaactcgatgcccagattgaacagcttatgcagtgcaagcccctctcagaacaggaggtcagaggattgtgtgaaaaggccaaggagattctcatggaagaaagtaatgtgcagcctgtcaagtgccctgttacaatctgtggcgacatacatggtcaatttcatgatcttgcagagctgttccggatcggtggaaagtgtccagatacgaattatttgttcatgggcgactatgttgaccggggatactattcagttgagactgtcactcttctagtgtcattgaaggtgcggtatccccagcgaattaccattcttcgaggaaatcatgagagtcgtcagattactcaagtatatggattctatgatgagtgtttacggaagtatggaaatgcaaatgtctggaagatatttacagacctttttgactacttcccattgacagcactggtagagtcagaaattttttgcttgcatggtggtttgtcaccttccattgacacattagataacataaggaattttgaccgtgttcaagaagtgcctcatgaaggtcccatgtgcgatcttttgtggtctgatccagatgatagatgtggatggggaatctccccacgtggtgcagggtatacatttggacaagatatttctgaacaatttaaccatacaaacaacttaaaacttatcgctagagctcatcaacttgtcatggaaggcttcaactgggggcatgagcaaaaggttgtcaccatatttagtgcaccaaactactgctatcggtgtggtaatatggcatctattttggaagttgatgatactaaaggacatacttttattcagtttgagccagcaccaaggcgaggagaaccagatgtgacaaggaggacaccggattattttttatgatttgttctaccgcatgtctgctgcttgctgtttttctgccatcaatgcgccatctgctatttgatctttggagctgccgttttatgatgatacgcatactgttgatgcaaagcttttcagagtttcaaattgatacgttatattcaaattatgcttcagggtggatgggggaagcatgtattatgatcaggtattccctacaaggatctgtgttttgttagtttggaactctttctgtagccagtgcaactgcactgcgatgtgtatcaatttaagatgctgctttaatatagggaggcaatttatttgccaggtgtttatttaatctttaactttgtaaacacttatatttgggcattgtctactgattgagtagtttgcccatttcaatctcattagctggtagtttgggacaattgatgttaccaacgctcatgagaaattgcattttattgtgattttaacctatccatggattggtgaatgcctactttagaaaccctgaattctcacggggcatctttcaggaaagcaggttttctgtatttacttttagcagatattatccatttgcaagcacatcgtaaggtcaaggatctggatgttggtaaatgggaaaggacacattttatttttgtggctgtgatattatttatctcaaagtttgtaattttaaagtgaaattatttattgttttctgcaaatttgtttgtggaagcatatatttttgtgtttcgatccttgagggtaattggatcattctctcaatatgtatcaatttgtttgaaagatgaagttgtaaaacaggccatacacgtgataattattctctacgtttgtttgaaacatgaattgtaagactgacaatgt

SEQ ID NO: 3545 - DNA, 1443 bp, Triphysaria pusilla
cggagaatgataccctaaaccagaaaacgacgacgttgagggatcaataacagtagagagagaattcaagaaatctagggtcagttttccataccagatggacacgacgatggcgtcgaccggaggcggagccagtggcaacctagacgagcaaatcgctcagctcatgcagtgcaaacccttatccgaacaagaggtacgggcattatgcgagaaggctaaggagattcttatgaacgagagcaacgtgcagcctgtgaaaagcccagtgaccatatgtggtgatattcatggacagttccatgatcttgctgagctttttcggatcggtgggaagtgtccagatacaaattatttgttcatgggggattatgttgatcgagggtactactcggtggagaccgtgacgctcttggtggctctgaaagtgcgtttccctcaacgactcacgattctacgtgggaatcatgaaagtcgccagattactcaggtttatgggttttatgatgaatgcctgagaaagtatggcaatgctaacgtgtggaagacctttacagatttgtttgattatttccctctcactgcattggtcgagtcggagattttctgtctgcacggtggattatcgccgtccattgaaactctcgacaatgttcggaatttcgaccgtgttcaagaagttcctcatgagggggccatgtgtgatctcttatggtccgaccccgacgaccgatgcggttgggggatctctcccaggggcgctggatatacattcggacaagacatatcggagcagtttaaccataccaacggtttgaagcttattgctagagctcaccagctagttatggaagggtttaactgggctcatgagcaaaaggtggttaccatctttagtgcgcctaattattgttaccgctgtggtaatatggcatctattctggaagttgatgattgcaggggtcatagtttcattcagtttgagccagctccaaggcgtggtgagccagacgtaactcgaaggacaccggattattttctctgattcagtcgggaattgttgcctaaactccaacgtgtcttctagctgcttatgtgttgataactacttcaaagttaaaaaaaaaaagggacccgaaaaaatatcgatgatggaatggtaggaagcaggtagaaagacgtatgtgggctttctccagtttaggttattattaccctgaaattcagagagacactgcacaagctgcagtagattttggcggtgctatcgctgcagaaaatattatagatgcaattttcttttcttttttcaatatttccttttatatttgagaacgaaattcgattaaactctctttgaattattaacaacttggaaaacactattagggtttgtaatcttttcaactgtctaatatctgtgggtgcttttatattagtctt

SEQ ID NO: 3546 - DNA, 1369 bp, Triphysaria pusilla
cgttgagttaccaatatcagcaagtgatagaatccaagaaatctagggtcagatttccacccagatggacacgacgatggcgtcggccggtggcggagctagtggtaacctcgatgagcaaatcgctcagctcatgcagtgcaagcccttgtccgaacaagaggtgcgggcattatgcgagaaggctaaggagattcttatggacgagagcaacgttcagcctgtcaaaagcccagtgaccatatgtggtgatattcatggacagttccacgatcttgctgagctttttcggattggtgggaagtgtccagatacaaactatttgtttatgggggattatgttgatcgagggtactactctgtggagactgtgacgctcttggtggctctcaaagtgcgttttcctcaacgactcactattctacgtgggaatcatgaaagtcgacagattactcaggtttatgggttttacgatgaatgcctgagaaagtacggcaatgctaacgtgtggaagacatttacagatttatttgattattttcctcttactgcattggtcgagtctgagattttctgcctgcatggtggattatcgccgtccatcgaaactctcgacaatgttcggaatttcgatcgtgttcaagaagttcctcatgagggggccatgtgtgatctcttatggtccgaccctgatgaccgatgcggttggggaatctctcccaggggtgctggatatacattcggacaagacatatcggagcagtttaaccataccaatggtttgaagcttattgctagagctcaccagctagttatggaagggtttaactgggctcatgagcaaaaggtggttaccattttcagtgcgcctaattattgttaccgctgtgggaacatggcatctattctggaagttgatgattgcaggggtcatagtttcattcagtttgagccagctcctaggcgtggtgagccagacgtaactcgaaggacaccggattattttctctgattcagtttgcctaaattgaaatgcctgttagctgcttatgtgttgatgcctgcttaaaaggttgaaaaaaaaggacccgaaaaaatatcgatgatggaatggtagaaagacgcaggtggtgctttctccagtttaggttattatcattaccctgaaattcacggagatagtaactgcactagcggcagtagagttggcggtgttaacgctgcagaaaaatattatagatgcaatttacttcgcatttttctttctttctttatttatttcttttttatatttgagaacgaatattaaattctcttagagttgttaacaacttggaaaacactattaggtttgtaaacttgtcacctt

SEQ ID NO: 3547 - DNA, 1335 bp, Triphysaria pusilla
gaaataccaaagaaaatactagggtacagatttccacccagatggacacgacgatggcgtcggccggtggcggagctagtggtaacctcgatgagcaaatcgcccagctcatgcagtgcaagcccttgtccgaacaggaggtgcgggcattatgcgagaaggctaaggagattctaatggacgagagcaacgtgcagcctgtgaaaagcccagtgacgatatgtggtgatattcatggacagttccacgatcttgctgagctttttcggattggtgggaagtgtccagatacaaactatttgtttatgggggattatgttgatcgaggttactactcggtggagaccgtgacgctcttggtggctctgaaagtgcgttttcctcaacgactcacgattctacgtgggaatcatgaaagtcgccagattactcaggtttatgggttttatgatgaatgcctgagaaagtatggcaatgctaacgtgtggaagacctttacagatttgtttgattattttcctctcactgcattggtcgagtcggagattttctgtctgcacggtggattatcgccgtccatcgaaactctcgacaatgttcggaacttcgatcgtgttcaagaagttcctcatgagggggccatgtgtgatctcttatggtccgaccccgacgaccgatgcggttggggtatctctcccaggggcgctggatatacattcggccaagacatatcggagcagtttaaccataccaacggtttgaagcttattgctagagctcaccagctagttatggaggggtttaactgggctcatgagcaaaaggtggttaccatctttagtgcgcctaattattgttaccgctgtgggaatatggcatctattctggaagttgatgattgcaggggtcatagtttcattcagtttgagccagctccaaggcgtggtgagccagacgtaactcgaaggacaccggattattttctctgattcagtcgggaattgttgcctaaactcctatgtgtcgtctagctgcttatgtgttgataactacttcaaagttaaaaaaagaaaagactcgaaaaaatatcgatgatggaatggtaggaagcaggtagaaagacgtatgtgggctttctccagtttaggttattattaccctgaaattcagagagacactgcacaagctgcagtagattttggcggtgctatcgctgcagaaaatattatagatgcaattttcttttcttttttcaatatttccttttatatttgagaacgaaattcgattaaactctctttgaattattaacaacttggaaaacaaaaaaaaaaa

SEQ ID NO: 3548 - DNA, 1008 bp, Triphysaria pusilla
accaatatcagcaagagatagtagaatccaagaaatctagggtcagatttccacccagatggacacgacgatggcgtcggccggtggcggagctagtggtaacctcgatgagcaaatcgctcagctcatgcagtgcaagcccttgtccgaacaagaggtgcgggcattatgcgagaaggctaaggagattcttatggacgagagcaacgtgcagcctgtgaaaagcccagtgacgatatgtggtgatattcatggacagttccacgatcttgctgagctttttcggattggtgggaagtgtccagatacaaactatttgtttatgggggattatgttgatcgagggtactactctgtggagactgtgacgctcttggtggctctcaaagtgcgttttccacaacgactcactattctacgtgggaatcatgaaagtcgccagattactcaggtttatgggttttacgatgaatgcctgagaaagtatggcaatgctaacgtgtggaagacctttacagatttatttgattattttcctcttactgcattggtcgagtctgagattttctgcctccatggtggattatcgccgtccatcgaaactctcgacaatgttcggaatttcgatcgtgttcaagaagttcctcatgagggggccatgtgtgatctcttatggtccgaccctgatgaccgatgcggttggggtatctctcccaggggtgctggatatacattcggacaagacatatcggagcagtttaaccataccaatggtttgaagcttattgctagagctcaccagctagttatggaagggtttaactgggctcatgagcaaaaggtggttaccatcttcagtgcgcctaattattgttaccgctgtgggaacatggcatctattctggaagttgatgattgcaggggtcatagtttcattcagtttgagccagctcctaggcgtggtgagccagacgtaactcgaaggacaccagattattttctctgatt

SEQ ID NO: 3549 - DNA, 1555 bp, Triphysaria pusilla
cccgtagtcagatcgatctgatttgcctcactctcactcactccgccgattccaccatcttcctccgtttcgctctcttcaatctctacagttctgccacccgtacattcacactttgctgattctttgcccaggtgtaaggcttttttgattgacagaagcgaaactatactgaggagcagtgggtctgatacaagacggagaacaaagcaagatgagcgcggatctggtggctgagagcacaaatgggaacctggacgagcagattgctcagctcatgcagtgcaagcctttgccagaacctgaggttagggccttgtgtgagaaggctaaagagatactaatggtggaaagtaatgtccagccggtaaaaagccccgtgacaatttgtggggatattcatggtcagtttcatgatcttgctgaacttttccgtattggaggaaagtgcccagacacaaactacctcttcatgggagattatgttgatcgtgggtattattcagttgaaactgtcactcttttagtggctctgaaagtgcgttatcatcaacggatcacaattcttagaggaaatcatgaaagcagacagatcactcaagtatatgggttttatgatgaatgtctgaggaagtatgggaatgccaatgtttggaagatatttaccgatctgtttgactatttccctctgacagcattggttgaatcagaaatattctgtttacatggtggattgtctccctctattgaaacccttgataatataagaaacttcgaccgtgttcaagaagttccacacgaaggtccaatgtgcgatctgttatggtctgatcccgatgatcgatgtggttggggtatttcacctcgtggtgctggatacacttttggccaggacatatcagagcaattcaaccataccaacaatctgaatctaattgctagagctcatcagcttgttatggaaggatttaactgggcccatgaacaaaaggttgttactatctttagtgcaccaaattattgttatcgttgtggaaatatggcatccattttggaagttgatgactgtggggatcaaactttcatccagtttgagccagctccaaggagaggagaacctgatgttacccggaggacgccagactatttcttgtagaggctgacagtttgtagactatttttgcctgcagtctgaggtgcttacatgccgtttcccgagatttgagcatgaagttacctgggccttttttgtcgaaaggtggtgcgactgagaaaggcatgtaagatagataaggcccgttgtctttaagttataacctagttgggttagggggcatgcatttgtgtatcgtgttttataatttttttgaacgtccaactgttccccgcccaaaaatagttgcattctttgttttcttttattttgttttcgatcactctattacgtggatgggtgttctatggaagtaatactgaactcttgaatcttgttttcttaaagttagttttctttcaaattttgatttccatcttgttcatcgactaaaaaaaaaaa

SEQ ID NO: 3550 - DNA, 1345 bp, Valeriana officinalis
gaaggagaaggagaacgaaaagagggttttcattttccgccattgatatcaccaccaccattctttttcttctctctcgagatctcaaccctttaaaacactcatcaaatctcatttttccggtttcattattcgaagggaccttctcctcctcttcctctctcgaacatgagtttcgatccggtcccttcgggtgctcaagggaacctcgatgaagagatttctcagcttatgcagtgcaagcctttgtctgagcaagaggttagggtgctgtgcgagaaggctaaggagattttaatgaatgaaagcaatgtccagcctgtgagaagccctgtaacgatatgcggtgatattcacggccaattccatgatcttgctgaacttttccgaattggtgggaagtgtccagatacaaattatctgtttatgggagattatgtcgatcgtggctactactcagttgaaacagtaacactattggtagcccttaaagtacgctatcctcaacgcataaccattctaagaggaaaccacgagagtcgtcagatcactcaagtttatgggttttacgacgagtgtcttagaaaatatggtaatgcaaatgtgtggaagaccttcacggatttattcgactactttccactaacagctttggtggaatctgaaatattttgtctgcatggtggattatcaccatcaattgaaacacttgatagcatacggaattttgaccgagttcaagaagttccccacgagggacccatgtgtgatcttttatggtctgatcctgacgaccgttgtggttggggtatctcccccaggggtgccggttatacattcggccaggacatatccgaacaattcaatcatactaacaacttgaagcttatcgctagagctcaccagcttgttatggaaggattcaattggggacatgaacaaaaagttgttacgatctttagtgcacctaattactgttatcggtgtggaaatatggcttccattcttgaagttgatgactgcaaaggtcacacttttattcagtttgatccggcaccaaggaggggagaaccagacgtaacgcgaagaacaccagattacttcttatgatcagtatcgttcttgaaaatctggtgatggaattcttagctgatagctttcataatatgtttgagaattttctttttgtttctttcagaaattccattttgattattatcaagtaaaaaaagacgtgtacaattgagtgagcagaagacatgtttgctgctattgtatcatttttctgctctctctgtttatcagtttttctttctggggttcctgtatttcacttattcttgct

SEQ ID NO: 3551 - DNA, 1431 bp, Triticum aestivum
ctcctcctccctcctcccccccactcgcggtcgcctctcccgatagatctggtgccagggttcgcggcgccggcggacgtgcggggggaggggtcgacgcgtgcctggtggccggaggggaggatggggaatccgcgtggcggcctcgacgagcagatcgagcagctcctgcagtgcaagcccctcgtcgagcccgagttgaaagcactgtgtgagaaagctaaagagattttgatggaggagagcaatgttcagcctgtgagaagccctgtcacgatatgtggtgatattcatggtcagtttcatgatcttgcggaactattcagaattggtgggaagtgtcctgatacaaactacctatttatgggagattatgtggaccgtggttactattctgttgaaactgtatcgcttctggtagctttgaaagttcgttatccgcatcggcttacaattcttagaggaaaccacgagagccggcagatcactcaagtttatggattttatgatgagtgcctacggaagtatgggagtgctaatgtatggaaaaccttcacggatctttttgactatttaccattgacagcattggttgagtcggaaatattttgcctgcatggtggactatcaccatccatcgagacacttgataatgtccgcggcttcgaccgcatccaagaagtccctcacgaggggccaatgtgtgaccttctatggtctgatcctgatgatcgatgtggttggggcatttcaccacgtggtgccggatacacatttggccaggatatttcagaacagtttaaccataccaatagccttaagctaatagcaagagctcatcagttagttatggagggattcaactgggcacatgagcaaaaggttgtgacaatatttagtgcacctaactactgttaccggtgcggtaacatggcctcgatcttggaggtggatgactgcagggagcatactttcatccagtttgagcctgccccaaggagaggcgagcctgacgtgacccgaaggacgccagactatttcttgtaaatgtagcctaggccattcgtttttgttttattttacgggatagcttaggttattccgacagcaaacaaaagaaagcgcgtgatagctagatgcgccgtgtcctgtcgtgtggtcataatttttgttgtttgggtctcgctctgttttgcttcactccttttgttgtaatctgtgtgctcatgctgggctcaggggtgtgaatgtgatggatgatgctggtaaatcaaaggcccggcgtagtagtaattttgttgactcaagttggctgtgtagtataacatgtgacgatggcattggtgattttatggatacagctgaagtcgtacactttgtaataacttgtgtgcagttgctgtcaacattgtgcacaaattaaccaagttt

SEQ ID NO: 3552 - DNA, 1402 bp, Triticum aestivum
cccccccactcgcggtcgcctctcccgatagatctggtgccagggttcgcggcgccggcggacgggggagcggagacgcgtgcctggtgggcggaggggaggatggggaatccgcgtggcggcctcgacgagcagatcgagcagctcctgcagtgcaagcccctcgtcgagcccgagttgaaagcactgtgtgagaaagctaaagagattttgatggaggagagcaatgttcagcctgtgagaagccctgtcacgatatgtggtgatattcatggtcagtttcatgatcttgcggaactattcagaattggtgggaagtgtcctgatacaaactacctatttatgggagattatgtggaccgtggttactattctgttgaaactgtatcgcttctggtagctttgaaagttcgttatccgcatcgacttacaattcttagaggaaaccacgagagccggcagatcactcaagtttatggattttatgatgagtgcctacggaagtatgggagtgctaatgtatggaaaaccttcacggatctttttgactatttaccgttgacagcattggttgagtcggaaatattttgcctgcatggcggactatcaccatccatcgagacacttgataatgtccgcggcttcgaccgcatccaagaagtccctcacgaggggccaatgtgtgaccttctatggtctgatcctgatgatcgatgtggttggggcatttcaccacgtggtgccggatacacatttggccaggatatttcagaacagtttaaccataccaatagccttaagctaatagcaagagctcatcagttagttatggagggattcaactgggcacatgagcaaaaggtcgtgacaatttttagtgcacctaactactgctaccggtgcggtaacatggcctcgatcttggaggtcgatgactgcaaggagcatactttcatccagtttgagcctgccccgaggagaggggagcctgacgtgacccgaaggacgcccgactatttcttgtaaatgtagcctaggccattcgtttttgttttattttacgggatagcttaggttattccgacagcaaacaaaaaaagaagatagcttagatgcgttgtgtcgtgtcgtgtggtcataatttttgttgtttgggtcctgctccgttttgcttcactccttttgttgtaatctgtctgcctcatgccaggctcgggggtgtgaatgtgatggatgatgctggtaaatcaaaggcctcgcgtagtagtaatttttgtgctttcaagttggctgtgtagtgtaacatgcgaggatggcatgtgtgattttatggatgcaactggacccgtacactttgtaataacttgtgcagcagttgttgtcaacattgtgcacaaattaa

SEQ ID NO: 3553 - DNA, 1370 bp, Epimedium sagittatum
caagaagagagagggttttccttttgggtggcacctccgtccgtccactcttttcgctcactcactctctctctctctctgagattcattcatctctcttggaagagcaattacgggttacgatttcgtcatcatcgtcatcttcttcttctgcttcgattgattgattggtttctgaaaaaagagggaaggaagcagcagaggaagaaaaatgagtgtggatcagatcccttcgtccaactctcagggcaacctggacgagcagatttcacagcttatgcaatgcaaacctctatctgaacaagaggtgagggggttgtgcgagaaggccaaggagatattaatggaagaaaacaatgttcagcctgtaaaaagtccggttactatctgtggtgatattcatgggcagtttcatgacctcgcagagctttttcgaataggagggaagtgtccagataccaattacttatttatgggagactatgtggaccgggggtattattcagttgaaactgtcacgcttctggtggccttgaaagtacgttaccctcaacgaattaccattcttcgggggaatcatgaaagtcgtcagataacacaagtttatggtttttatgatgagtgcctacggaagtatggcaatgctaatgtttggaagatcttcacggacctttttgactattttccattgacagccttagttgaatcagagatattttgtttgcacggtggattatccccttctattgagacccttgacaatattaggaattttgatcgtgttcaagaggttcctcatgaagggcctatgtgtgatcttctttggtctgaccctgatgaccgatgtggttggggcatttctccacgtggagctggatatacttttggtcaggacatatcggagcaattcaaccataccaacaacttaaagctgattgctagagctcatcaacttgtcatggagggattcaactggggacatgaacaaaaggtggtaacaatttttagcgcacctaattattgttatcgttgtgggaatatggcatccatcttggaagttgatgactgcagagggcatacattcattcagtttgagcctgctccaaggagaggagagccagatgtgactcgccggacgcccgattacttcctatgatgcctgactttggaatattgctgattctccagcggcaaagttctgcttaccgattgacttggtggttgaagacccttgacgagctgtttattggattcaaaatttataaagtcagcctgctatgctttgctgatcgtggttgggtcaaaagcatgtaagatggacaggtgagctccgttgtgtatggtgctggtgacactgcagcaacatgtat

SEQ ID NO: 3554 - DNA, 1332 bp, Eschscholzia californica
ccccccctatcctctctgctgctccccactctaccaccttttcttctcggcaaagctaatcccctctctttctctttctctctcttcatctctatctctctctctctccctgagacgacgacggtaacgaaatctagggttagggtttctaaatttccaggggttcggttcgataggcgatagtaaaagatatcgaagaagaagatgagtgtagatcagattgcatccaactcccatggcaacctagacgagcagatttcacagcttatgcagtgcaagccattatctgaacaagaggtcaggacattatgtgaaaaggctaaagagatattaatgaccgaaagcaatgtccagcctgtgaaaagtcccgtgacaatatgtggtgatatccatgggcagtttcacgatcttgcggaactttttcgcattggaggaaagtgtccagatacaaattatttatttatgggagactacgtggaccgtgggtattattcagttgaaactgtgacgctcttggtggccttaaaagtgcgctatccgcagagaattactattctcagaggaaatcatgaaagtcgtcagattacacaagtttatgggttttatgacgagtgcttgcgaaagtatggcagtgcaaatgtgtggaagaccttcactgacctttttgactattttcctttgaccgcattggttgaatcagaaatattttgtttgcatggtggattgtctccatccatcgagactctcgacaacatacgcaattttgaccgtgtacaggaagttcctcatgaagggcccatgtgtgatctcctgtggtctgatcccgatgaccgttgtgggtggggtatttccccccgtggtgctggatacacatttggtcaggacatatctgagcaattcaaccataccaacagcctaaagttgattgctagagctcatcaacttgtcatggaggggttcaactggggacatgaacaaaaggtggtaactatatttagtgcacctaactattgttatcgttgtggaaacatggcgtctattttggaagtcgatgactgcagaggccacacttttatccagtttgagccagcaccaaggagaggagagccagacgtgacccggagaacacctgattacttcttataatctcccctgtctgagttgccgatttttgcagcagatgtctaataacgacgaaaatgatgtggttgcagatagaggttttggggtgaaatgttttaacggtttagagttataattccaatccgcggtgctttaggtggtgatttttcagcaggagacaaaggcacatataacataatctaggtttgt

SEQ ID NO: 3555 - DNA, 1636 bp, Mimulus guttatus
taattttgatcgtctctctctcatctctctctctctatgctctcttcctcggttccaccatccccctctccgttcgcgagctttctctctcctctgtatttacatacaattcattacaatttatcatccaaccaatccacagcgcccccaatcgtgtcctggggctaattaattcttccatagcggccattttttgaacataggaaagcggcgtcgtattgaaagagagcggcggatctgtaataaatcggaaattagagaaaagatgagcgcggatctggtggctgcgagcacaaatgggaatctggacgagcagattgctcagctcatgcagtgcaaacccttgtcggagcctgaggttagaaccttgtgtgagaaggccaaggagatactgatgctggaaagtaacgtccagcctgtaaaaagtcctgtgacaatttgtggtgatattcatggccagtttcacgaccttgcggaacttttccgcatcggagggaagtgtccagacacaaactacctatttatgggagattatgttgatcgtggttattattcggttgaaactgtcactcttctggtgtctctgaaagtgcgctatcctcaacgtatcacgattcttagagggaatcatgagagtagacagatcacacaagtctatggattttacgatgaatgtctgcggaagtatggaaatgctaatgtctggaagatattcactgatctgtttgactatttccctctgactgctttggttgaatcggaaatcttttgtctgcatggtggactgtctccatcaattgaaaccctcgataatataagaaactttgaccgtgttcaagaagttccacacgaaggtcccatgtgtgatctgttgtggtctgacccagacgaccgttgtgggtggggcatatccccccgtggtgctggttacacttttggccaggacatatcagagcaattcaaccacacaaacaacttaaagctaattgctcgagctcaccagctggttatggagggatataactgggcccatgaacaaaaggttgtcactatttttagcgcaccgaattattgttatcgatgtggaaacatggcttccattctggaagttgatgattgcagagagcacacctttattcagtttgagccagctcctaggagaggggagcctgatgtgacacgaagaacgcccgattatttcttgtagaaactgactattggcgtttgaatagtcagttggaggtgcttattactaaaatgccctttcttcaaatacgatgttcaagtttgtagcctcgtttttggagatgctgaaagtgaaaagaggcatgttaaatatagatcaaaggtcttcttcccctttgtctgctgcactatatttctaacctattttagggaatttggattagggatatgcgctttttgtgtatcattgtctacgattttttgatattacgttgtttcccggtttttgtttttaataattgtttttttttttttttgctttaatttcctgagaatccctggacaggtgttctgtataagtaatgaagaacttctatcagttgtttgttctggtaattgtgttttagttaatttcacaaatggagataaattaagcttgcatttaatttca

SEQ ID NO: 3556 - DNA, 1622 bp, Tabernaemontana elegans
tcccccaaatcaaccttgtcaaacgacgtcgctaaggggagaagcaagaagaacgacaaggaagaacccaactagggttccgaattatccagtgtgttaagtttacatttatccgtacagtgaatcaagaaatattaaaagaaatgagctcggatccggcggtggcgtcgagcggcggtgcacatcatggaaacctcgatgaacagatttctcagcttatgcagtgcaaacccttgtccgaacaagaggttaggggactttgtgagaaggcaaaggagatcttaatggaggagagcaatgttcaacctgtgaaaagccctgtgaccatttgtggtgatattcacggacaattccatgatcttgcagaactctttagaattggtggcaagtgtccagatacaaattatttgttcatgggcgattatgttgatcgaggatattattcagttgaaactgtaactcttctggttgccctcaaagtgcggtaccctcaacgaattactattctgagaggaaaccatgagagtcgtcagattactcaagtatatgggttttatgatgaatgcctgaggaagtatggtaatgcgaatgtgtggaagatttttactgacctatttgactacttcccactgacagcattggttgaatccgaaatattttgtctccatggtggattgtctccttcagtcgaaactctggataacatacggaattttgaccgtgtgcaagaagttccccatgagggacccatgtgtgatctcttgtggtctgaccccgatgatcgttgtggttggggcatatcacccaggggtgcaggatatacatttggccaagacatttcagagcagtttaaccatacaaacaacttaaagctcattgctagagcacatcagctggttatggagggattcaattgggctcatgatcagaaggtagtcaccatatttagtgcacctaattactgctatcgctgtgggaacatggcatcgatactggaagtagatgattgcaaaggacacacgttcattcagtttgagccagctcctcgaagaggagaaccagatgtaactcgaagaacgccggattactttctatgatccagctggataagggttgctgacttctgtacaacaggtctcttttagctgctttgtgtattgacatctattttggagattgccaattatgtattcctatactgtgggctgggactggcagaagcgtgtacaacaggcagataggtgcacgatgcacgatgctcttttttaccgtatcctgaaactatgtcgagatgcacaaaggcaacatcggcacggggacactgcttgctgcatgggtatcatttcctggaattggtgcagcacgatctctctttccccatcttcctctccctcttctaaatattctgaaacaagtcctttttcacactcatattttggttttgtaggacagtttctgagttctttctttcctcgatattgtgttcgctaacttgtagcacaatgctcctccgggcgggtttttgtgtagagggaagaatatttgttattatttccttctcttcctcagttatgcttgattactttcttccttctaattgcacatttccctgtaaaattttc

SEQ ID NO: 3557 - DNA, 1278 bp, Vinca minor
ggtctggatccgtacaggccaagtaggattatcactgtttttctgaacaataacttctcccactctacagaatttttcttcagaaagtcttcgggtgcaacagatggcattggattttgagaatacatcccaaccctattagggttccgaattgattacttattatatttacattttatccataagagttgttattcaataaagattaaaattaaaagaatgagctcgaatccggcggtggcgtcgagcggcggtgctcatcatggaaacctcgatgagcagatttctcagcttatgcagtgcaaacccttgtccgaacctgaggttagaggactttgtgagaaggcaaaggagatcttaatggaagagagcaatgttcaacctgtgaaaagccctgtgaccatttgtggtgatattcacggacaattccatgatcttgctgaactatttagaattggtggcaagtgcccggatacaaattatttgttcatgggagattatgttgaccggggatattactcggttgaaaccgtaacacttctagtggccctcaaagtgcggtactctcaacgaattactattctgagaggaaaccatgagagtcgccagataacccaggtatatgggttttatgatgagtgcctaaggaagtatggtaatgcgaatgtgtggaagacttttactgacctctttgactacttcccactgacagcactggtggaatctgagatattctgtctccacggtgggttatctccttcaatcgagactctagacaacataaggaattttgaccgtgtgcaagaagttccccatgagggacccatgtgtgatctcttgtggtctgaccctgacgatcgttgtggttggggcatatctcccaggggagctggatatacatttggccaagacatctcagagcagtttaaccatacaaacaatttgaagctcattgctagagctcaccagctggttatggagggattcaattgggctcacgatcagaaggtcgtcaccatatttagtgcacctaattattgctatcgctgtgggaacatggcatccatactggaagtggatgattgcaaaggacacacattcattcagtttgagccagctcctcgaagaggagaaccagatgtaactcgaagaacaccagattactttctgtgatgtcgtttctgcacttgcatattttggtttagtaggacagtttctttcctcggtattgtgttcctcggtattggtaggagaatgctcccttgggatggggttttt

SEQ ID NO: 3558 - DNA, 1173 bp, Hordeum vulgare
ccacttcttcaccacgaccacgagcgctctccgctcctcggcctcgccgctatgctatacagccgggctccaactccaactccaacccacaccgcaattatataaccaccgccgctcccacctttccagaacttttgaccccctccccacctctcgttccccctccccctccccacgcagggtcgcgcgcggcggcgagatctgcccagggtggacccccggcgaggatgagcagcccccatggcggcctcgacgaccagatcgagcgcctcatgcagtgcaagcccctccccgaggccgaggttagagcactgtgcgagaaggccaaggagattttgatggaggagagcaatgttcagcctgtaaggagtcctgttacaatctgtggtgatattcacgggcagtttcatgatcttgcggaacttttccgaattggtggaaagtgtccagatacaaactacttgtttatgggagattatgtagaccgtggctactattctgtcgaaactgtcacgctgttggtgtctttgaaagttcgttatcctcagcgaatcaccattcttagaggaaaccatgagagccgacagattactcaagtttatggattctatgacgagtgtttaaggaagtatggaaatgcaactgtgtggaaaacctttacggatctgttcgactacttccccttgacagcattggtcgagtcagaaatattctgcttgcatggtggattatcaccatccatcgagacacttgataacatacgtaactttgaccgcacccaagaagttcctcatgaagggcccatgtgtgatcttctgtggtctgaccccgatgatcgatgcggttggggtatttctccccgaggcgctggatataccttcggacaggatatatcagagcagttcaatcataccaataacttaagacttattgctagagctcaccagttggtgatggagggattcaactgggctcatgagcaaaaagtggtcaccatatttagtgcacctaattattgctaccgctgtgggaatatggcatcaatcttggaagttgatgattgcagggagcatactttcatccagtttgagccggccccaagaaggggagaaccagacgtaactcgtagaacgccagactatttcctgtgatgtgaaatcggtttcgaccctc

SEQ ID NO: 3559 - DNA, 1143 bp, Glycine max
ctctttctctctctttctaaaaaccagaaacaacaaacacaaaccgaaaaggcgaaaggggttttccgagtgagatctagggtttccatcgattcggagagaggatattgatagaacgacctcaacgagcaaggtcaggaggtggagtactagaacatggattcggtgccttcgaattcgcatggaaacctcgatgagcagatttctcagctcatgcagtgcaaacccttgtccgagcaagaggtaagggtcttgtgtgataaggcaaaagaaattttgatggaagagagcaatgtccagcctgtgaaaagtcctgttacaatttgtggtgatattcatgggcaattccatgatcttgcagagctttttcgcattggagggaagtgtccagatacaaattacttgtttatgggagattatgttgatcgtggctattattctgttgaaactgttacgcttttggttgcccttaaagtgcgttatcgtcagcgtatcactattctgaggggaaatcatgaaagtcgccagattactcaagtttatgggttttatgatgagtgcctgcggaagtatggtagtgctaatgtttggaagatctttactgatttgtttgactactttccgttgacagcattggttgaatctgaaatattttgtcttcatggtgggttgtcaccatctattgaaaccctggataacatacgtaattttgatcgcgtacaagaagttcctcacgagggacccatgtgtgatcttctatggtctgatccagatgatcgttgtggttggggcatctctcctagaggtgctggatatacctttggccaggacatatctgagcaatttaaccataccaataacttgaagctgattgctagagctcaccagctggttatggaaggatataactggggacatgatcaaaaggtggttactatatttagtgctcctaactattgttatcgttgtgggaacatggcatcaattcttgaggttgacgactgcaaaggacacacattcattcagtttgagccagctccaaggaggggagagccagatgtaaccaggagaacacctgattacttcctatgatactattttggttgagttgctgttaccagcacagcaactaatgccctgcag

SEQ ID NO: 3560 - DNA, 1190 bp, Glycine max
caccacccttctttctctctctctctttctaaaaaccagaaacaacaaacacaaaccgaaaaggcgaaaggggttttccgagtgagatctagggtttccatcgattcggagagaggatattgatcgaacgacctcagcgagcaaggacaggaggtggagtactagatcatggattcggtgccttcgaattcgcatggaaacctcgatgagcagatttctcagctcatgcagtgcaaacccttgtccgagcaagaggtaagggtcttgtgtgataaggcaaaagagattttgatggaagagagcaatgtacagcctgtgaaaagtcctgttacaatttgtggtgatattcatgggcaattccatgatcttgcagagctttttcgcattggagggaagtgtccagatacaaattacttgtttatgggagattatgttgatcgtggctattattctgtcgaaactgttacgcttttggttgcccttaaagtgcgttatcgtcagcgtattactattctgaggggaaatcatgaaagtcgccagattactcaagtttatgggttttatgatgagtgcctgcggaagtatggtagtgctaatgtttggaagatctttaccgatttgtttgactactttccgttgacagcattggttgaatctgaaatattttgtcttcatggtgggttgtcgccatctattgaaaccctggataacatacgtaattttgatcgcgtacaagaagttcctcatgagggacccatgtgtgatcttctatggtctgatccagatgatcgttgtggttggggcatctctcctagaggtgctggatatacctttggccaggacatatctgagcaatttaaccataccaataacttgaagctgattgctagagctcaccagctggttatggaaggatataactggggacatgatcaaaaggtggttactatatttagtgcacctaactattgttatcgttgtgggaatatggcatcaattcttgaggttgatgactgcaaaggacacacattcattcagtttgagccagctccaaggaggggagagccagatgtaaccaggagaacgcctgattacttcctatgatactattttggttgagttgctgttaccagcacagcaaccaatgccatgcagtaatgtgcaagctcatctacttgtccaaatcagag

SEQ ID NO: 3561 - DNA, 1334 bp, Ambrosia trifida
caaaacaacaataataataatctcaaaattacgagggtttcctttttctgtacctccatttccgtttctgcacccacatttggctcatcgaaacaatcgatctgttgattatatgtatataatctgaacaagatgagtacagatctagctaccaacacccatggaaacctggatgaacagattgcacagctcatggagtgcaagcccttaaccgagcctgaggttaagacattatgtgagaaggcaaaagagatacttatgggcgaaagcaatgttcagcccgtaaaaagccctgtgacaatatgtggcgacattcatgggcagtttcatgatcttgctgaactttttcgtataggagggaagtgcccagataccaattacttgtttatgggggattatgtggaccgaggatattattctgtcgaaactgtcacgctcttggtggctctgaaagtgaggtatcctcagcgaattacgattctaagaggcaatcatgaaagtcgtcagatcactcaagtctatggattttatgatgaatgccttcgaaagtatggcagcgctaatgtttggaagacttttacagatctctttgactattttccattgactgcattggttgaatcagaaatattttgccttcatggtgggttgtcaccttcaattgaaactcttgatagtataagaaactttgaccgtgtgcaagaggtcccgcatgagggtccaatgtgtgatcttttatggtctgacccagatgaccgttgtggttgggggatttcaccacgtggtgctgggtacacatttggccaagatatttctgagcaatttaatcataccaacagcctaaaacttattgctagagctcatcagctggtgatggagggatataactggggacatgagcaaaaggtggtcactatctttagtgcgccaaattattgctatcgatgtgggaacatggcgtctatcttggaagttgatgattgcaagggccacacatttatccagtttgatcctgctcctaggagaggagaacctgatgtaaccagaagaacgcctgattatttcctctgaatggttcaagttaagaagttgccaagatttgatgctacaagaaaggaccaaatggtgcatgaaatcctccacatattatgtatgtttgtatgtatgattgattctagggtctttccaattcattgtttaagtaatgaggttttctgtaatctgcaaaaggaatgtttcatttgggggtgtttttatcaatacatacatacatttgttatattttggttgttaatctggtttatgaatttatttagtttgtattcaaaaaagaa

SEQ ID NO: 3562 - DNA, 1514 bp, Arabidopsis lyrata
aagcgaagagacagagaagagagagagggagagagagaaaggcgaagaatacgcagattccatccaatttagggttagggcttcccctaatttggaaacctagtcctgtttcctgatctgttatccggatcggacgagaggagagacgaagtaacgaaaatgggcgcgaattctattccgacggacgcaaccattgatctcgatgagcagatctcgcagcttatgcagtgcaagcccctctcggagcaacaggttcgagcattatgcgagaaagccaaggagatcttaatggatgaaagcaacgttcagcctgtgaaaagccctgtgacaatttgcggtgatattcatggacagttccatgatcttgctgagcttttccgtatagggggaatgtgccctgataccaattatctgtttatgggagactatgtggaccgcggttattattctgttgaaactgttacgctgttagtcgccttaaagatgcgatatcctcagcgaatcactattcttagaggaaaccatgaaagtcgtcagattactcaggtttatggattttatgatgaatgtctgcgaaagtacggcaacgcaaatgtttggaaaatctttaccgacctcttcgactattttcctctgacagccttggttgagtcagaaatattttgccttcatggtggattatctccatctatcgagacccttgacaacataaggaattttgatcgagttcaagaagtgccccatgaagggccaatgtgtgacttattatggtctgaccccgatgaccgatgtggttggggcatctctcctcgaggtgccggatatacgtttggtcaggatatatccgaacaattcaatcacacaaacaacttaaagctgatcgcccgagctcaccagttggttatggatggatacaactgggctcacgagcaaaaagtggtaactattttcagtgcaccaaactattgttatcgttgtgggaacatggcctcgattcttgaggtcgacgactgcaggaaccacaccttcattcagtttgaaccagcaccgaggagaggagaaccagatgtcacccgaaggactccagactattttctgtgatcactggacacagactcatctcaatcagcagctgcaggcacccacaagtgaaaagtcacagttggtaactcgagatttctggtttctatgcattgtgttcaggttgctctgtttaaaattcaacttagtgccaccaccggaatatagtgtgtattataggcgaagaaggctctcttatcttcctctataaccaagaaaagaaaaaaagatacccattatggacattgttttgttgatgttattagcttcttcttctctcttctgcatcagaatgtgtttttatgtgagagatcttctaattttatttcacgtaattcgttcttgaacctctctgatttttgaatgaaaccttgaaattgttctgtttatttgtttttgaaagcttgatataataactatagttactgaatgca

SEQ ID NO: 3563 - DNA, 1408 bp, Arabidopsis lyrata
tttcgatttcatctctcactctgctcgagagagagagagagagagaaagaaaaagcgaagaatacgcagaatccatccaatttagggttagggctgcccctaatctggtaacctgttcctcgtttctgatctgttttccggatccgactagaaggaaagaagacgacgtcgcagtaccaaaaagatgggcgcgaattcgcttccgacggatgcaaccctcgatctagatgagcagatctcgcagctcatgcagtgcaagcctctctccgagcaacaggtcagagcattatgtgagaaagctaaggagatcttgatggatgaaagcaacgttcagcctgttaaaagccctgtgacaatctgcggtgatattcatggacagtttcatgatcttgcagagcttttccgtatagggggaaagtgccctgataccaactatctgtttatgggagactatgtcgaccgtggatattattctgtcgaaactgttacgctgttggttggcttgaaagtacggtatccacagcgaatcactattcttagaggaaaccatgaaagtcgtcagattactcaggtttatggattttatgatgaatgtctgcgaaagtatggtaatgcaaatgtttggaagatatttacagacctctttgactattttccactgacagccttggtggagtcagaaatattctgccttcacggtggattatcaccatcaatcgagacccttgacaacattaggaactttgatcgagttcaagaagttccgcatgaagggcctatgtgtgacttattatggtctgatcctgatgacagatgtggttggggaatctctcctcgtggtgccggatatacatttggtcaggacatttccgaacaattcaatcacactaacaacttaaagctgatcgcccgagcgcatcagcttgttatggatggattcaactgggcccacgagcaaaaggtggttactatattcagtgcaccaaactattgctatcgctgtggaaacatggcctcaattcttgaggtcgatgactgcaggaaccacacgttcattcagtttgaaccagcaccaaggagaggagagccagatgtaacccgaaggacacctgactatttcctatgaagacactcagctcatcctgaagctgtaaagtccggttgttggtttttgaagatctctgcttattccatttggttcaacgcatttgtgttccaggttgcttctctttaaaatcaatttagccctctcccttggaatagtgtaatataggcaaagaggtcaatgaactttaaacctctcatgaacatgtgtttggctgaacttattagctctcttctgcatcagaatctgtttattgtgagatattatttcgatttatttcacgtaatttttcccgtttgttcc

SEQ ID NO: 3564 - DNA, 1491 bp, Arabidopsis thaliana
gacaaagaagagagagagagagagagagagagagagagagagagagagagagaaagtgggggaaaaaaggcgaagaatacgcagattccatccaatttagggttaggacttcccctaatttggaaacctagtcctgtttcctgatctgttttccggatcggacgagagacgaattaacgaaaatgggcgcgaattctattccgacggacgcaaccattgatcttgatgagcagatctcgcagctcatgcagtgcaagcctctctcggagcaacaggttagagcattatgcgagaaagccaaggagatcttaatggatgaaagcaatgttcagcctgtgaaaagccctgtgacaatctgcggtgatattcatggacagttccatgatcttgcagagcttttccgtatagggggaatgtgccctgataccaattacctgtttatgggagactatgtggaccgtggttattattctgttgaaactgttacgctgttagtcgccttaaagatgcgatatcctcagcgaatcactattcttagaggaaaccatgaaagtcgtcagattactcaggtttatggattttatgatgaatgtctacgaaagtacggcaacgcaaatgtttggaaaatctttacagacctcttcgactattttcctctgacagccttggttgagtcagaaatattttgccttcatggtggattatctccatctatcgagacccttgacaacataaggaattttgatcgagttcaagaagtgccccatgaagggccgatgtgtgacttattatggtctgaccccgatgaccgatgtggttggggcatctctcctcggggtgccggatatacatttggtcaggatatatctgaacaattcaatcacacaaacaacttaaagctgatcgcccgagctcaccagttggttatggatggatacaactgggctcacgagcaaaaagtggttactattttcagtgcaccaaactattgttaccgttgtgggaacatggcctcgattcttgaggtcgacgactgcaggaaccacaccttcatccagtttgaaccagcaccgaggagaggagaaccagacgtcacccgaaggactccagactatttcctgtgatcactggacacagactcatctcaatcagcagctgcaggcacccacaagtgaaaagtcacagttggctaactctagattctggtcctatgcattgtgttcaggttgctctgtttaaaattcaacttagtgcccaccaccggaatatagtgtgtattataggcgaagaaggcttcttatcttcctctataaccaagaaaagaaaaaagatacccattatgaacattgttttgttgatgttattagcttcttcttcttctcccttctgcatcagaatgtggtttcatgtgagaaatcttctaattttatttcacgttattcgttcttgaacatctctgatttttgaatagaaccttgaaattgttatgtt

SEQ ID NO: 3565 - DNA, 1388 bp, Arabidopsis thaliana
ctctctcactctgcacacgaaggcgagagagagagagaaagaaaaaagcgaagaatacgcagaatccatccaatttagggttagggctgcccctaatctggaaacctttgcctcgtttctgatctgttttccggatccgacttgaaggaaagaagacgacgacgcactaccaaaaacatgggcgcgaattcgcttccaacggatgcaaccctcgatctagatgagcagatctcgcagctcatgcagtgcaagcctctctccgagcaacaggtcagagcattatgtgagaaagctaaggagatcttaatggatgaaagcaacgttcagcctgttaaaagccctgtgacaatctgcggtgatattcatggacagttccatgatcttgcagagcttttccgtattgggggaaagtgtcctgataccaactatctgtttatgggagactatgtcgaccgtggatattattctgtggaaactgttacgctgttggttggcttgaaagtacggtatccacagcgaatcactattcttagaggaaaccatgaaagtcgtcagattactcaggtttatggattttatgatgaatgtctgcgaaagtatggcaatgcaaatgtttggaagatatttacagacctctttgactatttcccactgacagccttggtggagtcggaaatattctgccttcacggtggattatcaccatccatcgagacccttgacaacattaggaactttgatcgggttcaagaagttccacatgaagggcctatgtgtgacttattatggtctgatcctgatgacagatgtggctggggaatctctcctcgtggtgctggatatacatttggtcaggatatttcggaacaattcaatcacactaacaacttaaagctgatcgcccgagcgcatcagctcgttatggatggattcaattgggcacacgagcaaaaagtggttactatattcagtgcaccaaactattgctatcgctgtggaaacatggcctcaattcttgaggtcgatgactgcaggaaccacacgttcattcagtttgaaccagcaccgaggagaggagagccagatgtaacccgaaggacacctgactatttcctttgaagatactcagctcctcctgcagcttccggttgttggtttttgaagatctctgcttattccatttggttcaacgcatttgtgttccaggttgcttctctttaaaatcaatttagccctctcccttggaatagtgtaatataggcaaagaggtcaatgaactttaaaacctctcatgaacatgtgtttggctgaacttattagctcccttctgcatcagaatctgtttattgtgagatattttttcgatttatttcacgtaatttttccct

SEQ ID NO: 3566 - DNA, 1116 bp, Arnica chamissonis
ggtactcgattgagaagcattttgatcgatacaacgattcatcgaaatcgatctgattatatgtaaaaacgcataatttacatcagaagatgagtgtggatctagcttcgaacacccatggaaacctggacgagcagatttcacagctcatggagtgcaagcccttaaccgagcctgaggtcaagacattatgtgagaaggcaaaggagatacttatgggtgaaagcaatgtccagccagtaaaaagccccgtgacaatctgtggtgacattcatggacaatttcatgatcttgctgaactttttcgaataggagggaagtgcccagatactaattacttgtttatgggggattacgtggatcgaggatattattctgttgaaactgtcacgcttttggtggctctgaaagtgaggtatcctcagcgaattacaattctaagaggaaatcatgaaagtcgtcagatcactcaagtctatgggttttatgatgagtgccttcgaaagtatggcagtgctaatgtttggaagacttttacagatctctttgactattttccattgaccgcattggttgaatcagaaatattttgccttcatggtggattgtcaccttcaattgaaactctcgatagtataaggaactttgatcgcgtgcaagaggttccacatgaaggtccaatgtgtgatcttttatggtctgacccagatgaccgttgtggttgggggatttcaccacgtggggccggatacacctttggccaagatatttctgagcaatttaatcataccaacagcctgaaacttattgctagagctcatcagctggtcatggagggattcaactggggacatgagcaaaaagttgttactatctttagcgcaccaaattattgctatcgatgtgggaacatggcttctatcttggaagttgatgattgcaagggccacacatttatccagtttgatcctgctccgaggagaggagaacctgatgtaaccagacgaacgcctgattatttcctctgaatggttcagttaaaagcgtttcacggtcatttgtcaagattcaggcttttgatacaacgggttgggctaaaattcatcagatgaagtg

SEQ ID NO: 3567 - DNA, 1433 bp, Artemisia annua
tactccgacggggagggtttcattcattcattcattcttgttcatctttattcccaaatttcatttcaacaaaaaataatcaattcaattgattaaatatatgtataaataaataaaaacccataatttatttatatataaaaaacaaaatgagtgtggatctagcttccaacacccatgggaatcttgatgaacagatttcacagcttatggaatgcaaacccttaattgagcctgaggttaagacattatgtgagaaggcgaaagagatactgatgaatgaaagcaatgttcagccagtaagaagtcctgtgactatctgtggtgacatccatgggcagtttcatgatcttgctgaactttttcgcataggaggaaagtgcccggataccaactacttgtttatgggggattacgtggatcgaggatattactctgttgagactgtcacgctcctggtggctctgaaagtgcggtatcctcagcgaatcacaatcctaagaggaaatcatgaaagtcgtcagatcactcaagtctatgggttttatgatgaatgtcttcggaagtatggaaatgctaatgtttggaagactttcacagatctctttgattattttccattgaccgcattggttgaatcagagatattttgtcttcatggtggtttgtcaccttcaattgaaactcttgatagtataagaaacttcgatcgtgttcaagaggttccacacgaaggtccaatgtgtgatcttctatggtctgacccagatgaccgttgtggttggggcatttcacctcgtggagccggatacacttttggccaagatatctctgagcaatttaaccataccaacagcctgaagcttattgctagagctcatcagctggtcatggagggatttaactggggacatgagcaaaaggttgtcactatctttagcgcaccaaactattgctatcggtgtggaaacatggcttctatcttggaagttgatgattgcaagggccacacgtttatccagtttgatccggcccctaggagaggagagcctgatgtaaccagacgtactcctgattatttcctttaaatggacaatcctcacttgctagtacaacaactcggttaaagtgatttacgatcctttgccagaattgggattttgatacgactggtatgggctaaaattcatcaggtaaagtgccagagaaggaccaagtggcttgtaaaatggactttgtatgactagggtattattttttccttttttttggttgctattttacattttgggcattttctaattcattgttgaagtaatggggttttatgtatctgcaaagtgaatggttactgatagtttgactagtatcaatcaagatacataaattattatttgtattaagcaattgcccatgaaggtgctgatatcgtg

SEQ ID NO: 3568 - DNA, 1495 bp, Musa acuminata
ctccggtaatttcccacctctttcgcggtctctcgcgttagacggaaagatttgttggcgaggaagaaaggaggaggggtttggatcccggaggcgaggaggaaatctagggttagggcttccttattcgtggcgtcttgagagagagagagagagagagagagagagagagagagagagagagaggatgagcgcgaaggcggtgccggcgcccaactcacatgggaacctggaggagcagatcgcgcagctcatgcagtgcaaaccgctctccgaacaagaggttagagtcttgtgtgagaaggccaaagaggtattgatggaagaaagcaatgtccagcctgtgaagagccctgtgacaatatgtggtgacattcatgggcaatttcatgatcttgcagaactgtttcgaattggaggaaagtgtccagatacaaattacttatttatgggtgattacgtagaccgagggtactattctgttgaaactgtcacgcttttggtggccctcaaggtgcgttatcctcagcgaatcaccattcttagaggaaaccatgagagtcgtcagattacccaagtttatggattttatgatgaatgtttaagaaaatatggtaatgcgaatgtttggaagatcttcacagatttatttgattatttccccttgacagcactggttgaatctgaaatattttgtctacatggtggattatctccatctattgagacccttgatagcatacgtaactttgatcgtgttcaagaggttccacatgaggggcctatgtgtgatcttttgtggtctgaccctgatgaccgatgtggttggggtatttcccctcgtggtgctggatatacttttggccaagatatatcagagcagttcaaccacaccaataatcttaagctgatagcaagagctcatcaactagtcatggaaggatataactggggacatgaccaaaaggtggtcaccatatttagtgcaccaaattattgctatcggtgtggtaatatggcctcaatcttggaagtcgatgactgcaaggggcatacgttcatccagtttgagcctgcccccaggagaggagagccggacgtgactcgcagaactcctgactacttcctgtagatcagctaatggagaagttacgttcctgattccttgcagcaagtactgctttcacaatggcattgtgatctcagacatttctcattaggatggtacaatcagtttgccacttttatccatggctgtggtgatttggacggagtagatgtataatgatgttggaagctattcatctcttcatgtcgtggattccattgcggttggaggcggcaaggttgatggtggagcagcatgtatcattgtttttgctcttttcttttttctggttatctttttttttttttgcttctttttcatgctgtctaagggagcaagtttaaacttatggatctgctttgataaattcatagatttagctgagag

SEQ ID NO: 3569 - DNA, 1662 bp, Phaseolus vulgaris
tttaattatgtgtaatttcaattttgcccccgaaaaaggagtggtcatcgaacaaaacgagcacacggagcctcctaggctttggtttcttcaccaccaccacccttcacctctctttctctctcctctctctcctctctctctctcgctctctttctaagaaccagaaacatcaaacacaaaccgaaaaggcaaaaggggttttcctagtgagatctagggtttccatcgattcggtgagaggatattcatcaacgacctcagcgaggcaaggctaggaggtggagtactagagcatggattcggtgccttcgaattcacatggaaacctcgatgaacagatttctcagctcatgcagtgcaaacccttgtccgagcaagaggtaagggtcttgtgtgataaggcaaaagagattttgatggaagagagcaatgtccagcctgtgaaaagtcctgttacaatttgtggtgatattcatgggcaattccatgatcttgcagagctttttcgcattggagggaagtgtccagatacaaattacttgttcatgggagattacgttgaccgtggctattattctgtcgaaactgttacgcttttggttgcccttaaagtgcgttatcgccaacgtatcaccattctgaggggaaatcatgaaagtcgccagattactcaagtttatgggttttatgatgagtgcctgcggaagtatggtactgctaatgtttggaagatctttaccgatttgtttgactactttccgttgacagcattggttgaatctgaaatattttgtcttcatggtggattgtctccttctattgaaaccctcgataacatacgaaattttgatcgcgtacaagaagttcctcatgagggacctatgtgtgatcttctatggtccgatccggatgatcgttgtggttggggcatctctcctagaggtgctggatatacctttgggcaggacatatctgagcaatttaatcataccaataacttgaagctgattgctagagctcaccagctggttatggaaggatataactggggccatgatcaaaaggtggttactatttttagtgcacctaactattgttatcgttgtgggaacatggcatcaattctcgaggttgatgactgcaaaggacacacattcattcagtttgaaccggctccaaggaggggagagccagatgtaaccaggagaacgcctgattacttcctatgatactactttggttgagttgctgttaccagcacagcaactaatgccctgcagtaatctgcaagctcatctacttgtccaaatcagagccatgaatcatattgatatacttatattttcgaagttaggcttcgctggatgtgttatttagttgaattataactgaatctttccaagaggaagctgagcagtaggcgatgctattgtgggcatgtgtatcattccagcttgcaatgtatcaattttaatgttattttttcaattttccttctctatttatttacaactcttggcctttcttttctcaatttaggattattaaagggggtgggtttctgtagatggataatgctttaacatatcttttaatgagtgttttgtgattctttacccgccttgtgagaattatattataataggtagtcttgttttt

SEQ ID NO: 3570 - DNA, 1548 bp, Manihot esculenta
gctcttccctttcctcttcttcgttcactgggctagcgaactgcgggaactggaaagagaacacgagaagcgtctcattcaatcgcagggttagggttatccctaatccggttactgttaaatccgtttgcggtcttaaagccggagaggacaaccaagatgggtacgaattcgctatcttcagattcagtttcggatctcgatgagcagatctcgcagctcatgcagtgcaggccactctccgagctccaggtcagagcattgtgtgacaaggctaaggagatactgatgcaagaaagcaatgttcagcctgtgaaaagccctgtgacaatctgtggtgatattcatgggcagtttcatgatcttgcagaactttttcgaattggagggaagtgtccagataccaattatttatttatgggagattatgtggatcgtggctattactctgttgaaactgtcacactcttagtggcactgaaagtgcgttatccacagcgaataaccattcttagaggaaaccatgaaagtcgccagattactcaggtttacgggttttatgatgaatgtttacgaaagtatggcaatgctaatgtttggaagatcttcacagacctttttgactattttccactgactgccttggtcgagtcagaaatattttgcctacatggtggattgtccccatcaatagaaacccttgacggcgtgagaaactttgatcgtgttcaggaggttcctcatgaaggagcaatgtgtgatcttttatggtctgatccagatgaccggtgcggctggggtatttcacctcgtggtgctggatatacttttggccaggatatatctgagcagttcaatcatactaacaacttgaagttgattgctagagcacatcagcttgttatggatggatttaattgggcacatgaacaaaaggtggttaccatttttagtgcacctaattattgctatcgctgtggaaatatggcatcaattttggaagtggatgactgcaaggctcacactttcatccagtttgagccagctcctaggcgaggagagcctgatgttacccgtagaacacctgattacttcctgtgacacggctttctgttgcccccaccatgcctcaactgcccctcttccctgctttacgctcaggtggttgaggatcctagttgcagtagacgtttataaagtttaatatctatagaactttctgggcatgctttttcctggtggttatggactatgggagcataaaagcatgtataatagggcaaggttttgtgtgttttttctgttctgtcttgtacttgacaccaagctggatagtctcggcaatttgctaaagctcatggctgaccatcggcataaattataccatctttagcagaattgtgcatattcttgtcacgttcactttttctttgtctcctccttttggggccatgtagggtcataaaatggattcgatatatagtgtatgatctgttttttccaccttgtaattttcaatagagttgtttgtaagtatgattagttact

SEQ ID NO: 3571 - DNA, 1142 bp, Chrysanthemum coronarium
aaacccataatttatttatatataaaacaaaatgagtgtggatctagcttctaacacccatgggaatcttgatgaacagatctcacagcttatggaatgcaaacccttaattgagcctgaggttaagacattatgtgagaaggcgaaagagatactgatgaatgaaagcaacgttcagccggtaagaagtcctgtgaccatctgtggtgatatccatgggcagtttcatgatcttgctgaactttttcgcatcggagggaagtgcccggacactaactacttgtttatgggggattacgttgatcgaggatattattctgttgagaccgtcacgctcctggtggctctgaaagtgcgatatcctcagcgaatcacaatcctaagaggaaatcatgaaagtcgtcagatcactcaagtctatggattttatgatgaatgtcttcggaagtatggaaatgctaatgtttggaagactttcacagatctcttcgattattttccattgactgcattggttgaatcagagatattttgtcttcatggtggtttgtcaccttcaattgaaactcttgatagtataagaaactttgaccgtgttcaagaggttccacacgaaggtccaatgtgcgatcttctatggtctgacccagatgaccgttgtggatggggcatttcacctcgtggagccggatacacttttggccaagatatctctgagcaattcaaccataccaacagcttgaagcttattgctagagctcatcagctggtcatggagggatttaactggggacatgagcaaaaggttgtcactatctttagtgcaccaaactattgctatcggtgtggaaacatggcttctatcttggaagttgatgattgcaagggccacacgtttatccagtttgatccggcccctaggagaggagagcctgatgtaaccagacgtactcctgattatttcctttaaatggagaatcctcacttgctagtgcaacaactcggctaaagtgatttttgatcctttgccagaattgggattttgatacgactggtatgggctaaaaattcatcaggtaaagtgccagaaaaggaccaagcggcttgtaaaatggactttgtatgactagggtatttatttt

SEQ ID NO: 3572 - DNA, 1210 bp, Chrysanthemum coronarium
ctcatttttcatttcaatcaataacaaaaatcaattgaattgaataaatatatgtataaataaaacccataatttatttatatataaaacaatatgagtgtggatctagcttctaacacccatgggaatcttgatgaacagatctcacagcttatggaatgcaaacccttaattgagcctgaggttaagacattatgtgagaaggcgaaagagatactgatgaatgaaagcaatgttcagccagtaagaagtcccgtgactatctgtggtgacatccatgggcagtttcatgatcttgctgaactttttcgcataggaggaaagtgcccggataccaactacttgtttatgggggattacgttgatcgaggatattattctgttgagaccgtcacgctcctggtggctctgaaagtgcgatatcctcagcgaatcacaatcctaagaggaaatcatgaaagtcgtcagatcactcaagtctatggattttatgatgaatgtcttcggaagtatggaaatgctaatgtttggaagactttcacagatctcttcgattattttccattgactgcattggttgaatcagagatattttgtcttcatggtggtttgtcaccttcaattgaaactcttgatagtataagaaactttgaccgtgttcaagaggttccacacgaaggtccaatgtgcgatcttctatggtctgacccagatgaccgttgtggatggggcatttcacctcgtggagccggatacacttttggccaagatatctctgagcaattcaaccataccaacagcttgaagcttattgccagagctcatcagctggtcatggagggatttaactggggacatgagcaaaaggttgtcactatctttagtgcaccaaactattgctatcggtgtggaaacatggcttctatcttggaagttgatgattgcaagggccacacgtttatccagtttgacccggcccctaggagaggagagcctgatgtaaccagacgtactcctgattatttcctttaaatgaataatcctcactagctaatgcaacaactcggctaaagtggtttttgatcctttgccagaattgggattttgatacgactggtatgggctaaaaattcatcaggtaaagtgccagaaaaggaccaagtggcttgtaaaatggactttgtatgactagggtattttattttttcct

SEQ ID NO: 3573 - DNA, 1198 bp, Chrysanthemum coronarium
ctcatttttcatttcaatcaataacaaaaatcaattgaattgaataaatatatgtataaataaaacccataatttatttatatataaaacaaaatgagtgtggatctagcttccaacacacatgggaatcttgatgaacagatttcgcagcttatggaatgcaaacccttaattgagcctgaggttaagacattatgtgagaaggcgaaagagatactgatgaatgaaagcaacgttcagccggtaagaagtcctgtgaccatctgtggtgatatccatgggcagtttcatgatcttgctgaactttttcgcatcggagggaagtgcccggacactaactacttgtttatgggggattacgtcgatcgaggatattattctgttgagactgtcacgctcctggtggctctgaaagtgcggtatcctcagcgaatcacaatcctaagaggaaatcatgaaagtcgtcagatcactcaagtgtatgggttttatgatgaatgtcttcggaagtacggaaatgctaatgtttggaagactttcacagatctctttgattattttccattgaccgcattggttgaatcagagatattttgtcttcatggtggtttgtcaccttcaattgaaactcttgatagtataagaaactttgatcgtgttcaagaggttccacacgaaggtccaatgtgtgatcttctatggtctgacccagatgaccgttgtggttggggcatttcacctcgtggagccggatacacttttggccaagacatctctgagcaatttaaccataccaacagcctgaagcttattgctagagctcatcagctggtcatggagggatttaactggggacatgagcaaaaggttgtcactatctttagcgcaccaaactattgctatcggtgtggaaacatggcttctatcttggaagttgatgattgcaagggccacacgtttatccagtttgatccggcccctaggagaggagagcctgatgtaaccagacgtactcctgattatttcctctaaatggacaatcctcacttgctagtacaacaactcggttaaagtgatttatgatcctttgccagaattgggattttgatacgactggtatgggctaaaattcatcaggtaaagtgccagagaaggaccaagtggcttgtaaaatggactttgtatgactagggtatta

SEQ ID NO: 3574 - DNA, 1243 bp, Cirsium arvense
ttctgatttctgtattcaattgggaagcattttgatcggtagaacgattccttgatattgaaaccctagctctttattatatgtatacacacagataatatatataggagaagatgagtgtggatctagcttcgaacacccatgggaacctggacgaacagatttcacagctcatgcagtgcaagcccttaaacgagcctgaggttaggacgttatgtgagaaggcgaaagagatactaatgggtgaaagcaacgtccagccagtaaaaagccctgtgaccatctgcggtgacattcatgggcaatttcatgatcttgctgaactttttcgcataggagggaagtgcccggatacaaattacttgtttatgggggattacgtggatcgagggtattattctgttgaaactgtcacgctcttggtggctctgaaagtgcggtatcctcagcgaatcacaattctaaggggaaatcatgaaagtcgtcagatcactcaagtttatgggttttatgacgaatgtcttcggaagtacggcaatgctagtgtttggaagacttttacggatctctttgattattttccattgactgcattggttgaatcagaaatattttgccttcatggtgggttgtcaccttcaattgaaactcttgatagtataagaaatttcgatcgtgttcaagaggttccacacgaaggtccaatgtgcgatcttttatggtctgacccagatgaccgttgtggttggggcatttcaccccgtggagctggttacactttcggccaagatatatctgaacaatttaaccataccaacaacctaaagcttattgctagagctcatcagctggtcatggagggattcaactggggacatgaccaaaaggttgtgaccatctttagtgcaccaaactattgctatcgatgtgggaatatggcatctatcttggaagtcgatgattgcaagggccatacatttattcagtttgatcctgctcctagaagaggagaacctgatgtaacgagacgaacgcctgattatttcctgtaaccaatggaattggaaaactggttgccggaatcgatacaataatatgtggttaaaattcatgaggagtgcaagggaaggaccaaatttaaagggttactcaaatagtttgaattttaagatgcataattaattagcatttgtttgtatcaagcaattatccatttgaatattttgtttattgtatttggttc

SEQ ID NO: 3575 - DNA, 1466 bp, Vigna unguiculata
aaaaaaaccagaaacaataaacacaaacggaaaagacaaaaggggttttcctagtgagatctagggttcccatcgattcggtgagaggatattcatcaaacgacctcagcaaggcaaggttaggaggtggagtactagagcatggattcggtgccttcgaattcacatggaaacctcgatgagcagatttctcagctcatgcagtgcaaacccttgtccgaacaagaggtaagggtcttgtgtgataaggcaaaggagattttgatggaagagagcaatgtgcagcctgttaaaagtcctgttacaatttgtggtgatattcatgggcaatttcatgatcttgcagagctttttcgcattggaggaaagtgtccagatacaaattacttgtttatgggagactacgttgaccgtggctattattctgtcgaaactgttacgcttttggttgcccttaaagtgcgttatcgtcaacgtatcaccattctgaggggaaatcatgaaagtcgccagattactcaagtttatgggttttatgatgagtgcttacggaagtatggttctgctaatgtttggaagatctttacagatttgtttgactactttccattaacagcattggttgaatctgaaatattttgtcttcatggtggattgtcaccatctattgaaaccctcgacaacatacgtaattttgatcgcgtacaagaagttcctcatgagggacccatgtgtgatcttctgtggtcggatccggatgatcgttgtggttggggcatctctcctagaggtgctggatatacctttgggcaggacatatctgagcaatttaatcataccaataacttgaagctgattgctagagctcaccagctggttatggaaggatataactggggtcatgatcaaaaggtggttactatctttagtgcacctaactactgttatcgttgtgggaacatggcatcaattctcgaggttgatgactgcaaaggacacacattcattcagtttgaaccagctccaaggaggggagagccagatgtaaccaggagaacgcctgattacttcctatgatactcctttggtttagttgctgttaccagcacagcaactaatgccctgcagtaagtaatctgcaagctcatctacttgtccaaaccagagccatgaatcaccttgatacttataattttcgaagttaggcttcgctggatgtgttatttagttgaattataactgaatctttccaagaggaagctgagcagtaggcgatgctattgtgggcatgtgtatcattccagcttgcaatgtatcaattttaatgtttttttccccaattttccttctctatttattttaaactcttggcctttcttttcttaatttaggattattaagggggtgggtttctgtagatggataatgctttaatatatcttttaatgagtgttttgtgattcttt

SEQ ID NO: 3576 - DNA, 1396 bp, Cyclamen graecum
aatgcctggattaagaggtagataagagagtgaggagagtttctctctcttcgattgatcccatctttatcgctctctggcgaactgaatatagggttagggtttagagacctcatttctcgtgattaaatttattctctgtaattgagaagacgaagaagatgagttcggatctgctgcaatcaaacgcacacggtaacctcgatgagcagatcgaacagctcatgcaatgcaagcccctttccgaaccagaggttaggggactatgcgagaaagccaaagagatactaatggaagaaagcaatgttcagccagtaaaaagccctgtaaccatctgtggcgacattcacgggcagtttcacgatcttgcggaactttttcgcatcggagggaagtgtcctgacacaaattacctgttcatgggagattatgttgaccgtgggtattactcagttgaaacagttacactcttggtggctttgaaagttcgttatcatcaacgaataactattcttagaggaaaccacgaaagtcgacagatcactcaagtgtatgggttctatgatgaatgcttgaggaagtatggaaatgcaaatgtttggaagatcttcacagatctcttcgattattttccacttaccgccttggtagaatcagagatattttgtctccatggaggattgtcaccatcaattgaaacactggataacatacgaagttttgatcgtgttcaagaagtcccacatgaaggacccatgtgcgacctgttatggtctgaccctgatgaccgttgtggttggggtatctctcctcgtggtgctggatacacttttggccaggacatatctgagcaattcaacaataccaatagcctaaagcttattgctagggctcatcagctggttatggagggctttaactggggacatgatcaaaaagttgtcaccatctttagtgcacctaattattgttaccgatgtggaaacatggcctccattttggaagttgatgactgcaaaggacacactttcatccagtttgagccagctccaaggagaggagaaccagatgtaactcgaagaacgcctgattatttcttataaagcaactgctggtcagatgcagcagtagatgtcgggttgttcgtaaagtgaaggtgctatgatagtgttctgcagctagtggagcctgaaagtgttcgatgacattgaaacccatgtcagatttcctagaactagcgtagtgaactctgattgttttgatgtggcattccttcgatacgttgccattttttaatctgtcttttttcccctcatgttataaagattgaaggtatggagtctgtgtagagctaagatactaattaactgagttgtgtgttgctcctgtatgttga

SEQ ID NO: 3577 - DNA, 1408 bp, Fagopyrum esculentum
ccaaccagacgacggtgacggtaatttggaagaaagagacaataggatctgatagatctagggtttgccaggagcgcaaccatgagcttcgatccggtgccttcgaactctcatcacaacctcgatgaacagatcgcccagctcatgcagtgcaaacctctctccgaacaagaggtgaggggattgtgtgaaaaggcaaaggagatattaatggaggagagcaatgttcagcctgtgaagagtcctgtcaccatatgtggtgatattcatggacagttccatgatcttgcagaactttttcgcattggtggcaagtgtccggatacaaattacttattcatgggtgactatgttgatcgaggatattattcagttgaaactgttacattgttggtggcactgaaagttcgatatcaccaaaggatcaccattcttagaggcaatcatgaaagtcgtcagattactcaggtttacgggttttacgacgagtgcctgcgaaagtatggcaatgctaatgtttggaagaccttcactgatctatttgattacttcccactcactgctctggttgaatctgaaatattttgtctgcatggtggattatctccctccatcgagacgcttgataacataagaaattttgatcgtgtccaagaggttccgcacgaggggcctatgtgtgatctcttatggtccgacccagatgatcgctgtggatggggcatatcacctaggggtgctggatacaccttcggtcaagacatttcggagcaatttaatcataccaatagtttaaagctgattgctagagctcaccaacttgtgatggagggatacaactggggtcatgaccaaaaggtggtaacgatattcagtgctccaaattattgttatcgttgtggaaatatggcatccatcttggaagttgatgactgcaagggccacacattcattcagtttgagccagctccaaggagaggggagccagatgtaacacggagaacacccgattattttctgtgattcaacttgcccatatgatttgggatttgggagcctctgaagccggcttacaagttggcggccataactacgaggctgagaatagtcaagtcacttaataggtgggttggggttggctaagttggatctggaagggttaaaattgttttttttcaatctactgcttctcatgagctgagcaaagaaaagggcccctgaagaaagtgaagctttggtagctagttgcatgtgtatcaatttccagtgaacactgttggtattccttatattttgccctctttttttttttgttttttattttatctgttaattcgccgtagaagaaagaatggtgtggctgggttgtagagagacgatgagctaacttctgaacggttggttataa

SEQ ID NO: 3578 - DNA, 1594 bp, Humulus lupulus
cgggcaaaaactacaaatcccactcgctctcctccacgcgctcctccgttccaaagttggtctctcgctctatactccaacctcattcttcttcgttccactctccttgagcagaaccagttttcgaggactgatctctaagcttgggtgatttagggtaaaatccctaatcgaaacagcgttatcctggtgcggattcagggagaagagggtggtagcgagcgagcgagatgggcatgaattctatatcctcagagtccaatatcgatctcaatgagcagatctcgcagcttatggagtgcaagccactctccgagcaacaggttagagccttatgtgacaaggccaaggaaatcttaatggatgaaagcaacgttcagcccgttaaaagccctgtgaccatttgtggtgatattcatgggcagtttcatgatcttgctgaactttttcgaattggagggaagtgtccggatactaattatttgtttatgggagactatgtggaccgtggatattattctgttgaaactgtgacgcttctggtggccctaaaagtgcgttatccacagcgcatcactattcttagaggaaaccatgaaagtcgtcagattactcaagtttatgggttttatgatgaatgtcttcgaaagtatggaaatgccaatgtttggaagacctttacagacctctttgactattttccgttgactgcattggttgaatcggaaattttttgtctgcatggtggtttgtccccttccattgaaacccttgacagcatacgcaattttgatcgtgttcaagaggttcctcatgaaggaccaatgtgtgatctgttatggtctgacccagatgatcgatgtggttggggtatttctcctcgaggtgctggatatacttttggccaggatatttctgagcaatttaatcatacaaacagcttaaaactgattgccagagctcatcagttggtcatggatggattcaactgggcccatgagcaaaaggtagttactatatttagtgcacctaattactgctaccgttgtggcaacatggcctctattttggaagttgatgactgtaaaagccacactttcattcagtttgagccagctcctagaagaggggagccagatgttactcgtagaacacccgattacttcttataaagcagctggaattctcgatattctatttactttctactggttccactcatgctctggtgcttgtgcaagatgactgtcaggtttagaatttacaattctaccttctgatggtttgtgggatataggatctgtcatagaacatgcgctgcctactggtttgtcttacacttgaacatcgctggattttgcatctgagagatggccaaaagttgattgttttagtctgattgtatcatatccagtagaaatttgtggatattcacttttcttgtccccctccccccccttattttttactttctgttttgtttctaatctcttctcacccttcccattcttatggggtttgaatttgggtgaatggattttattagtggatattttgccctcttttctaaatgtcttcttaaacagtaatttac

SEQ ID NO: 3579 - DNA, 1572 bp, Lotus japonicus
cgggcagcgtgcaaatcttgttatttcacgcgccttctcctccatttgggttccgtccactcctcctcactgcgaccgagaaaggccgcggccggagccggagaatcatccatccaccctccatcctctcctcctagcctagggttcgttccgattcacgatgggtgccaactcgttgccatccgagtccactcacgatctcgacgagcagatctctcagctcatgcagtgcaagccactctccgagcaacaggtaaaagaattatgtgagaaggctaaggagattttaatggaggaaagcaatgtccagcctgtgaaaagccctgtcacaatttgtggtgatattcatggccagtttcatgatcttgctgaactatttcgaattggaggaaagtgtccagatactaactacttatttatgggtgattatgtggaccggggttattattcagttgagactgtgactctccttgtggcactgaaagtgcggtatcatcagcgaattactattcttaggggaaaccatgaaagccgtcagattactcaagtatatggattttacgatgaatgcttaagaaagtatggtaatgctaatgtttggaagacctttacagacctctttgatttttttccattgactgcattggtagaatcagaaatattctgtttgcacggtggcctgtcaccttcaattgagacccttgataacataagaaacttcgaccgtgttcaagaggttcctcatgaagggcccatgtgtgatctattgtggtctgacccggatgacagatgtggctgggggatatctcctcgtggtgctggatatacttttggccaggatatatctgaacaattcaatcacacaaacagccttaagttgattgcgagagctcatcagctggttatggatggatttaactgggctcatgaacaaaaggtggttaccatttttagtgcacctaactactgttaccgatgtgggaacatggcttccatattggaggttgatgattgcaagggacacacatttatccagtttgaacctgctccaaggagaggagaacctgacgtgacccgaagaacgcctgattacttcctgtgatgtagctgtgctgaatgttatactggtatatcatggttaccgctatttatgcactaatttcaggtagttgtgttgtgcatcctcattggagagattactactgtaagcatttaaatccatggatatacattcgcggcctatgcttttatggtttgtccaaacactgctttgacgtataataggcaggtaacattcaactgatctgttgcactcaagaacttgctggacacccagtctggagtagtcgccaagataatatgactttgtcggaatatgtattgttccatcaaaatgtggatattttttgtttagctttacctgtctatttttctcatgttttataattatacctccctttccaggttttaggcactatgactggattttttttgaactcgtcgatgtttttgctatgttctaccaatttttagtgaaagttgcatgatatagcgatttgattggctcttacg

SEQ ID NO: 3580 - DNA, 1411 bp, Medicago truncatula
aaagctttggtttcttcatcacctctctctctctctctctctctaacccattttggtttcttcaacaaacacaaataacaacaataatcgaaaaacaaagagggcttttcagagttagatctagggttccaatcgattcaaaaactggattattgattggagaagtcgaacatggattcaaattcccatggtaatctcgacgagcagatttctcagctcatgcagtgcaaacccttgtccgagcaagaggttagggtcttgtgtgataaggcaaaagagattttgatggaagaaagcaatgttcagcctgtaaaaagtcctgttacaatatgcggtgatattcacgggcaattccacgatctggcagagcttttccgcatcggagggaagtgtccagatactaattacttgtttatgggagattacgtcgatcgtggctattattctgtcgaaactgtaacgcttttggtctcccttaaagtgcgttatcgtcagcgtatcactattttgaggggaaatcatgaaagtcgccagattacccaagtttatggattctatgacgagtgcctacggaagtatggcagtgccaatgtttggaagatgtttactgatttgtttgactacttcccattgacagcattggttgaatctgaaatattctgtcttcatggtgggttgtccccatccattgaaacccttgacaacatccgtaattttgatcgtgtgcaagaagttcctcatgagggacccatgtgtgatcttctatggtctgatccggatgatcgctgtggttggggtatctctcctagaggtgctggatataccttcggccaggatatatcagagcagtttaaccataccaataatttgaagctgattgccagagctcaccagctggttatggaaggatataactggggtcatgagcaaaaggtggttaccatattcagtgctcctaattactgttatcgctgtgggaacatggcatccatccttgaagttgatgactgcaaaggacacacattcattcagtttgagccagcaccaaggaggggagagccagatgtaaccagaagaacccctgactacttcctatgatacgattttggttgagttgcttttgccaacaacttgtgcagtaatgtacaagctcatataccagttgaaaccagagctgtgaatcagattgatccttattttctaagttaggcttcactggatgtgttatttacctgaattataattgaatctttgcaagggagaagctgaggagcaggtgatgcttttgtgggcatgtataccattccagcatgcaatgtatcaatttgaatgtttctccaaattttcctttataactctgttgactttcttttttcattttaggattatcgttaatggggatgggtttatg

SEQ ID NO: 3581 - DNA, 1449 bp, Tropaeolum majus
gtcgttcagtctttttcggattagggaagggaaaacgaagggatctttgaatctgtttgaaagtacgaagaatacggtaaggtaatcatggattccgtcccttcgaactctcatggtaacctcgatgaggagattaatcagctcatgcaatgcaaacccttatccgaacaagaggtaagggtactatgtgagaaggccaaagaggtattgatgaaagaaaacaatgtccagcctgtgaaaagccctgtcacgatctgtggtgatatacatgggcagtttcatgatcttgcggagctttttcggattggagggaaatggccggacacaaattacttgtttatgggagattacgtagatcgtggctattattcagttgaaacggtcacactattggtagcactgaaggtgcgttacccacaacggataactattcttaggggaaatcacgaaagtcgtcagattactcaagtttatgggttttatgatgaatgcctaaggaagtatgggaatgctaatgtttggaagacgtttacagatctatttgactattttccacttacggcattggtggaatcagaaatattttgtctccatggtggattgtctccatccattgaaacccttgatagcatacgcaattttgaccgtgttcaagaagttcctcatgaggggcctatgtgtgatctgttatggtctgacccagatgatcgatgtggctggggcatctcaccaaggggcgctggatatacgtttggccaagatatttctgagcagtttaaccatacaaacaatttgaagctgattgctagggctcaccagcttgtcatggaaggatacaactggggtcatgagcaaaaagtcgttactatatttagtgcacctaattattgttatcgctgtgggaatatggcatcaatccttgaagttgatgactgccagggccacacatttattcagtttgaccctgctccaagaaggggagagccagatgtgacccgaagaacaccggattacttcctatgattcaagacctgataagtttccagtggcaagagttaattgccagctagtttataagcttgggggcattttgaatttaagatgaagatttatgatttggtgatgatgctagttcgggtagagaaaaacaagtagaaatgagacagcacaagacttgctatgtaagcctaagtttcgacaagaggaagcaattggtggcagatgattagccgcaaccacctgtttacttgattttgcttttgctggtagaatagttgtttgaaatggttaaatgttgtgtagaacgaggataaagtttcaatttgtattatctttaatcttaccatcatcgttctaataaattcttttatttttcgttgtttgtatttacatgttttctggccttgaccctttaattagttgtgggttgagttggttcaaccttattgc

SEQ ID NO: 3582 - DNA, 1488 bp, Phalaenopsis aphrodite
cgtctctcctccaaattgccaaactggaccgaagctaaccaggagagacagagacagagagagagagagacagagagagagttggaggtctagggctacacacttgttccggtatagagttatcgattgtggctgctggagaagaagatgagcgtgaatccggtgcaggcgagttctcatgggaacctggacgagcaaattacgcagcttatgcagtgcaagccgcttacggaacaagaggtgagagtcctatgtgacaaagcaaaggagattttaatggaagaaagcaatgtgcagcctgtgaaaagccctgtgacaatttgtggtgacattcatggacagtttcatgatctagcggaattgtttcgtattggtggaaagtgcccggataccaattacttgttcatgggtgattatgttgatcgtgggtattattctgttgaaactgtcacgcttctagtggctctcaaggtgcgttactctcagagaatcacaatcctcaggggcaatcatgaaagtcggcagatcactcaagtttatggattttatgatgaatgcttaagaaagtatggaaatgcaaatgtatggaagatatttacagatctcttcgattatttccccttgactgcattggtcgagtcagaaatattttgtttgcatggtgggttatccccatctatcgagactctcgataacatccgtaattttgatcgagttcaagaggttccacacgaggggccaatgtgtgatctcctatggtctgaccctgatgatcgatgtggttggggcatctctcctaggggtgctggatatacatttggccaggatatatctgagcaattcaaccatacgaacaaccttaagctgattgctagagctcatcaactggtcatggatggatataactggggccatgaccaaaaggttgtaaccatttttagtgcgcctaattattgctaccgctgtgggaacatggcatccatattggaagttgatgattgcaagggtcacacgtttattcagttcgatccagcgcccaggagaggcgaacccgacgtaactcgcagaacgcccgattatttcttataaacccatcctcctgattgaacgaacacaccattgatttctgtctccaatcattatttcaagctgcttaacggtttggttggtttagaacgcagagaaaattatgtggaggggagtactatgtaattaattagcttcattttgtgttttcgaaggcagcagagtgctgcggtatttccagctgcagcagcatgtattttcatcattggaagggagttgtatactctgtggtttagctctctctcatttgttttgatttttactctaattatatttgtttctttttagttctctaagctctgaccaatcatttgggtacttctagtaaaaccattctgggtctctaatcctttgttttgtctctgtaattgttctgggaagatttgagtctatttaattaca

SEQ ID NO: 3583 - DNA, 1515 bp, Phalaenopsis aphrodite
ttccgccactggcccttcgtttctcctccaaattgccaaactcgaccgaagctagccaggagagacagagtcagagagagagagacagggagagacagagagagagagttggaggtctaggtctacacacttgttccggtatagagttatcgattgtggctgctggagaagaagatgagcgtgaatccggtgcaggcgagttcacatgggaacctggacgagcaaattacgcagcttatgcagtgcaagccgcttacggaacaagaggtgagagtcctatgtgacaaagcaaaggagattttaatggaagaaagcaatgtgcagcctgtgaaaagccctgtgacaatttgtggtgacattcatggacagtttcatgatctagcggaattgtttcgtattggtggaaagtgcccagataccaattacttgttcatgggtgattatgttgatcgtgggtattattctgttgaaactgtcacgcttctagtggctctcaaggtgcgttactctcagagaatcacaatcctcaggggcaatcatgaaagtcggcagatcactcaagtttatggattctatgatgaatgcttaagaaagtatggaaatgcaaatgtatggaagatatttacagatctcttcgattatttccccttgactgcattggtcgagtcagaaatattttgtttgcatggtggactatccccatctatcgagactctcgataacatccgtaattttgatcgagttcaagaggttccacacgaggggccaatgtgtgatctcctatggtctgaccctgatgatcgatgtggttggggcatctctcccaggggtgctggatatacatttggccaggatatatctgagcaattcaaccatacgaacaaccttaagctgattgctagagctcatcaactggtcatggatggatataactggggccatgaccaaaaggttgtaaccatttttagcgcgcctaattattgctaccgctgtgggaacatggcatccatattggaagttgatgattgcaagggtcacacgtttatccagttcgatccagcgcccaggagaggcgaacccgacgtaactcgcagaacgcccgattatttcttataaacccatcctcctgattgaacgaacacaccattgatttctgtctccaatcattatttcaagctgcttaacggtttggttggtttagaacgcagagaaaattatgtggaggggagtactatgtaattaattagcttcattttgtgttttcgaaggcagcagagtgctgcggtatttccagctgcagcagcatgtattttcatcattggaagggagttgtatactctgtggtttagctctctctcatttgttttgatttttactctaattatatttgtttctttttagttctctaagctctgaccaatcatttgggtacttctagtaaaaccattctgggtctctaatcctttgttttgtctctgtaattgttctggaaagttttgagtctatttaattaca

SEQ ID NO: 3584 - DNA, 1625 bp, Cajanus cajan
ccgaaaaaggagtggtcatcgaacaaaacgagcacagcgaagcctccaacgctttggtttcttcaccaccactacccttcgcctctctctttctaaaaaccagaaacaacaaacgcaaaccgaaaaggcaaaagggttttccaagtgagatctagggtttccttcgattcggaaacaggaaattgatccaacgacctcaacgaggaggtggagtagtggagcatggattcggtgccttcgaattcccatggaaacctcgatgagcagatttctcagctcatgcagtgcaaacccttgtctgagcaagaggtaagggtcttgtgtgacaaggcaaaggagattttgatggaagagagcaatgtccagcctgtgaaaagtcctgttacaatttgtggtgatattcatgggcaattccatgatcttgcagagctttttcgcattggaggaaagtgtccagatacaaattacttgtttatgggagattacgtggaccgtggctattattctgttgaaactgttacgcttttggttgcccttaaagtgcgctatcgtcagcgtatcactattctgaggggaaatcacgaaagtcgccagattactcaagtttatgggttttatgatgagtgcctgcggaagtatggtagtgctaatgtttggaagatctttactgatttgtttgactactttccattgacagcattggttgaatctgaaatattttgtcttcatggggggttgtcaccatctattgaaaccctcgataacatacgtaattttgatcgtgtacaagaagttcctcatgagggacccatgtgtgatcttctatggtctgatccggatgatcgttgtggttggggcatctctcctagaggtgctggatataccttcggccaggacatatctgagcaatttaaccataccaataacttgaagctgatagctagagctcaccagctggttatggaaggatataactggggtcatgatcaaaaggtggttaccatatttagtgcacctaactattgttatcgttgtgggaacatggcatcaattcttgaagttgatgactgcaaaggacacacattcattcagtttgagccagctccaaggaggggagaaccagatgtaactaggagaacacctgattatttcctatgatactattttggttgggttgctgtttacagcacagcaactaatgccctgcagtaatgtgcaagctcatctacttgtccaaatcagagccatgaatcatattgatacttatattttcgaagttaggcttcgctggatgtgttatttagttgaattataactgaatctttccaagaggaagctgaggagcaggcgatgctattgtgggcatgtgtatcattccagcatgcaatgtatcaattttaatgttttgtttccaatttttccttttctatttatttgcaaactctcttgacgtttcttttctcaatttaggattattatcaagggggcgggtttctgtagatggataatacttcaacatatcttttaatgggtgttttactatttttttagccgtcttctgagaattatattttagtaggtagtcttgttttattgtttttacatgaaatgacttaattttccaa

SEQ ID NO: 3585 - DNA, 1602 bp, Solanum tuberosum
tcaaagaaaatgaattaaaaattcgttttttttacatagtcggtaaagagtagatcgacaaatttcgagggctttctcttgcattttctcttcttcttcttcttcttcttgcccagaagaacaaaaatacataaaagcaaagggcttttgtgggttggtggcaaaaaaatttcagaaatttattcaagattatatattgggaaaaaggaaaattgattcttgaagttgaaattttttagtttgaagattagttgtacgaaatgagttcagatctgatagctaacacacatggtaacctggatgagcagatttctcagcttatgcagtgcaagcctctatctgagcctgaggttagagcattatgtgagaaggctaaggagatactaatggaagaaagtaatgttcagccagtaaaaagccctgtgactatatgtggtgatattcatgggcagttccatgatcttgctgaactttttaggattggtggacagtgtccagatacaaattatctgtttatgggtgattacgttgaccgtggatattattcggttgaaacagttactctattggtagctctgaaagtgcgttatcctcaacgactaacaattcttagaggaaatcacgaaagccgacagatcacacaagtctatgggttctacgatgaatgcttgcggaagtatggcaatgctaatgtttggaaaacatttactgatctatttgattattttcctttgacggcattggttgaatccgaaattttttgtttgcatggaggactgtctccatctattgaaacccttgataatgtacgaagtttcgaccgtgtccaagaagttcctcatgaaggggccatgtgtgatcttttgtggtcagacccagatgatcgttgtggttggggtatgtcaccccggggtgctggatacacttttgggcaggacatatctgagcaatttcaccataccaataatctaaagctgattgctcgagctcatcagctggttatggagggatataactggagccatgaacaaaaagttgtcactatttttagtgcaccaaattattgttatcgatgtggaaacatggcctctattttggaagttgatgactgcagagggcacacatttatccagtttgatccagctccaagaaggggagaaccggatgtaacacgaagaacccctgattacttcttataaatgtgatggagagcaatatctatggtctgccaagtgctgttttttgcgataacttccatctattgtcgagatgtgagtgcatttatggcaaagctaataggctgctcccgggaggtaatccgaggataaagaggcttgaccaggtccccccccttgggttaaagtcatattctaacctatgttaggaatattagagtggagaagtgcagccagcaatgctgttatgtatgatttcatgaagacttgttttctgttgttcctttccaagctctgattttcagtcttagtgtgataattttgtcatatgttggttgcaaggaagtctgttgtgtaaagttaagaatcatctactttacattgtaacttttaccttgttaatgcagctcatccttcctttctgaaa

SEQ ID NO: 3586 - DNA, 1236 bp, Primula obconica
aatcaatcaccgatccgttaagaatctgtatgcgaagaagatgagtacggatctggtccaatccaacgcacacggcaacctcgatctgcagattcaacagctcatgcaatgcaagcccctttccgaaccggaggtaagaggactatgcgagaaggctaaagagatattaatggaagaaagtaatgttcagccagtaaaaagtcctgtgaccatctgtggtgacattcacgggcagttccatgatcttgcggaactttttcgcatcggaggaaagtgccccgacacaaattacctgttcatgggagactatgtcgaccgtggatattactcagttgaaactgttacacttttggtggctctgaaagttcgttatcatcaacgaataactattcttagagggaaccacgaaagtcgacagattactcaagtgtatgggttttatgatgagtgcttgagaaagtatgggaatgcaaacgtgtggaagatcttcacagatctatttgattatttcccgctcactgccttggtagaatcagagatattttgtctacatggtggattgtcaccatccattgatacactggataacatacgaagtttcgatcgcgtgcaagaagtcccacacgaaggtcccatgtgcgacctgttatggtctgaccctgacgaccgttgtggttggggaatctctccgcgtggtgccggatacacatttggccaggacatatctgaacaattcaaccataccaatagtttaaagcttattgctagggctcatcagttggttatggagggctttaactggggacatgatcaaaaagttgtcaccatctttagtgcacctaattattgttatcgatgtggcaacatggcatctattttggaagttgatgactgcaaaggacacactttcatccagtttgagccagccccaaggagaggagaaccagacgtaacacgaagaacacctgattatttcttataaagcaactattggtcagatgtagcagcttcatgttgggttatgatcgggtgcaaagcataagtaaatcaaagcttctaatgataagtgtactccagcaagtgtggcccatagtgtttgattacatctaacctgtcagacagggacggaactagaaagtgacaatagggtgccacggcatcctcataattgtaaaactttcatttttcactatatattttgagtatgatttttataaagtagtgatttggcatcct

SEQ ID NO: 3587 - DNA, 1437 bp, Chenopodium quinoa
tctggaagatctgctagggttttctcttcttacaagatgagcttcgatcccgttccttctaactctcatcacaatcttgatgagcagatcggtcagcttatgcagtgcaagcctctttccgaacaagaggttaggacattatgtgagaaggcaaaggagattttgatggatgaaagcaacgtgcagcccgtgaaaagtcctgtgacaatttgtggtgacatccatgggcagtttcatgatctagcagagcttttccgtattggggggaagtgcccagatacaaattacttatttatgggtgattatgttgatcgaggatattattcagtggagactgtaacgctcctggttgcacttaaagtccgctatccccaaaggatcaccattcttagagggaatcatgaaagtcgtcagattactcaagtttatggtttctatgatgaatgcctacggaagtatggaaatgccaatgtctggaagaccttcacagatttgtttgattattttccgctgactgcattggtggaatctgaaatattttgcctgcatggtgggttgtcaccatccattgaaacccttgataatatacggaatttcgatcgcgtccaagaagttccccatgagggacctatgtgtgatctcttgtggtctgaccctgacgaccgttgtggttggggtatatcacctaggggagctggatacacttttggccaagacatatctgatcaatttaaccataccaataacctaaagctgattgccagagctcaccaactggtgatggagggattcaactgggcacatgaccaaaaagttgtgacaatatttagtgctcctaactactgctatcggtgtggaaatatggcatccatcctggaagttgatgactgtaaaggtcacacatttattcagtttgagcctgctccaagaagaggggagcctgatgtcaccaggaggacacctgattatttcctgtgatttcaagttgccaatgacaagatggtttctggtggtggaaagcctcctacctgatcctatgtttattgagcgctatttcatggattgggggttgttattctcctatggtgatgaatggattgctagtcacatgtgatgcagcagataatcttcttttgacttcatgcttctagattatggtgaatttcgcgaaagaggagtctagggagcttgtaggaggatatgtaccaatttccagcaaaacattgtggtatctttaacgccaaattttctttgctttcttggtccttttttggcctttttaattcgtcttctaatttttttgtttattcaatgtagaagaatggttgtttcgtgggctgggggttctgtagagagacaaatagttaatttcctattccaatgggtgctttatataattttttcctctcaatagtcccaagaattatgtatttagcg

SEQ ID NO: 3588 - DNA, 1725 bp, Secale cereale
cccctcccctccccacgcaggcgcgcgcccggcggcgagatctgcccagggtggacccccggcgaggatgagcagcccccatggcggcctcgacgaccagatcgagcgcctcatgcagtgcaagcccctccccgaggccgaggttagagcactgtgcgagaaggccaaggagattttgatggaggagagcaatgttcagcctgtaaggagtcctgttacaatctgtggtgatattcacgggcagtttcacgatcttgcagaactgttcagaattggtggaaagtgtccagatacaaattacttgtttatgggagattatgtagatcgtggctactattctgtcgaaactgtcacgctgttggtgtctttgaaagtccgttatcctcagcgaatcaccattcttagaggaaaccatgaaagccgacagatcacacaagtttatggattctacgacgaatgcttaaggaagtacggaaatgcaactgtctggaaaacctttacggatctgtttgactacttccccttgacagcattggttgagtcagaaatattttgcttgcatggtggattatcaccatccattgagacacttgataacatacgtaactttgaccgcacccaagaagttcctcatgaagggcccatgtgtgatcttctgtggtctgaccctgatgatcgatgcggttggggaatttcccctcgaggcgctggatataccttcggacaggatatatcagagcagttcaaccataccaataacttgagacttattgctagagctcaccagttggtgatggagggattcaactgggctcatgagcaaaaagtggttaccatatttagtgcacctaattattgctaccgctgtgggaatatggcatcaatcttggaagttgatgattgcagggagcatactttcatccagtttgagccggccccaagaaggggagaaccagatgtaactcgtagaacgccagactacttcctgtgatgatgtgaaatcggtgtcgacctctgcaccaaaggtttgataactagctgaagcttgctggccgcagataaatcctttttgctgaaagtcagtctcccgtgtgctattcttcttaatttttccgcccatgatgcccctggctgtttgcgagccctgcatcgccgcatcgtgatgatcaaagtgtatacctacctacatacctacagctggaaggaaggatccattgtgttactcacctctctaattgatttgatgctctgcttggtggatgcgtggttagtgaacgaactcgagagcatcaaaagcatcgtttgtattgtgaaaggaagccttttatcattttcccctctgtattcatttttttccccatgttcgcctaattatttttcttttgatgattatttgttgtagagatggacagtgtagttgtatggttctgtgttgagcccttgttaggtcttgtgaaccagtattgattttccgtatagaagaatatttgtagtatgctgagcagtgtacttgtggtgttttacctgtgtttggccctgctagtggatattttttgtttatgaatgatgcaaagatgtggtattacccacaacaagagcatacactatcattacccttgcttacttatgcttacaaacttattttcgtcttaagaaaaactaaaaaaaaaaaaaaaaaaaaactaaaaataaccgtgtagtcgttagtactaaccctagtcgttc

SEQ ID NO: 3589 - DNA, 1575 bp, Secale cereale
ggcgcgctcccggcggcgagatctgcccagggtggactcccggcgaggatgagcagcccccatggcggcctcgacgaccagatcgagcgcctcatgcagtgcaagcccctccccgaggccgaggttagagcactgtgcgagaaggccaaggagatcttgatggaggagagcaatgttcagcctgtaaggagtcctgttacaatctgtggtgatattcacgggcagtttcacgatcttgcagaactgttcagaattggtggaaagtgtccagatacaaattacttgtttatgggagattatgtagatcgtggctactattctgtcgaaactgtcacgctgttggtgtctttgaaagtccgttatcctcagcgaatcaccattcttagaggaaaccatgaaagccgacagatcacacaagtttatggattctacgacgaatgcttaaggaagtacggaaatgcaactgtctggaaaacctttacggatctgtttgactacttccccttgacagcattggttgagtcagaaatattttgcttgcatggtggattatcaccatccattgagacacttgataacatacgtaactttgaccgcacccaagaagttcctcatgaagggcccatgtgtgatcttctgtggtctgaccctgatgatcgatgcggttggggaatttcccctcgaggcgctggatataccttcggacaggatatatcagagcagttcaaccataccaataacttgagacttattgctagagctcaccagttggtgatggagggattcaactgggctcatgagcaaaaagtggttaccatatttagcgcacctaattattgctaccgctgcgggaatatggcgtcaatcttggaagttgatgattgcagggagcatactttcatccagtttgagccggccccaagaaggggagaaccagacgtaacccgtagaacgccagactatttcctgtgatgatgcgaaatcggtgtcgacccctgcaccaaaggtttgataactagctgaagcttgctggccgcagataaatcctttttgctgaaagtcagtctcccgtgtgctattcttcttaatttttccgcccatgatgcccctggctgtttgtgagccgcttcgccgcatcgtgatgatcaaagtgtataccttacctacctacagctggaaggatccattgtgttactcacctctctaattgatttggtgctctgcttggtggacgcgtggttagtgaacgaacttgagagcatcaaaagcagcgtttgtattgtgaaaggaagcctttttcatttcccccctctgtattcatttttttccccatgttcgcgcgtttcgcctaatttttactttcttttgatgattatttgttgtagagatggacaatgtagttgtgtatggttccgtgttgggagcccttgctaggtcttgtgaaccagtattgattttccgtatagaagaatacttgtagtatgctgagcagtgtacttgtggtgttacctgtgtttggtcctgctagtggattattttttgtttatggatgatgcaaagatgtggtattaccca

SEQ ID NO: 3590 - DNA, 1438 bp, Secale cereale
tggcggcctcgacgaccagatcgagcgcctcatgcagtgcaagcccctccccgaggccgaggttagagcactctgcgagaaggccaaggagattttgatggaggagagcaatgttcagcctgtaaggagtcctgttacaatctgtggtgatattcacgggcagtttcacgatcttgcagaactgttcagaattggtggaaagtgtccggatacaaattacttgtttatgggagattatgtagatcgtggctactattctgtcgaaactgtcacgctgttggtgtctttgaaagtccgttatcctcagcgaatcaccattcttagaggaaaccatgaaagccgacagatcacacaagtttatggattctacgacgaatgcttaaggaagtacggaaatgcaactgtctggaaaacctttacggatttgtttgactacttccccttgacagcattggttgagtcagaaatattttgcttgcatggtggattatcaccatccattgagacacttgataacatacgtaactttgaccgcacccaagaagttcctcatgaagggcccatgtgtgatcttctgtggtctgaccctgatgatcgatgcggttggggaatttcccctcgaggcgctggatatacctttgggcaggatatatcagagcagttcaaccataccaataacttgagacttattgctagagctcaccagttggtgatggagggattcaactgggctcatgagcaaaaagtggttaccatatttagtgcacctaattattgctaccgctgtgggaatatggcgtcaatcttggaagttgatgattgcagggagcatactttcatccagtttgagccggccccaagaaggggagaaccagacgtaactcgtagaacgccagactacttcctgtgatgatgcgaaaccggtgtcgacccctgcaccaatggtctgataactagctgaagtttcctggctgcagataaatccttttgctgaaaatcatcaacctcctgtgtgttattcttctaaatttttccacccatgatgcccctggctgtttgcgagccgcttcgccgcatcgtgaccaaagtgtatacctacagctggaaggaaggatccattgtgttactcacctctctaattgatttgatgctctgcttggtggatgtgtggttagtgaacgaactcgagagcatcaaaagcagcgtttgtattgtgaaaggaagccttttatcatttcccccctctgtattcattttttcccctcatgttcgcgcgtttcgcctaatttttactttcttttgatgattatttgttgtagagatggacaatgtagttgtgtatggttccgtgttgggagcccttgttaggtcttgtgaaccggtattgattttccgtatagaagaatacttgtagtatgctgagcagtgtacttatggt

SEQ ID NO: 3591 - DNA, 1629 bp, Solanum phureja
tttccatcaccaccactcactctctcctctctctctccccctccccctctctctatcagtggagctgagaaacgatgtcgtagaacaggaaaaccaaatcaaacccacccccatgtctctattcctctttgtgtagatgtgtaaacaaggaatctaagattcttatgctgtaattgtggtaaaaatccaatcttttttgcatttctgtgattgttgtgaagaaaagattcaaacccagaagagaaaaaatgagcttggatccagtggtgtcttcttctcaagggaatcttgatgagcagattgctcagcttatgcagtgcaagcccttatctgaacaagaggtaaaaggattatgtcagaaagcaaaggagatattaatggatgaaagcaacgtgcagcctgtgaaaagccctgtgactatatgtggtgatattcacggccaattccatgatcttgctgagctttttcgtattggtgggaagtgtcctgacactaactatctatttatgggagattatgtagatcgtggatactattctgtggaaacagtaacgcttttggtggctctcaaagtgcgttatcctcaacggattacaattttgaggggaaatcatgagagtcgtcagattactcaggtttatgggttttatgatgaatgtttacgaaaatatggtaatgccaatgtgtggaaaactttcacagatctgtttgactactttcctctcacagctttggttgaatccgaaattttttgcctccatggtggtttgtctccatctgttgaaactcttgataatattcgtaattttgaccgcgtccaagaagtcccacatgagggggccatgtgtgatcttttgtggtccgatcctgatgatcgttgcgggtggggtatttcacccagaggtgctggatatacattcggacaagatatatctgagcagtttaatcacaccaacggcttaaaactaattgcgagagcacaccagctggttatggagggattcaattgggctcatgatcaaaaagtggttaccatatttagtgcccctaattattgctaccgctgtgggaatatggcatccatcttggaagttgacgattgcaatggccatacattcattcagtttgaaccagctcctaggagaggggagccagatgtaacgcgaagaacaccagattacttcttatgatcagagctgcacaaacttggtgattttatcgcatcagttctcgataaattggtctatatgctatgaccatctgtgaaatcctatagttattacagctatagtattgcgacactgcaaattgcacaaggcatgtaaatcgggcaggtgatgcattctgtcttacaaacagttctcctgaaacttaacgaaaatgcagcaaagagacaacgaaaactggtgaaggagtcactatgcatgtatcatttcctacaaacaatgatttaacctttctctttttcatcttatagtaatttttttgttaccatcatttcgttccccgattaatttgtcaccctgtagaaggtcgataactctcgtgtgagctctgtagagacaagacattatttttaccttgtaatggggtgcttgagtaatttataatctttcaccttgctcagtt

SEQ ID NO: 3592 - DNA, 1606 bp, Solanum phureja
tcaaagaaaatgaattaaaaattcgtttttttttacatagtcgataaagagtagatcgacaaatttcgagggctttctcttgcattttctcttcttcttcttgttcttctttcccagaagaacaaaaatacataaaaagcaaagggcttttgtgggttggtggcaaaaaaatttcagaaatttattcaagattatatattgggaaaaaggaaaattgattcttgaagttgaaattttttagtttgaagattagttgtacgaaatgagttcagatctgatagctaacacacatggtaacctggatgagcagatttctcagcttatgcagtgcaagcctctatctgagcctgaggttagagcattatgtgagaaggctaaggagatactaatggaagaaagtaatgttcagccagtaaaaagccctgtgactatatgtggtgatattcatgggcagttccatgatcttgctgaactttttaggattggtggacagtgtccagatacaaattatctgtttatgggtgattacgttgaccgtggatattattcagttgaaacagttactctattggtagctctgaaagtgcgttatcctcaacgactaacaattcttagaggaaatcatgaaagccgacagatcacacaagtctatgggttctacgatgaatgcttgcggaagtatggcaatgctaatgtttggaaaacatttactgatctatttgattattttcctttgacggcattggttgaatccgaaattttttgtttgcatggaggactgtctccatctattgaaacccttgataatgtacgaagtttcgaccgtgtccaagaagttcctcatgaaggggccatgtgtgatcttttgtggtcagacccagatgatcgttgtggttggggtatgtcaccccggggtgctggatacacttttgggcaggacatatctgagcaatttcaccataccaataatctaaagctgattgctcgagctcatcagctggttatggagggatataactggagccatgaacaaaaagttgtcactatttttagtgcaccaaattattgttatcgatgtggaaacatggcctctattttggaagttgatgactgcagagggcacacatttatccagtttgatccagctccaagaaggggagaaccggatgtaacacgaagaacccctgattacttcttataaatgtgatggagagcaatatctatggtctgccaagtgctgttttttgcgataacttccatctattgtcgagatgtgagtgcatttatggcaaagctaataggctgctcccgggaggtaatccgaggataaagaggcttgaccaggtccccccccttggttaaagtcatattctaacctatgttaggaatattagagtggagaagtgcagccagcaatgctgttatgtatgatttcatgaagacttgttttctgttgttcctttccaagctctgattttcagtcttagtgtgataattttgtcatatgttggttgcaaggaagtctgttgtgtaaagttaagaatcatctactttacattgtaacttttaccttgttaatgcagctcatcctttctttctgaaattt

SEQ ID NO: 3593 - DNA, 1620 bp, Glycine max
aacaaaacgaagcctccaaaacgctttggtttcttcaccaccaccacccctctcctctttctctctctttctaaaaaccagaaacaacaaacacaaaccgaaaaggcgaaaggggttttccgagtgagatctagggtttccatcgattcggagagaggatattgatagaacgacctcaacgagcaaggtcaggaggtggagtactagaacatggattcggtgccttcgaattcgcatggaaacctcgatgagcagatttctcagctcatgcagtgcaaacccttgtccgagcaagaggtaagggtcttgtgtgataaggcaaaagaaattttgatggaagagagcaatgtccagcctgtgaaaagtcctgttacaatttgtggtgatattcatgggcaattccatgatcttgcagagctttttcgcattggagggaagtgtccagatacaaattacttgtttatgggagattatgttgatcgtggctattattctgttgaaactgttacgcttttggttgcccttaaagtgcgttatcgtcagcgtatcactattctgaggggaaatcatgaaagtcgccagattactcaagtttatgggttttatgatgagtgcctgcggaagtatggtagtgctaatgtttggaagatctttactgatttgtttgactactttccgttgacagcattggttgaatctgaaatattttgtcttcatggtgggttgtcaccatctattgaaaccctggataacatacgtaattttgatcgcgtacaagaagttcctcacgagggacccatgtgtgatcttctatggtctgatccagatgatcgttgtggttggggcatctctcctagaggtgctggatatacctttggccaggacatatctgagcaatttaaccataccaataacttgaagctgattgctagagctcaccagctggttatggaaggatataactggggacatgatcaaaaggtggttactatatttagtgctcctaactattgttatcgttgtgggaacatggcatcaattcttgaggttgacgactgcaaaggacacacattcattcagtttgagccagctccaaggaggggagagccagatgtaaccaggagaacacctgattacttcctatgatactattttggttgagttgctgttaccagcacagcaactaatgccctgcagtaatgtgcaagctcatctccttgtccaaatcagagccatgaatcatattgatacttatattttcgaagttaggcttcggtggatgtgttgtttacttgaattataactgaatctttccaagtggaagctgagcagcaggcgatgctattgtgggcatgtgtatcattccagcttgcaatgtatcagttttaatgttttttccccttttttttccttttctatttatttgcaactctcttgacttttcttttctcaacttaggattattgttaagggggtgggtttctgtagattgataatgctttgaacatatcttttaatttatgattttttactcgtcttgtgagaattatattctaatataggtagtcttgtttttacatgaaatgactttcaatttttccaattatattcgtactctgc

SEQ ID NO: 3594 - DNA, 2640 bp, Glycine max
tttcaattttgcccccgaaaaagaagtggttatcgaacaaaatgagcatagcgaagcctcctaaacgctttggtttcttcaccaccaccacccttctttctctctctctctttctaaaaaccagaaacaacaaacacaaaccgaaaaggcgaaaggggttttccgagtgagatctagggtttccatcgattcggagagaggatattgatcgaacgacctcagcgagcaaggacaggaggtggagtactagatcatggattcggtgccttcgaattcgcatggaaacctcgatgagcagatttctcagctcatgcagtgcaaacccttgtccgagcaagaggtaagggtcttgtgtgataaggcaaaagagattttgatggaagagagcaatgtacagcctgtgaaaagtcctgttacaatttgtggtgatattcatgggcaattccatgatcttgcagagctttttcgcattggagggaagtgtccagatacaaattacttgtttatgggagattatgttgatcgtggctattattctgtcgaaactgttacgcttttggttgcccttaaagtgcgttatcgtcagcgtattactattctgaggggaaatcatgaaagtcgccagattactcaagtttatgggttttatgatgagtgcctgcggaagtatggtagtgctaatgtttggaagatctttaccgatttgtttgactactttccgttgacagcattggttgaatctgaaatattttgtcttcatggtgggttgtcgccatctattgaaaccctggataacatacgtaattttgatcgcgtacaagaagttcctcatgagggacccatgtgtgatcttctatggtctgatccagatgatcgttgtggttggggcatctctcctagaggtgctggatatacctttggccaggacatatctgagcaatttaaccataccaataacttgaagctgattgctagagctcaccagctggttatggaaggatataactggggacatgatcaaaaggtggttactatatttagtgcacctaactattgttatcgttgtgggaatatggcatcaattcttgaggttgatgactgcaaaggacacacattcattcagtttgagccagctccaaggaggggagagccagatgtaaccaggagaacgcctgattacttcctatgatactattttggttgagttgctgttaccagcacagcaaccaatgccatgcagtaatgtgcaagctcatctacttgtccaaatcagagccatgaatcatattgatacttatatttttgaagttaggcttcgctggatgtgttatttagttgaattataactgaatctttccaagaggaagctgagcagcaggcgatgcaattgtgggcatgtgtatcattccagcttgcaatgtatcaatttaatgttttttccccattttttccttttctattttttgcaactctcttgacctttcttttctcaatttaggattattgttaagggggtgggtttctgtagatggataatgcttttaacatatcttttaatggtgttttatgattttttacccgtcttgtgagaattatattctaataggtagtcttgtttttacatgaaatgtcgtttcattttccaattatttagagtgtgatggaggcatctgtgatgagtttaaggtaatatgattgataaggatgttctttctccgctaaccttagtgaaaattaaatgagtttttctaactacttaatgacttgataaattttatatttaagttaatatgatctgttcttaattaactaaatgccgccattatcgtattttggcagatatttcatattttctactcagtcaatgaataataatttgggccttgcaatttgtaactgttcaatttcagtatggatctcagatgtatgttgctgtgattttgcagatatatcatacttcctactcggtcaataaataattatttgctgtcctctgcaacattttattgactttttttggtacactgggaaaagttttttattcactgttcaatttcagaatggatttctcattggttgcaagtctattttcagaaactgttggagaatgaggttgagatgggtggacgcactgttattgaatgatgaaattgaatccagacactggtcatgtgggagatctagaataagctagagattacatcagatgttcgtcaagttgtcagaatcgttgtctcgtatcgcatagcacacatgcaaatcctaagcagctaactatacgatctttactgttcatgagatgattcattaattggtttgagagaatgtaatgggtaatactcaatgctcatcccattttttgggtggatgtgtgtagtaagaaaagtgagagaagaaaaacgaaaagtggagaaaaaataataaatggtgtgaaaataataaatgtaataaatccattttgggatagaattgtgatcagagatagagataggaagaaaagagatggaaagtgagtatatatttatgataattccgttgtttccttcatttaagctcccataaatataatgctgaaacaggattgatcgtccactaaagcagaagacagatctttagtagtccttggtgagctcacttggg

SEQ ID NO: 3595 - DNA, 1399 bp, Thalictrum flavum
tcggaaaaccattataaattatagggttttatcaattcatttaaatcgaatcgagaaggcgagaaagaagaagatgagtgtagatccagtgtccacgcattctcatggacatatcgatgagcagatttcgcagctaatgcagtgcaaacccttatcagaacaagaggtgaggacactgtgtgagaaggctaaggagatattgatggaagagagcaatgttcagcctgtaaaaagtcctgtgacgatttgcggtgatattcatgggcagtttcatgaccttgctgagctttttcgcattggaggaaagtgtccagataccaattacttgttcatgggagattatgtggatcgtggttattattcagttgaaactgtcacgcttctggttgctctcaaagtacggtaccctcaacgaatcaccatcctcagaggaaatcatgaaagtcgtcagatcacacaagtgtatggtttttatgacgaatgtctgcgaaagtatggcaatgccaacgtttggaagatattcacagacctttttgattactttccactaacagccttggtagaatctgaaatattttgtctgcatggtggattgtctccttctatagagacccttgacaacatcaggaatttcgatcgtgtccaggaagttccacatgaagggcccatgtgtgatcttctatggtctgacccagatgaccgatgtggttggggtatttctccacgtggagctggatatacctttggccaagacatatctgagcaatttaatcatacaaacaacttaaagcttattgctagagctcatcaacttgtcatggagggatttaattggggacatgaacaaaaggtggtgactatattcagtgcacctaattattgttaccgctgtgggaatatggcatctatcttggaagttgatgactgtagagggcacacattcattcagtttgagcctgctccaaggagaggtgagccggacgtgacccgcagaacacctgattactttctatgatgggctgtccttcagttattcccgattccagcagccaacgtctgcattttggttgattgctattgttgtaaaatccctggcgagagctgttaaatcggttgaatatttattctgctatgctgtctttctggtggtggtggtggctggggccaaaagcatgataggtgggcggggagacccatggactaggcagtgcaaatgttgctgatcaatatgtatctttcagaaaagtctgtattttctccttttcatcattttgtcttttacattttttttcttttggtatgtagtgggaaggaggggacttactgttaatgggtgcctttcatagtttttatttatttattggaactttaattggtcggaatagctgttgcctgttag

SEQ ID NO: 3596 - DNA, 1477 bp, Eutrema halophilum
gagagacagagagaaagagagagagagagctagaaagtggaaagaagcgaagaatacgcagatcccatccaatttagggtttgggcttcccctaatttggaaaactagtcctggtccctgatctgtttcctggatcggacgagagaaaagaggacgaaaaacaaagtaacgagaatgggcgcgaattctataccgacggacgcaaccattgatcttgatgagcagatctcgcagctcatgcagtgcaagcccctctccgagcaacaggttaaagcattatgcgagaaagccaaggagatcttaatggatgaaagcaacgttcagcctgtgaaaagccctgtgacaatctgcggtgatattcatggacagttccatgatcttgcagagcttttccgtatcgggggaatgtgccctgataccaattacctgtttatgggagattacgttgaccgtggttattattctgttgaaactgttacgctgttagtcgccttaaagatgcggtatcctcagcgaatcaccattcttagaggaaaccatgaaagtcgtcagatcactcaggtttatggattttatgatgaatgtctgcgaaaatatggcaacgcaaatgtttggaaaatcttcacagacctcttcgactatttcccactgacagccttggttgagtcagaaatattttgccttcatggtggattgtctccatctatcgagacccttgacaacataaggaattttgatcgagttcaagaagtgcctcatgaagggccgatgtgtgacttattatggtctgaccctgatgaccgttgtggttggggcatctctccacgtggtgcgggatatacatttggtcaggatatatccgaacagttcaaccactcaaacaacttaaagctgatcgcccgagcccatcagctggttatggatggatacaattgggctcatgagcaaaaggtggtaactatcttcagtgcaccaaactattgttatcgttgtgggaacatggcttcgattcttgaggttgatgactgcaggaaccacaccttcattcagtttgaaccagcaccgaggagaggagaaccagatgttactcgaagaacaccagactatttcctgtgatcactaagacaaaaaagtcatctcaccagctgcagccacaactgatagttcacagttggtaaatcttgtgttgaggttgctgtgttttaagttccaatttagtcccaccaccggaatatagtgtgtattataggcgaagaacctctcttatcttcctctataacccagaaaaaattaaaaaaaaaaagagaggtcaatacccattatgcacattgtttggtttatgttatcagcgtctcttttttcttccttcatcagaatgtgtttccatgtgagagatatttttagttttctttcttgtaatcctctcagaagtcactattttagtttacaaatccagtgaagctttttgattggaact

SEQ ID NO: 3597 - DNA, 1508 bp, Nicotiana tabacum
ccaccaccactcgctcactcctctctctctctctctgtagagctgagagaaaatcaaatcaaatcaaacccccgtttgatttcatccctcttttccgctagggtttctgcacaaagttccctccagaagcagttgaaaagaagatcaatcagcaatggatccggtgccatcgagcgcatctcatggaaatctcgacgaacaaattgctcagcttatgcagtgcaaacccttgtccgaacaggaggtaagaggactatgtgagaaagcgaaggagattctaatggaagagagcaacgtgcagcctgtgaaaagtcctgtgacgatatgtggtgatattcatggtcagttccatgatcttgctgagctttttcgaattggtggaaagtgtcctgacactaattatttattcatgggagattatgtagatcgtggatactattctgttgaaacagtaacgcttttggtggctctcaaagtgcgctatccccagcgaattacaatcctaaggggtaatcatgagagtcgccagattactcaggtttatgggttttatgatgaatgcctacggaaatatggtaatgccaatgtgtggaagactttcacagatctgtttgactactttcctctgactgcttcggttgagtcacacattttctgcctccacggtggtttgtctccatctattgaaactcttgataatattcgcaattttgaccgtgtacaagaagttccacatgagggtgctatgtgtgatcttttatggtctgatcctgatgatcgttgtggttggggtatctcacctaggggtgctggatatacatttggccaagatatctctgagcagtttaaccacaccaacaacttgaagctaattgctagagcacaccagctggttatggagggattcaattgggcccacgatcaaaaggtggttaccatctttagtgcacctaattattgttaccgttgtggcaatatggcatccatcttggaagttgatgattccagggagcgcacattcattcagtttgaaccagctccaaggagaggggagccagatgtaacccgaagaacacctgattacttcttatgatgcgaatgcacaaacctattgatttttgtgcggtaggtcctgctgactgctttatatgctacgagccttttaccagtttgtagtttttttcccgctacggtggcgctactactatgaaatgaagcatgtaaatcaggcatgtgatactgaaacctcattgagatgctgtgaagagatggtgaagccagtgacagagggtgcatgtatcatttttccgcagacaatattttcactctttggtcatatattttttggttagatagaaaggacaatgatttgcttcgtgataattcttgtccctttacaaggacaattcctgtcgtataagcgttgtagaggtaagattatttttttaaacaccttttaatgagtgctcgtgtaattttctatgaggtcacgactctattttgatttc

SEQ ID NO: 3598 - DNA, 1664 bp, Solanum lycopersicum
atcataaatcatcatgtaaaaaaagaaagttcttttttccatttctttgtttccatcaccaccactcactctctctcccctctctctcagtggagctgagaaaacgatgtcgtagaataggaaaaccaaatcaaaccaaccccatgtttcattttcctctttgtgtagatgtgtaaacaaagaatctaagattcttatgctgtaattgtggtaaaaatccaatcttttttgcatttctgtgattgttgtgaagaaaagattcaaccccagaagagaaaaaatgagcttggatccagttgtgtcttcttctcaagggaatcttgatgagcagattgctcagcttatgcagtgcaagcccttatctgaacaagaggtaaaaggattatgtcagaaagcaaaggagatattaatggatgaaagcaacgtgcagcctgtgaaaagccctgtgactatatgtggtgatattcacggccaattccatgatcttgctgagctttttcgtattggtgggaagtgtcctgacactaactatctatttatgggagattatgtagatcgtggatactattctgtggaaacagtaacgcttttggtgtctctcaaagtgcggtatcctcaacggattacaattttgaggggaaaccatgagagtcgtcagattactcaggtttatgggttttatgatgaatgtttacgaaaatatggtaatgccaatgtgtggaagactttcacagatctgtttgactactttcctctcacagctttggttgaatccgaaattttttgcctccatggtggtttgtctccatctattgaaactcttgataatattcgtaattttgaccgcgtccaagaagttccacatgagggggctatgtgtgatcttttgtggtctgatcctgatgatcgttgcgggtggggtatttcacccagaggtgctggatatacatttggccaagatatatctgagcagtttaatcacaccaacggcttaaaactaattgcgagagcacaccagctggttatggagggattcaattgggcccatgatcaaaaagtggttaccatatttagtgcccctaattattgctaccgctgtgggaatatggcgtccatcttggaagttgacgattgcaatggccatacattcattcagtttgaaccagctcctaggcgaggagagccagatgtaacgcgaagaacaccagattacttcttatgatcaaagctgcacaaacttggtgattttatcgcatcagttcttgataaactggtctatatgctatgaccttctgtgaaatcctatagttattacagattgcgacattgcaagttgcacaaagcatgtaaatcgtgcaggtgattcattcttccttacatacagttctcctgagacttaacgaaaatgcagcaaagagactgcgaaaactggtgaaggagtcactatgcatgtatcatttcctacaaacaatgatttaacctttttctcttatccttcttatagtaatttttttgttaccatcatttcgttccccgattaatttgtcaccctatagaaggacgataactcttgtgtgaaactctgtagagacaagacattattttttaccttgtaatggggttctttcttgagtaattcatctttcaccttgctcagtttgcac

SEQ ID NO: 3599 - DNA, 1615 bp, Solanum lycopersicum
aaagaaaatgaattaaaaattcgttttttttttttacatagtcgataaagagtagatcgacaaatttcgagggctttctctttcattttcccttcttcttcttcttgcccagaagaaaaaaaatacaaaaacagaaagggcttttgtgagttggtggccaaaaaaattcagaaatttattcaagattacatattggggaaaaggaaaattgattcttgaagttgaaattttttagtttgaagattagttgtacgaaatgagttcagatctgatagctaacacacatggtaacctggatgagcagatttctcagcttatgcagtgcaagcctctatctgagcctgaggttagagcattatgtgagaaggctaaggagatcctaatggaagaaagtaatgttcagccagtaaaaagccctgtaactatatgtggtgatattcatgggcagttccatgatcttgctgaactttttaggattggtggacagtgtccagatacaaattatctgtttatgggtgattacgttgaccgtggatattattcggttgaaacagttacgctattggtagctctgaaagtgcgttatcctcaacgactaacaattcttagaggaaatcatgaaagccgacagatcacacaagtctatgggttctatgatgaatgcttgcggaagtatggcaatgctaatgtttggaaaacatttactgatctatttgattattttcctttgactgcattggttgaatccgaaattttttgtttgcatggaggactgtctccatctattgaaacccttgataatgtacgaagtttcgaccgtgtacaagaagttcctcatgaaggggccatgtgtgatcttttgtggtcagacccagatgatcgttgtggttggggtatgtcaccccggggtgctggatacacttttgggcaggacatatctgagcaatttcaccataccaataatctaaaactgattgctcgagctcatcagctggttatggagggatataactggagccatgaacaaaaagttgtcactatttttagtgcaccaaattattgttatagatgtggaaacatggcctctattttggaagttgatgactgcagagggcacacatttatccagtttgatccagctccaagaaggggagaaccggatgtaactcgaagaacccctgattacttcttataaatgtgatggagagcaatatgtgttgtctgccaagtgctgtttttcgcgataacttccatctagtgtcgagatgtgagttcaattatggcaaagcttaataggctgctcctgggggaggtaatcggaggataaagaggcttgaccaggtccccttggttaaagtctatcatattctaacctatgttaggaatattagagtggagaagtgcagccagcaatggtgttatgtatgattttatgaagacttgttttctgttgttcctttccatgctctgattttcagtcttagtgtgataatttttgtcatatgttggttgcaaggaagtctcttgtgtaaagttaagaatctactttacattgtaacttttaccttgttaatgcagctcatcctaaaattggtattttttttcaactcaacaa

SEQ ID NO: 3600 - DNA, 1490 bp, Trigonella foenum-graecum
tttgttttcttcaacaaacaagtagcaataatcgaaaacgcaaaaagggcttttctaacttagatctagggtttccctcgattccaaaactggatcattgatccaaccacacagcgttaggaggaggtggagaagttgaacatggattcgaattctcatggaaatctcgatgagcagatttctcagctcatgcagtgcaaacccttgtctgaacaagaggttagggtcttatgtgataaggcaaaggagattttgatggaagagagcaatgtccagcctgtaaaaagtcctgttacaatctgtggtgatattcatgggcaattccatgatcttgcagagcttttccgcattggagggaagtgtccagatacaaattacctgttcatgggagattatgttgatcgtggctattattctgtcgaaactgtaacgcttttggtcgcccttaaagtgcgttatcgtcagcgtatcactattttgaggggaaatcatgaaagtcgccagattactcaagtttatggattttatgacgagtgcctacggaagtatggtagtgctaatgtttggaagatgtttactgatttgtttgactacttcccattgacagcattggttgaatctgaaatattctgtcttcatggtgggttgtctccatccattgaaacccttgacaacattcgtaattttgatcgtgtgcaagaagttcctcatgagggtcccatgtgtgatcttctatggtctgatccggatgatcgctgtggttggggtatctctcctagaggtgctggatatacctttggccaggacatatcagagcagtttaaccataccaacaatttgaagctgattgctagagctcaccagctggttatggaaggatataactggggtcatgatcaaaaggtggttaccatattcagtgctcctaattattgttatcgctgtgggaacatggcatccatccttgaagttgatgattgcaaaggacatacattcattcagtttgagccagctccaaggaggggagagccagatgtaaccagaagaacccctgactacttcctatgatacaacttaggtggagttgcttttgccaacttgtgcagtaatgtgcaagctcataccagttgaaatcagagctgtgaatcaaattgatccttattttcaaagttaggcttcactggacgtgttatttacttgaattataaattgaatctttccaagagagaagctgtggagcaggtgatgcatgtttaccattccagcatgcagtgtatcaatttgaatgtttctccaaattttccttttctatttatttgcaactatgtttacctttattttattattattattattattattattattattattatattaggattatcgttaatggggatgggtttctgtagatggacaatgctttgacatcttctaatgggtgttttatgattatttttaaccggttttgtgtagtcttgttttcttgg

SEQ ID NO: 3601 - DNA, 1595 bp, Tripterygium wilfordii
agatttccactttctccctctagagattcagagaaatctagggtttgccttttcgtttctgttgtggggattagtggtgtcctggagtgtaggttgagggttacggaattcgaagggatctcgatctgttgtttgagtatctgcggaagatgagtttggattccaactctcatggaaacctggacgagcagatttcgcagctcatgcagtgcaagcccctctcggagcatgaggttagggtgttgtgtgacaaggccaaggagattttaatggacgaaagcaatgttcagccggtgaaaagccctgttacaatttgtggagatattcacgggcaatttcatgatcttgctgagctttttcgcattggagggaagtgcccagatacaaactatttgttcatgggagactatgttgatcgtggttactactctgttgaaactgtagcactgttggtagcattgaaagtgcgctatcctcaacgaattactattctgagaggaaatcatgaaagtcgtcagattactcaagtatatgggttttatgatgaatgccttaggaagtatggcagtgccaacgtgtggaagatcttcactgatctctttgactattttccactaacagcattggttgaatcagaaatattttgtctccatggtggattgtccccttccattgaaacgcttgataacatacgtaattttgaccgtgtgcaagaagtacctcatgaaggtccaatgtgtgaccttctttggtccgacccagatgatcgttgtggctggggtatctcacctagaggtgccggatatacttttggccaggatatatctgaacaatttaatcacacaaataacttaaagctgattgcgagggctcaccaattggttatggaaggatacaactggggccatgaacaaaaggtggtaactatattcagtgcgcctaactactgttatcgatgtggaaacatggcatctatccttgaagttgatgactgcaagggacatacatttatccagtttgagcctgctcctaggaggggagagccagatgtgacccggagaactcctgattacttcctatgatgaaattgtcatcggtgttaccgtattcatggcagccggtatccactggctgttttacttgttgacaggtattctaatctaagactacgttctggtagtggttgggcagcaaaatacatgtaagatgggcaggtgaggcttcgttgatttgattgtttatttaaattggttgagttttccacaaagggggaaagcagcggagctggtcatgccgtagcatcgtatgtacaattttcagcgaacaatatggtatctttaattcctttgttgtttcttgtcctctttttttgttcttctagggtggctgttgggccatggaatttgtagagcgaagaccaacttttcttgtaatgggtgataggtgcttctgttacgtttcaactcttcttgacttctgagtcttgatggttttcctgggagagttcgtttcagatatgaatatttgatgtggaactataggcttatttctatatgatagtagaaaagcttttcttgctcctatcagtcatttac

SEQ ID NO: 3602 - DNA, 1331 bp, Tripterygium wilfordii
gaacaagtggactagttactctcaaaaaatacatcggtttctccaccactgttcctctttctctgtttctttaactccatatatctctagattttcactctctctagagattcagagaaatcttgggcttgcttttttacgtatcttggggattagtggtcgtggagtgtaggtttaggattacggaatttgaagggatctcgatctgttgttggagtattagcggaagatgagtttggattcggtcccatctaactctcatggaaacctggacgagcagatttcgcagctcatgcagtgcaagcccctctcggagcatgaggttagggtgttgtgtgacaaggccaaggagattttaatggacgaaagcaatgttcagccggtgaaaagccctgttacaatttgtggagatattcacgggcaatttcatgatcttgctgagctttttcgcattggagggaagtgcccagatacaaactatttgttcatgggagactatgttgatcgtggttactactctgttgaaactgtagcactgttggtagcattgaaagtgcgttatcctcaacgaattactattctgagaggaaatcatgaaagtcgtcagattactcaagtatatgggttttatgatgaatgcctgaggaagtatggcaatgccaatgtgtggaagatcttcaccgatctctttgactattttccactaacagcattggttgaatcagaaatattttgtctccacggtggattgtccccttccattgaaacccttgataacatacgtaattttgaccgcgtgcaagaagtacctcatgaaggtccaatgtgtgaccttctttggtctgacccagatgatcgttgtggctggggtatctcacctagaggtgccggatatacttttggccaggatatatctgaacaatttaatcacgcaaataacttaaagctgattgcgagggctcaccaattggtcatggaaggatacaactggggtcatgaacaaaaggtggtaactatattcagtgcgcctaactactgttatcgatgtggaaacatggcctctatccttgaagttgatgactgcaaggggcacacatttatccagtttgagccggctcctaggaggggagagccagatgtgacccggaggactcctgactacttcctatgaggaaatcgacctcagtgttactcatcgacaggtattttaaatctaaagactacattctggtagtggttgggcaacaagatacatgtaagatgggcaggtgaggcttcgttgttttgattgtttatttgaattggttgagttttccacaaaggggaagcag

SEQ ID NO: 3603 - DNA, 1686 bp, Triticum aestivum
ctccccacctctcgttccctccccctccccctcccctccccacgcgcgcgcgccggcgagatctgcccagggtggacccccggcgaggatgagcagcccccatggcggcctcgacgaccagatcgagcgcctcatgcagtgcaagcccctccccgaggccgaggttagagcactgtgcgagaaggccaaggagattttgatggaggagagcaatgttcagcctgtaaggagtcctgttacaatctgtggtgatattcacgggcagtttcacgatcttgcggaactgttccgaattggtggaaagtgtccggatacaaattacttgtttatgggagattatgtagatcgtggctactattctgtcgaaactgtcacgctgttggtgtccttgaaagttcgttatcctcagcgaatcaccattcttagaggaaaccatgaaagccgacagatcactcaagtttatggattctatgacgagtgcttaaggaagtatggaaatgcaactgtgtggaaaacctttacggatctgtttgactacttccccttgacagcattggttgagtcagaaatattttgcttgcatggtggattatcaccatccattgagacacttgataacatacgtaactttgaccgcacccaagaagttcctcatgaagggcccatgtgtgatcttctgtggtctgatcccgatgatcgatgcggttggggtatttctcctcgaggcgctggatataccttcggacaggatatatcagagcagttcaatcataccaataacttaagacttattgctagagctcaccagttggtgatggagggattcaactgggctcatgagcaaaaagtggtcaccatatttagtgcacctaattattgctaccgctgtggaaacatggcatcaatcttggaagttgatgattgccgggagcatactttcatccagtttgagccggccccgagaaggggagaaccagacgtaactcgtagaacgccagactacttcctgtgatgatgtgaaatcggtgccgacctctgcaccaaaggtttgataactagctgaagtttgttggccgcagacaaatctttttgctgaaagtcagtctcccgtgtgctattcttgttaattttttcgcccatgatgccccctggctgcttgcgagccgcttcgccgcatcgtgaccaaagtgtatacctacctacagctggaaggaaaggatcaattgtgttactcacctctctaattgatttgatgctctgcttggtggatgctgtggtagtgaacgaacttgagcatcaagcagggtttgtattgtgaaaggaagcctttttcatttcgttcccccctctgtattcattttttccccatgttcgcacgcttcgcctaatttttattttcttttgatgattatttgttgtagagatgaacactgtagttgtatgatcccgtgctgagagcccttgttaggtcttgtgaacccgtattgactttccgtatagaatacctgtacttgtagtatgctgagcagtgtacttatggtgtgtcctaccttgtggcatgaatgtttggtcctgctagtggatatatttcttgtttacgaatgatgcaaagatgcggtattatccacaagaagagcgtacattatcattacccttgttatgctcccaaatatttttcacttaaga

SEQ ID NO: 3604 - DNA, 1598 bp, Papaver somniferum
tagaagaggagaattgttgtctcgttttaccaccaattcatcgctctctgtcttacttcccactcattaattttagggttagggtttctaatatacctttcgattgtatcgctgaaaagtaattttattttatttttggaagaagatgagtgtggatccggtttcaaccaacactcatggcaacatcgatgagcagatttcacagcttatgcagtgcaagcccttacccgaacaagaggtcaggacattgtgcgagaaggctaaagagatattaatggaagaaagcaatgtacagcctgttaaaagtcctgtgacgatatgcggggacatccatgggcaatttcatgatcttgcagaactttttcgcattggaggacagtgtccagataccaattatttgtttatgggagactatgtggaccgtggttattattcagtggaaacggtaactctgctggtcgcctgaaagtgcgatatccacaacgaattacttattcttagaggaatacatgaaagtcgtcagataacacaagtctatgggttctacgatgaatgtttgcgaaagtacggcaatgcgaatgtgtggaagacttttacggacctatttgactattttccattgacagccttggtggaatcagaaatattttgtttgcatggtggactgtcaccgtctattgagacccttgataacatacgcaattttgaccgtgtacaagaagttcctcatgaagggcccatgtgtgatctcctgtggtctgatcctgatgatcgctgtggctgggggatttctccccgtggtgctggttacacatttggtcaggacatatctgagcaatttaatcatacgaacaacctaaagctgattgctagagctcatcaactagtaatggagggtttcaactggggacatgaacaaaaggtggttaccatatttagtgctcctaattattgctatcgttgtggaaacatggcatcaatcttggaagttgatgattgcaggggccacacttttatccaatttgagcccgctccaaggagaggggagccagatgtgacacggagaacgcctgattacttcttataacgtgacttttcattttcgtacgagttgttgccaattttcaagcggcaattgctgggttggtggatgacaacgatgggatggttgcgatctgtttcctagcagatgttttatcggatgtaagattcatcatgtcaacctgctgtgtttagtaggctgttggtagtgatctttgcaggttacaaaagaagaagaaaagcttttgaaatgagccagtgaatactaccaaaatttggatagttttttagtcctagtgctagattccctttaaaaaggaggcagtagtgctggctacgctgcaggagagcttgtaactcatccagctagacatttttttgtttttgcatctggttctctcattttctcttttgttcttttcatttgtagagtggagcagacaatagtattttcaaagagtgcctttccatcatttcctatacttttggctgttttgttgttccacaagtttctgtaaaacgcaacagaccaaactataatttctataatatttttt

SEQ ID NO: 3605 - DNA, 1079 bp, Vinca minor
atggaaatctagatgagcagatttctcagctcatgcagtgtaaacctttgtccgagaccgaggttagaacattatgcgagaaggccaaggagatactgatggaggaaagcaatgtccagccagtaagaagcccagtgacgatttgtggtgatattcatgggcaatttcatgatttggctgaactttttcgcataggagggaagtgcccagatacaaactaccttttatgggagattatgtggatcgtggatactattcagtggaaactgtaactctattagtggccctgaaggtgcgctactcccaacgaatcaccatccttcgaggaaatcatgagagtcgccagattacccaggtttacgggttttatgatgagtgtctgcgcaaatatggcaatgctaatgtttggaagacattcacagatctttttgattattttccactgacagcattggttgaatccgaaatcttctgcttgcatggtggattatcaccatctattgaaacacttgataacataagaaattttgatcgtgttcaagaagttccacatgaaggtcctatgtgtgatctcttgtggtctgatccagatgatcgctgtggttggggtatttctcctcgtggtgctggctacacatttggccaggatatatctgagcaattcaatcacaccaacaacttaaagctgattgctagagctcatcagctggtcatggagggctataattggagccatgaacaaaaagtcgttactatattcagtgcaccaaattattgctatcgttgtggaaacatggcatctatcttggaagtcgatgactgcaggcaacacacgttcatccagtttgagccagctccaaggaggggagagcctgacgtgacccggagaacgcctgattatttcctgtaaagcgttcgaggttgctgattagatgattttgcgtcatctgttattggaattgaagcttcttcacaagaagttactaggattctcgtctagtcgtgtgtggcagggaccaggaggtctgtaaaatattagcccattggatgtccaattttaaggggttacgcaatcctag

SEQ ID NO: 3606 - DNA, 1639 bp, Amsonia hubrichtii
cccccccctctctctcattggtttcaccgccaccactcactcgcttctcccactcttcctcctctcttcccccaaatccacctgtcaaacgacgtcggaaaggaagaaccaagaacgacgacgaagaagaacccaactagggttccagattatttagtgtcttaaattttacatttattcgtacagtgattcaagaaagattaaaagaaaatgagctcggatccggcggtggcgtcgagcggcggtgctcatcatggaaacctcgatgagcagatttctcagcttatgcagtgcaaaccgctgtccgaacaagaggtcagaggactttgtgagaaggcaaaggagatcttaatggaagagagcaatgttcaacctgtgaaaagccctgtgaccatttgtggtgatattcacggacaattccatgatcttgcagaactctttagaattggtggcaagtgcccagatacaaattatttgttcatgggagattatgttgatcggggatattattcagttgaaaccgtaacacttcttgtggccctcaaagtgcggtactcccaacgaattactattctgagaggaaaccatgagagtcgccagattactcaagtatacgggttctatgatgaatgcctaaggaagtatggtaatgcgaatgtgtggaagattttcaccgacttatttgactactttccactgacagcattggttgaatctgaaatattttgcctccatggtgggttgtctccttcagttgaaactttggacaacattcggaactttgaccgtgtgcaagaagttccccatgagggacccatgtgtgatctcttgtggtctgatcctgatgatcgttgtggttggggcatatcacccaggggtgctggatatacatttggccaagacatttcggagcagtttaaccatacgaacaacttaaagcttatagctagagcacaccaactggttatggagggatttaattgggctcatgatcagaaggttgtcaccatatttagtgcacctaattattgctatcgctgtggaaacatggcatccattcttgaagtagatgattgcaaaggacacacattcattcagtttgaaccagctcctcgaagaggagaaccagatgtaactcgaagaacaccagattactttctatgatgcagctgcataagggttgctgacttctgtagagcaggtctcatttagctgctttgtgtattgacgtctgtttgaaattggcgactatatatttcctgcatggactaggaatggcagaagcatgtaggacaggcagatagatgcacgatgcttcttttttacctatcatcctgaaactgtatggagatgctgcaaaggcgactttggatctgggacgctgcttgctgcatatgtatcatttcctggaattgatgcagcaccatctttctcccttctctcccaagtattcctgaaaagagtccttttgcgtacttatattttagttattttgtaggacagtttctttgagttctttcctcgatatcatgtttccctaactggtaggactatgctcccttggagcgggtttttgtgtagagggagaatatttattattgttttctttatcctttccaagggatacgttattatttta

SEQ ID NO: 3607 - DNA, 1526 bp, Vinca minor
ccaccgcatcaaacgacgtcgcaaggtggtgaaacgataacggcgacgaagaaagaagaagaacccaactagggttcccaatttattactctcttgaattatcattttatccataagagtaattcaagaaatatgagctcggatcctgcggtggcgtcgagcggcggtgctcatcatggtaacctcgatgagcagatttctcagcttatgcagtgtaaacccttgtctgaaccagaggttagaggactttgtgagaaggcaaaggagatcttaatggaagagagcaatgttcaacctgtgaaaagccctgtgaccatttgtggtgatattcacggacaattccatgatcttgctgaactatttagaattggtggcaagtgcccagatacaaattacttattcatgggagattatgttgaccggggatattactcagttgaaaccgtaacacttttagtggccctcaaagtgcggtaccatcaacggattactattctcagaggaaaccatgagagccgccagataactcaggtatatgggttttatgatgagtgcctaaggaagtatggtaatgcaaatgtgtggaagatttttactgatctatttgactacttcccactgacagcactggtggaatccgagatattctgtctccatggtgggttatctccctcaatcgaaactctagataacatacggaattttgatcgcgtgcaagaagttccccatgagggacccatgtgtgatctcttgtggtctgaccctgacgatcgttgtggttggggcatatcacccaggggagctggatatacatttggccaagacatctcagagcagtttaaccatacaaacaatttgaagctcattgctagagctcaccagctggttatggagggattcaattgggctcatgaccagaaggtcgtcaccatatttagtgcacctaattattgctatcgctgtgggaacatggcatccatactggaagtggatgattgcaacggacacacattcattcagtttgatccagctcctcgaagaggagaacccgatgtaactcgaagaacaccagattactttctgtgatgcagctgcacatgcattgttgctaacttctgtacgtagagcaggtctcgtttagctgtttgtgtattgacatttgttttggagatgggcgattatatatttcgtacaatctggaccccgcctgggactggcagaagcgcgtacaacatgcagattgaaactgtaaggaaatattgcaacggcgacattgacatttgaactgggatgctgctaactgcctatgcatcatctcccggaattcatccgaaatcttccctctccctttccctcttctaaaatattctgaaacaagtcgtttctgcagttatatttattttgatttagtaggacagtttattttgaggaaagtctatattgtgttcctgaacttgtaggaaaatgctccctaggggcttatttttgagtagagggaagagtatttgttattaaaaaaaaaaaaa

SEQ ID NO: 3608 - DNA, 1384 bp, Centaurea maculosa
tttcgagggttttcttctcctccgcgcccatcgtcatcatcaccaccaccatcttcactccctttgatctcaaatctctgaatgtttttcagataaattttcaatagatcaaaaggattttagcatctgaatccttttttgtttgtatgtgtatatatatgcacaaaactatccatatacatatacatatatagcaagatgagtggggagctagcttcgaacacccatgggaatctggacgagcagatttcacagctcatgcagtgcaaacccctaaccgaacccgaggttaggacattatgtgacaaggcgaaagagatattgatggatgaaagcaatgttcagccagtaaaaagtcctgtgactatctgtggtgacatccatggacaattccatgatcttgctgaactttttcgtattggaggaaagtgcccggatacaaattacttgtttatgggggattacgtggatcgagggtattattctgttgaaactgtcacgctcttggtggctctgaaagtacggtatcctcagcgaattacaattttaagaggaaatcatgaaagtcggcagattacccaagtctatggattttatgatgaatgtcttcggaagtatggcaatgctaacgtctggaagacttttacagatctgttcgattattttccattaactgcattggttgaatcggaaatattttgcctccatggtggattgtcaccttctatcgaaacccttgatagtataagaaactttgatcgtgtccaagaggttccacacgaaggtcccatgtgtgatcttctatggtctgaccctgatgaccgttgtggatgggggatctcaccccgtggagctggttacacctttggtcaactatttacaggatatctctgagcagtttaaccataccaacaacctcaagcttattgctcgagctcatcaattggtcatggaaggattcaattggggacatgatcaaaaggtcgtgaccatctttagtgcgccaaattattgttataggtgtgggaatatggcgtccatcttggaggtggatgattgcaagggccacacttttattcagtttgaacctgctccgaggagaggagaacctgatgtaacgagaaggacacccgactatttcctgtaaggttgagtagcgctgctaatgggatgatgacttgaagtttgttagttgatagaaggaaggtaagagaagtggttgggttgtattttggacatgtttttgatttgatgtgaaacgacgtatctaactctaggaaaggaaggaaggtaaggaaatggattatgttgttgagggtgtgtgtgtaatctatgattattttggtctcttaggttttgtgtgtgtgtatgtatatcgaccgat

SEQ ID NO: 3609 - DNA, 1297 bp, Ambrosia trifida
caaaacaacaataataataatctcaaaattacgagggtttcctttttctgtacctccatttccgtttctgcacccacatttggctcatcgaaacaatcgatctgttgattatatgtatataatctgaacaagatgagtacagatctagctaccaacacccatggaaaccttgacgaacagattgcacagctcatggagtgcaagcccttaaccgagcctgaggttaagacattatgtgagaaggcaaaagagatacttatgggcgaaagcaatgttcagcccgtaaaaagccctgtgacaatatgtggtgacattcatgggcagtttcatgatcttgctgaacttttcgtataggagggaagtgcccagataccaattacttgtttatgggggagttatgtggaccgaggatattattctgtcgaaactgtcacgctcttggtggctctgaaagtgaggtatcctcagcgaattacgattctaagaggcaatcatgaaagtcgtcagatcactcaagtctatgggttttatgatgaatgccttcgaaagtatggcaatgctaatgtttggaagacttttacagatctctttgactattttccattgactgcgttggttgagtcagaaatattttgccttcatggtgggttatcaccttcaattgaaactctggacagcataagaaactttgaccgtgtgcaagaggtcccacatgaaggtccaatgtgtgatcttttatggtccgacccagatgaccgttgcggctgggggatttcaccacgtggggctggatacacctttggccaggatatttctgagcaatttaatcataccaacaacctgaagcttattgctagagctcatcaactggtcatggagggattcaactggggtcatgagcaaaaagttgtcactatctttagcgcaccaaattattgctaccgatgtgggaacatggcttctatcttggaagttgatgattgcaagggccacacatttatccagtttgatccagctcctaggcgaggagaacctgatgtaacaagacgaacgcccgattattttctctgagtggtccagttaaagtggttcatggtcttttgtcaagattcgggcttttgatacaacggtatgggccaaaattcataaggtgaagtgcaagaaaagaaccaaatggtttgtaaaatgtatgattcatatgttgaagtaatgggcttttatgtatctgcaaagggtatgattcagatttcagaaggtgtttttgactagttttaatcaaaattaacatttctattaa

SEQ ID NO: 3610 - DNA, 1429 bp, Aquilegia formosa
accaccaccaccaccaccaccactgctctctctctctatatatatctcactcattcctaagattcattataattctagggttagggttttatcaattcattcaaatcgaatcaagaaagcaagaaacaagaattacggcaagaagaagaagatgagtgtagatccagtgtccacgcattctcatggacatattgatgagcagatttcgcagcttatgcagtgcaaacctttatcagaacaagaggtgaggacattgtgtgagaaggctaaggagatattgatggatgagagcaatgttcagcctgtgaaaagtcctgtgacgatttgcggtgatattcatgggcagtttcatgaccttgctgagctttttcgcattggaggaaagtgtccagataccaattacttgttcatgggagattatgtggatcgtggttattattcagttgaaaccgtcactcttctggtggctctcaaagtacggtatcctcaacgaattaccatcctcagaggaaatcatgaaagtcgtcagatcacacaagtgtatgggttttatgacgagtgtctgcgaaagtatggcaatgccaatgtttggaagatattcacagaccttttcgattactttccactaacagccttggtagaatctgaaatattttgtctgcatggtgggttgtccccttctatagagacccttgacaacatcaggaatttcgaccgtgtccaggaagttccacatgaagggcccatgtgtgatcttctatggtctgacccagatgaccgatgtggttggggtatttctccacgtggagctggttatacctttggccaagacatatctgagcaatttaaccataccaacaacttaaagcttattgctagagctcatcaacttgtcatggagggatttaattggggacatgaacaaaaggtggtgactatattcagtgcacctaattattgttatcgctgtgggaatatggcatctatcttggaagttgatgactgtagagggcacacattcattcagtttgagcctgctccaaggagaggtgagcctgacgtgacccgccgaacaccggattacttcctatgatgagctgtctttcagttattgctgattccaacagccaacgtccgctttttggttgactgctattgttgtaaaatccctggtgagagctgttaattgggttgaatatttattctgctatgctatctttctggtggtggtggtggctggggccaaaagcatgataggtgtgcgggcaaggcccatcaacttggcagtgcaaatgttgctgcaatcaacatgtatctttcagaaacatctgtattttcccattttgtctttacattttgttcttctttggtatgtagtagggaagggacttattgtttaatggatgcctttcatagtttttatttattt

SEQ ID NO: 3611 - DNA, 1507 bp, Theobroma cacao
gccagaaaggtagtgtagagagaaaaacgaaaaaagaaaatatttaaaacccaaaagaaaatttcccaatccaaactagggttagggttatccctaatccgtataacggttctcacgcttgattattccaactggtatatcaaagatgggcgctaatccctcaccaacagactcaaccaccgatctcgatgagcagatctcgcagctcatgcagtgtaagccgctttcggagcagcaggtcagagcattatgcgacaaggcaaaggaaatattaatggaagaaagcaatgtccagcctgtgaaaagccctgtgacaatttgtggtgatattcatgggcagtttcatgatcttgcagaactttttcgaattggagggaagtgtccggatacaaattacttgtttatgggagattatgtggatcgtgggtactattctgttgaaactgttacgctattggtggctttaaaagtccgttatccacagcggattaccattctcagaggaaatcatgaaagccgccagatcactcaggtttacgggttttatgatgaatgtctgcgaaagtatggcagtgctaatgtttggaagatctttacagacctttttgactattttccattaactgctttggtggagtcggaaatattttgtctgcatggaggactgtccccttcgattgaaactctggataacataagaaattttgatcgtgttcaagaggttcctcatgaagggcccatgtgtgatttattatggtctgacccagatgatagatgtggttggggtatctcaccgcgtggtgctggatatacttttggccaggatatatctgaacaattcaatcacacaaacagcttaaaattgattgctagagctcatcaactggttatggatggatttaactgggctcatgaacaaaaggtggttactatatttagtgctcctaattattgttatcgttgtggaaacatggcttctatcttggaagttgatgattgccagagtcacacattcatccagtttgagccggctccaaggagaggagagccagatgtcactcgtagaacgccagattacttcctctgaagcagctgtgtcataactgattcaagttactctacttttctacctctcctccatcatcttacatagtcaggtagttgccaatcctttgcagaagtctgttgcatctactacctgcgagttcttacatggcatgtttttttggtgatggtgggcaccaaaagcatgtatactaggctaggaaggtggcctttaatctatcatacacttggatattctgtcagagagattgcatagctgatgaaagactgacactatcagaatgtattaattatgtagttttttgtttttttttttgtgtttgttttgttttttggctcattctatatttttagcgtctgtactggagacggaaaagttcaaatatttagttggtgttttgacctttccctttaccaacccaaatgaggctaggctagttaa

SEQ ID NO: 3612 - DNA, 1354 bp, Daucus carota
aggggttggttcaaaatgcctgaagaagatacatacatataattaaatctatacatatatcgacaaatccaaaacacacactagcaaaagagatatacaacgagaggagatgaatgcggatctggcgtcgtcgaacgccaatctcgatgaacagatttcgcagcttatgcagtgcaagcctctctccgagcctcaggtgagggcattatgtgacaaggctaaagagatcttaatgaaagaaagcaatgttcagcctgttaaaagtcctgtgaccatatgtggggacattcatgggcagtttcatgatcttgctgagctttttcgcatcggaggaaagtgcccagatacaaattacctttttatgggagattatgtcgatcgtggatattattcagttgaaactgtcacgcttctagtggctctgaaagtgcgttatcatcaacgaatcacaattctgagagggaatcatgagagtcgacagatcacacaagtatacgggttctatgatgaatgtctgcggaagtatggcaatgctaatgtttggaagatatttacggatctttttgattactttccgctgacagctctggttgaatcggagatattctgtctgcatggtggattatccccatctattgaaacacttgataacatcagaaactttgatcgtgttcaagaagtcccacatgaaggcccaatgtgtgatcttttgtggtctgacccagatgatcgctgtggttggggtatatccccgcgtggtgctggatacacttttggccaagacatatctgagcaatttaaccacaccaacagcctgaagcttattgctcgagctcatcagctggttatggagggatataactggggacatgaccaaaaagtggtgacgatctttagtgcaccaaattattgctatcggtgtggaaacatggcatctatattggaagtcgatgactgcaacggccatacgtttattcagtttgagccagctccaaggagaggagaaccagatgtgactcgaagaacaccagattatttcttatgaaacagtcacatgtgttccttgaagattgagatatacatgccagtattttcagatgcttgagataggaaaggagactataatgtgtagcttaactttttggttggtgaaaagctttgtaacatggagaagctataggataccttcagcctaattttcgatctgacgttctttagaacttcttggattgaaaaatgagatggttaggctgtaatgtatcatgtgaaccgaaggttttcagcagtaattttctttcgcaatttgatagacctataaatgaatatgttttgtctattacaattcttttggccc

SEQ ID NO: 3613 - DNA, 1770 bp, Daucus carota
gagccaaagaaaaaaggttaagacgatcgtcccattggttttaccaacaatctctcttctcctctctcaaaattattgttcctctttctttctctctagggtttcgaaagaactcgaagaaaagggaggaagaagatgagttacgatccggttcaaagcagcgcaaatggtaatctcgacgaacaaattgctcagcttatccagtgcaaacccttgtccgagcaggaggttagggtgctatgtgagaaggccaaggagattctcatggaagaaagcaacgtccagcctgtcaaaagcccagtaacaatttgtggtgatattcatgggcaatttcatgatctcgcggagctgtttcgaattggagggaagtgtccagacacaaactacttgtttatgggagactatgttgatcgtggctattattcagttgaaaccgtaacactcttggtggctctcaaagtgaggtattcacagagaattactatattgagaggaaaccatgaaagtcgtcagattacgcaagtatatggcttctatgacgaatgcttaagaaaatatggtaatgcaaatgtgtggaagatcttcactgatttgttcgactattttcccctcacagcattggttgaatcagaaatattttgtctccatggtgggttgtcaccttctattgaaacccttgataatatacggaatttcgatcgtgttcaagaagttcctcatgaaggacctatgtgcgatcttttatggtctgaccctgatgatcgctgtggatggggtatttcacccaggggtgctggatatacttttggccaagatatttctgagcaatttaaccataccaacaacttaaagcttattgcaagagcacaccagctggttatggagggattcaactggggccatgagcaaaaggttgtcactattttcagtgcgcctaattactgttatcgatgtggaaacatggcatctatcctggaagtggatgattgcaaaggacacaccttcattcagtttgaaccagctccaaggagaggagagcctgatgttacccgcagaacgccagactatttcatgtgaagtagaactcaccgaacattcagcttttagtgctgctaactgctttttatagcttggaagttaccttaaatatttggagtcatatttaactatgacgaggagggtaatgaaaaacatgtaaaatgggatgtgtaaacagttgttttctggaaacccgttagagctatgggaaacagagcagtggatatgtttactacatattgtactgcgtcctgcgtggttatgtgtcgtcctctttgttattcccttgcacaattagttctttgattttttgtccagtgtagaaggatccattgtctggatttactagcagggttattgtgtagatgcaattttcaccttttcagtattctatagggttttctttttggccccaactcattatctttggcctttatcatttcttatattatatttggggtgagagtggattcttgtcattccccacctttgttttaaaaggccatctgatttcgaggccggacagtgagtatggcgatcatattctggtcttgcatttttatcaatctgttttgtggaatttaagctgtagtgtctaagttgtataaaagttctctgatgtgttcatttctgttagcatgtcaccttgggtaatgatgtgctatcagactcgacaattgtgctgtgtcatctaagctcttgtttgggtcatggaataggacccggagaaga

SEQ ID NO: 3614 - DNA, 1370 bp, Trifolium pratense
ttcaattgattcattcatcaacaacgaccaaggtggtggaggatttgaaaatggattcggttccttccaattcacatggaaatctcgacgaacagattgctcagctcatgcaatgcaaacccttgtccgaacaagaggtcagggtcttgtgtgacaaggcaaaggagatattgatggaagagagcaatgtccagcctgtaaaaagtcctgttacaatctgtggtgatattcatgggcagttccatgatcttgcagagcttttccgcattggagggaagtgtccagatacaaactacttgtttatgggagattatgttgatcgtggctattattctgttgaaactgtaacgcttttggtctcccttaaagtgcgttatcgtcagcgtatcaccattttgaggggaaatcatgaaagtcgacagattactcaagtttatggattttatgacgagtgcctacggaagtatggtagtgctaatgtttggaagatgtttactgatttgtttgactacttcccgttgacagcattggttgaatctgaaatattctgtctccacggtgggttgtccccgtctattgaaacccttgacaacattcgtaattttgatcgtgtgcaagaagttcctcatgagggacccatgtgtgatcttctatggtctgatccggatgatcgctgcggttggggtatctctcctagaggtgctggatacacttttggccaggacatatctgagcagtttaaccataccaataatttgaagctgattgctagagctcaccagctggttatggaaggatataactggggtcatgatcaaaaggtggttactatattcagtgcacctaattattgttatcgctgtgggaacatggcatccatccttgaagttgatgattgcaaaggacacacattcattcagtttgagccagcaccaaggaggggagagccagatgtaaccaggagaacccctgactacttcctataatacaacttcggtcgagctgcttttgccagcaactagtgctctgcagtaatgttcaagctcatataccagttaaaatcagagctgtgaatcaaattgatcgttattttcaaagttaggcttcactggatgtgttatttacttgaattataattgaatctttccaagagagaagaagctgaggagcaggagatgctactgtgggcatgtgtaccattgcagcatgcaatgtatcaatttgaatgtttctccaaattttccttttctatttatttgatactctgtttacctttattttcttattttaggattatccttaatggggatgggtttctgtagatggacaatgctttgacatatcttctaatgggtgttttatgatttttt

SEQ ID NO: 3615 - DNA, 1675 bp, Cucumis sativus
ttatgggcacggattcgatgttgtccgaggccaacagtagcttggacgagcagatctcgcagctcatgcagtgcaagccgctttccgagcaacaggttagggcattgtgtgacaaagccaaagaggttctaatggaagagagcaatgtacagcctgtgaagagtccagtaacaatatgcggagatattcatgggcaatttcatgaccttgcagagctttttcaaattggagggaagtgtccggacaccaattatctgtttatgggagattatgtggaccggggatattattctgttgaaactgtcacgttattagtggctctaaaggttcgctatcctcaccggattaccattcttcgagggaatcatgagagccgtcagatcactcaggtttatggcttttacgacgaatgtttaaggaagtatggaaatgctaatgtatggaagacgtttacagatctttttgactattttcctttgactgccttggttgagtctgaaatattttgcctccatggtgggttgtcaccatccattgaaacccttgataacatccgaaactttgaccgtgttcaagaggttccacatgaaggcccaatgtgtgacctattatggtctgatccagatgaccgatgtggctgggggatttcacctcggggtgctgggtatacatttggccaggacatatctgaacaattcaatcacatgaataatttaaagttgatagctagagctcatcaacttgtcatggatggatttaactgggctcatgaacaaaaggtggttactatttttagtgcgcctaactattgttatcgctgtgggaacatggcttcaattttagaggttgacgactgcaagagtcatacatttatccagtttgagccagcacccagaagaggagaacccgacgtcacccgtagaacaccagattacttcttatgaagcagctaagttgaacccttcccctgtatacagtaatgggttgtgtggttgttgtaggcaaagagaaccctgtgacatatgctgtgccatgcattgtgatgattttgcctgcgagcgagacaagaactttttatatagaaaaccctctgatttgtatttgaagatcaagacatcctcgagattcaaagatactcaactttctttcaccacttcggctcatttctccataatatgaatatctcaattagttttaattttgttacaacactttttctattgtagaaaattattatagtgctggcgttgtttaatcatgtactaggtggtgtaagtttgtttctgttctttttttatttttatttttttggaaaaaaggctgttaaaattagtagaattgctacatttttatttttaagaaaattttagtatgaagcatagttttgattttcgaggaatgtggctgagaatttttggagactagacagccttttcactaccacaagatcaagctggctttaattttaatttccattcagtccggggattttgtgaaatttagatcctacactttggacaagtggagcgaattattgttattattgccatcttttgtttgaattttattgttgcggatggacgtctctgtaaccaaactaatttcttggattttaacatttcgtttctaagcttttcaatttttgaaatgcctcatattttggctaattttgttt

SEQ ID NO: 3616 - DNA, 2034 bp, Eucalyptus grandis
agaagcaagaggagctctcgaaacattgatttcttcttcccctttctctctcctccccccccccccccgtctctctttctctctcttctgtgttctcgttcgctccgcgatttggaggaggaggaagaagaagaagaagaaggagaagaagaaggaggaggcggaaatttttttcgggggtggttcgcggggcggaattagggtttggcccggggggaaggtttcgcgggtggcgatctgtagatctgcggctgtgggaagttgggagttggaggttggaaggaaggaagaagaaggaagaaggagaagatgagcttggattcggttcctgccaattcgcatggcaacatcgatgaggagatttcgcagctcatgcagtgtaaaccgttgtccgagcaagaggtaagggttttatgcgagaaggctaaagaaatattgatggaggagagcaatgttcagcctgtaaaaagccctgtcacaatatgtggtgatattcatggccaatttcatgatcttgcagagcttttccgcattggaggaaagtgcccagatacgaattacttatttatgggagattatgttgatcgtggatattattcagtcgaaactgttacactattggttgctctcaaagtgcgatatccacagcggattaccattttaagaggaaatcatgaaagccgtcagatcactcaagtttatgggttttatgatgaatgccttcgaaaatatggcaatgctaatgtctggaagatttttaccgatctctttgactattttccgctgacagcactggttgagtcggaaatattttgcctacatggtggattgtcaccatctattgaaacccttgacaacattcggaattttgatcgtgtgcaagaagttcctcacgaggggcccatgtgtgatctattgtggtccgaccctgatgatcgttgtggttggggtatctcacccagaggagctggatatacctttggccaggatatatctgagcaatttaatcactccaacaatttgaagctcattgctagagctcatcagttggttatggaaggatataactggagccatgaacaaaaagtggtcaccatattcagtgcgcctaactattgttatcgttgtggaaacatggcatccatcctcgaagtagatgattgtagagcacacacattcattcagtttgagcctgctcccaggaggggagagccggatgtaacccgtagaacacctgattacttcctgtgacatatttgcattgagaagctaagcttatcgtggtcttcactcttgggctttcatatacttgggtgttcttgactgtctttcggtgctatgacatatatgtatcatggaggttggtgaagagtgcagcaggggctcacattttgtgtcagtgcctttagatctcaagttaccgcgagggaattgtgcgtcataggctgtcgatgagtggcatatatagcatttccagggaacaatgtggcatcttaagttctctcttctagttctcattaaaattttcttctttttcgctttttatctttctgtagaagtaatcactagaggacgtcggagcttgtagagggatgacttgacttctcttataatgggcgcttttccgatatcccaccattaaagtcgtctggtcctgccctgcatggcatctctttttcctctcctcttactgaagaaggcatgcttctattgaactattgcctgaatcgtgctgggggctcgattaacgctgcataacgagagatgaatgcgtaatgagatcaattgcagaggcttgtgtgacgagcaatatatctgtgaaatcagatgctgaagagtacgcctgccatacggcctgtattcgatgctgggctgcatctactcactgggatggagggagatgcaatgttaagagccgatcttagtggaccaaggtttcagtagggtttgttctattagtcgagttagctgcatcccgttctttcctggatataattgcagcatgctcgagcacctttctaattgcaatcaagt

SEQ ID NO: 3617 - DNA, 1225 bp, Flaveria ramosissima
gggtttcttttcttcttggcgctcatcatcatccctctaatttcttcacttttcattctaatttcctctaatatttttgattgattcatatattatttcttacaaaccatctgtagatacatacacacaatattatacattcacatagcgaaatgagtgtagatctagcttccaacagccatgggaaccttgacgaacagatttcacagctcatgcagtgcaaacccttatccgaacctgaggttaagggattatgtcagaaggcaaaagagacattgatggatgaaagcaatgtccagcctgtaaagagtcctgtgactatttgtggtgatattcatgggcaatttcatgatcttgctgaactttttcgcattggaggaaagtgtccagatacaaattacttgtttatgggcgattatgtggatcgagggtattattctgttgaaacagttacgcttttggtcgctctgaaagtgaggtatcctcaaaggatcactattttaagaggaaatcatgaaagtcggcagatcacacaagtctatgggttttatgatgaatgtctccggaagtatggcactgccaatgtttggaagatgtttacagatctttttgattatttcccgttgactgcattagttgaatcagaaatattttgccttcatggtgggttgtcgccttccattgaaacacttgatagtataagaagttttgatcgtgttcaagaggtcccacacgagggtccaatgtgtgatcttttgtggtctgatccagatgaccgttgtggttggggcatttcacctcgtggagctggttacacctttggccaggacatatctgagcaatttaaccacaccaacaacttaaagctcattgctagagctcaccagctggtgatggagggatttaactggggccatgaccaaaaagttgtgacgatctttagtgcacccaattattgttatcgatgtgggaacatggcttctatactggaggtcgatgactgcaaaggccacacattcatccagtttgacccagcccctagaagaggcgaacctgatgtaacgagaagaacacctgattatttcctgtgaagttgagtaatatctgtgacagtggttgaattggtgacgtgatccaacagatatccactaaagttcttcattgggaggacgggcttaagaggtcgtgaaattctggtctcttagttttatttttattttggtaa

SEQ ID NO: 3618 - DNA, 1352 bp, Panax ginseng
aagcagtggtatcaacgcagagtacatggggagtctcgattaaaaggttgatcggcgaccccccgagagcttctctttcttcccccaccctcgctggttgcaccaccgctgcagatagtaagagagaagaagaagaagatgagtgtggatctggccgcatcgaaagctcatggcaacctcgatgaacagatttcacagctcatgcagtgcaaacccttgccggaacctgaggttatggcattatgtgataaggctaaagagatactaatggaagaaagtaacgtccagcctgttaaaagccccgtgaccatatgtggcgacattcatgggcaatttcatgatcttgcggaactttttcgcattggaggaaagtgtccagatacaaattacttgtttatgggagattatgtggatcgtgggtattattcggttgaaactgtcacgcttctagtggctctcaaagtgcgttatcatcagcgaatcacaattcttagagggaatcatgaaagccgacagattactcaagtctatggattttatgatgaatgcctacgcaagtacggcaatgctaatgtttggaagatatttacagatctttttgattattttccactgactgcactggttgaatcggagatattttgtctgcatggtggattgtctccttccattgaaacacttgataatattagaaattttgatcgtgttcaagaagttccacatgaaggcccaatgtgtgatcttttgtggtctgacccagatgaccgctgtggttggggtatatctccccgtggtgctggatacacttttggtcaagatatatccgatcaatttaaccacaccaacaacctgaagcttattggtagagcacatcagttggttatggagggatttaactggggacatgagcaaaaagttgtaactatttttagtgctccgaattattgttatcgttgtggaaacatggcatctattttggaagttgatgattgcaatgggcatacatttatccagtttgagccagctccgaggagaggagaacctgatgtaacccgaaggacgccagattacttcctataaaccagttggtagagtttcttaagggttgatgtttgcacgctggttgggtcaaaagagataggaggttattgccgagattggatagaagatttgttagtggtgtagcttcagttcttggttaatcatgttaaatgggaagccaaggaacccttcaatctaatttatataatctaacctactttgttctttctaggatcgaggcaaggtggatatggctaggctgtaatgtatcattttgaatcagaacttgttaagctgtatttttgttcact

SEQ ID NO: 3619 - DNA, 1584 bp, Panax ginseng
ctcacacttccactaaccgagaatgacgaagaaagaagaaacaaaactgattattagggttagaaagaaaattctaataataaaggaaaattgaatcttcaagggacaataaaaatgaacttcgatctggtgcagccgagcgccaatggaaatgtcgatgaggaaattgcccagcttatgcagtgcaagcccttatctgagcaagaggttagggtgctgtgcgagaaggctaaagagattctaatggaagaaagcaatgtgcagcctgtcaaaagcccagtgacgatttgtggtgatattcacgggcaattccatgatcttgcagagctgtttcgaattggagggaagtgtccagatacaaattacttatttatgggagactatgttgatcgtggctattattcagttgaaactgtaacgcttttggtagctctcaaagtgaggtattcacaacgaattactattttgagaggaaaccatgagagtcgtcagattactcaagtatatggcttttatgatgaatgcctaagaaagtatggtaatgccaatgtgtggaagatctttacagatttattcgactattttccccttacagcattggttgaatcagaaatattttgtctccacggtgggttgtcaccttcaattgaaacccttgataatatacggaattttgatcgtgttcaagaagttccccacgagggacctatgtgtgatctcttatggtctgaccctgatgatcgttgtggttggggtatctcgcccaggggtgctggatatacttttggccaagatatatctgagcaatttaatcataccaacaacttgaagcttattgctagagcacatcagctggttatggagggattcaactggggccatgagcaaaaggtggttactatatttagtgcaccaaattattgttatcgatgtggaaacatggcatccattttagaagtagatgattgcaaaggacacactttcattcagtttgaaccagctcccaggaggggagagcctgatgtaactcgaagaacaccagactatttcctatgatgcagtagttagtttctaaaatttggagctgtgagtgcctgctaattgctatgtgtttgggagctaccaaacatatttgcagtgataattaactatgctgaagtgggtagtgaaaaagcatgtaaaatgggcagtgtaacatatacaaagattcagttattatcctggaactggatggtgctactgcggacgaggcagcagaggagctggtgagactgcttgctgcatattgtaccatttcctgcttaaaaatgcgtaatcctctcttcattccatttaacctctagttatgttcattttttgtccagtgtagaaggatggaccatttggggggtgtggggttttatgtagatgcaaaaatatttttggtgttttttttctttcttttcaatcatttagagggtgcttttaattattttgtttactagtagtagctgtgtcaaaaaacaggatgggatggttgtttcttttttcacttctttcaatattgaaggtatgcattttgggctggctgtttagatgacaaaa

SEQ ID NO: 3620 - DNA, 1816 bp, Cucumis melo
ccacctctctctctctctctctctctcccccccctcctttttctttcttctctctgtccactgcccaccgccgcagtggagtctcacgccccggccgggccttctctctgaaccttcacaccttgggcgcctccatcagctccagttatgggcacggattcgatgttgtccgaggccaacagtagcctggacgagcagatctcgcagctcatgcagtgcaagccgctttccgagcaacaggttagggcattgtgcgacaaagccaaagaggttctaatggaagagagcaatgtacagcctgtgaagagtccagtaacaatatgcggagatattcatgggcaatttcatgaccttgcagaactttttcaaattggagggaagtgtccggataccaattatctgtttatgggagattatgtggaccgtggatattattctgttgaaactgtcacgttattagtggctctaaaggttcgttatcctcaccggattaccattcttcgagggaatcatgagagccgtcagatcactcaggtttatggcttttacgacgaatgtttaaggaagtatggcaatgctaatgtatggaagacgtttacagatctttttgactattttcctttgactgccttggttgagtctgaaatattttgtctccatggtgggttgtcaccatccattgaaacccttgataacatccgaaactttgaccgtgttcaagaggttccccacgaaggcccaatgtgtgacctattatggtctgatccagatgaccgatgtggctgggggatttcacctcggggtgctgggtatacatttggccaggacatatctgaacaattcaatcacatgaataatttaaagttgatagctagagctcatcaacttgtcatggatggatttaactgggctcatgaacaaaaggtggttactatttttagtgcgccgaactattgttatcgctgtgggaacatggcttcaattttagaggttgacgactgcaggagtcatacatttatccagtttgagccagcacccagaagaggagaacctgacgtcacccggagaacaccagattacttcttatgaagcagctaagtcgaatccttcccctgtataccgtaatgggttgtgtggttgttgtaggcgaagagaaccctgtgacatatgctgccatgcgttgatgattttgcctgcgagcgagacaagaactttttatatagaaaaccctctgatttgtatttgaagatcaagacatcctcgagattcaaagatactcaactttctttcttcaccacttcggctcatttctccataatatgaatatctcaagtagttttaatattgttacaacactttctctattgtagaaaattattatagtgctggtgttgtttaatcatgtactaggtgtaagttagtttctgttatgtttttttttctttctttttttttttttgggaaaaaaggctgttaaagttagtggaattgctacattttattttttaagaaaattttagtatgatgcataattttgaggaatgtggctgtgagaatttttaaaggaaactaaacagccctttcactaccattaggtcaagctgggtttgattttaatttccgttcagtccggggattttgtgaaatttaaatcctacactttggaccagtggagcaaataattattattattgctatgttttgtttgaaatttataattacggatggacgtctctgtaaccaacctaatttcttggatttgaacatttcgttgctgagattttcaatctttgaaatagccttatactttggctaa

SEQ ID NO: 3621 - DNA, 1624 bp, Nicotiana benthamiana
tagcagatcgaaaatttcaaataaataaataaataaatcaaaatttcataaagtcgataaagagtagatcgacaaatttcgagggctttctctttcatttctcttcttttcctcctcctcttcttcttctttcccgcaaggaaaagaaagaaagaaaactaaagggcttttgtgggttgcggaaaaaaatatttacaaaatttattcaagaaatatattggaaaaaaaggttcttaattcttgtagttgaaattttgagttgtagaaaatgagttcttcggatctggtagcagcgagcacaccgggtaatctggatgagcagatttctcagctaatgcagtgcaaacctctctctgagcctgatgttagagcattatgcgagaaggccaaagagatactaatggaagaaagtaatgttcagccagtaaaaagccctgtgactatatgtggtgatatccatggacaattccatgatctcgccgagctctttaggattggtggacagtgtccagatacaaattatttgtttatgggtgattacgtcgaccgtggatattattcagtcgaaactgttaccctattggtagctttgaaagtacgttatcctcagcgattaacaattctcagaggaaatcatgaaagccgacagatcacacaagtctatgggttctatgatgagtgcttgcggaagtacggcaatgctaatgtctggaaaacatttactgatctatttgattatttccctttgacagcattggttgaatccgaaattttttgtttgcatggaggattatctccatctattgaaacccttgataatgtaagaagttttgaccgtgtccaagaagttccacatgaaggggccatgtgtgatcttttgtggtcagacccagatgatcgttgtggctgggggatgtcaccccgcggtgctggatacacttttgggcaggacatctccgagcaatttcaccaaaccaacaatctaaagctgatagctcgagctcatcagctggtcatggagggatataactggagccatgaacaaaaggttgtcactatttttagtgcaccaaattattgttatcgatgtggaaacatggcctctattttggaggttgacgactgcagagggcacacgtttatccagtttgatccagctccaagaaggggagaaccggatgtaacacgaagaacccctgattacttcttataaaaatggtcaactatttctgttgtcttccaatagctgcttgttttgctatattttccatctgctgtcgagatatgagcataattatggcaaagctagctactcttgggaggtaattcatggaccaagaagcttgtaaaacgctagaccaggtccccttggtttaaatcatattctaacctatgttaggaattgttagagtgggaaagtggagcaagctgtgttgtatcatttcatggagacttcttttcggttgttccattcatgttctgatcttcagtcttagtgtgatatttctctcaaagttgtcatatgttgttgcaaggaagtatgttgtgtaaagttaaaaatccactttacagtgtaatttttaccttgttaatgcagccgatccttgtgaagttggtttctttt

SEQ ID NO: 3622 - DNA, 1469 bp, Olea europaea
caaacacggcctaaagttactctctctacagggacgaaactctcgtacatctatcctcctgtcttccactgtgcccgtggcccgaaattcgggataagttgaaggagttactccctttttccagcatagttagcgacgtcggaacgaaggaaggtggatctgacataaaatagaaaattaaacaagatgagtgcggatctggtggcagcgaacacacatggaaatttggacgagcagattgctcagcttatgcagtgcaaacccttgtcggagcccgaggttaggactctatgtgagaaggctaaggagacactaatggaggaaagtaatgtacagcctgtcaaaagccccgtgacaatttgtggggatatacacgggcaatttcacgatcttgctgaacttttccgcattggagggaagtgtccagatacaaattatctatttatgggagactatgtagatcgtgggtattattcagttgaaactgtcactcttctagtggctttgaaagtgcgctatcctcaacggattactattcttaggggaaatcatgaaagtagacagattacacaggtctatggattttatgatgaatgcctgcggaagtatggaaatgctaatgtttggaagactttcacagacttatttgactacttccctttgaccgcattggttgaatcagaaatattttgtctgcatggtgggctgtccccctctatagaaacccttgataatataagaaactttgaccgtgttcaagaagttccacatgaaggtcccatgtgtgatcttttatggtctgaccctgatgatcgatgtggttggggtatctccccccgtggtgcaggatacacatttggccaggacatatcagagcaattcaatcataccaacaacttaaacctaattgccagagctcatcagttggttatggagggttacaactggtcccatgaacaaaaggttgtcactattttcagcgcaccaaattattgttatcgttgtgggaatatggcatccattctggaagttgatgataatagagagcatacatttatccagtttgagccggctccaaggagaggagaacctgatgtaactcgaagaacacctgattatttcttgtagatcaatcgacagtaactggctcatggtttgatgcaatggtcgaattcgagtgttcatttgtcatttttgatgtgatacgaaggtgaagaagcattgaaagtttggaagtggttgaggttcccttccaacaatcaatgttatattctaaccaatgcaagggtgcttgggagcggaaagtgggttggtcgaatctttgaatgtattgtttcatataatgttttgatgttcttgttgtttccctttcttttgataaacatatctgtaagttagttctctatttttctcgtcactgcgaactattgatttggtctgcagaagtaatggagaattctattaagttg

SEQ ID NO: 3623 - DNA, 1181 bp, Olea europaea
tctgacataaaatagaaaattaagcaagatgagtgcggatccggtggcagcgaacacacatggaaatttggacgagcagattgctcagcttatgcagtgcaaacccttgtcggagcccgaggttaggactctatgtgagaaggctaaagagacactaatggaggaaagtaatgtacagcctgtcaaaagccccgtgacaatttgtggggatatacacgggcaatttcacgatcttgctgaacttttccgcattggagggaagtctccagatacaaattatctatttatgggagattatgtagatcgtgggtactattcagttgaaactgtaactcttttagtggctctgaaagtgcgctatcctcaacggataacaattcttagaggaaatcatgaaagtagacagattactcaagtctatggattttatgatgaatgtctccggaagtatggaaatgctaatgtttggaagacattcacagatctgtttgactatttcccactgactgcattggttgaatcagaaatattttgtctgcatggtggattgtccccgtctgtcgaaactcttgataatataagaaactttgatcgtgttcaagaagttccacatgaaggtccgatgtgtgatctgttgtggtctgatccagatgatcgttgcggttggggcatctcccctcgtggtgctggatacacttttggccaggacatttcggagcaattcaatcataccaacaacttaaagctaattgctagagctcatcagctcgttatggagggatacaactgggcacatgaacaaaaggtggtcactatctttagtgcaccaaattattgttatcgttgtggaaatatggcatccattttggaagttgatgactgcagagagcatacatttattcagtttgaaccagctccacggagaggggaacctgatataactcggagaacacctgattatttcttgtagagctgatagtcactgacttgatgtttgcatgatggttagtcggagttgtttacatgtcctttgccggtatttgagcttctctactaggcccttttgaaggtggaaaaaggcttgtaaaatgctagacgtggctcggctgtccaaatcatattctatgttagggtggtccctggaagtggggttagtgatgcatgcttgtatcatttcgaat

SEQ ID NO: 3624 - DNA, 1396 bp, Tragopogon dubius
gtaaatcgatctcggcggttttcgagggtttgcttctcctccgcgttcatcatcatcgtctgcatcactcctctatgttatcaattatctgaattttattccgtttcaggtaatcccaatcgatcgaaggattctttcattagaatccctgtttgtgtgtgtatatatgcacaaaagtatatatacacatatagcaagatgaatgtggagctggcttcgaacacccatgggaatctggacgagcagatttcacagctcatggagtgcaaacccttaaccgaacccgaggtcaggacattatgcgagaaggcaaaagagatattaatggatgaaagcaatgttcagccagtaagaagccctgttactatctgtggtgacattcatgggcaattccatgatcttgctgaactttttcgtattggagggaagtgcccagatacaaattacttgtttatgggggattatgtggatcgaggatactactctgttgaaactgtcactctcttggtggctctgaaagtaaggtatcctcaaagaattacaattttgagagggaatcatgaaagccgacagattactcaagtctatgggttttatgacgaatgtcttcggaaatacgggaatgctaatgtttggaagacctttacagatcttttcgattatttcccactcactgcactggttgagtcagaaatattttgtcttcatggtgggttatcaccttcgattgaaaccctagataatataaggaattttgatcgggtgcaagaggttccacatgaaggtccaatgtgtgaccttttatggtctgaccctgatgaccgttgtggctggggcatttcaccccgtggggctggctacacctttggccaggatatttcagagcaatttaatcataccaacaacctaaagcttattgctcgagctcatcaactagtcatggagggattcaactggggacatgatcaaaaggttgttactatctttagtgctccaaattattgttatcggtgtgggaatatggcttctatcttggaggtcgatgattgcaagggccacacatttatccagtttgaacctgctcctaggagaggagaacctgatgttaccagaaggacgccggattatttcttgtaaactcaactaatgtctattgctgatgtggcatcgtgaggaaggggtttgtatatcggatatgtttttgggggccttttggtcatttgaagtgttacattttaacctaggagtattatactgttatgtctgaggctgtaatctatgactatttttgttttttaggtttttgtgtgttacatatatcggatcgaccttgttttgtattctgttttcacctttttagcggctcttctggtttgaatgtcaccgaggtttgaac

SEQ ID NO: 3625 - DNA, 1454 bp, Vicia sativa
gttatcgaacaaaacgagcccatcgaaccctccaacgctttggtttcttcatcaccaccaccttttcatctctttctctctctaaaagccataaacaacaaactagtaacaataatcgaaaacgcaaaagggcttttccgacttagatctagggtttccatcgattccaaaactggatattgatccagcaacgaagggttaggaggtggaggatttcaaaatggattcggtgccttccaattcccatggaaatctcgatgagcagattgctcagctcatgcagtgcaaacccctgtccgaacaagaggttagggttttgtgtgataaggcgaaggagattttgatggaagagagcaatgtccagcctgtaaaaagtcctgttacaatctgtggtgatattcacgggcaattccatgatcttgcagagcttttccgcatcggagggaagtgtccagatacaaattacttgtttatgggagattatgttgatcgtggctattattctgtcgaaaccgtaacgcttttggtctcccttaaagtgcgttatcgccagcgtatcactattttgaggggaaatcatgaaagtcgtcagattactcaagtttatggattttatgacgagtgcctacggaagtatggtagtgctaatgtttggaagatgttcactgatttgtttgactacttcccgttgacagcattggttgaatctgaaatattctgtcttcatggtgggctgtctccgtcaattgaaacccttgacaacattcgtaattttgaccgtgtgcaagaagttccccatgagggacccatgtgtgatcttttatggtctgatccggatgatcgctgtggttggggtatctctcctagaggggctgggtacacttttggccaggatatatctgaacagtttaaccataccaataatttgaagctgattgctagagctcaccagctggttatggaaggatataactggggtcatgatcaaaaggtggtcaccatattcagtgcacctaattattgttatcgctgtggtaacatggcatccatccttgaagttgatgattgcaaaggacacacattcattcagtttgagccagctccaaggaggggagagccagatgtaactaggagaacccctgactacttcctatgatacaattatggtcgagttgctgttggcagtaacttgtgccctgcagtaatatgcaacctcatataccagttgaaatgagagctgtgaatcaaactgatccttattttcgaagttaggctaaactggacgttattttcaaagttaggcttcactgaacgtgttattttacttgaattaatattgaacctttttcaagagagaaactgaggaacaggagatgctattgggggcatgtgtaccgttccagaatgcaatgtatcaatttgaatgtgtctccaaattttccttttctatttat

SEQ ID NO: 3626 - DNA, 1698 bp, Citrullus lanatus
tctctctcttcttcctctctctgtccactgcccaccgccgcagtggagtctcacgctccggccgggccttctcaggtgcagctatgggcacggattcgatgttgtccgaggccaacagcagcctggacgagcagatctcgcagctcatgcagtgcaagccgctctccgagcaacaggtaagggcattgtgtgacaaagccaaagaggttctaatggaagagagcaatgtacagcctgtgaagagtccagtcacaatatgtggagatattcatgggcaatttcatgaccttgcagaacttttccaaattggagggaagtgtccggacaccaattatctgtttatgggagattatgtggaccggggatattattctgttgaaactgtcacgttattagtggctctaaaggttcgttatcctcaccggattaccattcttcgagggaatcatgagagccgtcagatcactcaggtttatgggttttatgacgaatgtttaaggaagtatggcaatgctaatgtatggaagacctttacagatctttttgactattttcctttgactgccttggttgagtctgaaatattttgcctccatggtgggttgtccccatccattgaaacccttgataacatccgaaactttgaccgtgttcaagaggttccccatgaaggcccaatgtgtgacctattatggtctgatccagatgaccgatgcggctgggggatttcacctcggggtgctgggtatacatttggccaggacatatctgaacaattcaatcacatgaataatttaaagttgatagctagagctcatcaactggtcatggatggatttaactgggctcatgaacaaaaggtggttactatttttagtgcgcctaactattgttatcgctgtgggaacatggcttcaattttagaggttgatgactgccggagtcatacatttatccagtttgaaccggcacccagaagaggagaacccgatgtcacccgtagaacaccagattacttcttatgaagcaaccaagtcaaatccttcccctgtataccgtgttatgggttgtgcgttgttgtaggcagggagaacatgtgacttatgctgccatgcattgatgattttgcctgcgagacagacagaactttttatatagaaaaccctctgatttgtatttgaagatcaagacatcctcgagatacaaagatattcaactttctttcaccccctcggctcctttctccataatatctctcaagtagtttaattgttacaatactcttctattgtagaaaattatagttctggtatttatcatgtactaggtgtaagttagttccgttatgtttggaaaaaggctgttgaaattattggaattgttactttttatttcaagaaattttagtatgaagcataattttgacgaatgtgcctgagaattttgaaggaaactaaacaggcttcatttccataaggtcaagctggctttgattttaaattccaatcagccagagattttgttccatttgggtactatgtttaatcctacagtttcgataagtgtggggcaaatatttattgttatttttctatgaaatttataattatggatactattatggtttggaccttctaatgggttggatttgaacattttggtgctaagatttccaatctttttagttgcctggtattt

SEQ ID NO: 3627 - DNA, 1557 bp, Rosmarinus officinalis
ttccaccatctccatccactcgcactcttcgcgagttctcgtactgctcctctcctacttctttctctctctcgattcactgaatcctgtatatctttttccaatcactttttcagtttcccaaattttgccctagggtgaagtcatatcttcccgaggcaccaatttttggtggtgggaggcggcggcgactgaattacggtggatctgaaactaggaggaggaagaagcaagaagcaagatgagcgcggatctggtggcggagagtacacatggaaatctggacgagcagattgctcagctcaatcagtgcaagcctttatcagagcccgaggttaggaccttatgcgagaaggctaaggagatactaatggaggaaagtaacgttcagccagtgaagagccctgtgacaatctgtggtgatattcacggacaatttcatgatcttgcagaactattccgcattggagggaagtgtccagacacaaactatctattcatgggagattatgttgatcgtgggtactattcggtggaaactgtaactctattagtggctctgaaagtgcgctatcctcaacgtatcactattctaagaggaaaccatgaaagcagacagattactcaagtatatggtttttatgatgaatgtctgcgcaagtacggaaatgctaatgtttggaagatattcaccgatctgtttgattattttcccctgaccgcattggttgaatccgaaatattttgtctgcacggaggtttgtccccatctgttgagacccttgacaatataagaaacttcgaccgtgttcaagaagttccacatgaaggtccaatgtgcgatcttttgtggtctgatcctgatgatcgttgtggttggggtatatctcctcgtggtgctggatacacttttgggcaggacatatcagagcaattcaaccacagcaacaatttgaaattaattgctagagcccatcaactggttatggaaggataactgggcccatgagcaaaaggctgtcactatatttagtgcaccaaattattgttatcgcggtggaaatatggcatccattttggaagttgatgattgcagggagcatacgtttatccagtttgagccagctccaaggagaggagaacctgatgtcactcggaggacacccgactatttcttgtagctctgatgctgtaaactctttcatctatatgatgtgtccgtttggggtgcttgcatggtcattgcctgagattccgaggttcaagtaattcagcctatttgaaggtggtgcaagtgggaaaagatgcatgcaagatgagaggctcctagtctgaaaagttatattctaacctatcttagggtctagttgtcgggtagttggaataggggatgcttctgtgtatcatgttctataattttttgatgtgatgttccccatttctactcttaatttgtttttctatttgtcctttgaatcactgccatttggaggacaggtgtatttgtggaatcaatgcagaatttctgtcaatttaatctttgtcgttttgttggtt

SEQ ID NO: 3628 - DNA, 1377 bp, Fagus grandifolia
ctgcgtttttgaacaacaagctatggattcggtcccttcgaactcacatggcaacctggacgagcagatttctcagctcatgcagtgcaagcccttgtccgaacaagaggtaagggtgctgtgtgataaggctaaggagatactaatggaggaaagcaatgttcagcctgttaaaagtcctgttacaatttgtggcgatattcatgggcagttccatgatcttgcggagtctttttcgcattggagggaagtgtccagatacaaattacttgtttatgggagtattatgtcgacgtggctactactcagttgaaactgtaactctcctggtagccttgaaagtgcgtttattctcaacggattactattctgagaggaaatcatagaaagccgtcagattactcaagtttatggcttctacgacgagtgccttcgaaagtatggtaatgccaatgtgtggaagatctttacagatttgttcgactattttccactgacagcattggttgaatctgaaatattttgtctgcatggtggattgtccccttccattgaaacccttgataacattcgtaactttgaccgtgttcaagaagttcctcatgaggggcccatgtgtgatcttttatggtctgacccagatgatcgctgtggttggggtatctcacccaggggtgctggatacacctttggccaggacatatctgagcagtttaaccatactaataacttaaagctgattgctagagctcaccagctggttatggaaggatataactggggtcatgaacaaaaagtggtgaccatattcagtgcaccgaattattgttatcgctgtggaaacatggcatccatcctggaagttgatgactgcaagggccacacattcattcagtttgagcctgctccgaggaggggagagcctgatgtaacccggagaacacctgattacttcctatgatgcagctatcaattagttgctgaattcacaggggctagtgcttactagctggtttacgtgttgagggcttctattcagattttaaagtttataactttgctataatggtggttgggtggtgaaaagcatgtaaactgggcaggtgggggcttcgattacttttgctttcagtttcagagaggaagcagcagagctggcaacgatgaagcagcttatgtaccatttcctgcgaacaatatggcatcttttatttcttagcactgatttccttttatttcttctttcttctctttcttctgtatgtggtgtttgtttgggtcgtgtgaggatcctctagtaatttttatttatagtgtcttattattttactttgttcgtcctgcgtgacagcgactcagactagcgacgacgacaca

SEQ ID NO: 3629 - DNA, 1249 bp, Lippia dulcis
cacatgtagatactatttttacagtaattatcatccgtaggattctcatcttacgtcccgggataaggaataacgtattcacctattttcggcacaagaaagtgacgtcgcagtcggacggcggcggatctgattacaaatcagaaattaaagaaaaatgagtgcggatctggtgactccgaccgcccagtgggaatctggatgaacagattgcacagcttatgcagtgcaaacccttgtctgagcccgaggttagaacattatgtgaggaggctaaggagatactcatgcaggaaagcaatgtccagcctgtaaaaagtacccgtgacaatttgtggtgatattcatggacaatttcacgaccttgctgaactattccgctattggagggaagtgtccggacacaaactatctatttatgggagattatgttagatcgtggatactattcagttgaaacagttacactactggtggcattaaaagtgcgctatcctcaacgtatcacgattcttagaggaaatcatgaaagtagacagatcacccaagtctatggtttttatgatgaatgcctgaggaagtatgggagtgccaatgtttggtaagacattcactgacctatttgactattttcctttgaccgcattggtcgaatcagaaatcttctgtctgcatggtggattatccccatccattgaaacccttgataacattagaaacttcgatcgtgttcaagaagttccccatgaaggtcccatgtgtgatctgctgtggtctgatcccgatgatcgttgtggttggggcatatcccctcgtggtgctggatatacatttgggcaggacatttcggagcaattcaaccacaccaacagtttaaagctaattgctagagctcatcagctggtcatggagggatacaactgggctcatgaacaaaaagtcgtcactattttcagcgctcctaattactgctaccgctgtggaaatatggcatccatcttggaagttgacgatcacagagatcatacatttatccagtttgagccagctccaaggagaggggaacccgcgtgacccgcagaacgcctgattatttcttgtagagccgtctgttgctgcatcttgtccaaattaaggtgcgcaggggccatttgtcgagatccgagtttcaaagaggcttgatagtgcataaggttgttagggtcccctagtcgggttagcgatgctcgtttctgtttagttgtacttc

SEQ ID NO: 3630 - DNA, 1137 bp, Brassica oleracea
gattcccctaatttggaaaacctagtcctgagtttcccggatcggaggaagaagacggaagtaacgagaatgggcgcgaattcaataccgacggacgcaacgattggtctcgatgagcagatctcgcagctcatgcagtgcaagcctctctctgagcaacaggttagagcgttatgcgaaaaagccaaggagatcttaatggatgaaagcaacgttcagcctgtgaaaagccctgtgacaatctgcggtgatattcatggacagttccatgatcttgctgagcttttccgtattgggggaatgtgccctgataccaattacctgtttatgggagattacgttgaccgtggttattattctgttgaaactgttacgctgttagtcgccttaaagctgcgataccctcagcgaatcaccattcttagaggaaaccatgaaagtcgtcagatcactcaggtttatggattttatgatgaatgtctgcgaaagtatggcaatgcaaatgtttggaaaatctttacagatctctttgactatttcccactgacagccttggttgagtcagaaatattttgccttcatggtggcttgtctccatctatcgagacacttgacaacataaggaactttgatcgagttcaagaagtgccccatgaagggcccatgtgtgacttattatggtctgatcctgatgaccgttgtggttggggcatctctcctcgtggtgccggatatacatttggtcaggacatatccgaacagttcaaccactcaaacagcttaaagctgatcgccagagcccatcagctggttatggatggatacaactgggctcatgagcaaaaggtggtaactatcttcagtgcaccaaactattgttaccgttgtgggaacatggcttcgattcttgaggttgatgactgcaggaaccacaccttcattcagtttgaaccagcaccaaggagaggagaaccagatgttactcggagaacaccagactatttcctgtgatcactggacacagagtcacctcagcagctgcaaccaacaactgaaaagtcacagttggtaactcaagaatctggttactatgcgatgtgttaaggtttgctgtgttttgaagttcaatttagttcc

SEQ ID NO: 3631 - DNA, 1584 bp, Brassica rapa
ctacaaaccactcgctagtcgcttctctcacgcgccattccttttcgatctttctatcactcagagagagagagagagagaggggcgaagaataaggagattcaatccaatttagggttagtgatttccctaatttcgaaacctaatcctgattgtttcccggatcggaggaagtaacgagaatgggagcgaattctataccgacggacgcaacgattggtctcgatgagcagatctcgcagctcatgcagtgcaagcctctctctgagcaacaggttagagcgttatgcgaaaaagccaaggagatcttaatggatgaaagcaacgttcagcctgtgaaaagccctgtgacaatctgcggtgatattcatggacagttccatgatcttgctgagcttttccgtattgggggaatgtgccctgataccaattacctgtttatgggagattatgttgaccgtggttattattctgttgaaactgttacgctgttagtcgccttaaagctgcgataccctcagcgaatcaccattcttagaggaaaccatgaaagtcgtcagatcactcaggtttatggattttatgatgaatgtctgcgaaagtatggcaatgcaaatgtttggaaaatctttacagatctctttgactatttcccactgacagccttggttgagtcagaaatattttgccttcatggtggcttgtctccatctatcgagacacttgacaacataaggaactttgatcgagttcaagaagtgccccatgaagggcccatgtgtgacttattatggtctgatcctgatgaccgttgtggttggggcatctctcctcgtggtgctggatatacatttggtcaggacatatccgaacagttcaaccactcaaacagcttaaagctgatcgccagagcccatcagctggttatggatggatacaactgggctcatgagcaaaaggtggtaactatcttcagtgcaccaaactattgttaccgttgtgggaacatggcttcgattcttgaggttgatgactgcaggaaccacaccttcattcagtttgaaccagcaccaaggagaggagaaccagatgttactcggagaacaccagactatttcctgtgatcactggacacagagtcacctcagcagctgcaaccaacaactgaaaagtcacagttggtaactcaagaatctggttactatgcgatgtgttaaggtttgctgtgttttgaagttcaacttagtccccaccaccgagagaatagtgtgtattataggcgaagaagaccctctcttatcttcctctataaccaagaagaagagaaaaagaggtcaacggactctctacaatacccattatgcacattgtttattaacttcttctttctgcatcagtttgtcttttcatgtgagagatctgtttaatttaatttcttgtaattcttctcttaaatttcatctattattttttttgtttagaaatccagtgaagattttttattggaacttcgatgttttgcttttaaaatcttcatatagtaacaatggaagtgctgaattcattgactcagccactttgaaa

SEQ ID NO: 3632 - DNA, 1500 bp, Brassica napus
gagaggtgtggtgatgtaatttagaaaaataagtatggtcagctgcggtccggtccggaatattgtgccgagaaagcgtccgctcagagatccagagagagagaggggcgaagaataaggagattcaatccaatttagggttagtgatttccctaatttcgaaacctaatcctgattgttttccggatcggaggaagtaacgagaatgggggcgaattcaataccgacggacgcaacgattggtctcgatgagcagatctcgcagctcatgcagtgcaagcctctctctgagcaacaggttagagcgttatgcgaaaaagccaaggagatcttaatggatgaaagcaacgttcagcctgtgaaaagccctgtgacaatctgcggtgatattcatggacagttccatgatcttgctgagcttttccgtattgggggaatgtgccctgataccaattacctgtttatgggagattacgttgaccgtggttattattctgttgaaactgttacgctgttagtcgccttaaagctgcgataccctcagcgaatcaccattcttagaggaaaccatgaaagtcgtcagatcactcaggtttatggattttatgatgaatgtctgcgaaagtatggcaatgcaaatgtttggaaaatctttacagatctctttgactatttcccactgacagccttggttgagtcagaaatattttgccttcatggtggcttgtctccatctatcgagacacttgacaacataaggaactttgatcgagttcaagaagtgccccatgaagggcccatgtgtgacttattatggtctgatcctgatgaccgttgtggttggggcatctctcctcgtggtgctggatatacatttggtcaggacatatccgaacagttcaaccactcaaacagcttaaagctgatcgccagagcccatcagctggttatggatggatacaactgggctcatgagcaaaaggtggtaactatcttcagtgcaccaaactattgttaccgttgtgggaacatggcttcgattcttgaggttgatgactgcaggaaccacaccttcattcagtttgaaccagcaccaaggagaggagaaccagatgttactcggagaacaccagactatttcctgtgatcactggacacagagtcacctcagcagctgcaaccaacaactgaaaagtcacagttggtaactcaagaatctggttactatgcgatgtgttaaggtttgctgtgttttgaagttcaacttagtccccaccaccgagagaatagtgtgtattataggcgaagaagaccctctcttatcttcctctataaccaagaagaagagaaaaagaggtcaacggactctctacaatacccattatgcacattgtttattaacttcttctttctgcatctgtttgtcttttcatgtgagagatctgtttaatttaatttcttgtaattcttctcttaaatttcatctattattatttttgt

SEQ ID NO: 3633 - DNA, 1467 bp, Brassica napus
atcactcagagagagagagaggggcgaagaatacggagattcaatccaatttagggttaagagattcccctaatttggaaaacctagtcctgagtttcccggatcggaggaagaagacgggattaacgagaatgggcgcgaattcaataccgacggacgcaaccattggtctcgatgagcagatctcgcagctcatgcagtgcaagcctctctcggagcaacaggttagagcattgtgcgaaaaagccaaggagatcttaatggatgaaagcaacgttcagcctgtgaaaagccctgtgacaatctgcggtgatattcatggacagttccatgatcttgccgagcttttccgtattgggggaatgtgccctgacaccaattacctgtttatgggagattacgttgaccgtggttattattctgttgaaactgttacgctgttagtcgccttaaagctgcgataccctcagcgaatcaccattcttagaggaaaccatgaaagtcgtcagatcactcaggtttatggattttatgatgaatgtcttcgaaagtatggcaatgcaaatgtttggaaaatctttacagacctctttgactatttcccactgacagccttggttgagtcagaaatattttgccttcatggtggattgtctccatctatcgagacacttgacaacataagaaactttgaccgagttcaagaagtgccccatgaagggcccatgtgtgacttattatggtctgatcctgatgaccgttgtggttggggcatctctcctcgtggtgccggatatacatttggtcaggacatatccgaacagttcaaccactcaaacagcctaaagctgatcgccagagcccatcagctggttatggatggatacaactgggctcatgagcaaaaggtggtaactatcttcagtgcaccaaactattgctaccgttgtgggaacatggcttcgattcttgaggttgatgactgcaggaaccacaccttcattcagtttgaaccagcaccaaggagaggagaaccagatgttactcggagaacaccagactatttcctgtgatcactggacacagagtcacctcagcagctgcaaccaacaactgaaaagtcacagttggtaactcaagaatctggttactatgcgatgtgttaaggtttgctgtgttttgaagttcaatttagttccaccaccgagagtagtgtgtattataggcgaagaagaccctctcttatcttcctctataaccaagaagaagaaaaaaaaagaggtcaatggactctacaatacccattatgcacattgtttattaacttcttctttctgcatcagtttgtcttttcatgtgagagatctgtttaatttaatttcttgtaattcttctcttaaatttcatctatttatttttttgtttagaaatccagtgaagattttttattggaacttcgatgttttg

SEQ ID NO: 3634 - DNA, 950 bp, Manihot esculenta
atggtcgctgattcgctatcttcagattcaatcaccgatctcgatgagcagatctcgcagctcatgcagtgcaaaccactctccgagacccaggtcagagcattatgtgacaaggctaaggagatactaatgcaagaaagcaatgttcagcctgtgaaaagccctgtgacaatctgtggcgatattcatgggcagtttcatgatcttgcggaactttttcgaattggagggaagtgtccagacaccaattacttatttatgggcgattatgtggaccggggctattactctgttgaaactgtgacgcttttagtggcacttaaagtgcgttatccacaacgaataaccattcttaggggaaaccatgaaagccgccagattactcaggtttatggcttttatgatgaatgtttgcggaagtatggcaatgctactgtttggaagaccttcactgatttgtttgactattttccattgactgccttggttgagtcggaaatattttgtctgcatgggggattgtccccatcaatagaaacacttgacagtataagaaacttcgatcgtgttcaggaggttcctcatgaaggggcaatgtgtgatcttttatggtctgatccagatgaccgatgtggctggggtatatcacctcgtggtgccggatatacttttggccaggatatatccgagcagtttaatcatacaaacaacttgaagttgattgctagagcacatcagcttgttatggatggatttaattgggcacatgaacaaaaggtggttaccatatttagtgcacctaattattgttaccgttgtggaaacatggcttccatattggaagttgatgactgtaaggctcacactttcatccagtttgagccggcacctaggaggggagagcctgatgtgacccgtagaacacctgattacttcctgtaaatcaacct

SEQ ID NO: 3635 - DNA, 1453 bp, Trifolium pratense
gattcggttccttccaattcacatggaaatctcgatgaacagattgctcagctcatgcagtgcaaacccttgtctgaacaagaggtccgggtcttgtgtgacaaggcaaaggagattttgatggaagagagcaatgtgcagcctgtaaaaagtcctgttacaatctgtggtgatattcatgggcagtttcatgatcttgcagagcttttccgcattggagggaagtgtccagatacaaactacttgtttatgggagattatgttgatcgtggctattattctgtcgaaactgtaacgcttttggtctcccttaaagtgcgttatcgtcagcgtatcaccattttgaggggaaatcatgaaagccgtcagattactcaagtttatggattttatgatgagtgcctacggaagtatggtactgctaatgtttggaaaatgtttactgatttattcgactacttcccattgacagcattggttgaatctgaaatattctgtcttcacggtgggttatccccgtctattgaaacccttgacaacattcgtaattttgatcgtgtgcaagaagttcctcatgagggacccatgtgtgatcttctatggtctgatccggatgatcgctgcggttggggtatctctcctagaggtgctggatacacttttggccaggacatatctgagcagtttaaccataccaataatttgaagctgattgctagagctcaccagctggttatggaaggatataattggggtcatgatcaaaaggtggttactatattcagtgcacctaattattgttatcgctgtgggaacatggcatccatccttgaagttgatgattgcaaaggacacacattcattcagtttgagccagcaccaaggaggggagagccagatgtaaccaggagaacccctgactacttcctataatacaacttcggtcgagctgcttttgccagcaactagtgctctgcagtaatgttcaagctcatataccagttaaaatcagagctgtgaatcaaattgatcgttattttcaaagttaggcttcactggatgtgttatttacttgaattataattgaatctttccaagagagaagaagctgaggagcaggagatgctactgtgggcatgtgtaccattgcagcatgcaatgtatcaatttgaatgtttctccaaattttccttttctatttatttgatactctgtttacctttattttcttattttaggattatccttaatggggatgggtttctgtagatggacaatgctttgacatatcttctaatgggtgttttatgattttttaaccagtcctgtgtagtagtcttttttttcttctttgttttgcttgaaatgaatttataattttttacaaatgccaggtttatagaatttgtagaatatgttggacgaaatttataattttctaaatcatgctttg

SEQ ID NO: 3636 - DNA, 1513 bp, Lupinus angustifolius
gcctccaacgctttggtttctccaccttcaccactcttctctctctctctattttctttctctctctccaaaaaccagaaagaaaaaaagaaactaataacaaaaacaaaaaatctgagatctagggtttcaccatttctaagaaagaggaattaggaataatcaagcattatggattcggattctcatggaaacctcgatgagcagatttctcatctcatgcagtgcaaacccttgtcagagcaagaggtaagggccttgtgtgataaggcaaaggaaattttgatggaagagagtaatgttcagcctgtgaaaagccctgttacaatttgtggtgatattcatgggcaattccatgaccttgcagagctgtttcgcattggagggaagtgtccagatacaaattacttatttatgggagattatgttgaccgtgggtattattctgttgagaccgtaacgcttttggttaccttcaaagtgcgttatcgccagcgtatcacaattctgagaggaaatcatgaaagtcgacagattactcaagtttatgggttttatgatgagtgtctacggaagtatggcagtgctaatgtttggaagatcttcactgatttgtttgattactttccattgacagcattggttgaatctgaaatattttgtcttcatggtgggctgtccccatctatcgaaacccttgataacgtacgtaatttcgatcgtgtacaagaagttcctcatgaggggcccatgtgtgatcttctatggtctgatccggatgatcgttgtggttggggcatctctcctagaggtgctggatatacctttggccaggacatatctgaacaatttaaccatacaaataacttgaagctgattgccagagctcaccagctggttatggaaggatataactggggtcatgatcaaaaggtagttaccatatttagtgcacctaattactgttatagatgtgggaatatggcatcaatacttgaagttgatgactgcaaaggacacacattcattcagtttgagccagctccaaggagaggagagcctgatgtaaccagaagaacaccagattacttcctatgaacacaaactcttctgtttcagtagtagtagttcaccaccagcaactagttccttgccatgcatcaaattaattcattacattttgaagttaggcttctctggatgtgttattacctagttatgataattgagtagaggaagctgaggaacaggggatatatactatagttgccatgtgtgtgtacctttccaacatgcaatgtatcaattttattgtttctacaaattactattactttaatttgacttgtagctatcttaaactttcttttctcagtttaggattattgttatggggaagggtttatgtagatggttctaatgattggtagaagtccttcctttttggtacttcctctctcttctttcctgttatcttcaccatttacataatttctttgtccttattatattt

SEQ ID NO: 3637 - DNA, 1489 bp, Prunus persica
ccgtcctctcacctctgctttaagcacaatcagagagtgaggaccggaaccaatctctgaatctggggttagggttatccctaatccgaataccagtaatcccaattcgattctcgaagcagagagaagcaagatgggcgtcaattctgtatcctcggatacgagcagtgatctgaacgagcagatcgagcaacttatgcagtgcaagccactctcggaaccacaggtgagagggttatgtgagaaagcaaaggaaattctaatgggagaaagcaatgttcagcctgtgaaaagcccagtgacaatttgtggcgatattcatgggcagtttcatgacctggcagagctttttcgaattggagggaagtgtcctgataccaattacttgtttatgggtgattatgtggaccgtggttattattctgttgaaaccgtgacgctcttagtggccctgaaagtgcgttatcctcagcgtatcactattctcagaggaaaccatgaaagtcgtcagattactcaggtttatgggttttacgatgaatgtcttcgaaagtatggcaatgccaatgtttggaagatcttcactgacctttttgactactttccactgacagcattggttgagtcagaaatattttgcctgcatggtgggctgtccccttccattgaaaaccttgataacataaggaattttgatcgtgttcaagaggttccacatgaagggccgatgtgtgatctgttatggtctgacccagacgaccgatgtggttggggtatttcacctcgtggtgcgggatatacttttggccaggatatatctgaacaatttaatcatacaaacagtttaaagttgattgcaagagctcatcagttggttatggatggattcaactgggctcatgaacaaaaggtggttactatatttagtgcacctaattattgctatcgctgtgggaacatggcttctgttttagaagtcgatgactgcaggggccataccttcatccagtttgagccagctcctagaagaggagagccagatgttacccgtagaacacctgattactttctgtgaagctggtgcattggtgccattaattttgtggctcttccgctcttccactgctggttgcacattgtttttgcacaagatgactgttgggtttaaaatctaagtctacctgtctggttataggattccaagacgatgtaaaaaacacaggtaaggtgcctgctgatttcacttgaaccttgctggatttcctaccaaatagtttgcctagctgttgacacaccgtaattactgtatcatatccagcagaatatgtggatattctttttggtttttgtacttctatctttttctccttgtacgttttgctcacccgtcccattcttttggggctctcaagggtgcatggaactttattattagtggatgttttgcacttctattcaattactttatcagtgatgattggcaatgtga

SEQ ID NO: 3638 - DNA, 1528 bp, Raphanus sativus
gggcgccattcccttttcgatcttcttctatcactcaagagagagagagagaggggcggagaatacgcagattcaatccaatttagggttagagattcccctaatttggaaaacctagtcctgagtttccccggatcggacgaagaagacggaagtagcaacgagaatgggcgcgaattctataccgacggacgcgaccattggtctcgatgagcagatctcgcagctcatgcagtgcaagcctctctctgagcaacaggttagagcattatgcgaaaaagccaaggagatcttaatggatgaaagcaacgttcagcctgtgaaaagccctgtgacaatctgcggagatattcatggacagtttcatgatctcgctgagcttttccgtattgggggaatgtgccctgataccaattacctgtttatgggagattacgttgaccgtggttattattctgttgaaactgttacgctgttagtcgccttaaagttgcgatatcctcagcgaattaccattcttagaggaaaccatgaaagtcgtcagatcactcaggtttatggattttatgatgaatgtctgcgaaagtatggcaatgcaaatgtttggaaaatctttacagacctctttgactatttcccactgacagccttggttgagtcagaaatattttgccttcatggtggattgtctccatcaatcgagacccttgacaacataaggaactttgatcgggttcaagaagtgccccatgaagggcccatgtgtgacttattatggtctgatcctgatgaccgttgtggttggggcatctctcctcgtggtgctggatatacatttggtcaggacatatccgaacagttcaaccactcaaacagcttaaagctgatcgccagagcccatcagctggttatggatggatacaactgggctcatgagcaaaaagtggtaaccatcttcagtgcaccaaactattgttaccgttgtgggaacatggcttcgattctcgaagttgatgactgcaggaaccacacctttattcagtttgaaccagcaccgaggagaggagaaccagacgttactcggagaacaccagactacttcctgtgatcactggatacagagtcacctctcagcagctgcaaccaacaactgaaaagtcccagttaagattgctgtgtgtttttttaagttccaacttagtcccaccaccgaaagtatagtgtgtgttataggcgaagaagaccctctctttaccttcctcgataaccaagaagaagagaaaagaggtcaatggactctctacaatacccattatgcacaattgtttattaacttctttttctgcatcagaatgtctttttcatgtgagagatctgtttaatttgatttcttgtaattcttctcttaaatttcttctatttttttttttgtttgtttgtttgtttagaaatccaatgaagattttttattggaactttgatgttttgtttttaaaaatcttgagatagtaacaatggagtttactga

SEQ ID NO: 3639 - DNA, 1590 bp, Helianthus annuus
ataatttacagcctagaggtagctactctagacgtttctttttcttaattatcactttgcacatcggtttcaccaccaccacctcgccatcggtaccaccaccaccaccacccactctcctcttcaccctacaccgattctttcaaaaaattatttctgggtcttatcatttaacgttcctgtcaatttattgtacaagaaaaccatcgaaaaaaagggaagaaaggatgagctcgggtccagatgtctccggcgctaatggcaacatcgatgaatatatctctcagctcatgcaatgcaaacccttatcagaacaagaggttagggtgttgtgtgagaaggctaaggagatcttgatggtggaaagcaacgtacagccggttaaaagccccgtgacaatctgtggtgatattcatggccagttccatgatcttgcagagctatttcgaatcggagggaagtgtccggatacaaattatttatttatgggagattatgttgatcgtggttattactcggttgaaactgtaactttattggtggccctcaaagtgcggtatccacagcgtatcactatattaagaggaaaccatgaaagtcgccagattactcaagtttatgggttttatgatgaatgcctacgaaaatatggtaatgctagtgtgtggaagacttttacggatttgttcgactattttcctcttaccgcattggtggagtccgaaatattttgccttcatggtggattatctccttcaattgagacccttgataatataagaaattttgatcgtgttcaagaagtgccccacgaggggccaatgtgtgatcttctttggtcagatcccgatgatcgctgtggttggggtatctcacctcggggtgctggatacacatttggccaagacatatctgaacaattcaaccatacaaatgggttaaagctcattgcgagagcgcaccagctggttatggagggattcaactggggtcatgaacaaaaggttgtgacaatctttagcgcacctaattattgttaccgttgcgggaatatggcttccattcttgaagtagatgattgcaaaggtcacaccttcattcagtttgacccagctcctaggaggggtgagccagatgtgacgcgtaggacacccgactacttcctgtgagatggcgaattcagtctcttttggaccggtttttgcgcatcagacgcattgcagcatcttactattaccaagtaaaatgggcatgtgacataagcctggtataggctttttgcatttactagagaaaaagcacagcaattgttacacactaatttgtatcatctagcgctggttttctgttgtttttttgtctgttgttgatacaaacatgaagttgtggggtggggatatatagatgcaaaacagtttaaaatcatgctctctaattgctacctcatgttttatacctagaattaatcatgaaactagacattttcttggggttgtagttatgtgatgctttgcgtaccttcacctgcgtatcaagcattacattctatgttgaatgcactagctgtgtatcagcttctgtttgcgcgtt

SEQ ID NO: 3640 - DNA, 1376 bp, Eutrema halophilum
cacacggagcgagagagagagagagagaaagcgaagaatacgcagaatccatccaaatatagggttagggctgcccctaatctggaaaccttgtcctggtttctgatctgttttccggatccgtctagaggaaagaggaagaagacgcagtaactacaagatgggcgcgaattcgcttccgacggactcaaccctcgatctagatgagcagatctcacagctcatgcagtgcaagcccctctccgagcaacaggttagatcattatgcgagaaagctaaggagatcttgatggatgaaagcaacgttcagcctgttaaaagcccagtgacaatctgcggtgatattcatggacagttccatgatcttgcagagcttttccgtattggaggaaagtgccctgacaccaactatctatttatgggagactatgtcgaccgtggatattattctgtcgaaactgttacgctgttagttggcttgaaagtacggtatcctcagcgaatcactattcttaggggaaaccatgaaagtcgtcagattactcaggtttatggattttatgatgaatgcctacgaaagtatggcaatgcgaatgtttggaagatatttacagacctctttgactatttccctctgacagccttggtggagtcagaaatattttgccttcacggtggattgtcaccttctattgagacccttgacaacattaggaactttgatagagttcaagaagttcctcatgaagggcctatgtgtgacttattatggtctgatcctgatgacagatgtggctggggaatttctcctcgtggtgccggatatacatttggtcaggacatttccgaacaattcaatcacactaacaacttaaaactgattgcccgagcacatcagctggttatggatggattcaactgggcacacgagcaaaaggtggttactattttcagtgcaccaaactattgctatcgctgtggaaacatggcctccattcttgaggtcgatgactgcaggaaccacaccttcattcagtttgaaccagccccgaggagaggagaaccagatgtgactcgaaggacacctgactacttcctataagcacaagtcacctcctcttagctgcaaagtccggttgttggtttttgaagatctctgcttattccatttggttcaacgcattgtgttccagcttgcttttctttaaaatcaatttagcccttttccttggaatagtgtaatataggcaacgaggtcaatgaactttaaaacccccatgaatatttgtgttttgctgaacttattcagctcccttttgtatcagaatcttttcattgtgagatattattttgatttaattttacgcaattcttcc

SEQ ID NO: 3641 - DNA, 1453 bp, Tragopogon dubius
atttgcaaattgcatatcggtttcaccaccaccgctcgctccccccactctcttcttcactctcagcccgaccttcaagatttttgcagatttgcttcttggatcgtatcgctcatcaattcaaaatccaatataaggatcttcttatcatattattggccaagaacatacccgaaaagaaagaaacaaagatgagcttgggtccagctgtctcgggcgctaatggcaacgtcgatgaatatatttctcagctcatggaatgcaaaccgttgtcagaacaagaggttaggttgctatgtgagaaggctaaggagatcttgatggtggaaagcaatgtacagcctgttaaaagcccggtgacaatctgtggtgatattcatgggcaattccatgatctagctgagcttttccgaattggagggaagtgtcccgatacaaattatttattcatgggagattatgttgatcgtggttattactcagttgaaaccgtgacattattggtggccctcaaagtgcgttatccacaacgcatcactattttaagaggaaaccatgaaagtcgtcagattactcaagtttatgggttttatgatgaatgcctaagaaagtatggtaatgctagtgtgtggaagaccttcacagacttattcgactattttccactcactgcattggtcgaatctgaaatcttttgtcttcatggtggattatccccatcaattgaaaccctagacaatataagaaactttgaccgtgttcaagaagttcctcacgaaggcccaatgtgtgatcttctatggtcagacccagatgaccgttgtgggtggggcatttccccccgtggtgctggatacacttttggccaagatatatctgagcaatttaatcatacaaatgggttaaaactcattgctagagcacatcagcttgttatggagggattcaactggggtcatgaacaaaaggttgtgacaatctttagtgcaccgaattattgttaccgatgtgggaacatggcttcgattcttgaagtggatgattgcaaggggcacactttcattcagtttgaaccggctccaaggaggggtgagccagatgtgacacgtaggactccggactactttctgtgaggtgtcagtagaagtctcgtttggaccagtttatgtctattgtctgtctggataaagtgatgtctgtctggtgatggatgcaattaccgaggggggaaaaagcgtgacgactcatttggttcacaagtaatagcatcatgcggtgcttattttctcggatttttttaatgtttgttatttgtagaagcataaagttggatgggtgggggatatatagaagaagaaagacattttaacattagttgttttgattgatacttgcctttgtttttctattaatgtagttaaacaatactttttctttacttggtactatcttg

SEQ ID NO: 3642 - DNA, 1328 bp, Vinca minor
ctgtcttaaattttttgatttgatccataaagagtgattcaaaaaagattaaatttaaagaatgagctcggatacggcggtggcgtcgagcggcggtgctcatcatggtaatctcgatgagcagatttctcagcttatgcagtgcaaacccttatccgaaccagaggttagaggactttgtgagaaggcaaaggagatcttaatggaagaaagcaatgttcaacctgtgaaaagccccgtgaccatttgtggcgatattcatggacaattccatgatcttcaagaactctttagaattggtggcaagtgtcctgatacaaattatttattcatgggagattatgttgatcggggatattactcagttgaaactgtaacccttctagtggccctcaaagtgcgataccctcaacgaattactattctgagaggaaaccatgagagtcgccagataactcaggtgtatgggttttatgatgagtgcctaaggaagtatggtaatgcgaacgtgtggaagatttttactgacctatttgactacttcccactgacagcactggtggaatccgagattttttgtctccatggtgggttatctccttccatcgaaactctgggtaacatacggaattttgaccgcgtgcaagaagttccccatgagggacccatgtgtgatctcttgtggtctgaccctgacgatcgttgtggttggggaatatcgcccaggggagctggatatacatttggccaagacatctcagagcagtttaaccacacaaacaatttgaagctcattgctagagctcaccagctggttatggaggggttcaattgggctcatgatcagaaggttgtcaccatatttagtgcacctaattattgctatcgctgtgggaacatggcatccatactggaagtggatgattgtaaaggacacacattcattcagtttgagcctgctcctcgaagaggagaaccagatgtaacccgaagaacaccagattactttctgtgatgcagctgcacaagcgtagcaaacttctgtacgtacgtacatcaggtctctttagctgctttgtgtattgacatctgtttgggagattggcaaattatatatttcgtacaatgtggaccccgggactggcagaagcgcgtacaacatgcagataggaactgtatggaaatattgcaaggcggcattgacattggaactgggacgctgcctgctgcatatgtatcatttcctggaattcattgacctcatctctttctctcttccctcttctaatattctgaaacaagacgtttctgcacttatattttggttt

SEQ ID NO: 3643 - DNA, 1218 bp, Vinca minor
gtgcggcggatctggtggcgcctagcagcaatggaaatctggacgagcagatttctcagctcatgcagtgtaaacctttgtccgagaccgaggttagaacattatgtgagaaggccaaggatatactgatggaggaaagcaacgtccagccagtaagaagcccagtgacaatttgtggtgatattcacgggcaatttcatgatttggctgaactttttcgcattggagggaagtgtccagatacaaattatctttttatgggagattatgtggatcgtggatattattcagtggaaactgtaactctattagtggctctgaaggtgcgctactctaaaaggatcaccattcttagaggaaatcatgagagtcgtcagattacccaggtttatgggttttatgatgagtgtctgcgcaaatatggcaatgctaatgtctggaagacattcacagatctttttgattattttccactgacagcactggttgaatctgaaatcttctgtttgcatggtggattatcgccatctattgaaacacttgataatataagaaattttgatcgtgttcaagaagttccacatgaaggtcctatgtgcgatctcttgtggtctgatccagatgatcgctgtggttggggtatttctcctcgtggtgctggatacacatttggccaggatatatctgagcaattcaaccacaccaacaacttaaagctgattgctagagctcatcagctggttatggagggctataattggagccatgaacaaaaagtcgttactatctttagtgcaccaaattattgctatcgttgtggaaacatggcatctattttggaagtcgatgactgcaggcaacacacattcatccagtttgagccagctccaaggaggggggagcctgatgtgactcgtagaacgcctgattatttcctgtaaagcatttgaggttgctgactaggtggttgtctggctgatggcttctgtaaggcggttgacacgtctgtcattggaattgaagcttcttcacaacaaggtactaggattctcttctagtggtgtcacaaggaccaaaaggcgtgtaaaaagctttagcccattggaggtccagttttaagttatattctaattgagaagttggcggagctaggcatatctcaaataatactgtattgtatcatttcatgtagagaacttgagatctcgtcctcgttag

SEQ ID NO: 3644 - DNA, 1442 bp, Vaccinium corymbosum
aaaaagccgtgagccaaaatctagggttagggtttcagaccccatttcccgtgtactgacgtcagaagaagaagaagatgagcgtggatctggtggcctcgagcacacatggcaacgtcgacgagcagattgcacagctcatgcagtgcaagccattgtccgagcccgaggtaagggcattgtgcgacaaggctaaagagatactaatggaagaaagtaatgttcagcctgtaaaaagccccgtgaccatttgtggtgacattcatggacagtttcacgatcttgcggaactttttcgcattggagggaagtgcccagatacaaattacttgttcatgggagattatgttgaccgtgggtattattctgttgaaacagtcacgcttctggtggcattgaaagtgcgttatcctcaacggatcactattcttcggggaaaccatgaaagtcgacagataactcaagtctacgggtttttatgacgaatgcctacggaagtacggcaatgccaatgtttggaaaatatttacagatctttttgactttttcccgctcactgccctggtcgaatcagaaatattttgtctacatggtgggctgtccccatccattgacactcttgataacatccgtaattttgatcgtgttcaagaagtgccacatgaaggtcctatgtgtgatctgttatggtccgaccctgacgaccgttgcggctgggggatctctccacgtggtgctggatacacttttggccaagacatatccgagcaattcaaccataccaacaatttaaagctgattgctagagcccatcagctggttatggagggatataactggggacatgatcaaaaggttgttaccatctttagtgctcctaactattgttaccgctgtggaaatatggcctctattttggaagttgatgactgcaaaggacacacatttatccagtttgagccagctccaaggcgaggagaacccgatgttacccgaagaacgccagattatttcttataatgcagcacattgggttgctgatgtcaggcgtcggatgctggtttagatggtgtggtagcaggtcaagtccatgatcggattcaagattattggtaagaggcctattaccatgtaatggtcggggccccattggatttaaattatgttctaacctgagttagatttcctaggacttgggcagccggctggttgatgctgtaatgtagtattacatgtaaaacaaacttgtgttcgtttttgttttgttgtttcaaaaagtatgtttcggttttgctgtctctaatttatgttgtttggtgtttgaggtgatgaataggcgatacaaatttaatttatgtggcattctgtgttctttgctttcacgtgttactgactggactgaatttgattcggataatagatgctctcaatcttgttgctgt

SEQ ID NO: 3645 - DNA, 1005 bp, Cycas rumphii
gaaagaacaagggtttggtttccaagtggaaattatcaggaggaggaggaagaggaagaaaggatcgaagatacaggatgagcgtggagccggtctcgtccaacggtcatggccagctcgacgcccaaaccgaacaactcatgcagtgcaagccactcgcagaacaagaggtccgagtcttatgcgagaaggctaaagagattttgatggaagaaagcaatgtgcagccagtcaagtgccctgttacaatctgtggtgacattcatggtcaatttcacgaccttgcagagctatttcgaattggtggaaagtgcccagataccaattacttgttcatgggtgattatgtggaccgtggatattattctgttgaaactgtcacccttctagtggcattgaaagtgcgatatcctcaacggatcaccattctccgagggaatcatgagagtcgccagattactcaggtctatggattctatgatgagtgcttacggaagtatgggaatgcaaatgtctggaagatttttaccgacctttttgactatttcccattgacagcacttgtcgagtcagaaattttttgtctacatggcggcctgtcaccttctattgatacacttgataacataaggaattttgatcgtgttcaagaagtgcctcatgaaggtcccatgtgtgatctcttgtggtctgatccagatgatagatgtggttgggggatttctccacgtggagctgggtatacatttggacaagacatttctgagcagtttaaccataccaacagcttaaagctcatagctagggctcaccaactggtcatggaagggtacaactggggtcatgaacaaaaggttgtcaccatatttagtgcacctaactactgttatcggtgtggtaatatggcatctattttggaagttgatgataataaaggatacacatttattcagtttgagccagccccaaggcgaggagaaccggatgtgactcgaaggacaccag

SEQ ID NO: 3646 - DNA, 1395 bp, Amaranthus tuberculatus
cctcgaccgaatctagatgttccttctttttgttctttgtcttccttttcctttctctctctaacattttctctctcttcacggagaaaatctacggtgacgtcaaggtgaagggatatcggtaggggttggtggagatctggtagggtttcccaagatgagcttcgatccagttccttctaactctcatcacaatcttgatgagcagatcgctcagcttatgcagtgcaaacctctttccgaacaagaggttaggggattatgcgacaaggccaaggaagtattgatggatgaaagcaatgttcagccagtgaaaagtcctgtgacaatttgtggtgacatccacgggcagtttcacgatcttgcagagctttttcgcattggagggaagtgtccagatacaaattacttgttcatgggtgattatgttgatagaggatattactcagtggaaacggtaacgctcttagttgcgcttaaagttcgctatccgcaaaggataacaatcctcagagggaatcatgaaagtcgtcagattactcaagtgtatgggttctatgatgaatgcctacggaagtatggaaatgccaatgtctggaagaccttcacagatttgtttgattattttccgttgactgccttggttgaatctgaaatattttgtttgcatggtggactgtcaccttccattgaaacacttgataatatacgaaattttgaccgtgtccaagaagtgcctcacgagggacctatgtgtgatctcttgtggtccgaccctgatgaccgttgtggttggggtatatcaccccgaggagctggatacacttttggccaagacatatctgaccaatttaaccatactaataacctaaagctgattgccagagctcatcaactggtgatggagggattcaactgggctcatgatcaaaaggtggtaaccatttttagtgcacctaactactgttatcggtgtggaaatatggcatccatccttgaagtcgatgactgcaaaggtcacacatttattcagtttgaaccggctccaagaagaggggagcctgacgtcacccggaggacacctgattatttcctgtgagttaaagttaccaatgacgagatggtttctggtggtggaaagcctcctacctgatcctatgttattgagcaatatttcacggattagggtggttaattctcctgtggcgatgaatggattgttttgtcacatttgatacagcgtcttttgagttgatgcttcttgattatggtaaatttcgcgaatgaagaagcttatggagcttgtaggaggatatgtaccgatttccagcaaaactttgtggtatctttaacgccaaattttctttgctttttcggtcctttttggcccttttt

SEQ ID NO: 3647 - DNA, 1338 bp, Amaranthus tuberculatus
tctcgctctacaattttctctctcttcacggcgaaaattatacggtgaaggtgaagggatatcggtggggattggtggagatcttttagggtttcccaaaatgagtttcgatccagttccttctaattctcattacaatcttgatgagcagatcgctcagcttatgcaatgcaaacctctttcagaacaagaggttagggtgttgtgtgacaaggccaaggaaatactgatggatgaaagcaatgttcagcctgtgaaaagtcctgtgacaatttgtggtgacattcatgggcagtttcatgatcttgcagagctttttcgtattggggggaagtgtccagatacaaattacttattcatgggtgattatgttgacagaggatattattcagtggaaaccgtaacgctcctggttgcacttaaagttcgctatccccaaaggatcactattcttagagggaatcacgaaagtcgtcagattactcaagtttatgggttctatgatgagtgcctacggaagtatggaaacgccagtgtttggaagacttttacagatttatttgattattttccactgactgcattggttgaatctgaaatattttgcctgcatggtggactgtcaccttccattgaaacacttgataatatacgaaattttgaccgtgtgcaagaagtaccgcatgagggacctatgtgtgatctcttgtggtctgaccctgatgaccgttgtggttggggtatatcacccagaggagctggatacacttttggccaagacatatctgaccaatttaaccatactaataacctaaagctgattgccagagctcatcaactggtgatggagggattcaactgggctcatgatcaaaaggtggtaaccatttttagtgcacctaactactgttatcggtgtggaaatatggcatccatcctggaagttgatgactgcaaaggtcacacatttattcagtttgaaccggctccaagaagaggggagcctgacgtcacccggaggacacctgattatttcctgtgagttaaagttaccaatgatgagatggtttccggtggtggaaagcctcctacctgatcctatgttattgagcaatatttcacggattagggtggttagttctcctgtggcgatgaatggattgttttgtcacatttgatacagcatataagtcttttgagttgatgcttcttgattatggtaaatttcgcgaatgaagaagcttatggagcttgtaggaggatatgtaccgatttccagcaaaactttgtggtatctttaacgccaaattttctttgctttttcggtcctttttggcc

SEQ ID NO: 3648 - DNA, 1625 bp, Ambrosia trifida
tgaacaacaagaatcgataatatcgatctcgacggtttccaaagcttttcttcttcatcaaattcaccttcattacctcctctgtaatctcaaattcctaaatcccatcagtttttatacatttccaatcccaatccatcaaacaaatcttattattcttcaaacccctctttctgtgcatacatatgcacaataaaacacacacacatacacatacataaacataaacatgagtgtagagctggcttccgacacccatggcaatctagacgagcagatttcacagctcatgcagtgcaaacccttatccgaacccgaggttaggacattatgcgacaaggcaaaagagatattgatagatgaaagcaatgttcagccggtaaagagccctgtgactatttgtggtgacattcatgggcagttccatgatcttgctgagctttttcgtattggaggaaagtgcccggatacaaactacttgtttatgggggattacgtggatcgagggtattattctgttgaaactgtcacactcttggtggctctcaaagtacgatatcctcagcgaattaccattttaagagggaatcacgaaagtcggcagattactcaagtatatgggttttatgatgaatgtcttcggaagtatggcaatgcaaatgtttggaagacttttacagatctatttgattattttccgttgaccgcattggttgaatcagaaatattttgcctccatggcggtttgtcaccttctattgaaaccctagataacattagaaattttgatcgtgttcaagaggtcccacatgaggggcctatgtgtgatcttctatggtctgacccagatgaccgttgtggttggggtatctccccccgtggagctggttacacgtttggtcaagatatatcagagcaatttaaccataccaacagcttaaagcttattgctcgagctcatcaactggtcatggagggattcaactggggacatgaacaaaaggtggtcactatctttagtgcacctaattactgttacaggtgtgggaatatggcttctatcttggaggtggatgattgcaagggacacacgttcatccagtttgaacctgctcctaggagaggagaacctgacgtaactagaagaacgcctgattatttcctgtaaaactgacgctcattggatgatcatgtatcggacatcgttttgggggtttcctggttcaacgctctaacctaggattttgctgttgacgtcgagcgatgtaatttttcataattttgtttgtagctttttgtgtgtaatcttgtgtataccgaccttgtttcatttgattttctttcgttttctcttctggttaaagactgacaatatgcaagttttggtgcactgcttgatctactagaacactcaaatcttcatcatcaatgtgtagaatagttatgcaaaccaatgtttacgttgcaaagtcgatcggtttttgatcggcacacattgttgtcgagtttgttttgtaatattaccattatatgttgtataatcctcgtaggaatatgtttgtaacacctttacaactcattacaatatgccaactcgcttgacttttatacacaaaaaagaaaaa

SEQ ID NO: 3649 - DNA, 1227 bp, Arnica chamissonis
tgccattccaaaatatgatatacaaaataacagattaaagatcttcctgtcaatttattggccaacaaaaatatcaacaagatgagcatgggtccagatgtctccagcactaatggaaacatcgatgaatatatttcacagctcatgcaatgcaaaccgttatcagaacaagaggttagggtgttgtgtgagaaggcgaaggagatcttgatggtggaaagcaacgtgcagcctgttaaaagcccagtgacaatctgtggtgatattcatgggcaattccatgatcttgcagagctatttcggattggagggaagtgcccggatacaaattatttatttatgggagattatgttgatcgtggttattactcggttgaaacagtgacgttattggtggccctcaaagtgcgttatccacaacgcatcactatattaagaggaaaccatgaaagtcggcagattactcaagtttatggattttatgatgaatgcctacgaaaatatggtagtgctagcgtgtggaagacttttacggatttgttcgactattttccacttaccgcattggtggagtctgaaatattttgcctgcatggtggattatctccttcaattgagacccttgatagtataagaaattttgatcgtgttcaagaagtgccccacgaggggccaatgtgtgatcttctttggtcagacccggatgatcggtgtggctggggtatctcccctcggggtgccggatacacatttggccaagacatatctgaacaatttaatcatacaaacgggttaaagctcattgctagagcgcaccagctggttatggagggattcaattggggtcatgaacaaaaggttgtgacaatctttagtgcacctaactattgttaccgatgtgggaatatggcttccattcttgaagtagatgactgcaaaggtcacaccttcattcagttcgacccagctcctaggaggggtgagccagatgtgacacgtaggacaccagattactttctgtgaggttgcagattcagtcccttttggaccaggttttgcccatcagctgcagtgccacattttaccatcaagaagtaaaatggacatgtaacataagcctggtattggcttgcatttacagggataaaagagcggcaactgttgcaggctaatttgtataatctcgtgcttcttttctgctctgtttttttttctgttggtataagc

SEQ ID NO: 3650 - DNA, 1386 bp, Cichorium intybus
taacgcttaaggaagtcttctgaaatatatccaaacaaaagaacaactcgacgatttacgagggtttcgttcttgtttatgttcatctctgattttgtattcaattgtgaagcattttgatcgatagaaccatcgattgaatccgaaaaccctatgtgattatatgtataaaaatacataatattcatataagaggatgagtgtggatctggcttcgaacacccatggaaacctcgacgagcagatttcacagctcatgcagtgcaagcccttaaccgagcccgaggtcaagacattatgtgagaaggcaaaagagatactaatgactgaaagcaacgttaagccggtaaaaagccctgtgaccatctgtggcgacatccacgggcagtttcatgatcttgctgagcttttccgcataggagggaagtgccccgatacaaattacttgtttatgggggattatgtagatcgagggtattattccgttgaaactgtctcgctgttggtagctctcaaagtacgttaccctcaacgaatcacaattttaagaggaaatcatgaaagccgtcagatcactcaagtctatggattttatgacgaatgccttcgaaagtatgggagtgctaatgtttggaagacttttacagatctctttgattatttcccattaactgcattggttgaatcagaaatattctgtcttcatggtggtttgtcaccttcaattgaaacacttgatagtataagaaattttgatcgtgtacaagaggtcccacatgaaggtccaatgtgtgatcttttatggtccgacccggatgaccgatgcgggtggggcatttcgccccgtggagcgggttacaccttcggccaagatatttccgagcaatttaatcatacaaacagcctaaagcttattgctagagctcatcaattggtcatggagggattcaactggggacatgagaaaaaggttgtgactatttttagtgcaccgaattattgctatcgatgtgggaatatggcgtctattttggaagtggatgattgcaagggtcacacgtttatccagtttgatcctgctccaaggagaggagagcctgatgtaactagaagaacgcctgattatttcctgtgagctttaatagctgatggatgttttttgctatccccccccccccccccccccccccccccccccccccccccccccccccccccccccccccctgattagtttaaattaagttacataaaattaaacatttgtattaattaagcaattgcccttgagaggtgctctatttgcttcttagtataatttattggttatgtttgctttctttaatatttatgatgtttgattaagtaaaagtatggtttacttcc

SEQ ID NO: 3651 - DNA, 1419 bp, Cichorium intybus
cggttttcgagggttttcttctcctctaccttcaccatcatcgtcttcatcactcccctctgttatcaaatcctaaactttttgagcttcaagtaatctcaatagattgaaggattcttttattagaatccccgtttgtgcgtgtatatatatgcacaaaaatatatacacatctacagcaagatgagtgcggagctggcttcgaacacccatgggaatctggacgagcagatttcacagctcatggagtgcaaacccttaaccgaacctgaggttaggacattatgtgagaaggcaaaagagatattaatggatgaaagcaatgttcagccagtaagaagccccgtgactatctgtggtgacattcatggtcaattccatgatcttgctgaactttttcgtattggaggaaagtgtccagatacaaattacttgtttatgggagattatgtggatcgaggatactattctgttgaaactgtcactctcttggtggctctgaaagtacggtaccctcaaagaatcacaattttgagagggaatcatgaaagtcggcagattactcaagtctatgggttttatgacgaatgccttcggaagtatggtaatgctaatgtttggaagacttttacagatctgtttgattatttcccgttgactgcactggttgaatcagaaatattttgccttcatggtggactttcaccttcaattgaaacattagatagtataagaaattttgaccgcgttcaagaggtcccacatgaaggtccaatgtgtgaccttttatggtctgaccctgatgaccgttgcgggtggggcatttccccccgtggtgctggttacacttttggccaggatatatctgagcaatttaatcataccaacaacttaaagcttattgctcgagcccatcaacttgtcatggagggattcaactggggacatgatcaaaaagtggtcactatcttcagtgcaccaaattattgttatagatgcggtaacatggcttctattttagaagtcgatgattgcaagggccacacatttatccagtttgaaccggctcctaggagaggggaacctgatgtaacaagaaggacgcctgattatttcctgtaaactcaagaagtaagtaacaaatgtggttttgagtgatggtgttttactaaaagtggcataatcgatagaagaaggggttggttgtatatcagacatgttttgagggtgtttttgtcatttcaagttttactaacttaggattatgctgttgttgaatgtctgagaatgtaatgtatgattgttttttgttttttaggttttttgtgtgtacacgtatgtatatcgaatcgaccttgttttgtgttctctttgcaccttttttttttcgactctttcaagttcccttttaaggacttc

SEQ ID NO: 3652 - DNA, 1340 bp, Cichorium intybus
aatgaaatgttagagggaccgaaattggtatatctataacgctgaaggaagtcttctgaaatatatccaaacaaaagaacaactcgacgatttacgagggtttcgttcttgtttatgttcatctctgattctgtattcaattgggaagcattttgatcgatagaaccatcgattgaatctgaaaaccctatgtgattatatgtataaaaatacataatattcatataagaggatgagtgtggatctggcttcgaacacccatggaaaccttgacgaacagatttcacagctcatgcagtgcaagcccttaaccgagcccgaggtcaagacattatgtgagaaggcaaaggagatactaatgactgaaagcaacgttaagccggtaaaaagcccggtgacgatctgtggcgacatccacgggcagtttcatgatcttgctgaactttttcgcataggcgggaagtgccccgatacaaattacttgtttatgggggattatgtagatcgagggtattattccgttgaaactgtctcgctgttggtagctctcaaagtacgttaccctcaacgaatcacaattttaagaggaaatcatgaaagccgtcagatcactcaagtctatggattttatgacgaatgccttcgaaagtatgggagtgctaatgtttggaagacttttacagatctctttgattacttcccattaaccgcattggttgaatcagaaatattctgtcttcatggtggtttgtcaccttcaattgaaactcttgatagtataagaaattttgaccgtgtacaagaggtcccacatgaaggtccaatgtgtgatcttttatggtccgacccggatgaccgatgcgggtggggcatttcgccccgtggagcgggttacaccttcggccaagatatttccgagcaatttaatcatacaaacagcctaaagcttattgctagagctcatcaattggtcatggagggattcaactggggacatgagaaaaaggttgtgactatttttagtgcaccgaattattgctatcgatgtgggaatatggcgtctattttggaagtggatgattgcaagggtcacacgtttatccagtttgatcctgctccaaggagaggagagcctgatgtaaccagaagaacgcctgattatttcctgtgagctttaatagctgatggatgttttttgcaattttcttttttgtttggtcaaagtttgattagtttaaattaagttacataaaattaaacatttgtattaattaagcaattgcccttgggaggtgttctatttgcttcttagtataatttattggttatgtttgctttct

SEQ ID NO: 3653 - DNA, 1693 bp, Panax ginseng
cacacttccactaaccgagaacgaagaagaagaaacaaaactgattattagggtttgaaagaaaattctaataataaaggaaaattgaatcttcaagggacaagaaaaatgaacttcgatctggtgcagccgagcgccaatggaaatgtcgatgaggaaattgcccagcttatgcagtgcaagcccttgtctgagcaagaggttagggtgctgtgcgagaaggctaaagagattctaatggaagaaagcaatgtacagcctgtcaaaagcccagtgacgatttgtggtgatattcatgggcaattccatgatcttgcagagctgtttcgaattggagggaagtgtccagatacaaattacttatttatgggagactatgttgatcgtggctattattcagttgaaactgtaacgcttttggtagctctcaaagtgaggtattcacaacgaattactattttgagaggaaaccatgagagtcgtcagattactcaagtatatggcttttatgatgaatgcctaagaaagtatggtaatgccaatgtgtggaagatctttacagatttatttgactattttccccttacagcattggttgaatcagaaatattttgtctccacggtgggttgtcaccttcaattgaaacccttgataatatacggaattttgatcgtgttcaagaagttccccacgagggacctatgtgtgatctcttatggtctgaccctgatgatcgttgtggttggggtatctcgcccaggggtgctggatatacttttggccaagatatatctgagcaatttaatcataccaacaacttgaagcttattgctagagcacatcagctggttatggagggattcaactggggccatgagcaaaaggtggttactatatttagtgcaccaaattattgttatcgatgtggaaacatggcatccattttagaagtagatgattgcaaaggatacaccttcattcagtttgaaccagctcccaggaggggagagcctgatgtaactcgaagaacaccagactatttcctatgatgcagtagttagtttctaaaatttgaagccgtgagtgcctgctaattgctatgtgtttgggagctaccaaaaatatttgcattgataattactatgctggagtgggtagtgaaaaagcatgtaaaatgggcagtgtaacatatacaaagattcagttattatcctggaactggatggtgctctactgtggacgaggcagaggagctggtgagactgcttgctgcatactgtaccatttcctgcttaaaaatgcggaatcatctctcttcattccatttaacctctagttatgttcattttttgtccagtgtagaaggatggaccatttggggggtgtggggttatgtagatgcaaaaatatttttggtgttttttttctttcttttcaatcgtttagagggtgctgttaattattttgtttactagttgactcaacctatttaagttttttggttatttttcgcctagtagtagctgtgtaactatgggatgggatggttgtttctttttttttttcacttctttcaatatagaaggtaatgcattttgggctggctgtttagatgacatcaattggtgcaacttggtggtctctctatgctgttattttttgttttgtttttatgctaaaaatgtgcccaac

SEQ ID NO: 3654 - DNA, 1641 bp, Nicotiana benthamiana
aatcgctgtccccattttgtttgtttcctctttcttttttataatctctaggactcagtacgtagcagatcgaaaatttcaaataaataaataaatcaaattttgacaaagtcgataaagagtagatcgacaaatttcgagggctttctctcgcatttctcttttcttcttctttcccacaagagaaaaaaaaaaaaaaagcaaagggcgtttgtgggttgcggaaaaaatattcacaaatttattcaagaaatatattggaaaaagggtcttaattcttgaagttgaaattttgaggtgtagaaaatgagttcttcggatctggtagcagcgagcacacagggtaatctggatgagcagatttctcagctaatgcagtgcaagcctctctctgagcctgatgttagaacattatgcgagaaggccaaagagatactaatggaagaaagtaatgttcagccagtaaaaagccctgtgactatatgtggtgatatccatggacaattccatgatctcgccgagctttttaggattggtggacagtgtccagatacaaattatctgtttatgggtgattatgtcgaccgtggatattattcagtcgaaactgttaccctattggtagctttgaaagtacgttatccccagcgattgacaattctcagaggaaatcatgaaagccgacagatcacacaagtctatgggttctatgatgagtgcttgcggaagtacggcaatgctaatgtctggaaaacatttactgatctatttgattatttccctttgacagcattggttgaatccgaaatattttgtttgcatggaggattatctccatctattgaaacccttgataatgtaagaagttttgaccgtgtccaagaagttccacatgaaggggccatgtgtgatcttttgtggtcagacccagatgatcgttgtggctgggggatgtcaccccgcggtgctggatacacttttgggcaggacatctccgagcaatttcaccaaaccaacaatctaaagctgatagctcgagctcatcagctggtcatggagggatataactggagccatgaacaaaaggttgtcactatttttagtgcaccaaattattgttatcgatgtggaaatatggcctctattttggaggttgacgactgcagagggcacacgtttatccagtttgatccagctccaagaaggggagaaccggatgtaacacgaagaacccctgattacttcttataaaaatggtcaactatttctgttgtcttccaattgcttgttttgctatattttccatctgccgtcgagatatgagcataattatggcaaagctagctactcttgggaggtaatccacggacctagaagcttgtaaaacgctagaccaggtcccctcggtttaagtcatattctaacctatgttaggaattattagagtgggaaagtgcagcaagctgtattgtatcatttcatggagacttctttgcggttgttccattcttgttccgatcttcagtcttagtgtgatatttctctcaaagttttcgtatgttgttgcaaggaagtatgttgtgtaaagttaaaaatccactttacagtgtaacttttaccttgttaatgcagccgatcctt

SEQ ID NO: 3655 - DNA, 1266 bp, Rosa hybrid cultivar
agtgtggagggctaattaggtaattgaagcattaccacgtggcagcgggtggcgtaaaatgcaacgagcgtcctatatacccactcgctccttagttcacgcgcccccctctcatttttttttgtctccgtccgctctcgccctctctctgctttaagcgcgagatcagagagtgaggaccggaaggttggccctaaatccgagtaccacttatcccaatccattcgatttccgaagcagagagagagagagagagagagagacgaggagcaatatgggcgtgaattcggcatcctccgattccggcaacgatctcaacgagcagatcgagcagctcatgcagtgcaagccactctccgagcaacaggtgagagtgctatgcgagaaggcaaaggaaatcttaatggaagaaagcaatgtccagcctgtgaaaagcccggtgacaatttgtggcgatattcatgggcagtttcacgaccttgcggagctctttcgaatcggagggaagtgtcccgataccaattacttatttatgggagattatgtggaccgtggctattattcggttgaaactgtaacgcttctagtggccctgaaagtgcgttatcatcagcgcatcactattcttagaggaaaccatgaaagtcgtcagattactcaggtttatgggttttatgatgaatgtcttcgcaagtatgggaacgccagtgtatggaagaccttcaccgacctttttgactactttccactgacagcattggttgagtcagagatattttgtctgcatggtggattatcaccttcaatcgaaaaccttgataacataaggaattttgatcgtgttcaagaggttccgcatgaagggcccatgtgtgatctgttatggtctgacccagatgaccgatgtggttggggtatttcacctcgcggtgcaggatatacctttggccaggatatatctgaacaattcaatcatacaaatagtttaaagttgattgcaagagctcatcaattggttatggatggattcaactgggcccatgaacaaaaggtggttaccatattcagtgcacctaattattgctatcgctgtgggaacatggcgtctgttttagaagttgatgactgcaggggccatactttcatccagtttgagcctgctcctaggagaggggaaccggatgtcactcgtagaacacctgattactttttatgaagcagctgcgatggtgtcatttatttcgtagctctaccactttctgatgc

SEQ ID NO: 3656 - DNA, 1473 bp, Fragaria vesca
gcccctcctctctctctctgctttaagcgcgatcagagagcgaggaccggagccaatatcataatctggggttagggttgtccctaatccgaaaccaatacccactatccccaattccattcgattttcgaagatgggcgtcaatttggcttcctccgattccagcaatgatctcaacgagcagatcgagcagctcatgcagtgcaagccactctccgagcaacaggtgagagcgctatgcgagaaggcaaaggaaatcttaatggaagaaagcaatgtccagccggtaaaaagccctgtgacaatttgtggcgatattcatgggcagtttcacgaccttgcagagctttttcgaattggagggaagtgtcccgacaccaattacttatttatgggagattatgtggaccgtggttattactcagtcgaaactgtgacgctcctagtggccctgaaagtgcgttatcatcagcgtatcactattcttagaggaaaccacgaaagccgtcagattactcaggtttatgggttttacgatgaatgtcttcgcaagtatgggaatgccagtgtatggaagaccttcaccgacctttttgactactttccactgacagcattggttgagtcagagatattttgtttgcatggtggattatccccttcaattgaaaaccttgataacataaggaattttgatcgtgttcaagaggttccacacgaagggcccatgtgtgatctgttatggtctgacccagatgacagatgtggttggggtatttcacctcgtggtgcaggatatacttttggccaggatatatctgaacaattcaatcatacaaatagtttaaagttgattgcaagagctcatcaactggttatggatggattcaactgggcccatgaacaaaaggtggttaccatattcagtgcacccaattattgctatcgctgtgggaacatggcatctgttttagaagtcgatgactgcaggggccatactttcatccagtttgagcctgctcctaggagaggagaaccagatgttactcgtagaacacctgattactttttgtgaagcagctgcggtggtgtcgtttatttcatagctctaccactttccagtgcatggttgcacattgttttgcacaagatgaccattggttttaaattataaacccttcctggctggttatagcaatattccaaaaggatgtaaaatacaaaggtaaggtgtctgctgattgtcttagacctgaaccttgctggatttcccatcaaatagtttgcctagttgttgacactgtcagattgtattatatccagcagaagtatgtggataatccctcattgtttgttttcattttttgtaattgttctttttcatcttgtatgttttgtcacccttcccagtttgggccctcaaggatgcttgaacttaattattagtggatgatttcctttttatccgattac

SEQ ID NO: 3657 - DNA, 1362 bp, Helianthus annuus
aaccttttcttctcaaattcactcactcgctctacaatctccacacctgaattccaatcaatctattcttcaaacccctatctgtcttcacaaaaatacacacacacacataaaaatgagtgtagagcttgcatcggacacccatgggaatctggacgagcaaatttcacagctcatgcagtgcaaacccttaatcgaacctgaggttaggacattatgtgacaaggcaaaggagatattaatagatgaaagcaatgttcagccagtaaaaagcccggtgactatttgtggtgacattcatgggcaattccatgatcttgctgaactttttcgtattggaggaaagtgcccggatacaaactacttgtttatgggggattacgtggatcgagggtattattctgttgaaactgtcacactcttggtggctctgaaagtacgatatcctcaacgaattactattttaagagggaatcatgagagccggcagattactcaagtatatgggttttacgatgaatgccttcggaagtatggcaatgcaaatgtttggaagacatttacagatctatttgattatttcccattgaccgcattggttgaatcagaaatattttgcctccatggtgggctgtcaccttctattgaaaccctagataacattagaaattttgatcgcgttcaagaggtcccacacgaggggcccatgtgtgatcttttatggtctgacccagatgaccgttgtggttggggtatctccccccgtggtgctggttacacgtttggtcaagatatatcagagcaatttaaccataccaacagcctaaagcttattgctcgagctcatcaactggtcatggaaggatttaactggggacatgaacaaaaggtggtcaccatctttagcgcacctaattactgttacaggtgtgggaatatggcttctatcttggaggtcgatgattgcaagggacacacatttatccagtttgaacctgctcccaggagaggtgaacctgatgtaactagaagaacgcctgattattttctgtaagactgatgctcgtcggatgatcgtgtgaggacctgatgtaactagaagaacgaatgctcattggatgatcgtgtaccggacatcgttatgatggtttcctgggtcaagttacactctaacctaggattttgctgttgactgtccgacaatgtaatttttcattattttgtttgtaggtttttgtgtgtaatcttatgtatatggaccttgtttcatattcttttctttcgcccatttttctattagtccgactatatacatgttttggtgcgcactacttgatgtattagtacagagtcttcttcatc

SEQ ID NO: 3658 - DNA, 1553 bp, Nicotiana tabacum
caaatttcgagggctttctctttcatttctcttcttttcttcttcttcttcttcttcttcttcttcttcttcttcttcttcttctttcccacaaggaaaagaaagaaagaaaactaaagggcttttgtgggttgtggaaaaaatattcacaaaatttattcaagaaatatattggaaaaaaggttcttaattcttgtagttgaaattttgagttgtagaaaatgagttcttcggatctggtagcagcgagcatacagggtaatctggatgagcagatttctcagttaatgcagtgcaagcctctctctgagcctgatgttagagcattatgcgagaaggccaaagagatactaatggaagaaagtaatgttcagccagtaaaaagccctgtgactatatgtggtgatatccacggacaattccatgatctcgccgagctttttaggattggtggacagtgtccagatacaaattatctgtttatgggtgattacgtcgaccgtggatattattcagtcgaaactgttaccctattggtagctttgaaagtacgttatcctcagcgattaacaatcctcagaggaaatcatgaaagccgacagatcacacaagtctatgggttctatgatgagtgcttgcggaagtacggcaatgctaatgtctggaaaacatttactgatctatttgattatttccctttgacagcattggttgaatccgaaattttttgtttgcatggaggattatctccatctattgaaacccttgataatgtaagaagttttgaccgtgtccaagaagttccccatgaaggggccatgtgtgatcttttgtggtcagacccagatgatcgttgtggctgggggatgtcaccccgcggtgctggatacacttttgggcaggacatctccgagcaatttcaccaaaccaacaatctaaagctgatagctcgagctcatcagctggtcatggagggatataactggagccatgaacaaaaggttgtcactatttttagtgcaccaaattattgttatcgatgtggaaacatggcctctattttggaggttgacgactgcagagggcacacgtttatccagtttgatccagctccaagaaggggagaaccggatgtaacacgaagaacccctgattacttcttataaaaatggtcaactatttctgttgtctcccaatagcttgttttgctatattttccatctgctgtcgagatatgagcataattatggcaaagctagctactcttgggaggtaatccatggaccaagaagcttgtaaaacgctagaccaggtccccttggtttaagtcatattctaacctatgttaggaattattagagtgggaaagtgcagcaagctgtattgtatcatttcatggagacttcttttcggttgttccattcatgttctgagtcttcagtcttagtgtgatatttctctcaaagttttcatatgttgttgcaaggaagtatgttgtgtaaagttaaaaatccactttacagtgtaacttttaccttgttaatgcagccgat

SEQ ID NO: 3659 - DNA, 1395 bp, Zostera marina
cactctttgagtcttctcctttcgttgctcaaacctcgagatcggaatagacgaaaacaaggaggaaagttagggttagggttctcggggatcagagaggtaagatgacggcgggagagaatgtaccgtcttccaatgcgcatgggaacgtcgatgagcagattgtgcaactcatgcaatgcaaaccgttgtctgagcaagaggtaaaaacgttatgcgagaaggccaaggagattttaatggaagaaagtaatgttcagcctgtaaaaagtcctgtcacaatatgtggagatattcatggacaatttcacgatcttgcagaattatttaaaattggtggaaagtgtcctgataccaattacttatttatgggtgattatgtggaccgtggatattattcagttgaaactgtctcgctcttggtggctcttaaagtgcgccattcccagagaataactattcttaggggaaatcacgaaagtcgtcagataacccaagtttacggattttacgatgaatgcctgcgaaagtatggcaatccaaacgtgtggaagacttttacagatctttttgattatttccctctgacagcactggttgagtcagaaatattttgtttgcatggtggtctctcaccatctatcgagacacttgatcacataagaaattttgatcgtgtacaagaagtccctcatgagggaccgatgtgtgatcttctgtggtcagatcctgatgaccgttgtggctggggcatatcaccacgtggtgctggatataccttcggtcaagatatatcagagcaattcaaccataccaatagtttaaaattgatagccagagctcaccaattggtcatggaaggatacaactggggacatgagcaaaaagtggttaccatattcagtgctcctaattattgctatcgatgtggaaacatggcatccatcttggaagttgatgattgcaaggaacatacatttattcagtttgagccagcaccaagaagaggggagcctgatgtaacccgcagaacaccagattacttcctataatttagaaattcaaagtaaccctgctgacctcctgttgcaacaaaaatgttataaagagttgtgatctgcttgctgctaatagttcgtaccagttacactcttcttaaatgctcatttaggagctacttggtatttttgagaggggtggggatattaagtattaactaatgttgatttgtaatttaaatgtatttgttttattgttggggtcttggggagttgtgaatggatggagatgtgggtggaattaatccaaaatctcctttcaaaagtgggatttctattcgtctttgttctttatgtagagtcacgctttatctgctttaatttgaatgatattatt

SEQ ID NO: 3660 - DNA, 1497 bp, Cycas rumphii
atcgtgttatcattttccgtttggttagagagttcgcatcgaaagaagctgcaaggagggtttggagaggatccgattgcagcgacagagctgaagggattccagacatcgaagaagatgagcgcggattcgataccatccaacaccaatggtgaactcgacaaccaaattgcgcagctcatgcaatgcaagcctctctcggaacaagaggtccgattgttatgtgagaaggcaaaagagattttgatggatgaaagcaatgtacagccagtgaagtgtcctgttacaatatgtggtgacattcatggacaatttcatgatctggcagagttgtttcgaattggtggaaagtgtccagataccaattatttgttcatgggcgattatgtggatcgtggatactactcagttgaaactgttactcttttagtggcattgaaggtgcgatatccgcaacgaatcaccattctcagaggcaatcacgagagtcgccagattacccaagtttacggattctatgatgagtgcttacggaagtatgggaatgctaatgtctggaagatttttacggacctttttgactactttccattgacagcactggttgagtctgaaattttctgcctgcacggtggcttgtcaccttccattgatactctggataatattaggaaccttgaccgtgttcaagaagtgcctcatgagggtcccatgtgcgatttattatggtcggatccagatgacaggtgtggatggggaatttctcctcgtggtgctgggtacacatttgggcaagatatttcagagcagtataaccatacaaatggcctaaaacttatagccagagctcaccagcttgtcatggaaggctacaattggggccatgagcaaaaggtggttactatatttagtgcacctaactactgttatcgatgtggaaatatggcatctattctggaagtggatgataacagagggcacacctttactcagtttgaaccagctccaagacgaggagaaccagatgtgactcgaaggacacctgattattttttatgatttgctctaatgcttatagcttgctgattttttgccagcaagcattccatcttgagatacgccacttttctgatcttgcgagtattgttgatgctgaagctttttgaagtctttattgagttatcttttatccaaattatgcttcgcgaagggtaatttggcgaacatgtactctgatcaggtattttctgtgagggtccttgttccttttagtctgaactttattcttgggaagcacaaatgtgctgccaagtgtatcaattgacgatgtggttttagcttggggagaaaatttattaatgtgttatttcatcccaacattataaactctaagctgggcatagtctgctgattgagtagtctgcccatcccaatttcatagttggtgcctggggcagttacatgttccagcacttaatgtagttgtgatgtaatgtg

SEQ ID NO: 3661 - DNA, 1270 bp, Glycine max
tgcaaatcaagcactttgcttgttatttcacgcgccctctctccattttgacctccctttcctcttcgttccccactcactgcaacggcgccggagatccgtcgctctcctcctcctcctcctcctcctcctcctcctccgccgcgatgggcgccaattccatgctctccgagtcctctcacgatctcgacgaccagatctcccagctcatgcagtgcaagccactctccgagcaacaggtcagaggtttatgtgagaaggctaaggagattttaatggatgaaagtaatgttcagcctgttaaaagccctgtgacaatttgtggcgatattcatgggcaatttcatgatcttgctgaactgtttcgaattggagggaagtgtccagatactaactacttgtttatgggtgattatgtggaccggggttattattcagttgagactgtatcgctccttgtggcactgaaagttcggtatccccagcgaattactattcttagaggaaaccatgaaagccgtcagattactcaagtatatggattttatgatgaatgccttagaaagtatggtaatgctaatgtttggaagacctttacagacctttttgatttttttccattgactgcattggttgaatctgaaatattctgtttgcatggtggactgtcaccttcaattgagacccttgataacataaggaactttgatcgtgttcaagaggttcctcatgaaggccccatgtgtgatctattgtggtctgacccagatgacagatgtggctggggaatttctcctcgtggtgctggatatacttttggccaggatatatctgaacaattcaatcacactaacagccttaaattgattgctagagctcatcagcttgttatggatggatttaactgggctcatgaacaaaaggtggttaccatttttagtgcacctaactactgttaccgatgtgggaacatggcttccatattggaggttgatgattgcaagggtcacacattcatccagtttgaacctgctcctaggagaggagaacctgatgtcactcgtagaacgcctgattacttcttataatgtagctgttgaatgtcatactgttatatcatggttacctctactgcactaatttcaggcaggtaacattccactgattacactcgaggaattgctggacaccttgtctggagaagtcgccaagatgatgtcataatacgtattgttccagcaaaatgtggatattttttgtttgttttttc

SEQ ID NO: 3662 - DNA, 1175 bp, Brassica oleracea
ctttccccgatccgactataggaaggaagaggaagacatgggcgcgaattcgattccgacggacgcaacactcgatcttgatgagcagatctctcagctcatgcagtgcaagcctctctccgagcaacaggttagagcattatgcgagaaagctaaggagatcttgatggatgaaagcaacgttcagcctgtcaaaagtccagtaacaatctgtggtgatattcatggacaattccatgatcttgcagagcttttccgtattggaggaatgtgccctgataccaactatctatttatgggagactatgtcgaccgtggatattattctgtcgaaactgttacgctgttagttggcttgaaagtacggtatcctcagcgaatcaccattcttagaggaaaccatgaaagtcgtcagattactcaagtttatggattttatgatgaatgcttgcgaaagtatggcaatgccaatgtttggaagatcttcacagacctctttgattatttcccactgacagccttggtggagtcggaaatattctgccttcacggtggactgtcaccgtctatcgagacccttgacaacattaggaactttgatcgagttcaagaagttccacatgaaggaccgatgtgcgacttattatggtctgatcctgatgacaggtgtggctggggaatctctcctcgtggtgccggatatacatttggtcaggacatttccgaacaattcaaccacagtaacaacttaaaactgattgctcgagcgcatcagctggttatggatggattcaactgggcacacgagcaaaaggttgttactattttcagtgcaccaaactattgctatcgctgtggaaacatggcctccattcttgaggtcgatgactgccgaaaccacaccttcattcagtttgaaccagccccaaggagaggagaaccagatgtgacccgaaggacacctgactacttcctataaactctcagctgcaaagtcctgttgttggtttttgaagatgtctgcttatttgatttggtacaacgcatctgtgttccaggttgcttctcttgaaaatcgatttgagctcctcccttcgaatagtgtaatataggcaactgaggtcaatgaactttaaaacccctatgaatgtttgtgtttggttgatatgattcag

SEQ ID NO: 3663 - DNA, 1251 bp, Brassica oleracea
agcgagagagagagagagagagcgaagaatacgcagaacccatccaatttagggttagggcggctcctaatcatcatctcctggctcctgatctctcttctcgatctgactagacggaagaagacgcagtatcaaaaacatgggcgcgaattcggttccgacggacgcaacactcgatctagatgagcagatctcccagctcatgcagtgcaagcctctctccgagcaacaggtcagagcattatgcgagaaagctaaggagatcttgatggatgaaagcaacgtccagcctgtcaaaagtccggtaacaatctgtggtgatattcacggacaattccatgatcttgcagagcttttccgtattggaggaatgtgccctgataccaattatctatttatgggagactatgtcgaccgtggatattattctgtcgaaactgttacgctgctagttggcttgaaagtacggtatccccagcgaatcactatacttagaggaaaccatgaaagtcgtcagattactcaagtttatggattttatgatgaatgcctgcgaaagtatggaaatgcaaatgtttggaagatattcacagacctctttgactatttcccactgacagccttggtggagtcggaaatattctgccttcacggtggattgtcgccgtctatcgagacccttgacaacattaggaacttcgatcgagttcaagaagttccacatgaagggccgatgtgtgacttattatggtctgatcctgatgacagatgtgggtggggaatctctcctcgtggtgccggatatacatttggtcaggacatttccgaacaattcaaccactctaacagcttaaaactgattgctcgagcgcatcagctggttatggatgggttcaactgggcacacgagcaaaaggtggttactatcttcagtgcaccaaactattgctatcgctgcggaaacatggcctccattctcgaggttgatgactgcaggaaccacaccttcattcagtttgaaccagccccaaggagaggagaaccagatgtgacccgaaggacacccgactacttcctataaacaagaagtcacctcctctcagctgcatagcccggttgttggtttttgaagatctctgcttattctagttggtacaacgcatttgtgttccagcttgcttctctttaaaatcgatttagcctttgaaatagtgtaatataggcaacgaggtcaatgaacttaaaaacccc

SEQ ID NO: 3664 - DNA, 1260 bp, Brassica napus
gagggttaggcctgccagtaatcgctttccccgatccgactataggaaggaagaggaagacatgggcgcgaattcgattccgacggacgcaacactcgatcttgatgagcagatctctcagctcatgcagtgcaagcctctctccgagcaacaggttagagcattatgcgagaaagctaaggagattttgatggatgaaagcaacgttcagcctgtcaaaagtccagtaacaatctgtggtgatattcatggacaattccatgatcttgctgagcttttccgtattggaggaatgtgccctgataccaactatctatttatgggagactatgtcgaccgtggatattattctgtcgaaactgttacgctgttagtcggcttgaaagtacggtatcctcagcgaatcactattcttagaggaaaccatgaaagtcgtcagattactcaagtttatggattttatgatgaatgcttgcgaaagtatggcaatgccaatgtttggaagatcttcacagacctctttgattatttcccactgacagccttggtggagtcggaaatattctgccttcacggtggactgtcaccgtctatcgagacccttgacaacattaggaactttgatcgagttcaagaagttccacatgaaggaccgatgtgcgacttattatggtctgatcctgatgacaggtgtggctgggggatctctccccgtggtgccggatatacatttggtcaggacatttccgaacaattcaaccacagtaacaacttaaaactgattgctcgagcacatcagctggttatggatggattcaactgggcacacgagcaaaaggtggttactattttcagtgcaccaaactattgctatcgctgtggaaacatggcctccattcttgaggtcgatgactgcaggaaccacaccttcattcagtttgaaccagccccaaggagaggagaaccagatgtgacccgaaggacacctgactacttcctttgaatacagtcacctcctctcagctgcaaagtccggttgctagtttttgaagatctctgcttatttgatttggtacaacgcatctgtgttccaggttgcttctcttgaaaatcgatttgagctcctcccttcgaatagtgtataatataggcaactgagttcaatgaactttaaaacccctatgaatgtttgttgtttggttgaaatgattcagctcccttctgcatcagaatctgttgcatgtgagatattattatttt

SEQ ID NO: 3665 - DNA, 1512 bp, Cichorium intybus
agggtttcgttttctcaaccatcatttgcatattggtttcaccaccaccgctcgcttcccccactgtcttcttcactctcacccccaacccaaaagattcttgcagattttctttttggatctatcatttccccaattcaatatccaatatagagatcttctcatcaaattattggccaagaaaatacccaaaaacaagaaacaaaaatgagctccgctccagttgtctcgagcgctaatggcaacgtcgatgaatatattactcagctcatgcaatgcaaacctttatcagaacaagaggttaggttgttatgtgagaaggctaaggagatattgatggtggaaagcaatgtacagcctgttaaaagcccggtgacaatatgtggtgatattcatggccaatttcatgatcttgcagagctttttcgaattggagggaagtgtccggatacgaattatttattcatgggagattatgttgatcgtggttattactctgttgaaactgtgacattattggttgctttaaaagtgcggtatccacaacgtattactattttaagaggaaaccatgaaagtcgccagatcactcaagtttatggattttacgatgaatgcctccgaaaatacggaaacgcaagcgtgtggaaaacattcaccgatttattcgactacttcccactcacagcattggtggaatctgaaattttttgccttcatggtggattatctccttcaattgaaaccctagataatataagaaactttgatcgtgtacaagaagttccacatgaaggaccaatgtgtgatcttttatggtcagatcctgatgatagatgtgggtggggtatttcaccacgtggggccggatacacatttggccaagatatttctgagcaatttaatcatagtaatggattaaagttgattgctagagcacatcagctggttatggaggggttcaactggggtcatgaacaaaaagttgtgacaatttttagtgcaccgaattattgttaccgatgtgggaatatggcttcgattcttgaagtggatgactgcaagggtcacacctttattcagtttgacccagctccaaggagaggggagccagatgtgacacgtaggacacctgactacttcctgtgagctgagctggcagtagctttttcctgccaactgtctcgataaaatgatgtctgtctggataaagttctgtcggaagcataaagttgatgggtggggggttatatagaagaaggaaagacgatttaacatatgttgttttgattggtgcatgggtccccccccccccccccccccccccccccccccccccccccccccccccccccccccccccccccgactgtagtggtaaagaatattttatgtggacttggtatcttttgcatttgttggtttatttgttaagatgctatttaatttgtggaggtgtttattgaggttttactttcaagttgcattatggggggtgtttgggatggctaa

SEQ ID NO: 3666 - DNA, 1367 bp, Cichorium intybus
aatccaagaaacaaaaaggcgataacaagggtttcgttttctcaaccatcatttgcatattggtttcaccaccaccgctcgcttcccccactgtcttcttcactctcacccccaacccaaaagattcttgcagattttctttttggatctatcatttccccaattcaatatccaatatagagatcttctcatcaaattattggccaagaaaatacccaaaaacaagaaacaaaaatgagctccgctccagttgtctcgagcgctaatggcaacgtcgatgaatatattactcagctcatgcaatgcaaacccttatcagaacaagaggttaggttgttatgtgagaaggctaaggagattttgatggtggaaagcaatgtacagcctgttaaaagcccggtgacaatatgtggtgatattcatggccaatttcatgatcttgcagagcttttccgaattggaggaaagtgtccggatacgaattatttatttatgggagattatgttgatcgtggttattactctgttgaaactgtgacattattggtggccttaaaagtgcggtatccacaacgtattactattttaagaggaaaccatgaaagtcgccagatcactcaagtttatggattttacgatgaatgcctccgaaaatacggaaacgcaagcgtgtggaaaacattcaccgatttattcgactacttcccactcacagcattggtggaatctgaaattttttgccttcatggtggattatctccttcaattgaaaccctagataatataagaaactttgatcgtgtacaagaagttccacatgaaggaccaatgtgtgatcttttatggtcagatcctgatgatagatgtgggtggggtatttcaccacgtggggccggatacacatttggccaagatatttctgagcaatttaatcatagtaatggattaaagttaattgctagagcacatcagctggttatggaggggttcaactggggtcatgaacaaaaggttgtgacgatttttagtgcaccgaattattgttaccgatgtgggaatatggcttcaattcttgaagtagatgactgcaagggtcatacctttattcagtttgacccagctccaaggagaggggagccagatgtgacacgtaggacacctgactacttcctgtgagctgactgctgagctggcagtagctttttcctgccaactgtctgtctggataaaatgatgtctgtctggtgaaatgggcatgtgatgcttcatttgcaattattcgaaagaaaaaaagcgtggcaattcatttggtttacaagtatagcattcgagtagccgttattttccatgattttattttattttat

SEQ ID NO: 3667 - DNA, 1383 bp, Cichorium intybus
gaggaagaagaagggagggacatcaagaaacaaaaaggcgataacaagggtttcgttttctcaaccatcatttgcatattggtttcaccaccaccgctcgcttcccccactgtcttcttcactctcacccccaacccaaaagattattgcagattttctttttggatctatcatttccccaattcaatatccaatatagagatcttctcatcaaattattggccaagaaaatacccaaaaacaagaaacaaaaatgagctccgctccagttgtctcgagcgctaatggcaacgtcgatgaatatattactcagctcatgcaatgcaaacctttatcagaacaagaggttaggttgttatgtgagaaggctaaggagatattgatggtggaaagcaatgtacagcctgttaaaagcccggtgacaatatgtggtgatatccatggccaatttcatgatcttgcagagctttttcgaattggagggaagtgtccggatacaaattatttattcatgggagattatgttgatcgtggttattactctgttgaaactgtgacattattggtggccttaaaagtgcggtatccacaacgtattactattttaagaggaaaccatgaaagtcgccagatcactcaagtttatggattttacgatgaatgcctccgaaaatacggaaacgcaagcgtgtggaaaacattcaccgatttattcgactattttccactcacagcattggtggaatctgaaattttttgccttcatggtggattatctccttcaattgaaaccctagataatataagaaactttgatcgtgtacaagaagttccacatgaaggaccaatgtgtgatcttttatggtcagatcctgatgatagatgtgggtggggtatttcaccacgtggggccggatacacatttggccaagatatttctgagcaatttaatcatagtaatggattaaagttaattgctagagcacatcagctggttatggaggggttcaactggggtcatgaacaaaaagttgtgacgatttttagtgcaccgaattattgttaccgatgtgggaatatggcttcaattcttgaagtagatgactgcaagggtcacacctttattcagtttgacccagctccaaggagaggggagccagatgtgacacgtaggacacctgactacttcctgtgagctgactgctgagctggcagtagcttttttcctgccaactgtctggataaaatgatgtctgtggtgaaatgggcatgtgatgcttcatttgcaattattcgaaagaaaaaaaagcgtggcaattcatttggtttaaaagtatagcattcgagtagccgttattttccatgattttattttattttatt

SEQ ID NO: 3668 - DNA, 1544 bp, Vigna unguiculata
atcaagcatttagttgcttgttatttcacgcgccctctctcttcgtttggaccttctcttgctcactctctgcaacggcgccggagattcgtcgctcatattctccaccgccgcgatgggcgccaattccatgctctccgaattctctcacgatgtcgacgatcagatctcccagctaatgcagtgcaagccactctccgagcaacaggtcagagttttatgtgagaaggccaaggagattttaatggatgaaagtaatgttcagcctgttaaaagcccggtgacaatttgtggcgatattcatggacagtttcatgatcttgctgaactgtttcgaattggagggaagtgtccagacactaactacttgtttatgggtgattatgtggatcgcggttactattcagttgagactgtaactctccttgtggcactgaaagtgcggtatcctcagcggattactattcttagaggaaaccatgaaagccgtcagattactcaagtgtatggattttatgatgaatgccttcgaaagtatggtaatgctaatgtttggaagacctttacagatctttttgattttttcccattgacagcgttggttgaatcagaaatattctgcttgcatggtggactttcaccttcaattgagacccttgataacatacggaactttgatcgtgttcaagaagttcctcatgaaggccccatgtgtgatttattgtggtctgacccagatgacagatgcggctggggaatttctcctcgaggtgctggatatacttttggccaggacatatcagaacaatttaatcacacaaacagcctcaagttgattgctagagctcatcagctggttatggatggatttaactgggctcatgaacaaaaggtggttaccatttttagtgcgcctaactactgttaccgatgtgggaacatggcttccatattggaggttgatgactgcaagggccacacatttattcagtttgaacctgcgcctaggagaggagaacctgatgtgactcgtagaacgcctgactacttcttataaggtagctgttgaatgtcataccggtatatcattgttacctctactgcactaatttcaggtagttgcgcgcatcctcatcatgagattgctttaagcatttatctccattgatatacacgttccgtgcgtttggggttgtccaaagactgctttgatgtataataggcaggtaactttccactgatctgttacactcgagaacttgctgggcaccttgtctggatacgtcgccaagatgatgactatgtcagaattcatattgttccagcaaaaatgtggatattttttgtttgttttcccctctttattatttttttttttaattcttgttcagtaactctcattcgaggctttacaagctatatgactggactttttttgtctcgtggatgtttttgctaagttctatcatttttcagttcaagttgcatgatagtagtgattcagttttgttcttatgttcaacttatcaaaaaaaaaaaaaaaa

SEQ ID NO: 3669 - DNA, 1763 bp, Avena sativa
cagcacagcaaccttccctccctcgttgtctccgcgctacgaccacacttcaccaccaccacgagcgctccgctcctcgtcctcgccgctatctaaactaggctccagcaccgcaattatataaccaccgccccttccacctttccagaccttttgccccctgcccacctctccttccctccttccgcggtcctccccacgcacgctcgcgcgcgccggcgagatctgcccagggtggacggacctccggcgaggatgagcagcccccatggcggcctcgacgagcagatcgagcggctcctgcagtgcaagcccctccccgaggcagaggttagagcgctatgcgagaaggccaaggagattttgatggaggagagcaatgttcagcctgtaaagagtcctgtcacaatatgtggtgatattcatgggcagttccacgatcttgcagaattgttcagaattggtggaaagtgtccggatacaaattatttgtttatgggagattatgtagatcgtggctactactccgtcgaaactgtcacgcttttggtgtcgctaaaagttcgttaccctcagcggatcaccattctcagaggaaaccatgaaagccgacagatcactcaagtttatggattctatgatgagtgcttaaggaagtatggaagtgcaacggtgtggaaaacgtttacagatctgtttgactacttccccttgacagcactggtcgagtcagaaatattttgtttgcacggtggattatcaccatccatcgagacacttgataacatacgtaactttgaccgcatccaagaagttcctcatgaagggcccatgtgcgatcttctgtggtctgatccagatgatcgatgtggttggggtatttctcctcgaggtgctggatataccttcggacaggatatatcagagcagttcaaccatagcaataacttaagacttattgctagagctcatcagttggtcatggaaggattcaactgggctcatgagcaaaaagtggtcaccatatttagtgcacctaattattgctaccgctgtggaaacatggcatcaatcttggaagttgatgattgcagggagcatacttttatccagtttgagccggccccaagaaggggagagccagatgtaacccgtagaacaccagactattttctgtgatgcgaaactggtgttggcagcaaaggtttgatagctagctgaagtttcctggttgcagataatctttttgccccgtgtgttattcttctttattttttatccatgatgcctttggctaccgcgagctgctttgctgcatcgtgattcaagtgtatacgtacagcctggaagggattcattgtgttctcacctctctaactgatttgatgctctgctcgggggcctgcagctagtgacttttaagcgtcagagcagcatttgtattatgacaggagactatttcattccccatttgtaattcattttttccccctttggacattttcacctaattttcttttcatgattcttgtgtagagatgaacaatgtagttgtgtatggttctgtgttgagcccttaggtcttgttctgaacccgtcttgatttgtcgtatagaaatacttgaagaagagaactagcaccgttttgtgtgtatctgtggggaggaatgtgtggcctggtcactggatattttgtttatcatgcaaatagttgtccaggacaatccatctccaatttgaaccagtatatttttatttgtggc

SEQ ID NO: 3670 - DNA, 1253 bp, Avena sativa
cgccgccgcctccctcgtccacccctcctccctcggtcccctctcccggtagatctggtgacgccggcggccggggggcggagacgaggaggaggagtcgacgcgtgccgcgtgcgaggaggacaggatggggaatccgcatggtggcctcgacgaggagatcgcgcagctcttgcagtgcaagcccctcgccgagccaaagctgaaagcactgtgtgagaaagctaaagaaattttgatggaggaaagcaacgtgcagcctgtgagaagccctgtcacgatatgtggtgatattcatggtcagttccatgatcttgcagaactgttccgaattggtgggaagtgtcctgatacaaattacctattcatgggagattatgtggaccgcggttactattctgttgaaactgtatcgcttctggtggctttgaaagttcgctatccacagcgaattacaattcttagaggaaatcacgagagccgacagatcactcaggtttatgggttttatgatgagtgcttgcggaagtatggaagtgccaatgtatggaaaaccttcacggatctttttgactatttacctctgacagcattggttgagtcggaaatattttgcctgcatggtggactatcaccatccatcgagacacttgacaatgttcgtagctttgatcgcatccaagaagtccctcacgaggggccaatgtgtgaccttctatggtctgatcccgatgatcggtgtggttggggcatttcaccacgtggtgcaggatatacatttggccaggacatttcagaacaatttaaccacaccaatagccttaagctaatatcaagagctcatcagttagttatggagggattcaactgggcacatgagcaaaaggttgtgacaatatttagtgcgcctaactattgttaccgctgcggtaacatggcctcgatcttggaggtggatgattgcagggagcatactttcatccagttcgaccctgccccaaggagaggcgagcctgacgtgactcgaagaacgcctgactatttcttgtaaatgtagcttaggttatttgtttttttacgggatagcttaggttattccggcagcaaacaaaaaaggcgtgtgatagctagatgcgttgtgtgttgtcataatttttgtttgggtctcattctcaagtcaaatggcttcactcctgttgtattcacccggttgtaatttgctcgtgttgggctcaggggtgtgaatatgatgc

SEQ ID NO: 3671 - DNA, 1175 bp, Avena sativa
gtgacgccggcggccggggggcggacacgagggggaggagtcgacgcgtgccgcgtgcctggaggataggatggggaacccgcatggtggcctcgacgaggagatcgcgcagctcttgcagtgcaagcccctcgccgagccaaagctgaaagcactgtgtgagaaagctaaagagattttgatggaggaaagcaatgtgcagcctgtgagaagccctgtcacgatatgtggtgatattcatggtcagtttcacgatcttgcggaactgttccgaattggtgggaagtgtcctgatacaaattacctattcatgggagattacgtggaccgcggttactattctgttgaaactgtatcgcttctggtggctttgaaagtccgctatccacagagaattacaattcttagaggaaatcacgagagccgacagatcactcaggtttatggattttatgacgagtgcttgcggaagtacggaagtgccaatgtatggaaaaccttcacggatcttttcgactatttaccgttgactgcattggttgagtcggaaatattttgcctgcacggtggactatcaccatccatcgagacacttgacaatgttcgtagctttgatcgcatccaagaagtccctcacgaggggccaatgtgtgaccttctatggtctgatcctgatgatcggtgtggttggggcatttcaccacgtggtgccggatatacatttggccaggacatttcagaacaatttaaccacaccaatagccttaagctaatatcaagagctcatcagttagttatggagggattcaactgggcacatgagcaaaaggttgtgacaatatttagtgcgcctaactattgttaccgctgcggtaacatggcctcgatcttggaggtggatgattgcagggagcatactttcatccagttcgaccctgccccaaggagaggcgagcctgacgtgactcgaagaacgcctgactatttcttgtaaatgtagcttaggttatttgtttttttacgggatagcttaggttattccggcagcaaacaaagaaggcgtgtgtggtagctatagatgcgttgtgtgtcgtcataattttttgtttgggtctcattctcaagtcaaatggcttcactcctgttgtattcacccggttgtaatctgctcgtgc

SEQ ID NO: 3672 - DNA, 1633 bp, Populus trichocarpa
tcttattataacttttaacaatattactctaaatctcataaatacaattttcaaaaaaaaaaagaaaaagggaagggaaattatttttcttttcagcctcttaaccaaagtatcagactgtgctgtctcgttcactacccttcccgaaagaaaaactgcgaaaaagaaagacacgagggagtaaaatttgcttgattcaatccagggttagggttacccctcatcgggatatcggcaaacccgattcggtgctaaagatcgatcaagatggggacgaattcgttatcttttgaatcaatcaccgatcttgatcaacagatcgagcaactcatgcagtgcaagcctctctctgaacctcaggttagggcattatgcgagaaagctaaggagatactaatgcaagaaagcaatgttcagcctgtgaaaagccctgtgacaatatgtggcgatattcatgggcagtttcatgatcttgcagaactttttcggattggagggaagtgtcctgataccaattacttgtttatgggggattacgtggaccgtggctattattctgttgaaactgtgacgctcttggtggcattgaaagtgcgctatcaccagaggattaccattcttagaggaaaccatgaaagtcgtcagattactcaggtttatgggttttatgatgaatgtctacgaaagtatggtaacgctaatgtttggaagatcttcacggacctttttgactattttccattgactgctttggttgagtctgaaatattttgtttacatggtggattgtccccaaccatagagacccttgataacataaggaactttgatcgtgttcaagaagttcctcatgaaggagccatgtgtgatctgttgtggtctgatccagatgacagatgtggttggggtatatcacctcgtggtgctggatatacctttggccaggatatatctgagcaatttaatcatacaaacagcttgaagttgattgctagagcacaccagcttgtcatggacggatttaattgggcccatgaacaaaaggtggttaccatatttagcgcacctaattattgttaccgctgtggaaacatggcctccatattggaagttgatgactgcaacgggcacacattcatccagtttgagccagctcccaggaggggagaacctgacgtcacccgtagaacacctgactactttctgtaagcagcctttcgtaataccacttccacttcctcatccgcagcccccctcatgctctcacatacaagttttattatggaagttttattatgcccagctgaaggttatgagacgagaaaagcttgtattataataggcaagttgaatgcctcttctttcttgtcttgtacttgaaaccgcgccggattctttgtgggaatcggctaagctgatgcagacagcgttctaacatttgaatgtaagattcctgtttaatttcaaactttcttgatgctttacgctggagtttttttgaatggtgccttatctctgtgctgtgattgtgcatgtggatgctttgttgaaaatcttgctggcaggatcagttgccaagcaagagatataatcatcgatgacaaaaattataccatcatatacaagaacaaga

SEQ ID NO: 3673 - DNA, 1267 bp, Papaver somniferum
cagcttatgcagtgcaagcccttgtctgaacaagaggtcaggggattatgcgagaaggctaaggagatattaatggaagagagcaatgtacagccagtgaaaagccctgtcacaatctgcggtgatattcatgggcagtttcacgatctcgcagaactttttcgaattggaggaaagtgcccagataccaattacttattcatgggagattatgtggatcgaggttattattccgttgaaactgtaacgctgctggtggctctgaaagtgcgctaccctcagcgaattaccattcttcgaggaaaccatgaaagtcgtcagattacacaggtttatgggttttatgacgaatgcctacggaagtacggcaatgctaatgtatggaaaaccttcacggatctcttcgactactttccattgacagctttggttgaatcggaaatattctgtctgcatggaggactatctccttctattgagaccctcgataatatacgaaattttgaccgtgttcaagaagttcctcacgaagggcctatgtgtgacctcttatggtctgaccctgatgaccgatgtggatggggtatttcaccccgtggagctggatatactttcggccaagacatatctgagcaatttaaccataccaacaatttaaagctgattgctagagcgcatcaacttgtcatggagggattcaattggggacatgaacaaaaagtggttactatatttagtgcacctaactattgctaccgttgtggaaatatggcatccatcttggaagttgatgactgcagagggcacacgttcatccagtttgagccagctccaaggagaggagagcccgatgtgactcgtagaactcctgattattttctatgagagctgcctctacgagttattactgatttcccagcagcaaatctctcttctcactgtctatcttgcttgctggttgacacaagacatgaatgaaggtggtggttccgtttcccaattcttgttagtgtattggattttaagatctctataaattttacctgctatgcctttactttgatggtggtggaggcggcggcaacttcagaaaagcatgtgatgtgggaaggtagggatctactactgtgctgggttggtggtatatctttcaaaagaaggcgactcttcagcagcatgtaacaatttccagcaaagaacatgtgtttttttctatttctttttgttatttatggggatctgtagagggaagaaaagggtattgtgt

SEQ ID NO: 3674 - DNA, 1171 bp, Prunus mume
aatgcaacgcctacacacccactcgctctctccttcacgcgctctctcatttttgtctccgtcctctcacctctgctttaagcacgatcagagagtgaggaccggaaccaatctctgaatctggggttagggttatccctaatccgaataccagtaatcccaattcgattctcgaaacagagagaagcaagatgggcgtcaattctatatcctcggatacgagcagtgatctgaacgagcagatcgaacaacttatgcagtgcaagccactctctgaaccacaggtgcgagggttatgtgagaaagcaaaggaaattctaatgggagaaagcaatgttcagcctgtgaaaagcccagtgacaatttgtggtgatattcatgggcagtttcatgacctggcagagctttttcgaattggagggaagtgtcctgataccaattacttgtttatgggagattatgtggaccgtggttattattctgttgaaactgtgacgctcttagtggccctgaaagtgcgttatcctcagcgtatcactattctcagaggaaaccatgaaagtcgtcagattactcaggtttatgggttttacgatgaatgtcttcgaaagtatggcaatgccaatgtttggaagatcttcactgacctttttgactactttccactgacagcattggttgagtcagaaatattttgcctgcatggtgggttgtccccttccattgaaaaccttgataacataaggaattttgatcgtgttcaagaggttccacatgaagggccgatgtgtgatctgttatggtctgacccagatgaccgatgtggttggggtatttcacctcgtggtgcgggatatacttttggtcaggatatatctgaacaatttaatcatacaaacagtttaaagttgattgcgagagctcatcagttggttatggatggattcaactgggctcatgaacaaaaggtggttactatatttagtgcacctaattattgctatcgctgtgggaacatggcttctgttttagaagtcgatgactgcaggggccataccttcatccagtttgagccagctcctagaagaggagagccagatgttacccgtagaacacctgattactttctgtgaagctggtgcattagtgccatttattttgtggctcttcc

SEQ ID NO: 3675 - DNA, 1323 bp, Raphanus sativus
gattttctctgactcgaagcaagagacagaaaaggtgtaaaatccatcaaattaagggttaggggctgcccccaatcaatctgggaaacctttgatctgttttcccgatccgactagaggaagaagacagcagtaatgggcgcaaattcgattccgacggacgcaacactcgatttagatgagcagatctctcagctcatgcagtgcaagcccctctccgagcaacaggttaaatcattatgcgaaaaagctaaggagatcttgatggatgaaagcaacgttcagcctgtcaaaagcccagtgacaatctgtggtgatattcatggacagttccatgatcttgcagagcttttccgtattggaggaatgtgccctgataccaactatctatttatgggagactatgtcgaccgtggatattattctgtcgaaactgttacgctgttagttggcttgaaagtacggtatcctcagcgaatcactattcttagaggaaaccatgaaagtcgtcagattactcaagtttatggattttatgatgaatgcctgcgaaagtatggaaatgcaaatgtttggaagatattcacagacctctttgactatttcccactgacagccttggtggagtccgaaatattctgccttcacggtggattgtcgccgtctatcgagacccttgacaacattaggaacttcgatcgagttcaagaagttccacatgaagggccgatgtgtgacttattatggtctgatcctgatgacagatgtggctggggaatctctcctcgtggtgccggatatacatttggtcaggacatttccgaacaattcaaccactctaacagcctaaaactgatagctcgagcgcatcagctggttatggagggattcaactgggcgcacgagcaaaaggtagttactattttcagtgcaccaaactattgctatcgctgtggaaacatggcctccattctcgaggtcgatgactgcaggaaccacaccttcattcagtttgaaccggccccaaggagaggagaaccagatgtgacccgaaggacacctgactacttcctttaaacacaaatcacctcctttaagctgcaaagtcctgttggtttttgaagatctctgcttattatatttggtaaaacgcattttgtgatttagccctctcgcttggatagtgtaatgtaggaaacgaggtcaatgaactcttaaaccccaatgaatgtttgtgtttggctgaaattgtttagctcccttctgtatcagaatctttttcatttgagattattttctcgtaattcttcccttatatgacca

SEQ ID NO: 3676 - DNA, 1650 bp, Glycine max
gtgattggagggagtgaagtctttccctccacaagaaaaaaaaatcagaaaaaggaaatgagagattgttggacaccgtgcaaatcaagcactttgcttgttatttcacgcgccctctctccattttgacctccctttcctcttcgttccccactcactgcaacggcgccggagatccgtcgctctcctcctcctcctcctcctcctcctcctcctccgccgcgatgggcgccaattccatgctctccgagtcctctcacgatctcgacgaccagatctcccagctcatgcagtgcaagccactctccgagcaacaggtcagaggtttatgtgagaaggctaaggagattttaatggatgaaagtaatgttcagcctgttaaaagccctgtgacaatttgtggcgatattcatgggcaatttcatgatcttgctgaactgtttcgaattggagggaagtgtccagatactaactacttgtttatgggtgattatgtggaccggggttattattcagttgagactgtatcgctccttgtggcactgaaagttcggtatccccagcgaattactattcttagaggaaaccatgaaagccgtcagattactcaagtatatggattttatgatgaatgccttagaaagtatggtaatgctaatgtttggaagacctttacagacctttttgatttttttccattgactgcattggttgaatctgaaatattctgtttgcatggtggactgtcaccttcaattgagacccttgataacataaggaactttgatcgtgttcaagaggttcctcatgaaggccccatgtgtgatctattgtggtctgacccagatgacagatgtggctggggaatttctcctcgtggtgctggatatacttttggccaggatatatctgaacaattcaatcacactaacagccttaaattgattgctagagctcatcagcttgttatggatggatttaactgggctcatgaacaaaaggtggttaccatttttagtgcacctaactactgttaccgatgtgggaacatggcttccatattggaggttgatgattgcaagggtcacacattcatccagtttgaacctgctcctaggagaggagaacctgatgtcactcgtagaacgcctgattacttcttataatgtagctgttgaatgtcatactgttatatcatggttacctctactgcactaatttcaggtagttgcgcatcctcatatcacgagattgctgtaaacatttaaatccatggatatacacgttccgtgcttttgggggttgtccaaagactgctttgatgtataataggcaggtaacattccactgattacactcgaggaattgctggacaccttgtctggagaagtcgccaagatgatgtcataatacgtattgttccagcaaaatgtggatattttttgtttgttttttcgtgtttattttttgtctcttatgttcagtaactcccttttatggctttacaagctatatgactggattttgttgctcgtggatgtttttgtcgtgttctatcatttttcagttaaagttgcatgacatagtgattcagttttgttcttacgaattatgttcaacttatacgtttatcatttatctgctattttc

SEQ ID NO: 3677 - DNA, 1725 bp, Rosmarinus officinalis
cggccggggggaaagaaaatttccaccaaatatatttccacatcatccgtaaccatataactgttgccaaacaaattccaactaactgtaaattacggcaacctgagagggctttaaggtaatttcgaattcccttggaattcctcgccactactctctactctccagtttccagtatccacctgtcaccttcttcgcccagagcgagaaaaagcaaccaacggagggatcgatcgcttcggaaaatcgagaaatctagggtttattccgtacctgatggatgcggcggtggcttcgggcggtggcgaaggaaccaatggcaacctcgacgaacaaattgcgcagctcgtgcagtgcaaacccttgtccgagcctgaggtaaggatgttatgtggcaaggccaaggagatcctgatgcaagagagcaacgtgcagcctgttaaaagcccagtaactatatgtggtgatattcatggtcagttccatgatcttgctgagcttttccggattggtgggaagtgtccggatacaaattatttgtttatgggagattatgttgatcgaggatactactctgtggagacagtgacgctcttggtggctttgaaagtgcgttatcctcaaaggatcactattctacgtggaaatcatgaaagccgccagattactcaggtttatggtttttacgatgaatgcctaagaaaatacggaagtgctaatgtgtggaagaccttcacagatttatttgacttctttcctcttactgcactggttgagtcagaaatcttctgtcttcatggtggattgtctccatccattgaaacacttgataatatccgtaatttcgatcgtgttcaagaagttcctcatgaagggcctatgtgtgaccttttatggtctgatcctgatgatcgatgtggttggggcatctctcccaggggtgctggatatacatttggccaagacatatcagagcaatttaatcataccaacaacttgaagcttattgctagagctcaccagctggttatggaggggtttaactgggctcatgaccaaaaggttgttacaatctttagcgcacctaattattgctaccgctgtggaaacatggcatctattcttgaagttgatgattgcaggggtcatacattcattcagtttgagccagctcccagacgtggtgagccagatgtgactcgaagaacaccagattactttctctgagtagctggaggggttgccgagttcagttaggcagattcctgctagctgctttgtgtgttgatatctgcctataatttttctaaaaatatactgcaagtatcaatcttttggtggtagaaagcatacaaaagaagttcggtgctgccttcttcagttcacatacactgcaaaagagccagtggagctggctgtgctgtccattcacatacactactgatgcaaagatgtggaattttcccccactttctcgttttttccaatttttgcttaccatattttgtactagactacattaaatttttctctctctccaaaacttgtcttctcatttgagaaaatacaaaaggttgtagaggagagagttttatcacttcctaaatatctcagtggatgctgttatgtatttgtgaccctatatcggtcttttttcttgcaattaatgaatggtcttttgatcccttcgagcagggcagttcatgagctgctatctccgaccga

SEQ ID NO: 3678 - DNA, 1331 bp, Rosmarinus officinalis
atgaacagtttaaaataaaatagcagatagccaagatttgatcgtctctttcctcttccctctcttcatcgttaccaccaccatccccgcctctctccctctccatgtagatacaattttttacagtaattattatcctaggatcctcaccatttccgacacaaaaaggtgacgtcgtatcggacgtcggcggatctgataccaatcagaaattgaagcaagatgagtgcggatctgggggctccgaccgcccatgggaagctggacgaacagatttctccgcttatgcagtgcaaacccttgtctgagcccgaggctagaacattatgtgagaaggctaaggtgatactcatgcaggaaagcagtgtccagcctgtaaaaagccctgtaacaatatgcggtaatattcatggacaatttcacgaccttgctgaactattccgcataggagggaagtgtccagacacaaactatctatttatgggagattatgttgatcgtggttactattcagttgaaacagttacactactagtggcgttgaaagtgcgctatcctcaacgtatcacaattcttagaggaaatcatgaaagtagacagattacacaagtgtatggattttatgatgaatgtctcaggaagtatgggagtgcgaatgtttggaagacattcacggacctatttgactattttcctttgaccgctttggtcgaatcagaaatcttttgtctgcatggtggattatccccatccattgaaacccttgataacattagaaactttgatcgtgttcaagaagttccacatgaaggtcccatgtgtgatctattgtggtctgatcctgacgatcgttgtggttggggcatatccccacgtggtgccggatatacttttggccaggacatctcggagcaattcaaccacacaaacaatttaaagctaattgctagagctcatcaactggtcatggagggatataactgggcacatgaacaaaaagttgtcactatttttagtgcacctaattattgctaccgctgtggaaatatggcatccattttggaagttgatgattgcagggagcatacatttatccagtttgagccagctccaaggagaggggaacccgatgtgacccggagaacacctgattatttcttgtagagctgactgttgctataggcatggcagtccgatttgaggtggtgaggggccatttgtggagatccgagtttcaaagaggcttgatataatgcacaaggtcgtttagggtccctagttgtgggaagttggggtagtgatgatgcttctgtttattgtcttctgtaatt

SEQ ID NO: 3679 - DNA, 1344 bp, Amaranthus tuberculatus
tctctctaacattttctctctcttcacggagaaaatctacggtgacgtcaaggtgaagggatatcggtggggattggtggagatcttttagggtttcccaaaatgagtttcgatccagttccttctaattctcattacaatcttgatgagcagatcgctcagcttatgcaatgcaaacctctttcagaacaagaggttagggtgttgtgtgacaaggccaaggaaatactgatggatgaaagcaatgttcagcctgtgaaaagtcctgtgacaatttgtggtgacattcatgggcagtttcatgatcttgcagagctttttcgtattggggggaagtgtccagatacaaattacttattcatgggtgattatgttgacagaggatattattcagtggaaaccgtaacgctcctggttgcacttaaagttcgctatccccaaaggatcactattcttagagggaatcacgaaagtcgtcagattactcaagtttatgggttctatgatgagtgcttacggaagtatggaaatgccagtgtttggaagacttttacagatttatttgattattttccactgactgcattggttgaatctgaaatattttgcctgcatggtggactgtcaccttccattgaaacacttgataatatacgaaattttgaccgtgtgcaagaagtaccgcatgagggacctatgtgtgatctcttgtggtctgaccctgatgaccgttgtggttggggtatatcacccagaggagcaggatacacttttggccaagacatatctgaccaatttaaccataccaatagcctaaaattgattgccagagctcatcaactggtgatggagggattcaactgggctcatgaccaaaaagtggtaacaatctttagtgctcctaattactgttatcgttgtggaaatatggcatccatcctcgaggtagatgattgcaaaggccacacatttattcagttcgagccggctccaagaagaggagagcccgacgtcacccggaggacacccgattatttcctgtgatttcaagttgtcaatgacagatggtttctggtggtgggaaaagcctcttacctgatctcctatgttattgagcatgtatatcacagattaagggtggttattctcctgtggtgatattgattgcttgcccatcacattatacagcagaaatctgtcttttgactcagatgcttcttcattatggtaaatctcgctaatgaagaagctttggagcttgtacgaggatatgtactaattctcagcaaaactttgtggtatctttaacgcctattttttgttgctctctctgtcctttcgttc

SEQ ID NO: 3680 - DNA, 1274 bp, Arnica chamissonis
tgccatttcaaaatctgttatacaaaattacagattacagatcttcctgtcaatttattggccaacaaaaatatcaacaagatgagcatgggtccagatgtctccagcactaatggcaacatcgatgaatatatttcacagctcatgcaatgcaaaccgttatcagaacaagaggttagggtgttgtgtgagaaggcgaaggagatcttgatggtggaaagcaacgtgcagcctgttaaaagcccagtgacaatctgtggtgatattcatgggcaattccatgatcttgcagagctatttcggattggagggaagtgcccggatacaaattatttatttatgggagattatgttgatcgtggttattactcggttgaaacagtgacgttattggtggccctcaaagtgcgttatccacaacgcatcactatattaagaggaaaccatgaaagtcggcagattactcaagtttatggattttatgatgaatgcctacgaaaatatggtagtgctagcgtgtggaagacttttacggatttgttcgactattttccacttaccgcattggtggagtctgaaatattttgcctgcatggtggattatctccttcaattgagagccttgataatataagaaattttgatcgtgttcaagaagtgccccacgaggggccaatgtgtgatcttctttggtcagacccggatgatcggtgtggctggggtatctcccctcggggtgccggatacacatttggccaagacatatctgaacaatttaatcatacaaacgggttaaagctcattgctagagcgcaccagctggttatggagggattcaactggggtcatgaacaaaaagttgtgacaatctttagtgcacctaactattgttaccgatgtgggaatatggcttccattcttgaagtagatgactgcaaaggtcacaccttcattcagttcgacccagctcctaggaggggtgagccagatgtgactcgcaggacaccagattactttctgtgaggttgcagattcggtcccttttggactagcttttgcccatctgctgcagtgtcgcattttaccattatcatgtaaaatgggcaatataacataagcctagtataggcttgcatttacaaggaaaaagcgggcaactgttgcaggctaatttgtatcatctcgcgtttcttttttgctatgtttttttgttctgttggtataagcatgaagttgtggggtgggaatatatatagaagaaagacggtttgaaa

SEQ ID NO: 3681 - DNA, 1576 bp, Artemisia annua
aaaacacatctttggatcttatatttcaccaatccaataacccatcttttttctttttttatcaaattaattatcacccaaataataataataataataataatataaaaagagatgagcttgggtccagctgtttcaaacgctaatggaaacgttgatgaatatattattcagctcatgcaatgcaaacccttatcagaacaggaggttagggtgttatgtgagaaggctaaggagatcctgatggtggaaagcaatgtacagcctgttaagagcccagtgacaatctgtggtgatattcatgggcaatttcatgatcttgcagagctctttcgaattggagggaagtgccccgatacaaattatttattcatgggagattatgtggatcgtggttattactcggttgaaacagtgacgttattggtggctctgaaggtgcgatatccacaacgcatcactattttaagaggaaaccatgaaagtcgtcagattactcaagtttatggcttttatgatgaatgcctacgaaaatatggtaacgctagcgtgtggaagacgtttacagatttgttcgactattttccacttactgctttggtcgagtcagaaattttttgccttcatggtggattatctccttcaattgagacccttgataacataagaaattttgatcgtgttcaagaagttccacacgaggggccaatgtgtgatcttttatggtcagacccagatgaccgatgtggttggggtatctcacctcgtggtgctggatacacatttggccaagatatctctgaacaatttaatcatgcaaatgggttaaagctcattgctagagcacatcagctggtgatggagggattcaactggggtcatgaacaaaaggtcgtgacaatttttagtgcaccgaattattgttaccggtgtgggaatatggcttccattcttgaagtagatgactgcaagggtcacaccttcattcagtttgacccagctcccagaagaggtgagccagatgtgacccgtaggactccagattacttcttatgaggttgcagctgcatgcccttttggaccagcttttgcccggtcagctgaaatggtggttcatgcgattaccatgcaaaatgggcaggtgatgcttcatctgacataagccagataggggctgcggtcattgggaaagaagtgcatcagcaatccttgtgactcgttacatcatcatcatcatctagtgcttattttctgctctgatcatttatgtctgttgttagtagaagcataaagttgttgggtggggatacatagaagaaagacaatttaacatcatgtcttttgattgaagcctgatattgttctttttttgttgtcatattttttgactgtagttaatgaacatttgctgttgactttactactgtgcatttgttgttaattcgtaagaggtggtttttgcgtttgttctctgtattttgtaatagtcggcgtgtttgtttaaagatatcaattgtggtactcgtgttcaagtcaacagttaatgtaggcggtcagtttggctatgtttgataaa

SEQ ID NO: 3682 - DNA, 1556 bp, Musa acuminata
ctctcttgtttccctctctcccttctcctctttcctccctctctctctctcacctcttcgccatttctcgccgtcgaacgcggggtttcttcttcttgagggaggggagggaaggggagaggggctcgtttgcttgggatcgaggcgcgggcgaaatcttggattaaggtttcgatcttgggtcgtggcggcgtttcgaaggctggggaggtgctgaggccaagatgagcgtcaataccgtgccggcttccgcctcccatggcaacctggacgagcagatcgcgcagctcatgcagtgcaagccgctccccgagcaagaggttaggatgctgtgtgagaaggcaaaagaggtattgatggaagaaagcaacgttcagcctgtgaagagccctgtgacaatctgcggtgacattcatgggcaatttcatgatcttgcggaactatttcgaattggtggaaagtgtccagatacaaattacttgtttatgggtgattatgttgaccgtgggtactattctgttgagactgttacgcttttggtggctctcaaggtgcgttatcctcagcggatcaccattctcagaggaaaccatgagagtcgtcagattactcaagtttatggattttatgatgaatgcctgagaaaatatggtaatgcaaatgtatggaagatcttcactgacctttttgattatttcccattgacggcattggttgagtcagaaattttctgcctgcacggtggattatctccatctattgagactcttgatagcatcaggagctttgatcgggttcaagaagttcctcatgagggtcctatgtgtgaccttttgtggtctgatcctgatgatagatgtggttggggcatttctccccgtggtgctggatatacttttggccaagatatatctgagcaattcaaccataccaataaccttaggttgatagccagagctcaccaattggttatggatggatataactggggacatgaacaaaaggtggtaaccatatttagtgcaccaaattattgttatcgttgtggcaacatggcttccatcatggaagtcgatgaatgcaaagggcagacatttatccagtttgaaccagcgccgaggagaggagagcccgatgtgactcggagaacacctgactactttctttaagcagatatcggcgggatactgttgatgtctgacagcaagtgctgcttgctgcgtgaggttatgattgcaaatatattctcaagatctcataattagcattcttatattctcaagatctaatggcaaatatgttgtataatgtggccgtaagttttgccctttattgacgtgtaactgagatccattatggctggtggcaacacggttacgatgcagcagcggcagccgcatgtatcatgttgaaggcattatgttctccccaatttatatattttttttctattattgatttttaattctacttgtgccatttggtcttgctggagagaggggagagggtggacttgattgggctgcctgtgttcggccaaactagtaggccgagca

SEQ ID NO: 3683 - DNA, 1061 bp, Centaurea maculosa
cttcatcttcttcgttatgcctcaaaattaacaattttacaaaatacaaaattcaacaaaattaatccaaaatcgaagatcgaaagatgagcttggatctggtacagcgtgttaatcgcaatgttgatgaacatatcgcccagctcatgcagtgcaaacccttatctgaacaagaggttaggtcattatgtgataaggcaaaggagatcttgatgcaagaaagcaatgtgcagcctgttaaaagcccggtgacaatctgtggcgatattcatgggcagtttcatgatcttgcggagcttttccggattggagggaagtgcccagatacaaattacttgttcatgggagattatgttgatcgtggttattactcggttgaaacagtgaccctcttggtggctctcaaagtgcgttatccgcagcggattactattttaagaggaaaccatgaaagtcggcagatcactcaagtttatggattttatgatgaatgcctaaggaaatatggtagtgctaatgtgtggaaaacatttacggatctatttgactattttccactgactgcattggtggagtctgaaatcttttgtctccatggtggattgtctccttcgattgaaactcttgataatatacggaacttcgatcgtgttcaagaagtgccccatgaggggcccatgtgcgaccttttatggtctgatcctgacgatcgttgcggttggggtatctctcctcgtggtgctggatatacatttggacaagacatatctgagcaatttaatcataccaacaacttgaaactgattgcaagagcacaccagctggttatggagggtttcaactggggtcacgagcaaaaggttgtgacgattttcagtgcacctaattattgttaccgttgtgggaacatggcttcgatccttgaagtagatgattgcaagggtcacactttcattcagtttgaaccagctccaaggaggggagagccagatgtgacccgtaggacgccagattatttcttatgatgctgttttgattcatgggaaatacgcaaattgaaa

SEQ ID NO: 3684 - DNA, 1125 bp, Centaurea maculosa
aatacaagagagaagagtgagtgtggatctagcttcgaacacccatgggagcctggacgaacagatttcacagctcatgcagtgcaagcccttaatcgagcccgaggttaaggcattatgtgagaaggcaaaagagatactaatgggtgaaagcaacgtccagccagtaagaagccctgtgaccatctgtggtgacattcacgggcaatttcatgatcttgctgaactttttcgcataggagggaagtgcccagatacaaattacttatttatgggggattacgtggatcgagggtattattctgttgaaactgtcacgctcttggtggctctgaaagtgcgttatcctcagcgactcacaattctaaggggaaatcatgaaagtcgtcagatcactcaagtttatgggttttatgatgaatgtcttcggaagtatggcagtgctaatgtttggaagacttttacagatctctttgattactttccattgactgcattggttgaatcagaaatattttgccttcatggcgggttgtcaccgtcaatagaaactcttgatagcataagaaattttgaccgtgttcaagaggttccacacgaaggtccaatgtgcgatcttttatggtctgacccagatgaccgttgtggttggggcatttcaccccgtggagctggatacacctttggccaagatatatctgagcaatttaaccataccaacaacctaaagctgattgctagagcccatcaactggtcatggagggattcaactggggacatgatcaaaaggttgtgaccatctttagcgcaccaaactactgctatcgatgtggtaacatggcttctattctggaagtcgatgattgcaaggggcatacgtttatccagtttgatcctgctcctagaagaggagagcctgatgtaacgagacgaacgcctgattatttcctgtaagcaacggaaattgataatgattgctttgcttggtggtccatggtggtccttgccgggattgcgctttttgtttggtacaatggcaatggccaatgatatgtggttaaagttgatgaggagtgcagtgcaagggaaggaccaaatggcttgtaaaatggtttcatttttca

SEQ ID NO: 3685 - DNA, 1695 bp, Chrysanthemum coronarium
cccttaatttagttttcatttcattttcattccatatatcggtttcaccaccaccgctccctccccttccccaccccacttctcttctccttcttcactctcaccccaaaacacatccttggatcttatatttcaccaatccaataatccatcttttttatcaagttaattattacccaaataataatataaaaagagatgagcttgggtccagctgtttcaaacgctaatggaaacgttgatgaatatattattcagctcatgcaatgcaaacccttatcagaacaggaggtcagggtgttatgtgagaaggctaaggagatcctgatggtggaaagcaatgtacagcctgttaagagcccagtgacaatctgtggtgatattcatgggcaatttcatgatcttgcagagctctttcgaattggagggaagtgccccgatacaaattatttattcatgggagattatgtggatcgtggttattactcggttgaaacagtgacgttattggtggctctgaaggtacgatatccacaacgcatcactattttaagaggaaaccatgaaagtcgtcagattactcaagtttatggcttttatgatgaatgcctacgaaaatatggcaacgctagcgtgtggaagacgtttacagatttgttcgactattttccacttactgctttggtcgagtcagaaattttttgccttcatggtggattatctccttcaattgagacccttgataacataagaaattttgatcgtgttcaagaagttccacacgaggggccaatgtgtgatcttttatggtccgacccagatgaccgatgtggctggggtatctcacctcgtggtgctggatacacatttggccaagacatctctgaacaatttaatcatgcaaatgggctaaagctcattgctagagcacatcagctggtgatggagggattcaattggggtcatgaacaaaaggttgtgacaatttttagtgcaccgaattattgttaccgatgtgggaatatggcttccattcttgaagtagatgactgcaagggtcacaccttcattcagtttgacccagctcccagaaggggtgagccagatgtgacccgtaggactccagattacttcttatgaggtagcagctgcatgccctattggaccagcttttgcccggtcagctgaaatggtggttcatgcgattaccatgcaaaatgggcaggtgatgcttcttctgacataaagccaaatgggggttgcggtgattggaaaagaagtgcatcagcaatccttgtgactcgtttacatcatcatcatctagtgcttattttctgctctgattatttatgtctgttgttagtagaagcataaagttgttgggtggggatatatagaagaaagacaatttaacatcatgtcttttgattgaagcctgatatttattttgttatattttttgactgtagttaatgaacatttgctgttgactttactactgtgcatttgttgttaattcttaagaggtggtttcgcgtttgttctctgtattttgttatagttagcgtgtttgtttaaagatatcaactgtggcactcgtgtacaagtgaacagttaatataggcagtcagtttgtatagcatcagtgtactgatggttggggaaataaagtgtaaccttttttatgatgtgtgg

SEQ ID NO: 3686 - DNA, 1669 bp, Chrysanthemum coronarium
cccttaatttagttttcatttcattttcattccatatatcggtttcaccaccaccgctccctccccttccccaccccacttctcttctccttcttcactctcaccccaaaacacatccttggatcttatatttcaccaatccaataatccatcttttttatcaaatcaattattacccaaatattaatataaaaagagatgagcttgggtccagctgtttcaaacgctaatggaaacgttgatgaatatattattcagctcatgcaatgcaaacccttatcagaacaggaggtcagggtgttatgtgagaaggctaaggagatcctgatggtggaaagcaatgtacagcctgttaagagcccagtgacaatctgtggtgatattcatgggcaatttcatgatcttgcagagctctttcgaattggagggaagtgccccgatacaaattatttattcatgggagattatgtggatcgtggttattactcggttgaaacagtgacgttattggtggctctgaaggtacgatatccacaacgcatcactattttaagaggaaaccatgaaagtcgtcagattactcaagtttatggcttttatgatgaatgcctacgaaaatatggcaacgctagcgtgtggaagacgtttacagatttgttcgactattttccacttactgctttggtcgagtcagaaattttttgccttcatggtggattatctccttcaattgagacccttgataacataagaaattttgatcgtgttcaagaagttccacacgaggggccaatgtgtgatcttttatggtccgacccagatgaccgatgtggctggggtatctcgcctcgtggtgctggatacacatttggccaagacatctctgaacaatttaatcatgcaaatgggctaaagctcattgctagagcacatcagctggtgatggagggattcaattggggtcatgaacaaaaggttgtgacaatttttagtgcaccgaattattgttaccgatgtgggaatatggcttccattcttgaagtagatgactgcaagggtcacaccttcattcagtttgacccagctcccagaaggggtgagccagatgtgacccgtaggactccagattacttcttatgaggtagcagctgcatgcccttttggaccagcttttgcccggtcagctgaaatggtggttcatgcgattaccatgcaaaatgggcaggtgatgcttcatctgacatagccagataggggttgcggtcattgggaaagaagtgcgtcagcaattcttgtgactcctttacatcatcatcatcatctagtccttattttctgctatgattatttatgtctgttgttagtagaagcataaagttgttgggtggggatatatagaagaaagacaatttaacatcatgtcttttgattgaagcctgatatttattttgttatattttttgactgtagttaatgaacatttgctgttgactttactatgcatttgttgttaattcttagaaggtggtttcgtgtttgttctctgtattttgttatagttagcgtgtttgtttaaagatatcaactgtggcactcgtgtataagtgaacagttaatataggcggtcagtttgtatagcatcagtgtactgatggttggcgaaataaag

SEQ ID NO: 3687 - DNA, 1408 bp, Cirsium arvense
aaaaggttgtggtgatcgaaggaaaaaggcaaaataaggagggtttcattcgtttctgtatcggttttcaccaccacccactgccctcttcttcactcccaaaaccaaaatttcctcttcttgttcgttcgttcgttcgttatgtatcgccaccacccacaaaattaaattaaaaataaatccatcgattcaaataattgcccaagaaattacccaaaaggaagaaagataaaaagatgagcttggatccagtcgtacagcgcgttaatcgcaatgttgatgaacatatcgcccagctcatgcagtgcaagcccttatctgaacaagaggttaggtctctatgtgataaggcaaaggagatcctgatgcaagaaagcaacgtgcagcctgttaaaagccctgtgacaatctgtggggatattcatgggcagtttcatgatcttgcagagcttttccggattggagggaagtgcccagatacaaattacttgttcatgggagattatgttgatcgtggttattactcggttgaaacagtgactctcttggtggctctcaaagtgcgttatccacagcggattactattttaagagggaaccatgaaagtcggcagatcactcaagtttatggattttatgatgaatgcctaaggaaatatggtagtgctaacgtgtggaagacatttacggatctatttgactattttccgctgactgcattggtggagtccgaaatcttttgtctccatggtggattatctccttcaattgaaacccttgataatataaggaacttcgatcgtgttcaagaagtaccccacgaggggcccatgtgtgatcttttatggtctgatcctgatgatcgttgcggttggggtatctctcctcgtggtgctggatatacatttggccaagacatatctgagcaatttaatcataccaacaacttgaagctgattgcaagagcacaccagctggttatggagggatttaactggggtcatgaacaaaaggttgtgacgattttcagtgcacctaattattgttaccgttgtgggaacatggcttcaatccttgaagtagatgattgcaagggtcacactttcattcagtttgaaccagctccaaggaggggagaaccggatgtgacccgtaggacgccagattatttcttatgatgctgttttgattcaactagctcatgggaaatacgcaaaatgaaaagagcatcatcaacatcatcatcatcaacatcgttttactgggaaatgaggcagcgatcctggtgtaatttgctgctgcacaaatgcagtatcattttttctttcggttttcttgtttgtagaggaaagataaatgtcggtcttttgattgatgtcttttccctttcctgtcttttttttgcttg

SEQ ID NO: 3688 - DNA, 1219 bp, Cirsium arvense
tatccaatataaagctttttttcctatcaaattattggccaaatagatatgagcttgggtccagctgtctcgagcgctaatggcaacgtcgatgaatatatttctcagctcatgcaatgcaaacccttatcggaacaagaggttagggtgttatgtgagaaggctaaggagatcttgatggtggaaagtaatgtacagcctgttaaaagcccagtgacaatttgtggtgatattcatgggcaattccatgatcttgcagagctctttcgaatcggaggaaagtgtcctgatacgaattatttattcatgggagattatgttgatcgtggttattactcggttgaaactgtaacattattggtggccctcaaagtgcgctatccgcaacgcctcacaattttaagaggaaatcatgaaagtcgtcagattactcaagtttatgggttttatgatgaatgcctacggaaatatggtaatgctagtgtgtggaagacgtttacagatttgttcgactattttccgctcactgcattggtcgaatccgaaatcttttgcctccacggtggattatctccttcaatcgagacccttgataatataagaaatttcgatcgtgttcaagaagttccccacgagggaccaatgtgtgatcttttatggtcagacccagatgatcgatgtggttggggtatctccccccggggtgctggatacacatttggccaagatatatctgaacaattcaatcataccaacagcttaaagctgattgcaagagcacaccagctggtgatggagggattcaactggggtcatgaacaaaaggttgtgacgatctttagtgcacctaattattgttaccgatgtgggaatatggcttcgattcttgaggtggacgactgcaagggtcatacttttattcagtttgaaccagctccaaggaggggtgagccagatgtgacccggaggacaccggattactttctatgaggtagcggttgcagtctgtttcgaaccagggtttgggttgggcgtgagccgtgtgctggttcgtgaaccaggtgggtgatggttcgattaacgtagttgaagagggtttggtgaacaagtgtagcaattgtgatttttttttcctctttttttgggtatgtagaagcataaagttgaggggggaattggggagataatatagtagaagaaagacgatttaacatcatga

SEQ ID NO: 3689 - DNA, 1480 bp, Cynara scolymus
gaaaggttgtggtgatcgaaggaaaaggcaaaataaggagggtttccttcgtttctgtatcggttttcaccaccacccactgcctcttcttcactcgctcacatcccaaaaccaatttttcctcctcttgttcgttcgttcgttatgtctcgccacccacaaaattaaattaaaataaaatccctcgattcaaataatttctcaagaaattacccaaaacaaacaaacaagatgagcttggatccagtcgtacagcgcgttaatcgcaatgttgatgaacatatcgcccagctcatgcagtgcaaacccttatctgaacaagaggttaggtcactatgtgataaggcaaaggagatcctgatgcaagaaagcaatgtgcagccggttaaaagtcctgtgacaatctgtggggatattcatgggcagtttcatgatcttgcagagcttttccggattggagggaagtgcccagatacaaattacttgttcatgggagattatgttgatcgtggttattactcggttgaaacagtgactctcttggtggctctcaaagtgcgttatccacagcggattactattttaagaggaaaccatgaaagtcggcagatcactcaagtttatgggttttatgatgaatgcctaaggaaatatggtagtgctaacgtgtggaagacatttacggatctatttgactattttccgctgactgcattggtggagtctgagatcttttgtctccatggtggattatccccttccattgaaactcttgataatataaggaacttcgatcgtgttcaagaagtgccccatgaggggcccatgtgtgatcttttatggtctgatcctgacgatcgctgcggttggggtatctctcctcggggtgctggatatacatttggccaagacatatctgagcaatttaatcataccaacaacttgaagctgattgcaagagcacaccagctggttatggagggattcaactggggtcatgaacaaaaggttgtgacgattttcagtgcacctaattattgttaccgttgtgggaacatggcttcaatccttgaagtagatgattgcaagggtcacactttcattcagtttgaaccagctccaaggaggggagagccagatgtgacccgtaggacgccagattatttcttatgatgctatcttgattcaactggctcatgggaaatacgcaaaatgaaaaagggcataatcatcatcatcatcatcatcatcatcgttttactgggaaatgaggcagcgatcttggtgtaatttgctgctgcacaaacgcagtatcattttttctttcagttttcttgtttgtagaggaaagataaatgtcggtcgtttgattgatgtcttttccttttcctgctttttgctgtttcttataattctttgtgaccttagtaattaagaatactgctattaaattcttccccaggttcactcattctttgtc

SEQ ID NO: 3690 - DNA, 1505 bp, Fagopyrum esculentum
ggaatcgactagacggttacggctagtaagaagcaaggaaatcacgaattttacagatctaagatctgccaataaacgcaaggatgagcttcgatccgatgtcttcgaacactcatcacaacctcgatgaacagatcgtccagctcatgcagtgcaagcccctttccgagcaagaagtgagggctttggctgaaaaagccaaggaaatactgatggaagagagcaatgttcagccagtgaagagtcctgtgacaatatgtggtgacattcatggccagttccatgatcttgcagaactatttcgtattggtgggaagtgcccagatacaaattatttattcatgggtgactatgttgatcgaggatattattcagttgaaactgttacgctgttggtggcactaaaagttcgatatccccaaaggattaccattcttagaggcaatcatgaaagccgtcagattactcaagtgtatggattttatgacgaatgcctacggaaatacggcaatgctaatgtttggaaggttttcactgacctgtttgattacttcccactcactgccttggttgaatctgaaatattttgcctgcatggtggattatccccctctattgagactcttgataacataagaaattttgatcgtgttcaagaggttccacatgaggggcctatgtgtgatctcttatggtctgacccagatgatcgttgtgggtggggtatctcacctaggggtgctggatacacatttggccaagacatatcagaacaatttaaccataccaacagtctaaagctgatttctagagctcaccaacttgtgatggagggatacaactggggtcatgaccaaaaggtggtaacgatatttagtgctccgaattactgttaccggtgtggaaatatggcatccatcatggaagttgatgactgcaaagaccacaaatttattcagtttgagccagcacctaggagaggggagccagacgtaacacggagaacacctgattatttcctgtaatgggggttgcccttatgatgtcaagttgtagaagctaatctacaagttggcagcaacagcataaggatcgagagtggcgacccttttgatttctggagtggctcaagatgggtggatagttgctgcttttccatgaaagtgtgatgagcttcacaaagaaaaggaggcccgtgaaaagatgaagcctttgttgctgcatttgtatcaatgtccgggaaacattgttggtagccttaacaaaattgtttacgtttcttctctattttatttcatttcttcccttgtctcgttcgtgcagtgcggggtagagtattgtagagacatcgagccaacttgtcagttggttttaccctttatggatcttgttacaccatttgattagtttgatgttcacaactgggtgttgccttcatgacccttgctcgtctcaacagcttgcaatggatcatactaatccaaataaaacgtctcggtctagag

SEQ ID NO: 3691 - DNA, 1222 bp, Flaveria ramosissima
ggattcttccttcgaaaccctaattgcctctatacatatgcacaaaatataaacatacatatataaagatgagtgtggagatggcttcggacacccatgggaatctggacgagcagatttcgcagctcatgcagtgcaaacccttaaccgaatctgaggttaggacattatgtgacaaagcaaaagagatattaatagatgaaagcaatgttcagccagtaaaaagccctgtgactatctgtggtgacattcatgggcaattccatgatcttgctgaactttttcgtattgggggaaagtgcccggatacaaattacttgtttatgggggactatgtggatcgagggtattactctgttgaaactgtcacactcttggtggctctgaaagtacggtatcctcagcgaattactattttaagagggaatcatgaaagtcggcagattactcaagtatatgggttttacgatgaatgccttcggaagtatggcaatgctaatgtctggaagacttttacagatctatttgattattttcccttgactgcgttggttgaatcagaaatattttgtctgcatggtgggttgtcaccttctatagaaaccttagataatattaggaattttgatcgtgttcaagaggtcccacatgaggggcctatgtgtgatcttttatggtctgacccagatgaccgttgtggttggggcatctccccccgtggagctggttacacatttggtcaagatatctcagagcaatttaaccatacaaacagtctaaagcttattgctcgtgctcatcaactggtcatggaaggattcaactggggacatgatcaaaaggttgtcactatctttagtgcaccgaattattgttacaggtgtgggaatatggcttctatattggaggtggatgattgcaagggacacacatttatccagtttgaacccgctcctaggagaggagaacctgatgtaactagaagaacgccggattatttcctgtaaaattgagtagctgatgctcatgggatggttgaatattgaacatcaattgggggcttcccgatccaagtcacactctaacctagcatttgctgtcggctatcagaggatgtaatttttcataatttcatttgtaggcttttgtgtgtaatcttatgtatatcgccttgtttcgggatttcttttgtgttctcttctggtttagagatgacaatccg

SEQ ID NO: 3692 - DNA, 1421 bp, Zingiber officinale
gagatttagtttcagaggaagagcgagggagttgggctcgcagggggcgtgtggatcttgttagggtttggattcaaggaggagagaagaaatgagcgcgaacacagttccagcgccgcccagctcccatggcaacctcgacgagcagatcgagcagcttatgcagtgcagaccactgtcggaacaggaggttagagccttgtgtcagaaagccaaagaggtattgatggaagaaagcaatgtgcagccagtgaagagccctgtgacaatatgtggtgacatccatgggcaatttcatgatctggcagagctgtttcgaattggaggcaagtgtccagatacaaactacttatttatgggtgattatgtggaccgtgggtactattctgtcgaaactgttacgcttttggtggccctcaaggttcgatatcctcaaagaattaccattctcagaggaaatcatgaaagtcgtcagattactcaagtttatggattttatgatgaatgcttaagaaaatatggcagtgcaaatgtatggaagaccttcactgatttatttgattatttcccattgacagccctggttgaatcagaaatattttgcctgcatggtgggttatctccgactattgaaacccttgatggcatacggagctttgatcgtgtccaagaagttccacatgagggagctatgtgtgatcttttatggtctgatcctgatgacagacgtggttggggtatttctcctcgtggtgctggatatacatttggtcaagatatatccgagcaattcaatcatactaataaccttaatctgatagccagagcacatcaattagtcatggaaggatacaactggggacatgaccaaaaggtggttactatattcagtgccccaaattattgctatcggtgtggaaatatggctgccatcctggaagttgatgactgtaaaggtcatacattcattcagtttgagccagcccccaggagaggagagcctgatgtgactcgcagaactcccgattactttctctgagtctgctaattaggagttacattcttgatctctcacagcaattactgctcgctaatctgccttgtggttgcagacatttcagatcctatgaccaactcaatatttgtattccaaactgccagaacttagtggtttggatcgaatctatgtagattcatgttgaaagcggcacgtcccagtcatgcaattccttcccatagctttctctctctatttatttttcagtttttaaatcctgtagagggttcgattcaacttgcagactgctttagcaaattcatagattcagttaacctttcagtgcttgcccttgaatttctgtacgttacaatgacttgtcttggtagaataacataaagctataacctagctttccacgtgc

SEQ ID NO: 3693 - DNA, 1667 bp, Phalaenopsis aphrodite
cgcttattttatcgttcgtctcattttacccggctctccgtccctccaccaccgatcccttcactcttctcccaatacggagaaagagagggagagggttgaagatctaggtttacgcaattgctccgatctctgtttttcgcttcgcggctgccggaaaagaagatgagcgcgaatccgatgccagcaagttcccatggaaacctggacgagcagatcgcacagctgatgcagtgcaagccactctccgaacaagaggtcagagtattgtgtgacaaagcaaaggagattttgatggaagaaagcaatgtccagcctgtgaaaagccctgtgacaatttgcggtgacattcatggacagtttcatgaccttgcagaattgtttcgtattggtggaaagtgtccagatacaaattacttattcatgggagattatgtagatcgtgggtattattctgttgaaaccgttacgcttcttgtggcccttaaagtgcgatactctcagagaatcaccattcttaggggaaatcacgaaagtcggcagattacacaagtttatggtttctacgatgaatgcttaagaaagtatggtaatgctaatgtgtggaagatttttaccgatctctttgattattttccattgacagcattggttgagtcagaaatattttgtctgcatggtggattatccccatccatcgagacacttgataacattcgcaactttgatcgtgttcaagaggtccctcatgaagggccaatgtgtgacctactatggtctgatccggatgatcgatgtggttggggcatctctcctcgtggtgctggatatacattcggacaagacatttcagaacaattcaaccataacaacaaccttaagctgattgctagagcgcatcagttagtcatggacggatataactggggtcatgaccaaaaagttgtaaccattttcagtgcacctaactattgctatcgttgcgggaacatggcttccatactagaagttgatgactgcaaaggtcacacatttattcagtttgaccccgcaccaaggagaggcgaacctgatgtaacacgaagaactcctgattattttctataattcatcatccttttatagcatgtcactgatttctggttgcaagtgtagacttgctaagacggcgtacgtaaccggtttagggacaacacttatcgcttgtttcaagctgcttaacttagcggtttgaagggtaggagagaacacgtgtattgtggatggggaaggattttgaaatctttttgcgagattttaaggacttgctcttgattttcaatttgtggctgcgaaagcagcgggtccacggtggacataggctctctgcagcaggaggatgtgtcgtctcatttccgtgtcctgtgattccgctcccttgttttgattttgccccttctagtatatttactttattttcgatctgtgtagagattagtgatcaatgttagtgtgtgcaattcttagcttttaatagttcatttgagtaatttttgttgaaatgattgttgtctgcaatccaacctatcgtttcgactttgtgtaatatctgcaacttgttttgtatgttatcaaattgccaacatttgcttttgtaatagagctgttttttcgtaccaaaaaaaaaa

SEQ ID NO: 3694 - DNA, 1763 bp, Phalaenopsis aphrodite
gtccaagggggcgctcatttactgcttattttatcgttcgtctcattttacccggctctccgtccctccaccaccgatcccttcactcttctcccaatacggagaaagagagggagagggttgaagatctaggtttacgcaactgccccgatctctgtttttcgcttcgcagctgccggaaaagaagatgagcgcgaatccgatgccagcaagttcccatggaaacctggacgagcagatcgcacagctgatgcagtgcaagccactctccgaacaagaggtcagagtattgtgtgacaaagcaaaggagattttgatggaagaaagcaatgtccagcctgtgaaaagccctgtgacaatttgtggtgacattcatggacagtttcatgaccttgcagaattgtttcgtattggtggaaagtgtccagatacaaattacttattcatgggagattatgtagatcgtgggtattattctgttgaaaccgttacgcttcttgtggcccttaaagtgcgatactctcagagaatcaccattcttaggggaaatcacgaaagtcggcagattacacaagtttatggtttctacgatgaatgcttaagaaagtatggtaatgctaatgtgtggaagatttttaccgatctctttgattattttccattgacagcattggttgagtcagaaatattttgtctgcatggtggattatccccatccatcgagacacttgataacattcgcaactttgatcgtgttcaagaggtccctcatgaagggccaatgtgtgacctactatggtctgatccggatgatcgatgtggttggggcatctctcctcgtggtgctggatatacattcggacaagacatttcagagcaattcaaccataacaacaaccttaagctgattgctagagcgcatcagttagtcatggatggatataactggggtcatgaccaaaaagttgtaaccattttcagtgcacctaactattgctatcgttgcgggaacatggcttccatactagaagttgatgactgcaaaggtcacacatttattcagtttgaccccgcaccaaggagaggcgaacctgatgtaacacgaagaactcctgattattttctataattcatcatccttttatagcatgtcactgatttctggttgcaagtgtagacttgctaagacggcgtacgtaaccggtttagggacaacacttatcgcttgtttcaagctgcttaacttagcggtttgaagggtaggagagaacacgtgtattgtggatggggaaggattttgaaattcttttgcaagattttaaggacttgctcttgattttcaatttgtggctgcgaaagcagcgggtccatggtggacataggctctctgcagcaggaggatgtgtcgtctcatttccgtgtcctgtgattccgctccccttgttttgattttgctccttctagtatatttactttattttcggtgtgtgtagagattagtgatcaatgttagtgtgtgcaattcttagcttttaatagttcatttgagtaatttttgttgaaatgattgttgtctgcagtccaacctatcgtttcgactttgtgtaatatctgcaacttgttttgtatgttatcaaattaccaacatttgcttttgtaatagagctgttttttcgtccagtggttggtattagtgggaagaaaatgtaatcccatgcaaaccctattcctaccaaaattcaaataaaattattcgacattaa

SEQ ID NO: 3695 - DNA, 1153 bp, Plantago ovata
ttcataccaaaatgagcaccgatctgatagcccccagtacacatggaaatctcgacgagcagatttctcagctcatgcagtgcaagcctttgtcagaacctgaggtcagaggcttatgcgagaaggcgaaagagatactaatgcaagaaagtaatgtccagcctgtaaagagccctgtgacgatatgtggtgatattcatgggcaatttcatgatcttcaagaacttttccggattggaggaaagtgccctgacacaaactatctgtttatgggagattatgttgatcgtggatactattcggtagaaactgtcacgcttctagtgtccttgaaagtgcgctatccacagcgcatcacgattctccgaggaaatcatgaaagtagacagattacacaagtctatggattttatgatgaatgtttacgcaagtatggaaatgctaatgtttggaagatattcacagacctttttgactatttcccgctcactgcattggttgagtccgaaattttctgtctccatggtgggttgtctccttctgttgaaacccttgataatatacgaaactttgatcgagttcaagaagttccacatgaaggtccaatgtgtgatctgctatggtctgatccggacgatcgctgtggttggggtatttcacctcgtggtgctggatacacttttggccaggacatatcggagcaattcaatcacagcaacagtttaaagctaattgctagagctcatcagctggttatggagggatataattgggctcatgaacaaaaggttgtcaccatttttagtgcaccaaattactgttaccgctgtgggaatatggcatccattttggaagtcgatgattgcagagatcatacatttatccagtttgagccagccccaaggagaggagaacccgatgtcactcgaagaacacctgattatttcttgtagatctttctgttgttgaccttgtggtggtgctgacatgccccctatcttgagatccaattgtcaaagaggcatgtaatatagaagcgcttacatgctcggcacacccttgtctgaattctagtctaacctgttttaggagggtccctggaggtggattagaatgctcttgtgtatcatgttttgtaattcttttcatcctg

SEQ ID NO: 3696 - DNA, 1367 bp, Silene vulgaris
tatctctcttcctttcggaaacggcgaatagaacgacggtgtcgaaagggggaaaatcgccaaatctagggtttctgattttgaatttaatcgaagaagagatctgattctcgatttgcggacaagatgagtttcgatccagttccttcgtctaactcgcatcttaatctcgatgaacagatcgctcagcttatgcaatgcaaacctctttctgaacaagaggttaggggtttatgcgacaaggccaaggagatactgatggaggagagcaatgttcagccagtgaaaagtcctgtgacaatttgtggtgacatccatggacagtttcatgaccttgctgagcttttccgtattgggggaaagtgcccagataccaattatttattcatgggtgactatgttgatcgtggatactattcagttgaaactgtaacgctgctggtggcgctcaaagttcgctatcgtcaaaggatcaccattcttaggggaaatcacgaaagtcgtcagatcactcaagtctatggattctatgatgaatgtctacggaagtatggaaatgccaatgtctggaaggtcttcacagatttatttgactatttcccactgacggcactggtggaatctgaaatcttctgcttgcatggtggtttgtccccttctattgaaaccctcgataatataaggaactttgatcgtgtccaagaagtccctcatgagggacctatgtgtgatcttttgtggtctgacccagatgaccgttgcggatggggtatctcacccaggggagctggatatacttttggccaggacatatcagagcagtttaatcacagcaacagcctaaagctgattgctagagcccaccagctggtgatggaaggattcaactgggctcatgatcaaaaagtggtgactattttcagtgctcctaactattgttatcgttgtggaaacatggcatccatcctggaagtggacgattgccaaggccacacatttattcagtttgagccggctccaaggagaggagagccagatgtgaccagaaggacacccgattatttcctctaaattcagcagccgaacaaggtggtttctggtactacattgaggggagctgtctggtgtagcgaggtttattattattattattgttattctaaggtggcgtttggacactaatcgcatgtgaggcaagcagataatcaatcttctttcaactggatgctcgttcattcaaacaaaatttgcagcgggaggctgtgaagcttatgggagcataattagcatatgtaatgatttccgtcgaacattgtgctatctttaacatcatttttctttgccttttgtcagtcctttttggcctc

SEQ ID NO: 3697 - DNA, 1350 bp, Zostera marina
ctagggttacggtctgcgcaacaaagggaggagaatacataaagttattgaccatgctggacgaggacaagatgaacgtcgatttcgttcccccatctacgtctcatggtgatctcgatcagaagatttcgcagctcatgcagtgcaagcctctttccgaacaggaggttaaatctttatgtgagaaggcaaaggaaattttgatggaagaaaacaatgttcagcctgtgaaaagtcccgtcacgatatgcggtgacattcatggacagtttcacgatctcgcagaattgtttcgtattggtggaaagtgtccagataccaattatttattcatgggggattatgtagatcgtggatattattcggtagaaactgttacgttgcttgtctctctaaaggtgcggtatccccaaaggatcacaattctccgaggaaatcacgagagtcgtcagattacccaagtttatggattttacgatgagtgcttacggaaatatggaaatccaaatgtgtggaagacttttacagatctttttgattacttacctcttacagcactggttgaatcggaaatattctgtttgcatggaggtttatcgccatcaattgaaactcttgataacattcggaattttgatcgtgtccaagaagtccctcatgagggtcctatgtgcgatcttttatggtctgatcccgatgatcggtgtggatggggaatatctcctcgtggtgctggttacacttttggccaagatatttcagagcaatttaaccataccaacagcttgaagttgatagcgagagcccatcaattggtcatggaagggtttaattggggacatgagcaaaaggtggtaactatattcagtgctcccaattattgttaccgttgcggaaatatggcatccattttagaagttgacgattgcaagaaccacacattcatccagtttgatccagcaccaagaagaggagaacctgatgtaaccaggagaacaccagattacttcttataaattcaacctccggtggccttgcagataattctgccatttcaggttgtttactagtcggacgggcctactaattcctatttccgaaggtgtgatggataagctgatatttatttaatagttcatagtagattattattcaatggttctggttccatactttaatcctctttcttcattggatgtttggtgatggatggtgaagtaatattgagtaagtaattatgatttatgatgctccccattcatttctaaataaataaaactactctttggcagtttggtctatttttcacctttgtttaatttttgttcatgtagatgaaattatttattg

SEQ ID NO: 3698 - DNA, 1427 bp, Chelidonium majus
acaccaccaccgtccgctatctggcaaagctctcccactcaatccctctttctctagagacgacgacgaagtaatctaggggtagggttcgaatttttttgcttttttttgattagtaggtgaagtaaaaagaaaaaaagagtttggaagaagatgttgagtgtggatccggttccttcgaactcccatggccaccttgacgagcagatttcacagcttatgcagtgcaagcccttatccgaacaagaggtcagggccttatgtgacaaggctaaagagatattaatggaagaaagcaatgtccagcctgtgaaaagtcctgtgacaatatgtggtgatatccatgggcagtttcatgatcttgctgaacttttccgcattggaggaaagtgtccagataccaattatttgtttatgggagactacgtggaccgtggatattattcagttgaaactgtaactctcctggtggcgctgaaagtgcgtttcttgcaaagaattactattcttagaggaaatcatgaaagtcgtcagataacacaagtttatggcttctatgatgaatgcctacgaaagtatggcaatgcgaatgtgtggaagacgttcacggacctttttgattattttcccttgacagccttggttgaatcaagaaattattttgtttgcagtggggggttgtctccgtctattgagaccctagataacatacgcaattttgaccgtgtacaagaagttcctcatgaaggtcccatgtgtgacctcctttggtctgatcccgatgaccgttgtggttggggtatttctcccccgtggagctggatacacatttggtcaggacatatctgagcaatttaaccataccaacaacctaaagctgattgctagagctcatcaactagtcatggagggattcaactggggacatgaacaaaaggtggttaccatatttagcgctcctaattattgctaccgttgtggaaacatggcatctattttggaagttgatgattgcagaggccacacgtttatacagtttgagccagctccaagaagaggggagccagatgtgacccggagaacacctgattacttcttataatgtgggattgcctttgaattgttgctgattttgcagcagcaaatgtctgcttgctggatgagatcgttgcagatcggttttggggagatttttattggatttaagatttataatttcaacctgctatccattgttgctgtttgtgttgtcagcaggagagaggcatgtaaaatgaggcagtgtgctaccataatttggttgttgttcggaactagtgctaggtttccttttgaaaggagaggcagcataacttgtaacgctggaggagcttgtgtttcatttccagccagacatggtattacttttaagattatcttttctactt

SEQ ID NO: 3699 - DNA, 1321 bp, Glycine max
cacgcgttctctctccaatttggacctccctttccttcgttcctcactcactgcaacggcgccggagatccgtcgctctcctcctccaccaccaccgcgatgggcgccaattccatgctcgccgagttctctcacgatctcgacgaccagatctcccagctcatgcagtgcaagccactctccgagcaacaggtccgaggtttatgtgagaaggctaaggagattttaacggatgaaagtaatgttcagcctgttaaaagccctgtgacaatttgtggcgatattcatgggcagtttcatgatcttgctgaactgtttcgaattggagggaagtgtccagatactaactacttgtttatgggtgattatgtggaccggggttattattcagttgagactgtgtcactcctcgtggcactgaaagttcggtatcctcagcgaattactattcttagaggaaaccatgaaagccgtcagattactcaagtatatggattttatgatgaatgccttagaaagtatggtaatgctaatgtttggaagacctttacagacctttttgatttttttccattgactgcattggttgaatcagaaatattctgtttgcatggtggactgtcgccttcaattgagacccttgataacataaggaactttgatcgtgttcaagaggttcctcatgaaggccccatgtgtgatctattgtggtctgacccagatgacagatgtggctggggaatttctcctcgtggtgctggatatacttttggccaggatatatctgaacaattcaatcacacaaacagccttaagttgattgctagagctcatcagcttgttatggatggatttaactgggctcatgaacaaaaggtggttaccatttttagtgcacctaactactgttaccgatgtgggaacatggcttccatattggaggttgatgattgcaagggccacacatttatccagtttgaacctgctcctaggagaggagaacctgatgtcactcgtagaacgcctgattacttcttataatgtagctgttgaatgtcatactgttatatcatggttacctctactgcactaattttaggtagtagcgcatcctcatcacgagattgccgtaaacatttaaatccatggatatacgtgttccgtgcttttggggttgtccaaagactgctttgatgcataataggcaggtaacattccactgatctgttacactctgaggaattgctggacaccttgtctggagaagtcgccaagatgatgtcagaatacatattgttccagcaaaatgtggatatttttt

SEQ ID NO: 3700 - DNA, 1117 bp, Ambrosia trifida
agattgctcagctcatggagtgcaagcccttatccgagcctgaggttaagacattatgtgagaaggcaaaagagatacttatgggcgaaagcaatgttcagcccgtaaaaagcccagtgacaatatgtggtgacattcatgggcagtttcatgatcttgctgagctttttcgtataggagggaagtgcccagataccaactacttgtttatgggggattatgtggatcgaggatattattctgtcgaaactgtcacgcttttggtggctctgaaagtgaggtatcctcagcgaattacaattctaagaggcaatcatgaaagtcgtcagatcactcaagtctatggattttatgatgaatgccttcgaaagtacggcaatgctaatgtttggaagacttttacagatctctttgactattttccattaactgcattggttgagtcggaaatattttgccttcatggtgggctatcaccttcaattgaaactctggacagcataagaaacttcgaccgtgtgcaagaggtcccacacgagggtccaatgtgtgatcttctatggtccgacccagatgaccgttgcggttgggggatttcaccacgtggggctggatacacctttggccaggacatttctgagcaatttaatcataccaacaacctgaagcttattgctagagctcatcaactggtcatggagggattcaactggggtcatgagcaaaaagttgtcactatctttagcgcaccaaattattgctaccgatgtgggaacatggcttctatcttggaagttgatgattgcaagggccacacatttatccagtttgatccagctcctaggcgaggagaacctgatgtaacaaggagaacgcccgattattttctctgagcggtccaattaaagtggttcatggtcttttgtcaagattcgggcttttgatacaacggtatgggccaaaattcataaggtgaagtgcaagaaaagaaccaaatggtttgtaaaatgtaatgattcatatgttgaagtaatgggcttttatgtgtatctgcaaagggaatgattaagatttcaggttgtttttgactagttttaatcaaaatttacaatttact

SEQ ID NO: 3701 - DNA, 1258 bp, Arnica chamissonis
ctcgctcattcttttctttttcgggtatgcatctccacccacaagattaaatcttgaaattgcccaaaagatgagctcggatccagtcacgcaacgggttaatcacaatgttgatgaacatatcacgcagctcatgcagtgcaaacccttgtctgaacaagaggttaggtcattatgtgataaggcaaaggagatcctgatgcaagaaagcaatgtgcagcctgttaaaagccctgtcacaatctgtggggatattcatgggcaatttcacgatcttgcagagcttttccgaatcggtgggaagtgcccggatacaaattatttattcatgggagattatgttgatcgtggttattactcagttgaaactgtgactcttttggtggccctcaaagtgcgtcatccacaaagaattactattttaagaggaaaccatgaaagtcgccagattactcaagtttatgggttttacgatgaatgcttaagaaaatatggtagtgctaatgtgtggaagacgtttactgatctatttgattattttcccctcactgcattggttgaatctgaaattttttgtcttcatggtggattatccccttcaattgagacacttgataatataagaaattttgaccgcgttcaagaagtgccccatgaggggcccatgtgtgatcttttatggtctgatcctgatgaccgttgtggttggggtatttcacctcgtggtgctggatatacgtttggtcaagatatatctgagcaatttaatcacacaaacagcttaaagctcattgctagagcacaccagctggttatggagggatataactggggtcacgaacaaaaggtggtgacaatctttagtgcacctaattactgttaccgttgtgggaacatggcttcaattcttgaagtagacgattgcaagggccacactttcattcagtttgacccagctccaaggaggggagagccagacgtaacacgtaggacaccggattatttcctatgatgatgctgacctggcagatttcatcagaccagcacgtgcctgacgggaaataactagaccgaaaaggggatcgtgaatcttgcaaatgtggctgtgatgctggagttaagttgctgcacaaacatcagtttggtcatcgtctattgttctttcattttcatgtttttggctgttataattcttttgactattagttaagagtactccattaatttgttatcaagtattcttttgaatatcgataga

SEQ ID NO: 3702 - DNA, 1450 bp, Brassica rapa
cgccactcaacctcacgcgcccctctcattttcgattgcctctcactctgcgagagagagcgaaaaggcgaagacgacgcagaatccaatccaatccaagcaatgggcgcgaattcgattccgacggacgcaactctggatctcgatgagcagatctctcagctcatgcagtgcaagcctctctccgagcaacaggttagagcattatgcgagaaagctaaggagatcttgatggatgaaagcaatgttcagcctgtcaaaagccctgtgacaatctgtggtgatattcatggacagttccatgatcttgcagagcttttccgtattggaggaatgtgccctgataccaactatctatttatgggtgattatgtcgatcgtggatattattccgtcgaaactgttacgctgttagttggcttgaaagtacggtatcctcagcgaatcactattcttagaggaaaccatgaaagtcgtcagattactcaggtgtatggattttatgatgaatgcctgcgcaagtatggtaatgcgaatgtttggaagatatttactgatctcttcgactattttccactgacagccttggtggaatcggaaatattctgccttcacggtggattgtcaccgtctatcgagacccttgacaacattaggaactttgaccgagttcaagaagttccacatgaaggaccgatgtgcgacttactatggtctgatcctgatgacagatgtgggtggggaatctctcctcgtggtgccggatatacatttggtcaggacatttccgaacaattcaaccacagcaacagcttaaaacttatcgctcgagcgcatcaactggttatggatggattcaactgggcacatgagcaaaaggtggttactattttcagtgcaccaaactattgttatcgttgtggaaacatggcctctattcttgaggtcgatgactgcagaaaccacaccttcattcagtttgaaccagccccaaggagaggagaaccagatgtgacccgaaggacacctgactacttcctataaacaaaagtcacctcctctccagctgcaaagtccggttgttggttttttgaagatctctggcttattccatttggcaacgccttgtcttctgagtgaggttgcgtttctttgaaatcgatttagccttctaccttggaatagtgtaatataggcaatgaggtcaatgaactataaaacctagtcccatgaatgtttgtgtttggctgaaattatttagctcccttcttgcatcagaatctatttcttgtgagatattattttgacttaatttcatgttaattctttccttcaatttatgctttttacactgttttgatccaaacatgaccaatatatgttctttaaagccacaacaatggagactggtcaatgataaacaggggcatttaagattttatattgcaag

SEQ ID NO: 3703 - DNA, 1476 bp, Brassica rapa
acggcacgaaagctactacaaaccaccactcgcctctgtccctcacgcgcccccctctcatatcgaattcctctccactctgcgagagagagagagagaaaggcgaagaaaacgcaggatccatccatccatccatccaatttagggttaggccctgcccctaatctctttccccgatccaagacgaaaacatgggcgcgaattcgattccgacggacgcaaccctcgatcttgacgagcagatctcccagctcatgcagtgcaagcccctctccgagcaacaggttagagcattatgcgagaaagctaaggagattttgatggatgaaagcaacgttcagcctgtcaaaagtccagtgacaatctgtggtgatattcatggacaattccatgatctcgcagagcttttccgtattggaggaatgtgccccgataccaactatctatttatgggagactatgtcgaccgtggatattattctgtcgaaactgttacgctgttagttggcttgaaagtacggtatcctcagcgaatcaccattcttagaggaaaccatgaaagtcgtcagattactcaggtttatggattttatgatgaatgcctgcgaaagtatggcaatgcgaatgtttggaagatctttactgacctctttgattatttcccactgacagccttggttgagtcagaaatattctgccttcacggtggattgtcaccgtctatcgagacccttgacaacattaggaactttgatagagttcaagaagttccacatgaagggccgatgtgtgacttgttatggtctgatcctgatgacagatgtggctgggggatctctcctcgtggtgctggatatacatttggtcaggacatctccgaacaattcaaccacagcaacagcttaaaactgattgctcgagcgcatcagctggttatggacggattcaactgggcacacgagcaaaaggtggttactatttttagtgcaccaaactattgctatcgctgtggaaacatggcctccattctcgaggtcgatgactgtaggaaccacaccttcatacagtttgaaccagccccaaggagaggagaaccagatgtgacccgaaggacacctgactacttcctttgaacacagtcacctcctctcagctgcgaagtccggttgctagtttttgaagatctctgcttatttgatttggtgcaacgcatctgtgttccaggttgcttctcttgaaaatcgatttgagctcctcccttcgaatagtgtaatataggcaactgaggtcaatgaactttaaaacccctatgaatgtttgtgtttggttgatatgattcagctcccttctgcatcagaatctgttgcatgtgagatattattattttgatttattaccattattttcccttgaatttctgccacgatactcttttgatatatacgtgatgagtacatgactagtataaagttcttt

SEQ ID NO: 3704 - DNA, 1464 bp, Brassica rapa
tcgccacatttctcacgcgcccctctcatttcgatttcccctcactctgcacaagaagcgagagagagagagaggcgaagaagacgcagaacccatccaatttagggttaggggctgctcctgatcatcgtcctggctcctgatctctcttctcgatctgactagagggaagaagacgcagtatcaaaaccatgaattcggctccgacggacgcaacactcgatctagatgagcagatctcccagctcatgcagtgcaagcctctctccgagcaacaggtcagagcattatgcgagaaagctaaggagatcttgatggatgaaagcaacgtccagcctgtcaaaagtccggtaacaatctgtggtgatattcacggacaattccatgatcttgcagagcttttccgtattggaggaatgtgccctgataccaactatctatttatgggagactatgtcgatcgtggatattattctgtcgaaactgttacgctgctagttggcttgaaagtacggtatccccagcgaatcactatacttagaggaaaccatgaaagtcgtcagattactcaagtttatggattttatgatgaatgcctgcgaaagtatggaaatgcaaatgtttggaagatattcacagacctctttgactatttcccactgacagccttggtggagtcggaaatattctgccttcacggtggattgtcgccgtctatcgagacccttgacaacattaggaacttcgatcgagttcaagaagttccacatgaagggccaatgtgtgacttattatggtctgatcctgatgacaggtgtgggtggggaatctctcctcgtggtgccggatatacatttggtcaggacatttccgaacaattcaaccactctaacagcttaaaactgattgctcgagcgcatcagctggttatggatgggttcaactgggcacacgagcaaaaggtggttactatcttcagtgcgccaaactattgctatcgctgcggaaacatggcctccattctcgaggttgatgactgcaggaaccacaccttcattcagtttgaaccagccccaaggagaggagaaccagatgtaacccgaaggacacccgactacttcctataaacaacaagtcaccttctctcagctgcatagcccggttgttggtttttgaagatctctgcttattctagttggtacaacgcatttgtgttccagcttgcttctctttaaaatcgatttagcctttgaaatagtgtaatataggcaacgaggtcaatgaacttaaaaaccccatgaatgtttgtgtttggcttaaattgttcagctcccttctgcatcaaaatctgtttcatgtgagattattttaacatattttctcgtaatcattcccttgaattacttttgcaccctttgatataaacatgactactatgaagctctttaaagccacagcagtgga

SEQ ID NO: 3705 - DNA, 1249 bp, Brassica napus
tccaatttagggttagggctgctcctgatcatcatcttgtcctggctcctgatctctcttctcgatctgactagacggaagaagacgcagtatcaaaaccatgaattcggctccgacggacgcaacactcgatctagatgagcagatctcccagctcatgcagtgcaagcctctctccgagcaacaggtcagagcattatgcgagaaagctaaggagatcttgatggatgaaagcaacgtccagcctgtcaaaagtcctgtaacaatctgtggtgatattcacggacaattccatgatcttgcagagcttttccgtattggaggaatgtgccctgataccaattatctatttatgggagactatgtcgaccgtggatattattctgtcgaaactgttacgctgctagttggcttgaaagtacggtatccccagcgaatcactatacttagaggaaaccatgaaagtcgtcagattactcaagtttatggattttatgatgaatgcctgcgaaagtatggaaatgcaaatgtttggaagatattcacagacctctttgactatttcccactgacagccttggtggagtcggaaatattctgccttcacggtggattgtcgccgtctatcgagacccttgacaacattaggaacttcgatcgagttcaagaagttccacatgaagggccgatgtgtgacttattatggtctgatcctgatgacagatgtgggtggggaatctctcctcgtggtgccggatatacatttggtcaggacatttccgaacaattcaaccactctaacagcttaaaactgattgctcgagcgcatcagctggttatggatgggttcaactgggcacacgagcaaaaggtggttaccatcttcagtgcgccaaactattgctatcgctgcgggaacatggcctccattctcgaggttgatgactgcaggaaccacaccttcattcagtttgaaccagccccaaggagaggagaaccagatgtgacccgaaggacacccgactacttcctataaacaacaagtcacctcctctcagctgcatagcccggttgttggtttttaaagatctctgcttattctagttggtacaacgcatttgtgttccagcttgcttctctttaaaatcgatttagcctttgaaatagtgtaatataggcaacgaggtcaatgaactttaaaaaaccccatgaatctgtttggcatttgtgtttggcttaaattgttcag

SEQ ID NO: 3706 - DNA, 1337 bp, Brassica napus
tcagatcgaattcctctccactctgcgagagagagagagagaaaggcgaagaaaacgcaggatccatccatccatccaatttagggttaggccctgcccctaatctctttccccgatccaagacgaaaacatgggcgcgaattcgattccgacggacgcaaccctcgatcttgacgagcagatctcccagctcatgcagtgcaagcctctctccgagcaacaggttagagcattatgcgagaaagctaaggagatcttgatggatgaaagcaacgttcagcctgtcaaaagtccagtgacaatctgtggtgatattcatggacaattccatgatctcgcagagcttttccgtattggaggaatgtgccccgataccaactatctatttatgggagactatgttgaccgtggatattattctgtcgaaactgttacgctgttagttggcttgaaagtacggtatcctcagcgaatcaccattcttagaggaaaccatgaaagtcgtcagattactcaggtttatggattttatgatgaatgcctgcgaaagtatggcaatgcgaatgtttggaagatctttacagacctctttgattatttcccactgacagccttggttgagtcagaaatattctgccttcacggtggattgtcaccgtctatcgagacccttgacaacattaggaactttgatagagttcaagaagttccccatgaagggccgatgtgtgacttgttatggtctgatccggatgatagatgtggctggggaatctctcctcgtggtgctggatatacatttggtcaggacatctccgaacaattcaaccacagcaacagcttaaaactgattgctcgagcgcatcagctggttatggatggattcaactgggcacacgagcaaaaggttgttactattttcagtgcaccaaactattgctatcgctgtggaaacatggcctccattcttgaggtcgatgactgccgaaaccacaccttcattcagtttgaaccagccccaaggagaggagaaccagatgtgacccgaaggacacctgactacttcctataaactctcagctgcaaagtcctgttgttggtttttgaagatgtctgcttatttgatttggtacaacgcatctgtgttccaggttgcttctcttgaaaatcgatttgagctcctcccttcgaatagtgtaatataggcaactgaggtcaatgaactttaaaacccctatgaatgtttgtgtttggttgatatgattcagctcccttctgcatcagaatctgttgcatgtgagatattattattttgatttattaccattattttccct

SEQ ID NO: 3707 - DNA, 1416 bp, Brassica napus
gccccctctcatatcgaattcctctccactctgcgagagagagagagagatagaaaggcgaagaaaacgcaggatccatccatccatccatccaatttagggttaggccctgcccctaatctctttacccgatccgactataggaacgaagacgaaaacatgggcgcgaattcgattccgacggacgcaaccctcgatcttgatgagcagatctcccagctcatgcagtgcaagcctctctccgagcaacaggttagagcattatgcgagaaagctaaggagatcttgatggatgaaagcaacgttcagcctgtcaaaagtccagtgacaatctgtggtgatattcatggacaattccatgatctcgcagagcttttccgtattggaggaatgtgccccgacaccaactatctatttatgggagactatgtcgaccgtggatattattctgtcgaaactgttacgctgttagttggcttgaaagtacggtatcctcagcgaatcaccattcttagaggaaaccatgaaagtcgtcagattactcaggtttatggattttatgatgaatgcctgcgaaagtatggcaatgccaatgtttggaagatctttactgacctctttgattatttcccactgacagccttggtggagtcagaaatattctgccttcacggtggattgtcaccgtctatcgagacccttgacaacattaggaactttgatagagttcaagaagttccccatgaagggccgatgtgtgacttgttatggtctgatccggatgatagatgtggctggggtatctctcctcgtggtgctggatatacatttggtcaggacatctccgaacaattcaaccacagcaacagcttaaaactgattgctcgagcgcatcagctggttatggacggattcaactgggcacacgagcaaaaggtggttactattttcagtgcaccaaactattgctatcgctgtggaaacatggcctccattctcgaggtcgatgactgtaggaaccacaccttcatacagtttgaaccagcccctaggagaggagaaccagatgtgacccgaaggacacctgactacttcctttgaacagagtcacctcctctcagctgcgaagtccggttgctagtttttgaagatgtctgcttatttgatttggtacaacgcatctgtgttccaggttgcttctcttgaaaatcgatttgagctcctcccttcgaatagtgtaatataggcaactgaggtcaatgaactttaaaacccctatgaatgtttgtgtttggttgaaatgattcagctcccttctgcatcagaatctgttgcatatgagatattattattttgtatttattaccattattttcccttgaatttctgacatgatacttttttgatacatacatg

SEQ ID NO: 3708 - DNA, 1294 bp, Brassica napus
ctcattttcgattgcctctcactctgcgagagagagcgaaaaggcgaagacgacgcagaatccaatccaatccaagcaatgggcgcgaattcgattccgacggacgcaactctggatctcgatgagcagatctctcagctcatgcagtgcaagcctctctccgagcaacaggttagagcattatgcgagaaagctaaggagatcttgatggatgaaagcaatgttcagcctgtcaaaagccctgtgacaatctgtggtgatattcatggacagttccatgatcttgcagagcttttccgtattggaggaatgtgccctgataccaactatctatttatgggtgattatgtcgatcgtggatattattccgtcgaaactgttacgctgttagttggcttgaaagtacggtatcctcagcgaatcactattcttagaggaaaccatgaaagtcgtcagattactcaggtgtatggattttatgatgaatgcctgcgcaagtatggtaatgcgaatgtttggaagatatttactgatctcttcgactattttccactgacagccttggtggaatcggaaatattctgccttcacggtggattgtcaccgtctatcgagacccttgacaacattaggaactttgaccgagttcaagaagttccacatgaaggaccgatgtgcgacttactatggtctgatcctgatgacagatgtgggtggggaatctctcctcgtggtgccggatatacatttggtcaggacatttccgaacaattcaaccacagcaacagcttaaaacttatcgctcgagcgcatcaactggttatggatggattcaactgggcacatgagcaaaaggtggttactattttcagtgcaccaaactattgttatcgttgtggaaacatggcctctattcttgaggtcgatgactgcagaaaccacaccttcattcagtttgaaccagccccaaggagaggagaaccagatgtgacccgaaggacacctgactacttcctataaacaaaagtcacctcctctccagctgcaaagtccggttgttggttttttgaagatctctggcttattccatttggcaacgccttgtcttctgagtgaggttgcgtttctttgaaatcgatttagccttctaccttggaatagtgtaatataggcaatgaggtcaatgaactataaaacctagtcccatgaatgtttgtgtttggctgaaattatttagctcccttcttgcatcagaatctatttcttgtgagatattattttgacttaatttcat

SEQ ID NO: 3709 - DNA, 1144 bp, Centaurea maculosa
gctgtttctagcgggcatggcagcatcgatgaatttatttctcagctcatgcagtgcaaacccttatctgaacaagaggttagggtgttatgtgagaaggcaaaggagatattgatggacgaaagcaatgttcagcctgtgaaaagtcccgtaactatctgtggtgatattcatgggcaattccacgatctcgcagagctttttcgaatcggagggaagtgccccgatacaaattacttgttcatgggagattacgtcgaccgtggttattactccgttgaaacagtgacgctattggtggcgctcaaagtgcggtatccacaacggataacgattttaagaggaaaccacgagagtcggcagatcactcaagtttacgggttttatgatgaatgcctaagaaaatatggtaatgctagcgtgtggaagatttttacggatctattcgactaccttccattgactgcattggtggagtctgagattttctgtcttcatggtggattatcaccttcgatcgaaactctcgataacatacggaattttgatcgggttcaagaagttccgcacgaggggccgatgtgcgatcttttatggtctgatcccgacgatcgttgcggttggggtatctcaccccgtggcgctggttatacgttcggccaagatatatcggaacagtttaatcataccaacggcttaaagctgattgctagagcacaccagctggttatggagggatacaactggggtcatgaacaaaaggttgtgaccatctttagcgcccctaattattgttaccgttgtgggaatatggcctcggttcttgaagtagatgattgcaaaggtcacactttcattcagtttgaaccagccccaaggaggggagagccggatgtaacccgtaggactccagattacttcctataatacacggccgtttgcaatatcatttggattaaaatgtatgtgcccgatttgatatagttgaacattggctgttgttgtagtgtaaccgggaagtacgcgatgatgatgatgatgttggtgttgtctcgtgtattatctttacttcattttttcacgatccgatctctttgtagacaaaatacaatcttaatattgtcatctaattggttccatgttt

SEQ ID NO: 3710 - DNA, 1814 bp, Ceratodon purpureus
gcccttccatcgtgccgtgactactttggtcgtcggagtgttagtgttggtgtggttctatctctcccttgcagagactcggctcttttgtgactcctttagggttgtaatcagcgtcggtatttgtttggcttcatcgtcacttcgttgttctctgcccgtctttacttattttcctgtcagaggttgcaccaaagtcacgctgtgcgcgggtgcgggtgcggggagttcgcacatcgggtgggaggggagaccaccatgagcaagggggagaccatgagtgtacctccggtgtcgccgaatacgcacgggcagctcgatgcccagattgcacagctcatccaatgcaagcctttgcccgagtacgaggtgagaggactgtgcgaaaaagctaaagagattctgatggaagaaaacaatgttcagccagtcaagtgtcctgtgaccatatgtggagacattcatgggcaattccatgatcttgcggagctgtttcggattgggggaatgtgcccagacaccaactacttattcatgggtgattacgtggaccgaggttactactctgttgaaacagccacacttttggtggcactgaaagttcggtaccaagaccgcattaccatcttgcgtggcaatcacgagagtcggcagattactcaagtgtacggattctatgacgagtgtctccgaaaatacggaaacgctaacgtttggaagatctttaccgaccttttcgattatttccccctgacggccctggtggagtcggagatattttgtttgcatggaggattgtcgccgagcatagattcattggatcacattcgtgacctagaccgagtgcaagaggtccctcatgaaggtccgatgtgtgatcttctgtggtcagaccctgatgaccgatgcggatggggtatttcccctcgaggtgccgggtacacttttgggcaggacatttccgagcagtttaatcacaacaacaatttgaagctcgttgcaagagctcatcaactagttatggagggttacaattggggacatgaacaaaaggtggtgacgatattcagtgcacctaattactgctatcgttgcgggaatatggctgctatcttggaagttgatgacaatatgggtcatacatttatccagtttgagcccgctccaagacgaggcgagccggatgtgacgagacgcacaccggattatttcttgtagtggcgttttgggtagtgttaagagaccttttagaggcattttgagtcggttattcagtatgatctcaagggttttcggaggtgagcacggtgatgccaagtgcgagcgaatgggtgctgtcttgtaccgcacttcaagaggcgatgttgtgtagcattgagtaggtcatcgagacgtggcgggaattgtgcagggaagtgcttttgccgtgatgggccttgtggaaccagcgccttgagcagcagacgtgtgctgtgtatggaagttactgcagagctactaattccagaatgagcgttttaatgacggtgtggagttcttgttgtaatggttcggggtttgtgagggaataatagtaatggattgaggggacggcctgggagattctagtccgggatggggttgttttaggacttgggctattgcggagtctgtaggatgtttctgtggacgtagtaaagctctgtgccagcattagcggagcatgggcagatgaataatgccgctgggagtgactccgcaatcagaagtggatgtttagagttattcccgttgtatgataacacatttccaagtgatgtaatctgatcgttgtt

SEQ ID NO: 3711 - DNA, 1873 bp, Ceratodon purpureus
acaacgtccgtggtccatcttgagctcgggtgccgcggacacgaccttggtgacggtgcctggatcaaggggacctggcgagttttaatctcgtcgttagagtgtctgtgttagtgtggccctatcactactttgcgggtgctcagccctctgtctgctttagggttgcaatttgcgtcggccactgtttggcactaccgtcacttcgttggccttcgcccgtcttttcttcacagtttcttgtcagaggttgtatcaaagtcacactgtccgcgggcgtgagcgcgaagagttcgcatatcgtgtgggaagggagaccaccatgagcaagggggagaccatgagtgtacctccggtgtcgtcaaatacgcacggtcagctcgatgcacagattgcgcagctcattcaatgcaagcctttgcctgagcacgaggtgagaagactctgcgaaaaggcaaaggagattttgatggaagagaacaacgttcagccagtgaaatgtcctgtgaccatatgcggagacattcacgggcaatttcatgatcttgcggagctgtttcggattgggggaatgtgcccagacaccaactacctattcatgggtgattacgtggaccgaggttactactccgttgaaacagccacacttttggtcgcactgaaagttcggtaccaagaccgtattaccattttgcgtggcaatcacgagagtcgacagatcactcaagtgtatggattctatgacgagtgtctccgaaaatatggaaacgctaatgtgtggaagatctttaccgaccttttcgattatttccccttgacggccctggtggagtcagagatattttgtttgcatggaggattgtcgccgagcatagattcattagatcacattcgtgacctagaccgagtgcaagaggtccctcatgaaggtccgatgtgtgatcttctatggtcagaccctgatgaccgatgcggatggggcatttcccctcgaggtgccgggtacacttttgggcaggacatatccgagcagtttaatcacaacaacaatttgaagctcgttgcaagagctcatcaacttgttatggagggttacaactggggacatgaacaaaaggtggtgacaatattcagtgcacctaattactgctatcgttgcgggaacatggctgctatattggaagttgatgacaacatgggtcatacatttatccagtttgagccagctccaagacgaggcgagccggacgtgacgagacgcacaccggactatttcctatagttgcgttgttagtgtttggagtactcttaatgccatttgagtaggcccttcagcatgctctcatggattaggttttcggaggtgagcacggtgatgccaagtgcgagcgtgtgggtgatgtcttgtatcgcacatcaggaggtgatgttgcgtagttcactgagtgagtgatagcgacgtggcggagtttgtgcgggggagtacttatgccgtgaagggccctattggaaccagcgtcttaagcagatatgtaatgtgtatgcaagtaattgcagaactagtaactacagattgaacggttcattgacggggtagagttgtggttggagtggttcggggtttgagaaataatagtactggatttcccatctaaaccgtacagaggagatcccactgtgggatgggttgttttagagcttgggactattgaggagtctgtaggatgtctctgtggatgaagtaaagctctgtcatttgtggaacatggactgatgaatgatgccggtgggagtgacaccgcaatcggcagtgggtgtctagtagtctacagtggttcccaacgtatgatgatacattttcagatataatctg

SEQ ID NO: 3712 - DNA, 1676 bp, Cicer arietinum
gaaatttagtataataatttattctttttcttccaaccaaacaagcctaaagaaattcaaaaaagaaaagtgaaagaaaagaagaaaaaaaaagagcgattatcgtggagcgtgcaaatgaagcattagcttgtttatttcacgcgccttctccattttcgagtttctctttcgtcctcactccgagcgagaaaggacgctccaaacaaaaaatcttcaaatcttagggttacttaaactttccctaatttccctcttttctttcccatttcttccgattcaccatacaatgggtgctaattcaatgctaaccgagtcgactcacgatctcgatgagcagatctcacagctcatgcagtgcaagccactctccgaacaacaggtcaaagaattatgtgagaaggctaaggagattttaatggacgaaagcaatgtccagcctgtcaaaagcccggtgacaatttgcggcgatattcatggacaatttcatgatcttgctgaactatttcgaattggagggaagtgtccagataccaactacttgtttatgggtgattatgtggaccggggttattattcagttgagactgtaacactcctcgttgcactgaaagtgcggtatcctcagcgaattactattcttagaggaaaccatgaaagccgtcagattactcaagtatatgggttttacgatgaatgcctaagaaagtatgggagcgctaatgtttggaagatctttacagacctctttgatttttttccattgaccgcattggttgaatcagaaatattttgcttgcatggtggactctcgccttcaattgagacccttgataacataagaaactttgaccgtgttcaagaggttcctcatgaagggcccatgtgtgatctactgtggtctgacccagatgacagatgtggctgggggatttctcctcgaggtgctggatatacctttggccaggacatatctgaacaattcaatcacacgaacagccttaaattgattgctagagctcaccagctagttatggatggatttaactgggctcatgaacaaaaggtggttaccatttttagtgctcctaactactgttaccgatgtgggaacatggcttccatattagaagttgatgattgcaagggccatacatttatccagtttgaccctgctccaaggagaggagaacctgatgtcactcgaagaacgcctgactacttcctgtaatttagctgctgctgaatgtcatactggtatatcgtggttactctatttccggtctaatttgagatagttgtgcatcctcattggtgagattgctgtaggcatatacacttcccatgcttttgtggttgtccaaaggctcctttgatgtatgataggcaggttatattcaacccatctgttacactcaagaatttgctggacaccctgtttggagaagtcgtcaagataatgcctatacgaggatgtattattccagcaaaatgtggatattttttgtatgttttccctgtcatttttattttcttttataattttcatgttttaggtactatgactggatcaattaactcgtggatgcatttgatgttctctcaatttttagtaaaagttgcatgataatagtgattcgatttgatgttatgttcaatttaattatcaggcctta

SEQ ID NO: 3713 - DNA, 1871 bp, Gossypium hirsutum
cgtcttcgtcacagaagcaattagacataaagagtgtagagagaagaaaaagtaacatttcccaaaccaaactagggttagggttatccctaatccgcataaagttttttttacacgctctattcttgctacttaattatcaaatatgggcgcaccaacagactcagccctcgatctcgatgaacagatctcgcagctcatgcaatgtaagccactttcggagcagcaggtcagagcattatgcgacaaggcaaaggaaatattaatggaagaaagcaatgtccagcctgtaaaagcccctgttacaatttgtggtgatattcatgggcagtttcatgatcttcaagaactttttcgaattggggggaagtgtccggatacaaactacttgtttatgggagattatgtggaccgtgggtactattctgttgaaactgttacgctgttggtggctttaaaagtccgttacccccagcggattaccattctcaggggaaatcatgaaagtcgccagatcactcaagtttacgggttttatgacgaatgtctgagaaagtatggtagtgctaatgtttggaagatctttacagacctttttgactattttccattaactgctttggtggagtcagaaatattttgtctgcatggtgggttgtccccatcaattgaaaccttggataatgtaagaaactttgatcgtgttcaagaggttcctcatgaagggcccatgtgtgatttattgtggtctgatccagatgatcgatgcggttggggtatctcgccacgtggcgctggatatacttttggtcaggatatatctgaacagttcaaccatacaaacagcttaaaattgattgctagagctcatcaactggttatggatggatttaactgggcgcatgaacaaaaggtagttactatatttagcgccccaaattattgttatcgctgtgggaacatggcatcaatcttggaagttgatgattgcaagaaccagtcattcatccagtttgagccagctccaaggagaggagaacctgatgttacccgtagaacgcctgattacttcctctgaagctgctacattccataactgattcaagatactccgcttttcggcctctcctctccccctttacattgtcaggtagttgccgatcctttacagaaatcttttgcatctactgttcttttggtgatttggggggggggtaccaaaagcatacatgggaatgggttgggttatgaacttatgatctataatcctatcatcgagttgatcaatttatcttacacttggatattctgttgaagagattgtcatagctggtgaaactctgacactatcagaatgtaaatttttgtgtttgtttttgattacctgttctctttttctttggctttaacccatctttttggaatgcgtaagttcaatatttagtgggtgtttcctttgttttcttctttttgtcatacacaccagctggattaatctgaagtttaattctatatttcttttaaatctatttatctgatttagggttagttaatatatattcataataataacattgtattaaatgcatcagttaaccacttcagttcttattttcaatgtgggaatattatttagggtaaattatacccaaggtcattaaacttcaaaacgttacaaaagtgatcattaaagttttcaaaagttttcattcaagtcttaaactatatgaaagtttttattcaagttattaggctcttaggttttttctaaacaaaaattcgattagtgagttctaaacgacaattcgatgattgatacggttgattttggcttgtaggattgtgacattcaaaacaaatttataaaaaga

SEQ ID NO: 3714 - DNA, 1530 bp, Gossypium raimondii
tacacgctcctatcgttacctccattcacgcgctctttcatttcgtcttcgtcacagaagcaaagagacataaagagtatagagagaagaaaaagtaacatttcccaaaccaaactagggttagggttatccctaatccgcataaagttttttttacacgctctattcttgctacttaattatcaaatatgggcgcaccaacagactcagccctcgatctcgatgaacagatctcgcagctcatgcaatgtaagccactttcggagcagcaggtcagagcattatgcgacaaggcaaaggaaatattaatggaagaaagcaatgtccagcctgtaaaagcccctgttacaatttgtggtgatattcatgggcagtttcatgatcttcaagaactttttcgaattggggggaagtgtccggatacaaactacttgtttatgggagattatgtggaccgtgggtactattctgttgaaactgttacgctgttggtggctttaaaagtccgttacccccagcggattaccattctcaggggaaatcatgaaagtcgccagatcactcaagtttacgggttttatgacgaatgtctgagaaagtatggtagtgctaatgtttggaagatctttacagacctttttgactattttccattaactgctttggtggagtcagaaatattttgtctgcatggtgggttgtccccatcaattgaaaccttggataatgtaagaaactttgatcgtgttcaagaggttcctcatgaagggcccatgtgtgatttattgtggtctgatccagatgatcgatgcggttggggtatctcgccacgtggcgctggatatacttttggtcaggatatatctgaacagttcaaccatacaaacagcttaaaattgattgctagagctcatcaactggttatggatggatttaactgggcgcatgaacaaaaggtagttactatatttagcgccccaaattattgttatcgctgtgggaacatggcatcaatcttggaagttgatgattgcaagaatcagtcattcatccagtttgagccagctccaaggagaggagaacctgatgttacccgtagaacgcctgattacttcctctgaagctgctacattccataactgattcaagatactccgcttttcggcctctcctctccccctttacattgtcaggtagttgccgatcctttacagaaatcttttgcatctactgttcttttggtgatttgggggggtggtggtaccaaaagcatacatgggaatgggttgggttatgaacttatgatctataaatcatcgagttgatcaatttatcttacacttggatattctgttgaagagattgtcatagctggtgaaactctgacactatcagaatgtaaatttttgtgtttgtttttgattacctgttctctttttctttggctttaacccatctttttggaatgcgtaagttcaatatttagtgggtgtttccttttgtttttcttctttttgtcatacacaccag

SEQ ID NO: 3715 - DNA, 1325 bp, Lupinus angustifolius
gcgcccccttcattctgaatcctcactctctatctctccatcaccatgggcgccaattcgttaccttcagagtcttctcacgatctagacgaacagatctcgcagctcatgcaatgcaaaccactctccgagcaacaggttaaagttttatgtgagaaggctaaggagattttaacggatgagagtaatgtccagcctgtgaaaagccctgtgacaatttgtggtgatattcatgggcagtttcatgatcttgctgaactgtttcgaattggaggaaagtgtccagacactaactacttgtttatgggtgattatgtggaccggggttattattcagttgagactgtgacactccttgtggcactgaaagtgcggtatcctcagcgaattactattcttagaggaaaccatgaaagccgtcagattacccaagtatacggattttacgatgaatgcctaagaaagtatggtagtgctaatgtctggaagatctttactgacctttttgatttttttccattgactgcattggttgaatcagaaatattctgtttgcacggtggactgtccccttcaattgagacccttgataacataaggaactttgatcgtgttcaagaggttcctcatgaagggcccatgtgtgatctgttgtggtctgacccagatgacagatgtggctggggtatctctcctcgtggtgctggatacacttttggccaggatatatctgaacaattcaatcacacaaacagtcttaagttgattgctagagctcatcagctggttatggatggatttaactgggctcatgaacaaaaggtggttaccatttttagtgcacctaactattgttaccgatgtgggaacatggcttccatattggaagttgatgattgcatgaaccacacatttatccagttcgaacctgctccaaggagaggagaacctgacgtgacacgaagaacgccggattacttcctctaatgcagctgctgctgaatgtgtggtggtatcattgttacttctctactctctgcacttatttcagatagttgtgcatcatccacaatggtgagattggtgtaagcatttaaatccatgggtatacatgttcaaagactactttgatgtattatagtgcaagtaacattccactgatcttccctactcaacaacttgctgtggacacccttttggagaagttgctaagatgatgaccatgctttagaagctatgactggtatttttgtctagtggatgcttttgctatgctccatcaattatcagtaaaaaatgaatggtaatagtgcttcagttttgct

SEQ ID NO: 3716 - DNA, 1122 bp, Medicago truncatula
tcgtcactccgagcgagaaaatcatcatcttcttcttctcctagctcgctagggttcctttgatttgaatatttttcttcagattcatacaatgggtgccaattcaatgatagccgatgtcactcacgatctcaacgagcagatctctcagctcatgcagtgcaaaccactctccgaacaacaggttaaagaattatgtgagaaggctaaggagattttaatggatgaaagtaatgtccagcctgtgaaaagtcctgtgacaatctgtggcgatattcatgggcagtttcacgatcttgctgaattatttcgaattggagggaagtgtccagatacaaactacttgtttatgggtgattatgtggaccggggttattattcagttgagactgtaacactcctcgtggcactgaaagtgcgatatcctcagcgaattactattcttagaggaaaccatgaaagccgtcagattactcaagtatatggattttacgacgaatgcctaagaaaatatgggagtgctaatgtctggaagatctttacagacctctttgatttttttccattgactgcattggttgaatcagaaatattttgtttgcatggtggactgtcaccttcaattgagaccctcgataacataaggaactttgatcgtgttcaagaggttcctcatgaagggcctatgtgtgatctactgtggtctgacccagatgacagatgtggttgggggatttctcctcgtggtgctggatatacctttggtcaggatatatctgaacaattcaatcacacaaacagccttaaattgattgctagagctcaccagcttgttatggatggatttaactgggctcatgaacaaaaggtggttactatttttagtgctcctaactactgttaccgatgtgggaacatggcttccatattggaggttgatgattgcaagggccacacatttatccagtttgaacctgctccaaggagaggagaacctgatgtcacccgaagaacgcctgattacttcctgtaaagcagctgctgctggatgtcatactggtatatcgtggttactctacttccagtctaatttcaggcagacaatattccaccgatctgttg

SEQ ID NO: 3717 - DNA, 1572 bp, Arachis hypogaea
tttttggaggttgctctcgttccttctcgacactacctcactctgacacccttcacggcgaaaatcgccaccgctgaatcaatctttctccgcctagggttagggtttcccctaatcccccgacgcacaagcacctttcgccgtcgcgcttccgattctgcagagagaggaccaccacgatgggcgcaaattcgttgccatctgactccactcatgatctcgacgagcagatctcgcagctcatgcagtgcaagccactttctgagcaacaggttagagttttatgtgagaaggctaaggagattttaatggatgaaagtaatgtgcagcctgtgaaaagccccgtgacaatttgtggtgatattcatgggcagtttcatgatcttgctgaactatttcggattggagggaagtgtccagatactaattacttgtttatgggtgattacgtggaccgaggatattattcagttgagactgtaacgctgcttgtggcactgaaagtgcggtatcctcaacgaataaccattcttagaggaaaccatgaaagccgtcagatcacacaagtatatggattttacgatgagtgcctaagaaagtatggtagtgctaatgtctggaagatctttacagacctttttgatttttttcctctgaccgcattggtggagtctgaaattttctgtctgcatggtggactttcaccttcaattgagacccttgataacataaggagctttgatcgtgttcaagaggttcctcatgaaggggccatgtgtgatcttctgtggtctgatccagatgacagatgtggctggggaatttctccacggggtgctggatatacttttggccaggatatatctgaacaattcaatcacacaaacagtctgaagctgattgctagagctcatcagctggttatggatggatttaactgggctcatgaacaaaaggtggttacgattttcagtgcacccaactactgttaccgatgtgggaacatggcttccatattggaggttgatgattgcaagggccacacatttatccagttcgaacctgctccaaggagaggagaacctgatgttacccgtagaacgcccgattacttcctataatctagctgcttactgccatactggtatcgtggttatctattacttgtgcactaatttcagatagatgtgcattctccttggtgagattgctgtaagcatttaaatccatggaggtatacacgtcccatgctttttgtgattgtccaaaaagactgctttgatgtataatagggcaggtaaacattccactgatctgtgctcaagaacttgctggacacacaccccgtttggagaagtcgccaagatgtgatgactatatcagaatatgtatttttccagcaaaatgttgatattttttgtttttcttttctctgtctttatttcttcgtatgttttatacctcccatttcatgctttagaagctatgaatggattttatctcatggatgcttttgctgtgttttattaattctgactatataatttgcatgataatagttattgctgctta

SEQ ID NO: 3718 - DNA, 1616 bp, Cajanus cajan
aatctgaaaaagaaaaaagaaaaagaaaaagaaaaaggggattgttggagaccgtgcaaatcaagcattttgtgcacgcgccctctctatttgctccttctctccctcactcacttcaacggcgccggagattccacgctcctcttctccaccgccgcgatgggcgccaattccatgctctccgagtcctctcacgatctcgatgaacagatctcccagctcatgcagtgcaaaccactctccgagcaacaggtcagaggtttatgcgagaaggccaaggagattttaatggatgaaagtaatgttcagcctgttaaaagccctgtgacaatttgtggcgatattcatgggcagtttcatgatcttgctgaactgtttcgaattggagggaagtgtccagatactaactacttgtttatgggtgattatgtggaccgaggttattattcagttgagactgtaacactccttgtggcactgaaagtgcggtatcctcagcgaattactattcttagaggaaaccatgaaagccggcagattactcaagtatatggattttatgatgaatgccttagaaagtatggtaatgctagtgtttggaagatctttacagacctttttgatttttttccattgactgctttggttgaatcagaaatattctgcttgcatggtggactgtcaccttcaattgagacccttgataacattaggaactttgatcgtgttcaagaggttcctcatgaaggacccatgtgtgatctattgtggtccgacccagatgacagatgtggctggggaatttctcctcgtggtgctggatatacttttggccaggatatatctgaacaattcaatcacacaaacagccttaagttgattgctagagctcatcagctggttatggatggatttaactgggctcatgaacaaaaggtggttaccatttttagtgcacctaattactgttaccgatgtgggaacatggcttccatattggaggttgatgattgcaagggtcacacatttatccagtttgaacctgctcctaggagaggagagcctgatgtgactcgaagaacgcctgattacttcttataatgtagctgctgaatgtcatactggtatatcatggtttacctctactgcactaatttgtagttgcgcatcctcatcatgagattgctgtaagcatttaaatccatggatatactcgttccgtgcttttggggttgtccaaagactgctttgatgtataataggcaggtaacattccactgatctgttacgctcgagaacttgctggataccttttctggagaagtcgccaagatgatgactgtcagaatacatattgttccagcaaagtgtggatattttttgtttgtttttcccgtctttatttcctctctctcatgttcagtacctccattttatggctttacaagctatattgactggattttttgtctcgtggatgtttttgtcatgttctatcatttttcagttaaagttgcatgataatagtgattcagttttgttcttacgaattattatgttcaacttatcattaacgcttatctaaaagatcaattacgtttataactatttgccat

SEQ ID NO: 3719 - DNA, 1566 bp, Glycine max
ggactccgtgcaaatcaagcattttgcttgttatttcacgcgttctctctccaatttggacctccctttccttcgttcctcactcactgcaacggcgccggagatccgtcgctctcctcctccaccaccaccgcgatgggcgccaattccatgctcgccgagttctctcacgatctcgacgaccagatctcccagctcatgcagtgcaagccactctccgagcaacaggtccgaggtttatgtgagaaggctaaggagattttaacggatgaaagtaatgttcagcctgttaaaagccctgtgacaatttgtggcgatattcatgggcagtttcatgatcttgctgaactgtttcgaattggagggaagtgtccagatactaactacttgtttatgggtgattatgtggaccggggttattattcagttgagactgtgtcactcctcgtggcactgaaagttcggtatcctcagcgaattactattcttagaggaaaccatgaaagccgtcagattactcaagtatatggattttatgatgaatgccttagaaagtatggtaatgctaatgtttggaagacctttacagacctttttgatttttttccattgactgcattggttgaatcagaaatattctgtttgcatggtggactgtcgccttcaattgagacccttgataacataaggaactttgatcgtgttcaagaggttcctcatgaaggccccatgtgtgatctattgtggtctgacccagatgacagatgtggctggggaatttctcctcgtggtgctggatatacttttggccaggatatatctgaacaattcaatcacacaaacagccttaagttgattgctagagctcatcagcttgttatggatggatttaactgggctcatgaacaaaaggtggttaccatttttagtgcacctaactactgttaccgatgtgggaacatggcttccatattggaggttgatgattgcaagggccacacatttatccagtttgaacctgctcctaggagaggagaacctgatgtcactcgtagaacgcctgattacttcttataatgtagctgttgaatgtcatactgttatatcatggttacctctactgcactaattttaggtagtagcgcatcctcatcacgagattgccgtaaacatttaaatccatggatatacgtgttccgtgcttttggggttgtccaaagactgctttgatgcataataggcaggtaacattccactgatctgttacactctgaggaattgctggacaccttgtctggagaagtcgccaagatgatgtcagaatacatattgttccagcaaaatgtggatattttttgtttgtttttcatcttttttgtctcttatgttcagtaaaacccttttatggctttacaagctatatgactggatttttttttttgtctcgtggatgtttttgtcatgttctatcattttcagttaaagttgcatgataatagtgattcatttttgttcttacgaattatgttcatcttatcattaacgcgtatctaaagttagcctccc

SEQ ID NO: 3720 - DNA, 1168 bp, Taraxacum officinale
gtttcgcttttctcaaccatcatttgcctattggtttcaccaccaccgttcgcttcccccactgtcttcttcactctctcgcccaacccaaaaagattctttcagattttctttttggatctatcatttaccaattcaaaatccaatatacagatcttcttatcaatttattggctaagaaaatcccccaaaagaagaaacaaagatgagctcggctccagttgtctcgagcgctaatggcaacgtcgatgaatatattactcagcttatgcaatgcaaacccttatccgaacaagaggttaggttgttatgtgagaaggctaaggaaatcttgatggtggaaagcaatgtacagcctgttaaaagcccagtgacaatctgtggtgatatccatggccaattccatgatcttgcagagctttttcgaattggagggaagtgtccggatacaaattatttattcatgggagattatgttgatcgtggttattactctgttgaaacagtgacgttattggtggccctaaaagtgcggtacccacaacgtattactattttaagaggaaaccatgaaagtcgccagatcactcaagtttatggattttatgatgaatgcttacgaaaatatggtaacgcgagtgtgtggaaaacatttactgatttgttcgactactttccactcactgcattggtggaatctgaaatattttgccttcatggtggattatccccttcaattgaaaccctagacaacataagaaactttgatcgtgtacaagaagttccacatgaaggcccgatgtgtgatcttctttggtcagatcccgatgacagatgtggttggggtatctcacctcgtggggccggatacacttttggccaagatatatctgagcagtttaatcatagcaatgggttgaagctgattgctagagcacatcagctggttatggagggatttaactggggccacgaacaaaaggttgtgacgatatttagtgcacctaattactgttaccgatgtgggaacatggcttcaattctttgagtagatgactgccagggtcataccttcattcagtttgacccagctcccaggaggggggagccagatgtgacacgtaggacacctgattatttcctgtgaggtggcagtcaccttttggac

SEQ ID NO: 3721 - DNA, 1339 bp, Brassica napus
agacggaaggaaggaaaatgggggtcgattctttaccgacggacgcaaccattgatctcgatgagcagatctcgcagctcatgcagtgcaagcccctctccgagcaacaggttagatcgttatgcgagaaagccaaggagatcttaatggatgaaagcaacgttcagcctgtgaaaagccctgtgacaatatgcggtgatattcatggacagttccatgaccttgctgagcttttccgtattgggggaatgtgtcctgacaccaattacttgtttatgggagactacgttgaccgtggttattattctgttgaaactgttacgctgttagtcgccttgaagatgcgctatcctcagcgaatcaccattcttagaggaaaccatgaaagtcgtcagatcactcaggtctatggattttacgatgaatgtctgcgaaagtatggcaacgcaaatgtttggaaaatctttacggacctcttcgactattttccattgacagccttggttgagtcagaaatattttgccttcatggtggattgtctccatccatcgaaacccttgacaacataaggaactttgatcgagttcaagaagtgccccatgaagggccgatgtgtgacttactatggtctgatcctgatgaccgttgtggttggggaatctctccacgtggtgctggatatacatttggtcaggacatatccgaacagttcaaccactcaaacggcttgaagctgatcgcaagagcccatcagcttgttatggatggatacaactgggctcatgagcaaaaggtggtaactatcttcagtgcaccgaactattgttaccgttgtgggaacatggcttcgattcttgaggttgatgactgcatgagccacagcttcattcagtttgaaccagcaccgaggagaggagaaccagacgttactcgaagaacaccagactacttcctctgatcattagacacagagtcatcacagcagctgcagtcacaactgaaaaagccgcagttggtaactcaacaatctggttactatgcaatgtgtgtcaagtttgctgtgtgtttaagttcaacttagtcccatcaccagaatatagtgtgatataggcgaagaaggccctctcttatcttcctctataaccaagaacaagaggtcgatggattgattctacaatacccatcatgcatgcacattgtttggttgatgttattagcttctttttcttcttctttctgcatcagattgtgttttcatgtgagagatcctttttaattttatttattgtaattcttcacccaaatgtcactattttttagtttacaaatctagtgaag

SEQ ID NO: 3722 - DNA, 2382 bp, Elaeis guineensis
gttggtgttctgcttccttcctttccttctcgctcctccaatatcttttcccgcgataggacacgattctatcaatatatacatatataaatacatagatacggagagaggttggagggcaggtgattccgattttgaaagggaatttaaagctgccagagctagggttagggtttgtggctgcatcacctcggattggactggctggaggagaagatggacgtggatccggtccccgccaattcccatggcaacgtcgaagagcagatctcgcagctcatgcagtgcaagccgctctctgagcaagaggttagagttctttgtgacaaggctaaggaaattttgatagaagaaagcaatgtccaacctgtgaaaagccctgtgacaatatgtggtgacattcatgggcaatttcatgatcttgcagagctatttcggattggtggaaagtgtccagataccaattacttgtttatgggagattatgtagatcgtgggtattactctgttgaaacagttacgcttttggtggccctgaaggtgcgttaccctcaacgcattaccatccttaggggaaaccatgagagtcgtcagattacacaagtttatggattctatgatgagtgtttacgaaaatatggtaatgcaaatgtgtggaagacattcactgacctttttgactattttccattgacagcattggttgaatcagaaatattttgccttcatggtggtctgtctccacatgtcgacactcttgatggtatacgtaactttgatcgtgttcaagaagttcctcatgagggtgcaatgtgtgatctcctatggtctgacccagatgaccgatgtggttggggtatttctcctcgtggtgctggatataccttcggtcaagatatatcagagcaattcaatcataccaacaaccttaaactaatagctagagctcatcaattagtcatggagggatataactggggacatgaacaaaaggttgtcaccatatttagtgcacctaactattgctaccgatgcgggaacatggcctccatcttggaagttgatgactgcaaaggacacacattcatccagtttgagccagcaccaaggagaggagaacctgatgtaactcgtagaacacccgattattttctatgatcctattgttgcaggcttagctgacagaggaagcaattgtatgcttgctaattaattgggaacatggttgcagatatttttggaagataaatttacatttttttccctaaagatcctatgcttgatggtatggggataaagatcagtctacatgtgggttcccactcactctggctttctttctgttttgcttcctttcttttctttctctattttttcaactaaaatgatcttgtagaggaaagggatttaattttcagtgggtgattttcttatgggttggttttaactagactagttatttttactggttctcacatctgttagtttataacaagatactattgacacgatctggttccagtatcctgtgagttcctttgctggtactctgaaaaattattgtgcatacgattcagtttgagctttttttttggttatcgattgatgttgaggggaagttctttatgggatctcgcttgaccagtttaatctactgattttcctgtggtaaggctacatgtgttctttttaactggaagctcatgtgatgtggggattgaaacttgtctccctacataaccctggttctttcgagggtttccaccaatggtttggtcctaacctgtatcatacttggctgtcatcctgttatagccaaaagcccaagcctatctagcaagacccaagcccaaaaaaaaaagatatgaaaacagaggaaaaatcgggaagaagactcccgataggagtctttttctccggcgagaccaggcaaatcgggaatcctaggacctctcggagtcctagggtcctctataagaaggcctgccctttcccttggagccgatcatcggcccttttctcctcttttcctctccgattttcccgaagtagagccgtggatccttgccttgttctcgccgtgactgctcaccgacgaggtcaccggaggccgaggtgagtcttcctcttcttcccctcttccttctccttcctcccatgcccttgtgcgcggctgccggtgacgagagtcgccgattttcggtcggaaaaagggacctctgtttttggtctcttttcccgtgaatttttcggcgccggcgatcgaaattgaccgccggcaatgctcctctgcgaccgggggagtggcccccctctcccgccgcctccgccacgacggccgcgcctgacgccgcacaggcggccgccgtcctctcgccaaga

SEQ ID NO: 3723 - DNA, 1333 bp, Raphanus sativus
tcatttcgattgcctctcactctgccagagagagagagaaagagacaaggcgaagaagaggcaggaatcgaatcgaaagccttgttctgttttcccgatctgatcagtaatgggttcggcggctccgaaggacgcaactctggatctggatgagcagatctctcagcttatgcagtgcaagcctctctccgagcaacaggttagagccttatgcgagaaagctaaggagatcttgatggatgaaagcaatgttcagcctgtcaaaagcccagtgacaatctgtggtgatattcatggacaattccatgatcttgctgagcttttccgtattggaggaatgtgccctgatactaattatttatttatgggagattatgtcgaccgtggatactattctgtcgaaactgttacgctgttagttggcttgaaagtacggtatcctcagcgaatcactattcttagaggaaaccatgaaagtcgtcagatcactcaggtttatggattttatgatgaatgcctgcgaaagtatggcaatgccaatgtttggaagatatttacagacctctttgactatttcccactgacagccttggtggagtcggaaatattctgcctgcacggtggattgtcaccgtctattgagacccttgacaacattaggaactttgaccgagttcaagaagttccacatgaaggacccatgtgtgacttactatggtctgatcctgatgacagatgtggctggggaatctctcctcgtggtgccggatatacatttggtcaggacatttccgaacaattcaaccacagcaacagcttaaaacttatcgctcgagcgcatcagctggttatggatggatacaactgggcacacgagcaaaaggtggttactatcttcagtgcaccgaactattgctatcgctgtggaaacatggcctctattcttgaggtcgatgactgcaggaaccacaccttcattcagtttgaaccagccccaaggagaggagaaccagatgtgacccgaaggacacctgactacttcctttaaacaaaggtcacctcctctcagatgcaaaatccggttgatggtttttgaaggtctctgcttattccattttggcaatgcattttgttcgaggttgcatctccttaaaatcgctttagccttctcccttggaatagtgtaatataggcaatgaggtcaatgaactatataaaaaaaaaccttatgaatatttgtgttttggctgaaattattcagtatcttctgcatccgaatctatttcctgtgagatattattttggcttaatttcatgttattctttccttcga

SEQ ID NO: 3724 - DNA, 1476 bp, Helianthus annuus
tttcgtttcgtttcatttcatttcatcccccactgtcttcttcactcattcattcattcctttttgggttatgtttcaataaaaacccacaaatttaattccaataaatcaacctaatttcccatcaagatatgagcttggatccagttatgcagcgagttactcacaatgttgatgaacatatctcgcagctcatggagtgcaaacccttgtctgaacaggaggttaggtcattatgtgataaggcaaaggagatcctgatgcaagaaagcaacgtgcagccggttaaaagccctgtcacaatctgcggggatattcacgggcaatttcacgatcttgcagagctttttcggatcggtgggaagtgtccggatacaaattatttattcatgggagattacgttgatcgtggttattactcggttgaaacagtgacgcttttggtggccctcaaagtgcgttatccacaaagaattactattttacgaggaaaccatgaaagtcgccagatcactcaagtttatgggttttacgacgaatgcttaagaaaatacggtagtgctaatgtgtggaagacgtttaccgatctatttgattatttccccctaactgcattggttgaatcggaaattttttgtcttcatggtggattatccccttcaatcgaaacacttgatagtataaggaattttgaccgcgttcaagaagtgccccatgaggggcccatgtgtgatcttttatggtccgatcccgatgaccgttgtggttggggtatttcacctcggggtgctggatatacatttggtcaagatatatctgagcaatttaatcatacaaacagcttaaagctaattgctagagcacaccagctggttatggagggatttaactggggtcacgaacaaaaggtggtgacaatctttagcgcacctaattattgttaccgttgtgggaatatggcttcgattcttgaagtagacgattgcaagggtcacactttcattcagtttgaaccggctccaaggaggggagagccggacgtgacacgtaggacaccggattatttcctatgatgctgacttggccgttctcatccgaccaacatgcgcctaaccgctcgtgggaaataaggaggccgaaaatggaatatatgaatatttaaaatgtggcagtgatgctggagttaatttggtgcacaaacatcagtttggtcattttctgttgttttttttttggtctgtagagggaaggcatagaaagtgtttgttctttaattgatgtctttccttttcttgttattttttttgatgttataattctttttgacattagttaagaatactctattaatttgttatcaagattcatttgaaatttaatatctcagttacatttgtattttgttttttagaacggctcgtattttttgttttttttttagaacggcccgtattctatttctatcaactacctgta

SEQ ID NO: 3725 - DNA, 1571 bp, Trigonella foenum-graecum
agaaaaaaaagcgattattggggagcgtgcttcttggcttgttaaatcacgcgccatctccatttggcacttcctctttcctccctccgtccacagttctcctcactcagcgagagagaaaggacgcgtcatcttcttctcctagctagctagctagggttccttgatttgaatcttttcttcagattcattcattcaacaattcaatgggtgccaattcaatgatagccgattcaactcacgatctcaacgagcagatctctcagctcatgcagtgcaaaccactctccgaacaacaggttaaagaattatgtgagaaggctaaggagattttaatggatgaaagtaatgttcagcctgtgaaaagccccgtgacaatttgtggcgatattcacgggcagtttcatgatcttgctgaactatttcgaattggagggaagtgtccagataccaactacttgtttatgggtgattatgtggaccggggttattattcagttgagactgtaacactcctcgtggctctgaaagtgcggtatcctcagcgaattactatccttagaggaaaccatgaaagccgtcagattactcaagtatatggattttacgatgaatgcctaagaaaatatgggagtgctaatgtctggaagatctttacagacctctttgatttttttccattgactgcattggttgaatcagaaatattttgtttgcatggtggactctcaccttcaattgagacccttgataacataaggaactttgatcgtgttcaagaggttcctcatgaagggcctatgtgtgatctactgtggtctgacccagatgacagatgtggttgggggatttctcctcgtggtgctggatatacctttggtcaggatatatctgaacaatttaatcacacaaacagccttaaattgattgctagagctcaccagcttgttatggatggatttaactgggctcatgagcaaaaggtggttaccatttttagtgctcctaactactgttaccgatgtgggaacatggcttccatattggaggttgatgattgcaagggccacacatttatccagtttgaacctgctccaaggagaggagaacctgatgtcacccgaagaacgcctgattacttcttgtaaagtagctgctgctgaatgtcatactggtatatcgtggtttctctacttccagtctaatttcaggtagttgtggatcctcgttggtgagattgctgtaggcatttacatccattgatattgtggttgtgtccaaaggccgctttgatgtataataggcaggcaatattccaccgatcttttacactcaagaaattgctggacaccctttctggagaagtcgtcaagattatgactctacaaggaagtactattccagcaaaatgtggatattttttgtatgttttttttcttcttttcaaatcatgttttatatctcccttatgaggctttagactatgactggattttttaactcgtggatatttttgatatgttatctcaatttttagtaaaagttgcatgataatagtgtgtttaattaag

SEQ ID NO: 3726 - DNA, 1298 bp, Artemisia annua
attaatcccatttaatttaatttattaaattgaattaatttgatatataaataacccattaataaaaacataatgagcttggatcatgttaatcacaatgttgatgaatatattactcagcttatgcagtgcaaacctttatctgaacaagaggttaagtcattatgtgataaggcaaaggaaatcctgatgaaagaaagcaatgtacagcccgttaaaagccctgtgacaatatgtggggatattcatgggcagtttcacgatcttgcagagctttttcgtattggagggaagtgcccggacacgaattacttgttcatgggagattatgttgatcgtggttattactcggttgaaacagtgtccctgttggtggccctaaaagtgcgttatccacaacgaattactattctaagaggaaaccatgaaagccggcagatcactcaagtttatggattttacgatgaatgcctaagaaaatacggatctgctaatgtgtggaagatatttacggatctatttgattattttcccctcactgcattggtggagtcagaaatcttttgtcttcatggtggattgtccccttcaattgaaacacttgataatataagaaactttgatcgtgttcaagaagtgccacacgaggggcccatgtgtgatcttctatggtctgatccggatgaccgttgtggttggggtatctcacctcgaggtgctggatatacatttggtcaagacatatcagaacaatttaatcatacaaacggcttaaagcttattgccagagctcaccagctggttatggaaggattcaactggagtcacgaacaaaaggtcgtgacaatatttagtgcacctaattattgttaccgttgtgggaatatggcttcaatccttgaagtagacgattgcaagggtcacactttccttcagtttgaaccagctccaaggagaggagagccagatgtgacacgtaggacaccagattatttcctataataaggagaccaaaaggcatatatgaatcttaaaaacgaggcagcgatcctgaagtgagtttatttgctgcacaaacatagcaccatctaccacatctgttaacacactttggtcatcttcttttgttccctcattacttttttttaattctcagtttgtagaggaaagacatctaaatgtcccgtgtcttttcctttatgcgttttttggttctttgctgttataattctgactgtcctattctttttgacgttagttaaggatacttgctgtaatttgtaatcaaggttcattgg

SEQ ID NO: 3727 - DNA, 1229 bp, Brassica oleracea
gcgaaaaggcgaagaagacgcagaatccaatccaaatccaatccaatcagaagacgcagtagtaatgggcgcgaattcgattccgacggacgcaactctcgatctcggtgagcagatctctcagctcatgcagtgcaagcctctctccgagcaacaggttagagccttatgcgagaaagctaaggagattttgatggatgagagcaatgttcagcctgtcaagagcccggtgacaatctgtggtgatattcatggacagttccatgatcttgcagagcttttccgtattggaggaatgtgccctgataccaactatctatttatgggagactatgtcgatcgtggatattattctgtcgaaactgttacgctgttagttggcttgaaagtacggtatcctcagcgaatcactattcttagaggaaaccatgaaagtcgtcagattactcaggtttatggattttatgatgaatgcctgcgaaagtatggcaatgcaaatgtttggaagatatttacagacctctttgactatttcccacttacagccttggtggagtcagaaatattctgccttcacggtggattgtcaccgtctatcgagacccttgacaacattaggaactttgatcgagttcaagaagttccacatgaaggacccatgtgtgacttactatggtctgatcctgatgacagatgtggctggggaatctctcctcgtggtgccggatatacatttggtcaggacatttccgaacaattcaaccacagcaacagcttaaaacttatcgctcgagcgcatcaactggttatggatggattcaactgggcacatgagcaaaaggtggttactattttcagtgcaccaaactattgctatcgctgtggaaacatggcctctattcttgaggtcgatgactgcaggaaccacaccttcattcagtttgaaccagccccaaggagaggagaaccagatgtgacccgaaggacacctgactacttcctataaacaacaagtcacctcctctccagctgcaaagtccggttgttggttttttgaagatctctggcttattccatttggcaacgccttgtcttctgagtttgcgtttctttgaaatcgatttagccttctaccttggaatagtgtaatataggcaatgaggtcaatgaactataaaacctagccccatgaatgtttgtgtttggctgaaattatttagctcccttct

SEQ ID NO: 3728 - DNA, 1510 bp, Phaseolus vulgaris
cttctcttctcactcactgcaacagcgccggagattcttcgctcctcttctccaccgccgcgatgggcgccaattccatgctctccgaatcctctcacgatgtcgacgatcagatctcccagctcatgcagtgcaagccactctccgagcaacaggtcagagttttatgcgagaaggctaaggagattttaatagatgaaagtaatgttcagcctgttaaaagccctgtgacaatttgtggcgatattcatgggcagtttcatgatcttgctgaactgtttcgaattggagggaagtgtccagacactaactacttgtttatgggtgattatgtggaccggggttactattcagtggagactgtaactctccttgtggcactgaaagtgcggtatcctcagcggattactattcttagaggaaaccatgaaagccgtcagattactcaagtatatggattttatgatgaatgccttcgaaagtatggtaatgctagtgtttggaagacctttacagacctttttgattttttcccattgacagcgttggttgaatcagaaatattctgcttgcatggtggactttcaccttcaattgagacccttgataacataaggaactttgatcgtgttcaagaagttcctcacgaaggccccatgtgtgatctattgtggtctgacccagatgacagatgcggctggggaatttctcctcgaggtgctggatatacttttggccaggatatatctgaacaatttaatcacacaaacagcctcaagttgattgcaagagctcatcagctggttatggatggatttaactgggctcatgaacaaaaggtggttaccatttttagtgcgcctaactactgttatcgatgtgggaacatggcttccatattggaggttgatgactgcaagggccacacatttatccagtttgaacctgctcctagaagaggagaacctgatgtgactcgtagaacgcctgattacttcttataatgtagctgttgaatgtgataccggtatatcattgttacctctactgcactaatttcaggtagttgcgcgcatcctcatcatgagattgctgtaagcatttatatccatggatatacacgttccgtgcgtttggggttgtccaaagactgctttgatgtatagtaggcaggtaactttccactgatctgttacactcgagaacttgctggggcactttatctggatatgtcgccaagatgatgactatgtcagaattcatatcgttccagcaaaaatgtggatattttttgtttgttttccagtctttttttttttttcattcatgttcagtaactcccattcgtggctttacaagctatatgactggatcttttttgtctcgtggatgtttttgctaagttctatcatttttcagttaaagttgcttgataatagtgattcagtttcgttcttacttatgttcaacttatcattaacgcttatctaaagttagcctgcacttctaa

SEQ ID NO: 3729 - DNA, 1368 bp, Brassica napus
atggacgcctgcggaccggtccggaattccgggtcgaccacgcgtccgttttcgattgcctctcactctgcgagagagagagccaaaaggcgaagaagacgcagaatccaatccaaatccaatccaatcagaagacgcagtagtaatgggcgcgaattcgattccgacggacgcaactctcgatctcggtgagcagatctctcagctcatgcagtgcaagcctctctccgagcaacaggttagagccttatgcgagaaagctaaggagattttgatggatgagagcaatgttcagcctgtcaagagcccggtgacaatctgtggtgatattcatggacagttccatgatcttgcagagcttttccgtattggaggaatgtgccctgataccaactatctatttatgggagactatgtcgatcgtggatattattctgtcgaaactgtcacgctgttagttggcttgaaagtacggtatcctcagcgaatcactattcttagaggaaaccatgaaagtcgtcagattactcaggtttatggattttatgatgaatgcctgcgaaagtatggcaatgcaaatgtttggaagatatttacagacctctttgactatttcccacttacagccttggtggagtcagaaatattctgccttcacggtggattgtcaccgtctattgagacccttgacaacattaggaactttgatcgagttcaagaagttccacatgaaggacccatgtgtgacttactatggtctgatcctgatgacagatgtggctggggaatctctcctcgtggtgccggatatacatttggtcaggacatctccgaacaattcaaccacagcaacagcttaaaacttatcgctcgagcgcatcagctggttatggatggattcaactgggcacatgagcaaaaggtggttactattttcagtgcaccaaactattgctatcgctgtggaaacatggcctctattcttgaggtcgatgactgcaggaaccacaccttcattcagtttgaaccagccccaaggagaggagaaccagatgtgacccgaaggacacctgactacttcctataaacaacaagtcacctcctctccagctgcaaagtccggttgttggttttttgaagatctctggcttattccatttggcaacgccttgtcttctgagtttgcgtttctttgaaatcgatttagccttctaccttggaatagtgtaatataggcaatgaggtcaatgaactataaaacctagccccatgaatgtttgtgtttggctgaaattatttagctcccttctgcatcagaatctatttcttgtgagatattattttgacttaatttcatgttaattcttt

SEQ ID NO: 3730 - DNA, 1298 bp, Daucus carota
atacatacatataaataaatctatacatatatcgacaaatccaaaacacacactagcaaaagagatatacaacgagaggagatgaatgcggatctggcgtcgtcgaacgccaatctcgatgaacagatttcgcagcttatgcagtgcaagcctctctccgagcctcaggtgagggcattatgtgacaaggctaaagagatcttaatgaaagaaagcaatgttcagcctgttaaaagtcctgtgaccatatgtggggacattcatgggcagtttcatgatcttgctgagctttttcgcatcggaggaaagtgcccagatacaaattacctttttatgggagattatgtcgatcgtggatattattcagttgaaactgtcacgcttctagtggctctgaaagtgcgttatcatcaacgaatcacaattctgagagggaatcatgagagtcgacagatcacacaagtatacgggttctatgatgaatgtctgcggaagtatggcaatgctaatgtttggaagatattcacggatctttttgattatcttccacttactgctctggttgaatcagaaatattttgtctacatggaggactgtcaccttccattgaaacacttgataatatccgaaagttcgaccgtgttcaagaagttccacatgaaggcccaatgtgtgatctcttgtggtctgacccagatgatcgctgtggttggggtatatctccccgtggtgctggatatacttttggccaagatatatctgagcagtttaatcagaccaacagtctgaagcttattgctagagctcatcagctggtcatggaaggatttaactggggacatgagcaaaaggtggttactatatttagtgcaccaaattattgttatcgttgcggaaacatggcatcaatattggaggttgatgactgcaatggccatacgtttattcagtttgatccagctccgaggagaggagaacctgatgtaacccgaagaacaccagattacttcttataaaccaagttggtaaagcttcaaaggatgttggtgtctgcatgctagctggaataagtggtggcagggcatctgtaaaagaaattaaagattgcaagttgtgtagcttttgaatcttggtttgcagactcgagaggtctaagaacataagaagagtgaatgaagtatcagataatttttaatttaatgtaagctataggcttttagtactgaggcaactgtagctggcaaggcagttatgtaaaattttaaagacaatttcataatatgtatctttccttgaa

SEQ ID NO: 3731 - DNA, 1170 bp, Ricinus communis
aaaaaaaagaaacaaaaaaatccaagatgggagcgaattctccatcgtcagattcaatctccgatcttgatgaacagatctcgcagctcatgcagtgcaagccactctctgagcctcaggtcagagcattatctgaaaaagctaaggagatacttatgcaagaaagcaatgttcagcctgtgaaaagccctgtgacaatctgtggcgatattcatgggcagtttcatgatcttgcagaactttttcgaattggagggaagtgcccagatacaaattacttgtttatgggagattatgtggaccgtggctattactctgttgaaactgtgacgctcttagtggcattgaaagtacgctatccacagcgaataaccattcttagaggaaatcatgaaagtcgccagattactcaggtttacgggttctacgatgaatgcttgcgaaagtatggcagtgctaatgtttggaaaatcttcacagaccttttcgactatttcccattgactgcattggttgagtcggaaatattttgtctgcatggtggattgtcgccctcgatagaaaccctcgacaacataagaaattttgatcgtgttcaggaggttcctcatgaaggagcaatgtgtgatcttttatggtctgacccagatgacagatgtggttggggtatatcacctcgaggtgctggatatacttttgggcaggatatatccgaacaatttaatcatacaaacagcttgaagttgattgctagagcacatcagcttgttatggatggatttaattgggcccatgaacaaaaggtagttaccatattcagtgctcctaattattgttaccgctgtggaaacatggcttctatattggaagttgatgactgcagggcccacactttcattcagtttgagccagctcctaggaggggagagcctgatgttacccgtagaacaccggattacttcctgtaaatcagccctctgttgcaccagtaccactgcccctctctatccctacttcatgctcaggtagttgggaaatcctagttacaagagacatctactgggcttaatatttatagaactttctgggcatgctttctttctggtggatgccgagattccaaaagcatgtataaataggccaggttttgtgctttttgttctgtcttta

SEQ ID NO: 3732 - DNA, 1558 bp, Euphorbia peplus
atatacaaaaaccaaaaacaacaactcctccactcactcgcgctcgatctcccacgcgcctccgtctcctccaccgtgcaggcggcgacagctgcagaggagcgaactgcacacatcgcaccaccaccaccatcggattaaatcttagggttagggttatccctaatcccgatacaacaagatgggtgcgaattcgccatctacagattcaattagcgatctcgacgagcagatctcgcagctcatgcagtgcaagccgctctccgaaactcaggtcagatcattatgtgacaagggtaaggagatacttatgcaagaaagcaatgttcagcctgtcaagagcccagtgacaatctgtggtgatattcatgggcagtttcatgatcttgccgaactctttcgaataggaggaaagtgtccagatagcaattacctatttatgggagattacgtggaccgtggctattactctgttgaaactgtgacgctcttggtggcgctgaaagtgcgatacccacagcgaataaccattcttcgaggaaatcatgaaagtcgtcagatcacacaggtgtatggattttatgatgaatgcctgcggaagtatggcaatgctaatgtgtggaagatcttcacggacctttttgactattttcctttgactgccttggttgagtcagaaattttttgtcttcatggtggactatctccatcaatcgaaaccctcgacaatataagaaattttgatcgtgttcaagaggttcctcatgaaggagctatgtgtgatctcttatggtctgatccagatgatcgttgtggttggggtatttcacctcgtggtgctggatatacttttggtcaggatatatccgagcaatttaatcatacaaacagcctgaagttgattgccagagcgcatcagcttgttatggatggattcaactgggcacatgaacaaaaggtggtaactatattcagtgcacctaattattgttatcgttgcggcaacatggcttcaatattggaagttgatgactgcaacagtcacacttttatccagtttgagccggctcctaggaggggagagcctgacgttacccgtagaacacctgattatttcctgtgagtgagtcagcccatctgttgcagcagaatcatctgctacagtggtgtgtgcccctccgtcccaactttgtgcggtagatggttgataaaatcctagtttgcaagatgtatatctacggatatgactatctatagaacttcgtttggcatgctttttatcgggtgagtacgggatcccagaagcatgtgcgagaagccaggttttcagcattttgttctttttttttcttatatttactcgaaaatgatggaattatctgcaatcggctaaagctcatggcagatcatcagcactagattgtatgttctttagcagagttgtggatatcattgtttaattaacttgcacttttgttcgttcgttcgtatggcctgtagagcgatgaatggattttataactagtggacattaattactcctttgacgtttgtaatt

SEQ ID NO: 3733 - DNA, 1480 bp, Allium cepa
ttcgcttctcaaaactataagttgtttcacaggtcaaaatctccgatagaggaaagtatcgattctagtgttgaaaatttgagatctagacgaagatgagtgcaggcacgatcaattcgaactcccatggcaatctcgatgaggagattgctcagctcatgcagtgcaagcctctttctgagccagaggtaaaaatattgtgtgacaaggcaaaggaaattctaatgaaggaaagcaatgtccagcctgttagaagtcctgtcacaatttgtggtgacatccatgggcaatttcacgatcttgcagaactatttcggattggtggaaagtgcccagataccaattacttgtttatgggggactatgtggatcgagggtattattcagttgaaactgtcactcttctggttgcactgaaagtgcgatatccacagcgcattactatccttaggggaaatcatgaaagtcgtcagatcacacaagtgtatggattttacgatgaatgcttgagaaaatatggtaatgcaaacgtgtggaaaatcttcacggatctatttgattattttcctttgaccgcactggtggaatctgaaatattttgtctacatggtggcttgtctccgtcaattgatactcttgacaacatacgaaattttgaccgtgtccaagaagtgcctcatgagggaccgatgtgtgacctcttatggtctgatccagatgaaagatgtggttggggaatctcccctcgtggcgctggatatacctttggtcaagatatatcggagcaatttaatcgtgtgaataaccttaaactgatagcccgggctcaccaattggtcatggaaggatataactggggtcatgaacaaaaggttgtaaccatattcagcgcacctaattattgctacagatgtggaaacatggcttcaattttagaagttgatgattgtaagggtcatacatttattcagtttgaaccagcgcccagaagaggggaacctgatgtcactcgcagaacgcccgattacttcttatgatgtattctaaagtattttggtggaagtcatatgctttatgcaatgaagttgctgtactatggaaacatcacacaatcaaattaccatgtttaagtgaattgcttgggggtataaaatgcaactgcaaaaggtgatggagaccaattttagggatggtttgcatttcatatttcagtgcctcgatgtaattttgtatcttttgttcatgttcatttaccaggaaagttattatttgagttccgttgtaatcttaaatcttatatcgatgaataatgcttaattggccttccattattggccttgttaagttttagatagatttcttcctcagttgaagtaagaaataagcggatgtcttgtattatttaatatgtttactatgctataatcctaagttgtctaatatattggttttatgaaaaacacacacaaaggccgtcctc

SEQ ID NO: 3734 - DNA, 1529 bp, Physcomitrella patens
aagaagtgtgtccaaagctgagagttgaatctgttctccttcctctgtttctctcgcactctcgcgctctcacattgctccgcttgcgtttttatgccttcgaggtgggtttcacagtgaccctagtgatagaatacggtcgaggaaggtcgggagcggtgtgagtttcgaagcatttgtgcggaatctgcgcaatcgaggtgtcagggacgagtgcgcccggtggagtggagcagcttaggggggcgacatgagtgtccctccggtatcgtccaatgtgcacgggcagctggacgcacagattgctcagctcatacaatgcaagcctttgcccgagcttgaggttagagcattgtgcgagaaggcgaaggagatcttgatggaagagaacaatgttcagcctgtgaagtgccctgttactatatgcggagacatacacggccagttccatgatcttgcggagctatttcggatcggaggaatgtgcccagataccaactacttattcatgggcgattacgttgaccgaggttactactctgtcgagacggctacacttttggtggcattgaaggttcggcaccaagaccgtataaccatcttgcgtggaaaccatgagagtcggcagattactcaagtgtacggattctatgacgagtgtcttcgaaagtatggaaatgccaacgtttggaagatttttacggacctttttgattattttcctttgactgccctggttgagtcagagatattttgtttgcatggagggttgtcgccaagcatagattcattggatcacattcgtgacctggatagggtgcaagaagttccacatgagggtccgatgtgtgatctgttatggtccgaccctgacgaccgttgtggatggggcatttcacctcgtggtgctggctacacttttggtcaggatatttcggagcagtttaaccacaacaacaatcttaagcttgttgcaagggctcaccaactagttatggagggttacaattgggggcatgaacaaaaggtggtcactatattcagcgcacctaattactgctatcgctgtggtaatatggccgctatactagaagtccacgacaacatggctcacacatttatccagttcgaaccagctccaagacggggtgaaccagatgtcacccggcgtacgcccgactacttcttatgacacgacatgtacgcgacttggttgttaaagcatgcgtgacctaatttttagaagtttgttccagcctgtactagtgatgatcaaggttcttttctggtagttagcgaggtgctgccaagcattggcagccccacttggttgcgggaagcacgttttgtcataaaagtgatgtaatttctaggctatgaaagtacatgtaggtagtcacgttgcgcttgattcttcagtctccgtagtgggttcatactctttgccactgcagagctgctctttaacgtttgctccttgtttaattataattaattctaccttcagacactttcattttcaatttcat

SEQ ID NO: 3735 - DNA, 1455 bp, Populus trichocarpa
aaaaaatcagcctgttaactttatcaaccaaagcatcacactcgctttctcgttcacgcgcttcaccatttccttcactacaccaaaagaactgcgaaaagaaagacacaagtgaaaaaaatctgattgaatcaatataggtttagggctatccctaatcgggatattgttaaacccaattcggtgttaagatcaatcaagatgggcacgaattcgttatcttcagaatcaattaccgatcttgatcaacagatcgagcaactcatgcagtgcaagcctctctctgaacctcaggttaggacattatgcgagaaagctaaggagatactaatgcaagaaagcaatgttcagcctgtgaaaagccctgtgacaatatgtggcgatattcatgggcagtttcatgatcttgcagaactttttcgtattggagggaagtgtcctgacaccaattacttgtttatgggggattatgtggatcgtggctattattctgttgaaaccgtgacgctcttggtggcattgaaagtgcgctatcatcataggattaccattctcagaggaaaccatgaaagtcgccagattactcaagtttatgggttttatgatgaatgtctaagaaagtatggtaatgctaatgtttggaagatcttcaccgacctttttgactatttcccattgactgcattggttgagtctgaaatattttgtttacatggtggattgtccccaactatagagactcttgataacataagaaactttgatcgtgttcaagaggttcctcatgaaggagccatgtgtgatctgctgtggtctgatccagatgacaggtgtggttggggtatatcacctcgtggtgccgggtatacctttggccaggatatatctgagcaatttaatcatgtgaacagcttgaagttgattgctagagcacatcagcttgttatggatggatttaattgggcacatgaacaaaaggtggttaccatatttagtgcacctaattattgttaccgctgtggaaacatggcctccatactggaagttgatgactgcaagggccacacattcatccagtttgagccagctcccaggaggggagaacctgatgttacccgtagaactcctgattacttcctgtaagcagccttttgtaataccaccaccacttcctcacccacccacccaaccccaaatccctacctcatgctcagatggttgtggatcctagttactttgggtctatcaaatttaagttctagtatgccttgccgatggtcatgggatgagaaaaagcctgtattatagtaggcaagttggatgctttttctttcctgtcttgccttttctttcctgtcttgtgcttgaaaccacgctggatatttttgtgggaatcagctataagctgatgcacagtgaagcattagaatgtaaggtatccctgtttcatattta

SEQ ID NO: 3736 - DNA, 1300 bp, Brassica oleracea
ctcgatcttcgttaactgcacacaaagcgagagagaagaagagagaaagcgtagaaatttaggggattcctgatcggaggaagacggaaggaaggaaaatgggagtggattcgctaccaacggacgcaacgattgatctagatgagcagatctcgcagctcatgcagtgcaagcccctctccgagcaacaggttagatcgttatgcgagaaagccaaggagatcttaatggatgaaagcaacgttcagcctgtgaaaagccctgtgacaatctgcggtgatattcatggacagttccatgaccttgctgagcttttccgtattgggggaatgtgtcctgacaccaattacttgtttatgggagattacgttgaccgtggttattattctgttgaaactgttacgctgttagtcgccttaaagatgcgttatcctcagcgaatcaccattcttagaggaaaccatgaaagtcgtcagatcactcaggtctatggattttacgatgagtgtctgcgaaagtatggcaacgcaaatgtttggaaaatctttacggacctcttcgactattttccattgacagccttggttgagtcagaaatattttgccttcatggtggattgtctccatctatcgagacccttgacaacataaggaactttgatcgagttcaagaagtgccccatgaagggccgatgtgtgacttattatggtctgatcctgatgaccgttgtggttggggcatctctccacgtggtgctggatatacatttggtcaggacatatccgaacagttcaaccactcaaacggcttgaagctgatcgcaagagcccatcagcttgttatggatggatacaactgggctcatgagcaaaaggtggtaactatcttcagtgcaccaaactactgttaccgttgtgggaacatggcttcgattcttgaggttgatgactgcatgaaccacagtttcattcagtttgaaccagcaccgaggagaggagaaccagacgttactcgaagaacaccagactacttcctctgatcattagacacagagtcatcacagcagctgcagtcacaactgaaaaagtcgcagttggtaactcaacaatctggttactatgcaatgtgtgtcaagtttgctgtgtgtttaagttcaacttagtcccatcaccagaatatagtgtgatataggcgaagaaggccctctcttatcttcctctataaccaagaacaagaggtcgatggattgattctacaatacccatcatgcatgcacattgtttggttgatgttattagc

SEQ ID NO: 3737 - DNA, 1769 bp, Gossypium hirsutum
actcaatccaaagtccaaactagggttagggttatccctaatcaggataacgatttccacgctcgagtcttccaactgaaaaattaaacatgggcgccaattcgtcaccaacagacttgaccactgatctcgatgagcagatctcgcagctcatgcagtgtaagccactttcggagcagcaggtcagagcattatgtgataaggcaaaggaaatactgatgaaagaaagcaatgtccagcctgtgagaagcccggtgacaatttgtggtgatatccatgggcagtttcatgatcttgcagaactttttcgaattggagggaagtgccctgatacaaactacttgtttatgggagattatgtggatcgtggatactattctgttgaaaccgttacgctgttggtggctttaaaagttcgttatccacagcggattaccattctcagaggaaatcatgaaagccgccagatcactcaagtttatgggttttatgatgaatgtcttcggaagtatggcaatgctaatgtttggaagatctttacagacctttttgactattttccattaactgctttggtggaatcagaaatattttgtctgcatggtggattgtccccttcaattgaaaccctggataatataagaaactttgatcgtgttcaagaggttcctcatgaaggacccatgtgtgatttattgtggtctgacccagatgatagatgcggttggggtatttcaccacgtggtgctggatatacttttggtcaggatatatctgaacaattcaatcacaccaacagtttaaaattgattgctagagctcatcagctggttatggatggatttaactgggcacatgaacaaaaggtggttactatattcagtgctcctaattactgttatcgctgtggaaacatggcttctatattggaagttgacgattgcaagagtcacacattcatccagtttgagccagctccaaggagaggtgaacctgatgttacccgtagaacaccggattacttcctgtgaagcagctatatgccacaacttattcaagatactcaacttttgttcctctcctctccccttacatagtcaggtagttgtggatcctttgcagatgtctgttgcatctactgcctgccattcttacatatcttttttttttttttgatatggtgagcaccaaaagcatgtatatgctagctatgaagatgacctttaatctgtcttacccttcgattttctgtcatagtgattgcatagcagataaaagatgggcaatattggactgtatccattatgcagttctttttaattctgattcctttttttgttgttgggggtgggtcatcctatctttttgaccttggtacagagatggaaaacttaaatacgtaatgtgtttattgctttctgagaaatccgtctttattaacagggtgacacatctccccgtagtgtatgaataatggttgttttactttccccccaagtatccataacctaaccttaatatttgttggggttgaaagaacgggaatgggggtagaataacccttccatgatgtcaattttattgttagttttaggttgggtaggtttctgagtagcaatgtatccgtatatattttattgatcataaatttatttaaagtcttttacgagggatagggaatgttgagggatccaacattagagtgaaggtctgtgcttcggttgacctataaatttagatatttatgtattttcatgttattctcataa

SEQ ID NO: 3738 - DNA, 1790 bp, Gossypium raimondii
tcgtcttcgtgatagaagcaagagagccaggaaaagagtgtaaaagagataaaaaagaaagttaaaacaaaaagaaaaaagaaaattctcaatccaaagtccaaactagggttagggttatccctaatcaggataacgatttccacgctcgattcttccaactgataaattaaacatgggcgccaattcgtcaccaacagacttgaccaccgatctcgatgagcagatctcgcagctcatgcagtgtaagccactttcggagcagcaggtcagagcattatgtgataaggcaaaggaaatactgatgaaagaaagcaatgtccagcctgtgagaagcccggtgacaatttgtggtgatatccatgggcagtttcatgatcttgcagaactttttcgaattggagggaagtgccctgatacaaactacttgtttatgggagattatgtggatcgtggatactattctgttgaaaccgttacgctgttggtggctttaaaagttcgttatccacagcggattaccattctcagaggaaatcatgaaagccgccagatcactcaagtttatgggttttacgatgaatgtcttcggaagtatggcaatgctaatgtttggaagatctttacagacctttttgactattttccattaactgctttggtggaatcagaaatattttgtctgcatggtggattgtccccttcaattgaaaccctggataatataagaaactttgatcgtgttcaagaggttcctcatgaaggacccatgtgtgatttattgtggtctgacccagatgatcgatgcggttggggtatttcaccacgtggtgctggatatacttttggtcaggatatatctgaacaattcaatcacaccaacagtttaaaattgattgctagagctcatcagctggttatggatggatttaactgggcacatgaacaaaaggtggttactatattcagtgctcctaattattgttatcgctgtggaaacatggcttctatattggaagttgacgattgcaagagtcacacattcatccagtttgagccagctccaaggagaggtgaacctgatgttacccgtagaacaccggattacttcctgtgaagcagctatatgccacaacttattcaagatactcaacttttgttcttctccgctctccccttacatagtcaggtagttgtggatcctttgcagtgtctgttgcatctactgcctgccattcttacatatcttttttttttgatgatggtgagcaccaaaagcatgtatgctagctatgaagatgacctttaatctgtcttacccttggattttctgtcaaagtgattgcatagccagggcaatatcggactgtatccattatgcagtttttttttaaaattctgatttccttttttttgttgttggggggtgggtcatcctatctttttgaccttggtacagagatggaaaacttaaatacgtaatgtgtttattgctttctgagaaatccgtcattattaacagggtgacacatctcccagtagtgtatgaataatggttggttttacttttccccccaagtatccataacctaaccttaatagttgttaatacatggggttgaaagaaggggaatgggggtagaataacccttccacgatgtcaattttattattagttttaggttgggtaggtttctgggtagcaatgtatccgtatatattttattgatcataaatgtatttaaagtcttttacgagggatagggaatgttgagttattctcatacatt

SEQ ID NO: 3739 - DNA, 1526 bp, Pteridium aquilinum
gcaccatgtctcctctttctctctctatctgtgtgcgtatcgcctgttcaagccccgtgccctgcagcacagacgcgcaggaaccctagcgaggacctctgctacctgctttctgaactggagccatgagcgttgcacccgccatcgttgagcgcaatggccatctcgacgcgcacatcgcccagctcatgcaatgcaagcctctgctggagcccgaggtgagatctttgtgcgagaaagccaaagaaattctaatggaagagaataatgttcagcccgtcaaatgtccagtcactatttgcggcgacattcatggacagtttcatgaccttgcagagcttttccgaattggtgggaagtgtccagatacaaattatctttttatgggagattatgtggatcgtggatattactctgtggaaacagctactcttctagtggctttgaaagtcagatatcctgatagaattaccatcctcagaggcaaccacgagagccgtcagatcacacaagtgtacggattctatgacgaatgcctcagaaagtatgggaatgcaaacgtatggaagatttttacggacctttttgattattttcctctaacagctttggtggagtcggagatattttgtcttcatggcggcttgtcaccttccatagacacccttgatcatgtaaggaaacttgagcgtgtacaagaagtaccgcatgaaggacctatgtgtgacctattatggtccgaccctgatgatcgctgcggatgggggatctcacctcgtggtgctggctatacatttggacaagatatatctgcacaattcaatcacaccaacaatttaaagcttatcgcaagagcacatcagttagtaatggaaggttttaactggggacatgaacaaaaggtggtgacaattttcagcgcgccaaactattgctacagatgcgggaatatggcctcaatcttggaggtggatgataacatgggacacactttcatacaatttgagccagctccaaggagaggagaacctgcagatgtgacaaggaggactcctgattatttcttgtagcaagccaaaagcctttattggtgtgcacgtatttgttttcaccatctctgaagagtctgctggaatcaggagcaggtgtgtgtagggagcagattgttttaagttggtgctggtatagggcggattggggggtgtgtgtcgaggagctaccgagtattgaaagagctggcaagggaaggtagggccgtgataaggttagagtcacatgtgaaatatgtggttttttttttgccattgtgtaccatgtatgtggaaggccctttgtcttgtctcaattctcagtcaagaggcaaggatctatttattgtcagaacattttagtttcttgctttgattccttgtatacctaacggcatctcatatggaaggttggttgcgcatctcgaggaaaaaaacaaaaaaaaagaaagcctttgctgtgcatctcttgaagggtgaccctcccttcctctgcac

SEQ ID NO: 3740 - DNA, 1123 bp, Arnica chamissonis
aattccattcattttcagataatttcaatcaatcgaaagatttcattcttcgaatccctatctgtgtgtatacatacatatgcacacacacacataacaccatgagtgtggagctggcttcggacacccatgggaatctggacgagcagatttcacagctcatgcactgcaaacccttaatcgaacccgaggttaggacattatgtgacaaggcaaaagagatattaatagacgaaagcaatgttcagccaagtaaaaagccccgtgactatctgtggtgacattcatgggcaattccatgatcttgctgaactttttcgtattggaggaaagtgcccggatacaaactacttgttcatgggtgattacgtggatcgagggtattattctgttgaaactgtcacactcttggtggctctgaaagtacggtatcctcagagaattacaattttaagagggaatcatgaaagtcggcagattactcaagtttatgggttttatgacgaatgccttcggaagtatggcagtgctaatgtttggaagacttttacagatctgtttgattatttcccattaactgcattggttgaatcagaaatattttgccttcatggtgggttgtcaccttctattgaaaccctagataatataagaaattttgaccgtgttcaagaggtcccacatgaaggtcctatgtgtgacctcttatggtctgacccagatgaccgttgtggttggggtatctcaccccgtggagctggttacacatttggccaagacatctcggagcaatttaaccataccaacagcctaaagcttattgcccgagctcatcaactggtcatggagggtttcaactggggacatgatcaaaaggtggtaaccatctttagtgcaccaaattactgttataggtgtgggaatatggcatctatcttggaggtggatgattgcaagggacacacatttatccagtttgaacctgctcctaggagaggagaacccgatgtaaccagaaggacgcccgactatttcctctaacctaggattatgttccgagcatgtaatttatcattatttcatttctaggtttgcagtgtgccggttcttggggttttaaggt

SEQ ID NO: 3741 - DNA, 1503 bp, Brassica rapa
tcttctcttcttcactgagcgagagagagagagagagttgacaaaaaaaaaaaaaagagagagagagagagagagagagagggaaaaagcgaagaatacgcagattcaatccaatttagggttagagattcccctaatttggaaacctaatcctggtcgctgatctgttttcccagatcggacgaagaatgggggcgaattcgataccgacggacgcaaccattgatctcgatgagcagatcgggcagctgatgcagtgcaagcccctctccgagcaacaggttagatcattatgcgagaaagccaaggagatcttaatggatgaaagcaacgttcagcctgtgaaaagccctgtgacaatctgcggtgatattcatggacagtgccatgatcttgctgaacttttccgtattgggggaatgtgccctgataccaattacctgtttatgggagattatgttgaccgtggttattattctgttgaaactgttacgctgttagtcgccttgaagttgcgataccctcagcgaatcaccattcttagaggaaaccatgaaagtcgtcagatcactcaggtttatggattttatgatgaatgtctgcgaaagtatggcaacgcaaatgtttggaaaatctttacagacctcttcgattatttcccactgacagccttggttgagtcagaaatattttgccttcatggtggattgtctccatctatcgagacacttgacaacataaggaactttgatcgagttcaagaagttccccatgaagggccgatgtgtgacttattatggtctgaccctgatgaccgttgtggttggggcatctctcctcgtggtgccggatatacatttggtcaggacatatccgaacagttcaaccactcaaacggcttaaagctgattgcccgagctcatcagctggttatggatggatacaactgggctcatgaacaaaaggtggtaactatcttcagtgcaccaaactactgttaccgttgtgggaacatggcttcgattcttgaggttgatgactgcaggaaccacagcttcatccagtttgagccagcaccgaggagaggagaaccagacgttactagaagaacaccagattatttcctctgatcactggacacagaatcatctcagcagctgcctccacaactgaaaaaaggtcacagttggttggtaactcaagaaatgtgttttaagttcaacttagtcccaccaccagaatatagtgtgtattgtaggcgaagaaggtcctctcttatcatcctctataaccaagaaaaaaaagagaggtcaatggactgactcgacagtaccccatcatacacattgtttgattgatgttattagcttatttcttttttttttttctgtgaatcagaatgtgtttttttcatgttaaagagatctttttgtttctataattcttttggagatttcactactttttagtttacaaatccaaagaagcttttttcattggaac

SEQ ID NO: 3742 - DNA, 1263 bp, Brassica napus
gagagagggaaaaagcgaagaatacgcagattcaatccaatttagggttagagattctcttctaatttggaaacctagtagtcctggtcccagatcggacgaagacgacggagtaacgagaatgggcgcgaattcgataccgacggacgcaaccattgatctcgatgagcagatctcccagctcatgcagtgcaagcccctctccgagcaacaggttagatcattatgcgagaaagccaaggagatcttaatggatgaaagcaacgttcagcctgtgaaaagccctgtgacaatctgcggtgatattcatggacagttccatgatcttgcagaacttttccgtattgggggaatgtgccctgataccaattacctgtttatgggagattatgttgaccgtggttattattctgttgaaactgttacgctgttagtcgccttgaagttgcgataccctcagcgaatcaccattcttagaggaaaccatgaaagtcgtcagatcactcaggtttatggattttatgatgaatgtctgcgaaagtacggcaacgcaaatgtttggaaaatctttacagacctcttcgattatttcccactgacagccttggttgagtcagaaatattttgccttcatggtggattgtctccatctatcgagacacttgacaacataaggaactttgatcgagttcaagaagtgccccatgaagggccgatgtgtgacttattatggtctgaccctgatgaccgttgtggttggggcatctctccttgtggtgccggatatacatttggccaggacatatctgagcagttcaatcactcaaacagcttaaagctgattgcccgagctcatcagctggttatggatggatacaactgggctcatgagcaaaaggtggtaactatcttcagtgcaccaaactactgttaccgttgtgggaacatggcttcgattcttgaggttgatgactgcaggaaccacagcttcattcagtttgaaccagcaccgaggagaggagaaccagacgttactagaagaacaccagattatttcctctgatcactggacacagaatcatctcagcagctgcctccacaactgaaaaggtcacagttggttggtaactcaagaaatgtgttttaagttccaacttagtcccaccaccagaatatagtgtgtattgtaggcgaagaaggtcctctcttatcttcctcttaaccaagaaaaaaaaagagaggtcaatggactgactcgacagt

SEQ ID NO: 3743 - DNA, 1078 bp, Centaurea maculosa
ttgatccaaatcgaagatcgaaagatgagcttggatctggtacagcgtgttaatcgcaatgttgatgaacatatcgcccagctcatgcagtgcaaacccttatctgaacaagaggttaggtcattatgtgataaggcaaaggagatcttgatgcaagaaagcaatgtgcagcctgttaaaagcccggtgacaatctgtggcgatattcatgggcagtttcatgatcttgcggagcttttccggattggagggaagtgcccagatacaaattacttgttcatgggagattatgttgatcatggttattactcggttgaaacagtgacgcttttggtggctctcaaagtgcgttatccacagcggattactattttaagaggaaaccatgaaagtcgacagatcactcaagtttatggattttatgatgaatgcctaaggaaatatggtagtgctaatgtgtggaagacatttacggacctattcgactattttccactgactgcattggtggagtctgaaatcttttgtctccatggtggattgtctccttcgattgaaactctcgataatatacggaacttcgatcgtgttcaagaagtgccccacgaggggcccatgtgtgatcttttatggtctgatcctgatgatcgttgcggttggggtatctctcctcgtggtgctggatatacatttggccaagatatatctgagcaatttaatcataccaacaagttgaaactgattgcaagagcgcaccagctggttatggagggtttcaactggggtcatgagcaaaaggttgtgacaattttcagtgcacctaattattgttaccgttgtgggaacatggcttcgatccttgaagtagatgattgcaagggtcacactttcattcagtttgaaccagctccaaggaggggagagccagatgtgacccgtaggacgccagattatttcttatgatgctgttttgattcatgggaaatacgcaaattgaaaatcgtcatcatcatcatcatcgatttactgggaaatgaggcagcgatcctggtgtaatttgctgctgcacaaacgcagt

SEQ ID NO: 3744 - DNA, 1483 bp, Ceratodon purpureus
gttccatcggtccatccctctgtgctctctggaattcaccattgccaaactgaccgcagcttcggaggatccttgggccggtacgcggaactgggagagagttagccaaataggggagagaccatgagtattcctccgatgtcgtcgaatgtgcacggccagctcgatgcacagattgcgcagctcattcaatgcaagcctttgcccgagcacgaggtgagaggactgtgcgaaaaggctaaggagattctgatggaagagaacaatgttcagccagtgaagtgtcctgtgaccatatgtggagacattcatgggcaattccatgatcttgcggaactgtttcggattgggggaatgtgcccagacaccaactacttattcatgggtgattacgtggaccgaggttactactctgttgaaacagccacacttttggtggcactgaaagttcggtaccaagaccgcattaccatcttgcgtggaaatcacgagagtcgacagattacacaagtgtatggattctatgacgagtgtctccgaaaatacggaaacgctaacgtttggaagatctttaccgaccttttcgattattttcccctgacggccttggtggagtcggagatattttgcttgcatggaggattgtcgccgagcatagattcattggatcacattcgtgacctagaccgagtgcaagaggtcccacatgaagggccgatgtgtgatcttctatggtcagatcctgatgaccgatgcggatggggtatttcccctcgaggtgccgggtacacttttgggcaggacatttccgagcagtttaatcacaacaacaatttgaagctcgttgcaagagctcatcaactagttatggagggttacaactggggacatgaacaaaaggtggtgacgatattcagtgcacctaattactgctatcgttgcgggaatatggccgctatcttggaagttgatgacaatatggggcatacatttatccagtttgaaccagctccaagacgaggtgaaccagatgtcacccggcgcacacctgactacttcttatagtagattatggaagtgtagctattagagcttgctcgggcctgccttttcttgtcttgattcaccctgcacttctgattatcaaggctcctttttgatggtcggtatggcgctcccaagtattaacgttccgcatggttgctgaaagagggcattatggcaataagtgatgtgatttattgggtgttcaactctagggtcgaggtaaagttgtatgtccatttatcgagccaccttgctcttcattcatgagttctcgttgttacacttctttcccttttggagtacatatattaaattgatgtgagaactggtatagagctgctacctttacatttgttgatgatgttgaaggtagataaggtttatgctatcttgagaaaacttgttgatgaacacaaatattattttacacttacag

SEQ ID NO: 3745 - DNA, 1512 bp, Trifolium pratense
gtgctttgttagtatttgacgcgccttcttcatttctgagttcctctttctcttccgtccacacttctcctcactccgagcgagcgagaaaggacgctccaaatttcttcaaattctacgattatttatcatcaaactttcccttattcaaatcttcttcttccgattcattcattcattcaccatacacaacaatgggtgccaattccctcgccgatcccactcacgatctcaacgaacagatctctcagctcatgcagtgcaagcctctatccgaacaacaggttaaagaattatgtgagaaggctaaggagattttaatgcatgaaagtaatgtccagcctgttaaaagccctgtgacaatttgtggtgatattcatgggcagtttcacgatcttgctgaactatttcgaattggagggaagtgtccagataccaactacttgtttatgggtgattatgtggaccgtggttattattcagttgagactgtgacactcctcgtggcactgaaagtgcggtatcctcagcgaattactattcttagaggaaaccatgaaagccgtcagattactcaagtatatggattttatgatgaatgcttaagaaaatatgggagtgctaatgtctggaagatctttacagacctctttgatttttttccattgaccgcattggttgaatcagaaatattttgtttgcatggtggactgtcaccttcaattgagacccttgataacataaggaacttcgatcgtgttcaagaggttcctcatgaaggtcctatgtgtgatctactgtggtctgacccagatgacagatgtggttggggtatttctcctcgtggtgctggatatacctttggccaggatatatctgaacaattcaatcacacgaacagccttaaattgattgctagagctcaccagcttgttatggatggatttaactgggctcatgaacaaaaagtggttaccattttcagtgctcccaactactgttatcgatgtgggaacatggcttccatattggaggttgacgattgcaagggtcacacatttatccagtttgaacctgctccaaggagaggagagcctgatgtcactcgaagaacacctgattacttcctgtaaagtagctgcttctgaatgtcatactgggatatcgtggttactctatttcaagtctaatttcaggtagttgtggatcctcattggtgaaattgctgtaggcatttgtatccattgatattgtggttgtccaaaggctgctttgatgtaaaataggcaggtaatattccaccgatctgttacactgaagaatttgctggacaccctatctggagaagtcgtcaaagattatgactctacgaggatgtattattccagcaaaatgtggatattttttgtatgttttccaagtcaattattttaatcatgttttatatcttcctttccgggctttaggtactatgactggattatttaactcgtggatgcttttgataatgtt

SEQ ID NO: 3746 - DNA, 1266 bp, Orobanche aegyptiaca
tcatgcagtgcaagcctttgtcagaacctgaggttagggccttatgcgagaaggctaaagagatactaatggaggaaagcaatgttcagccggtaaagagccctgtgacaatatgtggtgatatacatggccagtttcatgatcttgctgaacttttccgtattggagggaagtgtccagatacaaactacctttttatgggagattatgttgatcgtgggtactattcggtcgaaactgtcagtcttttggtggctctgaaagtgcgctatcctcaacggatcacaattcttcgaggaaatcatgagagcagacagatcactcaagtatatggtttttatgatgaatgtctgaggaagtatggaaatgccaatgtttggaagatattcaccgatctgtttgactatttccccctgactgcgttggtcgaatcagaaatattctgtctgcatggtggattgtccccctctgttgaaacccttgataatataagaaactttgatcgcgttcaagaagttccacatgaaggtccaatgtgcgatctgttgtggtctgatcctgatgatcgatgtggttggggtatatcaccccgtggtgctggatacacttttggccaggacatatcggagcaattcaaccacaccaacaatcttaaactaattgctagagctcatcaactcgtgatggaaggatataactgggcccatgaacaaaaggttgtcactatttttagtgcaccaaattattgttatcggtgtggaaatatggcgtccattttggaagttgatgactgcagggagcatacctttatccagtttgagccagctccaaggagaggtgaacccgatgttacccggaggacgcctgactatttcttgtagagctgacaattgtactctttagtttgtggtgcttacatgccgtgcccttatatttgagcatgatgttactggggcctttttggaggtgttgcgactgagaaaaggcatgtaacatgaagacactttgtcttaagttataacctgtcttagggttatagagttgggaaacgttgggttttgggaatgcatacgtgtaatcgtgttttatatcttttttgatgttctattgtctcccttgcaaataattttattcttccgtttccgttgaatcactgccattccatggacaggtgtttctatggaagtaattatggacttctctatgttgcttgatcttttatttttccgttacttattcttaaaagtctgatttccatcttgaaac

SEQ ID NO: 3747 - DNA, 1660 bp, Physcomitrella patens
atttgctctacctttcccctcgcgcgacctctgggcttgttctagggttgcggtgcgtttctcaccattgcgtttcgagagtgtcggagttggtttttgaggcggagatcagcggaaacggagggtagggcgatagcgtggagaaggggaagcgcaacaggagggacgacatgagtgtgcctccgatatcctctaatgggcagctggacacacagattgctcagctcatacaatgcaaaccgttatccgaggtcgaggtcagaggactatgtgagaaggcgaaggagatattgatgcgggaaaataatgttcagccagtgaagtgtccagtcacaatttgtggtgatattcatggccagtttcatgatcttgctgaactcttccgaattggaggaatgtgtccagacaccaattacttatttatgggagattatgtggatcgtggttattattcagttgaaactgctacactgctagtggctttaaaagtacgatatcctgatcgtattaccattctgcgtggcaatcatgagagtcggcagatcacccaagtgtatggtttctatgacgagtgtcttcgaaagtacggaaatgccaacgtatggaagatcttcactgacctgtttgattattttcctttaacagcactcgtagagtcggagattttttgtttacatggagggctttcgccaagcatcgattccttggaccacattcgggacctggatcgagttcaagaggttcctcatgaaggtccgatgtgtgatctactttggtctgaccccgatgaccgttgtggttggggcatttctccccgtggtgctggctacacatttggccaggatatatctgagcagttcaatcacaacaacaatctgaagttggtcgcaagggcacatcaattagttatggagggctacaattggggacatgaacacaaggtggtcactattttcagcgcacctaattattgctatcgctgtggaaacatggcttctatattggaagtggatgacaatatgggccacactttcattcagtttgaaccagccccgagacgaggtgaaccagatgtgacaaggcgcacgccagactacttcttatagtgggactttctgatagtagtttttaaagtatgctttgagctattttggatcgtctgtagtccatgcattcaatgatgtagattttcctcaggttagcatggtgttaccaagcgatagcagcctgaatgctgtcataaccgccacaccatcatatgatatgtatttcattgagcgggcatgctactctgcgcttgagatgtaagcgagtctctatttggagtgtcattggtgtcaagagtcctgatgtgaccattttttatactagatgtctgctgtgtatcgaagcaattgtagagatagttggtataacttcagagctataatgatgtagtggagttgcggtttagggttaagatggatcagcggttagtctataatagtcattgattgatcactcttatcggagagtagcttcttccgacgtgggatttattagcgtcatcgttgaaccggacccatgtcggggttggattatgctgttaatggaatgactgtacaggcagttgctgaatattaagtgatgaggatcccgtcccaaggacccttcattctag

SEQ ID NO: 3748 - DNA, 1477 bp, Raphanus sativus
gcacgcgccatccccaaccaaactcgatcttctttcactgcgcacacaaagcgagagacgaagaagaagaagagagagagaaaacaaaagtgagaaaggaaagcgtagaaatttagggtttcctggatcggacgaagagggaaggaaggaaggaaggaaggaaggaaggaaacgagaatgggcgcgaattcgataccgacggaggcaacgattgatctcgatgagcagatctcgcagctcatgcagtgcaagcccctctccgagcaacaggttagatcattatgcgagaaagccaaggagatcttaatagatgaaagcaacgttcagcctgtgaaaagccctgtgacaatctgcggtgatattcatggacagttccatgatcttgctgagcttttccgtattgggggaatgtgccctgataccaactacctgtttatgggagattatgttgatcgtggttattattctgttgaaactgttacgctgttagtcgccttgaagatgcgatatcctcagcgaatcaccattcttagaggaaaccatgaaagtcgtcagatcactcaggtctatggattttatgatgaatgtttgcgaaagtatggcaacgcaaatgtttggaagatctttacagacctcttcgattacttcccattgacagccttggttgagtcagaaatattctgcctccatggaggattgtctccatctatcgagacacttgacaacataaggaactttgatcgagttcaagaagtgccccatgaagggcccatgtgtgacttattatggtctgatcctgatgaccgttgtggttgggggatctctccacgtggtgctggatatacatttggtcaggacatatccgaacagttcaaccactcaaacagcttaaagctgatcgcaagagcccatcagcttgttatggatggatacaactgggctcatgagcaaaaggtggtaactatcttcagtgcaccaaactattgttaccgttgtgggaacatggcttcaattcttgaggttgatgactgcatgaatcacagcttcattcagtttgaaccagcaccgaggagaggagaaccagacgttactcgaagaacaccagactactttctctgatcactagacacagagtgatctcagcagctgcagccaacaactgaaaagtcacagttggtaactcaagtatctggtttctgtgcagcttgttaaggttgctggcgaagaaggccctctctgatcttcctctatacccaagaaaaaagaggtcaatgggtgactctacattacccatcatgcatgcacattgtttggttgatgttattaccttcttttttcttctttctgcatcagattgtgttttctcagatctttttaattttatttattgtaattcttcacccaaatgtcatgcactattttttagtttacaaatctaatgactgattgcagtcgttttatctgtaacaaccgtgga

SEQ ID NO: 3749 - DNA, 1387 bp, Euonymus alatus
ggaggaaataaagctgaagggaaaggacaatgtcgaatcttttattagggttgtgtttgggattttgattgaatctgaatcttcgtcaaagaatgatttgttaaagtctagaaactgatcgaagaagggaaaaaatggcttcagatgccaacatggacgagcagattgagcagctgatgcagtgcaagcctttgacggaggaccaggttagggctctctgtgacaaggcgaaggaggtactaacggaggaaagtactgttcagcctgttaaaagtccagtaaccatttgtggtgatattcatgggcaatttcatgaccttatagagcttttccagattggagggaagtgtcctgatacctaactacttgttcatgggagattatgtggaccgtggctattattcagttgaaactgtaactctcttggttgctctcaaagtacgttatccacatcgaattactattctacgaggaaaccatgaaagtcgacagatcactcaagtttatgggttttacgatgaatgcctccgaaagtatggcagtgctaatgtttggaaaatgttcacggacctgtttgattatttgccattgacggccctggttgaatctgaaatcttttgtttgcatggtgggttgtcaccatccattgaaacccttgatagcatacggagttttgaccgtgtccaagaagttcctcatgaaggggccatgtgtgatcttttgtggtccgacccagatgatcgttgtggttggggcatctctcctcgtggtgctggatatacttttggccaggacatttctgagcaatttaaccatacaaacaacctcaatctgattgctagagctcatcagctggttatggagggatttaactgggcacacgatcaaaaggtagttaccatatttagcgcacccaattactgttatcgttgtggaaacatggcgtctatcttggaagttgacgactataaaggacacacatttacccagtttgagccggctccaagaagaggagaaccagatgtaactcgtaggactcctgattacttcttataattcttgtattagatgttgcagttccagcagtcgtggctatcgattcagatgaaatggtttctgctgctttaatattatcattctcggagtccatactacaattaaggcggtgtacgggcccaaagaatgtaaatgtgctgggctgttatttcttgattatctttgttaattatggtggtttgcttggaagggctgttaattggctatactatacatggatgtattaagttgctacggaagagagacaaaatgcctgattggattggctgcaatggtgagtattagaatgtattttctggtcatttgaaggtcgatattattattttacggc

SEQ ID NO: 3750 - DNA, 1558 bp, Rosmarinus officinalis
accttcttcgcccagagcgagaaaaagcaaccaacagaacgacgccgtcggaggaatcgattgcatcgggaaatcgagaaatctagggttttttccgtacctgatggatgcggcggtggcttcgggcggtggcgaaggaaccaatggcaacctcgacgaacaaattgcgcagctcgtgcagtgcaaacccttgtccgagactgaggtaaggatgttatgtggcaaggccaaggagatcctgatgcaagagagcaacgtgcagcctgttaaaagcccagtaactatatgtggtgatattcatggtcagttccatgatcttgctgagcttttccggattggtgggaagtgtccggatacaaattatttgtttatgggagattatgttgatcgaggatactactctgtggagacagtgacgctcttggtggctttgaaagtgcgttatcctcaaaggatcactattctacgtggaaatcatgaaagccgccagattactcaggtttatggtttttacgatgaatgcctaagaaaatacggaagtgctaatgtgtggaagaccttcacagatttatttgacttctttcctcttactgcactggttgagtcagaaatcttctgtcttcatggtgggttctcgccatccattgaagctcttgataatatccgtaatttcgatcgcgttcaagaagttcctcatgaagggcctctgtgtgaccttttatggtctgatcctgatgatcgatgtggttggggtatctctcccaggggtgctggatatacatttggccaagacatatcagagcaatttaatcataccaacaacttgaagcttattgctagagctcaccagctggttatggaggggtttaactgggctcatgaccaaaaggttgttacaatctttagcgcacctaattattgttgccgctgtggaaacatggcatctattcttgaagttgatgattgcaggggtcatacattcattcagtttgagccagctcccagacgtggtgagccagatgtgactcgaagaacaccagattactttctctgagtagctggaggggttgccgagttcagttaggcagattcctgctagctgctttgtgtgttgatatctgcctataatttttctaaaaatatactgcaagtatcaatcttttggtggtagaaagcatacaaaagaagttcggtgctgccttcttcagttcacatacactgcaaaagagccagtggagctggctgtgctgtccattcacatacactactgatgcaaagatgtggaattttcccccactttctcgttttttccaatttttgcttaccatattttgtactagattacattaaatttttgtctctctccaaaacttttgtcttctcatttgagaaaatacaaaaggttgtagaggagagagttttatcacttcctaaatatctagcggatgctgttatatacttttgtgaccatatattggtgttttttttgcatttaaagaatggtcttttgatcagtatgttctgctttaaggagttgaacttcgtactgttgtcgacg

SEQ ID NO: 3751 - DNA, 1451 bp, Brassica rapa
acgcgccgtcccaaaactcgatcttcgttaactgcacacaaagcgagagagaagaagagagaaagcgtagaaatttaggggattcctgatcggaggaaagacggaaggaaggaaaatgggagtggattcgataccaacagacgcaacgattgatctagatgagcagatctcgcagctcatgcagtgcaagcccctctccgagcaacaggttagatcgttatgcgagaaagccaaggagatcttaatggatgaaagcaacgttcagcctgtgaaaagccctgtgacaatctgcggtgatattcatggacagttccatgaccttgctgagcttttccgtattgggggaatgtgtcctgacaccaactacttgtttatgggagattacgttgatcgcggttattattctgttgaaactgttacgctgttagtcgccttaaagatgcgttatcctcagcgaatcaccattcttagaggaaaccatgaaagtcgtcagatcactcaggtctatggattttacgatgaatgtctgcgaaagtatggcaacgcaaatgtttggaaaatctttacagacctcttcgactattttccattgacagccttggttgagtccgaaatattctgccttcacggtggattgtctccatccatcgagacccttgacaacataaggaactttgatcgagttcaagaagtgccccatgaagggccgatgtgtgacttattatggtctgatcctgatgaccgttgtggttggggcatctctccacgtggtgctggatatacatttggtcaggacatatccgaacagttcaaccactcaaacggcttgaacctgatcgcaagagcccatcagcttgttatggatggatacaactgggctcatgagcaaaaggtggtaactatcttcagtgcaccaaactattgttaccgttgtgggaacatggcgtcgattcttgaggttgatgactgcatgaaccacagtttcattcagtttgaaccagcaccgaggagaggagaaccagacgtcactcgaagaacaccagactacttcctctgatcattagacacagagtcatctcagcagctaaagccacaactgaaaagtcacagttggtaactcaacaatctggttactatgcaatgtgtgtcaagtttgctgtgtgtttaagttcaacttagtcccatcaccagaatatagtgtgatatagtcgaagaaggccctctcttatcttcctctataaccaagaacaagaggtcaatggattgattctacaatacccatcatgcatgcacattgtttggttgatgttattagcttatttttcttcttctttctgcatcagattgtgttttcatgcgagagatccttttaattttatttattgtaattcttcacccaaatgtcactattttttagtttacaaatctagtgaagcttttttattgcaaaa

SEQ ID NO: 3752 - DNA, 1451 bp, Vicia sativa
tcactgcgagagcgagcgaggacgctgaaaaaatctcctcctcctagggtttgttaaaacttccccaatttgaatcttctctcccgatttcaccataaaatgggtgccaattcgaatctagccgaatccactcacgatctcaacgagcagatctctcagctcatgcagtgcaagccgctttctgaacaacaggttaaagaattatgtgagaaggctaaggagattttaatggatgaaagtaatgtccagcctgtgaaaagcccggtgacaatttgtggcgatattcatgggcagtttcatgatcttgctgaactatttcgaattggagggaagtgtccagataccaactacttgtttatgggcgattatgtggatcggggttattattcagttgagactgtaacacttctcgtggcactcaaagtgcggtatcctcagcggattactattcttagaggaaaccatgaaagtcgtcagattactcaagtatatggattttacgatgagtgcctaagaaagtatgggagtgctaatgtctggaagatctttacagacctcttcgattttttcccgttgactgcattggttgaatcagaaatattttgtttgcatggtggactgtcaccgtcaattgagacccttgataacataagaaactttgaccgtgttcaagaggttcctcatgaagggcctatgtgtgatctactatggtctgacccagatgacagatgtggttggggaatttctcctcgtggggctggatacacctttggccaggatatatctgaacagttcaatcacacgaacagccttaaattaattgctagagctcaccagcttgttatggatggatttaactgggctcatgaacaaaaggtggttaccattttcagtgctcctaattactgttaccgatgtggcaacatggcttccatattggaggttgatgattgcaagggccacacatttatccagtttgaacctgctccaaggagaggagaacctgatgtcactcgaagaacgcctgattacttcttgtagtgtagctgcggctgaatgtctctctcatactggcatatcatgggtactctactttcagtttaatatcaggtagttgtggatcctcattggggagattgccgtagtgcttatatccagttgatattttggttgtccaaaggctgctttgatgtaaaataggcggttaatattccaccgatctgttacactgaagaatttgctggacaccttatctggaagaagtcgtcaggattatgactctacaaggatgtattaatccagcaaaatgtggatattttttttgtatgttttccatgttattttttttatatattatgttttccaggccctagttcctacacgactggatttttttaaatctctgggacgcttttgatattttatctcaattttagtaaaagtttcatggt

SEQ ID NO: 3753 - DNA, 1385 bp, Nicotiana benthamiana
aataaaaaaaatgagcttagatccagtggtgtcatctcaaggaaatcttgatgagcaaattgctcagcttatgcagtgcaaacccttatccgaacaagagataagaggattatgcgggaaagcaaaggagatcttaatgaataaaagcaatgtgcagccagtgaaaagccctgtgactatatgtggtgatattcacgggcagttccatgatcttgctgagcttttccgtattggtgggaagtgtcccgacactaactatctatttatgggagattatgtagatcgtggatactattctgttgaaacagtaacgcttttggtggctctcaaagttcggtatcctcagcggattacaattttgaggggaaatcatgagagccgtcagattactcaggtttatgggttttatgatgaatgtttacgaaaatatggcaatgccaatgtgtggaagacttttacagatctatttgactatttcccgctcacagttttggttgaatctgaaattttttgcctccatggtggtttgtctccatctattcaaactcttgataatatttttgaccgagtccaagaagttccacatgagggggccatatgtgatcttttgtggtctgatcctgatgatcgatgcggctggggtatttcacccaggggtgctggatatacatttggccaagatatatctgagcagtttaaccacaccaacaacttaaaactaattgcgagagcacaccaactggttatggagggattcaattgggcacatgatcaaaaagtggttaccatatttagtgcccctaattattgctaccgctgtgggaatatggcatctatcttggaagttgacaattgcaatggccatacattcattcagtttgaaccagctcctaggagaggggaaccagatgtaacccgaagaacgccagattacttcttatgatcaagctgataaacatggtgattttattgcagcagttcttgctaaactggtttatatgctgtgagcttcgtatgagttctatagttgttactgctatagtatcacgatactgcgattgcatgaagtatgtacatcgggcaggtgacgtgttcttcctctcagagttctcctgaaacctcatggaaatgcagtgaagtgacaatttaaccgataacggcgtcactactgcatgtatcatttccaacaaacaatgttcaaccgtttttcttttccttacatatttttttcgttactagtagaaaggaccatcatttccttcgttgatatttttgtcccctctgtagaaagactatatctctcgtgtgagctctgtagaggcaagatattatttttacgtcataatgggttcttgagtaatttatgttctttcaccttgctcagt

SEQ ID NO: 3754 - DNA, 1018 bp, Flaveria ramosissima
ctcacagctcatggagtgcaagcccttaacggagcctgaggttaagacattatgtgagaaggcaaaagagatacttatggctgaaagcaatgttcagcctagtaaaagccctgtgacgatttgtggtgacattcatgggcagtttcatgatctcgcggaacttttcgaataggagggaagtgccctgatactaactacttgtttatgggggattacgtggatcgaggatattattctgttgaaactgtcacgctcttggtggctctgaaagtgaggtatccacagcgaattacaattctaagaggaaatcatgaaagtcgtcagatcactcaagtctatgggttttatgatgagtgccttcgaaagtatggcaatgctaatgtttggaagacttttaccgatctctttgactattttccattgactgcattggttgaatcagaaatattttgccttcatggtgggctgtcaccttcaattgaaactctggacagtataaggaactttgaccgcgtgcaagaggttccacatgagggtccgatgtgtgatcttctatggtctgacccagatgaccgttgtggttgggggatctcaccacgtggggccggatacacctttggccaagatatttctgaacaatttaatcataccaacaacctcaagcttattgctagagctcatcagctggtcatggagggattcaactggggacatgagcaaaaagttgtcacaatcttcagcgccccaaattattgctatcgatgtgggaacatggcttctatcctggaagttgatgattgcaagggccacacttttattcagtttgatcccgctcctaggagaggagaacctgatgtaaccagacgaacccctgattacttcctctaaacggttcacttatatcgattcatggtcctctggcaagattcgggcttttgatacaacgatatgggccaaaggtcatcaggggaagcgcaagaaaaggataagatggtttgtaaaatggacattgtatgat

SEQ ID NO: 3755 - DNA, 1126 bp, Ambrosia trifida
ttgttaccttcccaattccgttttcttagtgtaccctacattttgggttcattcgaaacaaattcgatctgtttgattatatgtatataatctgacaagatgagtacagatctagcaactaacacccactggaaacctggacgaacagattgctcagctcatggagtgcaagcccttatccgagcctgaggttaagacattatgtgagaaggcaaaagagatacttatgggtgaaagcaatgttcagcccgtaaaaagcccagtgacaatatgtggtgacattcatgggcagtttcatgatcttgctgagctttttcgtataggagggaagtgcccagataccaactacttgtttatgggggattatgtggatcgaggatattattctgtcgaaactgtcacgcttttggtggctctgaaagtgaggtatcctcagcgaattacaattctaagaggcaatcatgaaagtcgtcagatcactcaagtctatggattttatgatgaatgccttcgaaagtacggcaatgctaatgtttggaagacttttacagatctctttgactattttccattaactgcattggttgagtcggaaatattttgtcttcatggtgggctatcaccttcaattgaaactctggacagcataagaaacttcgaccgtgtgcaagaggtcccacacgagggtccaatgtgtgatcttctatggtccgacccagatgaccgttgcggttgggggatttcaccacgcggggctggatacacctttggccaggacatttctgagcaatttaatcataccaacaacctgaagcttattgctagagctcatcagctggtcatggagggattcaactggggtcatgagcaaaaagttgtcactatctttagcgcaccaaattattgctaccgatgtgggaacatggcttctatcttggaagttgatgattgcaagggccacacatttatccagtttgatccagctcccaggcgaggagaacccgatgtaacaagacgaacgcctgattattttctctgagtggtccagttgaagtggttcatgatcttttgtcgagattcgggcttttgatacaacggtatgggccaaaattcataaggtgaagtg

SEQ ID NO: 3756 - DNA, 1212 bp, Brassica oleracea
gaaaaagcgaagaatacgcagattcaatccaatttagggttagagattcccctaatttggaaacctaatcctggtcccagatcggacgaagacgacggagtaacgagaatgggcgcgaattcgataccgacggacgcaaccattgatctcgatgagcagatcgggcagctgatgcagtgcaagcccctctccgagcaacaggttagatcattatgcgagaaagccaaggagatcttaatggatgaaagcaacgttcagcctgtgaaaagccctgtgacaatctgcggtgatattcatggacagttccatgatcttgctgaacttttccgtattgggggaatgtgccctgataccaattacctgtttatgggagattatgttgaccgtggttattattctgttgaaactgttacgctgttagtcgccttgaagttgcgataccctcagcgaatcaccattcttagaggaaaccatgaaagtcgtcagatcactcaggtttatggattttatgatgaatgtctgcgaaagtatggcaacgcaaatgtttggaaaatctttacagacctcttcgattttttcccactgacagccttggttgagtcagaaatattttgccttcatggtggattgtctccatctatcgagacacttgacaacataaggaactttgatcgagttcaagaagtgccccatgaagggccgatgtgtgacttattatggtctgaccctgatgaccgttgtggttggggcatctctcctcgtggtgccggatatacatttggtcaggacatatctgaacagttcaatcactcaaacggcttaaagctgattgcccgagctcatcagctggttatggatggatacaactgggctcatgagcaaaaggtggtaactatcttcagtgcaccaaactactgttaccgttgtgggaacatggcttcgattcttgaggttgatgactgcaggaaccacagcttcatgcagtttgagccagcaccgaggagaggagaaccagacgttactagaagaacaccagattatttcctctgatcactggacacagaatcatctcagcagctgcctccacaactgaaaaggtcacagttggttggtaactcaagaaatgtgttttaagttccaacttagtcccaccaccagaatatagtgtgtattgtaggcgaagaaggtcctctcttatcttcctctataacc

SEQ ID NO: 3757 - DNA, 1521 bp, Euphorbia peplus
atgaattccaaaaagcgagcgatgcaatttccggcgagaaaaagcattttctggtgaggtaattttaaaatcgggtgagacggcagctggtccactcaattgtatcactcgctactccatacacgcgctctcccattttcgtcttcgttcgtattacacagagttattcaatcctagtagggttaggggtatccctaatcctgataccgttatcacgactatggattcgaatactccgtccactgattccgtgtccgatctcaacgagcacatctcccagcttatgcagtgccgccctctctccgaaccccaggttagatcattatgtgacaaggctaaggagatactgatgcaagaaagcaacgttcagcctgtcagaagccctgtcactatatgtggtgatattcatggacagtttcatgaccttgcggagctctttcgaataggagggaagtgtccggatagcaattacttatttatgggagattatgtggaccgtggctattattctgttgaaactgttacgctcctagtggccctgaaagtgcgttatcctgagcgaataacaattcttagaggaaatcatgaaagtcgtcagatcacacaggtttatgggttttatgatgaatgcctacgaaagtatgggaatgctaatgtgtggaagactttcacagacctttttgattattttccgttgactgctttggtggagtcggaaattttttgtttgcatggtggattgtcgccgtcaatagaaaccctggacaacataagaaattttgatcgtgttcaggaggttcctcatgaaggagctatgtgtgatctcttatggtctgacccagatgatcgatgtggttggggtatatcacctcgtggtgctggatatactttcggtcaagatatatcagagcaatttaatcatagcaacaacctgaagttgattgccagagctcatcagcttgttatggatggatttaactgggcacatgagcaaaaagtggttaccatattcagtgcacctaattattgttaccggtgcggaaacatggcttctatattggaagttgatgattgcagaggccacacattcatccagtttgaacctgctcctcggaggggagagcctgatgttacacgtagaacgcccgattatttcctgtaaatcagccttatgtcgcacctgtttgacctgttcctcagctgccactccatctgttttttgcgctttaggcggttgagatcctagttgcaacatatatctacagagtttagtgcttctagaagcatgctttttcctagtatggaggcgaaaagcgtgtgtaacagcccaggttttaagtgttttgttctttattttagctgttgaatgccggatagcaatcactatttagattgtatcttttgtagtagaactatggatgatgctttattcacccttatcgtcgacccttgttagttttggtatttggtagatgcattatcccgttatctccttgtaattgtcaacatggtttataaagt

SEQ ID NO: 3758 - DNA, 1524 bp, Gossypium raimondii
aaggtatctaaaagtagagaaatcattaatgatcaaattaattgtagaaatcaatttttttttttacaaattgaaatctgcacaatttgatctcatttttctttctaagaaaaaaaaatcaggttatatttttcttttgaattaataagtttgagaaaactttgggaatctaaggttaaagaataattaaaagaaatggaatcttcggtgggtttgaattcacatgataatttggataaacagatttctcagctgatgcagtgtaagcccttatcggagcaagagattaagctgctatgtgacaaggctaaggagatattaagggatgaaagcaatgtccagcctgttaaaagccctgttacaatatgtggtgatattcatggacagtttcatgatcttgcagagctttttcgaattggagggaagtgtccagatacaaattacttgttcatgggagattatgttgaccgaggttactattcagttgaaactgtaacactcttggtagccatcaaagcgcgttaccctcaacggattacgattctaaggggaaatcacgagagccgtcagattactcaagtgtatggcttttatgatgaatgtctaaggaaatatgggactgcaaatgtttggaagactttcactgatctatttgattattttccattaacagcattggtggaatctgaaattttctgtctccatggtgggttatccccggcaattgaaaccttggacaacatacgtaatttcgaccgtgttcaagaggttcctcatgaaggtcccatgtgtgatttattgtggtccgaccccgatgatcgttgcggttggggtatttctccaaggggtgctggatatacctttggccaagacatatctgagcaatttaaccacaaaaacagtttgaaactcattgctagagctcatcaactggtgatggaagggttcaattggggtcatgaacaaaacgttgttactatattcagcgcaccaaattattgttatcgatgcggaaacatggcttccatcttggaagttgatgattgcaaggctcatacattcattcagtttgagccagctcctaggagaggagagcccgatgtgactcggaggacacctgaatacttcctgtaaaaaggaatcagcatggacttgatgagcctccgatggtcagtgcccgtcaacggtggttgttccgtggcagcgagcttgtatgtggctgattagagacattatgtggggggggggggatgcaccatttctagcagataatgtgagactattatttattttccttcatttttgtttcctttcatgtggagggatgttgagaacattttctttataattgatgtttactacattttcgtaattttttcttcaattataaaggttttaaggtgtctgtgggcaattttatttaggggtcgagataaaattataaaattttggagggactaaggacccaatgttaatttttcgttagaatacttaaattatattgcttatatttttagaggtgcc

SEQ ID NO: 3759 - DNA, 1611 bp, Solanum tuberosum
caccaccaccactcgctcactcactcacttctcttcctttctttctctctctgtgcggagctgagagaaaatcaaaagcgaatcaaacctccattttgatttcttccccctttttatgctgtgaacaaaatctagggtttctgctgtggagtgtggagtgtggagaaagtttcctcatcgccgttgtctgtttcttggagttacctctggacccacaagtagtagaagaagatcaccatggattcggtaggaaatcttgatgaacaaattggtctgcttatgcagtgcaaacccttgtccgagcaggcggtaagaggactgtgtgagaaagcgaaggagattctagtgcaagagagtaatgtgcagcctgtgaaaagccctgtgacgatatgtggtgatattcatgggcagttccatgatcttgctgagctttttcgaattggtgggaagtgtcccgacactaattatttattcatgggagattatgtggatcgtggatactattctgtcgaaacagtttcgcttttggtggctctcaaagttcgctatccccaacgaattacaatcctaaggggaaatcatgagagtcgtcagattacgcaggtttatgggttttatgatgaatgccttcgaaaatatggtaatgccaatgtgtggaagactttcacagatctgtttgactactttcctctgactgctttggttgagtcagagatattttgcctccatggtggtttgtctccgactatcgaaactcttgatgatatacgcaattttgatcgggtccaagaagttccacatgagggggccatgtgtgatcttctatggtctgatcctgatgatcgttgtggttggggtatctccccaaggggtgctggatatacatttggccaggatatttctgagcaatttaaccacaccaacaacttgaatctaattgctagagcacaccagctggttatggagggattcaattgggcccatgatcaaaaggtggttaccatctttagtgcacctaattattgttaccgctgtggtaatatggcttccatcttggaagtggatgatgccaaggaccgtacattcattcagtttgaaccagctcccaggagaggggagccagatgtaacccgaagaacacccgattacttcctatgatgcaagtgggcaaatctattgatttctgtgcagaaggtcctgttaactgcttcatatgttgtgagcctcttacgagcttatagttcctctgctacaatggtgtaagcgaatggtatggaatgaagcatgtaaatcaggcatgtgatacttcgttctttccattgttgaaacctcattaagatgctgtgaagagatggtgaaaccagtgacagttagggtgcatgtatcattaatccgcaaacattgttcaactcttttttccctttgatcctatattcttttttttctcactgctagtagtagaaaggacaatgatctgcttactcgatacattttgtccctttacaaggacaatcactatcgcctaagctccatagaggtaaacgataatcacttttacacctttcaatgagtgttcgtgtaattttctatgagtgtcaagactctattttg

SEQ ID NO: 3760 - DNA, 1749 bp, Solanum phureja
caaaagcaaaagagtaggttttttcctatttcaccctttcctccctttggtttcaccaccaccactcgctcactcactcacttctcttcctttctttctctctctgtgcggagctgagagaaaatcaaaagcgaatcaaacctccattttgatttcttccccctttttatgctgtgaacaaaatctagggtttctgctgtggagtgtggagtgtgaagaaagtttcctcatcgccgttgtctgtttcttggagttacctctggacccacaagtagtagaataagatcaccatggattcggtaggaaatcttgatgaacaaattggtctgcttatgcagtgcaaacccttgtccgagcaggcggtaagaggactgtgtgagaaagcgaaggagattctagtgcaagagagtaatgtgcagcctgtgaaaagccctgtgacgatatgtggtgatattcatgggcagttccatgatcttgctgagctttttcgaattggtgggaagtgtcccgacactaattatttattcatgggagattatgtggatcgtggatactattctgtcgaaacagtttcgcttttggtggctctcaaagttcgctatcctcaacgaattacaatcctaaggggaaatcatgagagtcgtcagattactcaggtttatgggttttatgatgaatgccttcgaaaatatggtaatgccaatgtgtggaagactttcacagatctgtttgactactttcctctgactgctttggttgagtcagagatattttgcctccatggtggtttgtctccgactatcgaaactcttgatgatatacgcaattttgatcgggtccaagaagttccacatgagggggccatgtgtgatcttctatggtctgatcctgatgatcgttgtggttggggtatctccccaaggggtgctggatatacatttggccaggatatttctgagcaatttaaccacaccaacaacttgaatctaattgctagagcacaccagctggttatggagggattcaattgggcccatgatcaaaaggtggttaccatctttagtgcacctaattattgttaccgctgtggtaatatggcttccatcttggaagtggatgatgccaaggaccgtacattcattcagtttgaaccagctcccaggagaggggagccagatgtaacccgaagaacacccgattacttcctatgatgcaagtgggcaaatctattgatttctgtgcagaaggtcctgttaactgcttcatatgttgtgagcctcttacgagcttatagttcttctgctacaatggtgtgagcgaatggtatggaatgaagcatgtaaatcaggcatgtgatacttctttctttccattgttgaaacctcattaagatgctgtgaagagatggtgaaaccagtgacagttagggtgcatgcatcatttttccgcgaacattgttcaactcttttttccctttgatcctatattcttttttttctttctgttagtagtagaaaggacaatgatctgcttactcgatacattttgtccctttacaaggacaatcactatcgtctaagctccgtagaggtaaacgataatcatttttacacctttcaatgagtgttcgtgtaattttctattaggtcaagactctattttgatttcttaaaggggttttattcaagtctgacggatatttttagctcaaattttatagttgagtttaaaactcaaatgtatttcgcg

SEQ ID NO: 3761 - DNA, 1262 bp, Helianthus annuus
gatcatggagtctttgtttttcaatttcgaatatttttagaaaaaccagaggcgatccaatgaaataacaacaggcgctctctctctctcgttttctctcccagtgtcgtcttctccactcgctcattcattacatgtttcaaatcaatccatacaaatgagctcggatccagttatgcagggggtgaatcacaatgttgatgaatatatctcccagctcatgcagtgcaaacccttgtctgaaccagaggttaagtcattatgtgataaggcaaaagagatcctgatgcaagaaagcaatgtgcagcctgttaaaagccctgtgacaatctgcggggatattcacgggcaatttcatgatctcgcagagcttttccggatcggagggaagtgcccggacacaaattatttattcatgggagattacgttgaccgtggttattactcggttgaaacagtgtctctcttggtggcccttaaagtgcgttatccgcaaaggcttactattctaagaggaaaccatgaaagtcgccagatcactcaagtgtacggattttatgacgaatgcttaagaaaatacggaactgctaacgtgtggaagacatttaccgatctatttgattatttaccactcaccgcattggttgaatctgaaatcttttgtcttcatggtggattgtctccgtcaattgaaacactcgataatataagaaattttgaccgtgttcaagaagtgccccatgaggggcccatgtgtgatcttttatggtctgaccctgatgaccgttgcggttggggtatttcacctcggggcgctggatatacatttggtcaagatatatccgagcaatataatcatacaaacggcttaaagctaattgctagagcacaccagctggttatggagggattcaattggggacatgaacgaaaagttgtgacaatttttagcgcgcctaattattgttaccgttgtgggaatatggcgtcaattcttgaagtggatgattgcaagggtcacacgttcattcagtttgaaccagctccaaggaggggagagcctgacgtgacacgtagaacacccgattatttcttatgatgctgacatggcagtcttgatcagaccggcatgctgactcattctctcatgggaaataaagagaccaaaaagggcatatatggaattttgaaaatgaggcagtgatcctggagttgctttgctgcacaaacataacaaccatcagtttggtcatttttcattg

SEQ ID NO: 3762 - DNA, 1465 bp, Vigna unguiculata
aatcaaccgccattacgtaacactccattattttcacttactcgtcactctgctctctccccacaccggagaaaaccaaatcgctttctccgttagggttagggtttccattttcccctaatccaatcctgcagcgacatgggcgccaattcgttgccatcggcggaatccaacttcgatctcgacgagcagatctcgcagctcatgcaatgcaagccgctatccgagcaccaggtaagagttttatgtgagaaggctaaggaaattttaatggatgaaagtaatgtccagcctgtgaaaagccccgtgacaatttgtggtgatattcacgggcagtttcatgatcttgcagaactatttcgaattggagggaagtgtccagatactaattacttgtttatgggtgattatgtggaccggggttattactcagttgaaactgtaacacttcttgtgtcactgaaagtgcgatatcctcagcgaattactattcttagaggaaatcatgaaagtcgacagatcactcaagtatacggtttttacgatgagtgcctcagaaagtatggtaatgctaatgtttggaagacttttacagacctttttgatttctttccattgactgcattggtcgagtccgaaatattctgtttgcatggtgggctttcaccttcgattgagactcttgataacataaggaactttgatcgcgttcaagaagttcctcatgaagggccgatgtgtgatctgttgtggtctgaccctgatgataggtgtggctggggaatttctcctcgtggtgcaggatatacttttggccaggatatatctgaacaatttaatcactccaacaagcttaagttaattgctagagctcatcagctggttatggatggatttaactgggctcatgaacagaaggtggttaccatttttagtgcacctaactactgttaccgatgtgggaacatggcttcaattttggaggttgacgattccaagggccacacatttatccagtttgaccctgctcctagaagaggagaacctgatgttacccgtagaacgcctgattacttcctatgatgttgctgctgcagcatatcatactgatgtcatagttacaactcattctgcacaaatggcgtgtagtttgttcatcctcatccgcattgatgagattgctgtaagcacttaatctatgggtacgcacttcaaacattttcggcgactgcccaatactgctttgatgtaaaataggcaggtaaaaaattccagtttttttttgtgacgcccaagaacttgttggacatcctattggagaaatctccttagatgatggccggcgaaatgtggatattttttttgtttgtgtttccctgtctttagtagcaagggattttatatctgttgatgatttgcattgctttgttccatcaattttcagttaaagctgcatgatgatagt

SEQ ID NO: 3763 - DNA, 1149 bp, Capsicum annuum
taaagttgcaatcttttttgcacttttgtgccttttatgaaggaaaacttcaaccccataacagaaaaaatgagcttggatccagtggtatcttctcaaggaaatcttgatgagcagatttctcagcttatgcagtgcaagcctttatctgaacaagaggtaaaaggattatgtgagaaagcaaaggagatcttaatggatgaaagcaacgtgcagcctgtgaaaagccctgtgactatatgtggtgatattcacggccaattccatgatcttgctgagctttttcgtattggtgggaagtgtcctgacactaattatctatttatgggagattatgtagatcgtggatactattccgtggaaacagtatcgcttttggtggctctcaaagtgcggtatcctcaacggattacaattttgaggggaaatcatgagagtcgtcagattactcaggtttatggattttatgatgaatgtttacgaaaatatggtaatgccactgtgtggaagactttcacagatctgtttgactactttcctctcacagctttggttgaatctgaaattttttgcctccatggtggtttgtctccatctgttgaaactcttgataatatacgtaattttgatcgcgtccaagaagttccacatgagggagccatgtgtgatcttttgtggtctgatcctgatgatcgtttcgggtggggtatttcacccaggggtgctggatatacatttggccaagatatatctgagcagtttaaccacaccaacaacttaaaactaattgcaagagcgcatcagctggttatggagggattcaattgggcccatgatcaaaaagtggttaccatatttagtgcccctaattattgctaccgctgtgggaatatggcgtctatcttggaggttgatgattgcaatggccatacattcattcagtttgaaccagctcctaggagaggagagccagatgtaacgcgaagaacaccagattacttcttatgatcaagctgcacaaacttggtgattttatcgcagcagttcttgctaaactggtctatattctgtgaccttcttggaagttctatagttattacagctatagtatctagatactgcaaactgcacgaagcatgtaaatcgggc

SEQ ID NO: 3764 - DNA, 927 bp, Platanus occidentalis
aaaaggaagaggaagaagatgagtgtggatccagtcccttcgaactcccacagccacctcgatgagcagatttcacagcttatgcagtgcaagcccttgtccgaacaagaggtccgggcattatgtgagaaggctaaggagattttaatggaggaaagcaatgtacagcctgtgaaaagccctgtgacgatctgtggtgatattcatgggcaatttcatgatcttgcagaactttttcgaattggaggaaagtgtccagataccaattacttgttcatgggagattatgtggaccgtgggtattattcagttgaaactgtaacgctccttgtggccctgaaagtgcgttatcctcaacgaattaccattcttaggggaaatcatgaaagtcgtcagattacacaagtttatggattttatgatgaatgcctacgaaagtatggcaatgctaatgtatggaagatcttcacggacctttttgattattttccattaacagctttggttgaatcggaaatattttgtctgcatggtggactgtccccatccattgagactcttgataacatacggaactttgaccgtgttcaagaagttcctcacgaagggcccatgtgtgatctcttatggtctgacccagatgaccgctgtggttggggcatttctccccgtggagctggatacacttttggccaggacatttctgagcaatttaaccatacgaacaatctaaaactgattgctagagctcatcaactagtcatggagggatacaactggggacatgaacaaaaggtggttaccatatttagtgcacctaattattgttatcgctgtgggaacatggcatctatcttggaagtcgatgactgcagagggcacacattcatccagtttgagccagctcctagaagaggagagccagat

SEQ ID NO: 3765 - DNA, 1287 bp, Flaveria ramosissima
tcatcatcatcatcactcctctataatttcaatatctgaaattcattcaatttcagaaaaacttcaatcaatcaagggattcttccttcgaaaccctaattgcctctatacatatgcacaaaatataaacatacatatataaagatgagtgtggagatggcttcggacacccatgggaatctggacgagcagatttcgcagctcatgcagtgcaaacccttaaccgaatctgaggttaggacattatgtgacaaagcaaaagagatattaatagatgaaagcaatgttcagccagtaaaagccctgtgactatctgtggtgacattcatgggcaattccatgatcttgctgaacttttcgtattggaggaagtgcccggatacaaactacttgtttatgggggtactatgtggatcgagggtattactctgttgaaaccgtcacactcttggtggctctgaaagtacggtatcctcagcgaattactattttaagagggaaccatgaaagtcggcagattactcaagtatatgggtttttatgatgaatgccttcggaagtatggcaatgctaatgtttggaagacttttacggatctatttgattatttccccttgactgcgttggttgaatcagaaatattttgtctgcatggtgggttgtcaccttctatagaaaccttagataatattaggaattttgatcgtgttcaagaggtcccacatgagggccctatgtgtgatcttttatggtcggacccagatgaccgttgcggttggggcatctccccccgtggagctggttacacatttggtcaagatatctcagagcaatttaaccatacaaacagtctaaagcttattgctcgtgctcatcaactggtcatggaaggattcaactggggacatgatcaaaaggttgtcactatctttagtgcaccaaattattgttacaggtgtgggaatatggcttctatattggaggtggatgattgcaagggacacacgtttatccagtttgaacccgctcctaggagaggagaacctgatgtaactagaagaacgccagattatttcctgtaaaattgagtagctgatgctcatgggatggtcgaatattgaacatcattttggggggcttcccgatccaagtcacactctaacctagcatttgctgtcggctatcggaggatgtaatttttcatcatttcatttgtaggcttttgtgtgtaatcttatgtatatcgaccttgtttcgggatttctttgtgttctcttctggtttaga

SEQ ID NO: 3766 - DNA, 1708 bp, Gnetum gnemon
tactctgttgtttgccttttgatttttccgctctggttgttgctcgcattcttttatttccgtttcgtccttcaatttgtttttcctccctcggtcggctgctgctgctcttcctccgttttcctgcaaaatcgcgaggtttcgagaaatcgcaaagcagaaacagagggtttaggtttcggattccccttcgtcgtcgttgttgctaggcagtaagatgagcctcgattcttccgtcaccgctgccgccagcgccactagtagcgctagctatggacagctcgacgcgcagattgagcagctcatgcagtgcaagccgcttttggaaccagaggttcggggcttgtgtgaaaaggctaaagaaattttgatgcaggaaagtaatgtacagcctgtaaaatgcccagttacgatatgtggtgatatccatggacagtttcatgatcttgcagagctgtttcgaattggcggaaagtgtccagatacaaactacctttttatgggagactatgtggatcgtggatactattctgttgagacagtcacgcttctggtggctttaaaggttcggtacccccaacgcataacaattcttagagggaatcatgagagtcgacagattacacaggtatatggattctacgatgagtgcttgagaaagtatggcaatgcaaatgtttggaagattttcaccgacctgtttgactactttcccttgacagcactcgttgagtcggagattttctgtttgcatggaggattgtcaccttccatagacaccctagacaacataaggaactttgatcgtgtacaagaggttcctcatgaaggtccaatgtgtgacttgttgtggtctgaccctgacgataggtgtggatggggaatttcaccacgtggtgcaggatatacatttggacaagatatatccgagcagttcaaccatacaaacaacctaaagctgattgcacgcgctcatcaactggtcatggagggatacaattggggccatgagcaaaaggtagtcaccattttcagtgcaccaaattactgctaccgatgcgggaacatggcatctattctggaagtagacgataacaggggtcacacattcattcagtttgagccagccccaagaagaggagagcccgatgtaacaaggaggactccagattatttcttgtgatttattcttgtttgcaacaccacctctctccatactgtcattgagcctcttcctgcacactgttgaacttgcaatactggagctgctgtgttgtggtcacatatgattcgcactctttgacttccaagattactacggtatcaaatcgttgagtggttgctggaaatccaaagtggatgataagagagaaaagcataatgttgtaccatgcatcggccgttgccagtaagctgtgtttttagtttggacaacccaccctggggcagagcctggtttctgtcaggtgtatcaaattaagatattcgtctaatgtaggaaagcagcatgcatttattttgtatcccggttatttaatttttaggacacattggaaacttgttttgggcattttctactgattgagtagtctgcccagctattttataactctttttcccagttgccatggcaggcctgaaaatgaccgaaccatctggtgagaccttgagagggttttgaatgctagaaacacgatatagttgtggc

SEQ ID NO: 3767 - DNA, 1743 bp, Solanum lycopersicum
gtttgaaaacacgacaaaagcaaagagtggtttttgtttcctattttaccctttcctccctttggtttcaccaccaccactccagaccacccactcactctcttctctttcttttctctctccatgcggagctgagagaaaatcaaaagcaaatcaaacctccattttgatttcttcctccttttttgctgtcaacaaaatctagggtttctgccgtggagtttgaagaaagtttcctcatctctgttgtctgtttcttccagttccctcaagtagtagaagaagatcaccatggattcggtaggaaatcttgatgaaaaaattggtctgcttatgcagtgcaaacccttgtccgagcaggcggtaagaggactgtgcgagaaagccaaggagattctagtgcaagagagtaatgtgcagcctgtgaaaagccctgtgacgatatgtggtgatattcatgggcagttccatgatcttgctgagctttttcgaattggtgggaagtgtcctgacactaattatttattcatgggagattatgtggatcgtggatactattctgtcgaaacagtctcgcttttggtggctctcaaagttcgctatccccaacgaattacaatcctaaggggaaatcatgagagtcgtcagattactcaggtttatgggttttatgatgaatgcctacgaaaatatggtaatgccaatgtgtggaagactttcacagatctgtttgactactttcctctgactgctttggttgagtcagagatattttgcctccatggtggtttgtctcccactattgaaactcttgatgatatacgcaattttgaccgggtccaagaagttccacatgagggggccatgtgtgatcttttatggtctgatcctgatgatcgttgtggttggggtatctctccaaggggtgctggatatacatttggccaggatatttctgagcaatttaaccacaccaacaacttgaatctaattgctagagcacaccagctggttatggagggattcaattgggcccatgatcaaaaggtggttaccatctttagtgcacctaattattgttaccgctgtggtaatatggcttccatcttggaagtggatgatgccaaggaccgtacattcattcagtttgaaccagctcccaggagaggggagccagatgtaacccgaagaacacccgattacttcctataatgcaattgggcaaatctattgatttttgtgcagaaggtcctgctaactgcttcatatgttgtgagcctcttacgagcttatagttctttctgctacaatggtgtgagcggatgatatggaatgaagcatgtaaatcagtcatgtgatactttttctttccattgttgaaacctcattaagatgctgtgaagagatggtgaaaccagtgacagttagggtgcatgtatcatttttccgcgaacattgttcaactctttttttccctttgatcctattcttttttttttcttctgttagtgggagaaaggacaatgatctgcttcctcgatatgttttgtccctttacaaggacaatcactatcgtctaagctccatagaggtaaacgataatcatttttacaccttttaatgagtgttcgtgtaattttctctgaggtcaagactctatttgatttcttaaagtggttttattcaagtctgatgaatattcttagctcaaactttctggttcaattgaatcctccacatgta

SEQ ID NO: 3768 - DNA, 1598 bp, Cichorium intybus
tacaacaaaacgagagagtctttattattactattttttctttcaaatttcgaaatttttagaaaaccggaaaaggttgtggtgatcgaaggaaaaaggcaaagggtttcattcttcctttttcgtttttgtatcggttttcaccaccacccatcgctcccccactgtcttcttcactcgctcatcgttttctttttggttatgattcgccatccacaagattaaattcacaaatccttcgtttggccacgaaatcgcccaaaacaagaaaaagatgagcttcgatccagttatgcagcgcgttaatcgcaatgttgacgaacatatctcgcagctcatgcagtgcaaacccttgtccgaacaagaggttaggtcattatgtgataaggcaaaagagatcctgatgaaagaaagcaacgtccagcctgttaaaagcccagtaacaatctgtggggatattcatggtcaatttcatgatcttgcagagctttttaggattggaggaaagtgcccggatacaaattacttgttcatgggagattatgttgatcgtggttattactcggttgaaacagtgactctcttggtggccctcaaagtgcgttacccacaacgaatcactattctaagaggaaaccatgaaagtaggcagatcactcaagtttatgggttctatgatgaatgcctaagaaaatacggtaacgctagcgtgtggaagacatttacggatctatttgactattttccactcactgcattggttgaatctgaaatcttttgtcttcatggtggattatctccttcaattgaaacacttgataacataagaaactttgaccgagttcaagaagtgccacatgaggggcccatgtgtgatcttttatggtctgaccctgatgaccgttgtgggtggggtatctctccacgtggtgctggatatacatttggccaagacatatctgaacaatttaatcataccaatagcttgaagctcattgctagggcccaccagctggttatggagggtttcaactggggtcatgaacaaaaggttgtgacgatttttagtgcacctaattattgttaccgatgtgggaatatggcttcgattcttgaagttgatgattgcaagggtcatacttttattcagtttgaaccagctccaagacgtggagagccagatgtgacccgtaggacccctgattatttcctatgatttaaaaactctttattaaaagggcaaaatgggaaataagaagatgaaaaagaaatagttgttgaaaatcttgaatgttttgggaaataggtgttaatttgctgcacaaacacaccacctttgattcttcccttcattttttccccccccccccccccccccccccccccccccccccccccccccccccccccccccccccccccccccccccccccccccccccccccccccccttttgacactagttaagaatgcttgctattaatttgttctcaagcttcattggaaattggatagttgctgatgtggaaaatacatgcattttcttttttcttgcttgaaaacccaaagaatttgaatccttgaaatatttatgagg

SEQ ID NO: 3769 - DNA, 1592 bp, Amorphophallus konjac
aggagggagagtggagcgcgagaaggagggcgagctggggctagggtttgcttcaagcgctgtagttgcccgcttcgtcccgcgatccctcttgccgattaggagaagaagatgaccatggcggatccggtgccgtccgactcccatggcaacatcgacgagcaaatctcgcagctcatgcagtgcaagccgctctccgagcaagaggtcagagtcttgtgtgacaaggctaaggagatgttgatggaagaaagcaatgtccagcctgtcaagagccccgtgactatatgtggtgacattcatgggcaattccatgaccttgcagaactattccgaattggtggcaagtgtccagataccaattacttgtttatgggggattacgtagatcgtggatattattccgttgaaactgttacgcttctggttgcccttaaagtgcgttatccccagcgaattacactccttcgaggaaatcatgaaagtcgccagattacacaagtttatgggttttatgatgaatgcttacggaagtatggtaatgctaatgtatggaaaacattcactgatttatttgattattttcctctgacagcattggttgaatcagaaatattttgcttacatggtggcttatctccatcaattgagacccttgataacataagaaactttgatcgtgttcaagaggttccacatgaagggcccatgtgtgatttattatggtctgatcctgatgatcgctgtggttggggtatttccccacgtggtgctggatatacattcggccaagatatatctgagcaattcaaccatgcaaacaatctgaatctgattgctagagctcatcaactggtcatggatggatacaactggggacacgaacaaaaagtggtgactatttttagtgcaccaaattattgttaccgctgtggaaatatggcatctattatggaagtcgatgacaccaagggtcgcatgttcatccagtttgagcctgctcccagaagaggggagcctgatgttacacgcagaacaccggactactttctatgattcggcatttggaatacctgccctgattttcagcagcaagcagacgctcactgaatgacatggttgcggatattctgaggaattcatgtcactatatttgtaattccaagctgccgtccttggttatttgagtgggaaaacgtgtgcttcatgtggaggtatggctccccatatttctaaattatgaaaactgaactggttcctctgtgagaggcggtgacgctggcaagctaggggcaacagcggcggcagtagcagcagatgtaccattcataagagctcgtggtattttcccccttcttattttttctcttttctttctgtttgggtcttgtagagggaacgaattctgttaagggggcatttctattgtttccttgttctgcgttaattgatcaagttgcacactttcatttttggccttgtttcaagtttactattttctgagagccactagcacgcatagcctttcaggtacacagctacaacaccttctgaacagccaactgcattagcttctttggttattatttttt

SEQ ID NO: 3770 - DNA, 1286 bp, Glycine max
tttccccctaatccaatcgcgcagcagcagcagcgagatgggcgccaattcgttgtcatcggcggaatcaaccctcgatctcgacgagcagatatcgcagctcatgcaatgcaagccactctccgaacaccaggttagagttttatgtgagaaggctaaggagattttgatggatgaaagtaatgtccagcctgtgaaaagccccgtgacaatttgtggtgatatccatgggcagtttcatgatcttgctgaactatttcgaattggagggaagtgtccagatactaattacttgtttatgggtgattatgtggaccggggttattattcagttgaaactgtaacacttcttgtgtcactgaaagtgcgatatcctcagcgaattactattcttagaggaaaccatgaaagccgtcagatcactcaagtatatggattttacgatgaatgcctcagaaaatatggtaatgctagtgtttggaagatctttactgacctttttgatttctttccgttgactgcattggttgagtccgaaatattttgtttgcatggtgggctttcaccttcaattgagactcttgataacataaggaacttcgatcgtgttcaagaggttcctcatgaagggcccatgtgcgatctgttgtggtctgatccagatgataggtgtggctggggaatttctcctcgtggtgctggatatacatttggccaggatatatccgaacaatttaatcacacaaacaagcttaagttaattgctagagctcatcagctggttatggatggatttaactgggctcatgaacaaaaggtggttaccatttttagtgcacctaactactgttatcgatgtgggaacatggcctccattttagaggttgatgattccatgggccacacatttatccagtttgatcctgctcccaggagaggagaacctgatgtcacccgtagaacgcctgattacttcttatgatgttgctgctgctgcatatcatactggggtcgcagttacatctcattctgcacaaatttcaagtagtttgtgcatcctcatcctcgttgatgagattactgtaaggacttaaaatctttgggtatgcacaccaaacttttttggtgattgcccaataccgtactaatgtaaattaggcgagaaacattccagttttttgtgacgctcaagaacttgctggacaccctattggagaagtctcctagatgatggccatgtcagaatatgtattattccagtgacctgtggatatattttttgtgtt

SEQ ID NO: 3771 - DNA, 1416 bp, Glycine max
cacaccggaggagagaaaaccaaaatcactcttcactgttagggttagggtttcgattttccccttatccaatctcgcagcagcgagatgggcgccaattcgttgccatcggcggaatcaaacttcgatctcgacgagcagatctcgcagctcatgcaatgcaagccactttccgagcaccaggttagagttttatgtgagaaggctaaggagattttgatggaagaaagtaatgtccagcctgtgaaaagccctgtgacaatttgtggtgatattcatgggcagtttcatgaccttgctgaactatttcgaattggagggaagtgtccagatactaattacttgtttatgggtgattatgtggaccggggttattattcagttgaaactgtaacacttcttgtgtcactgaaagtgcgatatcctcagcgaattactattcttagaggaaaccatgaaagccgtcagatcactcaagtatacggattttacgatgaatgcctcagaaaatatggtaatgctagtgtttggaagatctttacagaccttttcgatttctttccattgactgcattggttgagtctgaaatattttgtttgcatggtgggctttcaccttcaattgagactcttgataacataaggaacttcgatcgtgttcaagaggttcctcatgaagggcccatgtgcgatctgttgtggtctgatccagatgataggtgcggctggggaatttctcctcgtggtgctggatatacatttggccaggatatatccgaacaatttaatcactcaaacaagctcaagttaattgctagagctcatcagctggttatggatggatttaactgggctcatgaacaaaaggtggttaccatttttagtgcacctaactactgttatcgatgtgggaacatggcttccattttggaggttgatgattccaagggccatacgtttatacagtttgatcctgctcccaggagaggagaacctgatgtcacccgtagaacgcctgattacttcctatgatgttgctgccgcatatcatactcctggcacagttacatctcattctgcacaaatttctagtactttgtgcatcctcatcctcgttgatgagattgctgtaagcacttaaaatctttgggtatgcactccaaacttttttggtcattgcccaaataccgcattaatgtaaattaggtaggtaacattccagttttttgtgacgctcaagaacttgctggaggtccaattggagaagtctcctagatgatggccaggtccgaatatgtattgttccagcgcaatgtggatatttttttgtttgtgtttccccatctctagaagtaatgactgggattttatatttctgttgatgatttgctttgctatgttctatcaattttcagt

SEQ ID NO: 3772 - DNA, 1083 bp, Centaurea maculosa
aattgatccaaatcgaagatcgaaagatgagcttggatctggtacagcgtgttaatcgcaatgttgatgaacatatgcccagctcatgcagtgcaaacccttatctgaacaagaggttaggtcattatgtgataaggcaaaggagatcttgatgcaagaaagcaatgtgcagcctgttaaaagcccagtgacgatctgtggggatattcatgggcaatttcatgatcttgcggagcttttccggattggagggaagtgcccagatacaaattatctgttcatgggagattatgttgatcgtggttattactcggttgaaacagtgaccctcttggtggctctcaaagtgcgttatccacagcggattactattttaagaggaaaccatgaaagtcgacagatcactcaagtttatggattttatgatgaatgcctaaggaaatatggcagtgctaatgtgtggaagacatttaccgatctattcgactattttccactgactgcattggtggagtctgaaatcttttgtctccatggtggattgtctccttcgattgaaactctcgataatatacggaactttgatcgtgttcaagaagtgccccatgaggggcccatgtgcgaccttttatggtccgaccctgacgatcgttgcggttggggtatctctcctcgtggtgctggatatacatttggccaagacatatctgagcaatttaatcataccaacaagttgaaactgattgcaagagcacaccagctggttatggagggtttcaactggggtcacgagcaaaaggttgtgacgattttcagtgcacctaattattgttaccgttgtgggaacatggcttcgatccttgaagtagatgattgcaagggtcacactttcattcagtttgaaccagctccaaggaggggagagccagatgtgacccgtaggacgccagattatttcttatgatgctgttttgattcatgggaaatacgcaaattgaaaaacgtcatcatcatcatcattgttttactgggaaatgaggcagcgatcctggtgtaatttgctgctgcacaaacgcagtacca

SEQ ID NO: 3773 - DNA, 1275 bp, Raphanus sativus
tctcgatgagcagatctcccagctcatgcagtgcaaacccccctccgagcaacaggtcagatcattatgcgagaaagccaaggagatcttaatggatgaaagcaacgttcagcctgtgaaaagccctgtgacaatctgcggtgatattcatggacagttccatgatcttgctgagcttttccgtattggtggaatgtgccctgataccaattacctgtttatgggagattacgttgaccgtggttactattctgttgaaactgtcacgctgttagtcgccttaaagttgcgatatcctcagcgactccccatccttagaggaaaccatgaaagtcgtcagattactcaggtttatggattttatgatgaatgtctgcgaaagtatggcaacgcaaacgtttggaaaatctttacagacctcttcgactatttcccactgactgccttggttgagtcagaaatattttgccttcatggtggattgtctccatctatcgagacacttgacaatataaggaattttgatcgcgttcaagaagtgccccatgaagggccgatgtgtgacttattatggtctgaccctgatgaccgttgtggttggggcatctctccacgtggggccggatatacatttggccaggacatatctgaacagttcaaccactcaaacagcttaaagctgatcgcccgagctcatcagctggttatggatggatacaactgggctcatgagcaaaaggtggtaacgatcttcagtgcaccaaactactgttaccgttgtgggaacatggcttcgattcttgaggttgatgactgcatgaaccacagcttcattcagtttgaaccagcaccgaggagaggagaaccagacgttactcgaagaacaccagactattttctctgatcactggacacggaatcatctcagcagctgcctccacaactgaaaaggtcacagttggttagtaactcaagaatctggtttctatgcaatatgttaaggttgcttgttaagttcaactcagtcccatcccaccaccagaatatagtgtgtatgttgtaggcgaagaaggccttctcttatcttcctctataaccaagaagaagaaaaagagaggtcgatggactgactcgatagtacctatcatacacattgtttaattgatgttattagcttatttcttctttctgcatccaaatgtgtgtttcatgtttaagaggatctttttgtttcgtataattcttttgtcagatttcactattttttagtttaca

SEQ ID NO: 3774 - DNA, 1748 bp, Glycine max
ttttaaaaagtgaacaaaacctgctgctagtttttaaaaagtgaacaaaagacagcgtagaattattaaattcaaccgccattacataacactacattttttttattcactcactccgttctctgctctttttcttcttctacccccacaccggaggagagaaaaccaatatcactcttcaccgttagggttagggtttcggtttccccctaatccaatcgcgcagcagcagcagcgagatgggcgccaattcgttgtcatcggcggaatcaaccctcgatctcgacgagcagatatcgcagctcatgcaatgcaagccactctccgaacaccaggttagagttttatgtgagaaggctaaggagattttgatggatgaaagtaatgtccagcctgtgaaaagccccgtgacaatttgtggtgatatccatgggcagtttcatgatcttgctgaactatttcgaattggagggaagtgtccagatactaattacttgtttatgggtgattatgtggaccggggttattattcagttgaaactgtaacacttcttgtgtcactgaaagtgcgatatcctcagcgaattactattcttagaggaaaccatgaaagccgtcagatcactcaagtatatggattttacgatgaatgcctcagaaaatatggtaatgctagtgtttggaagatctttactgacctttttgatttctttccgttgactgcattggttgagtccgaaatattttgtttgcatggtgggctttcaccttcaattgagactcttgataacataaggaacttcgatcgtgttcaagaggttcctcatgaagggcccatgtgcgatctgttgtggtctgatccagatgataggtgtggctggggaatttctcctcgtggtgctggatatacatttggccaggatatatccgaacaatttaatcacacaaacaagcttaagttaattgctagagctcatcagctggttatggatggatttaactgggctcatgaacaaaaggtggttaccatttttagtgcacctaactactgttatcgatgtgggaacatggcctccattttagaggttgatgattccatgggccacacatttatccagtttgatcctgctcccaggagaggagaacctgatgtcacccgtagaacgcctgattacttcttatgatgttgctgctgctgcatatcatactggggtcgcagttacatctcattctgcacaaatttcaagtagtttgtgcatcctcatcctcgttgatgagattactgtaaggacttaaaatctttgggtatgcacaccaaacttttttggtgattgcccaataccgtactaatgtaaattaggcgagaaacattccagttttttgtgacgctcaagaacttgctggacaccctattggagaagtctcctagatgatggccatgtcagaatatgtattattccagtgacctgtggatatattttttgtgtttccccatctctagaagcaatgactgtgtttccccatctctagaagcaatgacttggattttatatttctgttgatgatttgctttgctatgttctatcaattttcagtaaaagttgcatgataatagtgattcagttttgttctttactaattatgttcaatttcattcctagagcttattggtggttatcaattggcttcagattgccagtgaaaagaatatatatactttagttggtcaaactaaatagttgtgaacg

SEQ ID NO: 3775 - DNA, 1514 bp, Glycine max
tacataaaacaatcaattttttttttcactaactccgctctctgctcttcttcttcccccacaccggaggagagaaaaccaaaatcactcttcactgttagggttagggtttcgattttccccttatccaatctcgcagcagcgagatgggcgccaattcgttgccatcggcggaatcaaacttcgatctcgacgagcagatctcgcagctcatgcaatgcaagccactttccgagcaccaggttagagttttatgtgagaaggctaaggagattttgatggaagaaagtaatgtccagcctgtgaaaagccctgtgacaatttgtggtgatattcatgggcagtttcatgaccttgctgaactatttcgaattggagggaagtgtccagatactaattacttgtttatgggtgattatgtggaccggggttattattcagttgaaactgtaacacttcttgtgtcactgaaagtgcgatatcctcagcgaattactattcttagaggaaaccatgaaagccgtcagatcactcaagtatacggattttacgatgaatgcctcagaaaatatggtaatgctagtgtttggaagatctttacagaccttttcgatttctttccattgactgcattggttgagtctgaaatattttgtttgcatggtgggctttcaccttcaattgagactcttgataacataaggaacttcgatcgtgttcaagaggttcctcatgaagggcccatgtgcgatctgttgtggtctgatccagatgataggtgcggctggggaatttctcctcgtggtgctggatatacatttggccaggatatatccgaacaatttaatcactcaaacaagctcaagttaattgctagagctcatcagctggttatggatggatttaactgggctcatgaacaaaaggtggttaccatttttagtgcacctaactactgttatcgatgtgggaacatggcttccattttggaggttgatgattccaagggccatacgtttatacagtttgatcctgctcccaggagaggagaacctgatgtcacccgtagaacgcctgattacttcctatgatgttgctgccgcatatcatactcctggcacagttacatctcattctgcacaaatttctagtactttgtgcatcctcatcctcgttgatgagattgctgtaagcacttaaaatctttgggtatgcactccaaacttttttggtcattgcccaaataccgcattaatgtaaattaggtaggtaacattccagttttttgtgacgctcaagaacttgctggaggtccaattggagaagtctcctagatgatggccaggtccgaatatgtattgttccagcgcaatgtggatatttttttgtttgtgtttccccatctctagaagtaatgactgggattttatatttctgttgatgatttgctttgctatgttctatcaattttcagtaaaagttgcatgataatagtgattcagttttgttcttta

SEQ ID NO: 3776 - DNA, 928 bp, Brassica juncea
ccgacggacgcaaccctcgatctggatgagcagatctctcagctcatgcagtgcaagcctctctccgagcaacaggttagagcattatgtgagaaagctaaggagattttgatggatgaaagcaacgttcagcctgtcaaaagtccagtaactatctgtggtgatattcacggacaattccatgatcttgcagagcttttccgtattggaggaatgtgccctgataccaactatctatttatgggagattatgtcgaccgtggatattattctgtcgaaactgttacgctgctagttggcttgaaagtacggtatccccagcgaatcactatacttagaggaaaccatgaaagtcgtcagattactcaagtttatggattttatgatgaatgcctgcgaaagtatggaaatgcaaatgtttggaagatattcacagacctctttgactatttcccactgacagcgttggtggagtcggaaatattctgccttcacggtggattgtcaccgtctatcgagacccttgacaacattaggaactttgatagagttcaagaagttccacatgaaggacccatgtgtgacttactatggtctgatcctgatgacagatgtggctggggaatttctccccgtggtgctgggtatacatttggtcaggacatctccgaacaattcaaccacagcaacagcttgaaacttatcgctcgagcgcatcagctggttatggatggatacaactgggcacacgagcaaaaggtggttactatcttcagtgcaccaaactattgctatcgctgtggaaacatggcctctattcttgaggtcgatgactgcaggaaccacaccttcattcagtttgaaccagctccgaggagaggagaaccagatgtgacccgaaggacacctagaactacttcctataaac

SEQ ID NO: 3777 - DNA, 1774 bp, Avena sativa
cagcacagcaaccttccctccctcgttgtctccgcgctacgaccacacttcaccaccaccacgagcgctccgctcctcgtcctcgccgctatctaaactaggctccagcaccgcaattatataaccaccgccccttccacctttccagaccttttgccccctgcccacctctccttccctccttccgcggtcctccccacgcacgcgcgcgcgcggaggcgagatctgcccaaggtggacggacctccggcgaggatgagcagcccccatggcggcctcgacgagcagatcgagcggctcctgcagtgcaagcccctccccgaggcagaggttagagcgctatgcgagaaggccaaggagattttgatggaggagagcaatgttcagcctgtaaagagtcctgtcacaatatgtggtgatattcagtgggcagttccacgatcttgcagtaattgttcagtaattggtaggaaagtgtccggatacaaattatttgtttatgggagattatgtagatcgtggctactactccgtcgaaactgtcacgcttttggtgtcgctaaaagttcgttaccctcagcggatcaccattctcagaggaaaccatgaaagccgacagatcactcaagtttatggattctatgatgagtgcttaaggaagtatggaagtgcaacggtgtggaaaacgtttacagatctgtttgactacttccccttgacagcactggttgagtcagaaatattttgtttgcacggtggattatcaccatccatcgagacacttgataacatacgtaactttgaccgcatccaagaagttcctcatgaagggcccatgtgcgatcttctgtggtctgatccagatgatcgatgtggttggggtatttctcctcgaggtgctggatataccttcggacaggatatatcagagcagttcaaccatagcaataacttaagacttattgctagagctcatcagttggtcatggaaggattcaactgggctcatgagcaaaaagtggtcaccatatttagtgcacctaattattgctaccgctgtggaaacatggcatcaatcttggaagttgatgattgcagggagcatacttttatccagtttgagccggccccaagaaggggagagccagatgtaacccgtagaacaccagactatttcctgtgatgcgaaactggtgttggcagcaaaggtttgatagctagctgaagtttcctggttgcagataatctttttgccccgtgtgttattcttctttattttttatccatgatgcctttggctaccgcgagcatgctttgctgcatcgtgattcaagtgtatacgtacagcctggaagggattcattgtgttctcacctctctaactgatttgatgctctgctcgggggcctgcagctagtgacttttaagcgtcagagcagcatttgtattatgacaggagactatttcattcccctttgtaattcattttttcccctttggacattttcacctaattttcttttcatgattcttgtgtagagatgaacaatgtagttgtgtatggttctgtgttgagcccttaggtcttgttctgaacccgtcttgatttgtcgtatagaaatacttgaagaagagaactagcaccatgttgtgtgtattgtggggaggaatgtgtggcctggtcactggatattttgtttatcatgcaaatagttgtccaggacaatccatctccaatttgaaactagtagtatgtttttatttctggccaatt

SEQ ID NO: 3778 - DNA, 1743 bp, Eucalyptus grandis
gtggcgtgagtccttaaagaaactatggctctctatcgttccttcttcttcgtttctaccaagtgaaaaagggcatttcaaagcctttcccagtttttcagattgaggaggaggagggggagacgcgagagaagctggctacgccgtggaattccgaggaaagatagatcccgaggaggcgcgaggattacagagagagagagcaggaagagagggagaaatgagctcggattcactgtcctcctcccactcgcacgccggcatcgacggccacgtctcccagctgctgcagtgcaagcccttgtccgaacagcaggttagagtgctatgtgagaaggctaaggagatcctaatggaagaagataatgtccagcctgtaaaaagccctgtcacaatatgtggtgatattcacggacaattccatgatctggctgaacttttccgcattggagggaagtgcccagatactaattacttgttcatgggagattatgttgatcgaggatattattcagttgaaactgtttcactcttggtggcactgaaagtgcgtcatcctcagcggattacaattcttagaggaaaccatgaaagtcgccagataactcaagtttatgggttttatgatgaatgcctgcgaaagtatggtaatgctaacgtttggaagatattcactgatctttttgactatcttccattgacggccctggttgaatcggaaattttttgtctgcatggtgggttgtccccatctatcgaaacccttgataatatacgtaattttgaccgtgttcaagaagttcctcatgagggccctatgtgtgatctcctatggtctgacccggatgaccgctgtggttggggtatttcacccagaggtgctggttataccttcggtcaggacatatctgagcagtttaaccatacaaataatttgaagctaattgctcgagctcatcagttggttatggaaggatataactggggtcatgatcaaaaagtcgttacaatatttagtgcacctaactactgttatcgctgtggtaacatggcgtccatcctggaagttgatgactgcaaaggccacacattcatacagtttgagccagctccaaagaggggagagccagatgtaactcgcagaatgccagattatttcctttgatgtagcaggcttcaggtaagcatatcttgtcgcgggtgcatagttcctttcaaatgaggttgggtaggccattgaagtttccagagctggagcttctggatgatggtgcctactgggcttgaggcatctaaaatgttactggcgaggctttgggttgaaaaggaagggcaaccgtgcaggaaatggtgcagcgacaacttgtaattgtttgccttttaccctctattttcttaatttttgacatacttgttttctgggaagactggctgcgagatcaggcttgtagaggaagacgggttttcttttcttcaaatgcgtgattttctttgccttccttgtcagttcttttggctttagttttgatgtacgaatgttctgggcttaattgaatgggcaattaaatttagagaaacattctgttaaaaagaaactcgtatgatctatcagccaatgtggattttggtggggaacgatattctgatttcgaatttacaacaatcgatggattcaggtctttgctgtggccaggatcaagaatggtaggtcgttccccattattatggactctctctctctct

SEQ ID NO: 3779 - DNA, 918 bp, Arnica chamissonis
catgagtgtggagctggcttcggacacccatgggaatctggacgagcagattacacagctcatgcagtgcaaaccgttaatcgaacctgaggttaggacattatgtgacaaggcaaaggagatattaatcgatgaaagcaatgttcagccagtaaaaagccctgtgactatatgtggtgatattcatgggcaattccatgatcttgctgaactttttcgtattggaggaaagtgcccggatacaaactacttgtttatgggggattacgtggatcgagggtattattcggttgaaactgtcacactcttggtggctctgaaagtacggtatcctcagcgaattactattttaagagggaatcatgaaagccggcagattactcaagtatatgggttttatgatgaatgccttcggaagtatggcaatgctaatgtttggaagacctttacagatctatttgattatttcccgttgactgcattggttgaatcagaaatattttgccttcatggtggattgtcaccttcgattgaaaccctggataatattagaaattttgatcgtgttcaagaggtcccacatgaggggcctatgtgtgatctgttatggtctgacccagatgaccgttgtggttggggtatctcaccccgtggagccggttacacctttggtcaagatatctcagagcaatttaaccataccaacagcctaaaacttattgctcgagctcatcaactggtcatggaaggattcaactggggacatgatcaaaaggtggttactatctttagtgcaccaaattattgttacaggtgtgggaatatggcttctatcttggaggtggatgattgcaagggacacacatttatccagtttgaacctgctcctaggagaggagaacctgatgtaactagaag

SEQ ID NO: 3780 - DNA, 971 bp, Brassica juncea
atgcagtgcaagcctctctccgagcaacaggttagagcattatgcgagaaagctaaggagatcttgatggatgaaagcaatgttcagcctgtcaaaagcccggtgacaatctgtggtgatattcatggacagttccatgatcttgcagagcttttccgtattggaggaatgtgccctgataccaactatctatttatgggtgattatgtcgatcgtggatattattccgtcgaaactgttacgctgttagttggcttgaaagtacggtatcctcagcgaatcactattcttagaggaaaccatgaaagtcgtcagattactcaggtttatggattttatgatgaatgcctgcgcaagtatggtaatgcgaatgtttggaagatatttactgatctcttcgactattttccactgacagccttggtggaatcggaaatattctgccttcacggtggattgtcaccgtctatcgagacccttgacaacattaggaactttgaccgagttcaagaagttccacatgaaggaccgatgtgcgacttactatggtctgatcctgatgacagatgtgggtggggaatctctcctcgtggtgccggatatacatttggtcaggacatttccgaacaattcaaccacagcaacagcttaaaacttatcgctcgagcgcatcaactggttatggatggattcaactgggcacatgagcaaaaggtggttactattttcagtgcaccaaactattgttatcgttgtggaaacatggcctctattcttgaggtcgatgactgcagaaaccacaccttcattcagtttgaaccagccccaaggagaggagaaccagatgtgacccggaggacacccgactacttcctataagcacaagtcacctcctctcagctgcaaagtcctgttgttggtttttgaagatctctgcttatatttggtaaaacgcattttgtgatttagcc

SEQ ID NO: 3781 - DNA, 1239 bp, Ocimum basilicum
ccttgtccgagcccgaggttaaagccttgtgtgagaaggctaaggaaatattaatgcaggaaagcaatgtccagcccgttaaaagtcctgtgacgatttgtggtgatattcatggccagtttcatgaccttgcggagctttttcgcattggaggcaagtgcccagacacgaactatctatttatgggagattatgttgatcgtggttactattcagttgaaacagtgactctactggtaagtttgaaagtgcggtatcctcaacgcatcacaattcttagaggaaatcatgaaagtagacagatcactcaagtctatggattttatgatgaatgtctgaggaagtacgggactgcaaatgtatggaagacattcactgatctgtttgactattttcctttgactgctttggttgagtcagaaatcttttgcctgcacggtggattatccccatccattgaaacccttgataacataagaaactttgatcgtgttcaagaagttccacatgaaggtccgatgtgcgatcttttgtggtccgatcccgatgatcgttgtggttggggtatatctcctcgtggtgctggatacacttttgggcaggacatttcggagcaattcaaccactctaacagcttaaagctaattgctagagctcatcagctggtcatggagggatataactgggctcatgagcaaaaggtcgtcactatttttagtgcaccaaattattgctaccgctgtggaaatatggcgtccattttggaagtagatgattgcaaggagcatacgttcatccagttcgagccagctccacggagaggagagccggatgtaactcggaggacacctgactatttcttgtagtgctggcactagtgaaactcagttgtctgcatgttgggtcagtttgaagtgctcgcattgtcgttgccggagattcaagcttcaagttaacggaaggcggtatgtgtgggaagacgcatgaaagatgaggctccttgtctgaaaagttatgttctaacatgtctttggtggaaagttgggatagggtaggggcttttgtgtatcatcatgttttataattttttgatgttaccccaattatactatatcttttgtttttctatattctatccttggattaatgccattgtgaggagggtgtttgtggaattatttcagggattttatcattttatcttataagcatggacgttaatttagcctaaaactagtg

SEQ ID NO: 3782 - DNA, 1363 bp, Fagopyrum esculentum
aacagatcgtccagctcatgcagtgacaacgtcccctttccgagcaagaggtgaggtactttgtgtagaaaaggccaaggagatactaatggaagagagcaatgttcagccagtgaagagtcccgtgacaatatgtggtgatattcatggacagtttcatgatcttgcggaactatttcgtattggtggcaagtgtccggatacaaattacttattcatgggtgactatgttgaccggggatattattctgttgaaactgttacattgttggtggcacttaaggttagatatcaccaaaggatcaccattctcagaggcaatcatgaaagtcgtcagattactcaagtctatggattttacgacgaatgtctgagaaagtatggcaatgctaatgtttggaagaccttcactgatctatttgattacttcccactcactgctttggttgagtcagaaatattttgcctgcatggtggattatctccatccatcgagacacttgataacatacggaattttgatcgtgttcaagaggttccacatgaggggcctatgtgtgatttgttatggtctgacccagatgatcgctgtgggtggggtatatcacctaggggggctggttacacctttggccaagacatatcagagcaatttaaccataccaatagcctaaagctgattgctagggctcaccaacttgttatggagggatacaactggggtcatgaccaaaaggtggtaacaatattcagtgctccaaattactgttatcgttgtggaaacatggcatcgatcttggaagttgatgactgcaatggccacacgttcattcagtttgaaccagctccaaggagaggggagccagatgtaacgcggagaacgcctgattatttcctgtgattggatgatgtcgatttgtggagctggtctacaattgggaaaaggtaattaaaaagtatgaagaagtctgttttggcggtttcgggccaagttggatcggaatgggcaatatttggtttctataagttgatgcttgatgcaaatgtgacaagcttctcaaagagaaggaggccccaacaaatatggagctgctgcatatgtatcaatctccatggaacaacactgtttggtatccttcactcccatttctttatctcttttcttgtccggtttatttcgtctttttttttttgggttggattttattccttattgttgtttaaatgtagaaggttattgtaggagacgatgtggtaattacttaatggttgttttcataaatgttgttctaccattactctctcaggtcccaactcttgtcttcagttaccagtcaaaaggtaaacgtagtcagtgttaatg

SEQ ID NO: 3783 - DNA, 1154 bp, Olea europaea
ggtagcggagtctgtggctgcaaccacacacggaaagtactggacgagcagattgctcagctcatgcagtgcaagccttgtcgaccgaggtcagggcttatgcgagaaggctaaagagatattaatggaggagagtaatgtccagcctgtaaaaagccctgtgacaatttgtggtgatattcatggccaatttcatgatcttgctgagcttttccgcattggagggaagtgtccggatacaaattatctatttatgggagattatgtagatcgtgggtactattctgttgaaactgtaactcttttagtggctctgaaagtgcgctatcctcaacggataacaattcttagaggaaatcatgaaagtagacagattacacaagtctatggattttatgatgaatgcctgcggaagtatggaaatgctaatgtttggaagatattcacagatctgtttgactatttcccactgactgcattggttgaatcagaaatattttgtctgcatggtggattgtccccttctgttgaaactcttgataatataagaaactttgatcgtgttcaagaagttccacatgaaggtccgatgtgtgatttattgtggtctgatccagatgatcgttgcggttggggcatctctcctcgtggtgctggatacacgtttggccaggacatttcggagcaattcaatcataccaacaacttaaagctaattgctagagctcatcagcttgttatggagggatataactgggcccatgaacaaaaggttgtcactatttttagtgcaccaaattattgctatcgctgtggaaatatggcatccattttggaagttgatgactgcagagagcatacatttatccagtttgaaccagctccacgaagaggggaacctgatattactcgaagaacacctgattatttcttatagagctgatagttactgacttgatgttcgcatggtgattaattggagttgattacatgtcctccactgagagttgagcttctcaatttacgaggcccttttgacagtggaaacagtcatgtaaaatactagatatggttcgcctgtccgaattatattctatgttagagtggtccttggaagttagtgatagtgatgctatattgtatcatttcaaatg

SEQ ID NO: 3784 - DNA, 1089 bp, Chrysanthemum coronarium
caaacaatatgagtgtggatctagcttccaacacccatgggaatcttgatgaacagatttcacagcttatggaatgcaaacccttaattgagcccgaggttaagacattatgtgagaaagcgaaagaaatactgatgaatgaaagcaatgttcagccagtaagaagtcccgtgactatctgtggtgacatccatgggcagtttcatgaccttgctgaactttttcgcataggaggaaagtgcccggataccaactacttgtttatgggggattacgttgatcgaggatattattctgtcgagactgtcacgctcctggtggctctgaaagtgcgatatcctcagcgaatcacaatcctaagaggaaatcatgaaagtcgtcagatcactcaagtctatggtttttatgatgaatgtcttcggaagtatggaaatgctaatgtttggaagactttcacagatctctttgattattttccattgactgcattggttgaatcagagatattttgtcttcatggtggtttgtcaccttcaattgaaactcttgacagtataagaaactttgaccgtgttcaagaggttccacacgaaggtccaatgtgcgatcttctatggtctgacccagatgaccgttgtggatggggcatttcacctcgtggagccggatacacttttggccaagcacagcttgaagcttattgctagagctcatcagctggtcatggagggatttaactggggacatgagcaaaaggttgtcactatctttagtgcaccaaactattgctatcggtgtggaaacatggcttctatcttggaagttgatgattgcaagggccacacgtttatccagtttgatccggcccctaggagaggagagcctgatgtaaccagacgtactcctgattatttcctttaaatggagaatcctcacttgctagtgcaacaactcggctaaagtgatttttgatcctttgccagaattgggattttgatacgactggtatgggctaaaaattcatcaggtaaagtgccagaaaaggaccaagcggcttgtaaaatggactttgtatgactagggtattta

SEQ ID NO: 3785 - DNA, 943 bp, Ambrosia trifida
atacccaaaacatgagcttggatccagctacgcagcgtgtcaatcacaatgtcgatgaacatatctctcagctcatgcagtgcaagcccttgtctgaacaagaggttaggtcattatgtgataaggcaaaagagatcctgatgcaagaaagcaatgtgcagcctgttaagagccctgtgacaatctgtggggatattcatgggcagtttcatgatcttgcagagcttttcaggatcggagggaagtgcccagatacgaattatttattcatgggagattacgttgatcgtggttattactcagttgaaacagtgactctcttggtggcccttaaagtgcgttatccacaaaggattactattctaagaggaaaccatgaaagtcggcagatcactcaagtgtatggattttatgacgaatgcttaagaaaatacggtagtgctaacgtatggaagacattcactgatctatttgattatcttccactcactgcattggttgaatctgaaatcttttgtcttcatggtggattgtccccttcaatcgaaacactcgataatataagaaattttgaccgtgttcaagaagtgccccatgagggacccatgtgtgatctcttatggtctgaccctgatgaccgttgtggttggggtatttcacctcggggcgctggatacacatttggtcaagatatatccgagcaatataatcatacaaacggcttaaagctaattgctagagcacatcagctggttatggagggattcaattggggacatgaacgaaaagttgtgacaatttttagcgcacctaattattgttaccgttgtggtaatatggcttcaattcttgaagtggatgattgcaagggtcacactttcattcagtttgaaccagctccaaggaggggagagcctgacgtgacacgtagaacacctgatta

SEQ ID NO: 3786 - DNA, 1072 bp, Zostera marina
gaaacgttgtttccggaggatcgtcggagagagggaagttcgtcggagttaagaccataggtgaaggtggtggtggtggaggaggaggatattgagaggatgaacgctgacactactgctttcaaggcttctcctatacatggcgacagcatcgacgagcagattgagcagcttatggactgcaagcccctttcggagagagaggttaaagcattatgtgagaaggctaaggaaattttgatggaagaaagcaatgttcagcctgtgaaaagtcctgtgacgatatgtggtgacattcatggacagtttcatgatcttgcagaattatttcgtattggtgggaagtgtccagataccaattacttatttatgggagattacgtagatcgtggatattactcagtagaaactgtcacgctgcttgtttccctaaaggtgcggtatccctcaaggataactattctcaggggaaatcatgagagtcgtcagattacccaagtttatggattttatgatgagtgtttacggaagtatggtagtccgactgtatggaagacttttactgatctttttgactatttacctctcacagcactggttgaatctgaaatattctgtttgcatggtggtctatcaccatcaatcgaaacacttgataacattcggaattttgatcgggtccaagaagttccgcacgagggagctatgtgtgatcttctgtggtctgatcccgatgatcggtgtggatggggaatatctcctcgtggtgctggatacacctttggtcaggacatatcggaacaattcaaccataataacaacttaaacttgatagccagagctcatcaattggtcatggaagggttcaactggggacatgaacaaaaagtagttaccattttcagtgctcctaattattgttaccgatgtggaaatatggcgtccatattagaagttgatgattgcaagaaacatacatttatccagttcgagccagcgccgagaagaggagagccagacgtaaccagaagaactccagattacttcctataaacaatcttttgctcttatt

SEQ ID NO: 3787 - DNA, 1676 bp, Musa acuminata
cacagttttagttctccaaccctctccccgacacgattaaatggacgaaggatcgattgatttcctcctcttttaattcactcttcttcccctactttttctttttggctcttccgccatttctcaccttcgagggaaggaaagatttctgtaagggaaagggacggacttggaaccgggaggcgaccaagaaatctagggttagggtttttttcgcgtcccgtggcgtcccgcgggctgcagaggagaggaagatgagcgcaaacgcgttgccggcgcccagccgccatgggaacctcgacgaacagatcgagcagctcatgcagtgcaagccgctctccgagcaggaggttagggttttgtgtgagaaggccaaagaggtattgatggaagaaagcaatgttcagcctgtgaagagtcctgtgacgatatgtggtgacattcatgggcaatttcatgatcttgcagaactgtttcgaattggagggaagtgtccagatacaaattacttatttatgggcgattatgtagatcgtggatactattctgttgaaactgttacgcttttggtggccctcaaggtgcgatatcctcagcgaatcactattcttagaggaaatcatgagagtcgtcagatatggtaatgcaaatgtatggaagatctttacagatttgtttgattacttccccttgacagcactggttgaatcggaaatattttgccttcatggtggattgtctccatctattgaaactcttgataacatccgtaactttgatcgtgttcaagaggttccacatgaggggcctatgtgtgaccttttatggtctgatcctgatgacagatgtggttggggtatttctcctcggggtgcaggatatacctttggccaagatatatcagagcagttcaaccataccaataaccttaagctgatagccagagcacatcaattagtcatggaaggatataactggggacatgaccaaaaggtagttactatatttagtgctccaaattattgctaccggtgtgggaatatggcctccatcttggaagttgatgactgcaaggggcatactttcatccagtttgagccagcccccagaagaggagagccggatgtgactcgcagaactcccgattactttctgtgagtcagcgaatgtgggggctaggttcatggctttttcacagcaagtgcttctcgccaaaagtggggctgtggttgtggacatttccaatcctaggatcagtttttactccaagctgcctgagtttcgttggtttggaaggaatagatgtataatgatgttgaaagctgtacgtctcacgtcattcaactgtaacagggttcgttggaggcggtgaggcctatggttcagcttcggcagcagcgtgtatcgtttctgatggactgtctttccttttgtccttttttttttctggttattctttcgtttgctttttctccgcctatggaggagagggaatttacgcccaagtgttgtttttagcgaatggatagattcagttggatctttctcgatttgttcaacttaagacttctctatattagtgtttggatctttctcgatttgtcaacttaagacttctctatattagtgtttgctgctctaagatcagtttgtttgcctacttgattcatttcagc

SEQ ID NO: 3788 - DNA, 1918 bp, Panicum virgatum
gtcagagcgttgtgtgagaaggcgaaggagattctgatggaggaaagcaatgtcagcctgtaaagagtcctgttacaatttgtggtgatattcatggacaatttcatgatcttgctgaactcttccggattggtggaaagtgtccagatacaaactacttgtttatgggagattacgttgaccgtggctactattctgttgaaactgtcacgcttttggtggctttaaaagttcgctatcctcagaggatcaccattctcagaggaaaccacgaaagccgacagatcactcaagtttatggattctatgatgagtgcttaaggaagtatggaaatgcaaatgtctggaaaaccttcacggacctctttgactacttccccttgactgcattggttgagtcagaaatattttgcttgcatggtggattatcaccatctatcgagaccctcgataacatccgcaacttcgatcgcgtccaagaagttcctcatgaaggtccaatgtgtgatcttctgtggtctgatccagatgatcgatgtggttggggtatttcgccacgtggtgctggatatacctttggacaggatatttcagaacagttcaaccataccaataatttaaggcttattgctagagctcaccaattggtcatggagggattcaattgggctcatgagcaaaaagttgtgaccatatttagtgcacctaattattgctatcgctgtgggaacatggcgtcaatcttagaagtggatgattgcagggagcatactttcatccagtttgagccagccccaagaaggggagagccagatgtaactcgtaggacacctgactatttcctgtgatgcaaaagtgatgtggatctgcagcaaaggtttgatagataggtgaagtttcctggttgcagatatttttttgctcgaaaccccccgtgtgctattcttaagggctgttcggctgatcttggcacggcttgtctcgacttatctcgacttatttcctctcacataatactatttattctaccagccgagcactattcattctaccagctgagcactatttttgcccatggctcttcggctgtttccggctgttcagtcacatctgaattcaagtgtatacctacctactgcagctggaaggacaggattgtgttctcacttatctcttaactggttgatgcttttggcttggtttcgggtgctgcagtgggtgggttcaagcatcaagtagcaatctgtatgagagaggaaactgttcccgttgtattcattttgttcccctttgttccccacttttttctccttttctttttttttcgattcctgtagaggtaaacaattgtatggttctgtgttgggccattagtctttttctgactgcctcgatttgccgtatagaattaccatttaagcacaagtagtctaagttgtagcattctttgcaaccagcatttcaattgagctctggttttgctgttgattttgctttggacaaaatgaggcgagttgcaccgcccgaagaccagtggaacgaatgatctgtacgcgtgctgtctgtaacattgtatttataatttccttttgaaatactatcatcatgtatcctagccctgagctagtctcacctgaagatgcagcattctgtcatgtgccccttgagagggttcgctccctggatctggatggagccaaccaaacatgaaacatgcctagtattgatgtgcgaatgccataggccctgtttgggggagctggagcttctccaaaagctccatttggaaaagctccgccggctagttcaaaaagctacttttcagagaagctagagaggtctgtttggcggagcttcttgaccttcagcttctatctcctccctccttacttgcccgccggcctctgccaccatcgtc

SEQ ID NO: 3789 - DNA, 1514 bp, Phaseolus vulgaris
gccattacaccacactccattattttaactcactcctctcactctgctctctccccacaccggagaaaaccaaatcactttctccgttagggttagggtttccatttcccctaatccaatattgcaccgacatgggcgccaattcgttgccatcgacggaatccaacttagatctcgacgagcagatctcgcagctcatgcaatgcaagccgctatccgagctccaggtaagagctttatgtgagaaggctaaggagattttgatggatgaaagtaatgtccagcctgtgaaaagccccgtgacaatttgtggtgatattcatgggcagtttcatgatcttgcagaactatttcgaattggagggaagtttccagatactaattacttgtttatgggtgattacggccggggttattattcagtcgaaactgtaacacttcttgtgtcactgaaagtgcgatatcctcagcgaattactattcttagaggaaatcatgaaagtcgtcagatcactcaagtatatggcttttacgatgagtgcctcagaaagtatggtaatgctaatgtttggaagaccttcacagacctttttgatttctttccattgactgcattggttgaatctgaaatattctgtttgcatggtgggctttcaccttcaattgagactcttgataacataaggaactttgatcgtgttcaagaagttcctcatgaagggccaatgtgtgatctattgtggtctgaccctgatgataggtgtggctgggggatttctcctcgaggtgcaggatatacttttggccaggatatatccgaacaatttaatcacacaaacaagcttaagttaattgctagagctcatcagctggttatggatggatttaactgggctcatgaacagaaggtggttaccatttttagcgcgcctaactactgttaccgatgtgggaacatggcttccattttggaggttgacgattccaaaggccacacatttatccagtttgaccctgctcccagaagaggagagcccgatgttacccgtagaacgcctgattactttctatgatgttgctgctgcttctgcatatcgtaccagtgttgtagttgcaactcattatggacaaattgcaggtagtttgttcatcctcatcctcatcgtcatcgatgagattgctgtaagcacttaatctatgggtacgcactccaaacatatttggtgactgcccaatactgctttgatgtaaaataggcaggtaaaattccagttttttgtgacgcacaagaacttgctggacatcctattggagaaatctcctagatgatggccgtgtcagaatgtattattccggtgaaatgtggatattttttttgtgtttccctctttagtagcaagggattctatatctgttgatgatttgttttgctttgttctatcaattttcagttaaagctgcatgatgatagtgattcagttttgttcatactaattatgtcaaatttcattaca

SEQ ID NO: 3790 - DNA, 1482 bp, Cedrus atlantica
cccctctcagaacaggaggtcagaggattgtgtgaaaaggccaaggagattctcatggaagaaagtaatgtgcagcctgtcaagtgccctgttaccatttgtggtgacattcacggtcaatttcatgatcttgcggagctgttccggattggtggaaagtgtccagatacaaattatttgttcatgggtgactatgttgatcggggatactattcggttgagacggtcactcttctagtatcattgaaggtgcgctatccccagagaattactattctccgaggaaatcacgagagtcggcagattacacaagtgtatggattctatgatgagtgtttacggaagtatggaaatgcaaatgtctggaagatatttacagacctttttgactacttcccattgacagcactggtggagtcagaaattttctgcttgcatggtggcttgtcaccttccattgacacactagataacataaggaattttgaccgtgttcaagaagtgcctcatgaaggtcccatgtgcgatcttttgtggtctgatccagatgatagatgtggatggggaatctctccacgtggtgcagggtatacatttggacaagatatttctgaacaatttaaccatacaaacaacttaaaacttattgctagagctcatcaacttgtcatggaaggcttcaactgggggcatgagcaaaaagttgtcaccattttcagtgcgccaaactactgctatcggtgtggtaatatggcatcaattttggaagttgatgatactaaaggacatacttttattcagttcgagccagcaccaaggcgaggagaaccagatgtgacacggaggacaccggattattttttatgatttgtcttgctctcacctctgctgcttgccatttttctgccatcaaacctccacctgctatttgatctttggagctgctgccttatgatcatacgcatactgttgattcaaagctattcagagtttcaaattgatacattatattcaaattatgcttcagtgtggatgggggaacatgtattatgatcaggtattccctgaaggggtctgtgttcgttagtttggaactctttctttagccagtgcaagtgcactgccatgtgtatcaatttaagatgttgctgtagtgtagggagaggcaatctattgccgcgtgtttatttaatctttaactttgtaaacacttatatttgggcactgtctgctgattgagtagtagtctgcccatttcaatctcattgttggtagttcgggacaattgctgttaccaacgctcatgagaaattgcattttatggtgcttttaacctatccatagattggagaacgcctactttaggaaccccctgattcttaggaggcatctttcaggaaagcaggctttctgtatttacttttagtagatattgtccattcacaagcacatcgtaaggtcaagtatctggacgttggtaaa

SEQ ID NO: 3791 - DNA, 1131 bp, Carica papaya
aggttcgagtgttatgtgagaaagcaaaggagatactaatggaagaaagcaatgtccagcctgtgaaaagccctgtaacaatttgtggcgatattcatgggcagtttcatgatcttgctgaactttttcgaattggaggaaagtgtccagataccaattacttgtttatgggagattatgtggatcgtggctattattctgttgaaactgttacgcttttagtggcgctgaaagtgcgttatccacagaggattactattcttagaggaaaccatgaaagtcgtcagattactcaggtttatggattttatgatgaatgtctgcgaaagtatggcaatgcaaatgtttggaagatcttcacagacctttttgattattttccattgactgccttggttgaatcagaaatattttgcttgcatggtggattgtccccatccattgagaccctagacaatgtaaggaactttgatcgtgttcaagaagttccgcatgaaggcccgatgtgtgatttattatggtctgacccagatgatcgatgtggttggggaatatcacctcgtggtgctggatacacttttggccaggatatatctgaacaattcaatcacacaaacaacttaaagttgattgctagagctcatcagctggtcatggatgggtttaattgggcacatgaacaaaaggtggttaccatattcagcgcacctaattattgttatcgttgtggaaatatggcctctattttggaagttgatgattgcaagggccacacatttattcagtttgaaccagctcctaggagaggcgaacctgatgtcacccgtaggacacctgattacttcctttgaagcggttgccttcactagtccagtttcgtttactctgcaatgcttcctgcttcttcctctcctcaaatttagctggcttttgatcattttagcaggcctttgtctggttgatggcaagttcaatctaaagcgtgtaaaatatatagccaaagaagatgcatttgatttagcttactctagaaagcttgatggatttttgctgagagcttgcctatctgatgagattgacagcaccaggatgtgttaattgtgtagatattctgcttctattttgtttatc

SEQ ID NO: 3792 - DNA, 1056 bp, Ambrosia trifida
caaccaattaccaacaaaagatgagcttggatcacgttaatcacaatgttgatgagcaaatcactcagctcatggagtgcaaacctttgtctgagcaagaggttagggcattatgtgataaagcaaaggagatcctgatgcaagaaagcaatgtgcagcctgttaaaagccctgtcacaatctgtggggatattcatgggcaatttcacgatcttgcagagctttttcggattggtgggaagtgtccggatacaaattatctattcatgggagattatgttgatcgtggttattactcagttgaaaccgtgactcttttggtagccctcaaagtgcgttatccacaaaggattactattttaagaggaaaccatgaaagtcgacagatcactcaagtttatggattttacgatgaatgcttaagaaaatatggtagcgctaatgtgtggaagacgtttaccgatctatttgattatttccccctaactgcattggttgaatcggaaattttttgtcttcatggtggattatcgccctcaattgaaacactagataatataaggaattttgaccgtgttcaagaagtgccccatgaggggcccatgtgtgatcttttatggtctgatcctgatgaccgttgcggttggggtatttcacctcgtggtgctggatatacgtttggtcaagatatatcggagcaattcaatcatacgaacagcttaaagctgattgctagagcgcaccagctggttatggacggttacaactggggccatgaacaaaaggtggtgacgatctttagcgcacctaattattgttaccgttgtgggaatatggcttcaattcttgaagtcgacgattgcaagggccacactttcattcagtttgaaccagctccaaggaggggagagccagacgtgacacgtaggacaccagattattcctatgatgttgacttggctattttgataaggccaacatgcacctaaccaaccgctcatggaaattaggagggccgaaaagggatacatgaatctaggaaatgtggcagcaatg

SEQ ID NO: 3793 - DNA, 1141 bp, Nuphar advena
tcccccgctcttcccccccccccccccccgagacccagacagagagcgacacccaccaaggacgcccgccaccccgccccaaccctcaccgtcatctcgactcccagatcgcgcagcttatgcagtgcaagcccctctccgagcaagaggtaagacccttctgtgacaaagctaaggagatcttgatggaagaaagcaacgtccagcctgtgaaaagccctgtgacaatttgtggtgatatccatgggcaatttcatgatcttgcagagctctttcgtattggaggaaagtgtccagataccaattacttgttcatgggtgactacgtcgatcgtggatactactctgttgaaactgtaaccctcttggttgcccttaaggttcgttatccccaacgaattaccatccttagaggaaatcatgagagccgccagataactcaagtctatgggttttacgatgaatgcttgcggaagtatggaaatgccaccgtctggaagaccttcacggacctatttgactattttccactgacagctttggtagaatctgaaatattttgtctgcatggtggcctgtcaccatcaattgaaactctggataacatacgaaattttgaccgtgtccaagaagtccctcatgaaggacccatgtgtgatctcttatggtctgaccctgatgatcgatgcgggtggggtatatcaccacgtggtgctggatatacttttggtcaggatatatctgagcagtttaaccacaccaacaatttgaagctcatagctagagctcaccaacttgtcatggagggtttcagttggggccatgagcaaaaggtggtgacaatttttagtgcacctaattattgctaccgatgtgggaatatggcatcgattttggaagttgatgattgcaaaggtcacacattcattcagtttgaaccagctccacggcgaggagagccagatgtgactcggagaacccctgattactttttatagaagctgtcctgcttgttgatcttttgtggcagtggagttgtacccttgctgcttcaggaagggacagagtaaatatcatggaccttgtattggattatgattcattttgtcaaagcttattgcatggggggatcacagaaaag

SEQ ID NO: 3794 - DNA, 865 bp, Echinacea purpurea
tggacgagcagatttcacagctcatgcagtgcaaaccgttacccgaacctgaggttaggacattatgtgacaaggcaaaggagatattaatagatgaaagcaatgttcagccagtaaaaagcccggtgactatttgtggtgacattcatgggcaattccatgatcttgctgaactttttcgtattggaggaaagtgccccgatacaaactacttgtttatgggcgattacgtggatcgtggttattattctgtcgaaactgtcacactcttggtggctctgaaagtacgatatcctcagcgaattactattttaagagggaaccatgaaagtcggcagattactcaagtatatggcttttatgatgaatgcctgcggaagtatggcaatgctaatgtttggaagacttttacagatctgtttgattatttcccattgactgcattggttgaatcagaaatattttgcctccatggtgggttgtcaccttccattgaaactcttgatagtataagaaacttcgaccgtgtgcaagaggtcccacatgagggtccaatgtgcgatcttttatggtctgacccagatgatcgttgtggttggggtatctctccccgtggagccggttacacgtttggtcaagatatctcggagcaatttaaccataccaatagcctaaagctcattgctcgagctcatcaactggtcatggagggattcaactggggacatgaacaaaaggtggtcactatctttagtgcaccaaattattgttacaggtgtgggaatatggcttctattttggaggtggatgattgcaagggacacacgtttattcagttcgaacctgctcctaggagaggagaacc

SEQ ID NO: 3795 - DNA, 1331 bp, Festuca arundinacea
aggttagagcgctgtgcgagaaggccaaggagattttgatggaggagagcaatgttcagcctgtaaaaagtcctgttacaatatgtggtgatattcatgggcagtttcacgatcttgcagaattgttcagaattggtggaaagtgtccagatacaaactatttgtttatgggagattatgtagatcgtggttactattccgtcgaaactgtcacgctattggtgtctctaaaagttcgttaccctcagcggatcactattctcagaggaaaccatgaaagccgacagatcactcaagtttatggattctacgatgagtgcttaaggaagtacggaaatgcaatggtgtggaaaacttttacggatctgtttgactacttccccttgacagcattggttgagtcagaaatattttgcttgcacggtggattatcaccatccatcgagacacttgataacatacgtaactttgaccgcatccaagaagttcctcatgaagggtccatgtgcgatcttctgtggtctgatccagatgatcgatgtggttggggtatttctcctcgaggcgctgggtataccttcggacaggatatatcagagcagttcaaccataccaataatttaagacttattgccagagctcaccagttggtcatggagggattcaactgggctcatgagcaaaaagtggtcaccatatttagtgcacctaattattgctaccgctgcggaaacatggcatcaatcttggaagttgatgattgcagggagcatactttcatccagtttgagccggccccaagaaggggagagccagacgtaacccgtagaacaccagactatttcctgtgatgtgatgaaattggtgttggtttctgcaccaaaggtttgatagctagctgaagtttcctggttgagataatctttttgccccgtgtgttactcttcttattttttccccatgatgcctttggctattgtgagctgctttgctgcatcgtgactcaagtgtatacgtacagcctggaaggattcattgtgttctcaccacctctctaactgatttgatgctctgcttggggcctgcagctagtgacttttaagcatcaagcagcatttgtattatgacaggaaactatttcccctttgtaattcattttccccttatctaattttcttctcatgattcttgtagagatgaacaatgtagctgtgcggttctgtgttgagcccttaggtcttctgaacctgtcttaatttgtcgtacataaatactttgaagaactagtatgttgagcaacggttttgttgtgttatgaatgtttgatctgg

SEQ ID NO: 3796 - DNA, 2024 bp, Theobroma cacao
cacatctacagccacaaggcaaatcgcaacccgcgcgctacttgcactgtgattgtcacgctcttatccaagccctccaccacatgtttccctccgttacgatgggtccgttatttccactcgctaatctggaagacaccaacattccacccaaaaacaattttgaaatgccccttacatttttaccttggaaaaacactcaattaggggaaaaaaaagaaagaaagaaaactgatttttgttagaaggagtgagtgatccaaacaaaaagagaagaaagcgaagcagtctctctctctctctctctgtcttcacaaaaacattgggctcttcaccaccacttcctttcttttccttttctcttcagaaaactagaaatctctctttctctctctttctttggttcttcttctaagaaataaatttagagtttttttttttaaaaaagaacaattgtttgggaaattttaggaatctaggtttaggaattattaaagagagatggattcttcggtgagttcgaactcccatgggaacctggacgaacagatttcgcagctgatgcagtgcaagcccttatcggagcaggaggttagggtgttatgcgacaaggctaaggagatactgatggaggaaagcaatgttcagcctgtcaaaagtcctgtcacaatatgcggtgatattcatgggcagtttcatgatcttgcagaactttttcgaattggagggaagtgttctgattgaggcagctatcttgtgttttaaatgttatgctaacttttgtgaactatttgcaatgcgtctactcttggtagcccttaaagtgcgttacccccaacggataactatactgaggggaaatcatgagagccgtcagattactcaagtgtatgggttttatgatgaatgcctaaggaagtatggcaatgccaatgtatggaagatctttactgatctgtttgactattttccactaacagcgttggttgaatctgaaattttctgtctccatggtgggttgtctccatccattgaaaccctggataacatacgtaattttgatcgtgttcaagaagtccctcatgagggtcccatgtgcgatcttttgtggtctgacccagacgatcgttgtggttggggtatttctccaaggggtgctggatatacctttggccaagacatatctgagcaatttaaccatacaaataacttgaagctgattgctagggctcatcagctggtcatggaaggatacaattggggtcatgaacaaaaggttgttactatatttagcgcacctaattattgctatcgatgtggaaacatggcttccatcctggaagttgatgactgcaagggtcatacattcattcagtttgagcctgctccaaggagaggagagccggatgtaacccggaggacacctgattacttcttataaagtaaactggcagtgggttgatgagtctctggtggccagtgtccatcaatgcgtttgcgttgagggttttttcaaatttaagataagatttataattagcaatggtggttgttgggtggcagcgagcttgtatatggctgatgagggcttctttggtcagggttgtttccttgaattatgcttgggtttctgcaagaggaggcaaaagagctggtaacactgtaggggcatatgtaccattttccagcagacaatgtgacactattatttattttctttgattttaatttttgtttcctttaatcggtagaagaaagggcatgggctgttcgagggttgggatatgtagagggatgctgacaacattttctttataatgggtgctttggtttttttttttttatatatttttttccacagtgccaatcaaataggtgtttttctctctatttaacagaaccctgtttctttttacagtcaaatagaattgtattgggttcaatgtttttcttttttcttcttttttaaaagctcttaagacacaatgaaaatattcacgaaatcattaccttcttgattgaaa

SEQ ID NO: 3797 - DNA, 1052 bp, Panax ginseng
aggttagggtgctgtgcgagaaggctaaagagattctaatggaagaaagcaatgtgcagcctgtcaaaagcccagtgacgatttgtggtgatattcacgggcaattccatgatcttgcagagctgtttcgaattggagggaagtgtccagatacaaattacttatttatgggagactatgttgatcgtggctattattcagttgaaactgtaacgcttttggtagctctcaaagtgaggtattcacaacgaattactattttgagaggaaaccatgagagtcgtcagattactcaagtatatggcttttatgatgaatgcctaagaaagtatggtaatgccaatgtgtggaagatctttacagatttatttgactattttccccttacagcattggttgaatcagaaatattttgtctccacggtgggttgtcaccttcaattgaaacccttgataatatacggaattttgatcgtgttcaagaagttccccacgagggacctatgtgtgatctcttatggtctgaccctgatgatcgttgtggttggggtatctcgcccgaggggtgctggatatacttttggccaagatatatctgagctaatttaatcataccaacaacttgaagcttattgctagagcacatcagctggttatggagggattcaactggggccatgagcaaaaggtggttactatatttagtgcaccaaattattgttatcgatgtggaaacatggcatccattttagaagtagatgattgcaaaggacacaccttcattcagtttgaaccagctcccaggagggagagcctgatgtaactcgaagaacaccagactatttcctatgatgcagtagttagtttctaaaatttgaagccgtgagtgcctgctaattgctatgtgtttgggagctaccaaacatatttgcagtgataattactatgctgaagtgggtagtgaaaaagcatgtaaaatgggcagtgtaacatatacaaagattcagttattatcctggaactggatggtgctactgcggacgaggcagcag

SEQ ID NO: 3798 - DNA, 1340 bp, Cicer arietinum
gcaggtaagggtcttgtgtgataaggcgaaagaaattttgatggaagaaagcaatgtccagcctgtaaaaagtcctgttacaatttgtggtgatattcatgggcaattccatgatcttgccgagcttttccgcattggaggcaagtgtccagatacaaactacttgtttatgggagattatgttgaccgtggctattattctgtcgaaaccgtaacgcttttggtcgcccttaaagtgcgttaccggcagcgtattactattttgagggggaatcatgaaagtcgccagattactcaagtttatggattttatgatgagtgcctacggaagtatggtagtgctaatgtttggaagatgtttactgatttgtttgactacttcccattgacagcattggttgaatctgaaatattttgtcttcatggtgggttatccccatctattgaaacccttgacaacattcgtaattttgatcgtgtgcaagaagttcctcatgagggacccatgtgtgatcttctatggtctgatccggatgatcgctgtggttggggaatctctcctagaggtgccgggtacacatttggccaggacatatctgagcagtttaaccacacaaataatttgaagctgattgctagagctcaccagctggttatggaaggatataactggggtcacgatcaaaaggtggttaccatattcagtgcacctaattattgctatcgctgtgggaacatggcatccatccttgaagttgatgattgcaaaggacacacattcattcagtttgagccagctccaaggaggggagagccagatgtaaccaggagaacccctgactacttcctatgatatatacaactttggttgagttgctgttgccagcagcaacttgtaccatgcagtaatgtgcaagctcatctacctgttgaaatcagagctgtgaatcaaattgatccttattttcaaagttagcttcagtggacgtattaattattgaattataattgaatctttccaagaggaagctgaggagcaggcgatgctattgtgggcatgtgtactattccagcatgcaatgtatcaatttgaatgtttctccaaattttccttttctatttatttgtaactctgttgacctttcttttctcattttaggattatcgttaatggggatgggtttatgtagatggataatgctttgacataatcttctaatgggtgttttatgatttttttttaaactggtcttgtgtagtcttgttatctttgttttacttgaaatgaattttatttcttaaaaaatttatgttaattctaagttttggctatttatgga

SEQ ID NO: 3799 - DNA, 1009 bp, Acacia harpophylla
cccttcacagtctggacagtgccagctgctcgaaaagagcaccgcagaattcgcctagggttaggatttgccctaagttggattttgttcaccaggcgctcatcgatcatcaagcaagatgggggtggactcgttaccatcggaatcgagatatgatttagacgagcagatctcacagctgatgcagtgccagccgctgtcagagcaacaggttagagttctttgtgagaaggctaaggagattttaatggatgagagcaacgtccagcctgtgaaaagccctgtgacaatatgtggcgatattcacgggcagtttcatgatcttgctgaactatttcgaattggtgggaagtgtccagatactaactacttgtttatgggagattatgtggaccggggttattattcagttgaaactgtaacactccttgtggcactaaagtgcgttatccccagcgcataactattcttcgtgggaaccatgaaagtcgccagatcactcaagtatatgggttttatgatgaatgcctaagaaagtatggtaatgctaatgtttggaagatcttcacagacctttttgattactttccattgactgcattggttgagtcagagatattttgtttgcatggtggactctctccttccattgagactctagataatgtgaggaactttgatcgtgttcaggaggttcctcatgaagggcccatgtgtgatctattatggtctgacccagatgatagatgtggttggggaatttctcctcgtggagctggatatacttttggccaggatatatctgaacaattcaatcacaccaacaaccttaagttgattgctagagctcaccagctggttatggatggatttaactgggctcacgaacaaaaggtggttaccatatttagtgctcctaattattgttatcggtgcgggaacatggcttccatattagaagtcgatgattgcaaggaccacactttcatccagtttgaacctgctccta

SEQ ID NO: 3800 - DNA, 1099 bp, Carica papaya
ctctacaaactagaaatttcccacttttgctctctctctctctctctctggaggtgtgggaagttgcaggaggaggtgaaatctagggttttgaattggtgaatttgaaggttaattgttgaattatctaggggttagagaagggacagtcgaggggatcttggaatctgattgaagaagagagggggaaacaagaagaagaaggtagaagaggaagaggaagaggagaatggactcggtcccttcgaactcacacggaaacctcgatgagcagattaatcaactcatgcagtgcaagcccttatctgaacaagaggtaagaagcttatgtgagaaggcaaaagagatattgatggaagaaagcaacgttcagcctgtgaaaagccctgttacaatctgcggtgacatacacgggcagtttcatgatcttgcagagctttttcgtattggaggaaagtgtccagatacaaattatttattcatgggagattatgttgaccgtggctattactcagttgaaaccgtaacacttttggtagcattgaaagtgcgttatccacagcggattactattcttcgaggaaaccatgaaagccgtcagattactcaagtttatgggttttatgatgaatgcctaaggaagtatggcaatgctaatgtttggaagatctttacagatctgtttgactattttccattgacagcgctggttgaatcagaaatattttgtctccatggtggactctctccatccattgaaacccttgataatatacgcaattttgaccgagttcaggaagttcctcatgaaggccctatgtgtgatcttttgtggtcggatccagatgatcgatgtgggtggggtatctcacccaggggtgctggatatacctttggccaggacatctctgagcagttcaaccatacaaacaacttgaagctgattgctagggctcaccagcttgttatggaaggttacaactggggtcatgagcaaaaggttgtgactatatttagtgcacctaactactgttatcgctgtggaaacatggcttcgattctggaagtagatgactgcaagggccacacatttattcag

SEQ ID NO: 3801 - DNA, 1512 bp, Vinca minor
aacttccgattaaccagggatttcataatcatcttgccctagacgaattcattcccaagttccgatccacattttattcatataacaagcaaacggcggaggttggtggtggcgccggtgaagatgagtacggcggatctggtggcgccgagcacacatggaaatctggacgagcaaatttctcagcttatgcagtgtaaacctttgtccgagaccgaggttagaacattatgcgagaaggccaaagagatactgatggaggagagcaatgtccagccagtacgaagtccagtgacaatttgtggtgatattcatgggcaatttcatgatctggctgaactttttcgcatcggagggaagtgtccagatacaaattatctttttatgggagattatgtggatcgtggatattattcggtggaaactgtaactctattagtggctctgaaggtgcggtaccctcaacggatcaccattcttcgaggaaatcatgagagccgtcagattacccaggtttatgggttttatgatgagtgtctgcgcaaatatggcaatgctaatgtatggaagacattcacagatctttttgattattttccactgacagcattggttgaatccgagatcttctgtttgcatggtggattatcaccatctattgaaacacttgataacataagaaattttgatcgtgttcaagaagttccgcatgaaggtcctatgtgtgatctcttgtggtctgatccagatgatcgctgtggttggggtatttctcctcgtggtgctggatacacatttggccaggatatatctgagcaattcaaccacaccaacaacttaaagctgattgctagagctcatcagctggttatggagggctataattggagccatgaacaaaaagtcgttactatctttagtgcaccaaattattgctatcgttgtggaaacatggcatctattttggaagtcgatgactgcaggcaacacacattcatccaggtcatcctctctctctattttttttttatgactgttctgtttctcttgcatcacttatttcttgccttcacaatataatactactagcatttcgcttggtatgtatggactttattccctaatatttagagtgttgtattatgtgggttcatttcacgatgtagtttgagccagctccaaggaggggggagcctgatgtgactcgtagaacgcctgattatttcctgtaaagcatttgaggttgctgactaggtggttgtctggctgatggcttctgtaaggcggttgacacgtctgtcattggaattgaagcttcttcacaacaaggtactaggattctcttctagtggtgtcacaaggaccaaaaggcgtgtaaaaagctttagcccattggaggtccggttttaagttatattctaattgagaagttggcggagctaggcatatctcaaataatactgtattgtatcatttcatgtagagaacttgagatctcgtcctcgttagctc

SEQ ID NO: 3802 - DNA, 1164 bp, Brassica juncea
ttatgcgaaaaagccaaggagatcttgatggatgagagcaacgttcagcctgtgaaaagtcctgtgacaatctgcggtgatattcatggacagttccatgatcttgctgagcttttccgtattgggggaatgtgccctgataccaattacctgtttatgggagattacgttgaccgtggttattattctgttgaaactgttacgctgttagtcgccttaaagttgcgatatcctcagcgaatcaccattcttagaggaaaccatgaaagtcgtcagatcactcaggtttatggattttatgatgaatgcctgcgaaagtatggcaatgcgaatgtttggaagatctttactgacctctttgattatttcccactgacagccttggttgagtcagaaatattctgccttcacggtggattgtcaccgtctatcgagacccttgacaacattaggaacttcgatagagttcaagaagttccacatgaagggccgatgtgtgacttgttatggtctgatccggatgatagatgtggctggggaatctctcctcgtggtgccggatatacatttggtcaggacatctccgaacaattcaaccacagcaacagcttaaaactgattgctcgagcgcatcagctggttatggatggattcaactgggcacacgagcaaaaggtggttaccatcttcagtgcgccaaactattgctatcgctgcgggaacatggcctccattctcgaggttgatgactgcaggaaccacaccttcattcagtttgaaccagccccaaggagaggagaaccagatgtgacccgaaggacacctgactacttcctataaacaaaagtcacctcctctccagctgcaaagtccggttgttggttttttgaagatctctggcttattccatttggcaacgccttgtcttctgagtgaggttgcgtttctttgaaatcgatttagccttctaccttggaatagtgtaatataggcaatgaggtcaatgaactataaaacctagtcccatgaatgtttgtgtttggctgaaattatttagctcccttcttgcatcagaatctatttcttgtgagatattattttgacttaatttcatgttaattctttccttcaatttatgctttttacactgttttgatccaaaca

SEQ ID NO: 3803 - DNA, 846 bp, Mimulus guttatus
atgagtgtaaattattttgcaaatgagatactgatgctggaaagtaacgtccagcctgtaaaaagtcctgtgacaatttgtggtgatattcatggccagtttcacgaccttgcggaacttttccgcatcggagggaagtgtccagacacaaactacctatttatgggagattatgttgatcgtggttattattcggttgaaactgtcactcttctggtgtctctgaaagtgcgctatcctcaacgtatcacgattcttagagggaatcatgagagtagacagatcacacaagtctatggattttacgatgaatgtctgcggaagtatggaaatgctaatgtctggaagatattcactgatctgtttgactatttccctctgactgctttggttgaatcggaaatcttttgtctgcatggtggactgtctccatcaattgaaaccctcgataatataagaaactttgaccgtgttcaagaagttccacacgaaggtcccatgtgtgatctgttgtggtctgacccagacgaccgttgtgggtggggcatatccccccgtggtgctggttacacttttggccaggacatatcagagcaattcaaccacacaaacaacttaaagctaattgctcgagctcaccagctggttatggagggatataactgggcccatgaacaaaaggttgtcactatttttagcgcaccgaattattgttatcgatgtggaaacatggcttccattctggaagttgatgattgcagagagcacacctttattcagtttgagccagctcctaggagaggggagcctgatgtgacacgaagaacgcccgattatttcttgtag

SEQ ID NO: 3804 - DNA, 1065 bp, Ricinus communis
atctagggtttcagagaaattataatattagggttggattattaaaaatcgaaaggatctggatctctgattactaaattcataaagaagaaaaaaatgagcttggaatcggtccctacgaacacgcatggaaaccttgatgagcagattaatcagctcatgcagtgcaaacccttatctgagcaagaggtaagggggttgtgcgataaggctaaggagattttgatggaagaaagcaatgttcagcctgttaaaagtcctgttacaatttgtggtgatattcatggtcaattccacgatctcgctgaacttttccggatcggagggaagcttttagtagccctgaaggtacgatatcctcaacgcattactattctacgtggaaatcacgaaagccgtcagattacacaagtttatgggttttatgatgagtgcctacgcaagtatggcaatgccaatgtctggaagatatttactgacttgtttgattactttcctctgacagcattggttgaatcagaaattttttgtctgcatggtggattgtccccctctattgaaactcttgataacattcgtaactttgatcgcgttcaagaagttccccatgagggtcccatgtgtgatctattgtggtctgatcctgatgatcgctgtggttggggcatctcaccgagaggtgctggatatacctttggccaagacatatctgagcaatttaaccatacaaacaacttgaagctgattgctagagctcaccagctggttatggaaggatataactggggacatgaacaaaaggtagttaccatttttagtgcgcctaattattgttatcggtgtggaaacatggcatctatattggaggttgatgattgcaagggacacacattcattcagtttgagcccgctccaaggaggggagagccagatgtcacccggagaacacctgattacttcctatgatgcaagtcagatccaagttggtgagtacccgggtcttctagggcttttgcaaatttaaggttacaacttcgctatggtgttggttggggtggcgaaaag

SEQ ID NO: 3805 - DNA, 1302 bp, Triphysaria pusilla
cgacgatggcgtcggccggtggcggagctagtggtaacctcgatgagcaaatcgctcagctcatgcagtgcaagcccttatccgaacaagaggtgcgggcattatgcagaaggctaaggagattcttatggacgagagcaacgttcagcctgtgaaaagcccagtgacgatatgtggtgatattcatggacagttccacgatcttgctgagctttttcggattggtgggaagtgtccagatacaaactatttgtttatgggggattatgttgatcgagggtactactctgtggagactgtgacgctcttggtggctctcaaagtgcgttttcctcaacgactcactattctacgtgggaatcatgaaagtcgccagattactcaggtttatgggttttacgatgaatgcctgagaaagtacggcaatgctaacgtgtggaagacctttacagatttatttgattattttcctcttactgcattggtcgagtctgagattttctgcctccatggtggattatcgccgtccatcgaaactctcgacaatgttcggaattttgatcgtgttcaagaagttcctcatgagggggccatgtgtgatctcttatggtccgatcctgatgaccgatgcggttggggtatctctcccaggggagctggatatacattcggacaagacatatcggagcagtttaaccataccaatgggttgaagcttattgctagagctcaccagctagttatggaagggtttaactgggctcatgagcaaaaggtggttaccatcttcagtgcgcctaattattgttaccgctgtgggaacatggcatctattctggaagttgatgactgcaggggtcatagtttcattcagtttgagccagctcctaggcgtggtgagccagacgtaactcgaaggacaccggattattttctctgattcagtttgcctaaattgaaatgcctgttagctgcttatgtgttgatgcctgcttaaaaggttgaaaaaaaagacccgaaaaaatatcgatgatggaatggtagaaagacgcaggtggtgctttctccagtttaggttattatcattaccctgaaattcacggagatagtaactgcactagcggcagtagagttggcggctgcagaaaaatattatagatgcaatttacttcgcatttttatttatttattttcttttatatttgagaacgaatattaaattctgttagagttgttaacaacttggaaaacactattaggtttgtaaacttatcagctttctaatgtctgtgtgtgggtgat

SEQ ID NO: 3806 - DNA, 850 bp, Arnica chamissonis
tttcacagctcatggagtgcaggcccttaaccgagcctgaggttaagacattatgtcagaaggcaaaagagatattgacggacgaaagcaatgttcagcctgtgaagagccctgtgactatctgtggtgacattcatgggcaatttcatgatcttgctgaacttttttgcattggagggaagtgtccagatacaaattacttgtttatgggcgattatgtggatcgagggtattattctgttgaaacagtcacgtcttttggtcgctctgaaagttaggtatcctcagagaatcaccattttaagaggaaatcatgaaagccggcagatcacacaagtctatgggttttatgatgaatgtctccggaagtatggcactgccaatgtttggaagatgtttacagatctatttgattatttcccattgactgcattggttgaatcggaaatattttgtcttcatggtgggttgtcaccttccattgaaactcttgatagtataagaagttttgatcgtgttcaagaggttccacatgagggtccgatgtgcgatcttttgtggtctgacccagatgaccgttgtggttggggcatctcacctcgtggagctggttatacctttggtcaggacatatctgagcaatttaaccataccaacaacttaaagctcattgctagagctcatcagctggtaatggagggattcaactggggacatgaccaaaaagttgtgactatctttagcgcaccaaattattgttatcgatgtgggaacatggcttctatattggaagttgatgattgcaaaggccacacgttcatccagtttgaaccggcccctagaagaggcg

SEQ ID NO: 3807 - DNA, 1085 bp, Euphorbia esula
ggcatccccctcaatcctagggttaggggtatccctaatccggataccgttataccccttcccgattgtaattaccaatcaccatggattcgaattctccgtcgactgattcagttagcgatctgaatgagcagatctcgcagcttatgcagtgcaggccgctctcggaaccccaggtcagatcattatgtgagaaggctaaggagatactgatgcaagaaagcaacgtccagcccgtcagaagccctgtcactatatgtggtgatattcatggacagtttcatgatcttgcagaacttttccgaataggagggaagtgcccggatagcaattacttatttatgggagattatgtggaccgtggctattattctgttgaaacagttacgctcctagtggccctgaaagtgcggtatcctgaacgaataacaattcttagaggaaatcatgaaagtcgtcagatcactcaggtttatgggttttatgatgaatgcctacgaaagtatgggaatgctaatgtgtggaagatcttcacagacctttttgactatttcccgttgactgccttggttgagtcagaaatcttttgtcttcatggtggactatccccatcaatagaaaccctggacaacataagaaattttgatcgggttcaggaggttcctcatgaaggagctatgtgtgatctcttatggtctgacccagatgatcggtgtggttgcggtatatcacctcgtggtgctggctatacttttggtcaagacatatctgagcaatttaatcatagcaacaacctaaagttgattgccagagctcatcagcttgttatggatggatttaactgggcacatgagcaaaaagtggttaccatatttagtgcacctaattattgttaccggtgtgggaacatggcttctatattggaagttgatgattgcagaggccacacattcatccagtttgaacctgctccaaggaggggagaacctgatgttacacgtagaacccccgattatttcctgtcccataagcctcacgttcacacctgtttgacctgcttgagattgagatcctagttgcaatat

SEQ ID NO: 3808 - DNA, 1329 bp, Lupinus angustifolius
agagtggttatcgaataaatcgagaaccaagggaagcctccaacccctttggtttctctacctccactcctcttctctctccgaaaaccagaaacaaaaaagaaagaactcacaacaaaccaaaaaaactgagatctagggtttccaccatttcgaagaaagaagaattaggaagaataagccatcatggattcgaattctcatggaaacctcgatgagcagatttctcagctcatgcagtgcaaacccttgtccgagcaagaggtaagggccttgtgtgataaggcaaaggaaattttgatggaagagagtaatgtccagcctgtgaaaagccctgttacaatttgtggtgatattcatgggcaattccatgaccttgcagagctgttccgcattggtgggaagtgtccagatacaaattacttatttatgggagattatgttgaccgtggctattattcagttgaaaccgtgacgattactcaagtttatggattttatgatgaatgcctacggaagtatggcagtgctaatgtttggaaaaccttcactgatttgttcgattactttccattgacagcattggttgaatctgaaatcttttgccttcatggtgggctgtccccatctattgaaacccttgataacatacgtaactttgaccgtgtacaagaagttcctcatgaggggcctatgtgtgatcttctatggtccgatccggatgatcgttgtggttggggaatctctccaagaggtgctggatatacctttggccaggacatatctgaacaatttaaccataccaatagcttgaagcttattgctagagctcatcagttggttatggaaggatataactggggtcatgatcaaaaagtggttaccatattcagtgcacctaattattgttatcgctgtgggaacatggcatccatccttgaagttgatgactgcaaaggacacacattcattcagtttgagccagctccaaggaggggagagccggacgtaacccggagaacacccgattacttcctatgatacaactctggttgagtcgctgttcaccagcatcaactacggccttgcatttcgaagttaggctttgttggatgtgttaattacttgttataattgagtacaagaagctgaggagcaggattcttgttatggggatgggtctttgtagatggtttctgatggatgctttatatatttttttgagaatatgttctgataggaactccttttctcttgcttttacgtagtatttttttcttctttttcaaatacttttattaatacaattatctttgattgtttcttgac

SEQ ID NO: 3809 - DNA, 1382 bp, Panicum virgatum
acagccagttaaaagcccggtgacaatttgtggtgacattcatgggcaattccatgatcttgtagaacttttccggattggcgggaagtgtccagacacaaactatttgtttatgggagattatgtggatcgtggctattactctgttgagaccgtaactcttttggttgcactgaaggtgcggtacccacaccgaattactattcttcgtggaaaccatgagagtagacagatcacacaggtgtatggcttctatgatgaatgcctacgaaaatatggcagtgcaaatgtctggaagatcttcaccgatcttttcgactattttcctttgacagcattggtggaatcagaaattttctgcctccatggtggtttatctccttccattgagaatctcgatagtgttagaagcttagatcgtgttcaagaggtccctcatgagggacctatgtgtgaccttctgtggtctgatccagatgatcgatgtggctggggcatatctcctcgaggcgctggatacacttttggccaggacatatcggaacagtttaatcacaccaacaatcttaaacttgtagcccgggctcatcagttggttatggagggttataactgggcacatgaacaaaaggtggtgaccatattcagtgcacctaattactgttaccggtgtggcaacatggcatccatccttgaagttgatgactgcaggaatcactcatttattcagtttgagccagctccgaggagaggtgaaccagatgtgacacggagaacaccagattatttcctctgagttatctgctgtatcattttgatttttgtgcaagattgcaatagtggttgctggtcagtaacatttttgttggatccgtacgacaaagtaacctgaccagcaatagcaagaaaatgcggctgccttaatagtgtgagaattgatctccattcgtggcttcaagaggtgcccaaaccgacgtgagaatctggtggtgaattggcgcctgtgttggctctgttgaccgctggctcgacagagatatagcttttgttttagcataagttgctttggttcttcctttagttttgttttgcgttggtgtgcctacaacctcggtgattaaatgactacaaatgctgatccccttgttgcaattgtgaagaatgacacgcagctagtttcgttctttactgctcattatccgatgttacccgttgtacccacacttttttatgtagcaaccaaacgtgttatagcccatttgtttcgttctacatcttgcttcccatattgcttgtataatcgtatgaactattctgaactagacagtacttgagacagcatgtagtgttgtactgtactgaatttattaccttttaattta

SEQ ID NO: 3810 - DNA, 1624 bp, Panax ginseng
ctcacacttccactaaccgagaacgaagaagaagaaacaaaactgattattagggttagaaagaaaattctaataataaaggaaaattgaatcttcaagggacaataaaaatgaacttcgatctggtgcagccgagcgccaatggaaatgtcgatgaggaaattgcccagcttatgcagtgcaagcccttgtctgagcaagaggttagggtgctgtgtgagaaggctaaggagattctaatggatgaaagcaatgtgcagcctgtgaaaagcccggtgacgatttgtggtgatattcatgggcaattccatgatcttgcagagctgtttcaaattggggggaagtgtccagatactaattacttatttatgggagattatgttgatcgtggctattattcagttgaaacagtaacgctcttggtggcgctcaaagtgaggtatcctcagcgaattactattttgagaggaaaccatgagagtcgtcagtaggagccgggtgatagctatagttaaatattgtcagaagttctattctgatgtcctcttccatacagattactcaagtttatggattttatgatgaatgcctaagaaaatatggtaatgccaatgtgtggaagatctttacagatctgttcgactattttccccttacagcattggtcgaatcagaaatattttgtctccatggtggattgtctccttcaattgaaaccctcgataatattcgtaattttgaccgtgttcaagaagttcctcacgagggacccatgtgtgatcttctatggtctgaccctgatgatcgttgtggttggggaatctcgcccagaggcgctggatatacttttggccaagatatatctgagcagttcaaccataccaacaacttaaagcttattgctagagcacatcagcttgttatggagggattcaactggggccatgagcaaaaggtggtaactatatttagtgcacccaattattgttatcgatgtggtaacatggcatcgatcctagaagtagatgattgtaaaggacacacattcattcagttcgaaccagctcccaggaggggagagcctgatgtaactcgaagaacaccagactatttcctatgattcagtaggataaattgctgaatttcgagctgtgagtgcctgctagctgctttatgtgttttaggagctatctaaaatatttgaagtcatactatgatgaggtgggtagtgaaaaacatgtaaaatgggcagtgtaacatctactttggctcggttattatcctggaaccatatggagatactagaaacgaggcagtggagctggtgatatcatgtatgctgtgtaatgtaccatttactgcataacaatgcggcatcctctcttctcattcacttcaaccttaagttctgctcattttttgtctgttgtagaaggatcaacaatttgggatggggtggggttctgtagatgcaaaagtaattttttccttcctttccaattgttcaaggggtgttttgtttttagttgtcgacatattttaagtttgctgattatttttccacacatatcagatgcggaattgaatgattgtttctttttctacttctctcaatgtagaaggg

SEQ ID NO: 3811 - DNA, 1192 bp, Cocos nucifera
gcccccggccatttaaggctacaaccagtggggccagcccatggtggcgtttcctggttctcaacagaagggcccgagggtgcttttcctctttggttcctcagccaccgttggtgttctccttcctctctttccttctcgctcctccaatatcttttccccgcgataggatacgactcaattaatgtatatatagatacgaagagagaggttggagggcaggagattccgattttgaaagggaattaaaagctgccagagctagggttagggtttgtggttgcatcacctcggatcggactggctggaggagaagatggacgtggatccggtacccgccaattcccatggcaacgtcgaagagcaaatctcgcagcttatgcagtgcaagccgctctccgagcaagaggttagagttctttgtgacaaggctaaggaaattttgatagaagaaagcaatgtccaacctgtgaaaagccctgtgacaatatgtggtgacattcatgggcaatttcatgatcttgcggaactatttcgaattggagggaagtgtccagatacgaattacttatttatgggcgattacgtagaccgtggttactattccgttgaaactgttacgcttttggtggccctgaaggtgcgctatccacaacgaattactatccttagaggaaatcatgagagtcgtcagattacccaagtttatggattttatgatgaatgcttgcgaaaatatggtaatgcaaatgtgtggaagatcttcacagacctttttgattatttcccactgacagcattggttgaatcagaaatattctgccttcatggtgggttgtctccatctattgagacccttgataacatacgcaactttgaccgcgttcaagaagttcctcatgagggagctatgtgcgatcttctatggtctgacccggacgacagatgtgggtggggtatttctccccgtggtgctggatatacctttggccaagatatatctgagcaatttaaccataccaacaaccttaagctgatagccagagctcatcaattggtcatggagggatataactggggacatgaacaaaaagtggtaaccatattcagtgcacctaattattgctaccgctgtgggaatatggcttccatcttggaagttgatgactgcaaggggcatacatttatccag

SEQ ID NO: 3812 - DNA, 1725 bp, Hordeum vulgare
ggaagttgcactattgtcaaaaactatactctaagctctgtttttgcagtgttgtaaattgtactatattttgcttgaaattaggaagtttggtcatggtacaaatctaaaattttattattttcttagtggaattgacctaggaagtgaagattgaactatatcagggcatggccagttctagatgatcatgccactgtgcattctgtgttatcaattttttccccagttgcaccatatctagttgatctttgccatcttagtaaaatttaagcttcctttcagcctgtgagaagccctgtgacgatatgtggtgatattcatggtcagtttcatgatcttgcagaactattccgaattggtgggaagtgtccggatacaaactacctattcatgggagattatgtggaccgtggttactattctgttgaaactgtatcgcttctggtggctttgaaagttcgttatccacatcgaattacaattcttagaggaaaccatgagagccggcagatcactcaagtttatggattttatgacgagtgcctacggaagtatggaagtgctaatgtatggaaaaccttcacggatctttttgactatttaccgttgacagcattggttgagtcggaaatattttgcctgcatggtggactgtcaccatccatcgagacactagataacgtccgtagcttcgaccgtgtccaagaagtccctcacgaggggcccatgtgtgaccttctatggtctgatcctgatgatcgatgtggttggggcatttcaccacgtggtgctggatacacatttggccaggatatttcagaacagtttaaccataccaatagccttaagctaatagcaagagctcatcagttagttatggagggtttcaactgggcacatgagcaaaaggtcgtgacaatatttagtgcacctaactactgttaccgctgcggtaacatggcctcgatcttggaggtggatgactgcagggagcatactttcatccagtttgaacctgccccgaggagaggggaacctgacgtgacccgaaggacgcctgactatttcttgtaaatgtagcctaggctattcgttttctgtttcttattttacgggatagcttaggttattccgacagcaaacaaaaaaagcgcgtgatagcttagatgcgtcgtcgtgtcgtgtggttataatttttgttgtttgtgtctcgctccattttgcttcactccttttgttgtaatctaatctgctcatgccgggctgagtcaggggtgtgaaactgtgaatgtgatggatgatgctggtaaatcaaaggcctcgcgcagtagtaattttgttggctctcaagttggctgtgtagtttaacatgcggacgacggcattggtgatgattttatggatgcagccggacacgtacacttgtacggagtaataacttgtgcagcagttgttgtcaaacattgtgtgcaaattaaacaagtttggatcacgtagtaggaagctaggaccggaagagaactaatctcgtccaaccagcatggggtttcatcagcttgtacagatcttgttaaggctgttgtgaaatacaccctccgttccaaaatataagaccttttagagatttcactaagagactacatacggagcaaaatgagtgaatgtacagtctaaaatatatctatatacatccgtatgtaatttatagtacaatctctaaaa

SEQ ID NO: 3813 - DNA, 1110 bp, Flaveria ramosissima
tgagttaagacatatgtgagaaggcaaaagagatacttatggctgaaagcaatgttcagccagtaaaaagccctgtgacgatctgtggtgacattcatgggcagtttcatgatcttgctgaacttttccgaataggagggaagtgcccagatactaactacttgttcatgggggattacgtggatcgaggatattattctgttgaaactgtcacgctcttggtggccttgaaagtgaggtatccacagcgaattacaattctaagaggaaatcatgaaagtcgtcagatcactcaagtctatgggttttatgatgagtgccttcgaaagtatggcaatgctaatgtttggaagacttttactgatctctttgactattttccattgactgcattggttgaatcagaaatattttgccttcatggtgggttgtcaccttcaattgaaactcttgatagtataagaaactttgaccgcgtgcaagaggttccacacgagggtccaatgtgtgatcttctatggtctgaccctgatgaccgttgtggctgggggatttcaccacgtggggctggatacacctttggccaagatatttctgaacaatttaatcataccaacaacctcaagcttattgctagagctcatcagctggtcatggagggattcaactggggacatgagcaaaaagttgtcactatcttcagcgccccaaattattgctatcgatgtgggaacatggcttctatcctggaagttgatgattgcaagggccacacttttatccagtttgatcccgctcctaggagaggagaacctgatgtaaccagacgaacccctgattatttcctctgaacggtctacttatactgattcgtggtcctatggaaagattcgggcttttgatacaatgatatgggccaaaattcatcaggcgaagtgcaagaaaaggataagatggtttgtaaaatggacattgtatgattctaggtgatttgtttgttatcattctctattccgggcctttccaaatcgtatcaggcttttatatatctgcaaagagaatgatttagaagtgttttgactagttttaatctaagatacataaattaac

SEQ ID NO: 3814 - DNA, 1740 bp, Vitis vinifera
ctgttgtatgcattgtgtttactttgatgcaccttctgtaaggtgtttttttaatattattcttatatactattaaaaaaaagaaaaggtgggttgttttcctatttcccatatccactataacaaccaaacaactttcatttctcatttggacgtgttttttgtgtcattattgatgccattttccatcctattaatggattagtgttagtgaggatctgaaaccatatttggaggtctaacaactttctttgcggctgtaggttaggacattatgcgagaaggcgaaggagatactaatggaggaaagtaatgttcagccagtaaaaagccctgtgaccatatgtggagatattcatgggcaatttcatgatcttgcagaactttttcgaattggagggaagtgtccagatacgaattacttgttcatgggagattatgtggatcgtgggtattattcagttgaaactgtcacgctcttggtggccctgaaagtccgttatccacaacgtatcacaatcctcagaggaaatcatgaaagccgacagattactcaggtttatgggttttatgatgaatgcttacgcaagtatggaaatgctaatgtttggaagatttttacagacctttttgattatttcccattgacggccttggttgaatctgaaatattttgtttgcatggtggattgtccccatccattgaaacacttgataacattcggaattttgaccgtgttcaagaagttcctcatgaagggcccatgtgtgatctcttatggtctgatccagatgatcggtgtggttggggtatctctccccgtggtgctggatatacttttggccaggacatatctgagcaattcaatcatactaacaacctaaagctgattgctagagctcatcaactggttatggagggatttaactggggacatgaacaaaaagttgtcaccatatttagtgcacccaactactgttatcgctgtggaaacatggcatcaattttggaagttgatgactgcaaaggtcacacattcattcagtttgaaccagctccaaggagaggagaaccggatgtaacccgcagaacgcctgattactttttgtagtggtgccacccagtcactcaatttcctgcagcatcttcatactagtctgaatgaggtgttagtaatcaggctgctaggcttttattactggtggtgggatggtccagaagcatgtaaaatgggcattgcttaggcccccttgcatttaaattatgtaggctgtgcagctgccaatgctgtagtgtatcatttcctgcttaaattggggtgctattttggttttttgtttttgtccttttctttgtcatagatttgcttcttccttttttccttggggctgtagagggtacaaggagattcaattttttatttggcaatctaattttctcttatttcattgcgttaattagtttcatttcttttctttgatggtctgagtgacagaacaaatggatctgagcagcatttgttggctgcgcaagaaatgggctacaaagagtcgggcttgtggttttatcgcagagctaatataaatttgatgaacgtgttgcagggaccaaagttagcctaatataatatatttgttgatgatgggttctttgtagaaagaaggtgaattatatgaatggtgaggtatcaaaggagcagttacaagaggacgctaggagatgggctcaacagcgtttag

SEQ ID NO: 3815 - DNA, 1111 bp, Lactuca sativa
gaagaaaaaagggaaaaataacaagtcaagggtttcaattttcattttttctttttcgattttgtatcggttttcaccaccacccaatcccatcgctcccccactgtcttcttcactcgctcatcgttttccttttggttatgtttcgccatccacaagattttgaataaacaaatccttcgattggccacgaattcaaaaaaatcatgagcttcgatccagttatgcagcgcgttaatcgcaatgtcgacgaacatatctcccagctcatgcagtgcaaacccttgtccgaacaagaggttaggtcattatgtgataaggcgaaggagattctgatgaaagaaagcaatgtccagcctgttaaaagcccagtgacaatctgtggggatattcatggacaatttcatgatcttgcagagctttttaggattggtggaaagtgccctgatacaaactacttattcatgggagattatgttgatcgtggttattactcagttgaaacagtgactctcttggtggctctcaaagtgcgttacccacaacgaattactatcttaagaggaaaccatgaaagtaggcagatcactcaagtttatgggttttatgatgaatgcctaagaaaatatggtaatgctagcgtgtggaagacatttacggatctatttgactactttccactcactgcattggttgagtctgaaatcttttgtcttcatggaggattatctccttcaatagaaacacttgataacataagaaactttgatcgagttcaagaagtgcctcatgagggccccatgtgtgaccttttatggtctgatcctgatgatcgttgtggctggggtatctctccacgtggagctggatatacatttggccaagacatatctgagcaatttaaccataccaacagcttgaagctcattgctagggcccaccagcttgttatggaagggttcaactggggtcatgaacaaaaagttgtgactatatttagtgcacctaattattgctaccgatgtgggaatatggcttccattcttgaagtagatgattgcaagggtcacacattcatccaggtttgtcttttttttttttttttaaatta

SEQ ID NO: 3816 - DNA, 1646 bp, Cannabis sativa
tgaaactgttgctttatttttttagataatcctttgtcatcctggccttggagtttccttgtttaagctttctgtcttcattgtttgacattactgttaatttctctctatttttcattataggtaagggtgctgtgcgagaaggccaaggagatattaatggatgaaagcaatgttcagcctgtgaagagccctgttactatttgtggtgatattcatggacaattccatgatctggcagagcttttccgaattggaggaaagtgtccagatacaaattatttgtttatgggagattatgttgatcgtggctactattcagtcgagactgtaacactcctagtggccttgaaagtgcggtattctcaacgaattactattttaagaggaaatcatgaaagtcgtcagattactcaagtttatggattttatgatgaatgcctgcggaagtatggcaatgccaatgtttggaagatctttacagatttatttgactattttccacttacagctttggttgaatccgaaatattctgcttgcatggtggactgtcaccatccattgaaacgcttgataacattcgcaattttgaccgtgttcaagaggttccccatgagggtcctatgtgtgatcttctatggtctgacccagatgatcgatgtggatggggtatctctccaagaggggctggatacacatttggacaggacatatctgaacagttcaaccacaccaataacttgaagctcattgctagagctcatcagctggttatggaagggtataactggggtcatgaacaaaaagtggtcactatattcagtgcacctaattattgctatcgttgtggaaacatggcatccattctggaagttgatgactgcaaaaaccacacattcattcagtttgagccggctccaaggagaggagagcctgacgtaacgaggagaacacccgattatttcctatgatgaaacagtaaattagttgctgaatttccagtggctagcgcctgctcgctattttacattgttttaaaagctgctttctttaatagtaagtttatcattaagctgtggggtggtagtagtggtggtggcagtggtagcagttatggtcggggcagcgaacaagcatatgtgatggaagcgagcagagggtgaagcttactacgattcgttctcttgattttagtgtctctgcaagaaaaaggcacagcatatggttttagggggggaagacacttttgcagcaaacatggaatattctcttcttcacttgattttccattgatccattctcatctcattaacccctcatatttatttcttctgtattaggatgatcattttttttctttcttttttaattggttggttggggttttgtagagggatgatgatgcttttattttattttttttctttcttaattataatgggtgcttttatataatatttttttcaaatgtttgttctcaaataggttggactaaattttaccagttcttatgaatgtagcatgagtttcactagtgttggttgttttcttctattatataaatgcttgaagtctaaagccaatttatggaattagttcttaaaaatgctttaattaattctaaattttaaaatagtatcagaat

SEQ ID NO: 3817 - DNA, 1090 bp, Musa acuminata
ggttgggatcgaggggtggcgacatttagggttggggttccgatcctgggttttgggcggcgtcttaccgggctggtaaggtggtgaggccaagatgagcgtgaatcccatgccagcttcagtcacccatgggaacttggacgagcagatcgctcagctcatgcagtgcaagccgctctccgaacaggaggtgaggatgctatgtgaaaaggcgaaggaggtattaatggaagaaagcaatgttcagcctgtaaagagccctgtgacaatctgtggtgacattcatgggcaatttcatgatcttgcagaactatttcgaattggtggaaagtgtccagatacaaattacttgtttatgggtgattatgttgatcgtgggtactattctgttgagactgtaacgcttttggtggctctcaaggtgcgatatcctcagcgaatcaccattctcaggggaaaccatgagagtcgtcagattactcaagtttatggattttatgatgaatgcctgaggaaatatggtaatgcaaatgtgtggaagaccttcacagatctttttgattatttcccgttgacggcattggttgagtcagaaattttttgtctacatggtggattatctccatccattgagactcttgatagcatacgaagctttgatcgggttcaagaagttcctcatgaggggcctatgtgtgaccttttgtggtctgaccctgatgatagatgtggttggggtatttctccccgtggtgctggttatacctttggccaagatatatccgagcaattcaaccataccaataaccttaagttgatagcccgagctcaccaactggttatggaaggatataattggggtcatgagcaaaaggtggtaaccatatttagtgcaccaaattattgctatcgctgtgggaacatggcttccatcatggaagtcgatgaatgcaaggggcagacatttatccaggtgattatccttgttatcttctgtctctctcaacaaactcagtttaatgggtcaagtattgtgctttctttaaacatttgtctgttataatgctcgtgataactatcttggaatttc

SEQ ID NO: 3818 - DNA, 1113 bp, Flaveria ramosissima
ctcctaccttctcaaattctcaatatctgaattccgttcagtttcagataatttcaatcaattgaaacgttttgatctttgaatatttgattacttctgtatgtgtatgcatatgcacatttaaatataaacatatacaacatgagtgtggagctggcctcggacacccatgggaatctcgacgaacagatttcacagctcatgcagtgcaaaccgctaatagaatctgaggttaggacattatgtgacaaggcaaaagagatattaatagacgaaagcaatgttcagccagttaaaagccctgtgactatctgtggtgacattcacgggcaattccatgatcttgctgaactttttcgtattggaggaaagtgcccggatacaaactacttgtttatggggagttacgtggaccgaggatattattctgttgaaactgtcacactcttggtggctctgaaagtacggtatccacagagaattacaattctaagagggaatcatgaaagtcggcagattactcaagtttatgggttttatgatgaatgccttcgaaagtacggcaatgccaatgtttggaagacttttacagatctgtttgattatttcccattgactgcattggttgaatcagaaatattctgccttcatggcgggttgtcaccttctattgaaaccctagataatataagaaatttcgatcgtgttcaagaggtcccacatgaaggccctatgtgtgatcttttatggtctgacccagatgaccgttgtggttggggtatctcaccccgtggagctggttacacatttggtcaggatatctcggagcaatttaaccacacgaacagcctaaagcttattgctcgagctcatcaactggtcatggatggtttcaactggggacatgatcaaaaggtggtcactatctttagtgcaccaaattattgttataggtgtgggaatatggcatctatcttggaggtggatgattgcaagggacacacagttatccagttgaacctgctcctaggagaggagaacctgatgtgactagaaggacacccgattatttcctctaacctagtattttttattctcctagaaggtaattta

SEQ ID NO: 3819 - DNA, 1137 bp, Ambrosia trifida
tttatttggtcatgttcaatacccacaaattaatccaaatccaataacaaccaattacctatcaaaagatgagcttggatcacgttaatcacaatgttgatgagcaaatcactcagctcatggagtgcaaaccttgtctgagcaagaggttagggcattatgtgataaagcaaaggagatcctgatgcaagaaagcaatgtgcagcctgttaaaagccctgtcacaatctgtggggatattcatgggcaatttcacgatcttgcggagctttttcggattggtgggaagtgtccggatacaaattatctattcatgggagattatgttgaccgtggttattactcagttgaaaccgtgactcttttggtggccctcaaagtgcgttatccacaaaggattactattttaagaggaaaccatgaaagccggcagatcactcaagtttatggattttacgatgaatgcttaagaaaatatggtagcgctaatgtgtggaagacatttaccgatctatttgattatttccccctaactgcgttggttgaatcggaaattttttgtcttcacggtggattatcaccctcaattgaaacactagataatataaggaatttcgaccgtgttcaagaagtgccccatgaggggcccatgtgtgatcttttatggtctgatcctgatgaccgttgcggttggggtatttcacctcggggtgctggatatacatttggtcaagatatatctgagcaattcaatcatacgaacagcttaaagctgattgctagagcgcaccagctggttatggacggttacaactggggtcatgaacaaaaggtggtgacgatctttagcgcgcctaattattgttaccgttgtgggaatatggcttcgattcttgaagtagatgattgcaagggccacactttcattcagtttgaaccagctccaaggaggggagagccagacgtgacacgtaggacaccagattatttcctatgatgttgacttggcgattttgataaggccaacatgcacctaaccaaccgctcatggaaaataaggaggccgaaaagggaatacatgaatcttggaaatgtggcagcaatgctggagctaaatttgctgcacaagcatcagtt

SEQ ID NO: 3820 - DNA, 1205 bp, Bupleurum chinense
ctaatgaaagaaagcaatgtacagcctgtcaaaagtcctgtgaccatatgtggtgatattcatggtcaatttcacgatcttgctgagctttttcgcatcggaggaaagtgcccagatacaaattacttgtttatgggagattatgtcgaccgtggttattattctgttgaaactgttacgcttctagtggcccttaaagtgcgttatcatcagcgtatcacaattctaagaggaaatcatgaaagtcgacagatcacacaagtatatgggttttatgatgaatgcctacggaagtatggcaatgctaatgtttggaagatatttacagatctttttgattattttccgctgactgccctggttgaatctgaaatattttgtctacatggaggactgtctccttccattgaaacacttgataatatacgaaactttgatcgggttcaagaagttccacatgaaggcccaatgtgtgatcttctgtggtctgacccagatgaccgatgtggttggggtatttctccccgtggtgctggatacacttttggccaggacatatctgagcagtttaaccacaccaacaacctgaagcttattgctagagctcatcagttggtcatggaaggatttaactggggacatgaccaaaaagtggttactatttttagcgctccaaactattgttatcgttgtggaaatatggcgtcaatattggaagttgatgactgcaatgggcatacatttatccagtttgagccagctccgaggagaggggaacctgatgtaacccgaagaacaccagattatttcctatgaagcagttgaggcgacatctaaaaacgcgttcttcatgatggcgagattaagcaggaaacaggtgatcacatctagaaacaaattgaagattgcaatattgtgtagcttttcagttattgtagcagcaatggaaggtcggaagatatgaatggagaagccaaagtgacccttactataattataatatataattcgagctataggctttttagtgttgaggtatttggagttggttatgtcataatgcatcattgtagtggatcatccgaatgtctttccaaagactcgggcttaatttatgttgtttatttttgatcttgccatagttaaattatctaaacaagcagcaatgtttcagtgtgctttgctaagttcaaaatagagccagg

SEQ ID NO: 3821 - DNA, 1069 bp, Euphorbia esula
caaataccaaatacaactcactcactcgcgctccatcttccacgcgcctcctccttcctcctcctcctccaccgtgcaggcgaccgctgcagaggagcgaactgcatacaacgcaccaccaccgtctgattcagtcttagggttagggttatccctaatcccgatttcacctgttcctgttctttgagcagaaacaagatgggtgcgaattcgccatctacagattcaattagcgatctggacgagcagatctcgcagctcatgcagtgcaagccgctctctgaaactcaggtcagatcactatgtgacaaggctaaggagatactgatgcaagaaagcaatgttcagcctgtcaagagtccagtgacaatctgtggtgatattcatgggcagtttcatgatcttgcagaactctttcgaataggaggaaagtgtccagatagcaattacctgtttatgggagattacgtggaccgtggctattactctgttgagactgtgacgctcttggtggcgctgaaagtgcgatacccacagcgaataaccattcttagaggaaatcatgaaagtcgtcagatcacgcaggtgtatggattctatgatgaatgcctacggaagtatggcaatgctaatgtgtggaagatcttcacagacctttttgactattttcctttgactgccttggtggagtcagaaattttttgtcttcatggtggactatctccatcaatcgaaaccctagacaatataagaaattttgatcgggttcaggaggttcctcatgaaggagctatgtgtgatctcttatggtctgatccagatgatcgatgtggttggggtatttcacctcgtggtgctggatatacttttggtcaggatatatccgagcaatttaatcatacaaacaacctgaagttgattgccagagcgcatcagcttgttatggatggattcaactgggcacatgaacaaaaggtggtaactatattcagtgcacctaattattgttatcgttgtggcaacatggcttcaatattagaagttgatgactgcaacagtcacactttta

SEQ ID NO: 3822 - DNA, 1710 bp, Secale cereale
gtctgccacggtggacccgcgtaggatgagcagccccactggcggcctcgacgaccacgatcgagtcgccttcatagcaagttgctaagccctccccgaggccgaggttagagcactctgcgagaaggccaaggagattttgatggaggagagcaatgttcagcctgtaaggagtcctgttacaatctgtggtgatattcacgggcagtttcacgatcttgcagaactgttcagaattggtggaaagtgtccggatacaaattacttgtttatgggagattatgtagatcgtggctactattctgtcgaaactgtcacgctgttggtgtctttgaaagtccgttatcctcagcgaatcaccattcttagaggaaaccatgaaagccgacagatcactcaagtttatggattctacgacgagtgcttaaggaagtacggaaatgcaactgtctggaaaacctttacggatctgtttgactacttccccttgacagcattggttgagtcagaaatattttgcttgcatggtggattatcaccatccattgagacacttgataacatacgtaactttgaccgcacccaagaagttcctcatgaagggcccatgtgtgatcttctgtggtctgaccctgatgatcgatgcggttggggaatttcccctcgaggcgctggatataccttcggacaggatatatcagagcagttcaaccataccaataacttgagacttattgctagagctcaccagttggtgatggagggattcaactgggctcatgagcaaaaggtggttaccatatttagtgcacctaattattgctaccgctgtgggaatatggcatcaatcttggaagttgatgattgcagggagcatactttcatccagtttgagccggccccaagaaggggagaaccagacgtaacccgtagaacgccagactacttcctgtgatggtgtgaaatcggtgtcgacctctgcaccaaaggtttgataactagctgaagcttgctggcagcagataaatcctttttgctgaaagtcagtctcccgtgtgttattcatcttaatttttccgcccatgatgcccctggctgtttgtgagccgcttcgccgcatcgtgaccaaagtgtatacctacagctggaaggaaggatccattgtgttactcacctctctaattgatttgatgctctgcttggtggatgcgtggtagtgaacgaacttgagagcatcaaaagcagcgtttgtattgtgaaaggaagcctttttcatttcccccctctgtattcatttttttccctcatgttcgcgcgtttcgcctaatttttactttcttttgatgattatttgttgtagagatggacaatgtagttgtgtatggttccgtgttgggagcctttgctaggtcttgtgaaccagtattgatttttccgtatagaagaatacttgtagtatgctgagcagtgtacttgtgtgttactgttgttggtctgctagtggtattatttttttgttagtggtatgagttgactaaagtattggttacgttaactttaaccccaaacgtaaaaaccgaaaaaaaagtaaaaaaaaaaaaaaaaaccaaaaaaaaaaaaaaaaaaaaaaaaaaaaaaacgaaaaaaaaaaaaaaaaaaaaaaccgttggaaaacgaacgttaacggaacccgaaaagggtaacccaaac

SEQ ID NO: 3823 - DNA, 1274 bp, Flaveria ramosissima
ctccctctttaatttcaatatctgaaattcattcaacttcaaaaatgttcaatcaatcaagaaattcttcctaagaaaccttaattgtctgtatacatatgcccaaagtataaacattcatatataaagatgagtgtggagatggcttcggacacccatgggaatctggacgagcagatttcgcagctcatgcagtgcaaacccttaactgaatctgaggttaggacattatgtgacaaagcaaaagagatattaatagatgaaagcaatgttcagccagtaaaaagccctgttactatctgtggtgacattcatgggcaattccatgatcttgctgaactttttcgtattggaggaaagtgcccggatacaaactacttgtttatgggggactatgtggatcgagggtattactctgttgaaaccgtcacactcttggtggctctaaaagtacggtatcctcagcgaattactattttgagagggaatcatgaaagtcggcagattactcaagtatatgggttttatgatgaatgccttcggaagtatggcaatgctaatgtttggaagacttttacggatttatttgactatttcccattgactgcattggttgaatcagaaatattttgcctccatggtgggctgtcaccttctattgaaaccttagataatattaggaattttgatcgtgttcaagaggtcccacatgaggggcctatgtgtgatcttttatggtcggacccagatgaccgatgtggttggggcatctccccccgtggagctggttacacgtttggtcaagatatctcagagcaatttaaccatacaaacagtctaaagcttattgctcgagctcatcaactagtcatggaaggattcaactgggggcatgatcaaaaggttgtcactatctttagtgcgccaaattattgttacaggtgtgggaatatggcgtctatattggaggtggatgattgcaagggacacacaggttatcgagtttgaaccgctcctaggagaggagaacctgatgtaactagaagaacgccagattatttcctgtaaaatcgattagctgatgctcatgggatggtcgaatattgaacatcattttggggggacttcccaatccaagtcacactctaacctagcgcattttgctgtcggctatcgaagaatgtcatttttcatcattttgtttgtaggcttctgtgtgtaatcttatgtatatcgaccttgtttcgggatttcttttgtgttctcttctggtt

SEQ ID NO: 3824 - DNA, 1201 bp, Carthamus tinctorius
cttcctttcaccactcacactcaccccaaccaaaaattcattcaaaattccttcataaattaaaaaaaaaaattataaaggaacgatatgagctccgatacagctgtttctagcggccacggcagcatcgatgaatttatttctcagctcatgcagtgcaaacccttatccgaacaagaggttagggtgttatgtgagaaggcaaaggagatattgatggacgaaagcaatgttcagcctgtgaaaagtcccgtaacgatatgtggtgatatccatgggcaattccacgatcttgcagagctttttcgaattggagggaagtgccccgatacaaattacttgtttatgggagattatgtcgaccgtggttattactccgttgaaactgtgacgctattggtggcgctgaaagtgcgttatccacaacgaataactattttaagaggaaaccacgagagtcggcagatcactcaagtttacgggttttatgatgaatgcctaagaaaatatggtaatgctagtgtgtggaagatttttacggatctgttcgactatcttccattgactgcgttggtggagtctgagattttctgtcttcatggtggattatcaccttcgatcgaaactctcgataacatacggaattttgatcgggttcaagaagttccgcacgaggggccgatgtgcgatcttttatggtctgatcctgacgatcgttgcggttggggtatctcacccaggggtgctggttatacgttcggccaagtctctcctttgccgtcctttttatcttgtcgaattttgtttttgaccgtagctaaatatttcattatttggtactttatttatcaggatatatccgaacagtttaatcataccaacagcttaaaactgattgccagagcacaccagctggttatggagggattcaactggggtcatgaacaaaaggttgtgacgatctttagcgcccctaattattgttaccgttgtgggaatatggcttcggttcttgaagtcgatgattgcaaaggtcacactttcattcagtttgaaccagccccgaggaggggagagccggatgtaacccgtaggacgccagattacttcctataatgcacggccgtcacagttccttttggactaaaatgtatgtgctcgatttgatatagttgatcatttgctgttgttgtagtgtaac

SEQ ID NO: 3825 - DNA, 1483 bp, Cucumis sativus
agtaaattacaggaagaggacgggggaagaagaacaagacggagtccttttctagggttttccgacggatcctttacgcctcaacgaatatcctatgaacttgaagggagcaccaccgaatcggcgggatcttgatctgtaattgccatcgctattggagtcaagaaatcacctcaaccaacctacgcgaaatcatggattccctatcttctaactctcacggaaatctggacgagcagatttcccagctcatgcagtgcaagcccttgaacgagcaggaggtaagagtattgtgtgacaaagccaaggagatacttatggacgagagcaatgttcagcctgttaaaagtccggtaacaatatgtggtgatattcacgggcaatttcatgatcttgcagaactttttcgcattggagggaagtgtccagatacaaattacctttttatgggagattatgttgatcgtggctactactcagttgaaactgttacacttttagtggcccttaaagtccgatatcctcaacgcatcacaattcttagaggaaatcatgaaagtcgtcagattacacaagtttatgggttctatgacgaatgcttaagaaagtatggcaatgctaatgtttggaagatttttactgacctgtttgactattttccactgacagcactggtggaatcagaaatattctgtctgcatggtggtttgtcgccatctattgaaaccctcgacaatatacggaattttgatcgtgttcaagaagttcctcatgaaggtcccatgtgtgatctcttatggtctgacccagatgatcgatgtgggtggggaatttctcccagaggtgctggatatacctttggtcaggacatatctgagcagtttaaccatagtaataatttaaagttgattgcaagagcacatcagctagtgatggaaggatataactggagtcatgaacaaaaggttgtgactatatttagtgcacctaattattgttatcgctgtggaaatatggcatcaattctggaagttgatgactgcaaagcgcacactttcattcaggtatacctctctttcctctccctccctcagaaagggagcaactactcagccagttattatgttttccttgtatgtgaacaatttttttgcttctgcagttcgaaccagctccaaggaggggtgaaccggatgttactcgaagaactcctgactactttttatgatgcgcctattgtcagatgaaaatttctagccgcaggtgtttccaaacatatgttttggctgtttttacattggagaattttagttttccctatggtggcggtggtggtggggaaagacaaaagcatgtaaatttcgataggttgctttcaggatggtggagtccatccttgcaaatctcaaggttttgctgaaggaagctatagggctggcgacttgttaactgcatatgtaacatctccaaagaacaatgtatt

SEQ ID NO: 3826 - DNA, 1722 bp, Taxus baccata
gtttgaattgtgcttctttaggtaccagaatgaggattgagtaagcgggtattctagtttttactggagggttttaaattttgaaaaacaggctttgtatttgggagatctgggggtggcagtgttgaattaggttagggtttcaggacttggcgggttattggattttggggaagccgtggtttcggatttgttggtgttgagataaacagtaagtggatcagacatgccttcgtatggtgatttggataggcaaatagagcagctgttagaatgcaagcctctgacggagggtgaggtgaagcacttgtgtgagcaggccagggcaattctggtggaggaatggaatgtacagcctgtcaagtgtccggtcactgtctgcggagacattcatgggcagttccacgatttgttggagttgtttcggatcggcggaaaggctcccgacaccaattacttgttcatgggagactatgtggatcgagggtactattctgtagagacagtaactctgctagttgctctgaaggttcgctatagggatagaattaccattttgcgaggaaatcatgagagccgccaaattactcaagtctatggcttttatgatgaatgcttgagaaagtatggcaacgcaaatgtgtggaaattttttacagacctctttgactacctccctctaacagcactcattgaaagtcagatcttctgcttgcatggtggcctctctccatcactggatacactagataacattcgatccctggatcgtatccaagaagtgccacacgaagggcccatgtgcgatttactttggtcagacccagacgatcgttgtggttggggaatttcacctagaggggctggatacacatttggacaggatatagcagcacagttcaatcacactaatggtttgagtctggtttccagagcacaccaacttgtcatggagggttacaattggtgtcaggaaaagaatgtggttaccgtctttagtgccccaaactactgctatcgatgtgggaacatggctgccattatggaggttggtgagaacatggaacaaatttattcagtttgagccagcacctcgtcaattcgaaccagatgctacacgcaagactccagattactttttgtaatcactatgatctgggattattgaatttttcttttgatctgtaaagttttcagtctcaagaaactgtttgagaaattgagagcattctttatttggagttggcaattgcttccttttgctaaggaacgtttaggtttttaccaaatcataatatacagattttagttaaaaagggataaatgtatgagttgcaaaattgacttcatgtaaagcctaacagagtgattagaacgaaaaaggtatcctctttattcgagtgtaaagaagagattttcgatttattgagtgtcaggattttttcgttctcaggagcagttgatggtcttggaacaaatgtaagaaagaattatttatagtacttacccctgaagtcgatgcaatacaccttttggtaccgagacctcatgtaaaatcctctggctctcagacttggatgttctttgtagcactttattttctcaggttaagttttagccatgattgtgtcattccattttactaaaaacggcttctagtttactctggttttgtaaagtcgccatcacagcctatctctattgtttctaagcaagtcggac

SEQ ID NO: 3827 - DNA, 1392 bp, Chrysanthemum coronarium
ttagcccattctgacttgaagttgtgtttacactttacattaccactttcaaaatgcacatccgattatccgatttcaaaccagttatttgacttctaaactagataattatatgttgaatctcgttagcccattctgacttgaagttgtgtttacactttacattaccactttcaaaatgcacatccaattatccaaacaccccctaagtacttgaaaaaagaatgtaggacatggttcatgcacctcttaagtagcatgtctgatcctagacgttgcatacatggcatttgggatcaagcttgcacttttaagttattacatacccggagacattttcattaagaaagtgcaactattaactgaataccttaataaaaagacgtctcatactaatatgcttttgaaaaatgtaggttaagtcgttatgcgagaaggcaaaggagatcctgatgaaagaaagcaatgtacagcctgttaaaagccctgtgacaatatgtggggatattcatgggcagtttcacgatcttgcagagctttttcgtattggagggaagtgcccggatacaaattacttgttcatgggagattatgttgatcgtggttattactcggttgaaacagtgtctctgttggtggccctcaaggtgcgttatccacaacgaattaccattctaagaggaaaccatgaaagccggcagatcactcaagtttatgggttttacgatgaatgcctaagaaaatacggaactgctaatgtgtggaagacatttacggatctatttgattattttcccctcattgcattggtcgagtcagaaatcttttgtctccatggtggtttgtccccttcaattgaaacacttgataatataagaaactttgatcgtgttcaagaagtgccacacgagggacccatgtgtgatcttctatggtctgatccggatgaccgttgtggttggggtatctcacctcgaggtgctggatatacatttggtcaggacatatcagaacaatttaatcatacaaacggcttaaagcttattgccagagcacaccagctggttatggaaggattcaactggggtcacgaacaaaaggtcgtgacaatctttagtgcacctaattattgttaccgttgtgggaatatggcttcaatccttgaagtagacgattgcaagggtcacactttccttcagtttgaaccagctccaaggagaggagagccagatgtgacacgtaggacaccagattattttctataataacgagaccaaaaggcatatatgaatcttaaaaacgaggcagtgatcctgaagtgagtttatttgctgcgcaaacatagcaccatctaccacatctgtcaacacagtttggtcatcttcttttgtc

SEQ ID NO: 3828 - DNA, 852 bp, Cynara scolymus
ggtgttatgtgagaagctgaggagatcttgatggtgggacgtaatgtacagcctgtaaaaagtccggtgaccatttgtggcgatattcatgggcaattccatgatcttgcagagctctttcgaatcggagggaagtgtccggacacgaattatttattcatgggagattatgttgatcgtggttattactcggtggaaactgtaacattattggtggccctcaaagtgcgctatccgcaacgcctcacaattttaagaggaaaccatgaaagtcgtcagattactcaagtctatgggttttatgatgaatgcctacgaaaatatggtaatgctagcgtgtggaagacctttacagatttgttcgactattttccgctgactgcattggtcgagtccgaaatcttttgccttcacggtggattatctccttcaattgagacccttgataatataagaaatttcgatcgtgttcaagaagttccccacgagggaccaatgtgtgatcttctatggtcagacccagatgatcgatgtggttggggtatctcaccccggggtgctggatacacatttggccaagatatatctgagcaatttaatcataccaacagcttaaagttgattgcaagagcacaccagctggtgatggagggattcaactggggtcatgaacaaaaggttgtgacgatctttagtgcacctaattattgttaccgatgtgggaatatggcttcgattcttgaggtggacgactgcaagggtcacacctttattcagtttgaaccagctccgaggaggggggagccagatgtaacccgtaggacaccagattactttctatgaggtagcggt

SEQ ID NO: 3829 - DNA, 1846 bp, Populus trichocarpa
agggaccaaaatttaggggaaaaaaaaactctaaattattacaccaacctacgggggagaaataaagaaaatagacaacgaggagaaccccagccagtctctctctctctctctcttcgcccctccaattttcgtgttttctcccgaatccttaaccctagtaactccagaatccccaatctccggtctgcacgatggccatgacctgaatcatccaagaaaaatcaaattgaatcgcccttttttggattcgatccgaaaatccctttcaaaaaagtaaagaaaagatgccgtctcacgtggatctggaccgtcagatcgagcacttgatgcagtgcaagccgctagctgaagcagaagttaaagcactgtgtgagcaggccagagcggtccttgtggaggaatggaacgttcagcctgtcaaatgtccagtaactgtctgcggtgatattcacggtcagttccatgatcttgtcgagctctttcgcatcggtggtaacgctcctgacactaattacctcttcatgggcgactatgtagatcgaggatattactctgtggagactgtcactcttttagtggcactgaaagttcgatatagagacaggatcacaattctaagaggaaatcatgagagtcgtcaaataactcaagtgtatggattttatgatgaatgcttgaggaagtatggaaatgccaatgtctggaaacatttcaccgacctctttgattatctcccacttacagccctaattgagagtcagatcttctgcttgcatggtggtctttccccgtctttggacacattagataatattcgttccctagaccgtatacaggaggtacctcatgagggtccaatgtgtgacctcctttggtctgatccggatgatcgttgtggatggggaatttctcctcgtggggctggatacacctttggacaggatatctctcaacagttcaaccacactaatggccttgctctcatttctagagctcaccagcttgttatggaaggatacaattggtcccaggacaagaatgtggtgacagtgttcagtgcgccaaattactgctatcgctgtgggaatatggctgcaatacttgagataggggagaatatggagcagaatttccttcaatttgatccagcacctcgacagattgaacccgatacaacacgcagaactcctgactattttttataatttgcatagcttacccttggttggcaaatttttcaaatttatggttgtggttttgtagatgcatcttacagaatagaggattttggtgtttacttgatgaagagacaaagaaacatcgttattgtcattcttttggtcagtttttgttctatggtttctgcgttcttgtgagtttataagtttacttacgtggtttttgtcttgtattttaggaagtgaaagaaacagcaataacagtgcattcatcatatagtttacacccccctggttaaacaacttctgcaagtgctcgatgaaatttttcttttgaattgttgaaaattgacgcgagtgctgtcattggaactagtttcttttgattttgttgatcaaaacacgtttgttttatttcttgtccgttaggattttaatatatactgcctttctattgatttttgtttttttttagttactttctgaatgcatatatactgccttcattgcgtctgaactttagttcaatttgttgaatatctgaaaatgggaaaagttcataaagtctgtcattttgggtggaaataatggagataatatcaactctacccccttcggtattttggggggaaaactgaagtaatttgtggaaaactagcttggaa

SEQ ID NO: 3830 - DNA, 1605 bp, Populus trichocarpa
ggagagagaaaggaccgacattaagagaaaaacaaaattattacactaacctgcgaaaaaaccaaagaaaaaagatcccattccagccgatatttttagctgtgttttctcccaataaaagcctgaaccctaaatagcaacctctaaataaaatccccaatctctgtctggtcccgtccggtccggacgatgacctgaatcattcccccaccccaaaaaaagcaaacaaactctattcgattcaatcaatcgaaagtctctttgaagaaaagatgccgtctcacgtggatctggaccggcagatcgagcacttgatgcagtgcaagccactagctgaagcggaagtgaaagcactgtgtgagcaagccagagcggtccttgtggaggaatggaacgttcagcctgtcaaatgtccagtaactgtctgtggtgatattcacggtcaattccatgatcttgtcgaactctttcgcatcggtggcaacgctcccgacactaactacctcttcatgggcgactacgtagatcgaggatattactctgtggagactgtcactcttttagtggcactgaaagttcgatatagagataggatcacaattctaagaggaaatcatgagagtcgtcaaataacccaagtgtatggattttatgatgaatgcttgcggaaatatggaaatgccaatgtctggaaatatttcaccgacctctttgattacctcccacttacggccctaattgagagtcagatcttctgcttgcatggtggtctttccccatctttggacacattggataatattcgttccctggaccgtatacaggaggtacctcatgagggtccaatgtgtgatctcctttggtctgatccggatgatcgttgtggatggggaatttctcctcgtggggctggatacacctttggacaggatatctctcaacagttcaaccacactaatgggctcactctcatttctagagctcaccagcttgtcatggaaggatacaattggtcccaggacaagaatgtggtgacagtgttcagtgcgccaaattactgctatcgctgcgggaatatggctgcaatacttgagattggggagaatatggagcagaatttccttcaatttgacccagcacctcgtcagattgaacctgataccacacgcagaactcctgactattttttataatttgcatagcttacccccagatggcaaaattttcaaagttatggttgtggttttgtagatgcatgttacagaatagaggattttggtgcttactcgaggaatagacaaaaagaaacatggttattgttattcttctggtcagaactgctcaatgttttctgcattcttgtgaatttataggtttactttgtaggtggtttttgtcttgtattttagaaagttaaaggaacagcaataacaatgcattcatcttatagttgataccccttggtcaaacaaaaactctgctttcgaattgttaaagttgatgtgggtgctgtaatttaaactagtttcatttttgtttagttttatttcctgtctgctatattatttttttaatatatactccctctgtattgtctttatattt

SEQ ID NO: 3831 - DNA, 1039 bp, Flaveria ramosissima
gatttccgagggttttcttctcgacattcatcatcatcatcatcatcatcatcactcctctataatttccaatatctgaaattcattcaatttcagaaaacttcaatcaatcaagggattcttccttcgaaaccctaattgcctctatacatatgcacaaaatataaacatacatatataaagatgagcgtggagatggcttcggacacccatgggaatctggacgagcagatttcgcagctcatgcagtgcaaacccttaaccgaatctgaggttaggacattatgtgacaaagcaaaagagatattaatagatgaaagcaatgttcagccagtaaaaagccctgtgactatctgtggtgacattcatgggcaattccatgatcttgctgaactttttcgtattggaggaaagtgcccggatacaaactacttgtttatgggggactatgtggatcgagggtattactctgttgaaaccgtcacactcttggtggctctgaaagtacggtatcctcagcgaattactattttaagagggaaccatgaaagtcggcagattactcaagtatatgggttttatgatgaatgccttcggaagtatggcaatgctaatgtttggaagacttttacagatctatttgattatttccccttgactgcgttggttgaatcagaaatattttgtctgcatggtgggttgtcaccttctatagaaaccttagataatattaggaattttgatcgtgttcaagaggtcccacatgaggggcctatgtgtgatcttttatggtcggacccagatgaccgttgtggttggggcatctccccccgtggagctggttacacatttggtcaagatatctcagagcaatttaaccatacaaacagtctaaagcttattgctcgtgctcatcaactggtcatggaaggattcaactggggacatgatcaaaaggttgtcactatctttagtgcaccaaattattgttacaggtgtgggaatatggcttctatattggaggtggatgattgcaagg

SEQ ID NO: 3832 - DNA, 1307 bp, Ricinus communis
ctgcactagacccaatctgtcttctcgctcagctcgaaaccttacccttaaccctaaccctaactcccaaatctctaagctttgccatgacctaacctataaaaatatccaatccttctcaagatcgattgaggatattaagtaattaatccagaagaaaagtagaagacgatgccgtctcacgttgatctggataggcagatcgagcatttgatgcagtgtaagccattatcagaaggagaagtgaaagcgctatgcgagcaagcaagagcgatcttggttgaggaatggaatgtgcagcctgttaaatgtccggtcactgtttgtggggatattcacggacagtttcatgatcttgttgagctgtttcgtattggtggaaatgcacctgataccaattacctttttatgggtgattatgtcgatcgaggatattactcggtggaaactgtgactcttttagtggccttgaaagttcgatatagagataggattacaatcctaagagggaatcacgagagtcgccagattactcaagtgtatggcttttatgatgaatgcctaaggaaatatggaaatgccaatgtctggaaacatttcactgacctctttgattttctaccacttacagctcttattgagagtcagatcttctgcttgcacggtgggctctctccatctttagacacattagataatatccgtgccttggaccgtattcaagaggttccccacgaaggtccaatgtgtgatctcctatggtctgatccagatgaccgttgtggttggggtatttctcctcgcggagctggatacacttttgggcaagacatctctcagcagttcaaccacactaatggactcacactcatttctagagctcaccagcttgttatggaaggatacaattgggcccaggacaagaatgtggtaacggttttcagtgcaccaaattactgctatcggtgtgggaatatggctgcaatacttgagattggggaaaatatggagcagaatttccttcaatttgatccagcgcctcgtcagattgaacctgacaccacgcgaagaactcctgactattttttgtaattttcatagcatggcctgagctggcaatttttctaattctctgtcatggttttgtagatgcatcttatagaatagacgacttttggtgtttactcgataaagggacaaaaagaaaacattgttgctatcattcttttggttgaaatgttattctattcctgtattaatgtgagtttataggtttactgtcttgtattttataaaatgaaggaaac

SEQ ID NO: 3833 - DNA, 1159 bp, Avena sativa
aatttgcggtgacattcacgggcaattccatgatcttgttgagcttttccggattggtggcaagtgtccagacactaattatttgtttatgggggactatgtagatcgtggctactactctgttgagaccgtttcactcttggtagcattaaaggtgcgccacccacatcggattacaatccttcgtggaaaccatgagagtcgacagatcacacaggtgtatggattctatgatgaatgcttacgaaagtatggcaatgcaagtgtatggaagatatttacagatctttttgattattttccattgacagcgctggtggaatctgaaattttctgcctccatggtggtttgtctccatcaattgagaatcttgatagtgtccgtagcttagatcgtgtccaagaggttccacacgaggggcctatgtgtgatcttctatggtctgatccagacgatcgatgtggctggggcatatctcctcgtggtgccggttacacttttggacaggacatatctgaacaattcaatcacaccaacaatctcaaacttgtagctcgggctcatcagttagttatggagggatataactgggctcatgaacaaaaggttgttaccatattcagtgctccgaactattgttaccggtgtggcaacatggcatccattctggaagttgatgactgcaacagccactcgtttatccagtttgagccagcccctaggagaggcgagccagacgtaacacggagaacgcccgattacttcctctgagttagcgggcggcaccattttctcagcttgtattgcgataatccgcaccgatcagtgagatagattctgctggatccaaatctgcacatgagccaacaaacaataacaagggccctatgtaaaacctgacccccattggtcaagtccagaagatgctgctatcctgaaacaaaacaagcttcatgcagctacacctgcctgagttccaggtgggggaaaaagggccatgatatgtcctcttcgcagttgggcatttcttagaggcatggggaattgcattggcaaaaagactgaaactcctatatatgtagcttaagcttgtattactaggcttgtaatctgtactatcaatgccaaagatacagataattaaatcatatttcagtt

SEQ ID NO: 3834 - DNA, 1234 bp, Hordeum vulgare
atcttagtaaaatttaagcttcctttcagcctgtgagaagccctgtgacgatatgtggtgatattcatggtcagtttcatgatcttgcagaactattccgaattggtgggaagtgtccggatacaaactacctattcatgggagattatgtggaccgtggttactattctgttgaaactgtatcgcttctggtggctttgaaagttcgttatccacatcgaattacaattcttagaggaaaccatgagagccggcagatcactcaagtttatggattttatgacgagtgcctacggaagtatggaagtgctaatgtatggaaaaccttcacggatctttttgactatttaccgttgacagcattggttgagtcggaaatattttgcctgcatggtggactgtcaccatccatcgagacactagataacgtccgtagcttcgaccgtgtccaagaagtccctcacgaggggcccatgtgtgaccttctatggtctgatcctgatgatcgatgtggttggggcatttcaccacgtggtgctggatacacatttggccaggatatttcagaacagtttaaccataccaatagccttaagctaatagcaagagctcatcagttagttatggagggtttcaactgggcacatgagcaaaaggtcgtgacaatatttagtgcacctaactactgttaccgctgcggtaacatggcctcgatcttggaggtggatgactgcagggagcatactttcatccagtttgaacctgccccgaggagaggggaacctgacgtgacccgaaggacgcctgactatttcttgtaaatgtagcctaggctattcgttttctgtttcttattttacgggatagcttaggttattccgacagcaaacaaaaaaagcgcgtgatagcttagatgcgtcgtcgtgtcgtgtggttataatttttgttgtttgtgtctcgctccattttgcttcactccttttgttgtaatctaatctgctcatgccgggctgagtcaggggtgtgaaactgtgaatgtgatggatgatgctggtaaatcaaaggcctcgcgcagtagtaattttgttggctctcaagttggctgtgtagtttaacatgcggacgacggcattggtgatgattttatggatgcagccggacacgtacacttgtacggagtaataacttgtgcagcagttgttgtcaaacattgtgtgcaaattaaacaagtttg

SEQ ID NO: 3835 - DNA, 1328 bp, Manihot esculenta
agagcgccacatccaaacactcctctctctcactctctctctctctaccaagaagcttaacccttaccccaaatctccatgccatgacctgagctcagagcccaatatctctaagctccattacggatcgaatcaaaaaattagaattaaaggcagaagacgatgctgtctcatggtgatctggaccggcagatcgagtacctaatgcagtgtaagccactgacggaaagtgaagtgaaggcactgtgcgagcaagcaagagcgatcctggtggaggaatggaacgtgcagccggttaaatgccccgtcactgtctgtggtgatattcatggccagttccacgatcttgtcgagctctttcgcatcggtggaaacgcccccgacactaactatcttttcatgggcgactacgttgatcgaggatattattcggtggaaactgtgactcttttagtggcactgaaagttcgatacagagataggattacgattctaagaggaaatcatgagagtcgtcaaataactcaagtgtatggcttttatgatgaatgcttaaggaaatatggaaatgccagtgtttggaaatatttcactgacctctttgattatctgccacttacagccctaattgagagtcagatcttttgcttgcatggtgggctttccccatcgttagatacattggataatatccgctccttggaccgtatacaagaggttccccatgaaggtccaatgtgtgatctcttatggtccgatccagatgatcgatgtgggtggggaatttctccacgaggagctggatacacttttggacaagatatctctcaacagttcaaccacactaatgggcttagtctgatttctagagctcaccagcttgtcatggaaggatacagttggtcccaggacaagaatgtggttactgttttcagtgcaccaaactactgctatcggtgtgggaatatggctgcaatacttgaggttggggaaaatatggagcagaatttccttcaatttgatccagctcctcgtcagattgaacctgatacgacacgcagaactcctgactattttttgtaaccatcatagcatggcaatttttctaattctgtcatggttttgtagaggtgtcttacagagtaggggatttttggagtttacttgatataaagggacaaaagaaacattgttaccctcattcttttggttgcaattgttctactgcttctgcatttatatgagtttataggtttacctgtaggtggtttttgttttctactgtagaaagtgaaggaaacagaaataacaagctattcttcaccttt

SEQ ID NO: 3836 - DNA, 819 bp, Primula obconica
ctaaggagatttaatgagaagcaatgttcagcctgtaaaaagccctgtaacaatttgtggtgatatccatgggcaattccatgatcttgcagagcttttccgcattggaggaaagtgtccagatactaactatttgtttatgggagattatgttgatcgtggctattattcggtagaaactgtcactctcctggtggccctgaaagtgcgttatcacaaccgaattactattttgagaggaaaccatgagagtcgacagattacacaagtttatgggttttacgatgaatgcctacgcaaatatggcaatgccaatgtatggaaggtctttacagatttgttcgactacttccctcttaccgcgttggttgaatccgaaatcttctgtctccatggtggattatctccttcaattgaaactcttgataatatacgtaattttgaccgtgtccaagaagtccctcatgaggggccaatgtgtgacctattatggtctgatcctgatgatcgctgtggttggggtatctcacccaggggggctggatacacctttggccaagacatatcagagcaatttaaccacacaaatagcttgaagctaattgctagagcacaccagctggtcatggaagggtttaactggggacatgaccaaaaagtagttactatatttagcgcacctaactattgctatcgatgtggaaacatggcatccattctggaagttgacgactgcaaaggccacacttttattcagtttgagccagctccgaggaggggggagccagatgtaacacggagaacacctgattactttct

SEQ ID NO: 3837 - DNA, 1495 bp, Selaginella moellendorffii
agtgtttgtggaaggaggaggctatggcgcgtcgcggcgaggtcttgtccctggcggccgctctcgaagaaatgcgatgcctcgcgaaggcgctcggcatctagatgcggagctcacggcgcggcagtgtttcttccatccccgggcagggagatttcgaggtttctggtctcaagcagctggagctagggcgcattggctgtggatgagggatcgccggaatcgcaggccgcggatctgatcgttccggtagcgctagggtttttgtttcactgttctcgcttcgtcctccgccatgccttcccacaacgatcttgataggcagatcgagcagctgtgggagtgcaagccgctgtcggagctggaagtgaagaatctgtgcgagcaggcgcgcgccatactggtggaggaatggaacgtccagccggtgaaatgccccgtgaccgtgtgcggcgacatccacggccagttccacgatctgattgagctcttccggattggaggcaaggcccccgatacgaattatctcttcatgggcgactatgtcgatcgcggctactactccgttgagaccgtgacgctgctcgtggccttgaaggtacggtatcgagatagaataacgatcctgagggggaaccatgaaagcaggcagatcacgcaagtttatggtttctacgacgaatgccttaggaaatatggaaacgcgaatgtctggaagtacttcaccgatttgttcgattacttgccactcacggcgctgattgagaaccaaattttctgcctccacggtggtctttcgccgtctctggatactctagaccacatccgtgcgctggatcgcattcaagaagtaccgcatgaaggcccaatgtgtgacctcctttggtcggacccggatgatcggtgtggatggggaatctccccgaggggcgcgggatacacattcggtcaagacatcgcggaacagttcaaccacactaatggcctgagcttggtggcccgtgcacaccagcttgtgatggaaggatacaactggtgccaggacaagaacgttgtgacggtgtttagtgcccccaactactgttaccggtgtggcaacatggcggcaataatggagattgatgagacgatggggcggaccttcctccagtttgagccagctccccgacagagcgagcccgacgttactcgcaagactcccgactactttttgtaagaaaggcaagttccatcttactgttcttctgggggcttaagtttgaggggagagggagagaggagagagggatcgatcgagctgcggaaaccaggaaggaatttgatgggggatatgtatagcgtcgaatgtagttcgcttggttgggggagcaaaaaaaaagaagagaaaagagagaggagctggctgtaacatttgcagaagaaggccacggcttgttcttgtgcaagaattttagatgggagtggaggcttgcaaaaaggtctattctttgatttc

SEQ ID NO: 3838 - DNA, 1672 bp, Saccharum officinarum
gccaacaaaagccacccatcttcctcgggcggctggagccagccagcctgcctgtccgtcccggtgcagcttgctcgcctcgcctcgcttctgagttctgagtgagttgtgacgaggagggtgttgacgggtgaagaagccatggtggggagctacgcgaacggtggcggggctgcggcgctggtggcggaggagaagctggacgcgctgcggcggctgctgggcaagtcggacggcgacccgctgcgggtcgtcggggtgggcgccggggcgtggggaagcgtgttctgcgcgctgctgcaggacgcgtacggccggcaccgcgaccgggtgcaggtgcgcgtgtggcgccggcccggccgcgccgtggaccgcgccgacgccgagcgcctcttcgaggtcatcaactcccgcgaggacgtgctgcgccgcctcatccgccgctgcgcctacctcaagtacgtcgaggcgcggctcggggaccgcacgctgcacgccgacgagatcctccgcgacggcttctgcctcaacatgctggacacaccgctctgcccgctcaaggtcgtcaccaacctgcaggaggccgtctgggacgccgacatagtcgtcaacggcctgccctccacggagaccagggaggtgttcgaggagatcgggaggtactggaaggagcggatcacccagccgctcataatctcgctggcaaaggggatcgaggcgtcgctcgaccctgtgccccggatcattacgcccacgcagatgatcagcaatgcaactggaagtccattggagaatattctgtatcttggagggccaaacattgcttctgagatttataacaaagaatacgcgaatgctcgcatatgtggagctgacaagtggaggaaacctcttgcgaatttcttgaggcaaccccatttcattgtatgggacaatagtgatctcattactcatgaagtcatgggcggcttaaaaaacgtatatgccattggggctggtatggtggcggcccttacgaatgagagtgcaaccagcaaatcagtatacttttccctctgcacatctgaaatgatatacatcacccatcttctagcacgagagcctgagaaacttgcaggacccttattagccgatacttatgtcacactgctgaaaggtcgcaatgcatggtacgggcagaagttagctaagggagagctgactctagaaacgggggacagcatcaaaggcaaagggactatccagggtgtttctgcagtcaatgcattttatgaactgctgagccagggaagcctaagcgtgatgcatccagaaaccaagaaggctgttgctcctgttgagctatgcccaatactcaaaacgctgtacaaaattttgatcaagagggagcttacgaccaattctatcctccaggcaatacgtgatgaatcaatgtatgatccacgggaaagaattgagttggcacagaggcagtctctttaccggccatctcttcttggcctacctaaaggtgatgccaaggcctaagatatgggtgtttgtctcttcctgcaatacgtatttggtgtcagtttggaggaggcttgtactggccttcaagatccttatttacgtgcctcagatgtgtgttgggttgggtgtacactatagagttcgatgatggtaactcgcc

SEQ ID NO: 3839 - DNA, 1894 bp, Zea mays
gcaagtttgcgctgggatttggtatttctggccgcccaaccccacaaaacccccacgaaacccacccgcatttcccctgtgcagctgtgctggccaagtcgtctggactctggagcctgtctgcccgtcccggttcagcttgctcgcctcgcttatgagttctgagctgtgacaagaactcaggaggtggttgacgggtgaagcgatggtggggagctacgcgaacggtggcggggctgcgccggcggcggtagcggcggagaagctcgacgagctgcggctgctgctggggaagtcggacggcgacacgctgcgggtcgtcggggtgggcgccggggcgtgggggagcgtgttctgcgcgcttctgcaggacgcgtacggccggcaccgcgaccgggtgcaggtgcgcgtgtggcgccgcgccgggcgcgccgtagaccgcgccgacgccgagcgcctcttcgaggtcatcaactcccgcgaggacgtgctgcgccggctcatccgccgctgcgcctacctcaagtacgtcgaggcgcggctcggggaccgcacgctgcacgccgacgagatcctccgcgacggcttctgcctcaacatgctcgacaccccgctctgcccgctcaaggtcgtcaccaacctgcaggaggccgtttgggacgccgacatagttataaacggcctgccctccacggagaccagggaggtattcggggagatcgggaggtactggaaggagcggatcagccagccgctcataatctcgctggcaaaggggatcgaggcgtcgctcgaccctgtgccccggatcattacgcccacgcagatgatcagcaatgcaactggagttcccttggagaacattctatatcttggaggcccaaacattgcttctgagatttataacaaagaatatgcgaatgctcgcatatgtggagctgacaagtggaggaaacatcttgcaaatttcttgaggcaacctcattttattgtatgggacaatagtgatctcattactcatgaagtcatgggcggcttaaaaaacgtatatgccattggggccggtatggtggcggcccttacgaatgagagtgcaaccagcaaatcagtatacttttcactttgcacatcggaaatgatatacatcactcatcttctagcaccagagcccgagaaacttgcaggacccttattagctgatacatacgtcacactgctgaaaggtcgcaatgcatggtatgggcagaagttagctaagggagaactgactctagaaatgggggacagcatcaagggcaaagggactatccagggtgtttctgcagtcaatgcattttatgaactgctgagccagggaagcctaagcgtgatgcatccagaaaccaagaaggctgttgctcctgttgagctatgcccaatactcaaaacactatacaaaattttgatcaagagggagcttacgaccaattccatcctccaggcaatacgtgatgaatcaatgtatgatccacgggaaagaattgagatggcacagaggcagtctctttaccggccatctcttcttggcctgcctaaagctgatgcgaaggcctaagatatggtgtttcttcctacctgatgagagcttgcaggagccaggaggcgcttactggtcttcaagatccttacgtgcctcagatgtgtgttgtgtcatgcgtgtacactaatacactatagagttgggtgatggcatatttagcatgccaggataaactttattgcccgtgtctgaaatacaagctgttgtgattcaaatttatttgtcacttagactggagtaaagatgtgtatgccttttattttatgatggcttcagagtctcaaaattggttgtaagattactccctgcgtctca

SEQ ID NO: 3840 - DNA, 1875 bp, Panicum virgatum
ccggcgcggccgcggccctcgggcttgccgatcgacagcgagtttcgcgctgggatttggtaatttctggtcacccaaccccacaaaaccccccgcgaaacccacccgcatttcctcccacccgtgctcgccagcaaaaccccccatcttcctcggcccagccggagcctgccttgcctgtccccggttgagctcggcgagggcctgtgaactgcgaagcgaggcggcgatggtggggacctacgcgaacggcgggtcggcggcggaggagaagctggacgagctgcggcggctgctggggaagtccgacggcgacccgctgcgggtcgtcggggtgggcgccggggcgtgggggagcgtcttctgcgcgctgctgcaggacgcgtacggccggtaccgggaccgggtgcaggtgcgggtgtggcgccgcgcggggcgcgccgtggaccgcgccgacgccgagcgcctcttcgaggtcatcaacgcccgcgaggacgtgctgcgccgcctcatccgccgatgcgcctacctcaagtacgtcgaggcgcgcctcggggaccgcacgcttcacgccgacgagatcctccgcgacggattctgcctcaacatgctcgacacgccgctctgcccgctcaaggtcgtcaccaacctgcaggaggccgtctgggacgccgacatcgtcgtcaacggcctgccgtccacggagaccagggaggtgttcggggagatcggcaggtactggaaggagcggatcacccagccgctgatcatctcgctggcgaaggggatcgaggcgtcgctcgaccctgtgccccggatcataacacccacacagatgatcagcaatgcaactggagtgcctttggagaacattctgtatcttggaggcccaaacattgcttctgagatttataacaaagaatatgcaaatgctcgcatatgtggagctgacaagtggaggaaacctcttgcaaaatttttgaggcagccccatttcattgtatgggacaacagtgatctcattactcatgaagtcatggggggcttaaaaaacatatatgccattggtgctggtatggtggcagcacttaccaatgagagtgcaaccagcaaatcagtgtacttttcactttgcacatctgaaatgatatacatcacccatcttctagcgcgagagcctgagaaacttgcaggacccttgttagctgatacatacgtcacactgctgaaaggccgtaatgcatggtatgggcagaagttagctaagggagaattgaccctagaaatgggggacagcatcaaaggcaaagggactatccagggtgtttctgcagtcaatgcattttatgaactcctgagccagggaagcctatgtgtgatgcatccagaaaccaagaagcctgttgctcctgttgagctgtgcccaatactcaaaacgctctacaaaattttaatcaagagggagcttgcgactgattccattcttcaagcaatacgagatgaatcaatgtatgatccacgggaaagaattgagatggcacagcgtcagtccctttaccggccatctcttcttggcctacctaaaggagatgccaaggcttagagatgtcctttatgcagtacgcatttgctatgaacatgcagaggtgtttgctggtctcaagatccttctttgcgtgcccccgaaaatgtgcgttgtctgtacactagagagttcgatggtggtatattaggatgtcaggatacactttatggcccatgtctgtacatacgtcttgttgtgattcaaatttatttgttatctagactggaataaagatatgtcttccttttcgtttatgagggctttggagtctcatattggttttcctcaaa

SEQ ID NO: 3841 - DNA, 2707 bp, Panicum virgatum
acgcgggtcgcatctagcaggatttgtttgcgaccggatccgttgcgactgacagtgaaattccgagagaggaggaggagagcgaaaggaaaggaaacggagcgttggacccggacccaacacggggatcgctttagaccgcggcgacggacgcacgagctgaccgcttctttgagtaagcttcccccgctcaagcgaaccctcacgccgccgaattgatgatgatgatggcagcgtgccaaggccatcttgcgtgcgctgtgctcgagtggactctctcttctggtcggctccgaactcggaccagctccgccaactagagcggccgcaacgagcagtcaaagccttatttctcctcgtgcacggccgtctgccgccgccggtcatcaattcggtcacgccgtgcgcccgcgcccgtccctttcggtttcggacgcgcctggcctggtgcgtccgtgtgtggcgtctccaccaccgcccctctttctcctcgtgcacggactcggcctccgatccgattccctccctgtgagcacctgaccgtgcgcgttgcctccgtggaagccttatttaaacgggaaaaaaccacatcaccgagccagaggggaaaaaggcacggtttttcgattttctcaggcccgctcgcctgcttgcggagttggtgccggtagctgagccgagacccgggcgggcgccgccgccaccaaccccccggggagaagcggagttcaaaagggaggggccggcgtggccgcagccctcgggcttgccgatcgacagctagcgagtttcgcgctgggatctggtaatttctggtgacccaaccccacaaaaccccccccgcgaaacccacccgcatttcctccccccgtgctcgtcgccagcaaaatcccaccacatcttcctcggccggctggagccagagcctgcctgccttgcctgtcctgaccccggttgagctcggcggcgatggtggggagctacgcgagcggcgggtcggcggcggcggcggcggagaagctggacgagctgcggcggctgctggggaagtccgacggcgacccgctgcgggtcgtcggggtgggcgccggggcgtgggggagcgtcttctgcgcgctgctgcaggacgcgtacggccggcaccgggaccgggtgcaggtgcgggtgtggcgccggccgggccgcgccgtggaccgcgccgacgccgagcgcctcttcgaggtcatcaacgcccgcgaggacgtgctgcgccgcctcatccgccgctgcgcctacctcaagtacgtcgaggcgcgcctcggggaccgcacgctccacgccgacgagatcctccgcgacgggttctgcctcaacatgctcgacacgccgctctgcccgctcaaggtcgtcaccaacctgcaggaggccgtctgggacgccgacatcgtcgtcaacggcctgccgtccacggagaccagggaggtgttcgaggagatcggcagatactggaaggagcggatcacccagcctctcatcatctcgctggccaaggggatcgaggcgtcgctcgaccctgtgccccggatcataacacccacacagatgatcagcaatgcaactggagtgcctttggagaacattctgtatctcggaggcccaaacattgcttctgagatttataacaaagaatatgcaaatgctcgcatatgtggggctgacaagtggaggaaacctcttgcaaaatttttgaggcagccccatttcattgtatgggacaatagtgatctcattactcatgaagtcatgggcggcttaaaaaacgtatatgccattggtgctggtatggtggcagcacttaccaatgagagtgcaaccagcaaatcagtgtacttttcactttgcacatctgaaatgatatacatcacccatcttctagcgcgagagcctgagaaacttgcagggcccttgttagctgatacatacgtcacactgctgaaaggccgtaatgcatggtatgggcagaagttagctaagggagaattgaccctagaaatgggggacagcatcaaaggcaaagggactatccagggtgtttctgcagtcaatgcattttatgaactcctcagccagggaagtctatgtgtgatgcatccagaaaccaagaagcctgttgctcctgttgagttgtgcccaatactcaaaacactttacaaaattttaatcaaaagagagcttgcgactgattccattcttcaagcaatacgagatgaatcaatgtatgatccacgggaaagaattgagatggcacagcgtcagtccctttacaggccatctcttcttggcctacctaacggagatgccaaggcttagatatgtcctttctgcagttcgcatatgatgcgaacttgcaggtgtctgctggtctcaactctcaagatccttctttgcgtgcccccgaaaatgtgcgttgtgtacactagagttcgatggtggtatattaggatgtcaggatacactttattgcccattctgtacatacgtcatattgtgattcaaatttatttgttatttagatggaataaagatatgtcttccttttcgtttatgatggctttggagtctcatagctgactggctgtaatcataagcagcaagctatgttcactgacatgacatgaactgatgtctgctaatacattagattttcttcttttttgaattatgcaaa

SEQ ID NO: 3842 - DNA, 2064 bp, Setaria italica
ttcgattttctcgtgcccgcccccgctcgtctgcttgctttaccggattggattgcgccaaggagttggtgctggttgctgagccgagacccgggcgggcgccgccaccaacccacccggggagaagcagagttcaaaggggcctgcgcggcctctgctcgccgatcgacagcgagttcgcgctgggatttggtagttctggtcgcccaaccccacaaaaccccgcatttcctttcctcctccgtgctcgccaacaaaacccccccatcttcatcggtcggccggagcctgcctgcctgtggagtcccggttgagctcggcgaggctgtgtgaactgcgaagcgggagcggcgatggtggggagctacgcgaacggcggcggggctgatgcggcggcggcgctggcggcggaggagaagctggacgagctgcggcggctgctgggcaagtccgacggcgacccgctgcgggttgtcggggtgggcgcgggggcgtgggggagcgtgttctgcgcgctgctgcaggacgcgtacggccggcaccgggaccgggtgcaggtgcgggtgtggcgccgggcggggcgcgccgtcgaccgcgccgacgccgagcgcctcttcgaggtcatcaacgcccgcgagggcgtgctgcgacgcctcatccgccgctgcgcctacctcaagtacgtcgaggcgcgcctcggggaccgcacgctcaccgccgacgagatcctccgcgacggattctgcctcaacatgctcgacacgccgctctgcccgctcaaggtcgtcaccaacctgcaggaggccgtctgggacgccgacatcgtcgtcaacggcctgccatccacggagaccagggaggtgttcggggagatcgggaggtactggaaggagcggatcacccagccgctcatcatctcgctggcaaaggggatcgaggcgtcgctcgaccctgtgccccggatcataacacccacgcagatgatcagcaatgcaactggagtgcctttggagaatattctatatcttggaggcccaaacattgcttctgagatttataacaaagaatatgctaatgctcgcatatgtggagctgaaaagtggaggaaacctcttgcaaaatttttgaggcagccccattttattgtatgggacaatagtgatctcattactcatgaagtcatgggtggcttaaaaaacgtatatgccattggtgctggtatggtggcagcacttaccaaagagagtgcaaccagcaaatcagtgtacttttcactttgcacttctgaaatgatatacatcacccatcttctagcgcgagagcctgagaaacttgcaggacccttgttagctgatacatacgtcacactgctgaaaggtcgtaatgcatggtacgggcagaagttggctaacggagagctgactctagaaatgggggacagcatcaaaggcaaagggactatccagggtgtttccgcagtcaatgcattctatgagctcctgagccagggaagcctatgtgtgatgcatccagaaaccaagaagcctgttgctcctgttgagctgtgtccaatactcaaaacactttacaaaattttaatcaagagggagcttgggaccgattctattcttcaggcaatacgagatgaatcaatgtatgatccacgggaaagaattgagatggcacagcgtcagtccctctaccggccatctcttcttggcctacctaaaggagacgccaaggcttagatatgcagtacgcatttgctgtgagcttgcaggaggtgtttgctggtctcaagatccttcttggcgtgccctccagaacgtgtgttgtgtgtacactatagagttcgacggtggtatatttagcatgccaggataaagtttattggccaagtctgtacatacaacctgttgtgattaaaatttatttgttatttagactggaataaagatatgttttccttttcttttatgatcgctttcgagtctcatattggctgtaactcataagcagtaagatatgtaagcagtatgaatgaagcaaaaaggcattctatta

SEQ ID NO: 3843 - DNA, 2466 bp, Brachypodium distachyon
cgccaccccaaaatccacctgttttgaccgggccactcccgttcccccgcccgcgtcactcgcttcctcgttcccctcgtgcacacgcgtccgcctccaccctctccactgcagctctcctcccaaatcggaacacggctcgccatctttttcccctagaagcggaaaccccgtcgtacaaaagcccccgcgaattcgctcgccaacttactgcctgcctccttgccccggacccggagtaagtagctgagacccgagaggtgcgagaccaggacaggccggcgccgccaccaaccgtcggcgccaggaattcaaaccggcggcggcgggcgcgtcgaggacagacagcgagcgcgcagctggggtttaaagtggcgtttttcgcccgcccagtccccacaaatccacccgcattcggcatttccgtcccctcgatctcaccgccacctcccccaactcaaaccccccgttcctccttgctcagcccgctagcttccgccgcccttggatctccccgcctcacgcgtgccgtgcagctggttgcgaggcggccttggcgatggggggaagctacacgaacggagtcggtgggggtgcggcgaacggcgcggcggaggggaagctggacgagctgcggcggctgctggggaaggcggagggggacccgctccggatcgccggggtgggcgcgggggcgtgggggagcgtcttctgcgctctgctgcaggacgcctacggccgcgactaccgcgacaaggcgcaggtgcgcgtctggcgccgcccgggccgcaccgtcgaccgcgccaccgccgagcacctcttcgaggtcatcaactcccgggaggacgtcctccgcaggctcatccgccgctgcgcctacctcaagtacgtcgaggcgcgcctcggcgaccgcacgctctacgccgacgagatactccgcgacggcttctgcctcaacatgatcgacacgccgctctgcccgctcaaggtcgtcaccaacttgcaggaggccgtctgggacgccgacatagtcatcaatggcctgccgtccacggaaaccagggaggtgtttggggagatcgggaggtattggaaggagaggatcaacccaccagtgatcatctctctggcgaagggagtcgaggcatcgctagatcctgtgccccggatcattaccccaacgcagatgatcaccgatgcaaccggagttccattggagaatgttctatatcttggaggccctaacattgcttccgaaatttacaacaaagaatatgcaaatgctcgtatatgtggagctgacaagtggaggaagcctctttctaaatttttgcggcaacctcatttcattgtatgggataatagtgatctcattacccatgaagtcatgggtggcttaaagaacatatatgccattggagctggtatggtagcagcactgaccaatgagagcgcaacaagcaaatcggtttacttttcactttgcacgtctgaaatgatatacatcacccacctcctagcggaagagcctgagaaactttctgggccactattagcagatacatatgtcacactattaaaaggtcgtaatgcatggtatgggcataaattagcaaagggcgaactgactctggaaatgggggacagcatcaaaggcaaagggactatacagggtgtctctgcagtcaatgcattttatgaactcctgagtcaaggcagcttaagtgtgatgcatccagaaaccaagaagcatgttgctcctgtcgagctgtgcccgatactcaaaacactctataaaattttaatcaagagggatcttggtaccaattccattctccaggcgatacgagatgaatcaatgtatgatccgcgggaaagaatcgagatggcacagcgccaatctctgtaccgaccatctctgcttggcctacctaaaggtgacaccaagtcttagatgcactcaccatttgtgcagatttgttgcgagcttgcgcggtgtgtcgacccttatatgtacactagcgggttcgatgagatgttttagcgccgccggcatgtacttattcaccaagtttcaactggcttcacgggcttgtccagcctcctgtatatacagccattggttattcagcttaaaaagttacattggtgattcagttgtattttactatttgtttcttagatgggaagagacgccggtgattcttttgaacttttgactaatttgctctccatgctttaagcaagcagcagtgctcctgcctacttcagaagaaagagacccatgtaatttttgtatatgtaatgcttgtatgcccgtgacagctcgtcagaagcagtggcagatttttgaagaatggccaagtttcatgtctttggtttgctggtaaagtccaatctgacgagatccaaacatgtctccatttattaggtgcctgtggcagttttttaacatggaattgaaat

SEQ ID NO: 3844 - DNA, 2106 bp, Oryza sativa
gtcagtccaccggtcacccgctcgtcagaggtaggtcgccgtcgccgcgtccccctccgccgccggctcccgtcgctctccggtctcacgcgccgcgcggccgcagcagcaacaacaacaacaacccgttttgaccgcgccttcctcctccgccggcccgcgcgctcgccgcgcgcggccgccacgggtttctctctagaagccccgcacgaattttatcccttttttcgcattctccccgcctcatctcctccttgacaccgacctctcctcctcggctcggggaattcaaacgcgcggcctcgccgggtggcctcgcctcgcctcgccgcgttccgacagcgagtgccccgctggtgccactatttcttgccgccccaacccctcgcatcgatcccccacacccacatctcgcctcctcttcctcgatcctttgtcttcttgcttagctagctctgccatggtggggagctacgcggcgggagggggacggggagcggcagtggcggcggtggcggaggggaagctggacgagctgcggcggaggatggggaaggcggacggcgacctgctgaggatcgtcggggtggggggcggggcgtgggggagcgccttctgcgcgctgctgcaggacgcgtacgggcggcaccgcgacaaggcgcaggtgcgggtgtggcggaggcccgggcgcgccgtcgaccgcgccaccgccgagcacctcttcgaggtcatcaactcccgggaggacgtcctccgcaggctcatccgccgctgcgcctacctcaagtacgtcgaggcccgcctcggcgaccgcacgctctacgccgacgagatcctccgcgacggcttctgcctcaacatggtcgacacgccgctctgcccgctcaaggtcgtcaccaacctgcaggaggcggtctgggacgccgacatagtcatcaacggcttgccctccaccgagaccagggaggtgttcggggagatcgggaggtattggaaggagaggatcagaccccccgtgatcatctcgctggccaaggggatcgaggcgtcgattgaccccgtgccccggatcattaccccgacacagatgatcagcaatgcaactggagttccattggagaatattctatatcttggaggtcctaacattgcatctgagatatataacaaagaatatgcaaatgctcgcatatgtggagctgacaagtggagaaaacctctagctaaatttctgaggcagcctcattttattgtgtgggataatagtgatctcatcactcatgaagtaatgggcggcttaaagaacatatatgccattggtgctggtatggtggctgcactaaccaatgagagtgcaaccagcaaatcggtttacttttcactttgcacgtctgaaatgatatacatcacccatctcctagccgaagaccctgagaaacttgccgggcctttattagccgatacctatgtaacactgctgaaaggtcgtaatgcatggtatgggcagaaattagctaagggtgaactgactcttgaaatgggggacagtatcaagggcaaagggactatccagggtgtctctgcagtccatgcattttatgagctcttgagccagagtagcttaagcgtgacacatccagaagtgaagaagcttgttgctccggtcgagctgtgcccaatactaaaaacactttataaaatcctaatcaagagggagcttgccactgactccattctccaggcaatacgagatgaatcaatgtatgatccacgggagaggattgagatgtctcagcgccagtgtctttaccgaccatctcttcttggcctacctaaagtagatattacccaggcttagatctattcttttttttttctgcagatttgttttgagatttgcaggattctttgatgtattctttgcatagtggtcctcaagatccttccttgtgtgccaagtgcatctcgtgttcgaacactgattccattctctactagagaatttgataatgaggtgttttggttttttattgtcagagttccaaatagtttcacgggctgatgccccccacatgtgtatataaagtacaaccactgttgattcaa

SEQ ID NO: 3845 - DNA, 1886 bp, Secale cereale
ccccgtctccctcttcgcttagctggcctgcgactgcgagcatcgatctcccagcgcgtggccgggcggactgagctagttgggggccgcggcgatggtggggacctacgccaacggagcaggaggaggaggaggaggaggtaaaaacggcgcggcggaggggaggctggacgagctgcggcggcggctggggaaggcggagggggacccgctccggatcgccggcgtgggcgcgggggcctgggggagcgtcttctgcgcgctgctgcaggacgcgtacggccgcgaccaccgcgacaaggcgcaggtgcgcgtgtggcgccgcgcgggccgcgccgtcgaccgcgccaccgccgagcacctcttcgaggtcatcaacgcccgcgagggcgtcctccgcaggctcatccgccgctgcgcctacctcaagtacgtcgaggcccgcctcggcgaccgcacgctctacgccgacgagatcctccgcgacggcttctgcctcaacatgatcgacacgccgctctgcccgctcaaggtcgtcaccaacctgcaggaggccgtctgggacgccgacatcgtcatcaacggcctgccctccaccgagaccagggaggtgttcggggagatcgggaggtactggaaggagaggatcagcccgcccatcataatctcgctcgccaaggggatcgaggcgtctctcgatcccatgcctcgcatcattacccccacacagatgatcgccaatgcaactggagttccgttggagaatattctatatctcggaggccctaacattgcttctgaaatttacaataaagagtatgcaaatgctcgcatctgtggagctgacaagtggaggaagcctctttctaaatttttgcggcagcctcatttcattgtatgggataatagtgatctcattactcatgaagtcatgggtgggttaaagaacatatatgccattggtgctggtatggtggcagcactgaccaacgagagcgcgacaagcaaagcagtgtacttttcgctttgcacgtctgaaatgatatacatcacccacctgctagcggaagagcctgagaaactttctggaccactattagcagatacttatgtcacactattgaagggtcgtaatgcttggtatggccataaattagctaaggcagaactgactctagaaatgggggacagcatcaaaggcaaagggactatacagggtgtctctgcagtcaatgcgttttatgaactcctgagtcaaggcagcataagcgtgacgcatccagaaaccaagaagcacgttgctcctgtcgagttgtgtccgatactcaaaacactctacaaaattctaatcaagagggagcttggtaccagttccattcttgaggcgatacgcgacgaatcaatgtccgatccacgggaaagaatcgagatggcacagcgccaatccctctaccggccgtccctcctcggcctgcctaaaggcgatatcaagctgtagtagttgcagcctttatttatgcagaaatgctgcgagtttccacggtttgccgattcttccgtcggtgtaccccgcaagtgcatacttgtagtatatatatgcttatatgtagcacgagatgagttttttaaaatgagcaaggcgagataaacttcttatcgtccgagttgaagcccacctgtatatacaacccttggttgaggttcaattgcatttattgcttatagatgggaaacgaggtacctgtgattcttttgaacttaaactcgttgccactgctttagttgattggcagtgttgacttcagaaacagaggacgcctgtagttctgtatatgtgatgcttttatgcctgtgaggttttgctctttcagaaacaaaaaaaaaaa

SEQ ID NO: 3846 - DNA, 2175 bp, Hordeum vulgare
gccgccaccaaccgtcggcgcgcaattcaaacgggcggcggccgggagggacagcggggccgcagctgggggatttaaatggcgcgtcttggcccccgcatccggcatccccccctcgatcccaccgccacctcccccgtcccgctctcgcttagctggcctgcgagcctcgatctctcctcgcgcgtggccggccaggcggactgagctagccggaggccgcggcgatggtggggagctacgccaacggagcaggactggggaagaagggcgcggcggaggggaagctggacgagctgcggcggcggctggggaaggcggagggggacccgctccggatcgccggcgtgggcgcgggggcctgggggagcgtcttctgcgcgctgctgcaggacgcctacggccgcgaccaccgcgacaaggcgcaggtgcgcgtctggcgccgcccgggccgcgccgtcgaccgcgccaccgccgagcacctcttcgaggtcatcaacgcccgcgagggcgtcctccgcaggctcatccgccgctgcgcctacctcaagtacgtcgaggcccgcctcggcgaccgcacgctctacgccgacgagatcctccgcgacggcttctgcctcaacatgatcgacacgccgctctgcccgctcaaggtcgtcaccaacctgcaggaggccgtctgggacgccgacatcgtcatcaacggcctgccctccaccgagaccagggaggtgttcggggagatcgggaggtactggaaggagaggatcaacccgcccatcattatctcgctggccaaggggatcgaggcgtcgctcgatcccatgcctcgcatcattacccccacacagatgatcgccaatgcaactggagttccattggagaatattctatatctcggaggccctaacattgcttctgaaatctacaataaagagtatgcaaacgctcgcatctgtggagctgacaagtggaggaagcctctttctaaatttttgcggcagcctcatttcatcgtatgggataacagtgatctcgttacacatgaagtcatgggtggcttaaagaacatatatgccattggtgctggtatggtggcagcactgaccaatgagagcgcaacaagcaaatcagtttacttctcactctgcacgtccgaaatgatatacatcacccacctcctagcggaagagcctgagagactttctggaccattattagcagacacttatgttacgctgttgaaaggtcgtaatgcatggtatgggcataaattagccaaggcagaactgactctggaaatgggggacagcatcaaaggcaaggggactatacagggtgtctctgcagtcaatgcattttatgaactcctgagtcaaggcagcataagtgtgacgcacccagaaaccaagaagcacgttgctcctgtcgagctgtgccccatactcaaaacactttacaaaattttgatcaagagggagcttggtacaagttccatccttgaggcgatacgagatgaatcaatgtccgatccacgggaaagaatcgagatggcacagcgccagtccctctaccgcccgtctctcctcggcctgcctaaagttaaataaatacagcctttgtatatgcagaaacgtcgcgagtttgcagggtttgttgatccttctggcagtgcaccgcaagtgcgtgtcgtttctttatacttcatccatcccaaaataagtgtctcaactttagtggaactttttactaaagttagtacaaagtctgagacactctttttggcatggagggagtacataatagtgctgagtatggaagagttctttttttttagcaaggcgagatgaacttcttgtggtcgaagtggatgcccacttgtacatacaacccttgattcaaattcaattgtacgtgttgctttgatgggaagagactctcttcccatctatttataagtagctctttgtcactgctttagatgagtggcatctttcctgtcttctactacttcagaagaaacagaggacacctgtagtcctgtatatgcctgtgacgggttcgtcacaagttttgctcttttggagagcgtgctagtttgagatccatttgtaatccaatgcttgtatgaggtgtcccactattcaatccctgataatattgttactgtggttg

SEQ ID NO: 3847 - DNA, 1741 bp, Secale cereale
ccgcgcaattcaaacgggcagcggggccgcagctgggggatttaaatggcgcctcttggcccccgcattcggcatccatccccccctcgacctcgatcccaccgccacctccggccggccaccccccgtctcgctcttcacttagctggcctgcgactgcgagcctcgatctcctcgcgcgtggccgggcggactgagctagtcaggggccgcggcgatggtggggacctacgccaacggagcaggtggaggaggaggaggaggtaaaagcggctcggcggaggggaagctggacgagctgcggcggcggctggggaaggcggagggggacccgctccggatcgccggcgtgggcgcgggggcctgggggagcgtcttctgcgcgctgctgcaggacgcgtacggccgcgaccaccgcgacaaggcgcaggtgcgcgtgtggcgccgcgcgggccgcgccgtcgaccgcgccaccgccgagcacctcttcgaggtcatcaacgcccgccagggcgtcctccgccggctcatccgccgctgcgcctacctcaagtacgtcgaggcccgcctcggcgaccgcacgctctacgccgacgagatcctccgcacggcttctgcctcaacatgatcgacacgccgctctgcccgctcaaggtcgtcaccaacctgcaggaggccgtctgggacgccgacatcgtcatcaacggcctgccctccaccgagaccagggaggtgttcggggagatcgggaggtactggaaggagaggatcagcccgcccatcataatctcgcttgccaaggggatcgaggcgtcgctcgatcccatgcctcggatcattaccccgacgcagatgatcgccgatgcaactggagttccgttggagaatattctgtatctcggaggccctaacattgcatctgaaatttacaataaagagtacgcaaacgctcgcatctgtgggtctgacaagtggaggaagcctctttctaaatttttgcggcagcctcatttcattgtatgggataatagtgatctcattactcatgaagtcatgggtggcctaaagaacatatatgccattggtgctggtatggtggcagcactgaccaacgagagcgcgacaagcaaagcagtgtacttttcgctttgcacatctgaaatgatatacatcacccacctgctagcggaagagcccgagaaactttctggaccattattagcagatacttatgtcacactactgaagggtcgtaatgcttggtatggccataaattagctaaggcagaactgactctggaaatgggggacagcatcaaaggcaaagggactatacagggtgtctctgcagtcaatgcgttttatgaactcctgagtcaaggcagcataagcgtgacgcatccagaaaccaagaagcatgttgctcctgtcgagctgtgtccgatactcaaaacactctacaaaattctaatcaagagggagcttggtaccagttccattcttgaggcgatacgcgacgaatcaatgtccgatccacgggaaagaatcgagatggcacagcgccaatccctctaccggccgtccctcctcggcctgcctaaaggcgatatcaagctgtagtagttgcagcctttatttatgcagaaatgctgtgagtttccatggtttgccgattcttctgttggtgtaccccgcaagtgcatatttgtagcatatatatatatagcacgagatgagtttt

SEQ ID NO: 3848 - DNA, 1853 bp, Oryza sativa
ggtcgcgacgcgagcagcggaggcgcaacaggcggcaaacgtcccggggcggtgccggcagccaagccaagccaagccgcctcggtctctccggccgacagtgattcggcggccaaacctaccagcagccaccaaaaattggcggacgactcctcagatcgcgtcacatgctgggcgacgacaagggaaggcggagaggtggaggagggagcaatgggcggggcggaggacgcgccgcgcgcggcggcggcgaacgggcacgggaatggggccaccgtggaggagaagctggacgagctgcggcgcctgctgggcaaggccgacggcgacccgctccggatcgtcggcgtcggcgccggggcctgggggagcgtcttctgcgcgctgatgcaggacgcgtacggacacctccgcgacaaggtgcaggtccgcatctggcgccgcccgggccgcgccgtcgaccgcgccaccgccgagcacctcttcgaggtcatcaacgcccgggaggacgtcctccgccgcctgatccgccgctgcgcctacctcaagtacgtcgagggccgcctcggcgaccgcaccctctacgccgacgagatactcagggacggcttctgcctcaacatgatcgacacgccgctctgcccgctcaaggtcgtcaccaacctccaggaggccgtctgggacgccgacattgtcatcaacgggctgccgtccacggacaccagggaagtcttcggggagattgggaggtactggaaggagaggattactgcccccatcatcctctctctggccaaagggatagaggcctccctggatcccctgccacggatcataactcccacacagatgattagcaatgcaacgggggttccattggaaaacattctttatcttggaggccctaacattgcttcagaaatttacaataaagaatatgcaaatgctcgtatatgtggagctgacaaatggagaaaacctcttgctaaatttttgaggcagcctcattttattgtatgggataatagtgatctcattacacatgaagtcatgggaggtttgaaaaatgtgtatgccattggtgccggtatggtggcagctctaacaaatgagagtgcaaccagcaaatccgtttactttgctctttgcacatctgaaatgatttacataacccaccttttggaagaagagcctgaaaaacttgctgggccattattggctgacacttatgtcacattgctgaagggtcgtaatgcatggtatgggcagaaactagctaaaggtgaactgacactagagatgggtgacagcataaaaggcaaaggaaccattcagggtgtctctgcagtcaatgcattttatgaactcctgagtcaggatagcttaagcgtaatgcatcctgaagccaacagatctgttgcaccggttgagatgtgcccaatcctgaaggcactgtacaaaattttgatcaagagggaacttcctcctgattcgatccttcaggccataagagatgaaacaatgtatgatccacgtgaaagaattgagatggcgcagggccattcactttaccggccatctcttcttggtcaacctaaaggagatgccaaagcttaggcagttcttccttttttttttggtgctagatatcctgtaagctctgtgtgctattatgcttgctgctgctgctgttgttgtaacactagtgagttccagcaagggaccaagatctcagttgattgcttcaagacttgttgagcttgttatgtagtttgatttgttaaacgcctgaaatgtgtacatagacgttgttttgtgtgatccaataataaaatatgcaaaaggtaatgttc

SEQ ID NO: 3849 - DNA, 1989 bp, Oryza sativa
cattccacccgaccctgttcgctttcgcttcgcctcgttcgcgggtcgcgacgcgagcagcggaggcgcaacaggcggcaaacgtcccggggcggtgccggcagccaagccaagccaagccgcctcggtctctccggccgacagtgattcggcggccaaacctaccagcagccaccaaaaattggcggacgactcctcagatcgcgtcacatgctgggcgacgacaagggaaggcggagaggtggaggagggagcaatgggcggggcggaggacgcgccgcgcgcggcggcggcgaacgggcacgggaatggggccaccgtggaggagaagctggacgagctgcggcgcctgctgggcaaggccgacggcgacccgctccggatcgtcggcgtcggcgccggggcctgggggagcgtcttctgcgcgctgatgcaggacgcgtacggacacctccgcgacaaggtgcaggtccgcatctggcgccgcccgggccgcgccgtcgaccgcgccaccgccgagcacctcttcgaggtcatcaacgcccgggaggacgtcctccgccgcctgatccgccgctgcgcctacctcaagtacgtcgagggccgcctcggcgaccgcaccctctacgccgacgagatactcagggacggcttctgcctcaacatgatcgacacgccgctctgcccgctcaaggtcgtcaccaacctccaggaggccgtctgggacgccgacattgtcatcaacgggctgccgtccacggacaccagggaagtcttcggggagattgggaggtactggaaggagaggattactgcccccatcatcctctctctggccaaagggatagaggcctccctggatcccctgccacggatcataactcccacacagatgattagcaatgcaacgggggttccattggaaaacattctttatcttggaggccctaacattgcttcagaaatttacaataaagaatatgcaaatgctcgtatatgtggagctgacaaatggagaaaacctcttgctaaatttttgaggcagcctcattttattgtatgggataatagtgatctcattacacatgaagtcatgggaggtttgaaaaatgtgtatgccattggtgccggtatggtggcagctctaacaaatgagagtgcaaccagcaaatccgtttactttgctctttgcacatctgaaatgatttacataacccaccttttggaagaagagcctgaaaaacttgctgggccattattggctgacacttatgtcacattgctgaagggtcgtaatgcatggtatgggcagaaactagctaaaggtgaactgacactagagatgggtgacagcataaaaggcaaaggaaccattcagggtgtctctgcagtcgatgcattttatgaactcctgagtcaggatagcttaagcgtaatgcatcctgaagccaacagatctgttgcaccggttgagatgtgcccaatcctgaaggcactgtacaaaattttgatcaagagggaacttcctcctgattcgatccttcaggccataagagatgaaacaatgtatgatccacgtgaaagaattgagatggcgcagggccattcactttaccggccatctcttcttggtcaacctaaaggagatgccaaagcttaggcagttcttccttttttttttggtgctagatatcctgtaagctctgtgtgctattatgcttgctgctgctgctgttgttgtaacactagtgagttccagcaagggaccaagatctcagttgattgcttcaagacttgttgagcttgttatgtagtttgatttgttaaacgcctgaaatgtgtacatagacgttgttttgtgtgatccaataataaaatatgcaaaaggtaatgttcaaaatatatttgtccacgatgcctgtacaatgcatcattaatgtccaccttattacgtacagtaccgatttatgcaaagaaatcttcagtact

SEQ ID NO: 3850 - DNA, 2443 bp, Panicum virgatum
cacccgaacggccacgcgaacggggccgtcgtggaggagaagctggacgagctgcggcggcagctggggaaggcggacggggacccgctccggatcgtcggcgtcggggcgggcgcgtggggcagcgtcttctgcgcgctgctgcaggacgcgtacggccacctccgcgacaaggcgcaggtccgcatctggcgccgccccggccgcgccgtcgaccgcgccaccgccgagcacctcttcgaggtcatcaacgcgcgcgaggacgtcctgcgccgcctgatccgccgctgcgcctacctcaagtacgtcgaggcgcgcctgggggaccgcacgctctacgccgacgagatactcagggacggcttctgcctcaacatgatcgacaccccgctctgcccgctcaaggtcgtcaccaacctgcaggaggccgtctgggacgccgacattgtcgtcaacggcctgccctccaccgacaccagggaggtcttcggggagattgggaggtactggaacgagaggattacggcccccatcatcatctcgctggccaaggggatagaggcctccctggatccactgccacggatcataactcccacgcagatgattagcaatgcaactggggttcctctggagaacattctatatcttggtggcccaaatattgcctctgaaatttacaacaaagaatatgcaaatgcgcgtatttgtggagctgacaaatggaggaaacctcttgcaaagttcctgaggcagcctcattttattgtgtgggataatagtgacctcatcactcatgaagttatgggaggcttaaaaaatgtatatgctattggtgctggtatggtagcagcactaaccaatgagagtgcgacgagcaaatctgtttactttgcactttgcacatctgagatgatctacatcacacaccttctggaagaagaacccgaaaaacttgccggaccgttattagcagacacttatgtcacattgttgaaaggtcgtaatgcctggtatgggcagaagttagctaaaggggaattgacattagaaatgggtgacagcataaaaggcaaagggaccattcagggtgtctctgcagttgatgcattttatgagcttcttagtcaggatagcttaagtgtgatgcatccagaagccaacagatctgttgcgccggttgagatgtgcccaattttaaaagcactgcatagaattttgatcaagagggaccgtcctgctgactcgattcttcaggctataagagatgagacaatgtatgatccacgtgaaagaattgagatggcacaaggtcactcactttaccgaccatctcttcttggtcaaccaaaaggagatgtaaaagcctagaattatttcccccactttgtcttattggttagaatttagatgatgttctaagatatctatgtcgttatgtgctcttacgcatgctgtacctgttgttgtaacattagtgaaatctgaggggatatttattgagctcgttaagtactcagattgatgtgttccaagcctccctcgtgtatatgacatgtctggtgatcgtgattcaatgacaataagatttgtgtttcacaaggggacacagacgcattttacttctgcttggtccaagatgtctctaaaatgcttgccctagactgcagagttgtagctgttgtgagtcggtgagtgatgattcattgatttgtgctccaacctttttagtttcaacacggttggtatgtactcgaactaaatattataatgctgcattttaatttcagcattgccgaaattcacttcaagttttttttagggtataaattcacttcaagtaataaactgacgagttcgtcgtcgcggtcgtgtcgaagttcgtccttggacgggccgcgcttactgggccagacggtatgagccattttatgtgcgagcgaaattgggggtctgctttgactcatactttcacgtacatcgtgagatacaataactggccacttaacgaaaaacgtgctccgacacgtcgcgagaaaaaaaaatacaataaccggaataatgcactgtgctttctaaactcatactttgcatgttccctaagccgggtcatgtgcatgttttctaaggtacgtgtactaggagtagtagtattttttttcccaaacttaacctattttttttagaaagaaaacttagcctaaattgggaggttcctttcagcagatcgcatcccaaacccaaatcattgcccatggccttaatggagcaagttttccttcgaagcaagcaagcaaccgaacgtccgaacctgctgaatgtggaggcagggcacgcacggaaagtctacgcggtcgccgagcactttccccgccggcgggcgtgcagtttccatcgcggccatcatccgcagcgcgagactcccgtgaggccgtgaccacgt

SEQ ID NO: 3851 - DNA, 1944 bp, Panicum virgatum
ttagttatagcttgcgtcgcgtcgcgtcgcgaaatccagccccgcccgtctctcctctcttccccacgaacgagccgagccggcgggcgggctatgtagcttgcgcacctgcgcttgccctcgttgttgcccgcggcgagacgcgagaggaggaggaggcaaaggcaatggggggagcggaggggccgggccacccgaacggccacgcgagcggggccgtggtggcggagaagctggacgagctgcggcggcagctggggaaggcggacggggacccgctccggatcgtcggcgtcggggcgggggcctggggcagcgtcttctgcgcgctgctgcaggacgcgtacggccacctccgcgacagggcgcaggtccgcatctggcgccgccccggccgcgccgtcgaccgcgccaccgccgagcacctcttcgaggtcatcaacgcgcgcgaggacgtcctgcgccgcctcatccgccgctgcgcctacctcaagtacgtcgaggcgcgcctgggggaccgcacgctctacgccgacgagatactcagggacggcttctgcctcaacatgatcgacacgccgctctgcccgctcaaggtcgtcaccaacctgcaggaggccgtctgggacgccgacattgtcgtcaacggcctgccctccaccgacaccagggaggtcttcggggagattgggaggtactggaaggagaggattactgcccctatcatcatctcgctggccaaggggatagaggcctccctggatccactgccacggatcataactcccacgcagatgattagcaatgcaactggggttcctctggagaacattctatatcttggtggcccaaatatcgcctctgaaatttacaacaaagaatatgcaaatgcgcgtatttgtggagctgacaaatggaggaaacctcttgcgaagttcctgagacaacctcattttattgtgtgggataatagtgacctcatcactcacgaggttatgggaggcttaaaaaatgtatatgctattggtgctggtatggtagcagcactaaccaatgagagtgcaacgagcaaatctgtttactttgcactttgcacatctgagatgatctacatcacgcacctcctggaagaagaacctgaaaaacttgccggaccattattagcagacacttatgtcacattgttgaaaggtcgtaatgcctggtatgggcagaagttagctaaaggggaattgacattagaaatgggtgacagcataaaaggcaaagggaccattcagggtgtctctgcagttgatgcattttatgagcttcttagtcaggatagcttaagtgtgatgcatccagaagccaacagatctgttgcgccggttgagatgtgcccaattttaaaagcgctacatagaattttgatcaagagggaccgtcctgctgactcgattcttcaggctataagagatgagacaatgtatgatccacgtgaaagaattgagatggcacaaggtcactcactttaccgaccatctcttcttggtcaaccaaaaggagatgtaaaagcctagaattattttccccactttgtcttattggttagaatttagatgatcttctaagatatctatgtggctatgtgctcttacgcacgccgtacctgttgttgtaacattagtgaaaatctgagaggatatttattgagctcgttaagtactcggattgatgtgttccaagcctccctcgtgtatataacatgtctggtgattcaatggcaataagatttgtgtttcacaaggggacacggacgcattttacttctgcttggtccaagatgtctctattgtagctgttgtgagtgatgattcattgatttgtactcccaagttttttagtttcaacacggttggtatgtactcgaactaaatatcataatgctgcattttaaatttt

SEQ ID NO: 3852 - DNA, 1952 bp, Setaria italica
ctggcaaccgctccagaggcgaccgggccggcagccagccccgcctccttcctcctcggtctctccggccggcgctttgtttctgccacctcgccgcggttcggcggccaaacccacccgaatccgcgtcgatccggagctggttctccgaaaggaaagccgcccgtttccttccctctctcccccggttagttatagcttgcgtcgcgaaatccagccccgcccgtctctcctcccgaacgagtcaagccgggctgccgggtgctgtagcttgcgcacctgcgcttccccttgtcgcttgcagcgagacgcgagggtcgtggcggcggaggcaatgggcggagcggaggggccgggccacccgaacggccacgcgaacggggccgtggcggaggagaagctggacgagctgcggcggcagctggggaaggcggacggggacccgctccggatcgccggcgtcggggcgggcgcctggggcagcgtcttctgcgcgctgctgcaggacgcgtacggccacctccgcgacaaggcgcaggtccgcatctggcgccgccccggacgcgccgtcgaccgcgccaccgcggggcacctcttcgacgtcatcaacgcgcgggaggacgtcctgcgccgcctgatccgccgctgcgcctacctcaagtacgtcgaggcgcgcctcggggaccgcacgctctacgccgatgagatactcagggatggcttctgcctcaacatgatcgacacgccgctctgcccgctcaaggtcgtcaccaacctgcaggaggccgtctgggacgccgacattgtcgtcaacggactgccctccaccgacaccagggaggtgttcggggagattgggaggtactggaaggagaggattactgcccccatcatcatctccctcgccaaggggatagaggcctccctggatccgctgccacggatcattactcccacgcagatgattagcaatgcaactggggttcctctggagaacattctatatcttggtggcccaaatatcgcttctgaaatttacaacaaagaatatgcaaatgcccgtatttgtggagctgacaaatggagaaaacctcttgcgaagtttttgaggcagccccattttatcgtgtgggataatagtgacctcatcactcatgaggtcatgggaggcttgaaaaatgtatatgctattggtgctggtatggtagcagcactaaccaatgagagtgcaacgagcaaatctgtttactttgcactttgcacgtctgagatgatctacatcacacaccttctggaagaagaacctgaaaaacttgctggaccgttattagcggacacctatgtcacattgttgaaaggtcgtaatgcatggtatgggcagaagttagctaaaggggaattgacattagaaatgggtgacagcattaaaggcaaagggaccattcagggtgtctctgcggtcgacgcattttatgagcttcttagtcaggatagcttgagtgtgatgcatccagaggccaacagatctgttgcaccagttgagatgtgcccaattttaaaagcgctacatagaattttgatcaagagggaccgtcctgctgattcgattcttcaggctataagagatgagacgatgtatgatccacgtgaaagaattgagatggcacaaggtcactcactttaccgaccatctcttcttggtcaaccaaaaggagatgtaaaagcctagaattatcttccccactttgtcttatccattagaatttagacggccatctactaagatctaaggcaccatgtgcttcttatgcacgatgtttctgttgttttaatattagtgaaatctgagaggatatttattgaatgtgttaagtactcagcttgatgtgtttcaaccctccactgtgtatataacatgtttggtgattcaatggcagtaacatgtttgggga

SEQ ID NO: 3853 - DNA, 1831 bp, Zea mays
cgcggccgacgcttcgcctcgctgcgattcggcggccaaacccacccgaattcgcgtcgatccgagctcgtttcggccaaaagaaaagccgtccgctcctttctctctccccgagttagttattatagctttgctgccgtcgcttaatccagccttccccgtctctcctcttctgccgaacgagacagaccgggttatgtagcctgcctcgttttcggcgagagaggaagaggcggaggagatcagggcaatgggcggggcggaggcgctgggccagccggacggccatgcgaacggggccgtggtggaggagaagctggacttgctgcggcggcagctggggaaggcggacggcgacccgctccggatcgtcggcgtcggggcgggcgcctggggcagcgtcttctgcgcgctgctgcaggacgcgtacggccacctccgcgacaaggcgcaggtccgcatctggcgccgcccgggccgcgccgtcgaccgcgccaccgccgagcacctcttcgacgtcatcaacgcgcgcgaggacgtcctgcgccgcctgatccgccgctgcgcctacctcaagtacgtcgaggcgcgcctcggcgaccgcacgctctacgccgacgagatactcagggacggcttctgcctcaacatgatcgacacgccgctctgcccgctcaaggtcgtcaccaacctgcaggaggccgtctgggacgctgacattgtcgtcaacggcctgccttccaccgacaccagggaggtgttcggggagatcaggaggtactggaaggagaggattactgcccccatcatcatctccctcgccaaaggaattgaggcctcgctggatccactcccacggatcataactcccacgcagatgattagcaatgcaactggagttccatcagagaatattctttatcttggcggacctaatattgcttctgaaatttacaacaaagaatatgcaaatgcacgtatttgtggagctgacaaatggagaaagccccttgcaaagtttttgaggcagcctcattttattgtgtgggataacagtgatctcatcactcatgaagtcatgggtggcttaaaaaatgtctatgctattggtgctggtatggtagctgcactaaccaacgagagtgcaaccagcaaatctgtttactttgcactttgcacatctgagatgatctacatcacacaccttctggaagaagaacctgaaaaacttgctggacccttattagctgacacttatgtcacattgttgaaaggtcgtaatgcatggtatgggcagaagttagctaaaggtgaattgacattagaaatgggtgacagtattaaaggaaaagggaccattcagggtgtctctgcagttgatgcgttttatgagcttcttagtcaggatagcttaagtgtcatgcatccagaagccaacagatctgttgcgccggttgagatgtgcccgatcctaaaagcactacataggattctgatcacgagggaccgtcctgctgattcgattcttcaggctataagagatgagacaatgtatgatccacgcgaaagaattgagatggcacaaggccattcactctaccgaccatctcttcttggtcaaccaaaaggagacgtgaaaacctagaagtcattttctttccctttcctttgttggctaggacttggagcatcttctaagttgctgtatgtttatgcacggtgtgcttgttgttgtaacttgtaacattagtggaatctgagaacatatttatttagcttgttcaatattagtagtcagtcttgtatgatgtagtgtagagcatgattttag

SEQ ID NO: 3854 - DNA, 2113 bp, Brachypodium distachyon
cccccgtccgtcctttctttagctcctgctactttccacccaccaagctgccacctcccgtcccgcggtggtgatcccagtaaaatcatccttcgatccccaacgcccggccggagacgcgaaactgaaaccgcgcccaccaaccagcgagaccctcccaagggccggcggcccccgcctcggtctctccggccggccgattgctcgcgtcacctcgtcgtaaattcggcggccaaacccacgacggcatatcgtatcgcggcgtccttgtcccgtcttctccccggttggttatagcttgcctgcccatccttggaacgtgtcagggaggttatgcagtagcttgtgcggctgggcttcgttttttgctttcgacgacaagggaagggggagggaagggaaagaggagggagggagcaatgggcggagcggaggacgcgccgaacgggcacgcccccgccaatgggggcgtggaggagaaggtggacgagctgcggcgcctcatgggcaaggcggacggcgacccgctccggatcgtcggcgtcggggccggggcctggggcagcgtcttctgcgcgctcctgcaggacgcctacggccacctccgcgacaaggtgcagctccgcatctggcgccgcccgggccgcgccgtcgaccgcgccaccgccgagcacctcttcgaggtcatcaacgcccgcgaggacgtcctgcgccgcctgatccgccgctgcgcatacctcaagtacgtcgagggccggctcggcgaccgcaccctctacgccgacgagatactcagggacggcttctgcctcaacatgatcgacacgccgctctgcccgctcaaggtcgtcaccaacctgcaggaggccgtctgggacgctgacattgtcatcaacggcctgccgtccacggagaccagggatgtgtttggggagattgggaggtactggaaggagagggttaatgacccagtcatcatctccctcaccaaagggatagaagcgtccctggatccggtgccgcggatcataacgcccacacagatgattagcaatgcaactagggttccattggataatattctgtatcttggtggccctaacattgcctctgaaatatataataaagaatacgctaatgctcgtatttgtggaaccgacaagtggaggaaacctcttgctaagtttttgaggcagcctcacttcattgtgtgggataatagtgatctcatcactcacgaagtcatgggaggtttgaagaatgtatacgccattggtgctggtatggtggcagcattaaccaatgagagtgcaaccagcaagtccgtttactttgcactttgcacatctgaaatgatctacatcacccaccttctggaagaagaacctgaaaaacttgctggcccattgttagctgacacctacgtcacattgttgaaaggtcgaaatgcatggtatggtcataagttagctaaaggggaattgactctagaaatgggtgatagcataaaaggcaaagggacaattcagggtgtctctgcagtcgatgcattttataaactcctcagtcaggatagtttgagtgtaatgcatccagaaggcaacaaatctgttgcgccggttgagatgtgccccatcctgaaaagactttataaaattttgatcaagagggaacttcctactgagtcaattcttcaggctataagagacgagtcgatgtatgatccacgtgaaagaattgagatggcgcagggccactcactttaccgaccatcaattcttggtcaaccacacggggtcgcgaaagcctaggacagattttcctttcctttcccttctttctcgtagttttagacgttttcgaagctttatgtgctcttatgcatgctgttgtaccattggtaagttaaatgaagatttttaattggttgttttaaggaagacctgtttagcgtgttagtagcttgatgtgtttcacgccaatctggcaatcttgtgtatatagaaagtttgctgatttaataattgtaatcatgtatcgtgttccaaatggaaaaacgatccaatcatatactccctctatgtgtttcaaatgcagccttgttcagaacttc

SEQ ID NO: 3855 - DNA, 1677 bp, Pennisetum glaucum
gggtggtggtggtggtgtagcttgcgcacctgcgcttccccttgttgctcgcggcgagacgcgagggtgccggcggcggaggcaatgggcggagcggaggggccgggccaccacccgaacggccacacgaacgggtccgtggcggaggagaagctggacgagctgcggcggcagctggggaaggcggacggggacccgctccggatcgccggcgtcggggcgggcgcctggggcagcgtcttctgcgcgctgctgcaggacgcgtacggtcacctccgcgacaaggcgcaggtccgcatctggcgccgccccgggcgcgccgtcgaccgtgccaccgcggggcacctctttgacgtcatcaacgcgcgggaggacgtcctgcgccgcctgatccgccgctgcgcctacctcaagtacgtagaggcgcggctcggggaccgcacgctctacgccgacgagatactcagggacggcttctgcctcaacatgatcgacacgccgctctgcccgctcaaggtcgtcaccaacctgcaggaggccgtctgggacgccgacattgtcgtcaacggcctgccctccaccgacaccagggaggtgttcggggagattgggaggtactggaaggagaggattactccccccatcatcatctccctcgccaaggggatagaggcctccctggatccgctgccacggatcattactcccacgcagatgattagcaatgcaactggggttcctctggagaacattctatatcttggtggcccaaatatcgcttctgaaatttacaacaaagaatatgcaaatgcgcgtatttgtggagctgacaaatggagaaaacctcttgcgaagtttttgaggcagccccattttattgtgtgggataatagtgacctcatcactcatgaggtcatgggaggcttgaaaaatgtatatgctatcggtgctggtatggtagcagcactaacaaatgaaagtgcaacaagcaaatctgtttactttgcactttgcacgtctgagatgatctacatcacacaccttctggaagaagaacctgaaaaacttgctggaccattgttagcagacacatatgtcacactgttgaaaggtcgtaacgcatggtatgggcacaagttagctaaaggggaattgacattagaaatgggtgacagcataaaaggcaaagggaccattcagggtgtttctgcagttgatgcgttttatgagcttcttagtcaggatagcttaagtgtgatgcatccagaagccaacagatctgttgcgccagttgagatgtgcccaattttaaaagcactacacagaatcttgattaagagggaccgtcctgctgattcgattcttcaggctataagagatgagacaatgtatgatccacgtgaaagaattgagatggcacaaggtcactcactttaccgaccatctcttctcggtcaaccaaaagatgtaaaagtctagaattaaccttcccaccgtttgttattgggtagaatttagacgatctaagatctatgtcgctatgtgcttatgcacgatgttcatgttgttgtaacttgagtgaaatctgagaggatctgagctgctttgatgtgtttcaagtcttccttatatgtatataacatgtgtgttgattcaatggcaataatttgtgcttgg

SEQ ID NO: 3856 - DNA, 2120 bp, Oryza sativa
cgtcgctctccggtctcacgcgccgcgcggccgcagcagcaacaacaacaacaacccgttttgaccgcgccttcctcctccgccggcccgcgcgctcgccgcgcgcggccgccacgggtttctctctagaagccccgcacgaattttatccgttttttcgcattctccccgcctcatctcctccttgacaccgacctctcctcctcggctcggggaattcaaacgcgcggcctcgccgggtggcctcgcctcgcctcgccgcgttccgacagcgagtgccccgctggtgccactatttcttgccgccccaacccctcgcatcgatcccccacacccacatctcgcctcctcttcctcgatcctttgtcttcttgcttagctagctctgccatggtggggagctacgcggcgggagggggacggggagcggcagtggcggcggtggcggaggggaagctggacgagctgcggcggaggatggggaaggcggacggcgacctgctgaggatcgtcggggtggggggcggggcgtgggggagcgccttctgcgcgctgctgcaggacgcgtacgggcggcaccgcgacaaggcgcaggtgcgggtgtggcggaggcccgggcgcgccgtcgaccgcgccaccgccgagcacctcttcgaggtcatcaactcccgggaggacgtcctccgcaggctcatccgccgctgcgcctacctcaagtacgtcgaggcccgcctcggcgaccgcacgctctacgccgacgagatcctccgcgacggcttctgcctcaacatggtcgacacgccgctctgcccgctcaaggtcgtcaccaacctgcaggaggcggtctgggacgccgacatagtcatcaacggcttgccctccaccgagaccagggaggtgttcggggagatcgggaggtattggaaggagaggatcagaccccccgtgatcatctcgctggccaaggggatcgaggcgtcgattgaccccgtgccccggatcattaccccgacacagatgatcagcaatgcaactggagttccattggagaatattctatatcttggaggtcctaacattgcatctgagatatataacaaagaatatgcaaatgctcgcatatgtggagctgacaagtggagaaaacctctagctaaatttctgaggcagcctcattttattgtgtgggataatagtgatctcatcactcatgaagtaatgggcggcttaaagaacatatatgccattggtgctggtatggtggctgcactaaccaatgagagtgcaaccagcaaatcggtttacttttcactttgcacgtctgaaatgatatacatcacccatctcctagccgaagaccctgagaaacttgccgggcctttattagccgatacctatgtaacactgctgaaaggtcgtaatgcatggtatgggcagaaattagctaagggtgaactgactcttgaaatgggggacagtatcaagggcaaagggactatccagggtgtctctgcagtccatgcattttatgagctcttgagccagagtagcttaagcgtgacacatccagaagtgaagaagcttgttgctccggtcgagctgtgcccaatactaaaaacactttataaaatcctaatcaagaggttggtcagattacctttgttgctgttcctgctagtactaatatatgtgtacaggcttaagttctttgcacatttcacctgcagggagcttgccactgactccattctccaggcaatacgagatgaatcaatgtatgatccacgggagaggattgagatgtctcagcgccagtgtctttaccgaccatctcttcttggcctacctaaagtagatattacccaggcttagatctattcttttttttttctgcagatttgttttgagatttgcaggattctttgatgtattctttgcatagtggtcctcaagatccttccttgtgtgccaagtgcatctcgtgttcgaacactgattccattctctactagagaatttgataatgaggtgttttggttttttattgtcagagttccaaatagtttcacgggctgatgccccccacatgtgtatataaagtacaaccactgttgattcaa

SEQ ID NO: 3857 - DNA, 2056 bp, Sorghum bicolor
acaaggcccaactcgatttcgcacggcccaggtcactgttctctcttccttcgtggcgaaggcgacgtgtaccggcgcacgaacccaaccggcaaccgcgacagaggcggccgggccggcagcaagccccgcctccctcgggctctccggccgtcgctttgtttctgccacctcgccgcgattcggcggccaaacccacccgaattcgcgtcgatctgagcgagctcgtttctgctaaaaggaaaagccatccgctcctttctctctcccgagtttgttattattatagctttgcttccgtcgcgtgatccaaccttccccgtctcttcggccgaacgagtcagaccgggcaggttatgtagcctgccttgcttgcggcgagaggcgagagtggaagaggaggtcaaggcaataatgggcggggcggaggggcttgggcagccggacggccacgcgaacggggcggccgtggtggaggagaagctggacgcgctgcggcggcagctggggaaggcggacggcgacccgctccggatcgtcggcgtcggggcgggcgcctggggcagcgtcttctgcgcgctgctgcaggacgcgtacggccacctccgcgacaaggcgcaggtccgcatctggcgccgcccgggccgcgccgtcgaccgcgccaccgcccagcacctcttcgacgtcatcaacgcgcgcgaggacgtcctgcgccgcctgatccgccgctgcgcctacctcaagtacgtcgaggcgcgcctcggcgaccgcacgctctacgccgacgagatactcagggacggcttctgcctcaacatggtcgacacgccgctctgcccgctcaaggtcgtcaccaacctgcaggaggccgtctgggacgccgacattgtcgtcaacggtgtgccgtccacggacaccagggaggtgttcggggagattgggaggtactggaaggagaggatcactgcccccataatcatctccctcgccaagggaatagaggcctcgctggatccactgccacggatcataactcccacgcagatgattagcaatgcaactggagttccaatggagaatattctttatcttggtggacctaatattgcttctgaaatttacaacaaagaatatgcaaatgcacgtatttgtggagctgacaaatggagaaaacctcttgcaaagtttttgaggcagcctcattttattgtgtgggataacagtgatctcatcactcatgaagtcatgggtggcttaaaaaatgtctatgctattggtgctggtatggtagctgcactaaccaacgagagtgcaaccagcaaatccgtttactttgcactttgcacatctgagatgatctacatcacacatattctcgaagaagaacctgaaaaacttgctggacccttattagctgacacttatgtcacattgttgaaaggtcgtaatgcatggtatgggcagaagttagctaaaggtgaattgacattagaaatgggtgacagtattaaaggaaaagggaccattcagggtgtctctgcagttgaagcgttttatgagcttcttagtcaggatagcttaagtgtcatgcatccagaagccaacagatctgttgcgccggttgagatgtgcccgatcctaaaagcactacataggattttgatcacgagggaccgtcctgctgattcgattcttcaggctataagagatgagacaatgtatgatccacgtgaaagaattgagatggcacacggccattcactctaccgaccatctctgcttggtcaaccaaaagatgtcaaaacctagaatttattttctttccctttcccttgttggttagaacttagacgatcttgtgagttgctatatgtttatgcacggtgtaattgttgttgtaacattagtgagctctgagaagggacctgattcatgttagcttggtaaatattagtagccttgtatgatgcagggcatgattttaggggaaaaaaaataaaaccgatttcatatgttttctgagttaagaaattctatgaatttccttagattaaat

SEQ ID NO: 3858 - DNA, 2166 bp, Hordeum vulgare
gcagtgggggatctggcgccggtgcgagggcagggcacggcgccaggtccgccatggcaaactacccaaatccgacaccatcaccaacccaccatcatcagtccgtcaccgtccgtgcgacctccggatcctcgaatccgcctcgcctaccccgtccccgtccttttcttaccgcgccccgcctccgctcacccacctgccacctcccgctccgccgtgacgcggcggatcccagaaaagaaatcccccaccactccgctttcgacgcgaggatcgcccgaccggcgagcgaaaccgcgccaccaaccggcgaccgctcgggcaggcgagccgcggcccgcctcggtctctccggcagacagtccgcgtcacccccgtcgcaattcggcggccagacccacgcaaattgcgtccttttctcgtcttcttcctcccgaagcggcgcgcagaggaggagccgaggaagcaatgggcggagccgaggacgggacgcacgcgtccaacgggcacgccaatggggccgtggaggacaaggtggacgagctgcggcggttgatggggaaggccgacggggacccgctccggatcgtcggcgtcggggccggggcctggggcagcgtcttctgcgcgctcctgcaggacgcctacggccacctccgcgacaaggtgcagctccgcatctggcgccgccccggccgcgccgtcgaccgcgccaccgccgagcacctcttcaacgtcatcaacgcgcgcgaggacgtcctgcgccgcctgatccgccgatgcgcctacctcaagtacgtcgagggccgcctcggggaccgcacgctctacgccgacgagatactcagggacggcttctgcctcaacatgatcgacaccccgctctgcccgctcaaggtcgtcaccaacctgcaggaggccgtctggaacgctgacattgtcatcaacggcctgccctccacggagacgaggggcgtgtttggggagattgggaggtactggaaggagagggttaatgcccctgtgatcatctcgctcacgaaagggatagaagcatcagtggatccggtgccgcggatcataactccgacacagatgatttgcaatgcaactaaggttccattggataatgttctgtatcttggtgggcctaacattgcgtctgaaatatacaataaagaatatgcgaatgctcgtatttgtgggactgacaaatggaggaaacctcttgctaaatttttgaggcagcctcattttattgtctgggataatagcgatctcatcactcatgaagtcatgggaggtttgaaaaatgtgtacgccattggtgctggtatggtggcagcactaaccaatgagagtgcaaccagcaagtctgtttattttgcactttgcacatccgaaatgatctacatcacccaccttctggaagaagaacccgaaaaacttgctggaccattattagctgacacttatgtcacattgttgaaaggtcgtaatgcttggtatggacataggttagcaaaaggggagctgactctggaaatgggtgatagcataaaaggcaaagggacaatccagggtgtctctgcggtcgatgcattttataaccttctcagtcaggatagtttgagtgtaatgcatccagaagccaacaaatctgttgcgccagttgagatgtgccccatcttgaaaacactttataaaattctgatcaagagggaacttcctactgagtcgattcttcaggctataagagatgagtcaatgtgtgatccgcgcgaaagaattgagatggcacggggccagtcactctaccgaccatctattcttggtcaaccaaatggagatgtgaaagcctagacagattctcccatctttttccttctttctgttagtcgctagacgttttcgaagccctatgtgctcttgtccattcagctgctgcttctgctgctgttgttgtaacattagtaagttcagttaagaactttagttgactattctgaggaagatgtgttgagtgtgttagtagcttgatgtggttcacaccatcttgtgtatataaagcgatttaataaatgctattattctataatatcctatttgaaatggaaaaaacaatacaatcatatattgtgcttcaaataggggaccactttgtac

SEQ ID NO: 3859 - DNA, 2153 bp, Hordeum vulgare
gccggtgcgagggcagggcacggcgccaggtccgccatggcaaactacccaaatccgacaccatcaccaacccaccatcatcagtccgtcaccgtccgtgcgacctccggatcctcgaatccgcctcgcctaccccgtccccgtccttttcttaccgcgccccgcctccgctcacccacctgccacctcccgctccgccgtgacgcggcggatcccagaaaagaaatcccccaccactccgctttcgacgcgaggatcgcccgaccggcgagcgaaaccgcgccaccaaccggcgaccgctcgggcaggcgagccgcggcccgcctcggtctctccggcagacagtccgcgtcacccccgtcgcaattcggcggccagacccacgcaaattgcgtccttttctcgtcttcttcctcccgaagcggcgcgcagaggaggagccgaggaagcaatgggcggagccgaggacgggacgcacgcgtccaacgggcacgccaatggggccgtggaggacaaggtggacgagctgcggcggttgatggggaaggccgacggggacccgctccggatcgtcggcgtcggggccggggcctggggcagcgtcttctgcgcgctcctgcaggacgcctacggccacctccgcgacaaggtgcagctccgcatctggcgccgccccggccgcgccgtcgaccgcgccaccgccgagcacctcttcaacgtcatcaacgcgcgcgaggacgtcctgcgccgcctgatccgccgatgcgcctacctcaagtacgtcgagggccgcctcggggaccgcacgctctacgccgacgagatactcagggacggcttctgcctcaacatgatcgacaccccgctctgcccgctcaaggtcgtcaccaacctgcaggaggccgtctggaacgctgacattgtcatcaacggcctgccctccacggagacgaggggcgtgtttggggagattgggaggtactggaaggagagggttaatgcccctgtgatcatctcgctcacgaaagggatagaagcatcagtggatccggtgccgcggatcataactccgacacagatgatttgcaatgcaactaaggttccattggataatgttctgtatcttggtgggcctaacattgcgtctgaaatatacaataaagaatatgcgaatgctcgtatttgtgggactgacaaatggaggaaacctcttgctaaatttttgaggcagcctcattttattgtctgggataatagcgatctcatcactcatgaagtcatgggaggtttgaaaaatgtgtacgccattggtgctggtatggtggcagcactaaccaatgagagtgcaaccagcaagtctgtttattttgcactttgcacatccgaaatgatctacatcacccaccttctggaagaagaacccgaaaaacttgctggaccattattagctgacacttatgtcacattgttgaaaggtcgtaatgcttggtatggacataggttagcaaaaggggagctgactctggaaatgggtgatagcataaaaggcaaagggacaatccagggtgtctctgcggtcgatgcattttataaccttctcagtcaggatagtttgagtgtaatgcatccagaagccaacaaatctgttgcgccagttgagatgtgccccatcttgaaaacactttataaaattctgatcaagagggaacttcctactgagtcgattcttcaggctataagagatgagtcaatgtgtgatccgcgcgaaagaattgagatggcacggggccagtcactctaccgaccatctattcttggtcaaccaaatggagatgtgaaagcctagacagattctcccatctttttccttctttctgttagtcgctagacgttttcgaagccctatgtgctcttgtccattcagctgctgcttctgctgctgttgttgtaacattagtaagttcagttaagaactttagttgactattctgaggaagatgtgttgagtgtgttagtagcttgatgtggttcacaccatcttgtgtatataaagcgatttaataaatgctattattctataatatcctatttgaaatggaaaaaacaatacaatcatatattgtgcttcaaataggggaccactttgtacagat

SEQ ID NO: 3860 - DNA, 2126 bp, Secale cereale
atcctcgaatccgtcccgcctaccccctcccgtccttttcttaccgcgccccggctccgctcacccacctgccacctcccgctccgccgtgacgcggcggatcccagaaaagaaaagaaattctccgatcccccaccacctcgctttcgacgcgaggatcgcccgaccggcgagggaaaccgcgccaccaagcgccgaccgctcgggcaggcaagccgcggcccgcctcggtctctccggcgtcacccccgtcgcaattcggcggccagacccacgcaatttgcgtccttttctcgtcttcttcctcccggttagttataacctgcctgcccgtacttggaacaaccgaacgagtcagacaggttatgtagaggtggcttgcgcggctggccttggttttgcttgcggcgagaagcgaggggaaggaggagccgaggaagcaatgggcggagcggaggacggggcgcacgcggcggggggccacgcgtcgaacgggcacgccaatggggccgtggaggacaaggtggacgagctgcggcggctgatggggaaggccgacggggacccgctccggatcgtcggcgtcggggccggggcctggggcagcgtcttctgcgcgctcctgcaggacgcctacggccacctccgcgacaaggtgcagctccgcatctggcgccgccccggccgcgccgtcgaccgcgccaccgccgagcacctcttcgacgtcatcaacgcgcgcgaggacgtcctgcgccgcctgatccgccggtgcgcctacctcaagtacgtcgaggcccgcctcggggaccgcacgctctacgccgacgagatactcagggacggcttctgcctcaacatgattgacaccccgctctgcccgctcaaggtcgtcaccaacctgcaggaggccgtctggaacgctgacattgtcatcaacggcctgccgtccacggagacgagggatgtttttggggagattgggaggtactggaaggagagggttaatgccccagtcatcatctcgctcaccaaagggatagaagcatccctggatccggtgccgcggatcataactccgacacagatgattagcaacgcaactaaggttccattggataatattctatatcttggtggccctaacattgcgtctgaaatatataataaagaatatgcgaatgctcgtatttgtggaactaacaaatggaggaaacctcttgctaaatttttgaggcagcctcattttattgtctgggataatagtgatctcatcactcatgaagtcatgggaggtttgaaaaacgtgtacgctattggtgccggtatggtggcagcactaaccaatgagagtgcaaccagcaagtctgtttactttgcactttgcacatccgaaatgatctacattacccaccttctggaagaagaacccgaaaaacttgctggaccgttattagctgacacttacgtcacactgttgaaaggtcgtaatgcttggtatgggcataggttggctaaaggggaactcactctggaaatgggtgatagcataaaaggcaaagggacaatccagggtgtctctgcagtcgatgcattttataaacttctcagtcaggatagtttgagcgtaatgcatccagaagccaacaaatctgttgcgccagttgagatgtgccccatcttgaaaacactttataaaattttgatcaagagggaacttcctactgagtcgattcttcaggctataagagatgagtcaatgtgtgatccgcgtgaaagaattgagatggcacggggccagtcactttaccgaccatctattcttggtctaccaaatggagatgtgaaagcttagacagattctcctattgctttccttctttctgttagtcgctagacattttcgaagccctatgtgctcttgtccattcggcggctgcttcttctgctgctgctgttgttgtaacattagtaagttcagttaaaaactttagttgactattttgaggaagatgtgttgagtgtgttagtagcttgatttggttcacactatcttgtgtatatagaatgatttaataatgctattattctgtatcctatttgaaatggaaaaacaatacattcacata

SEQ ID NO: 3861 - DNA, 2316 bp, Triticum aestivum
gccggcgccagggcacgccacggctcggcgccagggccgccatggcaaactaccctaatccgacaccatcatcagtccgtcaccccctgcgacctccggatcctcgaatccgtcccgcctacccccgcccgtccttttcttaccgcggccctgctccgctcacccacctgccacctcccgctccgccgtgacgcggcggatcccagaaaagaaaagaaattctccgatcccccaccacctcgctttcgacgcgaggatcgcccgaccggcgagcgaaaccgcgccaccaaccggcgaccgctcgggcaggcaagccgcggcctgcctcggtctctccggccgacaccccgcgtcacccccgtcgcaattcggcggccagacccacgcaatttgcgtccttttctcgtcttcttcctcccggttagtttataacctgcctgcccatccttggaacaaccgaacgagtcagacaggttatgtagtggtggcttgcgcggctggccttggttttgcttgcggcgagaagcaatgggcggagcggaggacggggcgcacgcggcggggggccacgcgtcgaacgggcacgccaatggggccgtggaggagaaggtggacgagctgcggcgggtgatggggaaggccgacggggacccgctccggatcgtcggcgtcggggccggggcctggggcagcgtcttctgcgcgctcctgcaggacgcctacggccacctccgcgacaaggtgcagctccgcatctggcgccgccccggccgcgccgtcgaccgcgccaccgccgagcacctcttcaacgtcatcaacgcgcgcgaggacgtcctgcgccgcctgatccgccgatgcgcctacctcaagtacgtcgagggccgcctcggggaccgcacgctctacgccgacgagatactcagggacggcttctgcctcaacatgatcgacaccccgctctgcccgctcaaggtcgtcaccaacctgcaggaggccgtctgggacgctgacattgtcatcaacggcctgccgtccacggagacgagggttgtgtttggggagattgggaggtactggaaggagagggttaatgccccagtcatcatctcgctcaccaaagggatagaagcatccctggatccggtgccgcggatcataactccgacacagatgattagcaaagcaactaaggttccattggataatattctatatcttggtggccctaacatcgcgtctgaaatatataataaagaatatgcgaatgctcgtatttgtggaactgacaaatggaggaaacctcttgctaaatttttgaggcagcctcattttattgtctgggataatagtgatctcatcactcatgaagtcatgggaggtttgaaaaatgtgtacgctattggtgctggtatggtggcagcactaaccaatgagagtgctaccagcaagtctgtttactttgcactttgcacatccgaaatgatctacatcacccaccttctggaagaagaacccgaaaaacttgctggaccgttattagctgacacttatgtcacattgttgaaaggtcgtaatgcatggtatgggcataagttagctaaaggggaactgactctggaaatgggtgatagcataaaaggcaaagggacaatccagggtgtctctgcggtcgatgcattttataaacttctcagtcaggatagtttgagtgtaatgcatccagaagccaacaaatctgttgcgccagttgagatgtgccccatcttgaaaacacttcataaaattttgatcaagagggaacttcctactgagtcgattcttcaggctataagagatgagtcgatgtgtgatccgcgtgaaagaattgagatggcacgggggcagtcactttaccgaccatctattcttggtcaaccaaatggagatgtgaaagcttagacagattctcctatcgttttccttctttctattagtcgctagacgttttcgaagccctatgtgctcttgtccattcgggggctgctgcttctgctgctgttgttgtaacactagtaagttcagttaaaaactttagttgactattttgaggaagatgtgttgagtgtgttagtagcttgatgtggttcacaccatcttgtgtatatagaacgatttaataatgctattattctgtatcctatttgaaatggaaaaacaatacaatcacatttcatgctttgaatagaggaccactttgtacagatattttacgcttgttatgaatgatacaccctctattttttcaacagatttgattacctgctcgaacagatgtga

SEQ ID NO: 3862 - DNA, 2439 bp, Cocos nucifera
gagggagagagggcgagaggggtccgacccaaggagaagcggcggctcttggcgtctccgacacggaagcaaaaggaaagggcggtgcttcccatgaatcgaggttgaatgaccaaaacccccacgttggctccaaaattgcgtgtcaatggatcgccgcgtgcgttttccacgttctttctggcaggaatttgatggagaaacatttgagcgtctgagtggaaaaattcatgtgagaacgccttttttaagattgttggtttgaatagttccactcggagggatcgaattcgctggtctgtggacgtttctctcgtcaaagttcgatctttttgaattcttatctggttttgcttctgattctgttctacttgctggatcccttgatttccattctggttttgtgtttatattgggaagatagatagatttatcttgtgggaagcatttaaaagagctaaaataaataaataaataaataaagtctgttttttggtattggatttgtttttagtaaatcattcctctcagaattgcgaaagttcgcgttgtgttagctgttttgcttgaagaaagatggttggaagtgtcgtaggagtccacagttctcctcactccaatggttctgttcaccactccaatggtgcggaggataagctcgatgagctccgtcggctgctcggcaaatcagaaggcgatccgctaaagattgttggcgtaggtgctggcgcttggggcagtgtctttgttgccctactgcaggatgcctacggccacttccgcgataaggtccagataagaatatggagaaggcctgggagacccgtcgataggtgcactgcagagcatctctttgaggtgatcaattccagggaggatgtcttgaggcgtttgatccggcgatgtgcttacttgaaatatgttgaggggaggcttggggatcgcacactgtatgcagatgagatcctgagggatggcttctgcttgaacatgatcgatacgccgctttgtccgctgaaggttgtgacaaatttgcaggaggcggtctgggatgccgacatcgtggtgaacggtttgccatcgacagagacacgagaggtgtttgaggagattggtaggtattgggaggaaaggacaagggatccagttataatatctttggcaaagggtatagaggcagctctggatccagttccgcatataataactcctacacaaatgattagccatgcaactggggttccaattgagaacattctgtatcttggaggcccgaatattgcttcggagatttataacaaggaatatgctaatgctcgaatatgtggagctgttaagtggaggaaacccctcgctcagtttttgaggcagccacatttcattgtgtgggacaacagcgatctcatcacgcacgaggttatgggaggactgaagaatgtgtatgccattggtgctgggatggtagctgctctaaccaacgagagtgcaactagcaaatcagtatattttgctcactgcacatctgaaatgatattcatcactcacctgttggcagaagaaccagaaaaacttgctggtccgttgcttgcagacacttatgtaaccttgttgaaaggtcgcaatgcttggtatggacagatgttagccaagggcgaactgagtctggacatgggtgatagcatcaaagggaaagggaccattcagggtgtttctgctgttgatgcattttatgaactcctaagtcaatccagcttaagtgtgttacatcctgaagagaacaagcccgttgctccagttgagctgtgccccttcctgaaaacactttacaagatattgattaaaagggaacttttaacaccggcaattcttcaggcattaagagatgagacgatgtatgatcctcgtgaccgaattgagatggcacagagtcatgctctctatagaccgtcacttcttggccaaccttgacaaggaatcctctcttattggaggtaccatgtgattggaaggagatttaggtcatgcatgttgttatttcaatttgtaatgagcttgtgagagctgtgacatataaagtatctgcttataatgcatgttagtgaaatcttggttcatattgtttggatcattattttctatgttacatttgcagtcttaaatagactttattgaaataaaaagagtcaaatggttttttaattcatttgagttgcaagccaatgatgcatataagactgcacaaatataggttatcagacttacaatttggtgcacattcagaaaagttcgctgcagaatcctaacaacttatttaccatgcacagatcttccagcagccattatataacccaaattcttgagaggatactcatatacaaccacatagactctcaattatatgtaaacatcttagtgttaacattcaaagtactgacaaac

SEQ ID NO: 3863 - DNA, 2136 bp, Ananas comosus
gtggggatcgaatttggggggttttttccggatcacccagttgtcaaaatcccatcttttgattgtctcgtgagtcggttgtgaatttctttgcgatttttggttgttggtggaattggagtaattggtgcaaggaggtaggaggagctctagaacaaaacggcgccctttttagttgttgccgtatagtttttcaacaagcttagagtaaatcttgggtatttttgaacttttgttgtgtagttcttcttacttaattcaacatggtgagcactgttgaaggagtccatagttcaccttacgccaatggctcctctcaccactcgaacggcgtcgaagagaagctcgacgagctccgccgcctcctcgggaaatccgagggtgatctcttaaagatcgtcggtgtgggcgccggcgcgtggggcagcgtgttcgccgcccttctgcaagacgcctacggccacctccgggagaaggtgcagatacggatttggcggcggcccggccggccggtcgaccgcgccactgcagagcatctcttcgaagtaatcaattcgagggaagatgtcctgcggcgcttgatcagacggtgcgcgtacttgaagtatgtcgaagctcggctaggcgatcgaacgctttacgcagatgagattttgagggacggattttgtttgaatatgatcgacacgccgctttgtcagttgaaggtcgtgacgaatttgcaggaggcggtgtgggacgcggatattgtgataaatggattgccttcgacggagacgagggaggtgtttgaggagatcggtaagtattggaaggagaggattaccgtgccgataatcatatccctggccaagggtatagaagcgtcgctcgatccggttccgcgtataataactcccacggaaatgattaaccgtgctactggaattccaattgagaacattctatatcttggagggccaaacatcgcttcggagatttataacaaggaatatgcaaatgctcgaatctgtggagctgagaagtggaggaaacctctcgctaaatttttgaggcagccacatttcatcgtgtgggataacagcgaccttgtcacgcatgaagttatgggaggcttaaagaatgtatatgctattggtgccggtatggtagccgctttgaccaacgagagtgcgactagcaaatcagtgtactttgctcactgcacatctgaaatgatattcatcactcacctcttagcagaagagcccgagaaacttgccgggccattattagcggatacttatgtaactttattgaaaggtcgcaatgcttggtatggacagatgttggccaagggggaattgagtctagatatgggtgacagcatcaaaggaaaaggaacaattcagggcgtctctgctgtgaatgcattttatgagctcctgagtcagaccagcttaagcgtgttgcatcccgaagcgaagaaacacgtcgctccagtggagctctgccccatcctgaagaccctctacaaaattttgatcaaaagggatctgtcgaccgcgtcgattcttcaggcattaagagacgaatccatgtacgatcctcgcgacagaatcgagatggcgcagagccacgcgctctatcgaccgtcacttcttggccaaccttgagcaagcagcaacttctttaaagaggccctcattgcgcttgttatgtgagcttgttggcactggtgcatatatattactttcgataaagtggtcgtagtttttgacgagtgaattttcttcttttttctacttaatcacataaattgtgtaatatacagttcctgcagttgagtgtctcttcctttctctgttctttctattttttatttcctttgttatgataagaagggagtgtgactctgtaaacttggagaaaaggaagaatgaaatacaacttctgtttccagaactttgtgcagcagcatatcatttttcggccttccatgactcttcttattttgaagttatgagtttcgtgtgacacaactatcttggcttcaggcttagtttgataatgaggtgaccaaaaggatctgttttactggaatttttgttctctgatactaatatcggcggagaacgcgagttagaaagcatttca

SEQ ID NO: 3864 - DNA, 1987 bp, Elaeis guineensis
caaggagaagcggcggctcttggcgtctgcggcacggaagccaaagtgaagggcggtgcatttgatggagagagaaacatttgagagtctgaatggaaaaatccgcgtgagaacgccttttaagattgtcggttggaatggttctactcgttgggatcgacatcgaattcgctggtctgtggacgtttcttccgtcaaagtccggtctttataagtgctggattccttgatgtccaatctggttttctgtttatattgggaagatagatagatttatcttgtgggaagcatttaaaagatctaaaaaaaggtctttttggcattggatttgtttttagtaatcattcctctcagaattgtaaaagttcgtgttgttttagctgttttgcttgaagaaagatggttggaagtatagtaggagtccacagctctcctcactccaatggttctgttcattactccaatggcgcggaggagaagctcgatgaactccatcggctgctcggcaaatcagaaggcgatcccctaaagattgttggcgtaggtgctggcgcttggggcagtgtctttgttgccctgctgcaggatgcctatggccacttccgcgataaggtccagataaggatatggagaaggcctgggagacccgtcgataggtctactgcagagcatctcttcgaggtgatcaattcaagggaggatgtcttgaggcgtttgatccggcgatgtgcttacttgaaatatgttgaggggaggctcggggatcgcacactgtatgcagatgagatcctgagggatggcttctgcttgaacatgatcgatacgccgctttgtccgctgaaggttgtgacaaatttgcaggaggcggtctgggatgccgacatcgtggtgaatggtttgccatcgacggacacacgagtggtgtttgaggagattggtaggtattggaaggagaggacaagggatccagttataatatctttggcaaagggtatagaggcagctttggatccagttccacatataataactcctacacaaatgattagccatgcaactggggttccaattgagaacattctgtatctcggaggcccgaatattgcttcagagatttataacaaggaatatgctaatgctcgaatatgtggagctgttaagtggaggaaacccctcgctaagtttttgaggcagccacatttcattgtgtgggacaacagtgatcttatcacgcacgaggtgatgggaggactgaagaatgtgtacgccattggtgctgggatggtagctgctctaaccagcgagagtgcaactagcaaatcagtatatttcgctcactgcacatctgaaatgatattcatcactcaccttttggcagaagaaccagaaaaacttgctggtccgttgcttgcagacacttatgtaaccttgttgaaaggtcgcaatgcatggtatgggcagatgttagccaagggcgaactgagtctggacatgggtgatagcatcaaagggaaagggaccattcagggtgtttctgctgttgatgcattttatgaactcctaagtcaatccagcttaagtgtgttacatcctgaagagaacaagcctgttgctccagttgagctgtgccccatcctgaaaacactttacaagatattgattaaaagggaacttttaacaccagcaattcttcaggcattaagagatgagaccatgtatgatcctcgtgaccgaattgagatggcacagagccatgctctctatagaccatcacttcttggccaaccttgacaaggaatcctctcttattggcggtaccatgcgattggatggagatgtcatgcatgttgttatttcaatttgtaatgagcttgtgagagctgtgacatataaagtatctgcttgtaatgcatgttagtgaaattttgttcatattgtttggatcattatttcctatgttacattttacagtcttaataaactttat

SEQ ID NO: 3865 - DNA, 2018 bp, Oryza sativa
acttcgtcgctcgctcgctcattaatggcggccactgcatcgttggcgccgtccatctccattaatgcctccatccacctcgcccatccctacactctactactcctccacttaacaagatgagctgagcgccagcttctcggcacgggccgttgcatcctctccattccatccaccacccacccacccatccaacctccgcccccggtatccttgagctggaggaggtggtggtggtggatcacctgttcttgggattctgctgctgcgagtgcgtgcattgtggtggggggtgtttggttcttggttggtgagcggtgtttgaagcggtttcgcgcgtggtcgttgggtgatgcgagagctgggaagctgtgaaagcctcgcgcttaagatggtcgggagcgtgcacgtgaatggatcggtgaacggcggcaatggcaccgaggagaggctcgacgagctgcgccgcctgctcggcaagtccgacggcgacttgctgaagatcgtcggcattggcgccggcgcgtggggcagcgtcttcgccgccctgctgcaggacgcctacggccgtttccgggagaaggttcagatacggatatggcgccgggcggggcggtcggtggaccggaccaccgcggagcatctgttcgaggtgatcaactcgagggaggacgtgctgaggcggctcatccgccgctgcgcctacctcaagtacgtcgaggcgcgcctcggcgacaggacattgtacgccgatgagatactgagggacggcttctgcctgaacatgatcgacacgccactctgccctctcaaggtggtcaccaacctgcaggaagctgtctgggatgctgacattgtggtgaacggccttccatccaccgagacgagggaggtgttcgaggagatcagcaagtactggaaggagcggatcagcgttccggtgataatctcgctcgcaaaggggatagaagcatccttggacccaattcctcgtatcattacgcccacgcagatgattagttctgcaactggagttccaactgagaatatactatatcttggaggcccaaacattgcctcagagatttataacaaagaatatgcaaatgctcgaatctgtgggtccaacaagtggaggaaacctctcgctaagtttctgagacaaccacatttcattgtctgggataacagtgatcttgttacacatgaggtgatgggtggtttgaagaatgtctacgccatcggtgctggaatggttgcagctttaactaatgagagtgcaacaagcaagtcggtgtattttgctcattgcacgtcagagatgatattcattactcatttgctcacagaacaacctgagaaacttgctggccctctgctggctgatacttatgttactctcctgaaaggtcgcaatgcgtggtatgggcaaatgctagcgaagggagaactgagccctgacatgggcgacagcatcaaggggaaggggatgattcagggtatctctgctgttggtgcattttttgagcttctcagtcaacccagcttaagtgtgcaacacccagaggaaaataagcaagttgcacctgctgaactgtgcccgatcttgaagaggctctatagaatactaataaaaagggagctctcgacaagagatattctgcaagccctgagagatgaaaccatgaatgatcctcgtgaaaggattgagatggcgcaaagccatgcattctaccgcccatctctcctaggaaaaccatgacctgttcgtcctgtatatgattagaacataaacaaggttggatgagacctctagtttgacatgcttagcatcattcgttattaagcctgaagaaggtgattgtcgctggcctatgtgtgaactgtgaatcccaatggggcttatttttctggaattgttagtactttgattatcatgccgtacaacagtacaagagagagtgcacagagtcaataaagaatttcctacacacgccatgtgtgagtttcatgggggc

SEQ ID NO: 3866 - DNA, 2141 bp, Oryza sativa
gggagcaggagaaccttcgtcgtctctcgcccacttcgtcgctcgctcgctcattaatggcggccactgcatcgttggcgccgtccatctccattaatgcctccatccacctcgcccatccctacactctactactcctccacttaacaagatgagctgagcgccagcttctcggcacgggccgttgcatcctctccattccatccaccacccacccacccatccaacctccgcccccggtatccttgagctggaggaggtggtggtggtggatcacctgttcttgggattctgctgctgcgagtgcgtgcattgtggtggggggtgtttggttcttggttggtgagcggtgtttgaagcggtttcgcgcgtggtcgttgggtgatgcgagagctgggaagctgtgaaagcctcgcgcttaaggtgctcgatcaattgccgctgagagcgcacgcctctgatttcgctgctgaattacggctgttggcgagaggagacagatggtcgggagcgtgcacgtgaatggatcggtgaacggcggcaatggcaccgaggagaggctcgacgagctgcgccgcctgctcggcaagtccgacggcgacttgctgaagatcgtcggcattggcgccggcgcgtggggcagcgtcttcgccgccctgctgcaggacgcctacggccgtttccgggagaaggttcagatacggatatggcgccgggcggggcggtcggtggaccggaccaccgcggagcatctgttcgaggtgatcaactcgagggaggacgtgctgaggcggctcatccgccgctgcgcctacctcaagtacgtcgaggcgcgcctcggcgacaggacattgtacgccgatgagatactgagggacggcttctgcctgaacatgatcgacacgccactctgccctctcaaggtggtcaccaacctgcaggaagctgtctgggatgctgacattgtggtgaacggccttccatccaccgagacgagggaggtgttcgaggagatcagcaagtactggaaggagcggatcagcgttccggtgataatctcgctcgcaaaggggatagaagcatccttggacccaattcctcgtatcattacgcccacgcagatgattagttctgcaactggagttccaactgagaatatactatatcttggaggcccaaacattgcctcagagatttataacaaagaatatgcaaatgctcgaatctgtgggtccaacaagtggaggaaacctctcgctaagtttctgagacaaccacatttcattgtctgggataacagtgatcttgttacacatgaggtgatgggtggtttgaagaatgtctacgccatcggtgctggaatggttgcagctttaactaatgagagtgcaacaagcaagtcggtgtattttgctcattgcacgtcagagatgatattcattactcatttgctcacagaacaacctgagaaacttgctggccctctgctggctgatacttatgttactctcctgaaaggtcgcaatgcgtggtatgggcaaatgctagcgaagggagaactgagccctgacatgggcgacagcatcaaggggaaggggatgattcagggtatctctgctgttggtgcattttttgagcttctcagtcaacccagcttaagtgtgcaacacccagaggaaaataagcaagttgcacctgctgaactgtgcccgatcttgaagaggctttatagaatactaataaaaagggagctctcgacaagagatattctgcaagccctgagagatgaaaccatgaatgatcctcgtgaaaggattgagatggcgcaaagccatgcattctaccgcccatctctcctaggaaaaccatgacctgttcgtcctgtatatgattagaacataaacaaggttggatgagacctctagtttgacatgcttagcatcattcgttattaagcctgaagaaggtgattgtcgctggcctatgtgtgaactgtgaatcccaatggggcttatttttctggaattgttagtactttgattatcatgccgtacaacagtacaagagagagtgcacagagtcaataaagaatttcctacacacgccatgtgtgagtttcatgggggcttattttcctggaa

SEQ ID NO: 3867 - DNA, 2324 bp, Brachypodium distachyon
aaaggcaatagagaaagcacgagcagctcgggaaggagcgagcgggcggcaacaccttcctcttcctcccccactcatttaatggcggccacagcttggttggcgccatcgtctacctccatcaatgcctccacccacctcccccatctcgtacagtcctacttaacacaagcccccgcgctcggggccgttgcatccatgacccatccacccaccgccacctccacctcatcacttatccacccccggcctcaccgccaggccagctccgcctccgcggctctcgagctggacggtgggtggacacgtttaaggccgcggctttgccgttgctctgcttttgctttacccgcttcgatcgatctgctttactcttatccttgctcctctgagcgcggggttctcggtgttgcgtttgatttcgcgttccacggttctgtggttgtaggtggtggtggatgaccagctctcggaattcctccggcgggattggggtcttgttaggttcgtgtttggtgagcgattttcgcgcgttgttgggtgacgcgagcgtcgggccttaaggtgttcgagtaattgccgaggagagcagagcacacacaaacatttttcagcatttttttggttcgccgctggatttatttccctattgcctattggtttgcgtgagggggagatggtggggagcgtgcacgtcaatggatcgctgaacggcgccaatggcaccgaggagcggctggacgagctgcggcggctgctcggcaagtccgagggcgacttgctgaagatcgtcagcgttggcgccggcgcctggggcagcgtctttgctgctcttctgcaggacgcctatggccatttcagggagaaggtgcagatacgggtctggcgccggccggggcgggcggtcgaccggtccaccgcggagcatctcttcgaggtgatcaactcgagggaggacgtgctgaggcgcctgatccgccggtgcgcctacttgaagtatgtcgaggcgcggcttggggaccggaccttgtacgccgatgagattttgagggatgggctgtgtttgaacatggtcgacacgccactgtgcccgttgaaggtggtcactaacctgcaggaagctgtctgggatgctgacattgtggtgaatgggctgccttccaccgagacacgggaggtgtttgaggagatcagcaagtattggaaggagcggatcgctgtcccggtgatcatttcccttgcaaaggggatagaagcctccttgggcccaattcctcgtatcgtcacgcctacacagatgatcagttcggcaactggagttccaactgagaatatactctatcttggaggcccaaacattgcctcggaaatttataacaaagaatatgcaaatgctcgaatctgtggatccaacaagtggaggaaaccgcttgctaagtttttgaggcaaccgcatttcattgtgtgggataacagtgaccttatcactcatgaggtgatgggtggcctgaagaacgtatacgctattggcgccggaatggtggcagctttaacaaacgaaagtgcaacaagcaaatctgtgtattttgctcactgcacatcagagatgatattcatcactcatctactgacagaacagccagagaaacttgctggccctctgctggctgatacttacgtaaccctcctaaaaggtcgcaatgcatggtacgggcaaatgctagcgaagggggaactcagtcccgatatgggtgacagtatcaagggaaaggggatgattcagggtatttctgctgttggcgcattttttgagctgctcagtcaacccagcttaagtgtacaacacccagaggaaaacaagcaagttgctcctgctgaactgtgcccaattctgaagaggctttatagaatcctaataaaacgggagctcccggtaagagacattctccaagccctgagagacgaaacgatgaacgaccctcgtgaaaggatcgagatggcacaaagtcatgcgttctaccggccgtctctgcttggaaagccatgacctttgttagtcctgtacatgattagaatgtaaacaaaagttgggttggctccaactcgtgacaaccatttccaattgagcaaggcatctctgggtttcttctactggcttttgtgcttggatcccaggagccttccttagagtggagggtttgtttgtgcgtagtacttcttagtagattaccatgttgtacaatagagtaccatgtcaataaaatatttcctggacaataaacacgagacaagacggttacctccagtaggatgttactggcacc

SEQ ID NO: 3868 - DNA, 1741 bp, Triticum aestivum
gagatggttgggagcgtgcacgtcaacgggtcggtgaacggcgccaacggcaccgaggagcggctggacgagctgcgccggctgctcggcaagtccgacggcgacctgctcaagatcgtcagcatcggcgccggcgcctggggcagcgtcttcgccgccctcctgcaggacgcctacggccacttcagggagaaggtgcagatacgggtgtggcgccggccggggcgggcggtcgaccggtccaccgccgagcatctgttcgacgtgatcaactcgcgggaggacgtgctgaggcgcctcatccgccgctgcgcctacctcaagtacgtcgaggcgcggctgggtgaccggaccctgtacgccgacgagattttgagggatgggttctgcttgaacatggtcgacacgcccctctgcccgttgaaggtggtcaccaacctgcaggaagctgtctgggatgctgacattgtggtcaatggcctgccatccactgagacgagggaggtgtttgaggagctcagcaagtattggaaggagcggatcagcgttccggtcatcatttcccttgcaaaggggatagaagcctccttggacccaattccgcgtatcatcacgcctacacaaatgatcagctccgcagctggcgttccaactgagaatatactctatcttggaggcccaaacattgcctcggaaatttataacaaagaatatgcaaatgctcgaatctgcggatccaccaagtggaggaaacctctcgctaagtttttgaggcaaccgcatttcattgtttgggataacagtgaccttgtcactcatgaggttatgggcggactgaagaacgtatatgctattggtgctggaatggtggcagctttaacaaacgagagtgcaacaagcaaatcagtgtattttgctcactgcacgtcagagatgatattcattacccatctactgacagaacagccagagaaacttgctggccctctgttggctgatacttacgtcactctcctgaaaggtcgcaatgcatggtacgggcaaatgctagcgaagggagaactcaggctcgatatgggtgacagtatcaagggaaaggggatgattcagggtatttctgctgttggtgcattttttgagctgctcagtcaacccagcttaagtgtgctacacccagaggaaaacaagcaagttgctcctgctgaactgtgcccgattctgaagaggctttatagaattctgataaaaagggagctcccagtgggagacatcctccaagccctgagggacgaaaccatgaacgacccccgtgagaggatcgagatggcgcagagtcacgcgttctaccgcccgtcactgcttgggaagccgtgacctcggtagccccgtgtacatgattagaatgtaaacaaaaggcttggattagctccagccctgtcatgcttcacatcatcatcggttgagcaaaggcgtctccgggtttctgctggcttgtgtgtttggatcccaggccccagcggccatagtttgtggggtcgttggactgtcatgttgtacaagagagtaatgatcgagtcaataatatgttgctacttgggcaataaacatgtggcgtgaacgagacacaggttatttgtgtgtttttaacccctgctgctaaattatttgttttcgacgaaatgagatgcaaatagttgtagagctttcgggccggcccgttgttcctctaagtattttacgg

SEQ ID NO: 3869 - DNA, 1778 bp, Secale cereale
cagcacctggagctttctcgggggactggagcgttaggttcgaggttggtgagcgatctcgcgaccctgggcgtgcgcttaaggtgttcgatcgattgccgaccagaacacacacacctttcagaactttttggttctctggatcgggttgcaaggcagagatcagagatggttgggagcgtgcacgtcaatgggtcggtgaacggcgccaacggcaccgaggagcggctggacgagctgcgccggctgctcggcaagtccgacggcgacctgctcaagatcgtcagcatcggcgccggcgcctggggcagcgtctttgctgccctgctgcaggacgcctacggccacttcagggagaaggtgcagatacgggtgtggcgccggccggggcgggcggtcgaccggtccaccgccgagcatctgttcgacgtgatcaactcgcgggaggacgtgctgaggcgcctcatccgccgctgcgcctacctcaagtacgtcgaggcgcggctgggacgaccggaccctgtacgccgatcgagatcttgagggatgggttctgtttgaacatggtcgacacgcccctctgcccgttgaaggtggtcaccaacctgcaggaagctgtctgggatgctgacatcgtggtgaatgggctgccgtccactgaaacgagggaggtgttcgaggagctcagcaagtactggaaggagcggatcagcgttccggtcatcatttcccttgcaaaggggatagaagcctccttggacccaattcctcgtatcatcacgcctacacaaatgatcagttccgcagctggtgttccaactgagaatatactttatcttggaggcccaaacattgcctcggaaatttataacaaagaatatgcaaatgctcgaatctgcggatccaccaagtggaggaaacctctggctaagtttttgaggcaaccacatttcattgtttgggataacagtgacattgtcactcatgaggttatgggtggactgaagaacgtatatgctattggtgctggaatggtggcagctttaacaaacgagagtgcaacaagcaaatcagtgtattttgctcactgcacgtcagagatgatattcattacccatctactgacagaacagccagagaaacttgccggccctctgctggctgatacttacgtaactctcctgaaaggtcgcaatgcatggtatgggcaaatgctagccaagggagaactcaggctcgatatgggtgacagtatcaagggaaaggggatgattcagggtatttctgctgttggtgcattttttgagctgctcagccaacccagcttaagtgttctacacccagaggaaaacaagcaagttgctcctgctgaactgtgcccaattctgaagaggctttatagaattctgataaaaagggagctaccggtgaaagacatcctccaagccctgagggacgaaaccatgaacgacccccgtgagaggatcgagatggcgcagagccacgccttctaccgcccgtctctccttgggaagccgtgacctcggtagccccgtgtacatgattagaatgtaaacaaaaaggcttggattagctcctgccctgtcatgcttcacgtcatcatcggttgagcaaaggcgtctccgggtttcgtttctgctggcttgtgtgttgtgtttggaactttggaccccagcggccatagtttgtgtggtcatgttgtacaagagagtactaatggagtcaataatatgttgctacttggacaataaacatga

SEQ ID NO: 3870 - DNA, 1917 bp, Cocos nucifera
gaagaggaaaagaaagggggaaagaaatatagatttttctggtgagaagcattttagaaaaaaggtggaaaaagtcttgtttttcctggtattgggtttgttttgagtgctcattcatcttagaattgtgaaagtttgtggtgtgtccacctttttgcttgaatagaaatggttggaagtgtagaaggaacccacaggtctccttctcactctaatgggcctgttcactactccaatggtgtggaggagaagctcgacgagctccgccggctgctcggcaaatcagaaggtgatctgctgaagattgttggcattggtgctggtgcttggggcagtgcctttgctgccctcctgcaggatgcctatggccatttccgtgataaggtccagataagaatatggagaaggcctgggagatctgttgataggtctactgcagagcatctgtttgaggtgatcaattcaagggaggatgtcttaaggcgtttgatacagcgatgtgcttacttgaaatatgttgaggccaggcttggggatcgcacactctttgcagatgaaatcctaagggatggcttctgcttgaacatgattgacacaccactttgcccactgaaggttgtgactaatttgcaggaggcagtctgggatgcagacattgtggtgaatggtttgccatcgacagagacacgtgaggtgtttgaggagattggtaggtattggaaggagaggatcagggttcctattattatatctttggcaaagggcatagaggcagctctggatcaggttccgcgtataataactcctacacagatgattagccatgcaactggggtttcgatcgagaacattctgtatcttggagggccaaatattgcttcagagatttataacaaggaatatgctaatgctcgaatatgtggacctgataagtggaggaaaccccttgctaagtttttgaggcagccacatttcattgtgtgggacaacagtgatcttgtcacacatgaggtcatgggaggactgaagaatgtgtacgctattggtgctgggatggtagcggctctaaccaatgaaagtgcgactagcaaatcagtatatttcgcacactgcacatctgaaatgatattcatcacacacctattggcagaggaaccagagaaacttgctggtccattgcttgcagacacttatgtaaccttgttgaaaggtcgcaatgcttggtacgggcagatgttagccaagggggagctgagtgtggacatgggtgatagcatcaaaggaaaagggactattcagggtgtctctgctgtcgatgcattttatgaactcctaagtgaatcgagcttaagcgtgttacatcctgaggaaaacaagcctgttgctcctgttgagctgtgccccatcctgaaaacactttacaagatattaataaaaagggaacttccaacaaaggcaattcttcaggcattaagagatgagaccatgtatgatcctcgtgaacggattgagatgggacagagccatgttctttatagaccatcacttcttggccaaccttgaccgagaatcatctcttattcaaggtatcatgtgattggaaggagatttatgtcatgcatgttattatttcaatttgtaatgggcttgttagacctgcagcatatttaagtatctatttgtaaagcacacttttcagttcgtgaaattttgtgcatattgtttagaccattatttattaagccacacttagacagtcatggtagaacccaaagttccagtcatgtaagaagagttgaatagctttctgattcatttgagtcgcatgaccatgagaggtgcaaggctcggcccaaatataagttatcaaactttacaatttcttgcattttcggacttacctcatctaatggatac

SEQ ID NO: 3871 - DNA, 2137 bp, Hordeum vulgare
atccgccccaccccacgccacctccacctcatcagttatccatccatcccgccacctcaccgcggcgccggctgccccggccagctccgcccccgggatactcgagctggaggtgggtggagacataaacgcagccgcccggccggcctgctcaacccgcttacttattcttgcgccggggtgcagtgcagcgcccggcttgcgtttgattactgttccacgttctgtgcgtgtaggtggtggtggatgaccagctcctgcaactttctcgggggattgcagtgttaggttcgaggttggtgggcgatcccgcgtccttgggcgtgcgcttaaggtgttcgattcattgcccaggagactaggagagcacacgcacctttcagccatttccgatctgctgggttgggttacaaggccgagatggttgggagcgtgcacgtgaatggatcggcgaacggcgccaacggcaccgaggagcggctggacgagctgcgccggctgctcggcaagtccgacggcgacttgctcaagatcgtcagcatcggcgccggcgcctggggcagcgtctttgccgctctgctgcaggacgcctacggccacttcagggagaaggtgcagatacgggtgtggcgccggccggggcgggcggtggaccggtccaccgcagagcatctgttcgacgtgatcaactccagggaggacgtgctgaggcgcctcatccgccggtgcgcctacctcaagtacgtcgaggcgcgcctgggtgaccggaccttgtatgccgatgagattttgagggatggcttctgcttgaacatggtcgacacacccctctgcccgttgaaggtggtcaccaacctgcaggaagctgtctgggatgctgacattgtggtgaatgggctgccgtccactgaaacaagggaggtgtttgatgagctcagcaagtattggaaggagcggatcagcgttccggtgatcatttcccttgcaaaggggatagaagcctccttggacccaattcctcgtatcatcacgcctacgcaaatgatcagttccgcagctggcgttccaactgagaatatactctatcttggaggcccaaacattgcctcagaaatttataacaaggaatatgcaaatgctcgaatctgcggatccaccaagtggaggaaacctcttgctaagtttcttagacaaccgcatttcattgtttgggataacagtgacattgtcactcatgaggttatgggtggcctgaagaatgtatatgctattggtgctggaatggtggcagctttaacaaacgagagtgcaacaagcaaatcagtgtattttgctcactgcacgtcagagatgatattcattacccatctactgacagaacagccagagaaacttgccggccctctgctggctgatacttatgtaactctcctaaaaggtcgcaatgcatggtatgggcaaatgctagcgaagggagaactcaggctcgatatgggtgacagtatcaaaggaaaggggatgattcagggtatttctgctgttggtgcattttttgagctgctcagtcaacccagcttaagtgttctacacccagaggaaaacaagcaagtggctcctgctgaactgtgcccaattctgaagaggctttatagaattctgataaaaagggagctcccggtgagagacatcctccaagccctgagggacgaaaccatgaacgaccctcgtgagaggatcgagatggcgcagagccacacattctaccgcccgtctctcctcgggaagccgtgacctcggctgccctgtgtacatgattagattgtaaacaaaaaaaaggcttggattagctccaaccctgtcatgcttcacatcactatgggttgagcaaaggcgtgtcctggtttcagatctgctggcttgtgtgtttggaaatttggaccccggtggccatagcccgtggggtcgttagactgtcatgttgtacaagagagtactgatcgagtcaataatatgttgctacttggacagtaaacatgaggcgtaaatgagacgctctggttatttgtgtgtttttaagcctcaatgctaaattatttgttttcgacgaaatgaaatggctaaaaaaagcatggaaaaa

SEQ ID NO: 3872 - DNA, 2378 bp, Hordeum vulgare
aagcgggtttggggcggcccgctgtacgtctaagtcgtcgtctcccccgggcagggaagaccagacggacggagcacgggcagctcgggaagcagcagcggcgacaccgttgcctcccgcctcccccactcattaatggcggccactgcatggttggccgcggtacccatctcctccatcaatgccgccacccacctcccccatcttcgtactaaacgccagccaacccaagccaagcttccgtccatccgccccaccccacgccacctccacctcatcagttatccatccatcccgccacctcaccgcggcgccggctgccccggccagctccgcccccgggatactcgagctggaggtgggtggagacataaacgcagccgcccggccggcctgctcaacccgcttacttattcttgcgccggggtgcagtgcagcgcccggcttgcgtttgattactgttccacgttctgtgcgtgtaggtggtggtggatgaccagctcctgcaactttctcgggggattgcagtgttaggttcgaggttggtgggcgatcccgcgtccttgggcgtgcgcttaaggtgttcgattcattgcccaggagactaggagagcacacgcacctttcagccatttccgatctgctgggttgggttacaagggcgagatggttgggagcgtgcacgtgaatggatcggcgaacggcgccaacggcaccgaggagcggctggacgagctgcgccggctgctcggcaagtccgacggtgacttgctcaagatcgtcagcatcggcgccggcgcctggggcagcgtctttgccgctctgctgcaggacgcctacggccacttcagggagaaggtgcagatacgggtgtggcgccggccggggcgggcggtggaccggtccaccgcagagcatctgttcgacgtgatcaactccagggaggacgtactgaggcgcctcatccgccggtgcgcctacctcaagtacgtcgaggcgcgcctgggtgaccggaccttgtatgccgatgagattttgagggatggcttctgcttgaacatggtcgacacacccctctgcccgttgaaggtggtcaccaacctgcaggaagctgtctgggatgctgacattgtggtgaatgggctgccgtccactgaaacaagggaggtgtttgatgagctcagcaagtattggaaggagcggatcagcgttccggtgatcatttcccttgcaaaggggatagaagcctccttggacccaattcctcgtatcatcacgcctacgcaaatgatcagttccgcagctggcgttccaactgagaatatactctatcttggaggcccaaacattgcctcagaaatttataacaaggaatatgcaaatgctcgaatctgcggatccaccaagtggaggaaacctcttgctaagtttcttagacaaccgcatttcattgtttgggataacagtgacattgtcactcatgaggttatgggtggcctgaagaatgtatatgctattggtgctggaatggtggcagctttaacaaacgagagtgcaacaagcaaatcagtgtattttgctcactgcacgtcagagatgatattcattacccatctactgacagaacagccagagaaacttgccggccctctgctggctgatacttatgtaactctcctaaaaggtcgcaatgcatggtatgggcaaatgctagcgaagggagaactcaggctcgatatgggtgacagtatcaaaggaaaggggatgattcagggtatttctgctgttggtgcattttttgagctgctcagtcaacccagcttaagtgttctacacccagaggaaaacaagcaagtggctcctgctgaactgtgcccaattctgaagaggctttatagaattctgataaaaagggagctcccggtgagagacatcctccaagccctgagggacgaaaccatgaacgaccctcgtgagaggatcgagatggcgcagagccacacattctaccgcccgtctctcctcgggaagccgtgacctcggctgccctgtgtacatgattagattgtaaacaaaaaaaaggcttggattagctccaaccctgtcatgcttcacatcactatgggttgagcaaaggcgtctcctggtttcagatctgctggcttgtgtgtttggaaatttggaccccggtggccatagcccgtggggtcgttagactgtcatgttgtacaagagagtactgatcgagtcaataatatgttgctacttggacagtaaacatgaggcgtaaatgagacgctctggttatttgtgtgtttttaagcctcaatgctaaattatttgttttcgacgaaatgaaatggctaaaaaaagcatgg

SEQ ID NO: 3873 - DNA, 1999 bp, Allium cepa
gtactttggacatatcaacaagaaagccagcttcttgttggagtttgataacctaacgttaaccccaaagctactggaatagtactattttgatcagggctctctttattgtgtgtgagcacaacccattattggaatttcgcaaaagaggctaaatttcagtaaaagatctaatttcgatatttctgccattcacattttcccccctttgccgtcttctgatcactggctttcgagtctttttgaaggtgagatattgaattttaatactgtattttagcaagtaatccaagaaggtttggttgtttggctttattcgtagtacaaaaactggaagtcgtatatacattggggatctcttagccttcgtaatctgaaacatggttgctccaaattctccttatttgaatggttccattcaaaattcaaatggggttgaagaaaagctagatgaatttcgccgcactttaggaaaagcagatggcgatctcttaaaagttgttggagtaggagctggcgcatggggcagtgtcttctctgcacttttacaagatgcatatggcagttttcgtgataaaattcaaataagagtatggagaaggcctggtagagctgtagatagagctacagctgagcatttgtttgaagtaatcaattctcgagaagatgtattaaggagattgattcggagatgtggttatctgaaatatgttgaggcaaggcttggtgatagaacattatatgcagatgagattctgaaggatggattttgtttgaatatgatagatactccactttgtcctatcaaagtagtcactaatttgcaagaagcagtttgggatgctgacattgttattaatggtttgccttcgaccgaaacacgagaagtgtttgaagagattagtatgtattggaaagagaggataagtactccagttattatatctttggcgaaggggattgaggcagctttggatcctgaaccaaggattgttacccctactcaaatgattaatcatgcaactggggttccgatggagaatattctttatcttggtggaccaaacatagcttcagaaatttacaacaaggagtatgctaatgctcgaatatgtgggtctgataagtggagaaaacctcttgctaaatttctgaggcagccacattttattgtatgggataatagcgatcttgttacacatgaagtcatgggaggcttgaagaatgtctatgctattggtgctggtatggtggctgctctaacaaacgagagtgccacaagcaaatcagtgtactttgcgcattgcacttcagaaatgatattcatcacacacttgttgacagaagagccagagaaactagcaggaccactgctagcagacacttatgttaccttgcttaaagggcgtaatgcatggtacggtcaaatgctcgccaaaggtgaattgagtatcgatatgggtgacagtatcaaaggaaaaggaactatccagggtgtatctgcagttggagcattttatgagcttcttagtcaatccagcttaaatgtattcgacccagaagagaacaagctggttgctccagttgagttgtgccccattctcaaaacactttatggagtgttaataacaagggaactttcaactcaagcaattcttcaggcgttaagagacgagaccatgaaggatcctcgtgaaaggattgagttagcacaaaatcatactttttacaggccttctcttcttagtcaacagaagtagatttgttgagaaaattgtatactttaatattttgtagtagatatttaatatgtagtggcgtgtaatgtatgtttgaaggttttcagttatgaacttgtactagtataaaatacatatgatgaacatttcttagttaccgaacttgaagcaacacgaataacatgaatgaagtacgtgcgttggaaaataataatatgattgcacctctttgctatttccaactttataaaaacacacac

SEQ ID NO: 3874 - DNA, 1915 bp, Triticum aestivum
gttctcgaggacccaaccccacctccacctcatcacttatccatccgtccatcccgccacctcaccgcggcgccggctgcctcccgcccggccagctccgcccccggggtcctcgagctggaggtggtggtggataaccagctcctggaactttctcgggggactggagtgtttaggtccgaggttggtgagcgaactcgcgaccctgggcgcgcgcttaaggtgttcgatcgattgccgaccagagcacacgcacctttcagccatttctgatctgccggattgggttacaagggcgagatggtcgggagcgtgcacgtcaacggagcggtgaacggcgccaacggcaccgaggagcggctggacgagctgcgccggctgctcggcaagtccgacggcgacctgctcaagatcgtcagcatcggcgccggcgcctggggcagcgtcttcgccgctctgctgcaggatgcctacggccacttcagggagaaggtgcagatacgggtgtggcgccggcaggggcgggcggtggaccggtccaccgccgagcatctgttcgacgtgatcaactcgagggaggacgtgctgaggcgtctcatccgccgctgcgcctacctcaagtacgtcgaggcgcggctgggagaccggaccttgtacgccgatgagatcttgagggatgggttctgtttgaacatggtcgacacgcccctctgcccgttgaaggtggtcaccaacctgcaggaagctgtctgggatgctgacattgtggtcaatgggctgccgtccactgagacgagggaggtgttcgaggagctcagcaagtattggaaggagcggatcagcgttccggtcatcatttcccttgcaaaggggatagaagcctccttggacccaattcctcgtatcatcacgcctacacaaatgatcagttccgcagctggcgttccaactgagaatatactctatcttggaggaccaaacattgcctcggaaatttataacaaagaatatgcaaatgctcgaatctgcggatccaccaagtggaggaaaactctcgccaagtttttgaggcaaccacatttcattgtttgggataacagtgacattgtcactcatgaggttatgggcggactgaagaacgtatatgctattggtgctggaatggtggcagctttaacaaacgagagtgcaacaagcaaatcagtgtattttgctcactgcacgtcagaaatgatattcattacccatctactgacagaacagccagagaaacttgccggccctctgctggctgacacttacgtaactctcctgaaagggcgcaatgcatggtacgggcaaatgctagcgaagggagaactcaggctcgatatgggtgacagtatcaagggaaaggggatgattcagggtatttctgctgttggtgcgttttttgagctgctcagtcaacccagcttaagtgtgctacacccagaggaaaacaagcaagttgctcctgctgaactgtgcccgattctgaagaggctttatagaattctgataaaaagggagctcccagtgggagacatcctccaagccctgagggacgaaaccatgaacgaccctcgtgagaggatcgagatggcgcagagccacacattctaccgcccgtctctccttgggaagccgtgacctcggttgccccgtgtacatgattagaatgtaaacaaaaggcttggattagctccaaccctgtcatgcttcacatcattatcggttgagcaaaggcgtctccgggtttctgctggcttctgtgtttggatcccaggccccagcggccatagtttgtgggggtcgttagactgtcatgttgtacaagagagtattgatcgagtgaataatatgttgctacttggacaataaacatgaggcgtaa

SEQ ID NO: 3875 - DNA, 1501 bp, Elaeis guineensis
tggtattggatttgtttttgagcgctcattcatcttagaatttgtgaaagtttgtggtgtgtccactgttttgcttgaatagaaatggttggaagtgtagaaggaacccacaggtctcctcctcactctaatgggcctgttcactattccaatggtgtggaggagaagctcgatgagctccgccggctgctcggcaaatccgaaggtgatctgctgaagattgttggcattggtgctggtgcttggggcagtgcctttgctgccctcctgcaggatgcgtatggccacttccgtgataaggtccagataagaatatggagaaggcctgggagatctgttgataggtttactgcggagcatctgtttgaggtgatcaattcaagggaggatgtcttaaggcgtttgatacagcgatgtgcttacttgaaatatgttgaggcgaggcttggggatcgcacactctttgcagatgaaatcttaagggatggcttctgcttgaacatgattgacacaccactttgtccactgaaggttgtgactaatttgcaggaggcagtctgggatgcagacattgtggtgaatggtttgccatcgacagagacacgtgaggtgtttgaggagatcagtaggtattggaaggagaggattagggttcctattattatatctttggcgaagggcatagaggcagcactggatccggttccacgtataataactcctacgcagatgattagccatgcaaccggggttccaatcgagaacattctgtatcttggagggccaaatattgcttcggagatttataacaaggaatatgctaacgctcgaatttgtggacctgataagtggaggaaacccttgctaagtttttaaggcagccacatttcattgtgtgggacaacagtgatcttgtcacacatgaggtcatgggaggactgaagaatgtgtacgctattggtgctgggatggtagcagctctaaccaatgagagtgcgactagcaaatcggtatattttgcacactgcacatctgaaatgatattcatcacacacctattggcagaggaaccggagaaacttgctggtccattgcttgcagacacttatgtaaccttgttgaaaggtcgcaatgcttggtacgggcagatgttagccaagggggagctgagtctggacatgggtgatagcatcaaaggaaaagggaccattcagggtgtctctgctgtcgatgcattttatgaactcctaagtgaatcgagcttaagtgtgttacatcctgaggaaaacaagcctgttgctcctgttgagctgtgccccatcctgaaaacactttacaagatattaataaaaagggaacttccaacaaaggcaattcttcaggcattaagagacgagaccatgtatgatcctcgggaacggattgagatgggacagagccatgctttctatagaccatcacttcttggccaaccttgactgtgaatcatctcttattcaag

SEQ ID NO: 3876 - DNA, 2536 bp, Amborella trichopoda
attctcttccttcatgttcacaaccataatgtcggcgatgcaactttattgcgccctcatgctcatggcctgaacaccttagggtttcgacctccattgaagagagagagtcaaattcctagagagagtgaaattcctcggggactccgtctgggcagtaatgggtggatggccaaatccccaacgaattggtgacagacgagattcgcctcaagcgctttctgggtttcttcaagtaccttcctagggacgaaacccagatctttgattttgctacgattttcatattcgggtcggtgatcaacccaaacacgcagagagagagagagagagggttgaagaattcgctgtgtgttaagagataaaggagaattggctctgggttgcaacgtaaaagaaaattgggttgagagataaagagaaggcttccaaaatttgcctgtcttgaacacacacctagagagagatatggtgagcagcaaagagtccagtcccaactcaattcattccaatggtggcattccccatttgaatggcgtcgaggagaagcttgatgagctccgtctcctattgggtaaatcagagggcgacgtccttagaatcgtaggcgttggagcaggggcttggggcagcgtcttcgcagctctcatgcaagatgcttatggccaccttcgagacaaaattcaggtcaggatttggaggagggccgggcgatcggttgatagagcaacagctgagcacttattcgaggtgatcaattcaagagaagatgtactaagaaggcttataagacgatgcgcgtaccttaagtatgttgaggcgaggttgggtgatcgaactctctatgctgatgagattttgaaagatgggttttgtctaaatatgattgatacgcctctctgtcctctcaaagttgtgacaaacttgcaagaagctgtttgggatgctgatattgtggttaatgggcttccatctactgagacaagggaggtgtttcaggagattagtaggtattggaaggagaggctcacacctcccattataatctcgttgtccaagggtattgaggctgcgctcgagcctgttcctcacataatcactcctactcagatgataaatcgtgcaactggagttcctatggaaaatatactttatcttggagggccaaatattgcttctgagatatataacaaggagtatgctaatgctcgaatttgtggagctgacaagtggaggaaaccactagcaaaatttttaagacaaccccatttcattgtttgggataatagtgacctcattacacatgaagttatgggtggtctgaagaatgtctatgctattggcgcaggtatggttgcagctttaaccaatgagagtgccacgagcaaatcagtatattttgcacactgtacatctgagatgatttttataacacatctgttggctgaggaaccagaaaagcttgctggacctttgcttgctgatacctatgtcacactgttgaaaggtcgaaatgcatggtatggtcagatgctagcaaaaggggaattaaggccagacatgggcgacagcattaaaggaaaggggatgattcagggggtgtcagccgttggagctttttatgagcttctcagccagtcttgcctgagtgttttacatcccgaaggaaaaacacctgttgctccagttgagctgtgcccaatcctgaagacgctctacaaaatactgatctcaagggagatttcaactgaggggatcctccaagcattgagggatgagactatgaatgaccccagggatcgcattgagattgctcagagccatgctttctacaggccatcccttctggggcagcctaaatgagtaatggtgatggtgataaatgtgagaaacttatagaaaaccacagaggatgtccacaaggttacttctatggagagcaatacggcatttaaagaatagtgtaacaagggaatagggggcattcatcggctacggaacatgtgtatttatttgaagtatttgagatgagattcatcatcaggagattttctccattgatccaagatgtgtatcggctttccttggagaaagggaacaattcttatatatgtttggaaagaaattttgtgccatttagttgtcttgatgtaacgtaaatcagtcactcactaatctttgattacaatcgtctaaaacttgttttagaaacactttaaattaaattaaggctgattaactacaagttcagcgaatttttatacacaaaattgagtaaacaaacttgcaaaatcaatgcaaaactttagaatttgttttagtatctagttgatgagatttcaaatctgtaacagattgaactctatccttaaacaaaacccacaaaccaaaaaaactaaaaactgattgtgatcaaatttagaactagtccacagctacgaaagaagaggggtctagaaaaattttaaattggattcagaaggtttcataactaaatctaggattttggaagttaatgggtatgggaaagttaggg

SEQ ID NO: 3877 - DNA, 2229 bp, Sorghum bicolor
cctctgctcctcctcctcccccactccactccacgtctccgctcccggccctcgctcgcttgctcattaatggcgggcactgcatggttggcgccatccatgcccatcaatgcctccacccacctccgggccgccccgcccccatctatctacatatccacgccgatcgggcgcttgcttccaatccagcgccggccggaccgttgcatccatccccatccccatccgtcacccaccccgcgcccctcctcctctcccaatgccggctgccggccagctccgtccccgggatccttgagctggaggtggcggtggatgaccagctctcagagtctgagcggaggatcggagggcgtttcgttaggtccgcggttggtgagcggcggtcggagcggtctcgcgcgcggcggggtcgttgggtgatgcaggaatcgggctctgggagggtgggaatacctcgcgctcgcgctcaaggtgctcgattaattacctagctagtggagcgcgcgcctgtgagccgagcccttcctgctgcactgactactgggcttgggatatggttgggagcgtgcacgtcaatggatcggtccacggtggcaatggcacggccacggaggagcggctggacgagctgcgccggctgctcggcaagtcggagggcgacttgctgaagatcgtcagcgtcggcgccggtgcgtggggcagtgtcttcgcggctctcctgcaggatgcctacggccatttccgggacaaggtgcagataaggatctggcgccgcccggggcggacggtggaccgctccaccgcggagcacctgttcgaggtgatcaactccagggaggacgtgctcaggcgcctcatccgccgctgcgcctacctcaagtacgtcgaggcgcggctcggagaccgcacgctgtatgctgacgagatactcaaggatggcttctgtctgaacatgatcgagacgccgctctgccctctcaaggtcgtcaccaacctgcaggaggccgtctgggatgccgacatcgtcgtgaatggggtgccgtcaaccgagacgagggaggtgtttgatgagatcagcaagtattggaaggagaggatcagtgttccagtgataatttcccttgccaagggaatagaagcctcgttggatccaatacctcgtatcattacacctactcaaatgattagctctgcagctggagttccaactgagaatatactgtatctaggaggaccaaacatcgcctcagaaatttataacaaagaatatgcaaacgctcgaatctgtggatccaacaagtggaggaagcctcttgctaagtttttgaggcagccacatttcattgtctgggacaacagtgatcttgtcactcatgaggtgatgggtggcctgaagaatgtctatgcaattggcgctggaatggtggctgctttaacgaatgagagtgcaacaagcaaatctgtatatttttctcattgcacatcagaaatgatcttcatcactcatttgctgacagaacaacctgagaaactcgctggtcctctgctggctgacacttatgtaactctcctaaaaggtcgcaatgcatggtatgggcaaatgcttgccaagggagagttgagtcctgacatgggcgatagtatcaagggaaagggaatgattcagggtgtctctgccgttggtgcattttttgagctgcttagtcaacccagcttaagtgtgcagcacccggaagaaaacaagctggtcgctccagctgagctatgcccaattctgaagaggctttatagaatactgataaaaagggagctcccagcaagggacatcctccaagcactgagggatgaaacgatgaatgatcctcgggaaaggattgagatggcacaaagccatgcattctaccgcccgtctctccttggaaaaccatgatctagttaatcctgtaaattagtagaatataaacagacgctgtgcttcgagcaggtgtctcccctgtgcttgctgtcctgtgtccgacctgcatggggctttgtgagttgtctaattctttgtgcttcctcattgctataatgtacaagagattactgaatcaataaatgttctaagtgcatattatatgaacacccaatttgaaaagtagtcaaggaagatttcttgctggaaattggcatcgtgcaacgtgttgtgtgggtgtgtctgattttcacggtcaagatgggcttgtt

SEQ ID NO: 3878 - DNA, 2044 bp, Gossypium hirsutum
aacaaactctagacggagatatctaatgttttgttttgtttcctattttttgattctatcctttagctgccttcaatgaactccaactgtttagatgcattcattctgatgatattgttttatattggaactctgtacaagaacaatttctagaacgggttggtatgaatatctatagggagtgagaaaaagttagctctggttttggtacaagaatccaccaataaaattttattcttattcaatcacggagaattcaacatgtttttccttgtttcaaataaaggctgtttagtgcggttttaggagagcaaaagccatataaaatcattaggtaatttggcaaattttccatgatccttttctacctcacaacatatatcctacatccttagaatcagagaattgggttttctttgttggaaaaagatggtagggagtatagacacattgcaccggagtttgaactcaaatggatctttttacaactttaatggtttggaggagaaacttgatgagcttcggcaccttctatgcaagagtgatggtgatccgttgaggattgtgagtgtgggagcaggtgcttggggaagtgtgttcgcagctttgctgcaagatagctacgggcagtttcgagacaaggttcaaatcagaatatggaggaggcctgcaagagcagttgatagagctaccgcagaacatctctttgaagtgatcaattccagggaagatgtattgaggaggttgatacgacgttgtgcctatttgaagtatgttgaggctaggctaggcgatcgaacactatttgcggatgagattttgaaagatgggttttgcttgaacatgattgatacgccactttgtcctttgaaagttgtgactaatttgcaggaagctgtttgggatgccgatatcgtggtaaacggcttgccttccaccgagacacgtgatgtgttccaagagatcagcaattattggaaagaaaggatcactgtgcctatcattatctctttgtctaagggtatagaggctgcactgcaaccccttcctcatatcattaccccaacacaaatgattaatcgagcaactggagtacctatagagaacatactctatcttgggggaccaaatattgcctctgagatatacaacaaggaatatgctaacgctcgaatatgtggagccgaacagtggagaaaacccctagcaaagttcttaagacagccccatttcattgtatgggacaacagtgatcttgtcactcatgaagtcatgggcggcctgaagaatgtctatgccatcggagccggaatggtagcagccctgaccaaggaaagtgctactagcaaatctgtgtattttgcacattgtacatcagaaatgatatttattacccatttgttggctgaagaaccagagaagctggcaggccctttgctggctgacacttatgtgacattgttaaaaggtcgtaatgcatggtatggccaaatgttagccaaaggagaactaagtcgagatatgggtgatagcatcagcggaaaaggaatgattcagggagtgtctgcagtaggagcattttatgaacttctgagtcaatcgagcttaagtgtgttgcatccagatggaaacaagcctgttgcccctgttgagttgtgccctctattgaagacgctctacaaaattcttataacaagggagaagacggctgaagcgattctgcaggcactgagggatgaaaccctgaatgatcctcgagagcgcattgagattgcccagacacatgcattctataaaccttcacttctaggccagccttgacaagtttgatgcataccaagatttcaagtttaaagggaactaatcatatggaaccaattgtttcagaattcaacatggtgtgtcattgtcataaatatagagtgctgcctttatccgaagctccatccatgaaatttgtctcagtgaatttttttttcttttttgacaaagggagcatttttatgttgtgacaacaagaatgaaaatttttatagcgagaatc

SEQ ID NO: 3879 - DNA, 2301 bp, Musa acuminata
ctcgcatttatgggcttgatagggtcggccacatcacaagccttcaatgcctccaccaacttgaaaccccgagcagctgttcttgcatccatagatcacacattttcgcttcctcgcccaccctcgtccctcccaccgcattaaaacccgcccaagtttggatcttgaaagtcccaggtaatcgtcagctatgtgagagcttgaaggagctcaaccaccgctttgccgtgccaactaacaatgctggctctttctctaccgggcgtgggctttacttgattggaacttggacgagctgaggagaaaaagggtggggttgatgagcagacccgacggcaattaccaaggcaactgccagtgttttgctcctttcggtgtttaatttggtcagacaaggtggagtggggcgattgaggcgttttactaccgatttatgcttgaaagctgtgatctttggctgtttccttgtggagagatctacagttggtttggtcagaaagcgtggaggtagaaaatatcttgggctgagatactacgtcgaagagctgtcatttgcccattggaaaccatctctcagcaaatattattacttgccaaattagtcgtttgagcgaattggaagttctctgtgtttgctgctcgaaagaagatggttggcactgtcgaaattaatcatagttctgtcaactcgaatggatcccgtcacaattccaatggagctgaagaaaggctagatgagctccgccgtctccttggcaagactgatggtgatctgcttaagattgttggtgtaggggctggtgcctggggcagcgtgtttgctgccctcttgcaggatgcatatggtcatcttcgcgataaggttcagattagaatatggagacggcctggcagatcagttgaccgttccacagcggagcatttgttcgaggttatcaattcacgggaggatgttttgaggcgtttgatcagaagatgtgcgtacttgaagtatgtggaggcaaggctcggtgatcgaacactgtatgcggatgagatattgagggatggattttgcttaaacatgattgataccccactttgtccattgaaggttgtaacgaatttgcaggaggcagtgtgggatgcagatattgtggttaatggtttgccttctacggagactagggaggtatttgaggatatcagtaggtattggaaggagaggattactgttccaattattatctctcttgcaaagggtatagaagcggctctagatcctgtcccacgtatagtaacacctactcagatgatcaaatgtgcaactggagttccaatcgagaacattctctatcttgggggtccaaacattgcttcagagatttacaacaaggaatatgctaatgctcgaatctgtggagcagagaagtggagaaaacctcttgccaagttcttgcggcagccacatttcattgtgtgggataacagcgatctagtcactcatgaagtgatgggtggcttgaagaatgtttatgctattggtgctggaatggtagcagctctaacaaatgagagtgcaacaagcaaatcagtatactttgcccactgcacttctgaaatgatatttattactcatctgttggccgaacaaccagaaaaactagctggtcctttgttagccgatacatatgtgaccttattaaagggtcggaatgcatggtatggacaaatgctggccaagggagaactgagtcttgacatgggtgacagcataaaaggaaaaggaatgattcagggagtctctgcagttggtgcattttacgagctacttagccagtctagcttaagtgtgttgcatcctgaggagaagaaacccgttgctccggctgagctgtgtcccatcctcaaaaccctttataaaatactgattagaagggagtgtccttcacaagccattcttcaagcgctacaagatgaaactatgaacgatcctcgtgaaaggatagagatagctcagagtcaagctttctacaggccatcacttctcggtcaacgttaacataaactgttgatggttacaaaactaaaatatcaaaagcgaagtcttgctggtcatgttggagctgatactgagattttattgctttggtggcatgctaaatgtttgatgagagaagctaaatggttaaagaatgtaaatttctccatcatgtaatgggctgcttctgcataaaatcgagtaaacttgcgatgcgagtggggtgtttagttgtactttatgaataattataattcatttatatcaagttgtgtttagtc

SEQ ID NO: 3880 - DNA, 1611 bp, Pennisetum glaucum
gagagagagagatggttgggagcgtgcatacgaatggatcggtgcacggtgccaatggcactgaggagcggctggacgagctgcgccggctgctcggcaagtcggatggagacttgctcaagatcgtcagcgtcggtgccggcgcgtggggcagcgtctttgctgctcttctgcaggacgcctatggccacttccgggagaaggtgcagataaggatttggcgccgtccggggaggacggtggaccggtccactgcggagcatctgttcgaggtgatcaactcgagggaggacgttctaaggcgcctgatccgccggtgcgcctacctgaagtatgtcgaggcacggctcggggatcggacactgtatgccgatgagatactgaaggatgggttctgtttgaacatgatcgaaacgccgctctgccctatgaaggtcgtcaccaacctgcaggaagccgtctgggatgctgacattgtggtgaatggggtgccatccaccgagacaagggaggtctttgaggagatcagcgagtattggaaggagaggatcagtgttccggtaataatttccctggcaaaggggatagaagcctcattggatcctattccccgtatcattacacctactcaaatgattagttcggcaactggagttccaactgagaatatactctatcttggaggaccaaacatcgcctcagaaatttataacaaagaatacgcaaatgctcgaatctgtggatccaacaagtggaggaagcctcttgctaagtttttgaggcaaccacattttattgtatgggacaacagtgatcttgtcactcatgaggtgatgggtggcctgaagaatgtctatgcaattggcgctggaatggtggcagctttaacaaatgagagtgcaacaagcaaatctgtatattttgctcattgcacgtcagagatgatattcattactcatttgttaacagaacaacctgagaaacttgctggacctctcctggctgacacttatgtaactctcctaaaaggtcgcaatgcatggtatgggcaaatgcttgccaagggagagttgagtcctgacatgggtgatagtatcaagggaaagggaatgattcagggtatctctgccgttggtgcattttttgagctgcttagtcaacccagtctaagtgtgcaacacccggaagaaaacaagcaggttgctccagctgaactatgcccaatcctgaagaggctttacagaatactgataaaaagggagctaccagcaagagacattctccaagccttgagggatgaaacgatgaatgatcctcgcgaaaggattgagatggcacaaagccatgcattctaccgcccatctctcctcggaaaaccatgatccttttagttctgtatattattagtagaacataaacgaaggcggggatgacaccgaattcgccaggctacctatcattcttgatcgagcttggagcaggtgtacctgcactgctgctggcctgtgtttgagcttatagggcctttgtcagctgtggaattccttgtgctcattcatccattgccatgttgtataagattactgaatcaataaacttcgtgatcgtcag

SEQ ID NO: 3881 - DNA, 2408 bp, Populus trichocarpa
cccatcaatgcctctttgtctacctccctccctctctctctttcaatcactccaagaaaaaaaattctaaagctgctttcaccagtttctcgcctccctttctcaccttccatgcacttttaatgtcccttcactatatacgaagtttcacacacattgcaatcttccatgcttaatgcatttccctccaagcaacgcaagttgaattctctgctaccagaattttggcgggtcttgatgacgtaaaggaactgaacatgcttttttacttctttgttttatatttagtggttttttgaaagtttatagttgggtggatgaactaactcagacggacaaaacaaagctatagtgtttgatttttgtcattttgtcatgtgctaattaagaagatagagaggggtttaggtatttttacctcttcttttgttttgttctttcgtgttgaattattggttggtttgaaaatcttagtagagggatgagaattagttttggttttggtgataagatctaccaataaagatttcattgtttcatggcaaggtggcaacttgggaattgggattttgttttttcaaggaaagatttgacaagtttggagttgtaagatcaaagtccatataaagatcaaagttgggttgattttagaatttggtatagttgatattgcaatattgatacccatcagacctttttttgacagggtttgatcttgttgatttgttgttgcgggaagaagatggttggaagtattaaggcagtgaatcatcataataacggatgtggtctagaagagaagcttgatgagcttcgaagccttctcggcaaggctgatggtgatccattgagaattgttggtgttggggcaggtgcttggggaagtgtttttgcagctttgctgcaggatagttatggccaatttcgagagaaggtccaaatcaggatatggagaaggcctggaagagctgttgatagagccacagcagaacatctctttgaagtgatcaattcgagggaggatgtattgaggaggttgatctggcgatgtgcgtatttgaagtacgttgaggccaggcttggcgaccggactctttttgcagatgagattttgaaagatggattttgcttgaacatgattgacacaccactttgtcctttgaaggttgtgactaacttgcaagaggctgtttgggatgctgatattgtggtaaatggcttgccttccacggagacacgtgaggtgttcgaagagatcagtcaatattggaaggagagaatcacagcacctatcatcatctccttggcaaagggtatagaagctgcattaaaacctgttcctcgaataatcacacctacgcaaatgattaacagagcgactggagtgccaatggaaaatatactttatcttggtggaccaaatattgcttcagaaatatacaacaaggaatatgctaatgctcgaatatgtggagctgacaagtggagaaagcctcttgctaagtttttgaggcagccccatttcattgtatgggacaacagtgaccttgtcactcatgaagtcatgggtggcctgaagaatgtctatgccattggagctggaatggtagcagcccttactaatgaaagcgctaccagcaagtcagtctactttgcacattgtacatcagagatgatatttattactcatctactggcggaagaacctgagaagcttgcagggcctttgctggcggacacatacgtaacgttgttaaagggtcgtaatgcatggtatggacaaatgttagccaaaggggaaataagccgggatatgggtgatagcatcagtgggaaaggaatgattcagggtgtttcagcagttggagcattctatgaactcctgagtcagtcaagcttgagcgtgttacaccctgatgaaaagaagcctgttgctcccgttgagctctgtcccatcttaaaaacgttgtataaaatactgataataagggagcaatcatcacaagctattctgcaagcgctgagggacgaaacattgaacgacccccgggaacgcattgagattgcacaaagccatgctttctacaggccttctcttcttggccagccttaggctactttgcgttgccaaaaaaagtgatcatgaaggaatcaataaaacacatgaaagcaattgttgtatgaagttatgaacactctggagtaaaacacacgctggtgttatcatgtattctgcaaaattgtcttataattgtgaaagctcaaagccttcaattatcgcctaaatgttatttttttacatcatgtattctgtaaaaatgctatttacagtcttatttatttaattctcgtttggcaggaaacaaacactgaattaaagtgtttggttaatacaaaccatatttttt

SEQ ID NO: 3882 - DNA, 4322 bp, Ricinus communis
ttaataagcagtgccacatggcatgatcatattaaccgagtggcattgagattaaccatttcatttccactggcgagcgcacgcaagccaccaaatacatttttccaacgcaaaacgccaaccattgtcctcttctttttcttacttgttatatttacttctttttgcaagaaaactcaacacacgaatttgggatttggaatttggaattttgatgccattcttgcctctcaacacacaaggctgacacgcttcttttatctcccaaaccgacttccgttagacggaattctcttgctttagtccacttctggtaatacccattgtgtgaatgaatgagcacaagctaacaaaaacataaaatagaaaaaagtctagaatcagtatcaccgcgttgaggaagctgacaaacaaaagaggtggtttcgctttctcttctctttgttcactttgtacgcttatgttgactgggtttcttggttgggttagatgacggaagctttagactaagttcattcttgcatttctttctgtaatatcttactcggattgtcattagatatgctgatggcggcataaagtaccatgaaaaacccgtgtagcaaaattcagtttcgatcaatgttttagagtttctaagttctagatcaatgttctagaaacaacaaaatctagctgttgttatgtttgatagctaatttgatgatctaagcccttacacttgatgagggatgtagcctctatatatatatatatacctggaaattgggttgctttaagatccatagaaattgttaggaatctgttgtctctagatagcaatataatttttgtgtgttgagcttagtaaatatcgacagaagagatcctttctttggtattggtgctacgtttcctagttctatataaaggttcatcacacaagacttaataacggtagtgtaagtcgagaggagaaaatggctaaaaatactgaaacagagagtcacaatgtacattcaaatggatcaattcataatcagaactcgaatggtgctttagaagaaaagctagatgagcttcgacgtctcatgggcaaatcggaaggtgatcctttgaggattgttggcgtcggtgctggtgcttggggtagtgtctttactgctttgttgcaagatagttatggtcacctaagagataaggttctaataaggttatggagaaggcctggaaaatcagttgatagagccacagctgagcatttgtttgaagtgattaattccagggaagacgtattaaggagattgattaggcgttgtgcatacttaaagtatgttgaagcaagattaggtgataggaccttgtatgcagatgagattttgaaagatggcttttgcttaaacatgatagataccccactttgccctttaaaggttgtaaccaatttgcaggaagcggtgtgggatgctgatattgttattaatgggttgccttccactgagaccagtgaggtgttccagcaaattagtaggtattggaaagagaggataacagtaccagttatcatctctttggcaaaaggcatagaggctgagttggagcctgagcctcgcataataactcccactcaaatgataaatcgagcaactggagtcccaatggagaacatcctctatcttggaggacctaacatcgcctcggagatttacaataaggaatatgctaatgcccgaatatgtggcgcagaaaaatggaggaaacctttggcaaagtttttgaggcaaccccattttatagtgtgggataatagtgatctagttactcatgaagtcatgggtggattaaagaatgtatatgcaattggagctggaatggtagcagctctgaccaacgagagtgcaacaagtaaatcagtgtactttgctcactgtacatcagaaatgatatttatcacgcatttgttggcagaggaacctgagagacttgcgggtccccttttagctgacacttatgtcaccttattgaaaggccgtaatgcatggtacggtcagcagttggccaaaggggggttgaaccttgatatgggtgacagcatcaagggcaaggggatgattcagggtgtctctgcagtgaaagcattctatgaactgctgagtcagtcttgcttaagtgtcctacatcctgaagaaaagaagcctgtagcccctgttgaactttgccccatattgaagatgctatatagaatactcataacgagggagtttccggcacaggctattcttcaagctttaagggatgaaacgatgaatgacccaagagatcgcattgagattgcacaaagccatgtattctacagagcatcactcctgggaaagaaaccttgacgatatactgactaattttgcatgttgctgttgtcaatcgatatgatgtgataagctacataatgtagttccacaatttcagaaagtatcaggacaaggacgctagattgcgagttggttgttaagtttgttgttgtatcaattgctttatttgttgagtttggccatgcagaacagtgaaatgaacagatttgtcaaactggattttcctttcacattaatgttaaatcgaattgaatctgtgtatgcattaaccctccaagctgcaactcctggcttgaattggagccatgattttaaagtttcccatttagttaaacatacaaaagtgaacacaaaaatggtgcatatgtcaagtttgatatatattgcattttaaataaatactaccggtatcatttaaattcctacatgtttcaaatcctgcatccgactttagttgagttattatgtagttaataaaagagagattaccacattgccaatgttgaagctccattaagttacattgatgtgaatccttcccccatacatgaaacggcacgatgagaacattttgtttgttttgatgtgccaagacataggtctaaacccctttgccataaccattaccagtggactgcatatatcactcacaggccatgtactcgtagtgagaccaatttgatatcaatcccaagccaaattagaactcctttcagggcacgtagattgaaaggcctgccttgaaagtttgagacgtcatgctactacaaggggcagaagtaatcactatttataaacttcaaatggtagttggagcttgtgtgctagcctgcttaccctttttttgcattactttaacttctgcataaaagttttctcctcgccatggtgttcacagaaccgtacatatgcattacttttgctttgtttttcagtataggagcttggacttctcaatgcatggctcgaaccctccaagaagcatcaatgtatgagaggcatgagcaatggatggctagttatgcacgtgtatacaaggatgctaatgagaagcagatgcgttacaagatattcaaggaaaatgtacagcgtatagattcttttaacagtgagtcagacaagtcttacaagcttgcagtcaatcaatttgcagatcttacaaacgaggagttcaaatccttaaggaacggattcaagggtcacatgtgctctgctcaagcaggacattttagatatgagaatgttactgcagtacctgctagcattgattggagaaagaaaggtgccgtaacacagatcaaggaacaaggccaatgtggatcttgttgggcgttttcagcggtggcagcagtggaaggaatcactgagataaaaactggaaaattgatttcactttcagagcaagagcttgttgactgtgacaccaacagtgaggatcaaggatgtcagggtggtctgatggatgatgcctttaaattcattgaacagcatggcctggctagtgaggccacctatccatatgatgcagctgatagcacttgcaagacaaaggaagaagctaagccttcagccaagataaccggttatgaggatgttccagcaaacgatgaagctgcactaaagaatgctgttgctaaccaaccagtttctgttgccatcgatgctgggggatttgagtttcagttctactcgagtggtatcgagtggtatcttcacagggtcctgtggaacagaactagatcacggtgttgctgctgttggttatggagttggcggtggaaagaaatattggttggtgaagaactcatggggtacacaatggggggaagaaggatacattcgcatggaacgagagatagctgcaaaggaaggcctatgtggcatagcattgcaagcttcttaccccactgcataacattcaacatgaaaaccaaggccatctctcttgatgattgtttaaattataaactgtaa

SEQ ID NO: 3883 - DNA, 6650 bp, Zea mays
aacttgaacaaactcatacgcaataacatccgccgccttctgcctcctgttcactgttcttctctaatctctgattcttcttccacttctgatctctgagcataacatttggtatcaaagacttgtcatcctggatctgctgccggaggtgccgcggcgggcgcgatcgtctgcgatggagcaatcggagactatcacccacaagttgcttgaggaaatgcgtctcatggaggcgcgtctatctgagcaaatcagcgggcgctgcgccggcgtcgagcgccgcgtggaggaacactgtgaggagatacgcgtgccttcacccagcgctgcgatgccatccaccaacaagtggatgttgcggcgttgcgcggtgaagaacgcctgatcgccctcgaactcatgaagaccgaggctgatatgtggcgtcccgatctggagaagcgggtcgacgatctggagttggaagttacccgtgtcaacaaattccttgaacgggaacgtcgccagccagccttcgacaagccgggactctttggtccacacgcgtcggcatccgtgcgtcctccagccggatttcctcacgctgatggggcccgtggccaccgcttcgaaccaccaaaccgggagggtgagtttgggttccctgcgacccaacctcacggcctggtcaagggaagaagcgttggagcccacacgacgccggcgtgctgagcctttcatccaccggaaggcttggccgcaggcgacggcgtctgagatcaccaaggtggagcgtgttggtaaccaggggcaaccaacggagaagcttattgttgactcaacccgtcacacttcgccaatggacagagtagcgactctgaagagctatcgccgtgcccgtgggttatgtgaccgatgcgcagaaaagtggactccaggtcacaaatgtgcaaccacagttcagctccatgctattgaagagcagcctgggagggcagtaacagattggtgacgatgagattatctggaacgattcagcaacaggacctggttattcttattgattcgggatcgtcacactcgttcctctttgatcgtcttcgaccactgctagctggtgtccaggaacttgctcagccgttctcagttcagctttggatttagtggtgggcatggactggttgcaacggtttagtcctatgcatgtcgattgggcaaacaagtggttggtaattccatacaatggatcgtcagtgtgcttacaaggacttcagtcatcttttccttctggttctgtggtgcagttgctgctatcagctgagatacagctcaattcagttcaagaagagtctcagttggaggtacatcccaaggttcaagcggttcttcaacaattttcagatgtgtttgctgatcctgtgggtttacctcccagccgacagtgtgaccatgctattccattggtccctggtgctcaccctttcaatgtcaagccctatcgttatccaccggctctcaaggatgaaatagagacacaagtacgtgacatgctgtcgcagggagtcatccaaaagagccacagtctgtttgcatcgccagtattgctggtcaagaagaaagatcaaacgtggcgcttctgtattgattaccgctatctcaacgctataacagtgaagagctcgtatcctgttccaatctttgatcagctgatggatgaactgtcctctgcacaatggtttagcaagcttgatctgaaagcgggttaccatcaaatctgtctagtaccaggagaagaaccaaagacggccttccaaacacatttgggtcatttcgagtttcgagtaatggcttttggcttgactggagctcccaacacttttctgggtgccatgaatgatacactggcaccagtattgcgtcgttgtgccctcgtgttcttcgatgacatacttatttacagtcctacatttgagtcccacttgcaacatttatccgaggtcctcactttgttgaagcaagatcactggaagatcaagttgtccaaatgtgcttttgcccagaccactattgcttatctcggtcatataatcagtgctcacggtgtggcgactgacccagctaagttgcaaattattcagcagtggtcagccccaacaaatactaaggagctacgcagttttctcggtttggctggtttttaccgtaaattcgtacgacatttcagcatcatcgccaaacctctgacggacttactcaagaaaaattccctgttcgtttggacatcagatcatcagtcagcatttgagaccctcaagcaggctttaatatctgctccagtgctggctcttccagacttcaaccaaccattctgcatttatacagatgcctgcagtacaggcgtaggtgcggtcctgatgcaaaaggggcacccgttggcgttcttgagcaaggctctgggtcccaaaaaccaaggcttgtcgacatacgagaaggaatatcttgcaattgtgattgctatagcacagtggcgctcataccttcagttggcagaattccatatttatacggatcaccaaagcttggctcagttaaacgaacaacgtctccacactgtttggcaacaaaaggtatacaccaagctggccggccttcaatacaagattgtttacaaaaaagggaaatcgtggagggttatcaacatgaccagcaggcacagagtttgttatcgcagttggcccttgatccgtcggcactagctgcaacatacactcttaaagatggcttgattcgacataagggacgtctatggttaggcaagaatgaggtgttacaacaaaaggtcatcgccgccttccacgactcagctttggggggtcactcgggtgtgcctgtcacttatcgacgagtgaagcaattattttcatggaagggcatgaagaagacagttcaccagtttgtgcagtcatgtcccatatgccagcaagcgaagccggatcgtgctaaatacccaggtctgcttgctcctctacccattccaccgcacgcctggcattcaatttctatggatttcatagaaggcctaccgaaatcgggatcctggaactgcattctagtggtggtcgaccgtttctcaaaatatagtcattttctggcccttgctcatccattcacagccgcgggggtggccaaggttttcttggacaatatttataagcttcacggtatgccagcaagtattgtgtcggatcgagatcgaatcttcacaagtcaattctggcagcagctgtttacattgactagaacacagctttgcatgagctcggcttaccatccccagtctgatggtcaaactgagcgagtaaaccaatgtattgaaacttatctcaggtgttttgtccatgcttgtcccaagaaatgctgtcactggctgtcagtcgcggaattttggtataacaccaactaccattcggcaattgggcgttcaccctttgaggttctatatggtcatgcagctcgccattttggtattgattcagtctcgtccgtcgcagtggaggacctcagacagtggttgacggacagagaaatcatatccaagttgattcaccagcatttgactcgagctcagtcccgcatgaaaaaacaggctgacaagaaacgttcggagcgatcattccaggtgggcgatcaggttctggctcaccgcattattcagcgaggaggagctctgattccacaaatcaaagtggtgtggtcaggttgggatcccgccttagcgatatgggaggacgctgaggccctgaaagctgcgtttccgaacgcgccggcttggggacaagccgcttccaaaggagaggggactgtcagcacctctgtggaggaggaggctgtggaagagacggaagtggaacaggcagcactcggcggcaaacgcactcgacgcaccaacgtttgtgtgatgagcccagaatgggctgtgtaatcctagtctcttgtaattcagggccagcccatgtgacggtataatacctagtctgtggtttctgaagaggcatgcaaaacttaaacaaactcatacgcaataacatccgtcgccttctgcctcctgttcactgttcttctctaatctctgattcttcttccacttctgatctctgagcataacagtaggccgttcgagttgcgaccatacaggctcgcggaaaatcgtggacagcgatacttgcggatgttgctcgcctgtcccagtcctgcatgtgcacgtatgtgccagtgtcaacgaagacagcgatcaactcgatctgttgcctgtttcgtgatagcatcccccatatccctccccatcgagtactcatcccccatctctgtcgtcgtcgctggcgcatcggtgtcgatcgcagcagttcgcttcatcactcaaaaatccatcttcgtcaataaccagttcgggaagctgcgagcgaagcactgaagcagatgcttgtcttgtcttgtcccggccctctcatcctcctcccccactccactacggcactcccggccctcgctcgcttgctcattaatggcgggcactgcatggttggcgccatccatgcccattaacgcctccacccacctccgggccgcccccgcccccatctacttttattcacgccgatcgggcacttgcttccaatacagcgccggccgggccgttgcgtccgtccatcctcatccccatccgccacccaccccgcgcccctccttctcactccagtgctggctgccggccagctccgcccccggggtccttgagctggaggtggcggtggatgaccagctctcggagttttctgaggcgaggatcggagggcgttgcgttaggtccgcggttggtgagcggcggtcggagcggtctcgcgcgcggcggggtcgttcgatgacgcaggaatcgcgctctgggagggtgggaatacctcgcgctcgcgctcaaggtgctcgattaatttactgcctgaggctgagggggggcgcgcctgtgagctgaaccgttcccgctgcactgactcctgagctcgggaaatggttgggagcgtgcacgtcaatggatcggtccacggcggcaatggcacggccacggaggagcggctggacgagctgcgccggctgctcggcaagtcggagggggaccttctcaagatcgtcagcgtcggcgccggcgcgtggggcagcgtcttcgccgcgctactacaggacgcgtacggccatttccgggacaaggtgcagataaggatctggcgtcgcccgggccggacggtggaccgctccaccgcggagcacctgttcgaggtgatcaactccagggaggacgtgctcaggcgcctcatccgccgctgcgcctacctcaagtacgtcgaggcgcggctcggagaccgcacgctgtatgccgacgagatactcaaggacggcttctgcctgaacatgatcgagacgccgctctgccctctcaaggtcgtcactaacctgcaggaggccgtctgggatgccgacatcgtcgtgaatggggtgccgtccaccgagacgagggaggtgtttgatgagatcagcgagtattggaaggagaggattagtgtcccggtgataatttccctcgccaagggaattgaggcctcgttggatccaatacctcgtatcattacacctactcaaatgattagctctgcaactggagttccaactgaaaatatactctatcttggaggaccaaacatcgcctcggaaatttataacaaagaatatgcaaacgctcgaatctgtggatccaacaagtggaggaagcctcttgctaagtttttgaggcagccacatttcattgtctgggacaacagtgatcttgtcacccatgaggtgatgggtggcctgaagaatgtctatgcaatcggtgctggaatggtggcagctttaacaaacgagagtgcaacaagcaaatctgtatattttgctcattgcacgtcagagatgatattcattactcatttgctgacagagcaacctgagaaactcgctggtcctctgctggctgacacgtatgtaactctcttaaaaggtcgcaatgcatggtatgggcaaatgcttgccaagggagagttgagtcctgacatgggtgatagtatcaaggggaagggaatgattcagggtatctctgcagttggtgcattttttgagctgcttagtcaacccagcttaagtgtgcagcacccagaagaaaacaagcaggttgctccagctgagctatgcccaatcctgaagaggctttacagaatactgataaaaagggagctcccagcaagggacattcttcaagccctgagggacgaaacgatgaatgatcctcgggaaaggattgagatggcacaaagccatgcattctaccgcccgtctctccttggaaaaccatgatctagttagtcttgtagattagtagaatataaacggacgctgtgctgcaggtttctccactgtgcttgctgtccttgtgtccgagctacatggggatggggctttgtcagttgtcgaattctttgtgcttcctcgttgccatggtgtacaagagattactgaaccaataaatgttctaagtgcatattatatgaacacccaatttgaaagtacccgaggaagatttcttatgc

SEQ ID NO: 3884 - DNA, 1987 bp, Secale cereale
ccactcattaatggcggacactgcatggttggctgcggcgcccatctcccccatcaatgccgccacccacctccctcatctactaaacgccagccagcccaagcttccgtccaccccaccccacctccacctcatcacttatccatccgtccatccgtccacctcaccgccgcgccggctgccccggccagctccgccccgggggtcctcgagctggaggtggcggtggatgaccagctcctggagctttctcgggggactggagcgttaggttcgaggttggtcagcgatctcgcgaccctcggcgtgcgcttaaggtgttcgatcgattgccgaccagaacacacacacctttcagaactttctggttctctggatcgggttgcaaggcggagatcagagatggttgggagcgtgcacgtcaatggggcggtgaacggcgcgaacggcaccgaggagcggctggacgagctgcgccggctgctcggcaagtccgacggcgacctgctcaagatcgtcagcatcggcgccggcgcctgggcagcgtcttgctgcctgctgcaggacgcctacggccacttcagggagaaggtgcagatacgggtgtggcgccggccggggcgggcggtcgaccggtccaccgccgagcatctgttcgacgtgatcaactcgcgggaggacgtgctgaggcgcctcatccgccgctgcgcctacctcaagtacgtcgaggcgcggctgggagaccggaccctgtatgccgatgagatcttgagggatgggttctgtttgaacatggtcgacacaccgctctgcccgttgaaggtggtcaccaacctgcaggaagctgtctgggatgctgacattgtggtgaatggcctgccgtccactgaaacaagggaggtgtttgaggagctcagcaagtactggaaggagcggatcagcgttccggtcatcatttcccttgcaaaggggatagaagcctccttggacccaattcctcgtatcatcacgcctacacaaatgatcagttccgcagctggtgttccaactgagaatatactctatcttggaggcccaaacattgcctcggaaatttataacaaagaatatgcaaatgctcgaatctgcggatccaccaagtggaggaaacctctcgcaaagtttttgaggcaaccacatttcattgtttgggataacagtgacattgtcactcatgaggttatgggcggactgaagaacgtatatgctattggcgctggaatggtggcagctttaacaaacgagagtgcaacaagcaaatcagtgtattttgctcactgcacgtcagagatgatattcattacccatctactgacagaacagccagagaaacttgctggccctctgctggctgatacttacgtaactctgctgaaaggtcgcaatgcatggtatgggcaaatgctagcaaagggagaactcaggctcgatatgggtgacagtatcaaggaaaggggatgattcagggtatttctgctgttggtgcattttatgagctgctcagtcaacccagcttaagtgttctacacccagaggaaaacaagcaagttgctcctgctgaactgtgcccaattctgaagaggctttatagaattctgataaaaagggagctaccggtgaaagacatcctccaagccctgagggacgaaaccatgaacgacccccgcgagaggatcgagatggcgcagagccacgccttctaccgcccgtcactccttgggaagccgtgacctcggtaccgtgtacatgattagaatgtaaacaaaaggtttggattagctccagccatgtcatgctacacaccaatatcggttgagcaaaggcgtctcctggttttgtttctgctggcttgtgtgttgtggttggacttggacccagtggcaatagtttgtgtggtcatgttgtacaagagagtactgatggagtcaataatatgttgctacttgga

SEQ ID NO: 3885 - DNA, 2045 bp, Setaria italica
cgcttgcttccaatccagtctcgggccgttgcatacttccatccgccacccaccccgaccttgcccgccgcgccgcgccccagtgccggctgccggccagctgcgcccccgggatccttgagctggaggtggtggtggatgaccagttctcggaattttctgaggggaagatcggggggtgttgtgttggtccgcagtgggtgagcggcgtttgaagcgatttcgcgcgtggcggagtcgttgggtgatgcaggaattttatcctgggcggctaggactgcgtcacgctcaaggtgttcgattaattgcctctgagagcacacacacgtgcgagctcagctgctataggtatactggtttgagtggtttttgaattctgatcaattgcgagagagatggttgggagcgtgcatatgaatggatcggtgcacggtgccaatggcactgaggagcggctggacgagctgcgccggctgctcggcaagtcggagggagacttgctcaagatcgtcagcgtcggtgctggcgcgtggggcagtgtctttgctgctcttctgcaggacgcctatggccacttccgggagaaggtgcagataaggatttggcgtcgcccggggaggacagtcgaccggtccactgcagagcatctcttcgaggtgatcaactcgagggaggacgttctaaggcgcctcattcgccgctgtgcctacctgaagtatgtcgaggcacggctcggggatcggacattgtatgctgatgagatattgaaggatggattctgtctgaacatgatcgaaacaccgctctgccctctgaaggtcgtcaccaacctgcaggaagccgtctgggatgctgacattgtggtgaatggagtgccatccaccgagacaagggaggtgtttgaggagatcagtaagtattggaaggagaggatcagtgttccggtaataatttccctggcaaaggggatagaagcctcattggatccgattcctcatatcattacacccactcaaatgattagttcagcaactggagttccaactgagaatatactctatcttggaggaccaaacatcgcctcagaaatttataacaaagaatacgcaaacgctcgaatctgtggatccaacaagtggaggaagcctcttgctaagtttttgaggcagccacatttcattgtctgggacaacagtgatcttgtcactcatgaggtgatgggtggcctgaagaatgtctatgcaattggcgctggaatggtggcagctttaacaaatgagagtgcaacaagcaaatctgtatattttgctcattgcacgtcagagatgatattcattactcacttgttaacagaacaacctgagaaacttgctggtcctctgctggctgacacttatgtaactctcctaaaaggtcgcaatgcatggtatgggcaaatgcttgccaagggagagttgagtcctgacatgggtgatagtatcaagggaaagggaatgattcagggtatctctgccgttggtgcattttttgagctgcttagtcaacccagtttaagtgtgcaacacccggaagaaaacaagcaggttgctccagctgaactatgcccaatcctgaagaggctttacagaatattgataaaaagggagctcccagcaagagacattctccaagccttgagggatgaaacgatgaatgatcctcgcgaaaggattgagatggcacaaagccatgcattctaccgcccatctctcctcgggaaaccatgatcatattagttctgtatattagaagaacataaacgaaggtgggatgagatcgaatttgccaagctaccgatcattcttgatcgaacttggagcaggtgtatctgcactgctgctggcctgtgtttgagcttatagggccttcgtcagttgtggaattttttgtgctccttcattgccatgttgtacaagatcactgaatcaataaactttatgatcgccagtcatatgaacagagtacctgaggaataagctactcttgaatctcttgatggaaattag

SEQ ID NO: 3886 - DNA, 2050 bp, Musa acuminata
cagctgtccaatctcggatctttgccctctgttcatgctcacctacgccttccctccgtgagcaacaagccgaggcggcgccgtccatgcgatgggcgggtttcgtgcgtaaacgacggggaaagagcacgaggatggacggttctggagttcgctgcacggcacgcggcttcttccgtcattgcgtttccatgtgaagagagatggtgggcagcgtcgacggaacccgcggttcttcccattctaacggacctgttagctgctctaatggcgcggaagagaggttggatgagctccgtcggctcctgggcaaatcagagggtgacctgctcaagatcgtcggcgtcggcgccggggcgtggggcagcgtctttgctgccctcctgcaggatgcctacggccagttccgcgagaaggtacaaatcagaatatggaggcgtcctgggcggcccgtcgaccgctccaccgcagagcatctcttcgaggtgatcaactcgagggaggatgtcttgaggcggctgatcaggcggtgcgcgtatctgaagtacgtcgaggcgaggctcggcgaccgcacgttatacgcagacgagatcttgagggatggattctgcttgaacatgattgacacgccgatttgcccgctgaaggtcgtgaccaatctgcaggaggcagtgtgggacgctgatatcgtggtgaacggcttgccgtcaacggagacgagggaggtgttcggggagattagccggtattggaaggagaggatcggtgcaccaatcatcatatctctggccaagggcatagaggcagctttggatccggttccgcggatcataacacctacacagatgattaaccatgcaactggagttcctattgagaacattctctatgttggtgggccaaacattgcttcagagatttacaacaaggaatatgctaacgctcggatatgtggagccgaaaaatggaggaaaccactcgcaaagtttttgaggcagcctcattttatcgtatgggataatagtgaccttgtcacacatgaggttatgggagggttgaagaacgtctacgctattggtgctgggatgatagcggctctaaccaatgaaagcgctactagcaaatcggtatattttgcgcattgcacatcagagatgatattcatcactcacctcttggctgaagacccagagaagttagctggaccactgctagctgacacatatgtgaccctattgaaaggtcgcaatgcatggtatggtcagatgttggccaagggtgagattagtctggacatgggcgatagtatcaagggaaaagggacaattcagggcgtctctgctgtgcatgcattttatgaactcctaagtcaacccagcttaagcgttttggatcctgaagaacagaagcacgttgcaccagttgagctgtgccccattatgaaaacgcttcacaagatattgatcaagagggaacttcggacaaacgcaatccttcaagcactgagagatgaaacaatgaacgatcctcgtgatcggatcgagctggcacaaagccatgctttctacagaccgtcgcttcttggtcatgaccattgatgcaacatcgtatatcgaccgttgtaattgagtgtcagaattcagtgcactgtaaagcttattgttcaggcagtggattttgcatgaattgctttgaattaccagtggattctgaagcaaatgtcaaatgtccattaagcatgacaggttgagtcgggagcttgtgggatgatagtatctaagatagagcacacctatttggtgagacactcgaatccaatagccatccctttgacatcttcaagtggcattttgagtatcatcaaacctcatcagcgtgatcagatgagctttcaggaatcattgtaccaattgtggccaaaagaagagatcatcatcacataattgtgcattgagcacgagatgttaagaaaatgtgtggaaagcattattgttttgagatacatgtattttcatgtgtgtgttctccaaatagaaggcttttccataca

SEQ ID NO: 3887 - DNA, 1357 bp, Echinochloa colona
acacgacgacttgctgcaggacgcgtacggccacctccgcgacaaggcgcaggtccggcagtctggcgccgcccgggccgcgccgtcgaccgcgccaccgccgagcacctcttcgaggtcatcaacgcgcgcgaggacgtcctgcgccgcctgatccgccgctgcgcctacctcaagtacgtcgaggcgcgcctcggggaccgcacgctctacgccgacgagatactcagggacggcttctgcctcaacatggtcgacacgccgctctgcccgctcaaggtcgtcaccaacctccaggaggccgtctgggacgccgacattgtcgtcaacggcgtgccgtccaccggcaccagggaggtgttcggggagattgggaggtactggaaggagaggatcactgcccccatcatcatctcgctggccaaggggatagaggcctccctggatccgctgccacggatcattactcccacgcagatgattagcaatgcaactggggtcccattggagaacattctatatcttggtggccctaatatcgcttctgaaatttacaacaaagaatatgcaaatgcacggatttgtggagctgacaaatggagaaaacctcttgcaaaatttttgaggcagcctcattttatcgtatgggataatagtgacctcatcactcatgaagttatgggaggcttaaaaaatgtatatgctattggtgctggtatggtagcagcactaaccaatgagagcgcaacaagcaaatctgtttactttgcactctgcacatctgagatgatctacatcacacaccttctggaagaagaacctgaaaaactagctggaccgttattagctgacacttatgtaacattgttgaaaggtcgtaatgcctggtatgggcagaaattagctaaaggggaattgacactggaaatgggtgacagcataaaaggcaaagggaccattcagggtgtctctgcagttgaagcattttatgagcttcttagtcaggatagcttaagtgtgatgcatccagaaggcaacaagtctgttgcaccggttgagatgtgcccgatcctaaaagcgcttcatagaattttgatcaagagggaccgtcctgccgattcgattcttcaggctataagagatgagacaatgtatgatcctcgcgaaagaattgagatggcacaaagccactcactttaccgaccatctcttcttggtcaaccaaaaggagatgtaaaagcctagaaagttattttcttttccttcctcttgttggttagaatttagacgatcttccaagtcgctctgtgctcttatgcatcctgctgctgttgttgtaacattagtaagtctgaga

SEQ ID NO: 3888 - DNA, 2178 bp, Populus trichocarpa
ctttgttgttgttaacagataaggtcggtgtttttgactttatatatatttatttgttttttgaaagtttatagctgggtagatgaacaaactcagacggacaaaacaaagttatagggtttgatttttctcattttgtcatgtactaattgagtagatgaaagaagggttcgtgtatttcttccacctcttctcttgttttgtactttagtgtcaaattattagaggtttccttaataggttggtttgaaaatcttagtagaggaatgaaaaattagttttggtttaggtaataagatctaccaataaagatttcatttttaatgcaaggtgacaacttggtaatcaggacttggttttttcgagggaagatttgagtagtttggagttgtgagatcaaaatctataccaggatcaatgttgggctgattttagaatttggtatagttgatgaaatttcaatattgatacccattagagtataccttttctattggacacagttcgatcttgctaatttattgttgctagaagaagatggttggaagtattaagacaatgaatcatcacggtaatggatggtctgctcaaaattgtaatggcctagaagagaagcttgatgagcttcgaagccttctaggcaagactgatggtgatcctctgagaattgtcggcgttggagcaggtgcttgggggagtgtttttgcagctttgctgcaggatagttatggtcggttccgagagaaggtccaaatcaggatatggagaaggcctggaagggctgttgatagagtcacagcagagcatctctttgaagtgatcaattcgagggaggatgtattgaggaggttgatccggcgatgtgcatatttgaagtacgttgaggccaggctaggcgatcggactctatttgctgatgagattttgaaggatggattttgcttgaacatgattgatgtaccactttgtcctttgaaggttgtgactaatttgcaagaggctgtttgggatgctgatattgtggtaaatgctgtgccttccacagagacacgcgaggtgtttgaagagattagccaatattggaaggagagaatcacaacacccatcatcatctctttggcgaagggtatagaagctgcattagaacctgttccccatataatcacacctacacaaatgattaacagagcgactggagtaccaacgcagaatatactttatcttggtggaccaaatattgcttcagaaatatacaacaaggaatatgctaatgctcgaatatgtggagctgataagtggagaaagcctctggctaaatttctaaggcagccccatttcattgtgtgggacaacagtgaccttgtcactcatgaagtcatgggtggcctgaagaatgtctatgccattggagctgggatggtagcagcccttactaatgaaagtgctaccagcaagtcagtctactttgcacattgtacatcagagatgatatttattactcatctattggctgaagaacctgagaagcttgcagggcctttgctggcggacacatatgtaaccttgttaaagggtcgtaatgcatggtatggccaaatgttagccaaaggggaaattagccgggatattggtgataacatcagtgggaaaggaatgattcagggtgtttcggcagttggagcattctatgaactcctgagccagtcaagcttgagtgtgttacatcctgatgaaaagaaacctgttgcacctgttgaactctgcccgatcttgaaaacattgtataaaatactgataataagggagcaatcatcacaagctatcctccaagcactaagggatgaaacactgaatgatcctcgggaacgcatcgagattgcacaaagccatgctttctacaggccttctcttcttggccaacctttggctactttgcattgccaataaaagttatcatgaaggaattaatagaacatataaaagaaattgttgaatgagccctctgaataaaaacacattgctgttataatgtattctgtattgtcttagtattatgaaagctcaaagcctttaattagttgattgatttcatcatcttgcgttatttttgtggaacacttgctgagcttaaaattataaactctatgtattcagaaggtttggagttcgacattgcac

SEQ ID NO: 3889 - DNA, 1470 bp, Citrullus lanatus
ttcttttgtttctctggggctggtttttcttcataggagacagacaatgagtccctcacattcaaatggttcaactcataactgcaatggattggaagagaagcttgatgaacttagaaggcttataggtaagtctgatggtgatccactgaggattgttggtgtgggagctggagcttgggggagcgtttttgcagctctgcttcaagacagctatggccaatttcgagagaaggttcaaatccggatatggagaagagcaggaagagttgtggataaagccacagcagaacacctctttgaagtgatcaattcaagggaagatgtgctgaggaggctcattaggcgatgtgcttatctaaagtatgtcgaagcgaggctaggtgatcgggtgctctacgcagatgagattttgaaagatggattttgcttgaacatgattgacacaccactttgccctttaaaggtggtgaccaacttgcaggaggctgtttgggatgctgacattgtggtcaatggcctaccctccactgaaaccagagagatttttgaagagataagtaaatattggaaagagagaatcacagtgcctattattatctctttggcaaagggtatagaagctgctctgcagcctgttccccacataataactcctactctgatgatcaatcgggcaactggagtgcctatagaaaatatattgtatcttggtggaccaaatatcgcctcggagatttataacaaggaatatgcgaatgctcgaatttgcggagctgaaaagtggaggaaaccccttgcaaactttttgaggcaacctcagtttattgtctgggataatagtgaccttgtgacacatgaagtcatgggcggtctaaaaaatgtctatgccattggagcagggatggtggcagcccttactaatgagagtgccaccagtaaatcagtatattttgcacattgtacctcagagatgatattcattacttacttgctagcagaagaacccgagaagctagctgggcctttgctcgctgacacgtatgtgaccttgttgaaaggtcgtaatgcctggtacgggcaaatgttggccaagggtgaacttagcctagatatgggtgatagcattagtggcaaagggatgattcagggagtgtctgctgttagtgctttctatgaaattctgagtcagtcaagcttaaatgtgttacatcccgaagacaacaagcctgtcgctcctgtgcagctttgtcccatcttaaagacactatataaaatactgattaaaagggatggatcacctcaagctatacttgaagcattgcgagacgagaccttgaatgatccccgagatcgcatagagttggcacaaagccatgctttctacaggccttcacttcttggtcaaccttgagttgtagattccatgtcaaaacttaaaactgggcaaacacatctgacttcatggaa

SEQ ID NO: 3890 - DNA, 2026 bp, Gossypium hirsutum
tttcctatttcttttttattatatcccttagcagccttcaatgaactccaactgtttagatgcattcattctgatgatattgttttatattggaactctgtacaagaacaatctctagaacgggttggtatgaatatctatatggagtgatcaaaagttagctctggttttggtacaagaatccaccaataaaattttgttcttattcaatcagggagaattcaacatgtttttccttgtttcaagtaaaggctgtttagtgcggttttaggagagcaaaagccatataaagtcattaggtaatttggcaaaatttccatgatccttttctacctcacaacatatatcctacatccttagaatcagagaattgggttttctttgttggaaaaagatggtagggagtatagacacattgcaccggagtttgaactcaaatggatctttctacaactgtaatggtttggaggagaaacttgatgagcttcggcaccttctatgcaagagtgatggtgatccgttgaggattgtgagtgtgggagctggtgcttggggaagtgtgttcgcagctttgctgcaagatagctacgggcagtttcgagacaaggttcaaatcagaatatggaggaggcctggaagagcagttgatagagctaccgcagaacatctctttgaagtgatcaattccagggaagatgtattgaggaggttgatacgacgttgtgcctatttgaagtatgttgaggctagactaggcgatcgaacactatttgcggatgagattttgaaagatgggttttgcttgaacatgattgatacgccactttgtcctttgaaagttgtgactaacttgcaggaagctgtttgggatgccgacatcgtggtaaacggcttgccttccaccgagacacgtgatgtattccaagagatcagcaattattggaaagaaaggatcactgtgcctatcattatctctttgtctaagggtatagaggctgcactgcaaccgcttcctcatatcattaccccaacacagatgattaatcgagcaactggagtacctatagagaacatactctatcttgggggaccaaatattgcctctgagatatacaataaggaatatgctaacgctcgaatatgtggagccgaacagtggagaaaaccgctagcaaagttcttaagacagccccatttcattgtatgggacaacagtgatcttgtcactcatgaagtcatgggcggcctgaagaatgtctatgccatcggagctggaatggtagcagccctgaccaaggaaagtgctactagcaaatcagtgtattttgcacattgtacatcagaaatgatatttattacccatttgttggctgaagaaccagagaagctggcaggccctttgctggctgacacttatgtgacattgttaaaaggtcgtaatgcatggtatggccaaatgttagccaaaggagaactaagtcgagatatgggtgatagcatcagcggaaaaggaatgattcagggagtgtctgcagtaggagcattttatgaacttctgagtcaatcgagcttaagtgtgttgcatccagatggaaacaagcctgttgcccctgttgagttgtgccctttattgaagacgctctacaaaattcttataacaagggagaagacggctgaagcgattctgcaggcactgagggatgaaaccctgaatgatcctcgagagcgcatcgagattgcccagacacatgcattctataaaccttcacttctaggccagccttgacaagtttgatgcataccaagatttcaagtttaaagggaactaatcatatgtaaccaattgtttcagaattcaacatggtgtgtcattgtcattgtcataaatatagagtactgtactgcctttatccgaaactccatccttgaaatttgtctgagtgaatttttttttcttttttgacaaagggagcatttttatgttgtgacaacaagaatgaaatttttttagcgagaatcacgagaa

SEQ ID NO: 3891 - DNA, 2158 bp, Gossypium raimondii
gcccgcttgtctttttctttttatttattattctatcttttctgttgaagtttatagttgggtagatgaacaaactctagacggagatatcaatgttttgttttgtttcctatttttttttttatatcccttagctgccttcaatgaactccaactgtttagatgcattcattctgatgatattgttttatattggaactctgtacaagaacaatttctagaacgggttggtatgaatatctatagggagtgagcaaaagttagctctggttttggtacaagaatccaccaataaaattttgttcttattcaatcagggagaattcaacatgtttttccttgtttcaagtaaaggctgtttagtgcggttttaggagagcaaaagccatataaagtcattaggtaatttggcaaaatttccatgatccttttctacctcacaacatatatcctacatccttagaatcagagaattgggttttctttgttggaaaaagatggtagggagtatagacacattgcaccggagtttgaactcaaatggatctttctacaactgtaatggtttggaggagaaacttgatgagcttcggcaccttctatgcaagagtgatggtgatccgttgaggattgtgagtgtgggagctggtgcttggggaagtgtgttcgcagctttgctgcaagatagctacgggcagtttcgagacaaggttcaaatcagaatatggaggaggcctggaagagcagttgatagagctaccgcagaacatctctttgaagtgatcaattccagggaagatgtattgaggaggttgatacgacgttgtgcctatttgaagtatgttgaggctagactaggcgatcgaacactatttgcggatgagattttgaaagatgggttttgcttgaacatgattgatacgccactttgtcctttgaaagttgtgactaacttgcaggaagctgtttgggatgccgacatcgtggtaaacggcttgccttccaccgagacacgtgatgtgttccaagagatcagcaattattggaaagaaaggatcactgtgcctatcattatctctttgtctaagggtatagaggctgcactgcaaccccttcctcatatcattaccccaacacaaatgattaatcgagcaactggagtacctatagagaacatactctatcttgggggaccaaatattgcctctgagatatacaataaggaatatgctaacgctcgaatatgtggagccgaacagtggagaaaaccgctagcaaagttcttaagacagccccatttcattgtatgggacaacagtgatcttgtcactcatgaagtcatgggcggcctgaagaatgtctatgccatcggagccggaatggtagcagccctgaccaaggaaagtgctactagcaaatcagtgtattttgcacattgtacatcagaaatgatatttattacccatttgttggctgaagaaccagagaagctggcaggccctttgctggctgacacttatgtgacattgttaaaaggtcgtaatgcatggtatggccaaatgttagccaaaggagaactaagtcgagatatgggtgatagcatcagcggaaaaggaatgattcagggagtgtctgcagtaggagcattttatgaacttctgagtcaatcgagcttaagtgtgttgcatccagatggaaacaagcctgttgcccctgttgagttgtgccctttattgaagacgctctacaaaattcttataacaagggagaagacggctgaagcgattctgcaggcactgagggatgaaaccctgaatgatcctcgagagcgcatcgagattgcccagacacatgcattctataaaccttcacttctaggccagccttgacaagtttgatgcataccaagatttcaagtttaaagggaactaatcatatgtaaccaattgtttcagaattcaacatggtgtgtcattgtcattgtcataaatatagagtgctgcctttatccgaagctccatccatgaaatttgtctgagtgatttttttttcttttttgacaaagggagcatttttatgttgtgacaacaagaatgaaaattttttagcgagaatcacgagaatttaaatgattccaactcttgaatttaaagtcaac

SEQ ID NO: 3892 - DNA, 1660 bp, Zea mays
cctagctctagtctagaataaaacatctatctatctttatctatctatctatctatttgttgaacaggggccccccggaaactagctagctaggatgccaacagcagaggcgacgacgcccgtgccgccggagctgtcctccgggcaagggcggacggtttgcgtgaccggagctggagggttcattgcctcctggctcgtcaagcgcctcctggagaagggctacacagtccgcggcacggtcaggaaccctgtggatccaaagaacgaccacctgaggtcccttgacggcgccgacgaccgcctcgtcctcctccgcgccgacctgctggacccagagagccttgccgaggccttctccggctgtgacggcgtcttccacgccgcctccccggtcaccgatgaccctgagatgatgatcgagccagcgatccggggcacgcgctacgtgatggcggcggcggcagacgccggagtgaagcgcgtcgtgttcacgtcctccatcggcaccgtgtacatgaacccctaccgtgaccccagcaagcctgtggacgacacctgctggagcgacctcgagtattgcaagaacacccagaactggtactgctacgccaagacggtggcggagcagggcgcgtgggaggtggcgcggaagcgagggctggacctggtggtggtgaacccggtgctggtgctgggcccgctgctgcagccgacggtgaacgccagcacggaccacgtgatgaagtacctgacggggtcggccacgacctacgtgaacgcggcgcaggcgtacgtgcacgtcagggacgtggccgaggcgcacgtccgggtgtacgaggcgccccacgcgcacggccgctacatctgcgccgagagcaccctgcaccgcggcgacctctgccgcgtcctcgccaagctcttcccggagtaccccgtacccaccaagtgcaaggaccaggttaaccctccggtggtaggatacaagttcaccaaccagcgcctcaaggatctggggatggacttcgtgccggtcctccagtgcctctacgagacggtcaccagcctccaggagaaaggcatgctgcccgtgcttccgacaaaacacgaccatgcatgaccaactcggcaaatcatgatcatatcgatcccatccttgacgatactagctgctgctaccacgcatatcatatcatatatatacgatatatatagtggattcatataattgaccttatatatatatatatatatatatatatatatatatatatatatataatatgtgtgtgtgtgtgtgttattagtgtgtacaattaaatggcaactctaatgggtgcatgcatctgcatgcatgctttcctgacaagtgccacacatgcctgcaatgtatctctttggacgaatatttatatacaatactccgttgccaaatagatcatctatatatttccgagtaatacttttaacaaatctcgtttgcgtccgaaacttttatgatttgccacgaccttccgttattcttcacaacgtatatacataataatatatactcctacaacatataaacaaataatggtacctagtacctaacggttcttccgaggcaatgaattgaacacagctcgtacttaattagtagaaagccaaacactggaag

SEQ ID NO: 3893 - DNA, 1467 bp, Zea mays
agctcctcgcacacacatcacatcctatgtactcggctgctacgtagctatatatagctgcagaacagttttagttaccggactgtaggcacaccaagctaggggccccccggaaactagctagctaggatgccaacagcagaggcgacgacgcccgtgccgccggagctgtcctccgggcaagggcggacggtttgcgtgaccggagctggagggttcattgcctcctggctcgtcaagcgcctcctggagaagggctacacagtccgcggcacggtcaggaaccctgtggatccaaagaacgaccacctgaggtcccttgacggcgccgacgaccgcctcgtcctcctccgcgccgacctgctggacccagagagccttgccgaggccttctccggctgtgacggcgtcttccacgccgcctccccggtcaccgatgaccctgagatgatgatcgagccagcgatccggggcacgcgctacgtgatggcggcggcggcagacgccggagtgaagcgcgtcgtgttcacgtcctccatcggcaccgtgtacatgaacccctaccgtgaccccagcaagcctgtggacgacacctgctggagcgacctcgagtattgcaagaacacccagaactggtactgctacgccaagacggtggcggagcagggcgcgtgggaggtggcgcggaagcgagggctggacctggtggtggtgaacccggtgctggtgctgggcccgctgctgcagccgacggtgaacgccagcacggaccacgtgatgaagtacctgacggggtcggccacgacctacgtgaacgcggcgcaggcgtacgtgcacgtcagggacgtggccgaggcgcacgtccgggtgtacgaggcgccccacgcgcacggccgctacatctgcgccgagagcaccctgcaccgcggcgacctctgccgcgtcctcgccaagctcttcccggagtaccccgtacccaccaagtgcaaggaccaggttaaccctccggtggtaggatacaagttcaccaaccagcgcctcaaggatctggggatggacttcgtgccggtcctccagtgcctctacgagacggtcaccagcctccaggagaaaggcatgctgcccgtgcttccgacaaaacacgaccatgcatgaccaactcggcaaatcatgatcatatcgatcccatccttgacgatactagctgctgctaccacgcatatcatatcatatatatacgatatatatagtggattcatataattgaccttatatatatatatatatatatatatatatatatatatatatatataatatgtgtgtgtgtgtgtgttattagtgtgtacaattaaatggcaactctaatgggtgcatgcatctgcatgcatgctttcctgacaagtgccacacatgcatgcaatgtatctctttggacgaatttatatacaatactccgttgccaaa

SEQ ID NO: 3894 - DNA, 1485 bp, Setaria italica
cccaccagcactgtacttccttactcatctagtgatctagagcatatctggagaacgggttttcagcaagagtacctgtattaggctaactgctagggaccaatccatttcacatcatacacgcagacaagtcttccttttgatttggagggataccgaccatgccgactgagacgcccatgcccgccctctccggccacggccggacggtctgcgtcactggcgccggagggttcattgcctcctggctcgtcaagcgcctcctggagaagggttacactgtccgcggcacggtcaggaacccagttgatccaaagaacgaccacctgagggcgcttgaaggtgccacggaccgcctcgttctcctccgcgccgacttactggatcccgacagccttctcgcggccttctccggctgcgagggtgtcttccacgccgcctcgccggtcacagatgaccctgagaagatgatcgagccggcgatcctgggcacgcggtacgtgatcacggcggcggcggacaccggcgtcaagcgcgtcgtgttcacgtcctccatcggcacggtgtatatgaacccgtaccgcgaccccaacaagctcgtcgacgacacctgctggagcgacctcgaatactgcaagaagaccaagaactggtactgctacgcgaagacggttgccgagcagggcgcgtgggaggtggcgcggatgcgcggcctggacctgattgtggtgaacccggtgctggtgctgggtccgttgttgcagccaacggtgaacgcgagcacggaccacgtgatgaagtacctgacggggtcagccaagacgtacgtgaacgcggcgcaggcgtacgtgcacgtcatggacgtcgccgaggcgcatgtccgggtgtacgaggcgcccggcgcgcacggccgctacatctgcgccgagagcaccctccaccgcggcgagctttgccgcatcctcgccaagctcttcccggagtaccccatacccaccaagtgcaaggacgaagtgaaccccccggtgatcggttacaagttcaccaaccagcggctcaaggatctggggatggagttcgtgccggtgctgcagtgcctctacgagacggtgaagagccttcaggagaaagggatgctgccagtgctcccgccaaacgaccaggaccaacaacttatcacatcatgattattccatgtcattccactactggtctacttcatgctactacatatgacgagctatagctgattgatatatatagttaacctttttatccatatatatccatgcactcgtggcaagtttaatcggtgcatgcacgcgtgacagccaccgacccatatgttaagtgctgtatgacgtacacatgcagcacatctgtttggaaacgatatgattgtaatataatacatctgctgtgagccataagtgtaagtgggcaccctagacaaatccatgaagatatcaggtgcaaaaataggtg

SEQ ID NO: 3895 - DNA, 1248 bp, Echinochloa colona
acatcctagcactgtacgctcttctagagcatatatctggacaactatattttagcaggagtacctgtacgtcccaggccaactgctaggccggcatcaaaatccatttcaacgcgcacacacatacgtcgtgtgcctttaggttggagggatataccatgccggtcgagacgcccatgccggccctctccggtcacggccggacggtctgcgtcaccggcgccggagggttcattgcctcctggctcgtcaagcgcctcctggagaagggttacactgtccgcggcacggtcaggaaccctgttgatccgaagaatgaccacctgagggcgcttgagggtgctgctgaccgcctcgtccttctgcgcgccgacttgctggatcccgacagccttctcgcggccttctccggctgcgagggggtcttccatgccgcctccccagtcaccgatgaccctgagaagatgatcgagccggcgatccgcggcacacggtatgtgatcacggcggcggccgacaccggcgtcaagcgcgtcgtgttcacgtcctccatcggcacggtgtacatgaacccgtaccgcgaccccagcaagccagtcgacgacacctgctggagcgacctcgaatactgcaagaagaccgagaactggtactgctacgcgaagacggtcgccgagcagggcgcatgggaggtagcccggaagcgcggcctggacctgatcgtggtgaacccggtgctggtgcttggccctctgctgcagccgacggtgaacgcgagcacggaccacgtgatgaagtacctgacggggtcggccaagacgtacgtaaacgcggcgcaggcgtacgtgcacgtcaaggacgtggccgaggcgcacgtccgggtgtacgaggcgcccgacgcgcacggccgctacatctgcgccgagagcaccctccaccgcggcgacctctgccgcatcctcgctaagctcttcccggagtaccccatacccaccaggtgcaaggacgaggtgaaccctccggtaataggttacaagttcaccaaccagcggctcaaggaacttgggatggagttcgtgccggtgctgcagtgcctctacgagactgtgaagagcctccaggagaaagggatgctacccgtgctaccgccaaacgagcaggaccaacgacttatcgcgtcatgattccaacactatgctcactactggtctactgcattctactacatatatcacgatcgagctagct

SEQ ID NO: 3896 - DNA, 1433 bp, Echinochloa colona
tggcacacatcctagcactgtacgctcttctagagcatatatctggacaacaatattttagcaggagtacctgtcccaggctaactgctaggccggcctcaaaatccatttcaacgcacacacccatacgtcgtgttcctttaggttggagggatataccatgccggtcgagacgcccatgccggccctctccggtcacggccggatggtctgcgtcaccggcgccggagggttcattgcctcctggctcgtcaagcgcctcctggagaagggttacactgtccgcggcacggtcaggaaccctgttgatccgaagaatgaccacctgagggcgcttgagggtgctgctgaccgcctcgtccttctgcgcgccgacttgctggatcccgacagccttctcgcggccttctccggctgcgagggggtcttccatgccgcctccccagtcaccgatgaccctgagaagatgatcgagccggcgatccgcggcacaaggtacgtgatcacggcggcggcggacgccggcgtcaagcgcgtcgtgttcacgtcctccatcggcacggtgtacatgaacccgtaccgcgaccccagcaagcccgtcgatgacacctgctggagtgacctcgaatactgcaagaagaccgagaactggtactgctacgcgaagacggtcgccgagcagggtgcatgggaggtggcccggaagcgcggcctggacctgatcgtggtgaacccggtgctggtgcttggccctctgctgcagccgacggtgaacgcgagcacggaccacgtgatgaagtacctgacggggtcggccaagacgtacgtaaacgcggcgcaggcgtacgtgcacgtcaaggacgtggccgaggcgcacgtccgggtgtacgaggcgcccgacgcgcacggccgctacatctgcgccgagagcaccctccaccgcggcgacctctgccgcatcctcaccaagctcttccccgagtaccccatacccaccaagtgcaaggacgaggtgaaccctccggtaataggttacaagttcaccaaccagcggctcaagggacttgggatggagttcgtgccggtgctgcagtgcctctacgagactgtgaagagcctccaggagaaagggatgctgcccgtgctgccgccaaacgagcaggaccaacgacttatcgcgtcatgattccaacactatgctcactactggtctactgcattctactacatatatcacgatcgagctagctgattaatatatatagttaacctttttatccatatatatatgcatgtactcgtggcaactttaattggtgcatgcatgcgtgagagccaccgacccatacatatatcagtgctgtgtgacgaacacatgcaacaacacatctgtttaatctatatgatttgtaatatatatctgtcgtgagcaa

SEQ ID NO: 3897 - DNA, 1950 bp, Panicum virgatum
cgactagttagctgctaccaactctttgcagatccggattggagctgctgggtggcctacgcgcgactcggctcatcaactggttaagaaaaagcaaaccatcaataggtaccttagtctgccgtctccatgtctctgctaccatcccacactgacaaatagaagcttcttaccatgtactacacggaatattttaaatccaaaaagaagatgtactaataatcctcatgcagattcattcatcaagtagagtacaagcaaataaagaaaatttctcaccaactactcccaggctaggactctctcgctcagggccccaccctttcaaccgtctttgaacctactctcgcactgagtttccccagccctatatatggccacaatctcgcctgatctccttgcatacataccccagcactgtaatcgcctttctcttctagagcatacctggagaacagtttttcaccaagagtacctgtctcaggctaactggtaggcaccatttcacatcacacaaacacacaccttccttttgacttggaggccgggatactacaccatgccgattgagacgcccatgccggccctctccggccacggcctgacggtctgcgtgaccggcgccggaggattcatcgcctcctggctcgtcaagcgcctcctggagaagggctacactgtccgcggcacggtcaggaaccctgttgatcccaagaacgaccacctgagggcgcttgaaggtgccgccgaccgcctcactctcgtccgcgccgacttgctggagcccgacagccttctcgcggccttctccggctgcgagggtgtcttccatgctgcctccccggtcaccgatgatcccgagaagatgatcgagccggcgatccgcggcacaaggcacgtgatgacggtggccgcggacaccggcgtgaagcgcgtcgtgttcacgtcctccatcggcacggtgtacatgaacccataccgcgaccccaacgagcccgtcgacgacacctgctggagcgacctcgagtactgcaagaagaccgagaactggtactgctacgcgaagacggtggcggagcagggcgcgtgggaggtggcgcggaagcgcgggctggacctggtagttgtgaacccggtgctggtgctgggtccgctgctgcagccgacggtgaacgcgagcacggaccacgtgatgaagtacctgacggggtcggccaagacgtacgtgaacgcggcgcaggcctacgtgcacgtcaaggacgtcgccgaggcgcacgtccgggtgtacgaggccgcccacgcgcacggccgctacatctgcgccgagagcaccctccaccgcggcgagctctgccgtatcctcgccaagctcttcccggagtaccccatacccaccaagtgtaaggacgaggtgaatcctccggtggccggatacaagttcagcaaccagcggctcaaggatctagggatcgagttcgtgccggtgctgcagtgcctgtacgagacggtgaagagcctccaggagaaagggatgctgcccgtcctcccgccaaacgacgaccaccaccccgaccaactgatgacatcatgatcatcgcaaggttcactactgatggcctacggcatgctgccacgcatatcatgagctagctgattaatatattataagcaaacctttttatcaacctaatatatggcaactttcgtggttgcatgcatgtacgcgtgacaaacactgcaccgaacgacccaaatgttagtgctgtatgacgtacacatgcaacacatctttgtggaatatatatgattgtaatttatataactgctctgagcaataactgggctcctttttagctgctatcctatgccacacacttggccttttgcttgtcctcgagtagagattgaaggaccaaataaagcggatgcaactcctttgataaaacctgc

SEQ ID NO: 3898 - DNA, 1636 bp, Oryza sativa
gcatccgctgcacccaccactcaaaaacctgcagcttgctccctagcttagctagcagacgacgacacaggtgtacctagcaaactagctagcaactgtacacgcgtagctgtcgtcatccctgcagggggcgtgataacatatatcatagggaaattaaattaactagctcgaagaaattcagggaggagatcgactgatcgagatgccgactgacgagacaaccgcggcggcgccggccaccaccgcgctctccggccatgggcgcaccgtgtgcgtcaccggcgccggcgggttcatcgcgtcgtggctcgtcaagcgcctcctcgagaagggctacaccgtgcgtggcaccgtccggaaccctatggacccgaagaacgaccacctgagagccctggacggcgccggcgagcgcctcgtcctcctccgcgccgacctcctcgaacccgacagcctcgtcgccgccttcaccggctgcgagggcgtcttccacgctgcctcccccgtcaccgatgatcctgagaagatgatagagccggcgatcagggggacgagatacgtgataacggcggcggccgacaccggcatcaagcgtgtggtgttcacgtcctccatcggcactgtctacatgaacccctacagggaccccaacaagcccgtcgacgacacctgctggagtgacctcgaatactgcaagaggacagagaactggtactgctacgcgaagacggtggcggagcagggtgcgtgggaggtggcgcggcggcgtggggtggacctggtggtagtgaacccggtgctggtgctgggaccgctgctgcaggcgacggtgaacgcgagcacggagcacgtgatgaagtacctgacggggtcggccaagacgtacgtgaacgcagcgcaggcgtacgtccacgtccgcgacgtcgccgaggcgcacgtccgcgtgtacgagtgcggcggcgcgcggggccggtacatctgcgccgagagcaccctgcaccgcggcgacctctgccgcgccctcgccaagcttttcccggagtaccccgtcccgagcaggtgcaaggacgaggcggcgccgccggtgaaggggtacctcttctccaaccagcgcctccgtgacctcggcatggacttcgtccccgtccgccagtgcctctacgaaaccgtgcgaagcctccaggacaagggcttgctgccggtgctgccgcccaccgccgacgaccaccaccacccttcctcgtgatcccccatccagctcccccggcgcccggccatcgtcactgcatattaatttctactggctgctgatatatactcttattgagttctaattttttcctttttccgatcggtttttacatatatattatatctacatgcacaccgatcgacacacgtatgtatatttttatgtgtgtattgtacgtgtattatgtatgtgatttaatggccgggtgcatgcatgcgcgactcgtgagcaaagtgatatagcgtcagtgctgtgtgtgacgtgcacagtgcatttaattagtacgtaatctatgtttggtgtcactgtaatataagcatatgatattgctccttggtaggagtgcatataattaatcaaatgtcatgcacctaagctgag

SEQ ID NO: 3899 - DNA, 1547 bp, Oryza sativa
ccaccactcaaaaacctgcagcttgctccctagcttagctagcagacgacgacacaggtgtacctagcaaactagctagcaactgtacacgcgtagctgtcgtcgtccctgcagggggcgtgataacatatatcacagggaaattaaattaactagctcgaagaaattcagggaggagatcgactgatcgagatgccgactgacgagacagccgcggcggcgccggccaccaccgcgctctccggccatgggtgcaccgtgtgcgtcaccggcgccggcgggttcatcgcgtcgtggctcgtcaagcgcctcctcgagaagggctacaccgtgcgtggcaccgtccggaaccctatggacccgaagaacgaccacctgagagccctggacggcgccggcgagcgcctcgtcctcctccgcgccgacctcctcgaccccgacagcctcgtcgccgccttcaccggctgcgagggcgtcttccacgctgcctcccccgtcaccgatgatcctgagaagatgatagagccggcgatcagggggacgagatacgtgataacggcggcggccgacaccggcatcaagcgagtggtgttcacgtcctccatcggcactgtctacatgaacccctacagggaccccaacaagcccgtcgacgacacctgctggagtgacctcgaatactgcaagaggacagagaactggtactgctacgcgaagacggtggcggagcagggtgcgtgggaggtggcgcggcggcgtggggtggacctggtcgtagtgaacccggtgctggtgctgggaccgctgctgcaggcgacggtgaacgcgagcacggagcacgtgatgaagtacctgacggggtcggccaagacgtacgtgaacgcagcgcaggcgtacgtccacgtccgcgacgtcgccgaggcgcacgtccgcgtgtacgactgcggcggcgcgcggggccggtacatctgcgccgagagcaccctgcaccgcggcgacctctgccgcgccctcgccaagcttttcccggagtaccccgtcccgagcaggtgcaaggacgaggcggcgccgccggtgaaggggtacctcttctccaaccagcgcctccgtgacctcggcatggacttcgtccccgtccgccagtgcctctacgaaaccgtgcgaagcctccaggacaagggcttgctgccggtgctgccgcccaccgccgacgaccaccaccacccttcctcgtgatcccccatccagctcccccggcgcccggccatcgtcactgcatattaatttctgctggctgctgatatatactcttattgagttctaattttttcctttttccgatcggtttttacatatatattatatctacatgcacaccgatcgacacacgtatgtatatttttatgtgtgtattgtacgtgtattatgtatgtgatttaatggccgggtgcatgcatgcgcgactcgtgagcaaagtgatatagcgtcagtgctgtgtgtgacgtgcacagtgcatttaattagtacgtaatctatgtttggtgtca

SEQ ID NO: 3900 - DNA, 1172 bp, Avena sativa
cctgccactctcctatagcaacagggccagatatacacgtctcgtcgtgtaactccgaaaggaaagccgagagagggagaaatgccgatcgagagcacggatagcgtgccggccgacctccccgggcacggacggacggtgtgcgtgaccggcgccggcggcttcatcgcgtcgtggctcgtgaaacgcctcctccagaaggggtacaccgtgcgcggcaccgtccgcaaccctgttgatccaaagaatgaccacctgagagccttcgacggcgccgccgaccgcctggtcctcctccgggccgacctgatggagcccgagagcctcgccgcggcgttcgccggctgcgagggcatcttccacgccgcctctcccgtcaccgacgaccctgagaagatgatcgagccggcgatacgcgggacgaactacgtgctgacggcggccgccgacctgggcatcaagcgcgtggtgttcacgtccaccatcggcacggtgtacatgaacccctacagggacgccgagaagcccgtggacgacacctgctggagcgacctcgaatactgcaagaagacagagaactggtactgctacgcgaagacggtggcggagcaggacgcgttcgcgtcggcgcggcagcggggcatcgagctgatcgtggtgaacccggtgctggttctcggcccgctgctgcagccgacggtgaacgccagcgcggagcacgtgctcaagtacctgaccgggtcggccaagacctacgtcaacgcggcgcaggcgtacgtgcacgtcaaggacgtcgccgaggcgcacgtccgcgtctacgaggcccccgccgcgcgcggccgctacatctgcgccgagggcaccacgctccaccgcggcgagctctgccgcgtcctcgccaagctcttcccggagtacccggtgcccaccaggtgcaaggacgaggtcaacccgcccgtgaaggggtacaagttcaccaaccagaggctcaaggatctgggcatggagttcgtgcccgtgctgcagagcatatacgagaccgtcaagagcctgcaggagaaagggatgctgccggtgctgccggaacaccaccacgacgaagacgacgtcgtcgtccaggacaatgatattgcactactcgtgaggagctgatcatcaagcataatgcacgg

SEQ ID NO: 3901 - DNA, 1696 bp, Triticum aestivum
gccaaagcgagcgacgaccgtcctgtcgatgcgggccacacggttttccaaccgtcttgaaccactccagctctctctttcgctgcctctataagtacagccacgatgcgtagtgccctatctcatctcatatccagcagctgcctagctctacttactacctgcgcagtgttgtgtggtactgtagtaagtagcagggaagaaccgttccgagtacacagcgtactttgggacctgtcgataccttgctaggcaccagctgctcgcaacatccccggatacgtcgtgccaatccggaagtaagccgagaggaagagagagatgccgatcgaggcggcagacaacgtaccggccgagcttcccggccacggccggacggtgtgcgtcaccggcgccggcggcttcatcgcctcgtggctcgtcaagcgcctcctccagaaggggtacaccgtgcggggcaccgttcgcaaccctgttgatccgaagaatgaccacctgagagccttcgacggcgccgccgaccgcctcgtcctcctccgcgccgaccttatggagcccgaaaccctcgtcgaggcgttcacgggctgcgagggcatcttccacgccgcttcccccgtcaccgacgaccctgagaagatgatcgagccggcgatccgggggaccaagtatgtgatcactgcagccgcggacatgggcatcaagcgtgtagtgttcacgtccaccatcggcacggtgtacatgaaccccaacagggaccccagcaagcccgtcgacgacacctgctggagcgaccttgaatactgcaaaaagacagcgaactggtactgctacgcgaagacggtggccgagcaggacgcgctggagacggcccggcagcgcggcatcgagctgatcgtggtgaacccggtgctggtgctgggcccgctgctgcagccgacggtgaacgcgagcacggagcacgtgatgaagtacctgacggggtcggccaagacgtacgtgaacgcggcgcaggcgtacgtgcacgtcaaggatgtcgccgaggcgcacgtccgcgtctacgaggcgcccggcgcgcacggccgctacatctgcgccgagggcaccacgctccaccgcggcgagctctgccgcgtcctcggcaagctcttccccgagtaccccgtacccaccaagtgcaaggacgaggtgaacccaccggtgaaagggtacaaattcacgaaccagaggctcaaggacctggggatggagttcgtgccggtgctgcagagcatatacgagacggtgaagagcctccaggagaaagggatgctgccggtgctaccgccaggcgacgacgtccgagacaacctgcatgagcagctcatgatgaagcccgcccagttgctacgtaattaattatactctacatttggtagggatatgctgtcggctagttaattctatgggacatgtctgtccattcgatcggtcttatatatgcgtacacgtatgcacttttaattggtgcatgcatgcgtgcgtgagtgggtgggttggttggcgatcatatataaggatcgatcagtgctgtatgacgcacatatgcacacaatgttatatccatatatagtgatataaatccacgaactacaataaccaggcaatgtgcaattttagattatatagactagcaaatatatccgtgcattgcagtggg

SEQ ID NO: 3902 - DNA, 1286 bp, Hordeum vulgare
catatccagcagctgcctagctagctactacactacttacctggtgattgtgttgtggtagcaggcaagaacctttcccagtacacatcgtactggtgcctgtcgataccttgctaggcccctgctgctagcaacatccccagatacgtacgtcgtgccaatccgaaagtaagtcgagagagatgccgatcgagacgacagataacgtgccggcagccgaccttcccggccacggccggacggtgtgcgtcaccggcgccggcggcttcatcgcctcgtggctcgtcaagcgcctcctccagaaggggtacaccgtgcgaggcaccgttcgcaaccctgttgatccaaagaacgatcacttgagagcctttgacggcgccgccgaccgcctcgtcctcctccgcgccgatcttatggagccagaaaccctcgtcgaggccttcaccggctgcgagggcatcttccacgccgcttcccccgtcaccgacgaccctgagaagatgatcgagccggcgatccgggggaccaagtacgtgatcactgcagccgcggacatgggcatcaagcgtgtggttttcacgtcgaccatcggcacggtgtacatgaacccccacagggaccccagcaagcccgtcgatgacacctgctggagcgaccttgactactgcaaaaagacagcgaactggtactgctacgccaagacggtggccgagcaggacgcgcttgagacggcgcggcagcgcggcatcgagctggtcgtggtgaacccggtgctggtgctgggcccgctgctgcagccgacggtgaacgcgagcacggagcacgtgatgaagtacctgacggggtcggccaagacgtacgtgaacgcggcgcaggcgtacgtgcacgtcaaggacgtggccgaggcgcacgtccgcgtctacgaggcccccgacgcgcacggccgctacatctgcgccgagggcaccacgctccaccgcggcgagctctgccgcgtcctcggcaagctcttccccgagtatcccgtacccaccaagtgcaaggacgaggtgaacccaccggtgaaagggtacaagttcactaaccagaggctcaaggacctggggatggagttcgtgccggtgctgcagagtatatacgagacggtgaagagcctccaggagaaagggatgctgccggtgctaccaccaagtgacgacgtccgagacaacatgcatgagcagctcatcatgaagcccgctcagttgctacgtaattaaatatttttcatatggatgtgctgtcga

SEQ ID NO: 3903 - DNA, 1520 bp, Hordeum vulgare
atatccagcagctgcctagctagctactacactacttacctggtgattgtgttgtggtagcaggcaagaacctttcccagtacacatcgtactggtgcctgtcgataccttgctaggcccctgctgctagcaacatccccagatacgtacgtcgtgccaatccgaaagtaagtcgagagagatgccgatcgagacgacagataacgtgccggcagccgaccttcccggccacggccggacggtgtgcgtcaccggcgccggcggcttcatcgcctcgtggctcgtcaagcgcctcctccagaaggggtacaccgtgcgaggcaccgttcgcaaccctgttgatccaaagaacgatcacttgagagcctttgacggcgccgccgaccgcctcgtcctcctccgcgccgatcttatggagccagaaaccctcgtcgaggccttcaccggctgcgagggcatcttccacgccgcttcccccgtcaccgacgaccctgagaagatgatcgagccggcgatccgggggaccaagtacgtgatcactgcagccgcggacatgggcatcaagcgtgtggttttcacgtcgaccatcggcacggtgtacatgaacccccacagggaccccagcaagcccgtcgatgacacctgctggagcgaccttgactactgcaaaaagacagcgaactggtactgctacgccaagacggtggccgagcaggacgcgcttgagacggcgcggcagcgcggcatcgagctggtcgtggtgaacccggtgctggtgctgggcccgctgctgcagccgacggtgaacgcgagcacggagcacgtgatgaagtacctgacggggtcggccaagacgtacgtgaacgcggcgcaggcgtacgtgcacgtcaaggacgtggccgaggcgcacgtccgcgtctacgaggcccccgacgcgcacggccgctacatctgcgccgagggcaccacgctccaccgcggcgagctctgccgcgtcctcggcaagctcttccccgagtatcccgtacccaccaagtgcaaggacgaggtgaacccaccggtgaaagggtacaagttcactaaccagaggctcaaggacctggggatggagttcgtgccggtgctgcagagtatatacgagacggtgaagagcctccaggagaaagggatgctgccggtgctaccaccaagtgacgacgtccgagacaacatgcatgagcagctcatcatgaagcccgctcagttgctacgtaattaaatatttttcatatggatgtgctgtcgactagttaattgaatgggacatgtttgtccattcggtcatatatatatgtacacgtatgcacttttcagtggtgcaggcatgcttgcgcgcgtgcatgagtgggtgggttggtgatcatattgtatcgatcagtgctgtatgacgcatccaacaatgttatatgcatagtcatataaatccatggactacaataaccagcaaatatgcaactttagattatatagatttgtacaca

SEQ ID NO: 3904 - DNA, 1602 bp, Secale cereale
tcagccaaagcgagcgaggaccgtcctgtcgatgcgggccacacggttttccaaccgtcttgaaccactcaagctctctctttcgctgcctctataagtacagccacgatgcgtggtgccctatctcatatccagcacctgcctagctctacttttactacctgcgcagtgttgtgtggtactgtagtagcgggcaagaaccgttccgagtacacagcttactggtgcctgtcgataccttgctaggccccaactgctagcagcatctacatcgtgccaatcggaaagtaatttagtcgagagagatgccgatcgaggcggcagacaacgtgccggccgaccttcccggccacggccggacggtgtgcgtcaccggcgccggcggcttcatcgcctcgtggctcgtcaagcgcctcctccagaagggttacaccgtgcggggcaccgttcgcaaccctgttgatccgaagaatgatcacctgagagccttcgacggcgccgccgatcgcctcgtcctcctccgcgccgaccttatggagcccgaaaccctcgtcgaggcgttcacgggctgcgagggcatcttccacgccgcttcccccgtcaccgacgaccctgagaagatgatcgagccggcgatccgggggaccaagtacgtgatcacagcagccgcggacatgggcatcaagcgtgtggtgttcacgtccaccattggcacggtgtacatgaacccccacagggaccccagcaagcccgtcgacgacacctgctggagcgaccttgactactgcaaaaagacagcgaactggtactgctacgccaagacggtggccgagcaggacgcgctggagacggcccggcagcgcggcatcgagctcatcgtggtgaacccggtgctggtgctgggcccgctgctgcagccgacggtgaacgcgagcacggagcacgtgatgaagtacctgacggggtcggccaagacatacgtgaacgcggcgcaggcgtacgtgcacgtcaaggacgtggccgaggcgcacgtccgcgtctacgaggcccccggcgcccacggccgctacatctgcgccgagggcaccacgctccaccgcggcgagctctgccgcgtcctcggcaagctcttccccgagtaccccgtacccaccaagtgcaaggacgaggtgaacccaccggtgaaagggtacaaattcacgaaccagaggctcaaggacctgggcatggagttcgtaccggtgctgcagagtatatacgagacggtgaagagtctccaggagaaagggatgctgccggtgctgccgccgagcgatgacgtccgggacaacatgcatgagcagctcatgctgaagcccgcccagttgctacgtaattaatcaccctactatatttgatgcggatatatgctgtcggctagttaattgtatggggcatgtctgtccattcgatatgcgtacacgtatgcactttttatgggtgcatatgcatgcgtgcgcgcgtgcgtgagtgggcgggttggttggcgatcatgtatatcgatcagtgctgtatgacgcacatatgcacacagtgttatatgcataatgatataaatccacg

SEQ ID NO: 3905 - DNA, 1638 bp, Brachypodium distachyon
cctcttccactctcgcatagcattcagcagttgcccccggagcacacaacgtactagctagcttctactggctaagctaagctagcggacgacattgctgctaagctttaggcaccggcggcaacctggtagtagcaacagtagtcagatattaccgaaagaggatccttcggagagtaagtaagtgatcgaaagagagatgccgatgatcgagacgacgacgacaggcggcgatgtgccgccggtgccggaggcggcggcgagcctcccggggcacgggcggacggtgtgcgtcaccggcgccgggggcttcatcgcgtcgtggctcgtcaagcgcctcctccagaagggatacaccgtgcgcggcaccgtccgcaaccctgttgatccgaagaacgaccacctgagagccttggagggcgcggcggagcggctcgtgctcgtccgtgccgacctcctcgacccggagagcctcgtcgccgccttccagggctgcgagggcgtcttccacgccgcttcccccgtcaccgacgaccccgagaagatgatcgagccggccatccgtggcactcggtacgtgctgtcggcggcggccgacatgggcatcaagcgcgtggtcttcacatccaccatcggcaccgtgtacatgaacccctacagagacgccgacaagcccgtcgacgacacttgctggagcgacctcgactactgcaagaagaccgcgaactggtactgctacgcgaagacggtggcggagcaggcggcgtgggagctggcggagcagcgcggggtgtcgctgctggtggtgaacccggtgctggtgctgggcccgcttctgcagcccacggtgaacgcgagcgcggagcacgtcatgaagtacctgacgggctccgccaagacgtacgccaacgcagcccaggcctacgtgcacgtccgggacgtcgccgaggcccacgtccgcgtctacgagcggcccacggcccgcggccgctacatctgcgccgagggcaccacgctccacagaggggagctctgccgcgtcctcgccaagctctttcccgagtaccccgtgcccacggaatgcaaggaccgagtgaacccgcccgtgaaagggtacaggttcacgaaccagaggctcaaggatttggggatggagttcgtgcccgtgctgcagagcatctacgagaccgtccggagcctgcaggagaaagggttgctgcccgtgctccccaccaccaccaacaacaacgacaacaacctgctgctctcatgagctcattcagctggaagcttagagctgccacggccagttgttgcttgctactactacctaattattggattaatatgatatgcatggatggtcatcatcatctggctgcaggataatgatgttaattacgtgaccggtttttctattgtgtatgtgtacgcgcatgcatgcgtgcatgcgtgtgcgcgggtgggttggtgaagtgcttgtatgacgcacatacaaacaaatgctacatgcactggtgtataatgcaaattatccatgggttggtcccagatatatatgagccgagagcactgtgtacatctttagcttctacatataataccccatgtggataaaagatttgttgtcacaatcaa

SEQ ID NO: 3906 - DNA, 1429 bp, Avena sativa
gcatatttggcactttccttcctgtacttacctacacttgtacgtgttgcgtagcagctagcgcaggaccggccggaagaacagttcggagcgtccctgccactctcctagcaacagcgccagatatatacatatcgtcgtatccctccgaaaggaaagctgagagaaatgccgatcgagagtacggatagcgtgccggcggccgacctccctgggcacgggcggacggtgtgcgtgaccggcgccggcggcttcatcgcgtcgtggctcgtgaaacgcctcctccagaaggggtacaccgtgcgcggcaccgtccgcaaccctgttgatccaaagaatgaccacctgagagccttcgacggcgccgccgaccgcctggtcctcctccgggccgacctgatggagcccgagagcctcgccgcggcgttcgccggctgcgagggcatcttccacgccgcctctcccgtcaccgacgaccctgagaagatgatcgagccggcgatacgcgggacgaactacgtgctgacggcggccgccgacctgggcatcaagcgcgtggtgttcacgtccaccatcggcacggtgtacatgaacccctacagggacgccgagaagcccgtggacgacacctgctggagcgacctcgaatactgcaagaagacggagaactggtactgctacgcgaagacggtggcggagcaggacgcgttcgcgtcggcgcggcagcggggcatcgagctgatcgtggtgaacccggtgctggttctcggcccgctgctgcagccgacggtgaacgccagcgcggagcacgtgctcaagtacctcaccgggtcggccaagacctacgtcaacgcggcgcaggcgtacgtgcacgtcaaggacgtcgccgaggcgcacgtccgcgtctacgaggcccccgccgcgcgcggccgctacatctgcgccgagggcaccacgctccaccgcggcgagctctgccgcgtcctcgccaagctcttcccggagtacccggtgcccaccaggtgcaaggacgaggtcaacccgccggtgaaggggtacaagttcaccaaccagaggctcaaggatctgggcatggagttcgtgcccgtgctgcagagcatatacgagaccgtcaagagcctgcaggagaaagggatgctgccggtgctgccggaacaccaccacgacgaagacgacgtcgtcgtccaggacaatgatgcactactcgtgaggagctgatcatcaagcataatgcacgtacggaagaacagctgatgctaagtacacaattactcacttgatatatatggaagctttcggctagttaattactactacgtgtgacatgtttgtccattcggtccatcatcatatgtatatgcacacacgtatgcacttttagttggtgcgtgctgtgcgtgcgtgcgtg

SEQ ID NO: 3907 - DNA, 2977 bp, Setaria italica
tctccctctcttgctgttccctctcgctcccttccctccctctgtacgctttctccgaagccgccattcccaagaggagcagcagccaagctcgtctccccagaagtaccagacgtccccggctccactcgccccccgccgcctctcctccccgcttggagatccggcccggcatttcttgggtggccactggttgccgcacttgttataaaaaaggcctgcttttctgggggttccctggggctctcatcttggatgacgtctcagtgaaaggtgctggtattgtagtatgacttgcttggctcggatgtccctgccggcgacgggctgagttggtgtactccttgtctgtccgtgttgaatcagtcttcttgggccatggggtcgtctggctgtagctccgagatagttgagtctaccgaggaagaatttgacagtgcgcccattggtggctccagcttgctgcatattaaactcagagatgaggagaaacgcagcaaatgtcatgattatcctgtggaagatgacctcgaccagcttcttaaagcgattgatagtaggacattccgtcgggcacttagtcctggcagtacaggtggagatgcgctgggaaagggtgttctcaagaaaccagctaggtctgggctgtctcaaaatgcaggcatcgggatatcctccaagactgttaatatgaagcaggcgttgagaaggctatgcatttcccaggcatcagaaatggctgcaatgaagaggctgtcgatgtcacctggatcttcgagttcatctgaagctgggaccatccacaggctctatgcctctttgatggtccaaagtagtactgagggtcttcttcatgatgatgaaaagatgaacctgattgaaatatcgctcactccggagaagatcgacaagagttcgtctagaggtacgagcgagttcagtgaagactgtgagttcgagacagccgatggaagtgcagtcacctctatccgttctgtgtcttcaacttcagctgaggttcggaagatcagaatccaagatgtcatcagtggtgaccctattgatagtgagagttccttggtggaaaatggtaaattaggaagtaaaatttctgcagctactgatgatggctccccaagagtcccaatcttgagcaaacccatcactacatccagacttgtcaagccagtcttccgatgcaaaacggctggtaagaagaaagtgaaagaagaaccatcttcgttgggtgattcctccaatagcactaaattctgctcttcaaaggagtcgatttccctcgcatcaaccagctgctcttcaacatctagtgttacaaatcccaccagctgtgcagaagaagagaaatcaactccaggaccagaaaaatctgatgaaacatcttccgagtggttgggagcagaggaaaagggcgagtgctcccagaattcaaagagcagcattagtgagtatggttgtagcacaagtattagtgatgagagccaatttggattgtgtggctatagtaacaggccacacatggcaaaggatctgcgctggctaaccattcgtcagttggcattgcaacagggatcgttaggactcgacaatttcaagcttctgaagaggcttggttgtggggacattgggactgtgtatcttgctgagttggttgattcagattgcttatttgctttgaaggttatggatatcgagtaccttattaatagaaagaagatgcttcgagctcaggctgagagggagatactagaaatgctggatcatccatttctcccaactctttatgcccattttaccacagacaatctctcatgcttggtcatggagtactgtccaggtggtgatttgcacgttcttcgtcaaagacagcctggaagaagctttccagagccagcagcaaggttttatgttgcagaagttctccttgctttggaatatcttcacatgctaggagtcatatatcgtgatctaaagccagaaaacattctagtccgtgaagatggacatataatgctatcagactttgacctttcactgaggtgctcagtgaatccagtgctccttcggtcatcctctgtaacagcaaaccaccaaccaaggaaacttgcaggaccttgtgcagagaactactgcatcaattcatcatgcctccagcagccttcttgtgcccaaacatcttgcttcacaccacgtctaccatcaattccaaagcctcggaagcctaaatcttcccagaaaaggcttcctcagcttgttgtagagcctattgatgcacgctctaattcctttgtcggcacgcatgagtaccttgcaccagaaatcatcaaaggggatggccatggaagcgctgttgactggtggacctttggtgtcttcctttatgaacttttatatggcaagacacccttcagaggacctgggaatgatgaaacattagcaaatgtggtctcacagaatctccggttcccggacaatccagctgtgagtagcaacgccaaagatctcatcagaggtttgctggtgaaggagcctgagaacagacttggatcgttgagaggagctgctgagatcaagcagcaccctttctttgaaggcttgaattgggccctgatacggtccgctgctccaccagagacacagccttgcaatgtcgtgactctcgcgaaagagcggaagaagaaagaaggcaagtgccttgagttcagaagtaactccgaggacctggaattcgaagttttttagtgaggccctggtacagtttagcattatttcctctgatagtctacattttttcttttgagtagccaaaggctgggggtgtacatgcagattcttgtatttcagtaactgctgtccctgtcaatagcatcactaaattgaaaagaataagcagagcttatgctattatcattgctgctgcatatgaattggttccccattggaggctccagtagatttt

SEQ ID NO: 3908 - DNA, 3038 bp, Zea mays
gcacggaggatcctggacgccctatatgccgattcgtctcctctctctctttctctttaagtctctacccctttctctctcctctgtgtgctccttgccctctatacaccagtacacctccgaagccgccattccagcagctgagctcgtcctgccaggacgcagtgccaagtgccaacggcaccactattccaccgcctgtgccccttccacgcgtggagatctgagccggcatttcctgggtgtgcgctggttgctgcgcttgccattaaaaggctacttttctgggagctccctggtgctctcatcttggaagacgttcagtggaaggtgcaggcttgcctgcccaggatgcccctgccggcgacggactgagttggcgtattccttgtctgccagtgttgaattagtctaattgggccatggagtcatctggctgtagctctgagatagttgagtccaccgaggaattcgatactacaccctctggtggatccagcttgctgcatattaaactcaaagatgaggagaaacgcggcaaaagtcatgattattctgtggaagatgacctcgaccagctccttaaagctatcgatagcaggaccttccgacgcgcgcttagtcctggcagtacaggtggagatgcgctgggtaagagtgttctgaagaaaccagctaggtctgggttgtctcaaaatgcaggcattgggatatcctccaaggctgttaatatgaagcaagcgctaagaaggctatgcatttcccaggcatcagaaatggctgcaatgaagaggttgtcgatgtcacctggatcttcaagttcatccgaagctgggactatccacaggctttatgcctctttgatggtccaaagtagttctgagggtcttctgcatgatgatgagaagatgaacctgattgaagtatcgatcactccagagaagattgataagagttcatctagaggtacaagtgagttcagtgaagactgtgaatttgagacagctgatggaagtgcagtcacctctacctctatctgttctgcttcgtcaacctacaccgatattaggaagatcagaatccaagatgtcatcattggtgaccctatggataacgagagttccttgggggaaaatggcaacctaggaaataaattttctgcagctactgatgatggctctcccaaagtcccaatcttgagcaaacctatcactacatctcgacttgtcaagccagtctttcgatgcaagccttccggtaagaagaaagtgaaacaagaaccatcttcgttgggtgattcctccaatagtactaaattctgctcttcaaaggagtcaatctccctcacatcaaccagctgctcttcaacatctagttttacaaatcccgccaaccgtgcagaagagaaatcatctcctgggccagaaaaatctgatggcacatcttctgagtggttggcagagcaaaatgaatgttcccagaactcaaagagcagcattagtgagtatggttgcagcacaagtatcagcggtgagagccaatttggattgtgtggctatagtaacaggccacacatggcgaaggatctgcgctggctaaccattcgtcagttggcactgcaacagggttccttaggactcgacaatttcaagcttctgaagaggcttggttgtggtgacattggaactgtatatcttgctgagttggttgattcagattgcttatttgctttgaaggttatggacatcgagtaccttattaatagaaagaagatgctacgagcacaggctgagagggagatactagaaatgctagatcatccatttctcccgactctttatgcccattttaccacagacaatctctcatgcttggtcatggagtactgtccaggcggtgatttgcatgttcttcgccaaaggcaacctggaaaaagctttccagagccagcagcaaggttttatgttgcagaagttctccttgctttggaatatcttcacatgttaggggtcatataccgtgatctaaagccggagaacattttagtccgtgaagatgggcatataatgttatcggacttcgacctttcactgaggtgctcagtgaatcctgtgctccttcggtcatcttctgttactgcgaaccaccaaccgaggaaacatacaggaccttgtgcagagaactactgcataaattcgtcttgcctccagcaaccctcttgtgcccaaacatcttgcttcacaccacgcctaccatcaattccaaagcctcggaaacctaaatcctcccagaaaaggcttccacagcttgttgtagagcctactgatgcacgttctaattcctttgttggcacacatgagtaccttgcaccagaaatcatcaaaggggatggccatggaagcgctgttgactggtggacgtttggtgtcttcctttatgaacttctatacggcaagacacccttcagaggacctgggaatgatgaaacattggcaaatgtggtctcgcagaatctccggttcccagaccatccagctgtgagcagcaacaccaaagatctcatcagaggtttactggttaaggagcctgagaacagatttggatcgttgagaggagctgctgagatcaagcagcaccccttctttgaaggcttgaattgggctctgattcggtctgctgctccaccagagacacaaccttgcaacatcgtgactcttgccaaagagcggaagaaagaaggcaagtgcctggagttcagaagcaactcagaggaccttgagtttgaagttttttagtttcgttctggtacagtttagcactatttccgctgatataagcctacatttttttttctatgaatagccaaaggcttgggggtgtacatgtagatccttgtatttcagtaattgctatgtccctgtcaatagcatcaccaaattgaaaagaataagcagcttatgctattattatcattgctgctgcatatgaattggttcctattggagacccagtaaattttactcgtgtatttgcatgaa

SEQ ID NO: 3909 - DNA, 3005 bp, Panicum virgatum
tctcgctgttccctaacttccctctcgctctcttccctctctctccccgccttctccaaagccgccattcccaagagcagcagcagcagcagccgagttcgtctccccagaagtacccgacgaccccggctccactgggccgccgccgcctctccttccagcttggagatccgggccggcatttcttgggtggccactggttgctgcactagttataaaaaaggcctgctttcctgggagttccctggggttctcatctcggatgacgtctctgtgaaaggtgcaggtattgtagtatgacttgcatgctccggatgtccctgccggcatcgggctgagttgacgtactccttgtttgtccgtgttgaatcagtctgctggagccatggggtcgtccggctgtagctccgagatagtggaatccatagaggaagaatttgacagtgcgcccattggtggatccagcttgctgcatattaaactcagggatgaggagaaacgcagcaaatgccatgattatcctgtggaagatgacctcgaccagcttcttaaagcgattgatagcagaacattccgtcgggcgcttagtcctgccagcacaggtggagatgcgctgggaaagagtgttctcaagaaaccagctaggtcagggttgtctcaaaatgcaggcattgggatatcctccaagactgttaatatgaagcaggcgctgagaaggctatgcatttcccaggcatcagaaatggctgcaatgaagaggctgtcgatgtcacctggatcttcaagttcatctgaagctgggactatccacaggctctatgcctctttgatggtccaaagtagtactgagggtcttctgcatgatgatgaaaagatgaacctgattgaaatatcgatcactcctgagaagatggataagagttcatctagaggtatgagcgagttcagtgaagattgtgaattcgagacagctgatggaagtgcagtcacctctgtccgttctgtgtcttcaacctcagctgagattcggaagatcagaatccaagatgtcattagtggtgaccctattgataatgagagttccttggtggaaagtgataaattaggaagtaaagtttctgcagctactgctgatggctctcccagagtcccaatcttgagcaagcccatcactacgtccaggcttgtcaagccagtcttccgatgcaagacagctgttaagaagaaactgaaagaagaaccatcttcattgggtgattcttccaatagcacaaaattctgttcatcaaaggagtcaatctccctcgcatcaaccagctgctcttcaacatctagcattacaaatcccaccagctatgcagaagaagagaaatcaactccagggccagaaaaatctgatgaaacatcttccgagtggttgggagcagaggaaaaaggtgagtgctcccagaattcgaagagcagcattagtgagtatggttgtagcacgagtatcagcgatgagagccaatttggattgtgtggctataataacaggccacacatggcaaaggatctgcgctggctaaccattcgtcagttagcattgcagcagggatcgttaggtctcgacaatttcaagcttctgaagaggcttggctgtggggacattgggacagtgtatcttgctgagttggttgattctgattgcttatttgctctgaaggttatggatatcgagtaccttattaatagaaaaaagatgctacgagcacaggctgagagggagatactagaaatactcgatcatccttttctcccaactctttatgcacattttaccacagacaatctctcatgcttggtcatggagtactgtccaggtggtgatttgcacgttcttcgtcaaaaacaacctggaagaagctttccagagccagcagcaaggttttatgtcgcagaagttctccttgctttggaatatcttcacatgctaggggtcatatatcgtgatctaaagccagaaaacattctagttcgtgaagatggacatataatgctatcagactttgacctctcactgaggtgctcagtgaatcctgtgctgcttcggtcatcctctgtagaagcaaaccaccaaccaaggaaacttgctggaccttgtgctgagaagtactgcatcaattcatcatgcctccagcagccctcttgtgcccaaacatcttgcttcacaccacgtctaccatcaattccaaagcctcggaagcctaaatcttcccagaaaaggctccctcagcttgttgtagagcctattgatgcacgctcaaattcctttgttggcacgcatgagtaccttgcaccagaaatcatcaaaggggatggccatggaagcgccgttgactggtggacctttggtgtcttcctttatgaacttttatatggcaagacacccttcagaggacctgggaacgatgaaacattggcaaatgtggtctcacagaatctccggttcccggacagtccagttgtgagtagcaacgccaaagacctcatcagaggtttgctggtgaaggagcctgagaacagacttggatcgttgagaggagctgctgagatcaagcagcatcctttctttgaaggcttgaattgggccctgatacggtctgctgctccgccagagacacaaccttgcaatgttgtgactcttgcgaaagagcggaagaagaaagaaggcaagtgcctcgagtttagaagtaactccgaggacctagaatttgaagttttttagtgaggccctggtacagtttcacactatttcctcggatagagtctacatttttttctttgagtagccaaaggctgggggtgtacatgtagattcttgtatttcagtaactgttgaccctgtcaatagcatcactaaattaaaaagaataagcagagcttatgctattatcattgctactgcatatgaattggttcctattggatgcaccagtagattttactcgtattttgcatgaacc

SEQ ID NO: 3910 - DNA, 3032 bp, Oryza sativa
accaccctctcctctctctcctcctcttctctctctagcctagctcagctctctcaactctctctctccagctccaccttctccgaggccgccattcccaaggttaccaccaccaccaccaccacgcagcagcggcctaggagtacttgcggcggctgcttgatcggttttcttggctcgtcagttgcagtattccctcctcaaaatatataaaaaggaaggagctccctgaggctagttggattggatgacgtctcgtgaaagttgcaagtgatggtgctctgactggtcttttgcctttgatgtctctgctggtgatgggataagttggcgcactatctatcttggctgtgtgttctgttgaatcttgtctagttgtgggtgtgtgtgtgatggggtcgtctggttgcagctctgagatagttgagttcaccgaagaattcgacgataatgcgccggttagttgccccaatttgatgcatattagagtgaagcctgaggagaaagatgggaggtgttaccctgtggaggatgaccttgaacagcttctcaaggcgatcgacagcaggaccttccgtcggacgcttagccctggtcaggctggcgccgacgctctgcggaagaatggtcagaagaaatcgtctaggtctgggccggctcaagctgcggggatcgggatttcgtccaagcctgttaatatgaagcaggcgttgaggaggctgtgcatttcgcaggcgtcggagatggccgcgatgaagaggctgtcgatgtcgcctggatcgtcgagttcgtcggaagtggggactatccacaggctttatgcctccttgatggtccagagcaacggtgagagccatctgcatgatgatgagaagatgaacttgattgagatatcgatcactccagaaaagtttagtaagaactcgtccagagcaacaagcgagttcagtgaagactgtgatttcgagacagccgacgggagtgcagtcacctccctgcattctgcatcatctacctcggctgagatacggaagatcaggatccaagatgtcatcagtggtgaccctatagacagcgagagttctatggtggaaaatgagaaattaaacaagaaagtttccacagctaccgacggtagctctcccagagcccctatcttgagcaaaccgatcactacctcacggcttgttaagccagtcttccgatgcaagaccatcggtaagaagaaactgaaagaagaaccaccttcattgggtacttcctccaacagtacaaaattctgctcttcaaaggagtccatctcccttgcatcaaccagttgctcttcaacatccagcataacaaatcccactagctgtgcagatgatgagaaaacaaatctcgggccagaaaaatctggtgataaatcgcctgagtggttaagatcagaggaaaagggggagtgctcccagaattcaaacagcattagtgagtatggatgtagcacgagcatcagtgatgagagccaatttggattgtgtagctacaacaacagaccacacatggcaaaggatctgcgttggataaccatccgtgagttggcattgcaacaaggatccttaggtcttgacaatttcaagcttctgaagaggcttggttgcggcgatatagggactgtgtacctagctgagttggttgattcagagtgcttgtttgctttgaaggttatggacatagagtacctgatcaatagaaagaagatgctgcgtgcacaggctgagagggagattctagaaatgctggatcacccattccttccgactctttatgcccattttaccacagacaatctttcgtgcttggtcatggagtactgtccaggaggtgatttgcatgttcttcgtcaaagacaacctgggagaagctttccggaaccagctgcaaggttttatgttgcagaggttctccttgcacttgaatatcttcacatgttgggggtcatataccgtgatcttaagcctgagaacatcctagtccgtgaagatggtcacattatgctatcggactttgacttgtccttaaggtgctcagtgaaccccgtactcctccgatcatcctctgtagcagcaaaccatcaaccaaggaagcttgcaggaccttgtgcagaaagcagctgcatcagttcatcatgccagccttcttgtgcccaaacatcttgtttcatggcacgtcctccattgccaaagcctcggaagcctaaatcttcacacagaaagctccctcagcttgttgttgaacctatagatgcaaggtccaattcctttgtaggaacacacgagtacctcgcaccagaaatcatcaaaggggatggtcatggtagtgctgtggactggtggacctttggcgtcttcctttatgaactgttgtacggtaagacacctttcagaggtcctgggaatgatgaaacattggcaaatgtggtttcgcagaatctcaagttcccagaaaatccatctgtcagcagtaatgccaaagatcttatcaaaggtttgctagtgaaggagccagagaacagacttggatcattgagaggagcagctgaaatcaagcaacaccctttctttgaaggcttaaattgggccttgatacgatctgccgctcctccagagacgcgaccctgtgacgttgtgaccctcgcgacagcgaagaagaagaaagaaggcaagtgcctggagttcaggagtaactctgaggacctggaatttgaagttttttagcaagtgtctttggtacagtttagcactcttctgccaaatagagtctacatttttcttttgggtagccaaaggctgggggtgtacattgtacaagtagatgtatttctggttactgctatgtacctgttaatagatcactaaattcaaaggaatgatggaagttgaagccatctgttgcataaggatcactaggtttgatcaaacactgatggctatactcttgttgtgcagtctaacactgatgagtcatgtagctttgctgctgctgttcttgct

SEQ ID NO: 3911 - DNA, 3129 bp, Brachypodium distachyon
ccctccccttctcctctctctcctccgagcccccccctctctctctccaccttccccccgaagccgccattcccgagattagcagctcagctcagcgccgagctctactgcccagagcccagggaacgcgagctgctcctagacgccgtttggagatccgggcggccatttttttgcctggttggtcgcgagctcaactttttttttcttttttttgaagaaaacaaaagttgtttctttggctgagtctcctagctgccgagtctttccatcttggttgacgtctcggtgaaaaggcacaaatgcagtagtaagaactgcctgccttggatggctctgcagacggtgggctagataagttgccaactgtcagtctgtcttgaatttgtctattaggagggtgatggggtcatctggttgctgctccgagatagtcgagtccactgaagaattggataatgcacctgttagtggctccagcttgctgcatattaaagtgaaacccgaggagaaagatggaaagtgccgtggttaccccgtggaagatgagctcgaccagctccttaaggcaatcgatagcaggacataccgccgagcacttagtcctggccaggctggtgcagatactctgttgaagaatgctcaaaagaaaacgtctaggtcagggtcatctcaaaatacagggatcgggatatgctccaaacctgttaatatgaagcaggcgctgagaaggctttgcatttcccaggcatcagaaatggctgccatgaagaggttgtcgatgtcgcctgggtcatctagttcatctgaagcagggactatccacaggctctatgcctccttgatagtccagagcagtgatgaaagccctctgcatgatgacgacaagacaaacttgattgaaatatcaatcactccgcaaaagattagtaagaattcatctagaggaacaagtgacttcagtgaagactgtgattttgagacagctgatggaagtgcagtcacctccctgcattctgcatcttctacctcagctgatatacggaagatcaggatccaagatgtcatgggtggtgatcctatagacagcgagagctcctttgtggaaaatggaaaattgggtgaaaacgtttctgcagccactgatgatagctctcccagactcactatactgagcaaacccatcacaacatcccggctcgtgaagccagtatttcggtgcaagacgaacagtaagagtaaaatgaaagaagaacaatcttcactgggcaattcctccaatagtaccaaattctgctcttcaaaggagtccatttcccttgcatcaacgagttgttcttcagcatccagtgttacaaaccccaccagctgtgcggaagaacagaagacgaatacagaaccagaaatatctgatgagagatcatctgaatggttaagaacacaggaaaagggtgagtgttctcagaattcaaagagcagcattagtgagtatggatgtagcactagtatcagcgatgagagccaatttggattatgtggctataccaacaggccccacatggcgaaggatatccgttggataaccattcgccagctggcattgcaacagggatccttaggactcgacaacttcaagcttctaaagagacttggatgtggggacattggaactgtatatcttgctgagttggttgattcggactgcttgtttgccttgaaggttatggatattgagtatctgattagtagaaagaagatgctgcgggcacaggctgaaagagagatactggaaatgctggatcatccatttcttcctacactttatgcccattttaccacggacaatctttcatgcttggtcatggagtactgtccaggtggtgatttgcatgttcttcgtcaaagacaacctgggagaagctttccggagccatctgccaggttttatgttgcagaagttctccttgcactggaataccttcacatgctgggagtcatatatcgtgatcttaagccagagaatatcttagtccgcgatgacggtcacatcatgctatcagactttgatctctcgctaaggtgctccgttaacgctgtgctcctgcggtcatcctctgttgcagtaaatcaacaaccaaagaagcttgcaggaccttgtgcagagagctactgcataaattcttcatgcctacagccctcttgtgcccaaacgtcttgtttccggccacgtccctcgaatccaaagtctcggaaacctaaatcttctctgaagaggctgcctcaacttgttgtggaacctacagaagcacgctccaattcctttgttggcacacacgagtatctcgcgccagagatcatcaaaggggatggtcatgggagtgctgttgactggtggacctttggggtcttcctttacgaacttttgtatgggaagacacccttcagaggtcctgggaatgacgaaacgttggcaaacgttgtttcccagaatctccggttcccggacaatccagtggtcagcagcaacgccaaggatctcatcagaggtttgctagtcaaggagccagagaatagactgggaacgttgagaggagcagctgagatcaagcaacatccattctttgaaggcttgaattgggcattgatacgatctgctgccccaccagaaacacggccttgtgatgtagtgactcttgcgacagtgaagaagaagaaagaaggcaaatgcctcgatttcaggagtaccgaggagttggaatttgaagtcttttagcgaggtcttggtacacttcatcactatttcgccgatagagcctacaatttttcttttgagtagccaaaggctgggggtgtacatgtagatccttgtatgttcagttactactatatatgttcctgttaataggtgtcgcaattaaaaggaatgatcaaagcccatgacatcattattgtcgcatgatggtttctttctcttggaggctccagtagatttagttagacctgctcctattgtgcagtcaaatactgctgaagcatgtaagatttgctgccttgctatttcttactgcaaagaaggaaaaagtttacgtttcttctcaaaggtgaaaggaagcatgaaagcacttcagt

SEQ ID NO: 3912 - DNA, 3203 bp, Oryza sativa
tcgcaccaccctctcctctctctcctcctcttctctctctagcctagctcagctctctcaactctctctctccagctccaccttctccgaggccgccattcccaaggttaccaccaccaccaccaccacgcagcagcggcctaggagtacttgcggcggctgcttgatcggttttcttggctcgtcagttgcagtattccctcctcaaaatatataaaaaggaaggagctccctgaggctagttggattggatgacgtctcgtgaaagttgcaagtgatggtgctctgactggtcttttgcctttgatgtctctgctggtgatgggataagttggcgcactatctatcttggctgtgtgttctgttgaatcttgtctagttgtgggtgtgtgtgtgatggggtcgtctggttgcagctctgagatagttgagttcaccgaagaattcgacgataatgcgccggttagttgccccaatttgatgcatattagagtgaagcctgaggagaaagatgggaggtgttaccctgtggaggatgaccttgaacagcttctcaaggcgatcgacagcaggaccttccgtcggacgcttagccctggtcaggctggcgccgacgctctgcggaagaatggtcagaagaaatcgtctaggtctgggccggctcaagctgcggggatcgggatttcgtccaagcctgttaatatgaagcaggcgttgaggaggctgtgcatttcgcaggcgtcggagatggccgcgatgaagaggctgtcgatgtcgcctggatcatcgagttcgtcggaagtggggactatccacaggctttatgcctccttgatggtccagagcaacggtgagagccatctgcatgatgatgagaagatgaacttgattgagatatcgatcactccagaaaagtttagtaagaactcgtccagagcaacaagcgagttcagtgaagactgtgatttcgagacagccgacgggagtgcagtcacctccctgcattctgcatcatctacctcggctgagatacagaagatcaggatccaagatgtcatcagtggtgaccctatagacagcgagagttctatggtggaaaatgagaaattaaacaagaaagtttccacagctaccgacggtagctctcccagagcccctatcttgagcaaaccgatcactacctcacggcttgttaagccagtcttccgatgcaagaccatcggtaagaagaaactgaaagaagaaccaccttcattgggtacttcctccaacagtacaaaattctgctcttcaaaggagtccatctcccttgcatcaaccagttgctcttcaacatccagcataacaaatcccactagctgtgcagatgatgagaaaacaaatctcgggccagaaaaatctggtgataaatcgcctgagtggttaagatcagaggaaaagggggagtgctcccagaattcaaacagcattagtgagtatggatgtagcacgagcatcagtgatgagagccaatttggattgtgtagctacaacaacagaccacacatggcaaaggatctgcgttggataaccatccgtgagttggcattgcaacaaggatccttaggtcttgacaatttcaagcttctgaagaggcttggttgcggcgatatagggactgtgtacctagctgagttggttgattcagagtgcttgtttgctttgaaggttatggacatagagtacctgatcaatagaaagaagatgctgcgtgcacaggctgagagggagattctagaaatgctggatcacccattccttccgactctttatgcccattttaccacagacaatctttcgtgcttggtcatggagtactgtccaggaggtgatttgcatgttcttcgtcaaagacaacctgggagaagctttccggaaccagctgcaaggttttatgttgcagaggttctccttgcacttgaatatcttcacatgttgggggtcatataccgtgatcttaagcctgagaacatcctagtccgtgaagatggtcacattatgctatcggactttgacttgtccttaaggtgctcagtgaaccccgtactcctccgatcatcctctgtagcagcaaaccatcaaccaaggaagcttgcaggaccttgtgcagaaagcagctgcatcagttcatcatgccagccttcttgtgcccaaacatcttgtttcatggcacgtcctccattgccaaagcctcggaagcctaaatcttcacacagaaagctccctcagcttgttgttgaacctatagatgcaaggtccaattcctttgtaggaacacacgagtacctcgcaccagaaatcatcaaaggggatggtcatggtagtgctgtggactggtggacctttggcgtcttcctttatgaactgttgtacggtaagacacctttcagaggtcctgggaatgatgaaacattggcaaatgtggtttcgcagaatctcaagttcccagaaaatccatctgtcagcagtaatgccaaagatcttatcaaaggtttgctagtgaaggagccagagaacagacttggatcattgagaggagcagctgaaatcaagcaacaccctttctttgaaggcttaaattgggccttgatacgatctgccgctcctccagagacgcgaccctgtgacgttgtgaccctcacgacagcgaagaagaagaaagaaggcaagtgcctggagttcaggagtaactctgaggacctggaatttgaagttttttagcaagtgtctttggtacagtttagcactcttctgccaaatagagtctacatttttcttttgggtagccaaaggctgggggtgtacattgtacaagtagatgtatttctggttactgctatgtacctgttaatagatcactaaattcaaaggaatgatggaagttgaagccatctgttgcataaggatcactaggtttgatcaaacactgatggctatactcttgttgtgcagtctaacactgatgagtcatgtagctttgctgctgctgttcttgctaacttatcataattttcttgtcgaagttacaacttacaagcatgatttggttatgtatatatgcaaatgacaatgaagttgacctgagcaatacctaaatggtgaaattgctaggctgctaagtttgtttttggacaaaaatttctccaactgcagtttcatcaagg

SEQ ID NO: 3913 - DNA, 2591 bp, Lolium multiflorum
ctgtctgtctgttgaatctgtctacttggagggtgatgggctcgtctggttgcagctctgagatagtcgagtccaacgaagaattggacaaagcgcctgtttgtggctccagcttgctgcatgttaaagtgaaacctgaggacaaagatggaaggtgccgtggttacgctgtcgaagatgagctcgaccagcttcttaaggcaattgatagcaggacataccgtcgagcccttagtcctggtcaggccggtgcggattcttttctcaagaatgctcaaaggaaaacatctaggtcagcttcatctcaaactgctggcatcgggatatgctctaagcctgttaatatgaagcaggcgctgagaaggctttgcatttcccaggcatcagaaatggctgcgatgaagaggttgtccatgtcgcctgggtcatccagttcatcagaagctggaactatccaaaggctttatgcctcattgatggtccagagcagtgatggaagccttgtgcatgatgatgacaagatgaacttgattgaaatatcaatcaccccagaaaatatcagtaagaattcatccagaggaacaagtgactatagtgaagactgtgatttcgagacagctgatggaagtgcagtcacctccatgcattctgcgtcttctacctcagctgatatacgcaaggtcagaattcaagatgttatcagtggtgacactagagaaagcgagagctctgttgtgcaaaatggaaaattgggtggaaaagtttctgcagatactgatgatacttctcccagactccctatattgagcaaacccatcacaacatcccggcttgtgaagccagcttttcgatgcaaagccagcagtaagagtaaaatgaaagaagaacaatcttcacttggtaattcctccaatagtactaaattctgctcttcaaaggagtccatttcccttgcatcaaccagctgctcgtcggcatccagtgttacaaatcctaccagctgtgtggaacaggagacaaatccaggcccagaagaatctgatgagagatcgtctgaatggttgagaacagaggaaaaaggcgagtgctcccaacattcgaagagcagtgttagtgagtatggatgtagcactagtatcagtgatgagagtcaatttggcttgtgcaactataacaacaggccccatatggcgaaggatctccgttggataaccattcgccagttggcattgcaacagggatccttaggacttgataatttcaagcttctgaagaggcttggatgtggggacattgggactgtgtatcttgcggagttggttgattcggattgcttgtttgccttgaaggttatggatattgagtacctgattagtagaaagaagatgctgcgagcacaggctgagagagagatacttgaaatgcttgatcatcctttccttcccactctttatgcccattttaccacagacaatctctcatgcttggtcatggagtactgtccaggtggtgatttgcatgttcttcgtcaaagacagcccggtagaaactttccagagccatctgcgaggttttatgttgcagaagttctccttgcgctggaatatcttcacatgctgggagtcatataccgtgatcttaagccagagaatatcctagtccgtgatgatggtcacatcatgctatcagacttcgatctctctctgaggtgctctgttagcgccgtgctcctccgatcatcgtctgtagcagcaaatcaccaaccaaagaaacatgcaggaccttgtgctgagagcaactgcatgaattcgtcatgcctccagcccacctcttgtgcccaaacgtcttgcttcaggccacgtccctcgatacctaagccacggaagcctaaatcttccttgaagagactgcctcaacttgttgtagagcctacagaagcacgctccaattcctttgttggcacacatgagtatctcgcaccagaaatcatcaaaggggatggccacgggagtgctgttgactggtggactttcggtgtcttcctttatgaacttctatacggtaagacacccttcagaggtcctggaaatgacgaaacattggcaaatgttgtttcccagaatctccggttccccgataacccagttgtcagcagcaatgccagagatctcatcagagggttgctagtcaaggagccagagaacagactgggaacgttgagaggagcagccgaaatcaagcaacaccctttctttgaaggcttgaattgggccttgatacgatctgctgccccgccagagacacgaccttgcgacgttgtgactcttgcgacagtacggaagaagaaagaaggcaaatgcctagacttcagtaatgccgaggaggtggaatttgaagttttctagtgaggtcttggtacagtttagtagaatttccgccgttagtctacaaattttctattgagtagccaaaggctgggggtgtacatgtacattcttgtatgttcattgttcagttactactatgttcctgttaatagatcacacaatcaaaaggaacgatcagagcccatcacatcattgttgctgcat

SEQ ID NO: 3914 - DNA, 3206 bp, Triticum aestivum
tcgctcggatcctggtcgcagcttggagatccggactggcatttttcctggtagggtggtcagtggcgagaaaaaaggttgttttttggctgagtctctgagctccggaggcttccatcttggatgacgtctccctaaaaggcacaattgcaatagtttgacctgcctgccttcgatgcctttgccggcggtgggctaagataagctggcatactgtctctgtctgttgaaatttctcaactaggagggtgatggggtcgtccggttgcagctctgagatagttgagtccaacgaagacttgggtaatgcgcccgttagtggctccagcgtgctgcatatcaatgtgaaaactgaggagaaagatggaagacgtcgtggtcatcctgtggaagatgagctcgaccagcttcttaaggcgattgatagcaggacttactgtcgagcacttagccccggccaggccggggcagattctttgttgaagcatggtcaaaagacacctaggtcagggtcatctcaaattgcagtccctgggatatgctccaaacctgtcaatatgaagcaggcactgagaaggcattgcatttcccaggcgtcagaaatggctgcaatgaagaggttgtcgatgtcgcctgggtcatcgagttcatctgaagcaggtactatccacaggctttatgcctccttgatggttcagagcagtgatggaagccttgtgcatgatgataaaaagaacttgattgagatatcaatcactccagaaaagattagtaagaatctatctagaggaacaagtggctttagtgaagactgtgattttgagacagctgatggaagtgcagtcacctccatccattctgcatcttctacctcaattgatatacaaaaggtcaggatccaagatgtcatcagtggtgaccctgtagaaagtgagagctccattgtgcaaaatggaaaaacgcataaacaagtttctgcggctactgatgatagtccatccagaatccccatattgatcaaacccatcacaacatcccggctcgtgaagccagtttttcgatgcaaaaccagcagtaagagtaaaatgaaagaagaacaaccttcacttggtaattcttccaatagtactaaattctgctcttcaaaggaatccatttcccatgtatcaaccagctcctcgtcggtgtccagcattagtaatcccaccagctgtgcagaaggggagataaatccaggaccagaaaaatgtgatgagaggtcgtctgaatggctaacattggaaaaaggtgagtgctcccagaattcaaagagcagcattagtgagtatggatgtagcactagtatcagcgatgagagccaatttggcttatgtggctataacaacaggccccatatggtgaaggatctctgttggataaccattcgccagttggcgttgcaacagggacccttaggacttgacaactttaggcttctgaagaggcttggatgtggggatatcgggactgtgtatcttgcagaattggttgattcagattgcttgtttgctttgaaggttatggatattgagtacctgattagtaggaaaaagatgctacgagcacaggctgagagagagatactagaaatgctggatcatccttttcttcctactctttatgcccattttacgacagacaatctctcatgcttagtcatggagtactgtccgggtggtgatttgcacgttcttcgtcaaagacaacccggtagaagcttcccagagccatctgcgaggttttatgttgcagaagttctcctcgcgctggaatatcttcacatgctgggagtcatataccgtgatcttaagccagagaatatcctggtccgcgatgatggtcacatcatgctatcagattttgatctctcgctaaggtgctctgttagcgccgtgctcctccggtcatcctcggtagcagcgaatcaccaaccaaagaagcttacaagcccttgtgcagagagctactgcatcaactcgtcgtgcctccagccctcttgtgcccaaacgtcttgtttcaggccacgcccctgggtaccgaagcctaggaagcctaaatcttccctgaagaggctgcctcaacttgttgtagagcctacagaagcacgctccaattcctttgttggcacacatgagtatcttgcaccagaaatcatcaaaggggatggtcacgggagtgctgttgactggtggacgtttggtgtgttcctttatgaacttttgtatggtaggacacccttcagaggtcctgggaatgatgaaacattggcaaatgttgtttcccagaatctccggttcccggataacccggttgtcagcagcaatgcaaaggatctcatcagaggattgctagtcaaggagccggagaacaggctgggaacgttgagaggagcagctgaaatcaagcagcaccctttctttgaagggttgaactgggccttgatacgatctgctgccccaccagagacacggccttgcgatgtcgtgactcttgcgacggtgcggaagaagaaagaaggcaaatgtctggacttcaggagccccgaggagctggagtttgaagttttctagtgaggtcttggtacagtttagcacaatttctgccgatagtctacaatttttctgttgagtaggtaaaggttggggctgtctgtacattgtagattcttgtatgctcagttgctgctatattcctgtgaatagatcacttttcttaattgaaaggaacaatcagagcccacggtatcattgccgttgcgtctattggaggctccagttgatctagtgatctcttcctgttgtgcagccgaattcttggaggagcatgcacatccactgtttctgctatgggcaagagggtgattacttttcctctcaaatgggcgcaataatgcatgcaagcactgatgtttcacctacaagacttggacttctgtgaaaggaactcttacaaaaacatcctttttcttactccaaatactccctccattcacttttgtaaggaaggccttacaatagtgaacagagggagtatgttttttctaagaatgaagtagggtttcttggtgcagtaaactgattttccaatgaagaagaagccacgagaatgatcacaaaaacaatcaaattatctgtactccctgcaatgtgtatctttgtctggttcct

SEQ ID NO: 3915 - DNA, 3210 bp, Triticum aestivum
ttctgctctcctctctctccctaccttcccgaggccgccgttcccaagattagttcacgccatagctcgcttccctggagcccgccgatcgccagctcgcgagacaccccactccgctcggatcctggtcgcagcttggagatccggactggcatttttccttgtagggtggtcagtggcgacaaaaaggttgttttttggctgagtctctgagctccggaggcttccatcttggatgatgtctccctaaaaggcacaattgcaatagtttgacctgcctgccttcgatgcctttgcaggcggtgggctaagataagctggcatactgtctctgtctgttgaatttctcaactaggagtgtgatggggtcgtccggttgcagctctgagatagttgagtccaacgaagacttggataatgcgcctgttagtggctccagcgtgctgcatatcaatgtgaaaactgaggagaaagatggaagacgtcgtggtcatcctgtggaagatgagctcgaccagcttcttaaggcaattgatagcaggacttaccgtcgagcacttagccccggccaggccggggcagattctttgtcgaagcatgctcaaaagacacctaggtcagggtcatctcaaattgcagtcactgggatatgctccaaacctgtcaatatgaagcaggcactgagaaggcattgcatttcccaggcgtcagaaatggctgcaatgaagaggttgtcgatgtcgcctgggtcatcgagttcatctgaagcagggactatccacaggctttatgcctccttgatggttcagagtagtgatggaagcgttgtgcatgatgataaaaagaacttgattgagatatcaatcactccagaaaagattagtaagaatctatctagaggaacaagtggctttagtgaagactgtgattttgagacagctgatggaagtgcagtcacctccatccattctgcatcttctacctcaactgatatacaaaaggtcaggatccaagatgtcatcagtggtgaccctgtagaaagtgagagctccattgtgcaaaatggaaaaacgcataaacaagtttctgcgactactgatgatagtccatccagaatccccatattgatcaaacccatcacaacatcccggctcgtgaagccagtttttcgatgcaaaaccagcagtaagagtaaaatgaaagaagaacaaccttcacttggtaattcttccaatagtactaaattctgctcttcaaaggaatccatttcccatgtatcaaccagctcctcttcggcgtccagcattagtaatcccaccagctgtgcagaaggggagataaatccaggaccagaaaaatctgatgagaggtcgtctgaatggttaacattggaaaaaggtgagtgctcccagaattcgaagagcagcattagtgagtatggatgtagcactagtatcagcgatgagagccaatttggcttatgtggctataacaacaggccccatatggtgaaggatctctgttggataaccattcgccagttggcgttgcaacagggacccttaggactcgacaactttaggcttctgaagaggcttggatgtggggatatcgggactgtgtatcttgcagaattggttgattcagattgcttgtttgctttgaaggttatggatattgagtacctgattagtaggaaaaagatgctacgagcacaggctgagagagagatactagaaatgctggatcatccttttcttcctactctttatgcccattttacgacagacaatctctcatgcttagtcatggagtactgtccgggtggtgatttgcacgttcttcgtcaaagacaacccggtagaagcttcccagagccatctgcgaggttttatgttgcagaagttctccttgcgctggaatatcttcacatgctgggagtcatataccgtgatcttaagccagagaatatcctcgtccgcgatgatggtcacatcatgctatcagattttgatctctcgctaaggtgctctgttagcgccgtgctcctccggtcatcctcggtagcagcgaatcaccaaccaaagaagcttacaagcccttgtgcagagagctactgcatcaactcgtcgtgcctccagccctcttgtgcccaaacgtcttgtttcaggccacgcccctgggtaccgaagcctaggaagcctaaatcttccctgaaggggctgcctcaacttgttgtagagcctacagaagcacgctccaattcctttgttggcacacatgagtatcttgcaccagaaatcatcaaaggagatggtcacgggagtgctgttgactggtggacgtttggtgtgtttctttatgaacttgtgtatggtaggacacccttcagaggtcctgggaatgatgaaacattggcaaatgttgtttcccagaatctccggttcccggataacccggttgtcagcagcaatgcaaaggatctcatcagaggattgctagtcaaggagccggagaacaggctgggaacgttgagaggagcagctgaaatcaagcagcaccctttctttgaagggttgaactgggccttgatacgatctgctgccccaccagagacacggccttgcgatgtcgtgactcttgcgacggtgcggaagaagaaagaaggcaaatgtctggacttcaggagcgccgaggagctggagtttgaagttttctagtgaggtcttggtacagtttagcacaatttctgccgatagtctacaatttttctgttgagtaggtaaatgttggggctgtctgtacatggtagattcttgtatgctcagttgctgctatattctgtgaatagatcacttttcttaattgaaaggaaaaatcagagcccatggcatcattgccgttgcgtctattggaggctccagttgatctagtgatctcttcctattgtgcagccgaatacttggaggagcatgcagatccactgtttctgctaagggcaagagggtgattacctttcctctcaaatgggcgcaataatgcatgcaagcactgatgtttcacctacaagactcggacttctgtgaaaggaactcttacaaagacatcatttttcttactccatatactccctccgttaaatgtctaaaacgccttacaaaagtgaacatagggagtaggttttttctaagaatgaagtagggtttcttg

SEQ ID NO: 3916 - DNA, 3334 bp, Hordeum vulgare
cggcatttgtacttctttaaccgtcagcggcagcgcaaaccatggcggacacacggatgtgccactccgtgttcgctgcagggacgataaggcgaccccttacttggtcccttttaggtcgactcgtcttcgtgggacgcaacccctctcacctttctgctctctctctctctctctctaccttccaaggccgccgttcccgagattagttcacgccatagctcggctccctggagcccgccgatcgccagctggcgagacactccactccgctcggatcctagtcgcagcttggagatccggactggcatttttcctgggtggtcagtggcgagaaaaaaagttgtttttttggctgagtctctgagccccggaggcttccatcttggatgatgtctccctaaaaggcacaattgcaatagtttgacctgcctgccttcgatgcctttgccgcggtgggctacataagttgccatactgtctctctctgttgaatttctcaactgggagggtgatggagtcgtccggttgcagctctgagatagttgagtccaacgaagacttggacaatgcgcccgttagtggctccagcttgctgcatattaatgtgaaaaccgaggagaaagatggaagacgtcgtggtcatcctgtggaagatgagctcgatcagcttcttaaggcgattgatagcaggacttaccgtcgagcacttagccctggccaggccggggcggattctttgttgaagcatgctcaaaagactcctagatcactgtcatctcaaattgcagtcactggaatatgctccaaacctgttaatatgaagcaggcactgagaaggcattgcatttcccaggcgtcagaaatggctgcaatgaaaaggttgtcgatgtcgcctgggtcatcaagttcatctgaagcagggactatccacaggctttatgcctccttgatggttcagagcagtgatggaagccttgtgcatgatgatagaaagaacttgattgaaatatcaatcactccagaaaggattagtaagaatttatctggaggaacaagtggctttagtgaagactgtgattttgagacagctgatggaagtgcagtcacctccatgcattctgcatcttctccctctactgatatacaaaaggtcaggatccaagatgtcatcaatggtgaccctgtagaaaatgagagctccattgtgcaaaatggaaaaacacataaacaagtttctgcggctactgatgatagttcatccagaatccccatattgatcaaacccatctcaacatcccggctcgtgaagccagttttccgatgcaaaaccagcagtaataagagtagaatgaaagaagaacaaccttcacttggtaattcctccaatagtactaaattttgctcttcaaaggaatccatttcccatgtatcaaccagctcctcttcggcgtccagcattactaataccaccagctgtgcagaaggggagataaatccaggcccagaaaaatctgatgagaggtcgtctgaatggttaacattggaaaaaggtgagcgctcccagaattcaaagagcagcattagcgagtacggatgtagcactagtatcagcgatgagagccaatttggcttatatggctataacaacaggccccatatggtgaaggatctctgttggataaccattcgccagttggcgttgcaacagggacccttaggactcgacaactttaggcttctgaagaggcttggatgtggggatatcgggactgtgtatcttgcagaattggttgattcacattgcttgtttgctttgaaggttatggatattgagtacctgattagcaggaagaagatgctacgagcacaggctgagagagagatactagaaatgctggatcatccttttcttcctactctttatgcccattttacgacggacaatctctcatgcttagtcatggagtactgtccgggtggtgatttgcatgttcttcgtcaaagacaacccggtagaagcttcccagagccatctgcgaggttttatgttgcagaagttctccttgcgctggaatatcttcacatgctgggagtcatataccgtgatcttaagccagagaatatcctagtccgtgatgatggtcacatcatgctatcagattttgatctctcactaaggtgctctgttagcgccgtgctcctccggtcatcctcggtagcagcaaatcaccaaccaaagaagcttacaagcccttgtgcagagagctactgcatcaattcgtcgtgcctccagccctcttgtgcccagacgtcttgtttcaagccacgcccctgggtaccgaagcctaggaagcctaaatcttccttgaagaggctgccacaacttgttgtagagcctacggaagcacgctccaattcctttgttggcacacatgagtatcttgcaccagaaatcatcaaaggggatggtcacgggagtgctgttgactggtggacatttggtgtctttctttatgaacttttgtatggtaggacacccttcagaggtcctgggaatgatgaaacattggcaaatgttgtttcccagaatctccggttcccggataacccggttgtcagcagcaatgcaaaggatctcatcagaggattgctagtcaaggagccggagaacaggctgggaacgttgagaggagcagctgaaatcaagcaacacccattctttgaagggttgaactgggccttgatacgatctgttgccccaccagagacacggccttgcgatgtcgtgactcttgcgacggtgcggaagaagaaagaaggcaagtgtctggacttcaggagcgccgaggagctggaatttgaagttttttagtgaggtcttggtacagtttagcacaatttctgcagatagtctacaatttttctgttgagtaggtaaaggctggggctgtctgtacatggttaatagatcacttttcccgttaatagatcacttttcctaattaaaaggaacaatcaaagtccatgacatcattgttgttgcatcctgttggaggccccagttgatttagtgatctgttcctattgtgcagccgaacacttgggggagcaataatgcatgaaagcactgatgtttcacctacaagacttggatttctgtgaaaggaactcgtacaaaagatcaattttcttacttcatataggttttttctaagaaagaagttcttggtgcagtaaactgatttttccaatgaagagaagccacgagaatgatcacaaaaataatcaaattacctgtactccctgcaatatgcatctttgtctggttccc

SEQ ID NO: 3917 - DNA, 3313 bp, Hordeum vulgare
cggcatttgtacttctttaaccgtcagcggcagcgcaaaccatggcggacacacggatgtgccactccgtgttcgctgcagggacgataaggcgaccccttacttggtcccttttaggtcgactcgtcttcgtgggacgcaacccctctcacctttctgctctctctctctctctctctaccttccaaggccgccgttcccgagattagttcacgccatagctcggctccctggagcccgccgatcgccagctggcgagacactccactccgctcggatcctagtcgcagcttggagatccggactggcatttttcctgggtggtcagtggcgagaaaaaaagttgtttttttggctgagtctctgagccccggaggcttccatcttggatgatgtctccctaaaaggcacaattgcaatagtttgacctgcctgccttcgatgcctttgccgcggtgggctacataagttgccatactgtctctctctgttgaatttctcaactgggagggtgatggagtcgtccggttgcagctctgagatagttgagtccaacgaagacttggacaatgcgcccgttagtggctccagcttgctgcatattaatgtgaaaaccgaggagaaagatggaagacgtcgtggtcatcctgtggaagatgagctcgatcagcttcttaaggcgattgatagcaggacttaccgtcgagcacttagccctggccaggccggggcggattctttgttgaagcatgctcaaaagactcctagatcactgtcatctcaaattgcagtcactggaatatgctccaaacctgttaatatgaagcaggcactgagaaggcattgcatttcccaggcgtcagaaatggctgcaatgaaaaggttgtcgatgtcgcctgggtcatcaagttcatctgaagcagggactatccacaggctttatgcctccttgatggttcagagcagtgatggaagccttgtgcatgatgatagaaagaacttgattgaaatatcaatcactccagaaaggattagtaagaatttatctggaggaacaagtggctttagtgaagactgtgattttgagacagctgatggaagtgcagtcacctccatgcattctgcatcttctccctctactgatatacaaaaggtcaggatccaagatgtcatcaatggtgaccctgtagaaaatgagagctccattgtgcaaaatggaaaaacacataaacaagtttctgcggctactgatgatagttcatccagaatccccatattgatcaaacccatctcaacatcccggctcgtgaagccagttttccgatgcaaaaccagcagtaataagagtagaatgaaagaagaacaaccttcacttggtaattcctccaatagtactaaattttgctcttcaaaggaatccatttcccatgtatcaaccagctcctcttcggcgtccagcattactaataccaccagctgtgcagaaggggagataaatccaggcccagaaaaatctgatgagaggtcgtctgaatggttaacattggaaaaaggtgagcgctcccagaattcaaagagcagcattagcgagtacggatgtagcactagtatcagcgatgagagccaatttggcttatatggctataacaacaggccccatatggtgaaggatctctgttggataaccattcgccagttggcgttgcaacagggacccttaggactcgacaactttaggcttctgaagaggcttggatgtggggatatcgggactgtgtatcttgcagaattggttgattcacattgcttgtttgctttgaaggttatggatattgagtacctgattagcaggaagaagatgctacgagcacaggctgagagagagatactagaaatgctggatcatccttttcttcctactctttatgcccattttacgacggacaatctctcatgcttagtcatggagtactgtccgggtggtgatttgcatgttcttcgtcaaagacaacccggtagaagcttcccagagccatctgcgaggttttatgttgcagaagttctccttgcgctggaatatcttcacatgctgggagtcatataccgtgatcttaagccagagaatatcctagtccgtgatgatggtcacatcatgctatcagattttgatctctcactaaggtgctctgttagcgccgtgctcctccggtcatcctcggtagcagcaaatcaccaaccaaagaagcttacaagcccttgtgcagagagctactgcatcaattcgtcgtgcctccagccctcttgtgcccagacgtcttgtttcaagccacgcccctgggtaccgaagcctaggaagcctaaatcttccttgaagaggctgccacaacttgttgtagagcctacggaagcacgctccaattcctttgttggcacacatgagtatcttgcaccagaaatcatcaaaggggatggtcacgggagtgctgttgactggtggacatttggtgtctttctttatgaacttttgtatggtaggacacccttcagaggtcctgggaatgatgaaacattggcaaatgttgtttcccagaatctccggttcccggataacccggttgtcagcagcaatgcaaaggatctcatcagaggattgctagtcaaggagccggagaacaggctgggaacgttgagaggagcagctgaaatcaagcaacacccattctttgaagggttgaactgggccttgatacgatctgttgccccaccagagacacggccttgcgatgtcgtgactcttgcgacggtgcggaagaagaaagaaggcaagtgtctggacttcaggagcgccgaggagctggaatttgaagttttttagtgaggtcttggtacagtttagcacaatttctgcagatagtctacaatttttctgttgagtaggtaaaggctggggctgtctgtacatggttaatagatcacttttcccgttaatagatcacttttcctaattaaaaggaacaatcaaagtccatgacatcattgttgttgcatcctgttggaggccccagttgatttagtgatctgttcctattgtgcagccgaacacttgggggagcaataatgcatgaaagcactgatgtttcacctacaagacttggatttctgtgaaaggaactcgtacaaaagatcaattttcttacttcatataggttttttctaagaaagaagttcttggtgcagtaaactgatttttccaatgaagagaagccacgagaatgatcacaaaaataatcaaattacctgtactccctgcaat

SEQ ID NO: 3918 - DNA, 3174 bp, Secale cereale
agctccgtggcaactgatccaacgagatagggcacttcctccctcgagagaaaaaaagaagaagaaagaaatacggcgcttcaaatcacacggaatgaatctccaaccactcggttgaaacctttcggcggcaggtatctttctttaaccgtcagcggcagcgcaaagcatggcggacacacggacgtgcactccgtgtctgctgcagggacgatcaggtgaccccttacttggccccttttagattcgtcttcgtgggaagcaacccctctcacttttctgctctcctctctctctgcccctaccttcccgaggccgccgttcccaagattagttcacgccatagctcgcttccctggagcccgccgatcgccagctggcgtggcacttcactccgctcggatcctagtcgcagcttggagatccagactggcatttttcctggtagggtggtcagtggcgagaaaaaagttgtgttttggccgagtctctgagttccggaggcttccatcttcgatgatgtctccctaaaaggcaaaattgcaatagtatgacctgcctgccttcgatgcctttgccggcggtgggctagataagttggcatactgtctgtgtccgttgaatttcccaactaggagggtgatggggtcgtccggttgcacctctgaaatagttgagtccaacgaatacttggataatgcgcccgttagtggctctagcgtgctgcatattaatgtgaaaactgaggagaaagatggaagacgttgtggtcatcctgtggaagatgagctcgaccagcttcttaaggcgattgatagcaggacgtaccgtcgagcacttagccctggccaggccggtgcggattctttgttgaagcgtgctcaaaggacacctaggtcagggtcatctcaaattgcagtcactgggatatgctccaaacctgttaatatgaagcaggcactgagaaggcattgcgtttcccacgcgtcagaaatggctgcaatgaagaggttgtcgatgtcgcctgggtcatcgagttcatctgaagcagggactatccacaggctttatgcttccttgatggttcagagcactgatggaagccttgtgcatgatgataaaaagaacttgattgaaatatcaatcactccagaaaagattagtaagaatctatctagaggaacaagtggctttagtgaagactgtgattttgagacagctgttggaagtgcagtcacctccatgcattctgcatcttctacctcaactgatatacaaaaggtcaggatccaagatgtcatcagtggtgaccctgtagaaagtgagagctccattctgcaaaatggaaaaacgcataaacaagtttctgcggctactgatgatagttcatccagaatccccatattgatcaaacccatcacaacatcccggctcgtgaagccagtttttcgatgccaaaccagcagtaagagtaaaatgaaagaagaacaaccttcacttggtaattcctcaaatagtactaaattctgctcttcaaaggaatccatttcccatgtatcaaccagctcctcttcggcgtccagcattactaatcctaccagcagtgcagaaggggagataaatccaggcccagaaaaatctgatatgaggtcgtctgaatggttaacattggaaaaaggcgagtgctcccagaattcgaagagcagcattagcgagtacggatgtagcactagtctcagcgatgagagccattttggcttatgtggctataacaacaggccccatatggtgaaggatctctgttggataaccattcgccagttggcattgcaacagggacccttaggactccacaactttaggcttctgaagaggcttgggtgtggggatatcgggactgtgtatcttgcagaattggttgattccgattgcttgtttgctttgaaggttatggatattgagtacctgattagtaggaagaagatgctacgagcacaggctgagagagagatactagaaatgctggatcatccttttcttcctactctttatgcccattttacgacagacaatctctcatgtttagtcatggagtactgtccgggtggtgatttgcacgttcttcgtcaaagacaacccggtagaagcttcccagagcaatctgcgaggttttatgttgcagaagttctccttgcgctggaatatcttcacatgctgggagtcatataccgtgatcttaagccagagaatatcctagtccgtgatgatggtcacatcatgctatcagattttgatctctcgctaaggtgctctgttagcgccgtgctcctccggtcatcctcggtagcagcaaatcaccaaccaaagaagcttacaagcccttgtgcagagagctactgcatcaattcgtcgtgcctccagccctcttgtgcccaaacgtcttgtttcaggccacgcccctgggtaccgaagcctaggaagcctaaatcttccctcaagaggctgcctcaacttgttgtagagcctacagaagcacgctccaattcctttgttggcacacatgagtatcttgcaccagaaatcatcaaaggggatggtcacgggagtgctgttgactggtggacgtttggtgtgtttctttatgaacttttgtatggcaggacacccttcagaggtcctgggaatgatgaaacattggcaaatgttgtttcccagaatctccggttcccggataacccggttgtcagcagcaatgcaaaggatctcatcagaggattgctagtcaaggagccggagagcaggctgggaacattgagaggagcagctgaaatcaagcagcaccctttctttgaagggttgaactgggccttgatacgatctgctgccccaccagagacacggccttgcgatgtcgtgactcttgcgacagtgcggaagaagaaagaaggcaaatgtctggacttcaggagcacagaggagctggaatttgaagttttctagtgaggtcttggtacagtttagcacaatttctgccgatagtgtacaaattttctgttgagtaggtaaaggctggggggatgtctgtacatggtagattcttgtatgctcagttgctgctatattcctgttaatagaccacttctcctaattgaatggaacaatcagagcccatgg

SEQ ID NO: 3919 - DNA, 2266 bp, Zea mays
atcgtggcgtggcacgacgctcacgtcgcgaacgcgaccgcgggcacctgcggaagggcagggagaactgaagaaccctgcggctcggctccgccgtcacgccacatggacatcaaggagcggatccgccgctcgccgccgtcgtcgccgcaggctgtgggggaggcggcggcgtccgcgcccggacacccgcgcgggaggaaggcccgggtcgcggtgcttcccctgtcagtcgcctgcggggtcacgctgttgttgctcgcgggcgtctccgccgcgaggaggggtgcccaattctccggcgcggatcctaccactctctccggcaacgacgatcgtggcggctttgaacaggccgggccgcgcgatggagagcatgcaactacggtgtcttccaaagttcaaagggacaaactaattggtggcttgttagctcctggttttgatgaacagtcatgtctaagtagataccaatcagcattgtatcgtaaagagtcgccccatttagtatcaacctaccttttggaaagactgagagaacatgaggttctccagaagaaatgtggcccatatacagactcatacaagaaagctattgagcaactgaattctggtcaggatataatggttggagattgcaactatttggtgtgggtatcttatagtggtcttggtaacaggatcttgactattgcctcagcatttctctatgccatccttacaaacagagttctacttgtagatggagataaaggcactgcagatcttttctgtgaaccattccctgaaacttcatgggtattaccgccggatttccctattactaaatttaagaacttcagtattggctcccctgagagttacggaaacatggcgaaaactgaagctattcattctgatggttcttttaagggtcctaaacctgcctttctatatcttcacctggctcatgactatgatgatcatgataagctttttttctgtgaacatagtcagcaacatctccagaagatcccatggctgatcttaagatccgataattactttgtaccttcgctttttctgatctcatcataccaagaggagctcacgaggctgtttccgcagaaagatgttgtcttccatcacttgggacgttacttgttccaccctaccaatgctgtgtggggcttgattacaaggtactatgattcttatcttgccagagctgacgagaagttaggtatccagatcagagtcttcgatactgaaaccggtccatttcagcatgtcttggatcaggtccttcattgcacactgaaggaaaaattactaccagagatcaacgcgcaacagccaattatctcgacagggaacatcaagtccaaagttgttctgattacttctttgaactcaggatactacgaaaggatcaggaacatgtactgggaacatccgactgagaatggtgagatgattagcttccatcagccaagccacgaggagcaccaggattcagacaagacaatgcataacatgaaagcatgggcagagatttatctgctgagcttatctgatgctatggtaacaagtgcatggtcaacttttggatatgtagctcagggtctgagtggttcgaagacgtggcttctgttcaagcctgaaaatcgcactgcgcctaatccaccttgccgtcaggtcatgtctatagaaccgtgctttcatgctccgcctttctatgattgcaaaactaggaagggaactgacacagggaagcttgttccacatgtaagacactgtgaagatatgagctgggggctcaagctagttgatacaggtgagctgtagataaccagatgcggtgttttttttcctttgtataattcatatatgtacagtagaaccgaatgctttgtgctgtggatttttcaggtacataggttcaggtttgtatttatattgaaggcaaggtttgagcgacacagttaatacaaaatggcataggggtgtttgtttgggattatataatctggctagattataattccaaacaaacacgtatgctgactgtggtcagcatgcttgaactgggcaaaagtcgaccaagaaaataaaaagtgagcaaatatactgaggactacgatcaatcgccaaagaacgataagctgtactaatttccttctccccccctgtcattaggagctattaatacagttcgtcagttattgaagtttttactcactgttcatgacaaaaattcgcaaggagcacattcgggttaagggat

SEQ ID NO: 3920 - DNA, 2147 bp, Setaria italica
gcggctcgggcgccgccgccgccgcgccacatggacatcaaggagcggatccaccgctcgccgccgccgacgccgcaggagcaggcgggggcggcgcccgcgcacccgcgcgggaggaagggccgggtcgcggcgctgccgctgtcggtcgcggcgctcgtggcgtgcggggtcgtgctgctgctgctcgcgggcggctccgcggcgaggaggggcagccagttcctcgacgcagatcctgccagtgccgggctcgccggcgacgaccgtggcgacgtgcaccaggcccgcccgcgcgatgggggtcatggaactatggaatcttccaaagttcaaagggacaaactcattggtggcttgttagctcctggttttgatgagcagtcatgtctaagtagataccaatcagtactttaccgtaaaaaatcgccccatttactatcaacataccttcttgaaagactaagagaacaagaggttctccagaagaaatgtggcccgcatacagagtcatacaagaaagctattgaactgctaaaatctggtcaggatgttaaggttggagattgcaactatttggtatgggtatcgtatagtggccttgggaacaggatcttaactattacctcagcatttctctatgccatccttacaaatagagttttacttgtagatggagataaaggcactgctgatcttttctgcgaaccattccctgaaacttcatggttattaccgttggatttcccgattaatcaatttaagaacttcagtgttggctcccctgagagttacggaaacatggtgaaaactgaacgcattcgttctgatggttcttttaagggtcctaagcctgcctttatttatcttcacctggctcatgattatgatgattacgataagctttttttctgtgaacatagtcagcagcatcttcagaggatcccatggctgatcataagatccgataattactttgtaccttcactttttctgatcccagcataccaagaggagctcatgaggctgtttcctcagaaagacgctgttttccatcacttgggacgttacttgttccaccctaccaatgttgtctggggcttgattacaaggtactatgattcttatcttgctacagctgacgagaagttgggtgtccaaatcagagtctttgatactgaaaccggtccatttcagcatgtcttggatcaggtcctttcttgtacactgaaggaaaatttactaccagaggttaatgcacaacagccaattgtgtcgacaaggaaactcaggtcaaaagttgttctgattacttctttgaactctggatactacgaaagaatcaggaacatgtattgggaacatccgacgatgaatggtgaggtaattagcttccaccagccgagtcacgaggagcatcaggattctgacaagaaaatgcataacatgaaagcatgggcagagatttatctgttaagcttatctgatgttatggtaacaagtgcatggtcaacttttgggtatgttgctcagggtctgagtggtctgaagacgtggcttatgttcaaacctgaaaaccgcactgcacctaatccaccttgccgtcaagttatgtccatggaaccgtgctttcatgctccacctttctatgattgcaaagctaggaggggaactgatacaggaaagcttgttccacatgtaagacattgtgaagatatgagctgggggctcaagctagttgatacggatgaacggtagatgactagatgtggtgtttttctttgtcgatttcacatatgtacagtacaactgctttctggtatgcattttttcttgaacgtcccgtatgaatttttcatgtacaggttcaacttcgtatctacattgaaggcaagatttttccttacttagtttagttaatatgaaatggcaagcttatggtcaagtataagcatagtgcaactataacaatattctctcctgctccttttttcacaaatcttgtacgcaacaactttgcatttctaatataatgttcaggccggcatcttgcccattgtatccccttaaaataacaaaatttgcccctttatattatttccatctcatgtagcattctcttcacgccttgtatgtcatgcatgaac

SEQ ID NO: 3921 - DNA, 2652 bp, Panicum virgatum
ctgcaagatcactatgtatctgcacgctctctggaattgagaccacggtgagtggtgtccatggacagttggacaaacgcccgggagtcccattccaatgctcccaaaagcggaagaccaacccaccacccgagcctcatgacccggccggcccgcacacacggccacacgatgacacgatccggtgatccgcgtatccggcgcccccgctcagcaggccaggaaccagaagtccagaaccactccccgtccccgcaccggcaaggccacacggcagacggcaccgtccgtccgacttttgaactttttttgggggtctcgcgtttcgcccgtactagcacgttcaacgtctacgctttggctgtagcgcgtgcggaaacgcgctccgaaggcaaatcgtccggcgaatttcttggcatcttttccaccgccgacgccgccgcatctggtgaaagcgaaacaaacgggggcgcaaaagccccacgaggccacgacgtctcctcgtcccggctctggcgccacgccgaggcgctccagttccgccgacagcgccgggccgacgacgcccccactccgccgtcgtgccatcacgtcctcgctcgtcgtccctgttccgaccccacccttcctcacctcaaacgcatcgaaaccccccctgtgcggctcggtcccccgcacgtgccgcgccctgctcgccggcatagtggcatcccacgtacacgcacgccctccctccctatttcagccgcgcgggtccgctccgcacccgaaccgcgccctccgtgccgcggccggaagtccagaaccgaagaaccccccgggtcgactcggctcggggcgccgcgccgcatggacatcaaggagcggatccgccgctcgccgccgccgccgacgccgccggcggcgcccgcgccagggcacccgcgcgggacgaagggccgggtcgcggtgctgcccctgtcggtggcggcgctcgtggcgtgcggggtcctgctgctgctgctgctctcgggcggctccgcggcgaggaggggcggccagttcctcgacgccgatcctgccaccgccaggccctccggcgacggccgtggcggcctgcaccaggcccgcccgcgcgatggtggccatgtaactatggagtcttccaaagttcaaagggacaaactcattggtggcttgttagctcctggttttgaggaacagtcatgtctaagtagataccaatcagcattataccgtaaagaatcgccccatttactatcagcataccttctggaaagactaagagaacatgaggttcttcagaagaaatgtggcccacatacagagtcgtacaagaaagctattgagcagctgaaatctggtcaggatattgaggttggagattgcaactatttggtatgggtatcttatagtggccttgggaacaggatcttaactattacctcagcatttctctatgccatccttacaaacagagttttacttgtggatggggataaaggcactgcagatcttttctgtgaaccattccctgaaacttcgtggttattaccgtcggatttccctattaatcaatttaagaacctcaatattggctcccctgagagttacgggaaaatgctgaaaactgcaaatattcactctgatggttcttttaagggtcccaaacctacctttatttatcttcacctggctcatgattatgatgactatgataagctttttttctgtgaacatagtcagcaacatcttcagaggatcccatggctgatcttaagatctgataattactttgtaccttcactttttctgatcccagcataccaagaggaactcatgaggctgtttcctcagaaagacgctgttttccatcacttgggacgttacttgttccaccctaccaacgttgtctggggcttgattacaaggtactttgattcttatcttgccagagctgacgagaagttgggtatccagatcagagtctttgatactgaaaccggtccatttcagcatgtcttggatcaggtcctttcttgtacactgaaggaaaatttactaccagaggttaatgcacagcagccaattgtctcaaccaggaaagtcaagtcgaaagtggttctgattacttctttgaactctggatactacgaaagaatcaggaccatgtattgggaacatccaacatcgaatggtgagatcattagctttcaccagccaagtcacgaggagcatcaggattctgataagaaaatgcataacatgaaagcatgggcagagatttatctgttaagcttgtctgatgttatggtaacaagtgcatggtcaacttttgggtatgttgctcagggtctgagtggtctgaaaacgtggcttatgttcaaacctgaaaaccacactgtgcctaatccaccttgccgtcaagttatgtccatggaaccgtgctttcatgctccacctttctatgattgcaaagctaggaggggagctgatacaggaaagcttgttccgcatgtaagacattgtgaagatatgagctgggggctcaagctagttgatacggatgaatggtagataactatgtggttttttcttcttcatttcatatatgtacagtacaagcgagtgctttctggaatgcaatttttt

SEQ ID NO: 3922 - DNA, 2711 bp, Panicum virgatum
gctctggaattgaaccacggtgagtggtgacaagtccatggacagttggacacacgcccgggagtccccattcaatgctcccaaaagcggaagaccacaccacccgagcctcatgacccggccggccaccacacgatgacacgatccggtgatcggcgtgtccggcgcccccgcccagcaggccaggaaccagaaccactccccatccccggcaccggcatggccgcccggtagaaggcgtccgttcgacttttggaaaaaaaaataggtctcgcgtttcgcccgtactcgtagcacgttcgacgtctacgctttggccgtagcgcgtgcggaaacgcgctccgaaggcaaatcgcccggcgaaattactggcatcatttccatcgccgacgccgccgcatctgggggtgaaagcgaaacaaacgtgggtccatttgccgagcaggcgaaagccccacgaggccacgacgtctcctcgtcctggcgctgtctcgccacgccgaggcgctccagttccgccgacacagcgccgcccccactcctcactccgtcgtgccatcacgtcctcgctcgctcgtccccacccttcctcacctcaaacacatcgaaaaccccctgtgcggctcgttcccccgtcacgtgccgcgccctgctcgccccttcccctggcttcctatttcagccgcgatcgggtccgctccgcacccgaaccgcgccatccgtgccgcggccggcgacccagaacccaagaaccccccgcggcatggacatcaaggagcggatccgccgctcgccgccgccgccgccgacgccgcaggcggcggcgcccgcgccggggcacccgcgcgggaggaagggccgggtcgcggtgctgccgctgtcggtggcggcgctcgtggcgtgcgtggtcctgctgctgctgctctcgggcggctccgcggcgaggaggggcggccagttcctcgacgcggatcctgccaccgccaggcggccctccggcgacggccgtggcggcctgcaccagccccgcccgcgcgatggggggcatggaactatggagtcttccaaacttcaaagtgataaactcattggtggcttgttagctcctggttttgatgaacagtcatgtctaagtagataccaatcagcattataccgtaaagaatcgccacatttactatcaacataccttctggaaagactaagagaacatgaggttcttcagaagaaatgtggcccacatacagagtcttacaagaaagctattgagcagctaaaatctggtcaggatattgaggttggagattgcacgtatttggtatggatatcttatagtggccttgggaacaggatcttaactattacctcagcatttgtctatgccatccttaccagcagagttttacttgtggatggggataaaggcactgcagatcttttctgtgaaccattccctgaaacttcgtggttattaccgtcggatttccctgttaatctatttaagaacctcaatattggctcccctgagagttacgggaaaatgctgaaaactgcaaatattcattctgatggttcttttaagggtcccacacctgcctttatttatcttcacttggctcatgattatgatgattatgataagcattttttctgtgaacatagtcagcaacatcttcagaggatcccatggctgatcttaagatctgataattactttgtaccttcactttttctgatcccagcataccaagaggaactcatgaggctgtttcctcagaaagacgctgttttccatcacttgggacgttacttgttccaccctaccaacgctgtctggggcttgattacaaggtactatgattcttatcttgccagagctgacgagaagttgggtatccagatcagagtctttgatactgaaactggtccatttcagcatgtcttggatcaggtcctttcttgtacactgaaggaaaatttactaccagaggttaatgcacagcagccaattgtctcagcaaggaaagtcagatcgaaagttgttctgattacttctttgaactctggatactacgaaagaatcaggaccatgtattgggaacatccaacatcgaatggtgagattattagctttcaccagccaagtcacgaggagcatcaggattcggataagaaaatgcataacatgaaagcatgggcagagatttatctgttaagcttgtctgatgttatggtaacaagtgcatggtcaacttttgggtatgttgctcagggtctgagtggtctgaagacgtggcttatgttcaaacctgaaaaccacactgcgcctaatccaccttgccgccaagttatgtccatggaaccgtgctttcatgctccacctttctatgactgcaaagctaggaggggaactgatacaggaaagcttgttccgcatgtaagacattgtgaagatatgagctgggggctcaagctagttgatacggatgaatggtagataactagatgtgattttttttttcttcattcatatatgtacagtacaagcgaatgctttctagtatgcaatttttttctcgaacgtctggtgtgtaattttcacttataggttcaacttgtatatctatattgaaggcgagattttcctggtttagtttaggtagaaatgacacagcatgctgatagttgtcgagtacaaacagtttgtgagc

SEQ ID NO: 3923 - DNA, 2162 bp, Zea mays
attcattcattcattcccctcgcgtcgcgtgattcgattggattccgttcccccgccccgttccgttccttcagcgccgctgccgctgccgctgcggctgcgccgaggccccagcgagtccccgaggcccgaccccaaaggctgcggcctgcggccgtcgcagtcccatcgattcctcccgcttggctttcccacccctcgaagccgaatccgatggttccacccgttgaccgcctccgccatcggaggccgcgccgcctcctccccgccttcttcctcggtccccgcgcccgcctcctcctatagatataccgcccgcgcatcgctccatggcggtcggcggcgacgacgacagcatggagcgggacttcgccgccaggctgcgcctcgcgcattcgccctccccggccacgcctgccgccgccgcctcatcctcccccaccgccgctggggggatcgccttccgcgcgccgcaggagcagttcaccgccgacgacttcgtactcggcaagatctacggcgtcggctcgtactccaaggtggtgcgggccaagaagaaggacactggtcgcgtctacgcgcttaagatcatggacaagaagttcatcaccaaggagaacaagatctcctacgtcaagatggagcgtattgtactcgaccagctcgaccaccctggcgtcatcaggctcttcttcactttccaggacacatactccctctacatggcgctcgagtcgtgcgaaggcggggagttattcgaccaaattgttcggaaaggtcggctctctgaggacgatgcacggttctatgctgctgaaattgttgatatattggagtacttgcatggccttggcctaattcatcgggatgtcaagccagaaaatctactgcttacttctgatgggcacatcaagattgctgactttggtagtgtgaagcctacaagggatactcctatcaaagttctcccaaattcaactactgaaagggcctgtacatttgttggaaccgctgcatatgtaccacctgaggtcctgaactctgccccagcaacctttggaaatgatttatgggcattgggatgcacactgtaccaaatgctttctggctcttcgccatttaaagatgctagtgagtggttaattttccagagaatcattgcaagggacctcaaatttccagagtatttttcagctgaagctagagatcttgttgacaaattgctggatgttgatccaggcaaaaggccaggtgcaggacctgatggttattcttccttgaaggagcatcctttcttcagaggcatagactggaagaacctgaggaagacacggccacctaagctcgcaatcgatgcaaatgcaaatgaagatgaggatagccaagattcaaattggttggcacacatgggaagtgtggcagtcaaccaacagtcaaatactgttggtaataatggtgccccgtcatcatctgaagtgcgctcccatatatctaaattagcttccatcgactcctttgactcaaaatggcaagaattcctggaccccggcgagtctgtagtcttaatatcaaagctgaagaagattaataagctagcaaacaagaagatccagttgatcctcactgacaaacctcaattgatctgtgttgacccttcaaaaatggtggccaagggaaacattatttggtctgatgacccaagtgaactcagtgtgcaagtatcagattcttcacattttagaatatgcacgccaaagaaggtgtcaacatttgaggatgcgaaacagcgtgcttggcaatggaagaaggcaattgaagacctccaacgctgccaaaggaattaattttcaattcaaatcaaaactctaaaatgtcgaattaggcactgttaatacatcatatccttttcacttgggaggaacatgagggggtttatttctcctgcatcctgctccaatgcctggttgcaaggaacttgctactcgctaattcacacactgaatgatggcccccaattttttcccttcccatccatgttttcaaatagtacacaattttgtttgtcacttttgtgaaccgttggagcagatatcttcaaaacaggctgcagtctggaaatattgacacaggaaactattttaacagtctgccatacttgattc

SEQ ID NO: 3924 - DNA, 2516 bp, Setaria italica
ctcccctcatttgatcacacaccccaccaaagcacacgagacaagcacaccctccccattcccaacggcaagccaagcaggggggccaggccacgagccaacgacacggcgaggaaagcaaagctcccccgccccggccggccgcccccatccacgatccatctctgatcaccgttcccctcccgtcgcgtcgcgcgattcgatccggttccgttcctccgccccgttcagtcccgctgcggctgccgccccggaggccagggaccccagcgacctccaaaggctgcggccgtcgcagtcccatcgattccgcccgcgcccgctttcccacccctcgaagccgaatccgatggttccacccgttgaccgcctccgccatcggaggccgcgccgcctcctcctcctccccgccttcctcggcccgcgcgcccgcctcctcgccccgaccctatagataccgcccgcgcatcccccatggcggtcggcggcgacgacgacaccatggagcgggacttcgcagccaggctgcgcctcgcgcattcgccatcccctgccccgcctcccgccaccgccgcggccgtcgcttcctcctccccgaccgccgcaggggggatcgccttccgcgcgccgcaggagcagttcaccgccgccgacttcgagctcggcaagatctacggcgttggctcctactccaaggtggtgcgggccaagaagaaggacacgggcaacgtctacgcgctcaagatcatggacaagaagttcatcaccaaggagaacaagatctcctacgtcaagatggagcgcatcgtgctcgaccagctcgatcacccgggcgtcatcaggctcttcttcaccttccaggacacatactccctctacatggcgcttgagtcatgcgaaggaggggagttgttcgatcagattattcggaaaggccggctgtctgaggacgaggcacggttttatgctgctgaaattgttgatatattggagtatttgcacagtgttggcctaattcatcgggatgtcaagccagaaaatttactgcttacttctgatgggcacataaagattgctgattttggtagtgtcaagcctacacgggatactccaattaaagtcctcccaaattcaactaatgaaagggcctgtacattcgttggaacagccgcatacgtaccacctgaagtcctgaactctgccccagcaacctttggaaatgacttgtgggcattggggtgcacactgtaccaaatgctttctggctcttcaccatttaaagatgccagtgagtggttgattttccagagaatcattgcaagggacatcaaattccctgagtatttttcagatgaagcaagagatcttattgacaagttactggatgttgatccaagcaaaaggccaggtgcgggacctgatggttattcttcattgaagaagcatcctttcttcagaggtattgactggaagaacctgaggaagacacgaccaccaaagctcgcgattgacccaaatgcaagtgaagatgaggatagccaggattccaattggttatcacacatgggaggtaccacagttaaccaacagtcaaacactgttagtaataatggtgttgcatcatcatctgaagttcgctctcatatatcaaaattagcttccatcgactccttcgactcaaaatggcaagaattcctggaccctggtgagtccgtagtcttgatatcaaagctgaagaagattaataagctagcaaacaagaaggtccagctgatcctcactgataaacctcaattgatctgtgttgacccttcaaaaatggtggccaaggggaacattatttggtctgatgacccaagtgaacttaatgttcaagtaacaaattcatcacattttagaatatgcacgccaaaaaaggtttcaacatttgaggacgcaaaacagcgtgcctggcaatggaaaaaggcaattgaagacctacaacgctgccaaaagtattgattctcaattcaaatcaggtttctaaaacctcaaattaagcattgttaatacatcacatccttttcacttggaggaacgtgagggggcttgtttctcctgctgttctgctcctgcgcctggctgcaaggaagttgttactcgctaattggcatgttgatgatgcccctatgaattttccagtttctgtctacacttacatacagggcacaattttgtttgttgtttttgtgtctgtcgcagcagatagcatgaaatggctgcgcccagaaatattaacacaggaaactatttcattgaaatgacttcagcagtgctgcccatggttcattgtctagattgtctttctgttctagtgcatctacatatttatgatgtcattatttgattctgcaagttactgactgttatgctcacaactgtagcatcacctattttgtccacagcatagagttgcagatggtactgtaggctgccttcgtttccatagctttgtaaatacacaatacattgattga

SEQ ID NO: 3925 - DNA, 2310 bp, Panicum virgatum
cacacgagacaagcgcaaccaattccttcccaacggccgtagggggacgagacggcgaggaaagcaaagctccccgccacgccacgccacgccccggccggccgcccccatccatttctgaggaaggatcaccacctcccctccgttcccctcgcgtcgcgtcgcgcgattcgatccgttccgttcgtcgccgctgcggctgcgccccggaccccagcgacgccaccaaaggctgcggccgtcgcagtcccatcgattccgcccgcccgcccgctttcccacccctcgaagccgaatccgatggttccacctgttgaccgcctccgccatcggaggccgcgccgcctcctcggcccgcgcgcccccgccctatagatagacacccgccgcccactccgcgatggcggtcgccggcgacgacgacgacaccatggagcgggacttcgccgccaggctgcgcctcgcgcattcgccctccccggccccgcctgccgcggccgctttctcctcccccaccgccgcaggggggatcgccttccgcgcgccgcaggagcagttcaccgccggcgacttcgagctcggcaagatctacggcgtcggctcctactccaaggtggtgcgggccaagaagaaggacacgggcaacgtctacgcgctcaaggtcatggacaaaaagttcatcaccaaggagaacaaaatctcctacgtcaagatggagcgcatcgtgctcgaccaactggatcacccgggcgtcatcaggctcttcttcaccttccaggactcatactccctctacatggcgctcgagtcgtgcgaaggaggggagttgttcgatcagattgttcggaaaggtcgtctgtctgaggacgaggcacggttttatgctgctgaaattgttgatatattggagtatttgcacagcgtcggcctaattcatcgggatgtcaagccagaaaatttactgcttacttctgatgggcacatcaagatagctgactttggtagtgtcaagcctacgagggatactccaatcaaagtccttccaaattcgactgatgaaagggcctgcacatttgttggaacagctgcatatgtgccacctgaggtcctgaactctgccccagcaacctttggaaatgacttgtgggcattggggtgcacactgtaccaaatgctttctggctcttcaccatttaaagatgccactgagtggttgattttccagagaatcattgcaagggacatcaaattccctgagtatttttcagatgaagcaagagatcttattgacaaattgctggatgttgatccaagcaaaaggccaggtgcggggcccgatggttattcttccttgaagaagcaccctttcttcagaggcattgactggaaggacctgaggaagacacgaccaccaaagctcgcggttgacccaaatgcaaatgaagatgaggacagccaggattcaaattggctatcacacatgggaagtaccacagttaaccaacagtcaaacactgttagtattaacagtgccgcgtcgtcatctgaagtacgctcccatatatctaaattagcatccatcgactccttcgactcaaaatggcaagaattcctggaccctggtgagtctgtagtcttgatatcaaagctgaagaagattaataagctagcaaacaagaaggtccagctgatcctcactgataaacctcaattgatctgtgttgacccgtcaaaaatggtggccaaggggaacattatttggtctgatgacccaagtgaacttagtgttcaagtaacaaattcatcacattttagaatatgcacgccaaagaaaatttcaacatttgaggactcaaaacagcgtgcctggcagtggaaaaaggcaattgaagacctccaacgctgccagaagtattgattttcaattcaaaccaggttcctgaaacctcaaattaggcaatgttaatacagtacaacatccttttctcttagaggaacatgaaggggcttgttttcctgctgtcctgctcatgtgcctggttgcaaggaagttgttactcgctaattggcatgttgacgatgaccctatgaattttccattctattgacacttacatatagggcacaattttgtttgttgtttttgtgtctgtcgccgtggatagcttcaaacggttgcgctccagaaatattaacacaggaaacaatttcatcgaaatggcttcaacagtgcttcccatggttcattgtcaattgtcttctgttctagtgcatctataaatgtgcatctacaaatttatgaagagttaa

SEQ ID NO: 3926 - DNA, 2432 bp, Panicum virgatum
aaagcacacgagacaagcgcaacccattcccaacggccgtgggggaacgcgacggcgaggaaagcaaagctccccgccccgccccggccaggcacagcccccatccatttctgaggaaggattaccacctcccctccgttcccctcgcgtcgcgtcgcgcgattcgattcggttcctttcctccgctccgttccgttcgtcgccgctgcggctgcgccccggaccggaccccagcgacgcccccaaaggctgcggccgtcgcagtcccatcgattccgcccgcccgctttcccacccctcgaagccgaatccgatggttccacccgttgaccgcctccgccctcggaggccgcgccgcctcctccccgccctcctcggcccgcgcgcccccgccctatagatagacacccgccgcccactccccgatggcggtcgccggcgacgacgacgacagcatggatcgggacttcgccgccaggctgcgcctggcgcattcgccctccccggccccgcctgccgccgcggccgcttcctcctcccccaccgccacaggggggatcgccttccgcgcgccgcaggagcagttcaccgccgccgacttcgagctcggcaagatctacggcgtcggctcctactcaaaggtggtgcgggccaagaagaaggacacgggcaacgtctacgcgctcaaggtcatggacaaaaagttcatcaccaaggagaacaaaatctcctacgtcaagatggagcgcattgtgctcgaccagctcgatcatccgggtgtcataaggctgttcttcaccttccaggactcatactccctctacatggcgctcgagtcgtgcgaaggcggggaattgtttgatcagattgttcggaaaggccggctgtctgaggaggaggcacagttttatgccgctgaaattgttgatatattggagtatttgcatagcgttggtctaattcatcgggatctcaagccagaaaatttactgcttacttctgatgggcacatcaagatagctgattttggtagtgtcaagcctacaagggatactccaatcaaagtcctgccaaattcaactaatgaaagggcctgcacatttgttggaacagctgcatatgtaccacctgaggtcctgaactctgccccagcaacctttggaaatgacttatgggcgttggggtgcacactgtaccaaatgctttctggctcttcaccgtttaaagatgccactgagtggttaattttccagagaatcattgcaagggacatcaaattccctgagtatttttcagatgaagcaaaagatcttattgacaagttgctggatgttgatccaagcaaaaggccaggtgcggggcccgatggttattcttccttgaagaagcaccctttcttcagaggcattgactggaaaaacctgaggaagacacgaccaccaaagctcgccattgacccaaatgcaaacgaagatgaggacagccaggattcaaattggctatcacacatgggaagtaccacagttaaccaacagtcaaacactgttaataataatggtgctgcgtcatctgaagtacgctcccatatatctaaattagcttccatcgactccttcgactcaaaatggcaagaattcctggaccctggtgagtctgtagtcttgatatcaaagctgaagaagattaataagctagcaaacaagaaggtccagctgatcctcactgataaacctcaattgatctatgttgacccgtcaaaaatggtggccaaggggaacattatttggtctgatgacccaagtgaacttagtgttcaagtaacaaattcatcacattttagaatatgcacgccaaagaaaatttcaacatttgaggactcaaaacagcgtgcctggcagtggaaaaaggcaattgaagacctccaacgctgccagaagtattgattttcaattcaaactaggttcctgaaacctcaaatcaggcaatatgaatacagtacaacatccttttcacttagaggaacatggaggagcttgttttcctgctgtcctgctcatgtgcctggttgcaaggaagttactcgctaattggcatgttgacgatgcccctatgaattttccatttctattgacacttaaatatagggcacaattttgtttgttgtttttgtatctctcgccgtggatagcttgaaacggttgcgctccagaaatattaacacaggatgtcaaacaattccatcgaaacggcttcacagtgcttcccatggttcattgtcaattgtcttctgttctagtgcagctacaaatttatgaagtcattatttgattttgcaagttactgtgcgataactgtcgcatcgcctattttgtccacataatagaatcacagaaggtactgtaggcactgtaggctgccatcttttccatatc

SEQ ID NO: 3927 - DNA, 1717 bp, Echinochloa colona
gcggcagccgcttcctcatccccgaccgccgccggggggatcgccttccgcgcgccgcaggagcagttcaccgccgccgacttcgacctcggcaagatctacggcgtcggctcctactccaaggtggtgcgggccaggaagaaggacacgggcaacgtctacgcgctcaagatcatggacaagaagttcatcactaaggagaacaagatctcctacgtcaagatggagcgcatcgtgctcgaccagctcgatcacccgggcgtcatcaggctcttcttcaccttccaggacacatactccctctacatggcgctcgagtcctgcgagggcggggagttgttcgatcagattgttcggaaaggtcggctgtgtgaggatgatgcacggttttatgctgctgaaattgttgatatattggagtatttgcacagtgtcggcttaattcatcgggatgtcaagccagaaaatttactgcttacttctgatgggcacatcaagatcgctgattttggtagtgtgaagcctacaagggatactccaatcaaagtcctcccaaattcaactaatgaaagggcctgtacatttgttggaacagccgcatatgtaccacctgaggtcctgaactctgccccagcaacctttggaaatgacttatgggcattggggtgcacactgtatcaaatgctttctggatcttcaccatttaaagatgccagtgagtggttaattttccagagaatcattgcaagggacatcaaattccctgagtatttttcagatgaagcaagagatcttattgacaagttgctggatgttgatccaagcaaaaggccaggcgcggggcctgatggttattcttccttgaagaagcatcctttcttcagaggcattgactggaagaacctgaggaagacacgaccaccaaagctcgcgattgacacaaatgcaaatgaaggtgaggatagccaggattccaattggttatcacacatgggaagtacgacagtcaaccaacagtcaaacactgttagtaataatgttgccgcatcatcatcagaagcacgctcccatatatctaaattagcttccatcgactccttcgactccaaatggcaagaattcctggaccctggcgagtctgtagtcttgatatcaaagctgaagaagattaataagctagcaaacaagaaggtccaattgatcctcactgacaaacctcaattgatctgcgttgacccttcaaaaatggtggccaaggggaacattatttggtctgatgacccaaccgagctcagtgtgcaagtatcaaattcttcacattttagaatttgcacgccaaagaaggtttcaacatttgaggacgcaaaacagcgtgcctggcaatggaaaaaggcaattgaagacctccaacgctgccaaaagaaatgataatcgattcaaaccaggttcctaaaacctcaaattaggcattgttaatacatcacaacatccttttcacttggaggagcatgagggggcttgtttctccggctgtcctgcttccgtgcctggttgcaaggaagtcgttactactcgctaattgcattttgactgacgcccctataaatttctgaatttctatcaacacttacatatagggcacaactttgtttattgtttttgtgtgtctgtagcagcagatagcatgaaatgactgagctgcagaaatattaacaca

SEQ ID NO: 3928 - DNA, 2245 bp, Oryza sativa
tgcctgtctgcctcctcccatcattcgatcactcctcctcctccctcctctctccctccctccgcgacccaacaaggaagacgacgaagaggaggagagagaagaggaggaggaggaggaaaagctctctctctctctctctctctctctctagattcgattcctttcgtccggcgcggccaacccgaaaggctgcggccgtcgcagtccaatcgattccccccctgcgctgcgctgcgctttcccacccctcgaagccgaatccgatggttcctccacccgttgaccgcctccgccatcggaggccgcgccgcgccctcgaaccccgcgccgcctgctgctgcctccgccgcctccgcctcctatagataccgccccggctcaccgcggcccggccctcccgaatggcggtcggcggcgacgacgacatggagagggacttcgccgccaggctccgcctcgcgccctcccccgcctccccgaccgccgccgccggaggtggcggtggcgggatcgccttccgcgcgccgcaggagcagttcaccgtcggcgacttcgagcttggcaagatctacggcgtcggctcctactccaaggtggtgagggccaagaagaaggatacggggaatgtgtacgcgctcaagatcatggacaagaagttcatcaccaaggagaacaagatctcctacgtcaagatggagcgcatcgtgctcgatcagctggatcacccgggcgtcatcaggctcttcttcaccttccaggacacctactccctctatatggcgcttgagtcgtgtgaaggtggggagctgtttgaccaaattgttcggaaaggtcgcctgtctgaggatgaggcccggttttatgctgctgaaattgttgatattctggagtatttgcatagtttaggcctaattcatcgggatgttaagccagaaaatttactgcttacttctgatgggcacatcaagattgccgattttggtagtgtgaagcctacaaaggacaccccgatcaaagtccttccaaattccactaacgagagggcctgtacatttgttgggacagctgcatatgtaccacctgaggtcctgaactctgccccaccaacctttggaaatgacttatgggcattggggtgtactctatatcaaatgctttctggctcttcaccatttaaagatgccagtgagtggttaattttccagagaattatagcacgcgatctcaaaattcctgagtacttctcagatgatgcaagggatctcattgacaagctgctggatgtcgacccaagcaaacgtccaggtgcaggacctgatggttatgtgtcattgaagaaacatcctttttttagaggcattgattggaaaaatataaggagcacacgggcaccgaagcttgcaatggaggcaaatgcaaatgaggatgaagatagtcaggattcaagttggttgtcacacatgggaagtgctccagtcaaccaacatgtcagtcctgttgggaatgatggtgcctcatcatcttctgaagtacgctcccatatatctagattagcttccatcgactccttcgactctagatggcaggacttcctggagcctggcgaatctgtcgttctaatatcaaaactgaagaagataaacaagctaacgaacaagaaggttcagttgatcctcaccgacaaaccacagctgatctgtgtagatcctggaaaaatggtgactaaagggaacatcatgtggtctgatgacccaagtgaactcaatgtgcaagtatcaaactcttcgcatttcaggatatgcacgccaaagaaggtgtcatcgtttgaggatgcaaaacagcgcgcctggcaatggaagaaggcgatcgaagacctacaacgctgccagaagaactgaccatgaccaactcaagacgtcaaaatggtgatattaagcattgtgtatacaccatagccatccttttcgcctggaggaacatgggggagactattgttcctggtctcctgcatctgtgcccgattgcaacgaagtctcaacagttggcacatcgatggatgttcctacatttttttgttttcttttccggccctgctaaattctcttatagcaaacaattttgctcgtttgttttgtaatttggtgcagcagatagcatcaggaattcaggatgattgaaaacgtttgcacttgaaacatttaacacaggaaactacatgagattgccagtttgtactgttgca

SEQ ID NO: 3929 - DNA, 2055 bp, Oryza sativa
gccaacccgaaaggctgcggccgtcgcagtccaatcgattccccccctgcgctgcgctgcgctttcccacccctcgaagccgaatccgatggttcctccacccgttgaccgcctccgccatcggaggccgcgccgcgccctcgaaccccgcgccgcctgctgctgcctccgccgcctccgcctcctatagataccgccccggctcaccgcggcccggccctcccgaatggcggtcggcggcgacgacgacatggagagggacttcgccgccaggctccgcctcgcgccctcccccgcctccccgaacgccgccgccggaggtggcggtggcgggatcgccttccgcgcgccgcaggagcagttcaccgtcggcgacttcgagcttggcaagatctacggcgtcggctcctactccaaggtggtgagggccaagaagaaggatacggggaatgtgtacgcgctcaagatcatggacaagaagttcatcaccaaggagaacaagatctcctacgtcaagatggagcgcatcgtgctcgatcagctggatcacccgggcgtcatcaggctcttcttcaccttccaggacacctactccctctatatggcgcttgagtcgtgtgaaggtggggagctgtttgaccaaattgttcggaaaggtcgcctgtctgaggatgaggcccggttttatgctgctgaaattgttgatattctggagtatttgcatagtttaggcctaattcatcgggatgttaagccagaaaatttactgcttacttctgatgggcacatcaagattgccgattttggtagtgtgaagcctacaaaggacaccccgatcaaagtccttccaaattccactaacgagagggcctgtacatttgttgggacagctgcatatgtaccacctgaggtcctgaactctgccccaccaacctttggaaatgacttatgggcattggggtgtactctatatcaattgctttctggctcttcaccatttaaagatgccagtgagtggttaattttccagagaattatagcacgcgatctcaaaattcctgagtacttctcagatgatgcaagggatctcattgacaagctgctggatgtcgacccaagcaaacgtccaggtgcaggacctgatggttatgtgtcattgaagaaacatcctttttttagaggcattgattggaaaaatataaggagcacacgggcaccgaagcttgcaatggaggcaaatgcaaatgaggatgaagatagtcaggattcaagttggttgtcacacatgggaagtgctccagtcaaccaacatgtcagtcctgttgggaatgatggtgcctcatcatcttctgaagtacgctcccatatatctagattagcttccatcgactccttcgactctagatggcaggacttcctggagcctggcgaatctgtcgttctaatatcaaaactgaagaagataaacaagctaacgaacaagaaggttcagttgatcctcaccgacaaaccacagctgatctgtgtagatcctggaaaaatggtgactaaagggaacatcatgtggtctgatgacccaagtgaactcaatgtgcaagtatcaaactcttcgcatttcaggatatgcacgccaaagaaggtgtcatcgtttgaggatgcaaaacagcgcgcctggcaatggaagaaggcgatcgaagacctacaacgctgccagaagaactgaccatgaccaactcaagacgtcaaaatggtgatattaagcattgtgtatacaccatagccatccttttcgcctggaggaacatgggggagactattgttcctggtctcctgcatctgtgcccgattgcaacgaagtctcaacagttggcacatcgatggatgttcctacatttttttgttttcttttccggccctgctaaattctcttatagcaaacaattttgctcgtttgttttgtaatttggtgcagcagatagcatcaggaattcaggatgattgaaaacgtttgcacttgaaacatttaacacaggaaactacatgagattgccagtt

SEQ ID NO: 3930 - DNA, 1941 bp, Hordeum vulgare
catgatttggatcacgcgcacacctctccccacgactcgtctcacaacctcacaaggtcacaagccaaggcaacgagacaaccaacgggcatggaaagaaagctccctcttccccctcatcctgtagacccgactgtgggtagcctccctccctcctagcagattcgattcctttcctccgcttccgccccaccgccaaagggagggagagagagagaggagaaagaaaggctgcggccgtcgcagtccaatcgattgccccaccgcccgccgcgccgcgctttcccgccctcccaagccgaatccgatggttccacccgttgaccgcctccgccatcggaggccgcgccgcgccacccccctccccctcccccgcagacgcctatagataccgatcgctccggcgcaatggcggtcggcggcgacgacgacatggagagggacttcgccgccaggctgcgcctcgcgccctcccacccctccgcacccgcctcggcctcccccgcggcggcggcggcggcgggcgggatcgccttccgcgcgccgcaggagcagttcaccgccgccgacttcgagctcggcaagatctacggcgtcggctcctactccaaggtggtcagggccaggaagaaggacacgggcaacgtctacgcgctcaagatcatggacaagaagttcatcaccaaggagaacaagatctcctacgtcaagatggagcgcatcgtgctcgaccagctcgatcacccgggcgtcatcaggctcttcttcaccttccaggactcctactccctctacatggcactggagtcctgcgaaggtggagagttgttcgaccaaatcgtacggaaaggccgcctgtcggaggacgaggcacggttttatgccgctgaaattgttgacattctggagtacttgcatagtgtaggcctaattcatcgggatgtgaagccagaaaatttactccttacttctgatggacacatcaagattgctgattttggtagcgtgaagcctactgtggacactccaatcaaagtcctcccaaattcaacaaatgagagggcctgcacatttgttggcacagctgcttatgtaccaccagaggtcctgaactctgccccagcaacttttggaaatgacttgtgggcattggggtgcacgttgtttcaaatgctttctggctcttcgccatttaaggatgccagtgagtggttgatttttcagcgaattattgcaagggatctcagatttcctgagttcttttcggatgaagcaagagatctcattgacaagttgctggatgttgatccaacaaaacggccgggtgcaggacctgatggttatgcttccttgaagaagcatcctttcttcagaggtattgactggaaaaatataaggaagatgcgtgcaccaaagcccgccgtggaaacaaatgcaaatgaggatgaggataatcaggattcagattggttgtcacacatgggaagtgcacatgccaaccaaaatgtccctgttgggaataatggtgctgcgtcatcttctgaagtacggtcccatgtatctaaattagcttccatcgactccttcgactctagatggcaggatttcctggagcctggtgaatctgtagtgttgatatctaagctgaagaagattaataagctatcaaataagaaggtccaggtgatcctcaccaacaaacctcagttgatctgtgttgaccctgcaaaaatggtgaccaaggggaatattagttggtctgatgatccaagtgaactcaatgtacaagtagccgactcctcgcattttaggatctccacgccaaagaaggtgttcatatttgaggatgcaaaacagcgtgcctggcaatggaagaatgcgattgaagatctccagcactgccaaaagagttgattttcaattgaaatctagataccaaac

SEQ ID NO: 3931 - DNA, 2229 bp, Hordeum vulgare
tcacaacctcacaaggtcacaagccaaggcaacgagacaaccaacgggcatggaaagaaagctccctcttccccctcatcctgtagacccgactgtgggtagcctccctccctcctagtagattcgattcctttcctccgcttccgccccaccgccaaagggagggagagagagagaggagaaagaaaggctgcggccgtcgcagtccaatcgattgccccaccgcccgccgcgccgcgctttcccgccctcccaagccgaatccgatggttccacccgttgaccgcctccgccatcggaggccgcgccgcgccacccccctccccctcccccgcagacgcctatagataccgatcgctccggcgcaatggcggtcggcggcgacgacgacatggagagggacttcgccgccaggctgcgcctcgcgccctcccacccctccgcacccgcctcggcctcccccgcggcggcggcggcggcgggcgggatcgccttccgcgcgccgcaggagcagttcaccgccgccgacttcgagctcggcaagatctacggcgtcggctcctactccaaggtggtcagggccaggaagaaggacacgggcaacgtctacgcgctcaagatcatggacaagaagttcatcaccaaggagaacaagatctcctacgtcaagatggagcgcatcgtgctcgaccagctcgatcacccgggcgtcatcaggctcttcttcaccttccaggactcctactccctctacatggcactggagtcctgcgaaggtggagagttgttcgaccaaatcgtacggaaaggccgcctgtcggaggacgaggcacggttttatgccgctgaaattgttgacattctggagtacttgcatagtgtaggcctaattcatcgggatgtgaagccagaaaatttactccttacttctgatggacacatcaagattgctgattttggtagcgtgaagcctactgtggacactccaatcaaagtcctcccaaattcaacaaatgagagggcctgcacatttgttggcacagctgcttatgtaccaccagaggtcctgaactctgccccagcaacttttggaaatgacttgtgggcattggggtgcacgttgtttcaaatgctttctggctcttcgccatttaaggatgccagtgagtggttgatttttcagcgaattattgcaagggatctcagatttcctgagttcttttcggatgaagcaagagatctcattgacaagttgctggatgttgatccaacaaaacggccgggtgcaggacctgatggttatgcttccttgaagaagcatcctttcttcagaggtattgactggaaaaatataaggaagatgcgtgcaccaaagcccgccgtggaaacaaatgcaaatgaggatgaggataatcaggattcagattggttgtcacacatgggaagtgcacatgccaaccaaaatgtccctgttgggaataatggtgctgcgtcatcttctgaagtacggtcccatgtatctaaattagcttccatcgactccttcgactctagatggcaggatttcctggagcctggtgaatctgtagtgttgatatctaagctgaagaagattaataagctatcaaataagaaggtccaggtgatcctcaccaacaaacctcagttgatctgtgttgaccctgcaaaaatggtgaccaaggggaatattagttggtctgatgatccaagtgaactcaatgtacaagtagccgactcctcgcattttaggatctccacgccaaagaaggtgttcatatttgaggatgcaaaacagcgtgcctggcaatggaagaatgcgattgaagatctccagcactgccaaaagagttgattttcaattgaaatctagataccaaacgggtgatattaagcaccctgagtagaccttacccatctttttcacttggtggaacacatgggggtttctcgcacctgccctcctcgcgtgcctgggaagaaaatcacttgtgacatgttgatcgatgtcccgtctacctccctaaacagttttgtttgtttgttagttgccgcagcagatagtatcagagtgattgaaatgttcgccctccagaacagttaacaaaagaagtccatgagatgatcgatttgtatcgttgtatttgtatcatcgaatcacattaacaatgctgccctagcttaattatattttcttgcgtcctctgcttg

SEQ ID NO: 3932 - DNA, 2139 bp, Secale cereale
cctccctccctcctcctagattcgatcctttcctccgcttccgcccaacccacccccaccgccaagagagagagagagagagagagggaaagaaaggctgcggccgtcgcagtcgaatcgattgccccaccgccccgccgcgccgcgctttcccgccctcccaagccgaatccgatggttccacccgttgaccgcctccgccatcggaggccgcgccgcgccacccccatcctcccccgcagccgcctatagataccgccccgcccgacatccccggcccaatggcggtcggcggcgacgacgacatggagagggacttcgccgccaggctgcgcctcgcgccctccaacccctccgcctccgcctcggcctcccccacggcgggcgggggcgggatcgccttccgcgcgccgcaggagcagttcaccgccgccgacttcgagctcggcaagatctacggcgtcggctcctactccaaggtggtgagggccaggaagaaggacacgggcaacgtctacgcgctcaagatcatggacaagaagttcatcaccaaggagaacaagatctcctacgtcaagatggagcgcatcgtgctcgaccagctcgatcacccgggcgtcatcaggctcttcttcaccttccaggacacctactccctctacatggcactggagtcctgcgaaggcggggagttgttcgaccaaatcatacggaaaggccgcctgcctgaagacgaggcacggttttatgccgctgaaattgttgacattctggagtatttgcatagtgtaggcctaattcatcgggatgtgaagccagaaaatttactccttacttctgatggacacatcaagattgctgattttggtagcgtgaagcctactgtggacactccaatcaaagtcctcccaaattcaactaatgagagggcctgcacatttgttggaacagctgcatatgtaccaccagaggtcctgaactctgccccagcaacttttgcaaatgacttgtgggcattggggtgcacgttgtttcaaatgctttctggctcttcgccgtttaaggatgccagtgagtggttgattttccagcggattattgccagggatctcagatttcctgagttcttttcagatgaagcaagagatctcattgacaagttgctggatgttgatccaaccaaacgaccaggtgcaggacctgatggttatgcttccttgaagaagcatcctttcttcagagacatcgactggaaaaatataaggaagacgcgtgcaccaaagcccgcagtggaggcaaatgcaaatgaggatgaggatagtcaggattcagattggttgtcacacatgggcagtgcacatgccaaccaaaatgtccctgttgggaacaatggtgccgcgtcatcttctgaagtacggtcccatgtatctaaattagcttccatcgactccttcgactctagatggcaggatttcctggagcctggtgaatccgtagtgttgatatctaagctgaagaagattaataagctctcaaataagaaggtccagctgatcctcaccaacaaacctcagttgatctgtgttgaccctgcaaaaatggtgaccaaggggaatattagttggtctgctgatccaagtgaactcaatgtacaagtagccaactcctcgcattttaggatctccacgccaaaaaaggtgtttgtatttgaggatgcaaaacagcgtgcctggcaatggaagaatgcaattgaagatctccagaactgccaaaagaattgattttcaattggaatcaagatacctaccaaaactgttgatgttaagcactctgaatacaccttagccatgtttttcacttggaggaacacatgggggtttcttgctcctgccctcctcgcgtccctgggaaggaaatcacttgtggcatgtttgatcgatgtcccccgtctacctccctaaacagttttgtttctttgttagttgctgcagcagatagcatcagagtgattgaaatgttggccctccggaacagttaacaaaagaaatccatgagatgatcgatttgtattgttgtatttgtatcatcgaatcaccttaacaatgttgccgtagcttaattatattctcttgcgtccta

SEQ ID NO: 3933 - DNA, 1780 bp, Pennisetum glaucum
ccgccgggggcatcgccttccgcgcgccgcaggagcagttcaccgccgcggacttcgagctcggcaagatctacggcgtcggctcctactccaaggtggtgcgggccaagaagaaggacacgggcaacgtctacgcgctcaagatcatggacaagaagttcatcaccaaggagaacaagatctcctacgtcaagatggagcgcatcgtcctcgaccagctcgatcacccgggcgtcatcaggctcttcttcaccttccaggacacatactccctctacatggcgcttgagtcgtgcgaaggaggggagttgttcgatcagattgttcggaaaggtcgattgtccgaggacgaggcacggttttatgctgctgaaattgttgatatactggagtatttgcacagcgttggcctaattcatcgtgatgtcaagccagaaaatttactgctcacttccgatgggcacataaagattgctgattttggtagtgtcaagcctacacgtgatactccaattaaagtcctcccaaattcaactaatgaaagggcatgtacatttgttggaacagccgcatacgtaccaccagaggtcctgaactctgccccagctacctttggaaatgacttgtgggcattgggatgcacactgtaccaaatgctttctggctcttcaccatttaaagatgccagtgagtggttgattttccagagaatcattgcaagggacgtcaaattccctgagtatttttcagatgaagcaagagatcttattgacaagttgttggatgttgatccaatcaaaaggccaggtggggggcctgatggttattcttcgttgaagaagcatcctttcttcagaggtattgactggaagaacctgaggaagacacggccaccaaagctcgtgatggacccaaatgcaaatgaagatgaggatagccaggattccaattggttgtcacacatgggaggtaccacagttaaccaacagtcaaacactgttagtaataatggtgttgcatcatcatctgaagttcgctctcatatatctaaattagcttccatcgactccttcgactcaaaatggcaagaattccttgaacctggtgagtccgtagttttgatatcaaagctgaagaagattaataagctagcaaacaagaaggtccagctgatcctcactgataaacctcaattgatatgtgttgacccttcaaaaatggtggccaaagggaacattatttggtctgatgacccgagtgaacttaatgttcaagttacaaattcatcacattttagaatatgcacgccaaaaaaggtttcaacgtttgaggacacaaagcagcgtgcctggcaatggaaaaaagcaattgaagacctacaacgctgccaaaagtattgattctcaatttaaatcaggtttctaaaacctcaaagtaggcattgttaatacagcagcacatccttttcacttggaggaacgtgagggagcttgtttctcctgctgttctgctcctgcatctggctgcaaggaagttgttactcggctactcgctaattggcatgttggtgatgcccctacgatttttccagtttctatctacacttacatacagggcacaattttgtttgttctttttgtgtctgtcgcatcagatagcatgaaatggctgcgccccagaaatattaacacaggaaactattccatcgaaatgaattcaacagtgctgcacatggttcgttagtaaactaaaaaaaaaaaaaaagtaaaaaaactactag

SEQ ID NO: 3934 - DNA, 1547 bp, Avena sativa
ccgtaatggcggtcggcggcgacggcgacgacgacatggagagggacttcgcagccaggctccgcctcgcgccctccgcctcctcgacggcgtctcccaaggcggccgcggctgcggctgctgccggtggaggagggatcgccttccgcgcgccgcaggagcagttcaccgccgacgacttcgacctcggcaagatctacggcgtcggctcctactcaaaggtggtgagggccaagaagaaggacacgggcaacgtctacgcgctcaagatcatggacaagaagttcatcaccaaggagaacaagatctcctacgtcaagatggagcgcatcgtgctcgaccagctcgaccacccgggcgtcatcaggctattcttcactttccaggacacatactccctctacatggcgctggagtcgtgcgaaggcggggagttgttcgaccagatcgccaggaaaggccgcctgcctgaggacgaggcacggttctatgccgctgaaattgttgatattctggagtatctgcatagcgtaggcctaattcaccgggacgtgaagccagaaaatttactgcttacttccgatgggcacatcaagattgctgattttggtagtgtcaagcctactatggacactccgatcaaagttctcccaaattcaactaatgagagggcctgcacttttgttggaactgctgcatatgtaccaccagaggtcctgaactctgccccagcaacttttggaaatgacttgtgggcattggggtgcacattgtttcaaatgctctctggctcttcgccatttaaggacgccagtgagtggttgattttccagagaattatagcaagggatctcaggattcctgagtacttctcggatgaagcaagagatctaattgacaagttgctggatgttgatccaatcaaaaggccaggtgcaggacctgatggttatgcttccttgaagaaacatcctttcttcagaggcattgactggaaaaatatacggaagacacatgcaccagaccttgccgctgaagcaaatgcaaatgaggatgaggatactcaggattcagactggttgtcacacatgggaagtgcaccattcaacccccctgtgggaaataatggtgctgtgtcatcttctgaagtacggtcccatgtatctaaattagcttctatcgactccttcgactctagatggcaggatttcctggagcctggtgagtctgtagtgttgatatcgaagctaaagaagattaataagttatcaaataagaaggtccagctgatcctcacaaacaagcctcagttgatttgtgttgaccctgcaaaaatggagaccaaggggaatattagttggtctgatgattcaagtgaactcaatgtgcaagtggcgaactcttcacatttcaggatatacacgccaaagaaggtgttcgtatttgaggattcaaaacagcgtgcctggcaatggaagaatgcgatcgaagacctccagcactgacagaagaattgattttcaaaattgaaatcatgatgccaaaat

SEQ ID NO: 3935 - DNA, 2750 bp, Brachypodium distachyon
caaccagtttcgtcagttaccgagtctccagagaaaaacggaaaagaaccgcaattcctcggtccatcacttcgtgcccattctcccccatcattcctctcacacgactcgcaacgcaacaaaggaagccaggacgaaaggaaagctctctctctctctctctccctctctcctctctgcagcagtctgttcatctctctctctccgtagagtggtggctagattcgattcctttcctccgctgcaccccaagcccagcaggggaaggctgcggccgtcggctttcccacccttcgaagccgaatccgatggttccacccgttgactgccttcgccatcggaggccgcgccattgcgccctcgaaccccgcgccctcctgccccaccgccgcctatagatagcggcccgccccccgcgattgctccggccaaatggcggtcggtggcgacgacgacatggagagagacttcgccgccaggctccgcctcgcgccttccccttcttccgcctccgcctcggcttcccccaccgcggcagccgctggcggcggcagcgggatcgccttccgcgcgccgcaggagcagttcaccgtcgacgagttcgagctcggcaggatctacggcgtcggctcctactccaaggttgtgagggcgaagaagaaggatacggggaacgtctacgcgctcaagatcatggacaagaagttcatcaccaaggagaacaagatctcatacgtcaagatggagcgcatcgtgctcgatcagctggatcacccgggcgtcatcaggctcttcttcacgttccaggatacctactccctctacatggcgctggagtcgtgcgaaggtggggagttgttcgaccagatcattcggaaaggtcgcctgtctgaggacgaggcacggttttatgctgctgaaattgttgatattttggagtatttgcatagcgtgggcctaattcatcgtgatgtgaagccagaaaatttactgctgacttctgatgggcacatcaagattgctgattttggtagcgtgaagcctactagggacactccaatcaaagtccttccaaattcaactactgagagggcctgcacatttgttggaacagctgcatatgtaccacctgaggtcctgaactctgccccggcaacttttggaaatgatttgtgggcattgggctgcacgttgtttcaaatgctgtctggctcttcaccatttaaggatgccagtgagtggttgattttccagagaattacagcaagggacctcagatttcctcagtacttttcggatgaagcaagagatctcgttgacaagttgctggatatggatccaatcaaacggccaggtgctggacctgatggttatgcttccttgaagaagcatcctttcttcagaggcattgactggaaaaatataaggaagacacgtgcaccaaaactcgcggtggaggaaaatgcaaatgaggatgatgatactcaggattcagattggttgtcgcacatgggaagtgcaccagtcaaccaacatgtccctgttgggaataatggtgccgcgtcatcttctgaagtacggtcccatgtatctaaattagcttccatcgactccttcgactctagatggcaggaattcctggagcctggtgagtctgtagtgttgatatctaagttgaagaagattaataagctatcaaataagaaggttcagctgatactcaccaacaaacctcaattgatctgtgttgaccctgcaaaaatggagaccaaggggaatattatttggtctgatgatccaagtgaactcaacgtacaagtaacaaactcatcacattttaggatatgcacgccaaagaaagtgttcatatttgaggatgcaaaacagcgtgcctggcaatggaagaatgcaattgaagacctccaacactgccagaagaattgattttaaattcacaccaagatgccaaaatgggtgatattaagcattgtgaatacaccgtggccatctttttcacttggaggaaaatttgggagattcttgctcctggcctcctctcgtgcccggcaaaggaaatcacttaatggcatgtggattgatgctatgtcaatttctctaaacaattttgtttgttgtctttgtgagttgctgcggctgatagcatcagagtagttgaaatgaagttttatcatgagatgacccattttgtactgttatatcatcgaactatcttaacaacattctcattgtgtatcttctttggcatctcctgtttgaaggcttaaaacgttgtgtgatgacttttgttggttgctgtcgatgttttactttcagcagattgtgagtactatgcacaaatttcttgtgttgtactcctacattatgttcgctgcatgtgagtggtcattttcaagaacattctaaatacagatctgttttgctgccatctaacttgacgttccaccttatatatcgaaacataaggaaatagagcatttagtacttgtcatggtttttcatagaattacactgaattgttctgtgcttgtaactctgtactatcactgtacactgaatttaatttccgtgacaagcttcctttattactgcttgccatggtttttcatggtgttacactgaattgtcctgtactctgtatctttgtttgtaccatcactgtactaaaactgcagcgtcccttttcttatggacataaagccgtgcaaagtgcaggtaagcagagaacccca

SEQ ID NO: 3936 - DNA, 1192 bp, Setaria italica
gagagacaagggggcggacgcacacacgccgaccgcgcgagcgagcgagagagatccccctctcccccgccggatccgatctgacccgacctgacctcgccgccacctgccgtgggagggagaagaggaggaggaagaggacgaggaggcggagatggctcccgtgtcggcgctcgccaagtacaagctcgtgttccttggggatcagtccgtcggcaagaccagcatcatcacccgcttcatgtacgacaagttcgacaacacataccaggctacaattggtattgatttcctgtcgaagacaatgtaccttgaagatagaaccgtgaggctccaactctgggatacagctggtcaagaaagattcaggagtttaattccaagctatatcagagactcctcagttgctgtcattgtattcgatgttgcaagcaggcagtctttcttaaatacatcaaagtggatagaggaagttcgcacagagaggggcagtgatgtcatcattgtgcttgttgggaacaaaactgaccttgttgacaaaaggcaagtctcgatagaggaaggggaaggcaaggcaaaggaccttggtgtgatgtttattgaaaccagtgctaaagctgggtttaacattaaggctctgttccgtaagattgcggctgcacttcctgggatggagaccctctcatcagcgaagcaggaagacatggttgatgtgaacttgaggtccggcaatgcaaactcgtcccagtctcaggctcaggctgggggatgcagttgttagttgcagcccctgacacttgctgctcatgatcttgagaccctgagcgttggaacgcgttatctctgctgtttctctcaggaaggagagttgattctctcgccagtgaatctcaccatagtccttacccggtgaacggaccatttgcgttggaacgatacgttttatgagttttctagtgttatttcctcagtggcctaagctagcaacagtgtatagatgggaccattcgagttgttgggtattagagctagtgattggttcatgttgcacttatatatttttcatctgtcttgttgcagttagcttgagtcctgttttcctatgtgtaccaaacatgtattggaatttttgtaagctataataagttctgcacggcaatagccaaatgatatcccagatatttgaccgtcg

SEQ ID NO: 3937 - DNA, 1216 bp, Zea mays
aacgcccagacgcgcaagcggaaggaagggggagcgcaacacgcgcggtcgccgggagagagagagagaaagggcgagctagcgagcgagatccccctctcccgctgccggatccgatctgacctgacctcgtcgccgcctgccgtgggagggagaagaggaagaggaggcggaggcggcggagatggcaccggtgtcagcgctcgccaagtacaagctcgtcttcctgggggaccagtccgtcggcaagacgagcatcatcacccgcttcatgtacgacaagttcgataacacctaccaggctacgattggtattgatttcctgtcaaagacaatgtaccttgaagatagaactgtgagactccaactctgggatactgctggtcaggaaagattcaggagtttaattccaagctatattagagactcttcagttgctgtcattgtattcgatgttgcaagcaggcagtccttcttaaatacatctaagtggatagaggaagttcgcactgagaggggcagtgatgttatcattgtgcttgttgggaacaaaactgaccttgttgacaagaggcaagtctcaatagaggaaggggagggcaaggcgaaggaccttggagtcatgtttattgaaaccagtgctaaggctgggtttaacattaaggcgctgttccgtaaaattgctgctgcacttcctggaatggagacgctctcatcagcgaaacaggaagacatggttgatgtgaacttgaggtccggcaatgcaaactcgtcccagtctcaggctcaggctgggggatgcagttgttagttgcagtctctgacacttgcttgctcatgatctttgggactctgagcatcagaaggcgttatcactgatgcttctctcgggaagaagagttgattgcctctcgccagtgaacacaccatagtctttacccggtgaatggaccgtttgcattggaacgatacgttttatgagttttctgttatttcctcagtggcctaagctagcaacagtgtatagttgggttgacacttcaaacttctaccattcgagttgggtattagaactagttattattggttcatgttgaacttatatatatttccatccttttgcagttagtttgagtcgtatttgctgtgtaccaaacatgtattgcaaatttggaatttttgtaagctataataaggccagcacggcaatatcccc

SEQ ID NO: 3938 - DNA, 1431 bp, Pennisetum glaucum
ctctttccctccagcctctcctccagcctcccaccagggtttatccaccggcggcggcgagatggtgcagcgtctgacctaccggaagcggcacagctatgccaccaagtccaaccagacgcgggtcgtcaagaccccaggtggtaagctcgtgtaccagtacaccaagaagagagccagcgggcccaagtgccccgtgaccgggaagaagatccaggggattccccacctcaggcctgcggaggggaagggggagcgcaacactcgcgagcgagagagacaagggggcggacacacacacgccgaccgcgcgagcgagcgagagagatccccctctccccccgccggatccgatctgaccctgacctgacctcgccgccgcttgcccgtgggggagggagaagaggaggaagaggacgaggaggcggagatggctcccgtgtcggcgctcgccaagtacaagctcgtgttcctcggggaccagtccgtcgggaagaccagcatcatcacccgcttcatgtacgacaagttcgacaacacataccaggctacaatcggtattgatttcctgtcgaagacaatgtaccttgaagatagaaccgtgaggctccaactgtgggatacagctggtcaagaaagattcaggagtttaattccaagctacatcagagactcttcagttgctgtcattgtatttgatgttgcaagcaggcagtctttcttaaatacatcaaagtggatagaggaagttcgcaccgagaggggcagtgatgtcatcattgtgcttgttgggaacaaaactgatctcgttgacaaaaggcaagtctcgatagaggaaggggaaggcaaggcaaaggaccttggtgtgatgtttattgaaaccagtgctaaagctgggtttaacattaaggctctgttccgtaagattgcggctgcacttcccgggatggagaccctctcatcagcgaagcaggaagacatggttgatgtgaatttgaggtccggcaatgcaaactcgtcccagtctcaggctcaggctggcggatgcagttgttagttgcagcccccgacaccttgctgctcatgatgagaccctgagccttgggacgcgttatcttcgctgtttctctcaggaaggagagttgaatctctcgccagtgaatctcaccatagtctttaccaggtgaaaggaccatttgcgttggaaccatacgttttatgagttttctagtgttattttctcagtggcctaagctagcaacagtgtatagatgggttggcactgcaaactcctaccattcgagttgttgggtattagagctagtgattggttcatgttgcacttatatatttttcatctgtcttgttgcagttagcttgagtcatgttttcctatgtgtaccaaacatgtattggaatttttgtaagcta

SEQ ID NO: 3939 - DNA, 1465 bp, Saccharum officinarum
cggacgcgtggggcgagcgctaggagtaataaacggcaggcaccaatctcggaggcaacgcccatacgcgcaggcggaaggaagggggagcgcaacactcggggagagagagagacaagggggggcggtcacacacacgccgaccgcgcgagctagcgagcgagcgagatccccctctcccgctgccggatctgatctcacctgacctcgtcgccgcctgccgtgggagggagaagaggaagaggaggaggcggcggagatggcaccggtgtcggcgctcgccaagtacaagctcgtcttcctgggggaccagtccgtcggcaagaccagcatcatcacccgcttcatgtacgacaagttcgacaacacctaccaggctacaattggtattgatttcctgtcaaagacaatgtaccttgaagatagaactgtgagactccaactctgggatacagctggtcaggaaaggttcaggagtttaattccaagctatatcagagactcttcagttgctgtcattgtattcgatgttgcaagcaggcagtccttcttaaatacatctaagtggatagaggaagttcgcactgagaggggcagtgatgttatcattgtgcttgttgggaacaaaactgaccttgttgacaagaggcaagtctcgatagaggaaggggaaggcaaggcgaaggaccttggtgtcatgtttattgaaaccagtgctaaagctgggtttaacattaaggcgctgttccgtaaaattgctgctgcacttcctggaatggagacactctcatcagcgaagcaagaagacatggttgatgtgaacttgaggtccggcaatgcaaactcgtcccagtctcaggctcaggctgggggatgcagttgttagttgcagtctctgacacttgctgctcatgatctctgagaccctgagcatcagaatgcgttatcactgatgcttccctcgggaaggagagttgattgcctctcagccagtgaacacaccatagtctttacccggtgaatggaccatttgcattggaacgatacgttttatgagttctctagtgttatttcctcagtggcctaagctagcaacagtgtatagttgggttggcactgcaaacttctaccattcgagttgggcattagagctagttattggttcatgttgaacttatatattttccatcttcttgttgcagttagcttgagtcatgcttgctatgtgtaccaaacatgtattggaatttggaatttttgtaagctaaaataaggccagcacggcaatagccccacatgatatccctgaaatttggatcgttcagaccatgatatcctaactccatacgtcaaacctttctctttctattatatgtgataataaaaaaaaaaaaaagggcggccgtctttaagatcaaacctacctcgctcgtttcgacgatagtttttttatggaactaaatca

SEQ ID NO: 3940 - DNA, 1396 bp, Panicum virgatum
gtgactgtacaacataatgtttttttattatttaagattaagaaaaacaaaacaaaaggctttcgtgccatttgccctccggtccggccgccttctccgcgaagtgctaataaacggcgggcaccaatctcggaggcaaacgaccagacgcgcaagggagggggagcgcaacactcgcgagggagagagagacaagggggcggacacccacacgccgaccgcgcgagcgagcgagagagatccccctctcccccgccggatccgatctgacctgacctcgccgccgccgcctgccgtgggagggagaagaggaggaggaggcggagatggctcctgtgtcggcgctcgccaagtacaagctcgtattccttggggaccagtccgtcggcaagaccagcatcatcacccgcttcatgtacgacaaattcgacaacacctaccaggctacaattggtattgatttcctgtccaagacaatgtatcttgaagatagaaccgtgagactccaactctgggatactgctggacaggaaagattcaggagtttaattccaagctatatcagagactcttcagttgctgtcattgtattcgatgttgcaagcaggcagtctttcttaaatacatcaaaatggatagaggaagttcgcactgagaggggcagtgatgttatcattgttcttgttggcaacaaaactgaccttgttgacaagaggcaagtctcaatagaggaaggggaaggcaaggcaaaagaccttggtgtgatgtttatcgaaaccagtgctaaagctggctttaacattaaggctttgttccgtaagattgcggctgcgcttcctgggatggagaccctctcatcagcgaagcaggaagacatggttgatgtgaacttgaggtccggcaatgcaaactcatcccagtctcaggctcaggctgggggatgcagttgttagttgcagtccctgacacttgctgcttatgatctcgagaccctgagtgttggaacgtgttatctctgctgtttctctcaggaaggagagttgattgtctctcatcagtgaatctcaccatagtctttacccggtgaatggaccatttgcgttggaatgataccttttatgagttttctagtgtttttttttctcagtggcctaagctagcaacagtgtatagttcggttggcactgcgaactcttaccattcgagttgggtattagagctagtgattggttcttgttgaacttatatatttttcatctgtcttgttgcagttagcttgagtcatgtttcctatgtgtaccaaacatgtattggaatttttgtaagctataataagtcctgcacggcgataaccaagtgatatcccagatatttcatcgttgaaatgctttgcttc

SEQ ID NO: 3941 - DNA, 1103 bp, Brachypodium distachyon
ccccctatctccatccacccgcccccgccggacccgatccgatctgacctccgccgccgcgcgtcggagaagatggcccccgtttcggctctggccaagtacaagctggtcttcctcggcgaccagtccgtcggcaagaccagcatcatcacccgcttcatgtacgacaagttcgacaacacctaccaggccacaattggtattgacttcctgtcaaagacaatgtaccttgaagacagaactgtgagactccagctctgggatacagctggtcaagaaagattcaggagtttaatccccagctacatcagagattcttcagttgctgtaattgtatttgatgtcgcaagcaggcagtctttcttaaatacttcgaaatggatagaggaagtccgcactgagaggggaagtgatgtcatcattgtgcttgttgggaacaaaactgaccttgttgacaagaggcaggtttccatagaggagggggaaggcaaagcaaaagaccttggtgtgatgtttattgaaaccagtgctaaagctggttttaatattaaggctctgttccgcaagatcgctgctgcactccctggaatggagactctttcatcagcgaagcaggaagacatggttgatgttaacttgaagtccggcaacgcgaactcatcccagtcacaggcgcaggctgggggatgcagttgttagctccagtccctaacactcagcagctcatgacgtcaaggaccccatgcgcatcaaacatccctaccctactgtttctctttctcggtttcaggagggttgattgtctcacggcagtgaatcttcatgatccaagtcaatgaacgagaaccatttccgttggaaagatacatttttatgattttctagtattttgtcagtggcctatgctagcaacagtgtatagttgggttggcactggtgagctcctattgctcgagctgagtattagagttagtgattggtttatgttttgatctatatttgcgtcgcccatcttgttgcagtcagcccgagtctgtgtttttctatggtgtactgaatatatattggaatttttgtaagctgtaataagcatatgttgcccc

SEQ ID NO: 3942 - DNA, 916 bp, Echinochloa colona
ggcggagatggctcccgtgtcggcgctcgccaagtacaagctcgtgttcctgggggaccagtccgtcggcaagaccagcatcatcacccgcttcatgtacgacaagttcgacaacacctaccaggctacaattggtattgatttcctgtccaagacaatgtaccttgaagatagaactgtgagactccaactctgggatacagctggccaggaaagattcaggagtttaattccaagctatatcagagactcttcagttgctgtcattgtattcgacgttgcaagcaggcagtctttcttaaatacatcgaagtggatagaagaagttcgcactgagaggggcagtgatgttataattgtgcttgttgggaacaaaactgaccttgttgacaagaggcaagtctcgatagaggaaggggaaggcaaggcaaaggaccttggtgtgatgtttattgaaaccagtgctaaagctgggtttaacattaaggctctgttccgtaagattgcggctgcacttcctgggatggaaaccctctcatcagcgaagcaggaagacatggttgatgtgaacttgaggtctggcaatgcaaactcgtcccaggctcaggctcaggctgggggatgcagttgttagttgcagttcctgacacttgctgctcatgatctcaagaccctgagcgttggaacgcgttatctctcaggaaggagagttgattgtctctcgccagtgaatctcaccatagtctttacccggtgaacggaccatttgcgttggaacgatacgttttatgagtttcctagtgttatttcctcagtggcctaagctagcaacagtgtatagttgggttggcactgcgaactcctaccattcgagttgggtattagagctagtgattggttcatgttgaacttatat

SEQ ID NO: 3943 - DNA, 1676 bp, Zea mays
ggagagagacaaggggggcggtcacacacacgcggaccgcgcgagctagcgagcgagcgagatccccctctcgcgctgctggatccgatctgacctgaccttacctcgtcgccgccagccgtgagagagagaagaggaagaggaggaggaggcggagatggcaccggtgtcggcgctcgccaagtacaagctcgtcttcctgggggaccagtccgtcggcaagaccagcatcatcacccgcttcatgtacgataagttcgacaacacttaccaggctacaattggtattgatttcctgtcaaagacaatgtaccttgaagatagaactgtgagactccaactctgggatacagctggtcaggaaaggttcaggagtttaattccaagctatatcagagactcttcagttgctgtcattgtattcgatgttgcaagcaggcagtctttcttaaatacatccaagtggatagatgaagttcgcactgagaggggcagtgatgttatcattgtgcttgttgggaacaaaactgaccttgttgacaagaggcaagtctcgatagaggaaggagaaggcaaggcaaaggaccttggtgtcatgtttattgaaaccagtgctaaagctgggtttaacattaaggcgctgttccgtaaaattgctgctgcccttcctggtatggagacactctcatcagcgaagcaggaagacatggttgatgtgaacttgaggtctggcaatgcaaactcgtcccagtctcaggctcaggctgggggatgcagttgttagttgcagtctctgacacttgctgctcatgatctctgagaccctgagcatcagaacgcgttaccactgatgcttctctcgggaaggagagttgatcggcattgaacacgcacacgctatagtttttacccggtgaatggaccatttgcattggaacgatacgtttgagttctctagtgttatttccagtggcctaagctagcaacagtgtatagttgggttggcactgcaaacttctaccgttcgagttgggtattagagctagttattggttcatgttgaacttatattattttctatcttgctgcagttatgtttgctatgtgtaccaaacatgtattggaatttttgtaagctataatatggccagcacagcagtagcctcacatgataccccttgaatctgtatcgttcaaaccgtggtatcctaaatttatatcgttcaaaccttttgccttttgcttttgagggtgtgtttggtttgtccaaacctcgcgctcctcctccggactctccccagtccccactccgtctcaaccccccccccccctccctccctccctccctccctccttgtcgcgcccagccggcctccggtccttcttcccggttcctggttgccgcctcggaacgcatggcgttgcacttgcagagcccgagttccttcccctacaggaggaggacacccggttcgtcgtggtaaccttctacaaattcgtgcccctcgacgacccccacgccgagttcgccagacacctcatcttcctccagtactatcgtgtttctgtcgggactcgggaagctcaagagagcgaccaccgcactggaggccgaagggaagggacgagatcgttgaatcgcaggtggacggctaggattggtcgcctgaggcgag

SEQ ID NO: 3944 - DNA, 1377 bp, Panicum virgatum
tattattatgaaaacaaaacaaaaggctttcgtgccatttgccgtccggtccggccgccttctccgcgaagggctaataaacggcggacaccaatctcggaggcaaacgaccagacgcgcaaagggaagggtgggggagcgccacactcgcgagggagagagagacaagggggcggacacacacacgccgaccgcgcgagcgagcgagagagatccccctctcccccgccggatccgatctgacctgacctctccgccgccgcctgccgtgggagggagaagaggaggaggaggaggcggagatggctcccgtgtcggcgctcgccaagtacaagctcgtgttccttggggaccagtccgtcggcaagaccagcatcatcacccgcttcatgtacgacaagttcgacaacacctaccaggctacaattggtattgatttcctgtcgaagacaatgtaccttgaagatagaaccgtgagactccaactctgggatactgctggacaggaaagattcaggagtttaattccaagctatatcagagactcttcagttgctgtcattgtattcgatgttgcaagcaggcagtctttcttaaatacatcaaaatggatagaggaagttcgcactgagaggggcagtgatgttatcattgtgcttgttgggaacaaaactgaccttgttgacaagaggcaagtctcaatagaggaaggggaaggcaaggcaaatgaccttggtgtgatgtttatcgaaaccagtgctaaagctgggtttaacattaaggctctgttccgtaagattgcggctgcgcttcctgggatggagaccctctcatcagcgaagcaggaagacatggttgatgtgaacttgaggtccggcaatgcgaactcatcccagtctcaggctcaggctgggggatgcagttgttagttgcagcccctgacacttgctgcttatgatctcgagaccctgagtgttggaacacgttatctctgctgttcctcaggaaggagagttgattgtctctcaccagtgaatctcaccagtctttacccggtgaatggaccatttgcgttggaatgatacgttttatgagttttctagtgttattttctcagtggtctaagctagcaacagtgtacagttgggttggctctgcgaactcttaccattcgagttgggcattagagctagtgattggttcatgttgaacttatatatatttttcatctctgtcttgttgcagttagcttgagtcatgtttcctatgtgtaccaaacatgtattggaatttttgtaagctataataagtcctgcacggcgatagccaagtgatatcctagatatttcatcgttaaaaatgttttgcttcttaaaa

SEQ ID NO: 3945 - DNA, 1053 bp, Oryza sativa
aaggagaaggagaagaagaggaggcacgagatggcccccgtgtcggcgctcgccaagtacaagctggtgttcctcggcgaccagtccgtcggcaagaccagcatcatcacccgcttcatgtacgacaagttcgacaacacctaccaggctacaatcggtattgacttcctgtcaaagacaatgtaccttgaagataggactgtcagactgcaactttgggatacagctggtcaggaacgattcaggagtttgattccaagctatatcagagactcttccgttgctgtcatcgtatttgatgttgcaagcagacagtctttcctaaacacttcaaaatggatagaggaagttagaactgagaggggcagtgatgttatcattgtgctggttgggaacaaaactgatcttgttgacaagaggcaagtctccatagaggaaggagagggcaaagcgaaagatctcggtgtgatgttcattgaaaccagtgctaaagctggttttaacattaaggcgttgttccgtaagattgcggctgcacttcctggaatggagaccctctcatcagcaaagcaggaagacatggttgatgtgaacttgaagtcaagcaacgccaactcatcccagtctcaggcacaggctgggggatgcagttgttagcttcagtcccctaacacttactgcttcgcggtctcaaggccccccatgcctctttcaccaaaagcatcagtactgcttgtctgaggggaggagagttaaattgtcgtctcatgccagtgaatccgaccgagtcttcgattcggtcgaacgaaccatttgcattggaaaaagataacgttttatgagtttctaccattttctcagtggcctaaagctagcaacagtgtatagttgggttggcactgtgaacttctatctcttgagttgggtatttagaagttagtgattgttttaagttcatcctctatatattttcatctcccatcttgtcacagttagcctcagtaatgttttctatggtgtaccgaacatatattggaatttttgtaagcttac

SEQ ID NO: 3946 - DNA, 1129 bp, Hordeum vulgare
ggacccgatcccgatctgatctcgccgccgccgccgcgcgccggacaagatggcccccgtgtcggctctggccaagtacaagctggtcttcctcggcgaccagtccgtcggcaagaccagcatcatcacccgcttcatgtatgacaagttcgacaacacctaccaggctacgattggtattgatttcctgtcgaagacaatgtatcttgaagatagaactgtgagactccaactctgggatacagctggtcaggaaagattcaggagtttaattccaagttacatcagagactcttcagttgctgttattgtatttgatgttgcaagcaggcagtctttcttaaacacgtcgaagtggatagaggaagttcgcactgagaggggcagtgatgtcattattgtgcttgtcgggaacaaaactgaccttgtggacaagaggcaagtctccattgaggaaggagaaggcaaggcaaaggacctcggtgtgatgtttattgagaccagtgctaaagctggttttaacattaaggctctgttccgcaagattgctgctgcactgcctggaatggagaccctttcgtcagcaaagcaggaagacatggttgatgtgaacttaaagtccagcaatgctaactcatctcagtcgcaggcacaggccgggggatgcagttgttagctccagtccctaacagtggcagctcatgatatcaaagatcccatgcccatcaaacggcatccctacccaagtcaatgaacgagaaccatttccgttggaaagatacgttttttatgtgttcttagtattttgtcagtggcctaagctagcaacagtgtatagttgggttggcactgtgaactcctatcgctcggctgagtattagagttagtgattggtttatgtttcaacctatatttctgtcgcccatcttgttgcagtcagcctgagtcctgtgtttttctatggtgtactgaatatatatattggaatttttgtaagctaataagtcttgtgtcaccaccagataatagcactagaatgcttgatttatagttccaatcacaaatcaccaggcctatgggattcacatgaaatgcatgccttccgttattgacagtggttgggctggat

SEQ ID NO: 3947 - DNA, 1198 bp, Hordeum vulgare
cggcacgaggctaatctcgggacgcgcaacgtgggggagcggggagcgcgacggacgaaggaggggcagggcgagagcttcggggagactcccacccataccgcgccaccgagcgagcgagatcccgcccttcccccttctccacccacccacccgccctgccggacccgatcccgatctgatctcgccgccgccgccgcgcgccggacaagatggcccccgtgtcggctctggccaagtacaagctggtcttcctcggcgaccagtccgtcggcaagaccagcatcatcacccgcttcatgtatgacaagttcgacaacacctaccaggctacgattggtattgatttcctgtcgaagacaatgtatcttgaagatagaactgtgagactccaactctgggatacagctggtcaggaaagattcaggagtttaattccaagttacatcagagactcttcagttgctgttattgtatttgatgttgcaagcaggcagtctttcttaaacacgtcgaagtggatagaggaagttcgcactgagaggggcagtgatgtcattattgtgcttgtcgggaacaaaactgaccttgtggacaagaggcaagtctccattgaggaaggagaaggcaaggcaaaggacctcggtgtgatgtttattgagaccagtgctaaagctggttttaacattaaggctctgttccgcaagattgctgctgcactgcctggaatggagaccctttcgtcagcaaagcaggaagacatggttgatgtgaacttaaagtccagcaatgctaactcatctcagtcgcaggcacaggccgggggatgcagttgttagctccagtccctaacagtgacagctcatgatatcaaagatcccatgcccatcaaacggcatccctacccaagtcaatgaacgagaaccatttccgttggaaagatacgttttttatgtgttcttagtattttgtcagtggcctaagctagcaacagtgtatagttgggttggcactgtgaactcctatcgctcggctgagtattagagttagtgattggtttatgtttcaacctatatttctgtcgcccatcttgttgcagtcagcctgagtcctgtgtttttctatggtgtactgaatatatatattggaatttttgtaagctaataagtcttgtgtcaccaccaaaaaaaaaaaaaaa

SEQ ID NO: 3948 - DNA, 1219 bp, Leymus cinereus x Leymus triticoides
gcgccccttgagggagcggggagcgcgagggacgaaggagggcagggcgagagcttcggggagactcccacccataccgcgccaccgagcgagcgagcgagatcccgcccttcccccttctctacccacccgccctgccggacccgatcccgatctgatctcgccgccgtcgccgcgcgccggacaagatggcccccgtgtcggctctggccaagtacaagctggtcttcctcggcgaccagtccgtcggcaagaccagcatcatcacccgcttcatgtacgacaagttcgacaacacctaccaggctacgattggtattgatttcctgtcgaagacaatgtaccttgaagatagaactgtgagactccaactctgggatacagctggtcaggaaagattcaggagtttaattccaagctacatcagagactcttcagttgctgttattgtattcgatgttgcaagcaggcagtctttcttaaacacgtcaaagtggatagaggaagttcgcactgagaggggcagtgatgtcattattgtgcttgttgggaacaaaactgaccttgtggacaagaggcaagtctccattgaggaaggggaaggcaaggcaaaggacctcggtgtgatgtttattgaaaccagtgctaaagctggttttaacattaaggctctgttccgcaagattgctgctgcactgcctggaatggagaccctttcatcagcaaagcaggaagacatggttgatgtgaacttaaagtccagcaatgctaactcatctcagtcgcaggcacaggctgggggatgcagttgttagctccagtccttaacactcgcagctcatgatgtcaaagatcccatgcccatcaaatggcatccctaccttactgcttccctctcggtctcaggaggattgattgtctcacggcagtcgagtccatgatccaagtcaatgaacgagaaccatttccgttggaaagatacgtttttatgtgttcttagtattttgtcagtggcctaagctagcaacagtgtatagttggcttggcactgtgaactcctatcgctcggctgagtattagagttagtgattggtttatgtttcaacctatatttctgtcgcccatcttgttgcagtcagcccgagtcctgtgtttttctatggtgtactgaatatatatattggaatttttgtaagctaataagtcttatgttacccca

SEQ ID NO: 3949 - DNA, 1110 bp, Lolium multiflorum
cataccgcgccaccgagcgagcgagcgagatcccgcctccccccttctccatccaccccgccccgccggacccgatcccgatcccgatctgatctcgccgccggacaccatggcccccgtctcggccctggccaagtacaagctggtcttcctcggcgaccagtccgtcggcaagaccagcatcatcacccggttcatgtacgacaagttcgacaacacataccaggccacgattggtattgacttcctgtcgaagacaatgtatcttgaagacagaactgtgagactccaactctgggatacagctggtcaggaaagattcaggagtttaattccaagctacatcagagattcttcagttgctgttattgtattcgatgttgcaagcaggcagtctttcttgaacacgtcgaagtggatagaggaagtccggacagagagaggcagtgatgtcatcattgtgcttgttgggaacaaaactgaccttgttgacaagaggcaagtttccattgaggaaggggaagccaaggcaaaagacctgggtgtgatgtttattgaaacaagtgctaaagctggttttaacattaaggctctgttccgcaagattgctgctgcacttcctggaatggagaccctttcatcagcaaagcaagaagatatggttgatgttaacctgaagtccggcaacgcgaactcatcccagtcacaggcacaggctgggggatgcagttgttagctccagtccctaacattcgcagctcatgatgtcaagacccacatgcccatcaaacaacatctacagtactgctcctctctcagtcaaaggaggattgattgtcttacagcagtgagtccatgatccgagtcaatgaacaagaaccatttccgttggaagatccgtttttacgagtttctagtattttgtcagtggcctaagctagcaacagtgtatagttgggttggcactgtgaactcccattgctcgagctgagtattagagttagcgattggtttatgtttcaacttatatttctgttgcccatcttgttgcagtcagcccaagtctgttttttctatggtgtattgaatatatatatattggaatttttg

SEQ ID NO: 3950 - DNA, 1434 bp, Avena sativa
ggcaacgtgggggagcggagagcgcgagagagagcaaggaggggcagggcgagagcttcggggagactcccacccataccgcgccaccgagcgagcgagatcccgccccttcccccttctccatccacccgacccgccggacccgatcccgatctgatctccgacgccgcctccgcgcgccggacaacatggcccccgtctcggccctggccaagtacaagctggtcttcctcggcgaccagtccgtcggcaagaccagcatcatcacccgcttcatgtatgacaagttcgacaacacctaccaggctaccattggtattgacttcctgtcgaagacaatgtatcttgaagacagaactgtgagacttcaactctgggatacagctggtcaggaaagattcaggagtttaattccaagctacatcagagattcttcagttgctgttattgtattcgatgttgcaagcaggcagtctttcttaaacacttcgaagtggatagaggaagtccgcactgagaggggcagtgatgtcatcattgtacttgttgggaacaaaactgaccttgtcgacaagaggcaagtctccattgaggaaggggaaggcaaggcaaaagacctaggtgtgatgtttattgaaaccagcgctaaagctggttttaacattaaggctctgttccgcaagattgctgctgcactgcctggaatggagaccctttcatcagcaaagcaggaagatatggttgatgttaacctgaaatccggcagcgcgaactcatcccagtcacaggcgcaggctgggggatgcagttgttagctccagttccaaactttttgcagctcatgatgtcaaggaccccatgcccatcaaacaaaacatctacattactgcttctctctctcggtttcagggggattgactgtcttccagcagtgagtccatgatccgagtcaatgaacgagaaacatttccgttggaaagatacgctttaagagtttctagtattttgtcagtggcctaagctagcaacagtgtatagttgggttggcactgtgaactcccattgctcgagctgagtattagagttagtgattggtttatgtttcaacctatatttctgtcgcccatcttgtttctgtcagcccaagtctgtgtttttctatggtgtactgaatatatatatactggattttttcgcaagctaataagtcctatgttatacctagattagtttagagggaagaacagcgacgcgagcagctagcaacgaaactaacgttcccgttctcgtaacttcgacgtacgaccgaagacgtacgaacgggaagtacgtagtaccggtccgaccggacggcgaccgtaaggactttaaaccgttccggtacgtaacgttaaagttacgaaaaactaacgtaacggtaaaaagtagtaaacg

SEQ ID NO: 3951 - DNA, 1353 bp, Oryza sativa
ggagccaaacaacgcccatacgacgagacgagaagaggagaagcggagcgcatcgctcggtcttccttccttccgtccgtccgcggggcacaaacgcacccaccacccccccataacgcgcgagatcccctctccgccccccctctcccgatccgccccgccggatcccgccccgccccgatccgatccgacctagcccgcctcgccgccgccgccgtcgccggccggagaagggaggaaggagaaggagaaggagaagaagaggaggcacgagatggcccccgtgtcggcgctcgccaagtacaagctggtgttcctcggcgaccagtccgtcggcaagaccagcatcatcacccgcttcatgtacgacaagttcgacaacacctaccaggctacaatcggtattgacttcctgtcaaagacaatgtaccttgaagataggactgtcagactgcaactttgggatacagctggtcaggaacgattcaggagtttgattccaagctatatcagagactcttccgttgctgtcatcgtatttgatgttgcaagcagacagtctttcctaaacacttcaaaatggatagaggaagttagaactgagaggggcagtgatgttatcattgtgctggttgggaacaaaactgatcttgttgacaagaggcaagtctccatagaggaaggagagggcaaagcgaaagatctcggtgtgatgttcattgaaaccagtgctaaagctggttttaacattaaggcgttgttccgtaagattgcggctgcacttcctggaatggagaccctctcatcagcaaagcaggaagacatggttgatgtgaacttgaagtcaagcaacgccaactcatcccagtctcaggcacaggctgggggatgcagttgttagcttcagtcccctaacacttactgcttcgcggtctcaaggccccccatgcctctttcaccaaaagcatcagtactgcttgtctgaggggaggagagttaaattgtcgtctcatgccagtgaatccgaccgagtcttcgattcggtcgaacgaaccatttgcattggaaaaagataacgttttatgagtttctaccattttctcagtggcctaaagctagcaacagtgtatagttgggttggcactgtgaacttctatctcttgagttgggtatttagaagttagtgattgttttaagttcatcctctatatattttcatctcccatcttgtcacagttagcctcagtaatgttttctatggtgtaccgaacatatattggaatttttgtaagcttacaataatctctacatggcagtagccatatgttatcccggttgttttgaccattcaaa

SEQ ID NO: 3952 - DNA, 1240 bp, Secale cereale
agagcttcggggagactcccacccataccgcgccaccgagcgagcgagcgagcgagatcccgccctccccccttctccacccacccgccctgccggacccgatcccgatctgatctcgccgccgccgccgcgcgccggacaagatggcccccgtgtcggctctggccaagtacaagctggtcttcctcggtgaccagtccgtcggcaagaccagcatcatcacccgcttcatgtacgacaagttcgacaacacctaccaggctacgattggtattgatttcctgtcgaagacaatgtaccttgaagatagaactgtgagactccaactctgggatacagctggtcaggaaagattcaggagtttaattccaagctacatcagagactcttcagttgctgttattgtattcgatgttgcaagcaggcagtctttcttaaacacgtcgaagtggatagaggaagttcgcactgagaggggcagtgatgtcattattgtgcttgttgggaacaaaactgaccttgtggacaagagacaagtttccattgaggaaggggaaggcaaggcaaaggacctcggtgtgatgtttattgaaaccagtgctaaagctggttttaacattaaggctctattccgcaagattgctgctgcactgcctggaatggagaccctttcatcagcaaagcaggaagacatggttgatgtgaacttaaagtccagcaatgctaactcatctcagtcgcaggcacaggctgggggatgcagttgttagctccagtccttaacactcgcagctcatgatgtcaaagatcccatgcccatcaaacagcaaccctaccttactgcttccctctcggtctcaggaggattgattgtctcacggcagttgagtccatgatccaagtcaatgaacgagaaccatttctgttggaaagatacgtttttatgtgttcttagtattttgtcagtggcctaagctagcaacagtgtatagttgggttggcactgtgaactcctatcgctcggctgagtattagagttagtgattggtttatgtttcaacctatatttatgttgcccatcttgttgcagtcagcccgagtcctgtgtttttctatggtgtactgaatatatattggaatttttgtaagctaataagtcttgtgttaccccagatatttgagcttgtgttaccccagatatttgagcaccagagtgcctggtttatggttccaatcacag

SEQ ID NO: 3953 - DNA, 1269 bp, Triticum aestivum
gcgaggcttcgccatttttcatttccggtcctccagccttgcaagcgctcgctaataaacggcaggcactaatctcggggacgcgcaacgtgggggagcggggagcgcgagggacgaaggaggggcagggcgagaccttcggggagactcccacccataccgcgccaccgagcgagcgagatcccgcccttcccccttctccacccacccgccctgccggacccgatcccgatctgatctcgccgccgccgccgcgcgccggacaagatggcccccgtgtcggctctggccaagtacaagctggtcttcctcggcgaccagtccgtcggcaagaccagcatcatcacccgcttcatgtacgacaagttcgacaacacctaccaggctacgattggtattgatttcctgtcgaagacaatgtaccttgaagatagaactgtgagactccaactctgggatacagctggtcaggaaagattcaggagtttaattccaagctacatcagagactcttcagttgctgttattgtattcgatgttgcaagcaggcagtctttcttaaacacgtcgaagtggatagaggaagttcgcactgagaggggcagtgatgtcattattgtgcttgttgggaacaaaactgaccttgtggacaagaggcaagtatccattgaggaaggggaaggcaaggcaaaggacctcggtgtgatgtttattgaaaccagtgctaaagctggttttaacattaaggctctgttccgcaagattgctgctgcactgcctggaatggagaccctttcatcagcaaagcaggaagacatggttgatgtgaacttaaagtccagcaatgctaactcatctcagtcgcaggcacaggctgggggatgcagttgttagctccagtccctaacactcgcagctcatgatgtcaaagatcccatgcccatcaaacagcaaccctaccttactgcttccctctcggtctcaggaggattgattgtctcacggcagttgagtccatgatccaagtcaatgaacgagaaccattttcgttggaaagatacgtttttatgtgttcttagtattttgtcagtggcctaagctagcaacagtgtatagttgggttggcactgtgaactcctatcgctcggctgagtattagagttagtgattggtttatgtttcaacttatatttacgtcgcccatcttgttgcagtcagcccgagtcctgtgtttttctatggtgtactgaatatatatatatatattgg

SEQ ID NO: 3954 - DNA, 837 bp, Hordeum vulgare
agggcgagagcttcggggagactcccacccataccgcgccaccgagcgagcgagatcccgcccttccccccccccccccccccccccccccccccccccccccccccccccccccccccccccccccccccccccccccccccccggacccgatcccgatctgatctcgccgccgccgccgcgcgccggacaagatggcccccgtgtcggctctggccaagtacaagctggtcttcctcggcgaccagtccgtcggcaagaccagcatcatcacccgcttcatgtatgacaagttcgacaacacctaccaggcacggcttctccccgctacgattggtattgatttcctgtcgaagacaatgtatcttgaagatagaactgtgagactccaactctgggatacagctggtcaggaaagattcaggagtttaattccaagttacatcagagactcttcagttgctgttattgtatttgatgttgcaagcaggcagtctttcttaaacacgtcgaagtggatagaggaagttcgcactgagaggggcagtgatgtcattattgtgcttgtcgggaacaaaactgaccttgtggacaagaggcaagtctccattgaggaaggagaaggcaaggcaaaggacctcggtgtgatgtttattgagaccagtgctaaagctggttttaacattaaggctctgttccgcaagattgctgctgcactgcctggaatggagaccctttcgtcagcaaagcaggaagacatggttgatgtgaacttaaagtccagcaatgctaactcatctcagtcgcaggcacaggccgggggatgcagttgttagc

SEQ ID NO: 3955 - DNA, 1289 bp, Aquilegia formosa
caaagtgacaactcaggtgttctcattcattctctctttctctttcattcttctttttcgatagatcgatcgctcgatcgatttcaattgaatcgaaagagagattcttaacagagtgatttaatctatcaatttcttcgatttcaatcgcaacaacaaatacttgtcaaacctttttcgttaaaatctttcatcgagatttcgatttcgatttgatttgatttgatttgatttggttcgattgttgtttgatagatctttgattaagtaatggcaccggtttctgctcttgcgaaatataagcttgtgttcttaggagatcaatctgttgggaaaacaagtatcattactcgatttatgtatgataaattcgacaatacgtatcaggctactattgggattgattttctatcaaagacaatgtacttggaagaccgaacagtacgcttgcagctttgggatacagctggacaggaaagatttaggagtctcattcccagctacatcagagattcctctgttgctgtcattgtctttgacgttgcaagtcgtcagtctttcctgaacacatcaaaatggattgaggaggttcggacagagcgtggtagtgatgttattatcgtccttgttgggaacaagacagatcttgtggacaaaaggcaagtttctatagaagaaggggaagctaaagctcgtgatcttaatgtcatgtttatcgaaaccagtgccaaagccggcttcaacattaaggcactctttcggaaaattgcagctgctttgccaggaatggaaacactttcttctaccaaacaagaggatatggtcgatgtaaacctgaagtcatcgaatgcaaattcttcacagtcacaaccccagggtggaggctgttcatgttaacgtgagttgctgagcaaacaagtttaatgtctccaccacttgccgctttattggttgtgatctgcttacttagttgtaaaggtttttttgttctttttttctttttcttcgaagttattggctttggtagctttagtaattgcggttcacaaggtgagcttccttttgcatcataagataagaagctgctattagaaggaatctaccttgtggtggaggtcgagttagaattaatcttttctgtagcaagatttgttaaaaccctataatagattcataagatgtttttttgtgacactttccttggacttaataatgcaattgtgtaactatttagatgaagtatatatatataatatatactggcaagagtgtaataaatttggcccacc

SEQ ID NO: 3956 - DNA, 931 bp, Cyclamen graecum
ccctacgcgcaaattctctctgtgatctctctctgctgcagagaacgacgaccgtccgatctgatccgatacgatccgatttgagaaatggcacctgtatcggctctggcgaagtacaagctggtgttcttgggcgatcagtccgtcgggaagaccagcatcatcacccgattcatgtacgacaagttcgacaacacttaccaggctacaataggtatcgattttctgtcgaagacaatgtatctcgaagatcgaactgtcaggctgcaactttgggatacagctggacaggaaaggtttaggagtcttatccccagctatattagagactcttctgttgcagttattgtgtttgatgttgcaagtaggcagtctttccttaacacttccaagtggattgaggaggtccgaactgagcgcggaagtgatgttattattgttcttgttggaaacaaaactgatctggtggacaaaaggcaagtctccatagaggaaggtgaagccaaagctcgagacctaaatgtcatgttcattgaaacaagtgccaaggctggcttcaacataaaggcattgttccgtaagatcgccgcagccttaccaggaatggaaacgctatcatccgcgaagcaagaagacatggttgacgtgaatctcaggtctagcaacccaaatgcatcgcagtctcaacaacagtcaggaggatgttcctgttaagacagcgtctacagaagcctttgctctgttcggcactcgccctgggcctccgaatgtacctgtaaagcacttttccttttaatatcttattatggattttttcttgtgcttttgctatgaaagaatttttattgtctcgaaccaggcgttcattaaactagtcatgcatggatttttgttctggacctatagtgatcgtagatgttcgcggagttgg

SEQ ID NO: 3957 - DNA, 1077 bp, Tropaeolum majus
gaaacccaggctccgagatctagatcctaacggcgatctctccggccacctagcctactgattcccccggcgagatcccgactttcaaattaaatcaatccgatcagtggcatttattcggctagatcagagtcatggcaccggtttcggctctcgccaagtataagctggtgtttttaggggatcaatccgttggaaaaaccagcatcatcactcgatttatgtatgataaattcgacaatacttatcaggccactattggtatcgatttcctttctaaaacaatgtatctcgaagatcggacagttcggctgcagctctgggatactgcaggacaagagcgattcagaagtcttattccgagctatatcagggactcctctgtggctgtcattgtatttgatgttgcaagcaggcagtccttcctaaacacttcaaagtggattgaagaggtccgaactgagcgtggtagtgatgttataatcgtgcttgttggaaacaaaacagatcttgttgacaaaagacaagtttcaatagaggaaggagaaggcaaggctcgtgaacttaatgttatgtttattgaaacgagtgcaaaggctggcttcaacattaaggcactcttccgtaagatcgcagcagccttgccaggaatggaaacactatcttcaacaaagcaagaagacatggtcgacgttaatctcaagtcatcgaacgcaaactcgtctcagtctcagcctcaagcaggaggatgtgcctgttgataggggatatacctcaatgttttgcaaggtattctgataacgccctattcatcctacaggctgcctgtaaattttgtcctggaccttttttttttgtagtcatttggatatggtttgattgtttttaaagattggacttcaaaaaaaaaagagttgtagaaagttaggctctagtcctaaactgtttttgttttatggttctttgtgtagtaaccggactattgttttaagtttaccttgttataagcatatgaatatttagaatattttcaatcatcatatatttttttgaaaaatatatcgtgaatcaatataa

SEQ ID NO: 3958 - DNA, 870 bp, Thalictrum flavum
attcgatctatttcttcgtattcgattgcaactaatactctttttaaaccttgtcgttgttgttgagatttcggttggtagttagatatatagagatctcgttttgatttgaatagattctctgtatcatttgattcttcgtgtttaatagatctctcattaagtaatggcaccggtttctgctcttgcgaaatataagcttgtgttcttaggagatcaatctgttgggaaaacaagtatcattactcgatttatgtatgataaattcgacaatacatatcaggctactattgggattgattttctatcgaagaccatgtacttggaagaccgaacagtacgcttgcagctttgggatacagctggacaggaaagatttaggagtctcattcccagttacatcagagattcctctgttgctgtcattgtctttgacgttgcaagtcgtcagtctttcctgaacacatcaaaatggattgaggaggttcggacagagcgtggtagtgatgttattatcgtcctggtcgggaacaagacagatcttgtggacaaaaggcaagtttctatagaagaaggagaagctaaagctcgtgatcttaatgtcatgtttatcgagaccagtgctaaagccggatttaacattaaggcactctttcggaaaattgcagctgctttgccaggaatggaaacactttcttctaccaaacaagaggacatggtcgatgtaaacctgaagtcatccaatgcaaattcgtcacagtcacaaccacagggtggaggctgttcatgttaacgtgagttgctaagcaaacgagttttatgtcttcactactggctgctttattggttgttatctgcttacttagctgt

SEQ ID NO: 3959 - DNA, 1064 bp, Malus domestica
tataaatacgcatctaaccgaaaatcaaaggaaagaagcgaatttcgaacgaggctccgagatctcgatctgtccgatcaatctccggcgagatctcgaccttgaacccgatccgatcctcatagatccgaaatcgccatggctcccgtttcggctctcgccaagtacaagctcgtcttcctgggggatcagtccgtcggcaaaaccagcatcatcactcgcttcatgtacgacaagttcgacaatacctatcaggctaccatcggcattgattttctgtcaaagacaatgtatcttgaagatcgaactgttcgattgcagctctgggatactgctgggcaggaaaggttcaggagtctcattcctagctacatcagggattcctctgtggctgtcattgtatatgatgttgcaagcagacaatcattcctaaacacttccaagtggattgaagaggttcgcactgagcggggaagtgatgttatcattgtacttgttggaaacaaaacagatcttgtagacaaaaggcaagtttctatagaggaaggagaagccaaagctcgtgacctcaatgttatgtttattgagaccagtgccaaggctggcttcaatatcaaggcgctgtttcggaagattgcagcagctttacctggaatggaaacactttcttcaacgaagcaggaagacatggttgacgtgaacctgaagtcttcgaatgcaaattcatcacagtcgcaggcacagtcaggcgggtgcgcttgttaattttaccccgttacttgtatgctctgctttgatcctacaatctgtaaagattagttaccgtcccagtcgtcccgccattttgtagcatttgaagttttgtgtttggttgattgttaaaggaagtgtacactgtttgcttggctgagcttagaatatcagactttcagattttcagttaatagtaattaaaagaaacatttacatttttttttctgcaaactaattttaataaattcctatggttgtattgtacgggtattttcggatattaaagtgtggcattgcgcattggtaggaaa

SEQ ID NO: 3960 - DNA, 998 bp, Eschscholzia californica
aaacgatcatctcaactgctgacattgtggatctcgattgtcaattattattaagtcagtgagatctaaaagaaagatggctccagtttctgctctggccaaatacaaacttgttttcttgggagatcaatctgttggaaaaacaagtatcatcactcgtttcatgtacgataagtttgataatacttatcaggccacgattgggattgattttctgtcaaagacaatgtaccttgaagatagaacggtcagattgcaactttgggatactgctggacaagaaagattcaggagtctcattcccagttacattagggattcctccgtcgcggtcattgtttttgatgttgcaagccggcaatctttcttaaatacttcaaaatggattgaggaggttcgcactgagcgtggtagtgatgttattattgtactcgtcgggaacaagacagatcttgtcgacaaaaggcaagtctcgatagaggaaggagaagctaaagctcgtgatcttaatgtgatgtttatcgaaaccagtgccaaagctgggttcaacattaaggctttgtttaggaagatagcagctgcattgccaggaatggaaacactttcgtcgacaaagcaagaggacatggtcgacgtgaatctgaaatcaactaatgcaaatgcatcacagtcacagccacagggtggaggatgttcttgttaatccaattattcatcactgaaattcttctcaaaccttgcccttctcttcccttttctttactcgaattctgatcagttgctctttgtcatctgtaaaggttttcgactttttttttttgtcgagcattttgtttttcggtatacagttaggttgtttgaataagctttttgcataatggagtgtctattaaagaaggaattagatatcagaaaggaatttacttggaggttgtgatcatggtggtcatagtatagtactaatatgtctgttctttgtattaagattactagaattt

SEQ ID NO: 3961 - DNA, 941 bp, Musa acuminata
cttcatctctctctctctctcttcgcactcttttcgcgttcggatctgttgctaggatcaacatggccccggtgtcggcgctcgccaagtacaagctggtattcctgggggatcagtcggtggggaagacgagcatcatcaccagattcatgtacgataagttcgacaacacctatcaggctacgattgggatagattttctatcgaagactatgtaccttgaagatcgaacagtcagactgcagctctgggacacagctggacaggaaagatttaggagccttatcccaagttatattcgggactcctcggttgcagtcattgtatatgatgtagcaagtagacaatccttcttgaatacttcaaaatggattgaagaggttcgtacagagaggggaagtgatgttatcattgtccttgttggaaacaaaaccgaccttgttgacaagaggcaagttccaatagaggaaggagaagctaaagcacaggaacttggtgtcatgtttattgaaacaagcgcaaaagctggcttcaatataaaggctcttttccgaaagatcgctgctgctcttccagggatggagaatctttcttcggcaaagcaggaagacatggtggatgtaaacttgaggtcatcaaatgcgaattcatcccaatcacagtcccagtctggtggttgtaggtgttgagttcatccataattgtttaggttgctattgaggtgttgtattttactgagctttctatcaactcataaactgcatcagcctacataggaaaggatgttttgatgagagagatatgcatgaactagtctctatgtttgttatatctggttctaggtgtatacatttgcgagaagatgctttgctcgagtctaaaactagaatcagttaaataattggattgggatgaaggattaatgcaggaaagaagacggg

SEQ ID NO: 3962 - DNA, 1525 bp, Eschscholzia californica
ccgttcgtcgtcgtcctccctacccaccgtaacctaactactactactaacggaaggtacggttcggtcgtcctcgtacgtacacgacgacacctctctctctctctctctctctctctctctctctctctctaaaccgtcccaattttgagagagaaaggaagaacatactcaaagtttcgaacaaaaaagcaaaaaactcctcggcttcatccatcgtccttcccaatcatatcaaacgatcatctgggtcccgaatttgtacttgtgtttcttgaatcgtttgatctgaaagatggctccagtttctgctctcgcgaaatacaagcttgtgtttttgggagatcaatctgtcggtaaaacgagtatcatcactcggtttatgtatgataaatttgacaatacttatcaggctacaattggaatcgattttctatcaaagacaatgtaccttgaagatagaacagtcagattgcaactttgggatactgctggtcaagaaagattcaggagtctgattcccagttacattagggattcttctgttgctgtcattgtgtatgatgttgcaagccggcaatcatttctaaacacttcaaaatggattgaggaggttcgcactgagcgtggaagtgatgttattattgtacttgtcgggaacaagactgacctcgtggacaaaaggcaagtctcgatagaagaagcagaggctaaagcgcgtgatctcaatgttatgtttatcgaaaccagtgctaaagctggttttaacataaaggctctgtttaggaagatagcagctgcattaccaggaatggaaacactttcttccacaaaacaagaagacatggtcgacgtgaatttgaagtcaactaacgcaaattcatctcaatcacaaacacaaggtggaggatgttcttgctaatgcactttatactacaccgaaatcttcacatttttcgcccgctgctttttcctgttatcttctcttcgacttctgatctactgctccatcgacactctgtaaagttcattactttttgtttgtttctgtcggactcttttgcttttctactttttcgctttttaaatctcttaaggacccattactagaagtctagtactagtttataatcttgataatacattgttctgattgcattgaaagtttgttacaagttaacaagagtggtatttcgaaatcgaaggtaggctatttttaagggatctggaatttgtttaggaactccaaataaatgactaaaaagacttagatttcaagatccattatttttctcttggtgtggaatacctcatttctagttcttcatacaccattagggaaattgtgaaacacaactatgagcattagaaataaaaatttagagtctttagtggtggtcttcatctgccctagttgttcttgacttcctattatcaagataatgttgataaatataagaagtaaagccccaaatagacaaaaccattgccaccacctttacaccactcaacttatcatgaaaaa

SEQ ID NO: 3963 - DNA, 1017 bp, Vitis vinifera
ggagaaacgagacccaagcagttggccgcctaattggtaagaaaccactttacttagcgttacaacttacgagtgaaggaagactctcgtttccgcgaaatctcttcaaaacatttcacgagaggacaaaacaaaacacagcccctgcagccagccctccctttcaaaactttcaaaaaaaaaaaaaaaacctctcccccttccttctctctcctcgtcccagatcagagcttctgccccatttcccatctcccactccaccttcctttccagatccgatctatggcccctgtctctgctctcgccaagtacaagctcgtcttcttgggagaccaatccgtcggaaagactagcatcatcactcgattcatgtacgacaaattcgacaacacctatcaggctactattggtatcgattttctatcaaagacgatgtaccttgaagatcggacggtccgtttgcaactctgggatactgcaggacaggaaaggttcaggagtctgatcccaagttacattagggactcctctgttgcagtcattgtatatgatgttgcaagcaggcagtcattccttaacactgccaagtggattgaggaggttcgtactgagcgaggcagtgatgttatcattgtccttgttgggaacaaaacagaccttgtggacaagaggcaagtgtctatagaggaaggagaagctaaagctcgtgatctaaatgttatgtttattgaaactagtgccaaggctgggttcaatataaaggcgctatttcggaaaattgcagcagccttaccaggaatggaaacactttcttcagcaaagcaagaagacatggttgacgtcaatcttaagtctagcaacacaaacgcatctcagtcacagccacaggcaggcggatgttcctgttgatgatatacaatgttgttctaaactcccactatgcagccccatttccttctcagctcctgtgatcctacaaaacgtctgtaaagttttcctcgcccatttcggtttctg

SEQ ID NO: 3964 - DNA, 1373 bp, Mimulus guttatus
gcgcagaaggaacacgttaatagcacagtagtagttagtgatttagcaaatccctctcatttccaaatcaacaaaacgcgcaaacaatatacaaattttttctcgcatcatcgatttctccggcagttctccgatttccttttttccggcgagatcgtgaactttccgtcggaaaaaaacagcaaccgatccgattctgaacgccccgatccggtttcgtaatttaatcgagttaattttgagtgatggctccggtgtcggcgcttgccaagtacaaattagtgttcctcggcgatcaatccgtcgggaaaaccagtatcatcactcggtttatgtacgacaaattcgacaacacttatcaggctactattggtattgatttcctatccaagacgatgtaccttgaagacagaactgtacgtttgcagctgtgggatactgctggtcaagaaaggtttaggagtctcatcccgagctatataagggactcctcagttgctgtcatagtatttgatgttgcaagtagacaatcgtttcttaacacttcaaagtggatcgaggaggttcgtactgagagaggaagtgatgttattatcgtcctagttggcaacaaaactgatttggtggataagaggcaagtttcaatagaggaaggagaggctaaagctcgtgatctcaacgtcatgtttatcgaaactagtgcaaaggccggtttcaatattaaggccttgtttaggaagattgctgcagctttgccaggaatggaaactttatcatcaacaaagcaagaagatatggtggacgtgaacctcaaatctagcaacgcaaacggatctcagtcacaacagcagtctggaggatgtgcctgctaattaattcaaaaaaaaagaaaaaaaacgagcctcgatttttttttttttttttttttgtggttctatcgtattttttggtcgggacaaaaaaatatatgcatctgtagaaagttcttgttatttgatagcggatcgattctggttgtgatttgtcaagagtacttttaaatcgggatatagtagtagattgtcgttgttgtttcattctctactgtgtgtgtttttctcatcttacgtatgtaccattttggcgtattcgtagtcattgagactgtagttagttttgttcctttcggtgttgtttatttttcttcttcaccgaccccctaagtatgcgtttattggatatgtattcatatgattacggatgtaaacgagagagttgattatgtgattgtttggatttgtcgattttttatcgagctattatgtttgatcgaactatctcagttcgattttcatctgtattcttatgatgtaactatccatccaagtataaat

SEQ ID NO: 3965 - DNA, 1910 bp, Primula obconica
aaatgctcctccgcagcgcatcttcctcggcgctgaagcagctgccgcatcagcccaactctctctcctctcccgacatctctctccccaaacgccgttctctttccctttctagacccgtctccgacaccgacctcgcctccctctctctctccagcagcccgactcccaagcggccgctctccgcatccgcctcgctcgtcgaggaggaggaaagcgtcgggccgcttgggtacgtggaccgggttctctctctcgggtcgggtttgttgttggaggaagggttcgttgggggaggcggcggaggatgttggatcggtaacggtggcgagggatccgacggctgtgatgatgccaccgattcgtattatcggagtatgatcgaggctaatcccgggaatggccttctgcttagcaattatgccaaatacttgaaagaggtgcgtaaggacttagtaaaggctgaagagtactgcgagagagcaattttggctaacccaagtgatgggaatgttctctctctctacgctgatctagtgtgggagactcacaaagatgctcctcgagcagaaagttactttgaccaagctgttaaagctgctcctgatgattgttacgttatggcatcatatgctcgatttctttgggatgctgaggaagatgaagaagaagatgatacggaggctaccaaaaatctatcagcacaaaatttctttcaaggaactcatcaaatgccttctggcattgctgctgcatcataagctctctttctctctcattctcaccccttgtatgatagtagctaatatgtatacccgctcaattttgtagtgttatgacttgtatgaaaaagaataatggatgaaagagaataatggatgaaatagaagtgctttttgattgcccattacggccgaaaagtttgtcgagggcaataggctgaatttcgttgtctgcatacactttaaaccggcctacctgagatctgctcgtgcaaacctattattcattacttaatttctgaaaagcagacagaaagaaagaggggaagtatcagtgatggctccagtatcagcgctagcaaagtacaagctcgtgtttttgggtgatcagtccgtcggcaaaaccagcatcatcactcgtttcatgtacgacaaattcgataatacttaccaggctactattggaatcgattttctgtctaagacaatgtatcttgaagatcgaactgtcaggctgcaactctgggatacagcaggacaggaaaggtttaggagtcttatcccaagctatattagagattcttctgttgcagttatcgtgttcgatgttgcaagcagacagtctttcctgaacacttccaagtggattgaggaggttcgaactgagcgcggaagcgatgttattattgttcttgttgggaacaaaactgatctggtggacaaaagacaagtctccattgaggaaggagaagccaaagctcgtgacctaaatgtcatgttcattgaaacaagtgcaaaggctggcttcaacataaaggcattgttccgtaagattgctgcagccttaccaggaatggaaacactatcctctgcaaagcaagaagatatggttgatgtgaatctcaagtctagcaacacaaatgcatctcagtcccaaccacaatcaggaggatgtgcctgttaaatataggatttgaatctaaagtgcccttttctgcgttttccaaagtacctgtaaagctcttattatcttatggtatttttgtgtgtttttgatataaaggatttttctttttttttcttccattttgtatctcaacgttgtcatcttcagctagtcatgcatgattttttcttgttccaatattgaattgagataaattgggagttgatatttggattgggcac

SEQ ID NO: 3966 - DNA, 1127 bp, Prunus mume
aaaacctcttcaaaccaatttcacgcgcaaaaaacagtttctctctgtctccgtttctccctttctctatatgccaacatatcatcgtcgtataaatacgcacccaaacgaaatcgaggaaaaataaaacaaacgaagcgaatttagaacgaggctccgagatctcgatctgtccgataaatctctggcgagatctcgaccttgaacccgatccgatccacgtagatccgaaatctccatggctcccgtttcggcactcgccaagtacaagctcgtcttcttgggggaccagtccgtcggcaaaaccagcatcatcactcgcttcatgtacgacaagttcgacaacacgtatcaggctaccatcggcattgattttctgtcaaagacaatgtaccttgaagatcgaactgttcgattgcagctctgggatactgctgggcaggaaaggttcaggagtctcattccaagctatatcagggattcctctgtggcagtcattgtatatgatgttgcaagcaggcagtcattcctaaacacttccaagtggattgaagaggttcgcactgagcggggaagtgatgttatcattgtacttgttggaaacaaaacagatcttgtagacaaaaggcaagtttccatagaggaaggagaagccaaagctcgtgagctcaatgttatgttcatcgaaactagtgccaaggctggcttcaatatcaaggcactgttccgaaagatagcagctgccttgcctggcatggaaacactttcttcgacgaagcaagaggatatggttgatgtgaacctcaagtcatccaatgcaaattcatcacagtcacaggcacagtcgggcggatgtgcttgttaatttacgtgggtttttttattcaacttctttaccccattccttgtatgcttcggtgatcctactgtctgtaaagcttagttactgtagcattcggagttttgtgtttggttgattggtaaaggatttttatactgtttggctaagcttagaatatcacaaacactcagacaaaattaaaagtaattaaaagagacgtcttgttttgcaaagtgattttaatagatttctatgattttatgttttgaaatattcttatattttc

SEQ ID NO: 3967 - DNA, 1001 bp, Musa acuminata
gaaaagggatattatatacaacaaggggttttcgtttgagatctcgatttcctttgcttctttcttcgcgtctcgatctcggacggatcatcatggccccggtgtcggcgctcgcaaagtacaagctggtgttcctgggggatcagtccgtggggaagacgagcatcatcacccgcttcatgtacgacaagttcgacaacacctaccaggctacaattggtatagacttcctatcaaagactatgtaccttgaagatagaacagtcagactacagctttgggacacagctgggcaggagagatttaggagcctgatcccaagttacattcgagactcttcggttgctgtcattgtgtacgatgttgcaagccgacaatctttcttaaatacttcaaagtggattgaagaggttcgaacagagaggggaagtgatgttatcatcgtccttgttgggaacaaaacggatctggttgacaagagacaagtctctatagaggaaggagaagccaaggcacaggaacttggtgttatgtttattgagacaagtgcaaaagctggcttcaatataaaggcgctgttccgaaagattgctgcagctctgccagggatggaaaatctttcttcaacaaagcaggaagacatggtcgatgtaaatctgagggcgacaaatgcaaattcatatcagtcgcagtcacagtctggaggttgcagttgttgaactcatccatattggcttccctcgacttacaacctgcatcgatcaactaagggagtgatggtttacggcagcggtttatgcaaatgagcaagtcccatgctattctgtggtgtgcactattaagatatttccagcattttcatttcatatctggatctagggatgtattctgcaattgtgggaaggtatgcttggattttgtctgaaagtaatagtcatagtaagtgactggtgtcgctgttagcctagcttaacaaaatataatagtatagtttatttatc

SEQ ID NO: 3968 - DNA, 1067 bp, Theobroma cacao
agagagagggagagggggggctagggatctcgatctaaatttcgatctctccggcgacgccttcgacttgtttccggtgagatctcgatatcggatccggtctcgacccgatccgtagtaatctccttacttagatccgaataaccatggctccagtttcggccctggccaagtacaagctggttttcttgggggatcagtctgtcgggaagaccagcatcatcactcgcttcatgtacgataaattcgataacacctatcaggcgaccattggtattgactttctatcaaaaacaatgtacctcgaagatcgaacagttcgattgcagctctgggatactgcaggacaggaaagattcaggagtcttattccaagttacattagggattcctctgtggcagtcattgtgtatgatgttgcgagcaggcagtccttcctaaatacttcgaagtggattgaagaggtgcggactgaacggggtagtgatgttatcattgtgcttgttgggaacaaaacagatcttgtggacaaaaggcaagtctcaatagaggaaggagaagccaaggctcgtgaccttaatgttatgtttattgaaactagtgccaaggctggctttaatatcaaggctctatttcggaagattgcagctgccttacctggaatggaaacactttcttcaacgaagcaagaagacatggtcgatgtcaatctgaagtctaccaatgcaaatgcatctcagtcgcagcaacagtctggaggatgtgcctgctgataacgcgcatcgatgatcagagctccagcttttcgacctttcttttgtgcttctgtgatcctacaaagtgcttgtaaaaaaaatctgtcctccccccttttgttttttgtagcattgggcttttgggttgggtcatcaaatgttggaaggatataactgttgagagaggagacttggttatggtagttaggctagtcctaacctgtcctatatatttgtaaggttcttgtgatctcagacaattgtgccaatattactgtttagtcatatattcagtttgggttttttgttaaa

SEQ ID NO: 3969 - DNA, 1109 bp, Chelidonium majus
aaaccaattcttgagagagaaagaaacagatttgaaccaaccccactcctacctctcctctgtctcctagatttctacagagccggcaactcctcgaaattctccgggcaaattttacaaaagtctttgtcgtcggagaactcgatctcgattataattctctgtttctttggttactgtttgatctattatctaatggctccggtttctgctcttgcgaaatacaagcttgtgttcttgggagatcaatctgttgggaaaaccagtattattactcggtttatgtacgataaattcgataacacctatcaggcaacaattggcattgattttctatcaaagaccatgtaccttgaagatcgaacagtccgattgcaactctgggatactgctggacaagaaagattcaggagtctcattcccagttacattagggattcctctgttgctgtcattgtttatgatgttgcaagtcgacaatctttcctaaacacttcaaagtggattgaggaggttcgcactgaacgtggaagtgatgttattattgtccttgttgggaacaagactgaccttgtggacaaaaggcaagtctcgatagaggaaggagaggctaaagctcgtgatctcaatgtcatgtttatcgaaactagtgccaaagctggcttcaacataaaggcactgtttaggaagattgcagctgcattgccaggaatggaaacactttcttcgacgaagcaagaggacatggttgatgtgaatctgaagtcaaccaacgcaaatgcatcccagtcacagccacagggtggaggatgtgcttgttaatgtacttacaccgacgtgctcgaacataccatttctcacccttttcctgctttatcagcttttgatctgctccttccctccccatctgtaaaggtttcgactttttggtttttcttttgtttcagagtcttttggctttggttacagtttagcttcctgtcaaacttccttttgcaatagagagtctattaaagaagctaaaatattaggaggaacctacttgaggtggtggtcatggcggtcctagtctgtcttgtgtgttttgtattaagatttcttaagaacct

SEQ ID NO: 3970 - DNA, 1032 bp, Heritiera littoralis
agagagaagacgctggggatctcgatcttgttctctccggcgacaatttcgaattgtttccggtgagatcttgtggttggatccgatctcgacccgatctatagtatcttatctcactgacttagatccgaataaccatggctccggtttcggctctggccaaatacaagctggttttcttgggggatcagtccgtggggaagaccagtatcatcactcgcttcatgtacgataaattcgataacacctaccaggctaccattggtattgacttcctatcgaaaacaatgtaccttgaagaccgaacagttcgactgcagctctgggataccgcaggacaggaaagattcaggagtctaattccgagttacattagggattcctctgtggcagtcattgtttatgatgttgcaagcaggcagtccttcctaaatacttcaaagtggattgaagaggtgcggactgaacgaggtagtgatgttatcattgtgcttgttgggaacaaaacagatcttgtggacaaaaggcaagtctcaatagaggaaggagaagccaaggctcgtgacctcaatgttatgtttattgaaactagtgccaaggctggcttcaatatcaaggctctatttcggaagattgcagctgctttacctggaatggaaacactttcttcaacaaagcaagaagacatggttgatgtcaatctcaagtctaccaatgcaaatgcatctcagtctcagcaacagtctggaggatgtgcctgctgatatgcacatcattggtctgagcccttattttgaacatttctttcatgcttctggatcctacaaagtgtttgtaaaaaatctgttctctcccgtttttgtagcattgggcttttgggtatggccgcattttaaagcagttaacttgagagaggagatctgttatggtagttaggctaggcccaacctgtcctatatgtgttcggttcttgcgatcttagacaattgtgccaaatttactgtcagtcatatattgagtttgattttgtag

SEQ ID NO: 3971 - DNA, 1159 bp, Mimulus guttatus
tcatctccattctcaattctctccatttactactttgacgcgaatcaaacctacaaattccgtcgtcaccgtttcctccggtagaaaaaaactgcgttccgccgagatcccgatctcttgtcggaaaactgcaaccgatctgaatccgaagatccgatctgatccgatccgagttagcactcagctgatccgagttcgagcgatggctccggtttcagctctagcgaagtacaaattagtgttcctgggagatcaatccgtcggaaaaacgagtatcatcactcgtttcatgtacgataaatttgacaatacttatcaggctacaataggtattgatttcctctcgaagactatgtatcttgaagatcgaactgtacggttgcagttatgggacactgctggacaagaaagatttaggagtctcataccgagctatataagggactcctctgttgcagtcatcgtatttgatgttgcaagcagacagacctttctcaatacttcaaaatggatcgaggaggttcgtaccgagagaggaagtgatgttattattgtgctcgttggcaacaaaactgacttggttgataagaggcaagtttcgatagaggaaggagaggccaaagcacgtgacctcaatgtcatgtttatcgaaacaagtgcaaaagccgggttcaatataaaggcactattccggaaaattgcagcagcactacccggaatggaaacactgtcatcagcaaagcaagaggatatggttgatgttaacctcaaatcgagcaacacaaacgcatctcaatctcaacaacagtccggagggtgtgcctgctaataattaattaaaaaaaaaacatcaacttctttatttgcgtttatatcgaattatttttctattaatgcatctgtaaatttcttcactgcccttttgataatagagtcgaattttggtcgtgattgtcggattaattctaagccggatatatatattagattgtcattacagttcgttgtgtcatgtatcatttggtgagcaattgttattcgggaccatagatagtttcttttccaaccttttattttattttattttattagtggtgttatatttgaatgcaagggtaattaatttattacactgttagtgagatttatttttattaca

SEQ ID NO: 3972 - DNA, 1250 bp, Mimulus guttatus
aaatataaaattattttgtcatctccattctcaattctctccatttactactttgacgccaatcaaacctacaaatttcgtcgtcaccgtttcctccggcagaacaaaaaaactgcgttccgccgagatcccgatctcttgtcggaaaactgcaaccgatctgaatccgaagatccgatccgatccgagttagcactcagctgatccgagttcgagcgatggctccggtttcagctctagcgaagtacaaattagtgttcctgggagatcaatccgtcggaaaaacgagtatcatcactcgtttcatgtacgataaatttgacaacacttatcaggctacaataggtattgatttcctctcgaagactatgtatcttgaagatcgaactgtacggttgcagttatgggacactgctggacaagaaagatttaggagtctcataccaagctatataagggactcctctgttgcagtcatcgtatttgatgttgcaagcagacagacctttctcaatacttcaaaatggatcgaggaggttcgtaccgagagaggaagtgatgttattattgtgctagttggcaacaaaactgacttggttgataagaggcaagtttcaatagaggaaggagaggccaaagcacgtgacctcaatgtcatgtttatcgaaacaagtgcgaaagccggcttcaatataaaggcactattccggaaaattgcagcagcactacccggaatggaaacactatcatcagcaaagcaagaggatatggtcgatgttaacctcaaatcgagcaacacaaatgcatcccaatctcaacagcagtcgggagggtgtgcctgctaattaaaaagaaaaaaacaccaacttctttatttgcatttatatcgaattatttttctattaatgcatctgtaaatttcttcactgcccttttgataatagagtcgaattttggtcatgattgtcggattaattctaagccggatatatatattagattgtcgttacagttcgttgtattatgtatcatttggtgagcaattgttattcgggaccatagatagtttattttccacctttttattttattagtggtgttatatttgaatgcaaggattattaatttgttacactgttagtgagatttatttttgtttgggttttggtttagagtgtagttagggttataacgttttttttgttcttttcttttttatccgaaatgcgaatgattatttaacgagaaaa

SEQ ID NO: 3973 - DNA, 1109 bp, Petunia hybrida
gcggggatacaaaaacacaaacatacagtctctcgctaagctcaccgaaatccgcactctccccttgctttctccgtgacatatacgatcgttttccggcgaaatcacgtcggaaaatcctgatcggatcccgtgatctcttaattacaattttcgttttgtgatttcgaaaagatccgaattagatatggctccagtttcagctcttgccaagtataagcttgttttcttaggagatcaatctgttggtaaaaccagtattattacgcgattcatgtatgataaattcgataatacttatcaggctacaattggtattgatttcctgtcaaagactatgtaccttgaagatcgtacagtacgattgcagctatgggatacagcaggtcaagagaggtttaggagtctcataccaagctatattagggactcctctgttgctgtcattgtgtttgatgttgcaagcaggcagtccttcttaaacacttcaaagtggattgaggaggtccggactgagaggggcagtgacgttattattgtccttgttggtaacaaaactgatcttgttgacaaaaggcaagtttcaattgaggaaggagaagcgaaagctcgcgaattaaatgtgatgttcattgaaaccagtgcaaaggccggattcaatattaaacctctttttagaaaaattgctgcagcattgccaggaatggagacactatcttcagctaagcaagaagacatggttgatgtcaacctcaagtcgagcaacacaaatgcgtctcaatcacaagcacagtcaggaggatgtgcttgttaattttatggtgcaattctatagttctcaaccaagttcttatattctgttttcgacatcaaatgtttctgtaaagttcttgacttacgtgggatttggatcccaaggtatctgtcattatttggatacaggaggtcgtcatcctagttgactagtacctagtaattagcatgtgtcacttatttgtatctgtctctagaactttgcaatttactagttccctcttaagcaacagtcctcagcgtattattgattgattcattgtggttgtgtaatcgaaattttttggtggacgttt

SEQ ID NO: 3974 - DNA, 931 bp, Lippia dulcis
tccggcgagatcgtgaactttccgtcgggaaaaacggcaatatatccaccggaggtgctattcatttttcaatcgactcgaatttgattgatggctccggtctcggctctcgcgaagtacaagttagtgttcctgggggatcaatccgtcggaaaaacgagtattattactcggtttatgtatgataaattcgataacacttaccaggctactattggtattgattttctatccaagactatgtatcttgaagatcgaactgtacgtttgcagctgtgggatactgctggacaagaaaggtttagaagtctcatacctagctatataagggactcctctgttgcagtcatagtgtttgatgtcgcaagcagacagtcctttcttaacacttcaaagtggattgaggaggttcgaactgagagaggaagtgatgttattattgtcctagttggcaacaaaactgatctggtcgataagaggcaagtttcaatagaggaaggagaggctaaagctcgtgatctcaatgtcatgtttattgaaacaagtgctaaggctggcttcaacataaagcccttgttcaggaagattgctgcagccttaccaggaatggagactctatcaacagcaaagcaagaagatatggttgatgtgaacctcaagtctagtaacgcaaacgcatctcaatcacaacagcagtcgggaggatgtgcgtgctaataacaagaactagaaattttgttgctttttgtgcttatcatattttggttggactatatatatgcatttgtagaggtattggtatttatagcattgaactgtagttgtgactcgcgagcggatttgaatcggatgcgtagattgtcagttgtttccttgtattctaattttcatcttacatttgtatcatttggtgggccgactgttgttaaga

SEQ ID NO: 3975 - DNA, 1233 bp, Populus trichocarpa
gttaaattagatataaaaatatagtggtgacgtggaagcttctttgaaaagagttgacgctccaaacaaaggtaccagccagcccattgccattgccattgccatcgccatcgatccccctctcttccaattacaatttacaaaagaagtaggaccttgatctagatctcgatctccatccgcatctatccgttcaggcgagatcttgattcttggatcctcttatattcgtgggagatagatccgattgatcaatacaacatcatataataatggcaccggtatcggcgttggccaagtacaagttggtgttcttgggggatcagtctgtgggaaaaaccagtattatcactcgcttcatgtacgacaaattcgacaatacctatcaggctaccattggtattgattttttatcaaagacgatgtaccttgaagatcgaactgttaggctgcaactctgggacactgcaggacaggaaaggttcaggagtctcatcccaagttatattagggattcctctgtggcagtcattgtttttgatgttgcaagcaggcaatctttcttgaatacttcaaagtggattgaagaagttcgctctgagcgggggagcgatgttatcattgtacttgttgggaataaaacagatcttgtggacaaaaggcaggtatcaatagaggaaggagaagctaaagctcgtgacctcaacgtcatgtttattgaaactagcgcaaaggctggcttcaatataaaggcactgttccggaagattgcagcagccttaccgggaatggaaacactctcttcaagtaagcaagaagatatggttgatgtcaatctgaagtcttccaatgcaaatgcatcacagtcccaacaacaatcaggaggatgcgcctgctaatatactaaaattgagacgatatgcctgctagtatacaaaaattgagatctgagcacgcttccatgagcccacactgtccgtgtagagtttgcatcctccccttattttgtagcatctgtattggtttcggttttggtgcgttgttataagacaatacttgaaagaggagatacttgttgtcgttaggctagccctaacaagtcatgtacgtatgcttgttatggacctagagagattgtgcgaaattttttttcttattaacattcatatttgattctgctttactgttgaaaatagactttcgaatgaattgatctgatcattcttacataca

SEQ ID NO: 3976 - DNA, 927 bp, Prunus persica
atgccaacagatcatcgtcgtataaatacgcacccaaacgaaatcgaggaaaaataaaacaaacgaagcgaatttagaacgaggctccgagatctcgatctgtccgataaatctctggcgagatctcgaccttgaacccgatctgatccacgtagatccgaaatctccatggctcccgtttcggctctcgccaagtacaagctcgtcttcttgggggaccagtccgtcggcaaaaccagcatcatcactcgcttcatgtacgacaagttcgacaacacgtatcaggctaccatcggcattgattttctgtcaaagacaatgtaccttgaagatcgaactgttcgattgcagctctgggatactgctgggcaggaaaggttcaggagtctcattccaagctatatcagggattcctctgtggcagtcattgtatatgatgttgcaagcaggcaatcattcctaaacacttccaagtggattgaagaggttcgcactgagcggggaagtgatgttatcattgtacttgttggaaacaaaacagatcttgtagacaaaaggcaagtttccatagaggaaggagaagccaaagctcgtgagctcaatgttatgttcatcgaaactagtgccaaggctggctttaatatcaaggcactgttccgaaagatagcagccgccttgcctggaatggaaacactttcttcaacgaagcaagaggatatggttgatgtgaacctcaagtcatccaatgcaaattcatcagagtcacaggcacagtcgggcggatgtgcttgttaatttacgtgggttttttattcaacttctttaccccattccttatatgcttcggtgatcctactgtgtctgtaaagcttagttactgtagcattcggagttttgtgtttggttgatcggtaaaggatttttata

SEQ ID NO: 3977 - DNA, 813 bp, Tripterygium wilfordii
gcttgattgaaatatctgtctgatccggtgagcgtttcgattagatcggaattgtcatggctccggtttcggctctggctaagtacaaactcgtcttcttgggagatcagtccgtggggaagaccagtatcattacccgcttcatgtacgataaattcgataacacatatcaggctactatcggtattgattttctgtcaaagacaatgtatcttgaagatcgaacagttcgattgcagctctgggatactgcggggcaggaaagattcaggagtctcattccaagttacatcagggattcctctgtggctgttattgtatttgatgttgcaagcaggcagtcatttctgaacacatccaagtggattgaagaggttcgcactgagcgaggcagtgatgttatcattgtgcttgttggcaacaaaacagatcttgtggacaaaaggcaagtttcaatagaggaaggagaagccaaagctcgtgaactcaatgtcatgtttattgaaactagtgccaaggccggtttcaatataaaggcattgtttcggaagattgcagcagccttgccaggaatggaaacactttcatcaacaaagcaagaagatatggtcgatgtcaatctcaggtcttccaacactaatgcatctcagtcacaaacacagtcaggagggtgtgcctgttgatagaaacatttgagatctaagcgcttcgttcatcttcttattcccttacatgctttatgacattcaaggctgtctataaattttccatgtccacaatttgtagcattggcttttgagtttggttcatttt

SEQ ID NO: 3978 - DNA, 743 bp, Persea americana
caactcgcaaactccagaatccagagatccgatctctggatctcgatctctgaaatggctcctgtttccgctctcgccaagtacaagctcgtgttcttgggcgatcaatccgtcggcaaaacgagcatcatcactagattcatgtacgacaagttcgacaacacataccaggctactattggcattgattttctatcaaagacaatgtatcttgaagatcgtacagttcgattgcagctctgggatacagctggacaggagagattcaggagccttataccaagctatattagagactcctccgttgcagtcatcgtatatgatgtcgcaagccggcaatctttcctgaatacttcaaagtggattgaagaggtccgcacagagcgcggaagtgatgttatcattgtccttgttgggaacaaaacagaccttgtggaaaaacggcaagtctcaatagaggaaggagaggccaaaggccgtgatcttggtgtcatgtttattgagacaagcgccaaagctggcttcaacattaaggccctgttcggaagattgctgctgcactgcctgggatggagacgctttcttcaacaaagcaagaagacatggttgatgtgaatctgaagtctaccaacgcaaactcatctcagtcacagcaacaatcagggggttgtgcttgttaatgcctatttaacctcttattgcttgctcgcctttgtcatttagtgtgccatttgcttttgctc

SEQ ID NO: 3979 - DNA, 1261 bp, Amborella trichopoda
ggttcaaaaatgtttttgaacgaaagctttttacacattgaaaacccgaaatgaacccatagaaattgccgatattttgaataaaaaataggtgaataaataaaaccgagggttgatatatctccgtttgaagcgtgagccctctttcgcagaacattacagttcataaaaccagcctttttctttctttttttgacaataaaccagcgtttttctttctttagccgccatcgactccaccccttcaacaaaattcaaagtgagagagtagagatcaaaccttggaaggttagccatggcgactgtttctcctctagcgaaatacaagctggttttccttggagatcaatcagttggaaagaccagcatcatcaccagatttatgtatgacaagttcgataacacttatcaggctaccattggaattgatttcctatcaaagacaatgtaccttgaagatcgaacagttcgcttgcagctctgggatacagctggacaagagcgatttaggagtcttattccaagctacatcagggattcctctgttgcagtcattgtatatgatgttgcaagccgacaatcatttttgaacacttctaagtggattgaggaagtacgcactgagcgtggtagtgacgttatcattgtccttgttggaaacaaaacggatcttgtggacaagaggcaagtttcaattgaagaaggggaagccaaagcgcgtgatctaggtgtgatgttcatcgaaacaagtgccaaggctggatttaacattaaggctctgtttcgaaagatagctgctgctcttccaggaatggagactctctcttcgacaaaacaagaagacatggttgacgtgaatctcaaggctacgaatgcaaacacatcacaaggccagcaacaagcaggcggatgctcttgttgaaactagtttccatcttcatcggtgtgctctggtccattcgtttgtggactcggctcaagttgtttctctctttccagtttggcggattaatgtgccaaacccttgagaagtgcaagtttgaaatttcagagagagaaagttggctgttatcgcgggagggggcttccttttcatggtagagtccaaagagataattgtattcgtatatggaattgtttgtattcagacacgttgggaaggtttgttgagaggcttggccgtctagaatatgcatatccataaccttatcatgatttctgaatatggtagtttgagctgtagcgctatatatttagaaat

SEQ ID NO: 3980 - DNA, 1110 bp, Amorphophallus konjac
ggtaagggctggcagtcgcgtcccatttgaaacggtagaagagatagagagtgtggaacgacccttcctcgcccctccctctgtctctcccctctcccgcaagcttcttccgatctttaccgccttagaggggtgcattcctctgtggtcagctcggatctgagcgggatcctcccccgccattgctatggcgcccgtgtccgccctcgccaagtacaagctggtcttcctcggcgaccagtccgttggcaagaccagcatcatcacccgcttcatgtatgacaagttcgacaccacctaccaggctactattggcattgactttctgtcaaagacaatgtaccttgaagatagaaccgtgaggttacagctctgggatacagcaggacaggaaagattcaggagtctcattccaagctacattagggattcatctgttgctgtcattgtatatgatgttgcaagtcgacagtcatttttgaacacttcaaagtggatagaggaggttcgcacagagaggggtagtgatgtcatcattgtccttgttggcaacaaaactgacctagtggacaaaaggcaagtctccatagaggagggagaggccaaggcacgagacctcggtgtcatgttcatcgagacaagcgcaaaagctgggttcaatataaaggcactgttccgtaagattgctgctgcactaccagggatggagaccctctcttcgacgaagcaagaagacatggtcgatgttaatctgaagtccaccaacacaagcacatcccagtcacagccgcagtccgggggttgcagctgttagttgcattgcccaatcacgtctcttacccttttttttgtagcggatccctgtatttgcttgttgctccctaaacttaaaatcttcagcgttgccttcagttctccaggagggaattcggacctttatttgagaaaaaagagaactcgcccgaaagtaatggcagcagagttagcctctattctggtgtgttgcctgtagtagagattcttttattaatatgtttaaaatagaacgcctaggtctttagtttgctcattcatggttccattgtctgtacgagactatcagaatgtatt

SEQ ID NO: 3981 - DNA, 1089 bp, Amsonia hubrichtii
acacacttctcctattcccatctaatataaattaataaccattttcccgttgccagggcaacgctgcaacccctaacccctctccttcctcactccttgatacccaggatccacctgtgcataccaaggatttctcctatagttttccggcgagatctcaatcgttagtcgtcggaaaatattggcgcgatccgtctataaaagtttcatattgttaaattcgttagatccaatttatggctccggtttcggctttggcaaagtataagttagtgttcttaggggatcaatccgtcggcaaaaccagtattattactcgatttatgtacgataagttcgacaatacttatcaggctacaattggtattgattttttatcgaagacaatgtatctcgaagaccgaactgtacgattgcagctgtgggatactgctggacaagaaagattcagaagtcttattccaagctatattagggactcctcagttgccgtcattgtgtatgatgttgcaagcagacagtctttcctgaacacttcaaagtggattgaggaggttcgcactgaaagaggcagtgatgtcatcattgtccttgtcggcaacaaaactgaccttgtggacaagaggcaagtatcaattgaggaaggagaagccaaagctcgtgaccttaatgtgatgttcattgaaaccagtgcgaaggctgggttcaatataaaggcactatttaggaaaattgctgcagccttaccaggaatggagacgctttcttctgctaagcaagaagacatggttgatgtcaacctcaagtctagcaacacgaatgcatctcagacacagcaacaatcaggcggatgtgcctgttgatgatgctcgactgaagatgttgttatctgcttcattgatatacattttctttgatctggcataagtatctgtaaagtttacacttgctgatagcatttaaattttgggtgtggttgattcaggatattggaactcatatatcagggaatttgtcattttagttgactagctctagtctctgtaatcttttatacatacggtttatgtcgttatgtagctttacatt

SEQ ID NO: 3982 - DNA, 867 bp, Ricinus communis
tgtttccctgatcggatccgtaaaatggcaccggtatcagcactagcaaagtacaagctggtgttcttgggggatcagtctgtgggtaaaaccagtatcatcactcgcttcatgtacgacaaattcgacaatacctatcaggctaccatcggtatcgattttctatcgaagacaatgtacctagaagatcgaactgttagattgcagctctgggataccgctggacaggaaaggttcagaagccttattccaagctatattagggattcctcagtagcagttatcgtttatgatgttgcaagtaggcaatcattcctgaacacctctaagtggattgaagaggttcgcactgagcggggcagtgatgtcatcattgtactcgttgggaataagacagaccttgtagacaaaaggcaagtttcaatagaggaaggagaagctaaagctcgtgaccttaatgtcatgtttattgaaactagtgcaaaggcaggcttcaacataaaggcactgtttcggaagattgcagcagcattgccggggatggaaacactttcttcaactaagcaagaggacatggtggatgtcaatctgaagtcttccaatacgaatgcttcacagtctcaaccacagtccggaggatgtgcctgttgatacagaaaagtcagatgttaagaaatccattttgcagtagtatcttgcatgctcatttgatcctctacacatctatctgagatgagcttgctcatttgtagaatccaatgtgttgaaaagggccttttcggccaaaacatgtttccaaccagttactagatgtagcaacgaaacaaaaagatacttcctgggaactgcttaaccaggcacctgacg

SEQ ID NO: 3983 - DNA, 1149 bp, Catharanthus roseus
cccctaaccccactcatttctcactgtttgctacgcagcagaattcatctctgcttattaaggaaacgcgtcagatttcttcgatcattttccggcgagatctcaaagccttaattcgtcggaaaatactgctgcgatccgccttcgcaaggtccagtcaattgtttgtttaattcattagatccgatttatggctccggtttcggctttggcaaagtataagttggtgttcttaggagatcaatccgtcgggaaaacaagtattattactcgattcatgtacgataagttcgataacacttatcaggctacaattggtattgattttttatccaaaacaatgtatcttgaagaccgaactgtacgattgcagctctgggatactgcaggacaagaaagatttcgaagtcttattccaagctatattagggactcctcagttgctgtcattgtgtatgatgttgcaagcagacagtctttcctgaacacttcaaagtggattgaggaggttcgcactgaaagaggcagtgatgtcatcattgtccttgttggcaacaaaactgaccttgtggataagagacaagtatcaattgaggaaggagaagccaaagctcgggaccttaatgtcatgttcattgaaaccagtgcaaaggctgggttcaatataaaggcactatttaggaaaattgctgcagccttaccagggatggagacactttcttctgccaagcaagaggatatggtggatgtcaacctcaagtctagcaacacaaatgcatctcaggcacagcaacaatcaggtggatgtgcctgttgatgatgttcaactgaaaatgactttatctgcttcattggtatacattttctttgattgggtgctcaagtatctgtaaagtttaagcttgccgatagcatttgaattttgggtttgattgatcatcaggatattggaactcagatatatcaggaatttgtcaattttactggtaggttgactagctctagtctctgtaatcttcttatatgtatgattatgcggttatctgtagcttctcatattcagattttgtcccccttttttgaacaattttatattcttgtatctggacctaaagtttaaaattttgatgtctttatcgcttgaaaatg

SEQ ID NO: 3984 - DNA, 1290 bp, Eucalyptus grandis
tctctctctcctcttctctctcgtataattaataggcaaaatacaaaaccaaataaatcgctcatcgattcggcacagaaaatccacccttccagcgacgaggtcctgagatctcgatctcgatctcgatctcgctctcgctccgcgctctccgctccatacccttttgaggcgagaggcgagatctcaaccttcctccgatccgctgcgggggttcgtcttgattcggccgacggagagaaactatggccccggtctcggctctcgccaagtacaagctcgtcttcctcggagaccaatccgtcggcaagaccagcatcatcactcgcttcatgtacgacaagttcgacaacacgtaccaggccactatcggtattgattttttatcaaagacgatgtacttggaagatcgaactgtacggttgcagctctgggatactgctggacaagaaaggtttcggagcctgataccaagttacataagggattcttccgtagcagtcattgtttttgatgttgcaagccgacaatcattcctcaatacttccaaatggattgaggaggtccgcactgaaaggggaagcgatgttatcattgtacttgttggaaacaaaaccgatctagtggataagaggcaagtgtcgatagaagagggagaagccaaagctcgtgagttgaatgtgatgttcattgaaactagtgcaaaagctgggttcaacataaaggctttgttccgtaagattgcagccgccttgccaggaatggagacactttcttcaacgaagcaagaagacatggttgacgtcaatcttaagtctaccaacccaaatgcgtctcagtcacaacagcagtctggaggatgtgcctgttgatagattcacgcctgagcatgtcatctttgctgaacatcgtctcgatatatgcttcctttgtcattttgaagtgtcttgtaagtttatattctcatttccttttcatagcatggagattttggtcggtttgtttttgcttgtcctcatacataggattcgtctgattagccttttaggtactgatgttttaaacctggaatgactcagactagtactagtattgtgatataattgaagtctgtttccattctcgaagtggaagaaaggaccttgccgatagagtcgggatttcttggtctctttgcatttatgttgaggaatatagagagctgcaatgctattgaattacatacccgtgtgaatattttcatgctggaaatacaaattgcaatagtttcaatggagggttggctggtca

SEQ ID NO: 3985 - DNA, 1437 bp, Nicotiana benthamiana
aatgcaaccatgttacggaacacagactgcgtgtttcgcccaaccccaacccctcttcaaaccacttatcacgcgctctgctacctccccatacaacacacacacacacacacttaatttctctcgctaaacccacgaatccatactcccatttgctttccccgtgatcattttccggcgagatctctgatactccgtcggaaaatcctgatcggatccgctatctctgaactgcgattcactttgcgatttcgaaagatccgattagatatggctccagtttcggctcttgcgaagtacaagctcgtcttcttaggagatcaatctgtcggcaaaaccagtattatcacgcgattcatgtatgataaattcgataacacttatcaggctacaattggtattgactttctgtctaagactatgtaccttgaagatcgtacagtacgattgcagctatgggatactgcaggtcaagagagatttaggagtctcataccaagctatattagggactcctctgttgctgtcattgtgtttgatgttgctagcaggcagtccttcttaaatacttcaaagtggattgaggaggttcgaactgagaggggcagcgatgttattattgtccttgttggtaacaaaactgatctagttgacaaaaggcaagtttcaatcgaggaaggagaagcaaaagctcgcgaactaaatgtgatgttcattgaaaccagtgcgaaggccggcttcaatattaaacctctttttagaaaaatcgcagcagcattgccaggaatggaaacactgtcttccgctaagcaagaagacatggttgatgtcaacctcaagtcaagcaacccaaatgcgtcccagtcacaaccacagtcaggaggatgtgcttgttaattttatggtttgcaattctatagatttcaactcaagttcttaaattttgttttccatgacaaatgcgtctgtaaatttctttcgactttcgaaacatttgaatactttgagttttgttatttgttaaagttggatacaggaggttgtcgtcctagttgagtaagacctagcatgtgtcacttatttgtattagtctctagacctatgcaatttagcagttttccttttggggaaaaactcttctaagtgcatactatcagttgattcattgtggttctttaataggaaattttggttggacgtgcttgagtaagtgatggttgaacaggatgtagctttgctagtacaatactactctggctgtgacatacttctctgcagatcattttttaaccttgcgcgaaaatttgtgtatggttgaaatagatggtactataaaagcagctacattacggcctcataagtctacttctcgctggaatgtagaccaaatcccgatatgtcactttgagttatctaagagtaaatagttctgtgttc

SEQ ID NO: 3986 - DNA, 1182 bp, Allium cepa
cccacaaaaagccaagcacaaaatcttttccgtacgggttccaacatacggaccggtgctttcatcagtaaaaattagctttgcgactacactgttctttcttttgatcttaaaaatcttaggtgagaattgacggtcaccgtcattttgaatggcgccagtgtctgctctcgcgaaatacaaactcgtgttccttggcgatcagtcggtcggcaagacgagcattatcaccagattcatgtacgacaagttcgataatacttatcaggctaccattggtattgattttctgtccaagacaatgtaccttgaagatcggactgttcgactacaactatgggatacagctggacaagagagatttcgaagtcttattcctagctacattcgtgattcctctgttgctgtcattgtatttgatgttgctagcaggcaatctttcctaaatacttccaagtggattgatgaggtgcgtacagagaggggtggtgatgttatcattgttcttgtggggaacaagactgatcttgtggacaaaaggcaggtttccatagaagaaggtgaggctaaagctcaggaacttggcgtcatgtttattgaaactagtgctaaagctggattcaatatcaaggcattgtttagaaaaatagctgctgcactaccaggaatggagactctctcctcaacaaagcaagaagatatggtcgatgtaaaccttagatctaccaatacaaattcatcaaattcacagccacaatctggatgcagctgttaatactctgcattcagcttcctttagactcagttaaaatttcttaaacagctacagaggaaatctttctgttttctgtttttggacaaatttaaaagatgtgcagatttacttgggtgtatattttgtttacgaatcaccaagtaaaattgaactctcctttctagagttgcagtatcaggaaatgtactcagttagtttgtcagtttattcctgctgacatcaattgtactgttagattgcctggtttagtaaattaatgttgcagagttgtcgtttgccaaatcaagcagaacatatgggtcattacatgggacggtgatttcttatcactttttgttgctctttttggtagaaaagcatgtaataatacgctgaacaaaagaattagtctaaattgtgcatgaaaa

SEQ ID NO: 3987 - DNA, 1119 bp, Carica papaya
attgtggtaggtctataaatagtcttttctttacattcctgagaaacccgaaggtgcggcgtcacgaacgcggagcaaccggtgatctctccggcgtagtggatatattccggcgagatcccgaccttggaacctctctctgttccgatccaaattcggggttcttttctggatagattcgaattatggctccggtttcggctctcgccaaatacaagctggtgttcttgggggatcaatctgtgggaaaaaccagcatcatcactcgcttcatgtacgataaattcgacaatacctatcaggcaactattgggattgattttctatcaaaaacaatgtaccttgaagatcgaacagttcgcctgcagctctgggatactgctggacaggagaggtttaggagtctcattccaagttacatcagggattcttctgtggcagtcattgtatatgatgttgcaagcagacagtccttcctcaacacttccaaatggattgaagaggttcgaactgagcgaggaagtgatgttataattgtgctcgtcggtaacaagacagaccttgtggacaaaaggcaagtttcgatagaggaaggagaagccaaggctcgtgagctaaatgttatgtttatagaaactagtgctaaggctggcttcaatataaaggcactctttcgcaagatagccgcagccttgcccggaatggaaacactttcttcaacgaagcaagaagacatggttgatgtcaatctcaagtcttctaacaactcgtctcagtcacagccacaatccggaggatgtgcatgttgatgtaaatcaatcaatcaaagctcgttctggcaacaattcttgtatgcttctggaagtctccatgaagtctgtaaagtttttgccctgtcccctttttgtagtattgtcattttagtttggttgattgagtggagatcggtgataatcaaggaagtgcttaaaggcaatgtagtagttaggcttagtcctaagcagtgttctttatgcttcttttggagttaagaagacagtttttgcattgtccttaaaaaagtgaaggcagttgttgggtgtatactgttaaacacatgttcagtttcaggtcaactta

SEQ ID NO: 3988 - DNA, 1090 bp, Plantago ovata
ggctcaatgtttatttaatgtaaaattttcgtctcgtccgtctatacagtgccagtacatagtttctctcgtgcagagaaattctcagactagttgcattcccaaaacaattctcgctcctgatcaattttcccggccaaatcaccgaccaaatttccggcgaaaccgtgccccttcatcgtcggaaaaatctcaccgttcattcccgaagatccgatccgtattttttgaatccaattcatggcgccggtttcagctctcgcgaagtacaagctagtgttcctgggagatcaatccgtggggaagactagtattatcactcgcttcatgtacgacaagtttgataatacttatcaggctactattggtattgattttctctccaagacaatgtatcttgaagatcgtactgtacgtttacagttatgggatactgctggacaagaaaggtttaggagtctcatccccagctacataagggattcctctgttgcagtcatagtatttgatgttgcaagtagacaatcctttcttaacacgtcaaaatggatcgaggaggttcgcactgagagaggcagtgatgtcattattgtcctagttggcaacaaaactgatctggtggataagaggcaagtttcaatagaagagggagaggcaaaagcacgtgatcttaatgtcatgttcattgaaactagtgcaaaggctggcttcaatataaaggcactattcaggaagatcgctgcagccttgcctggaatggaaacgttatcatcagcaaaacaagaggacatggtagatgtgaacctcaggtctagcaacacaactggtggtcaggctcaacagcaatcaggaggatgcgcctgctgataacttgtacttaacatctgcagcacggcatctttgtttggttcaaaatctcctgtgtaaagttcttgttataagcatcatcagcgttttgaattttggttgcgatagttttaagtcggattacaaaggattattcttattggggttcgttctattattatgttcttttctcaacacagatcttgtaccattttgcagacccgagttatttgagagtgaagtt

SEQ ID NO: 3989 - DNA, 1115 bp, Rosa hybrid cultivar
aaaaaagagtttctctccctctccgtctccgccaaacaagagatcatctcgtcatatatatatataaatacgcacccaaaccgaaatcgagacaaagaagaaatttccaacgaggctccgagatctcgatctgtccagattatctccggcgagatctcgaccttgaaaatccaacccccgatccacgtagatcccatggctcccgtctccgctctcgccaagtacaagctcgtcttcctgggcgaccagtccgtcggcaaaaccagcatcatcactcgcttcatgtacgataagttcgacaacacctatcaggctaccatcggcattgattttctgtcaaagacaatgtaccttgaagatcgaactgttcgattgcagctctgggacactgctgggcaggaaagattcaggagtctgattccaagttatatccgggattcctctgtggctgtcattgtatatgatgttgcaagcaggcaatcattcctaaacacttccaaatggattgaagaggttcgcaccgagcggggaagtgatgttatcattgtacttgttggaaacaaaacagatcttgtagataaaaggcaagtttcgatagaggaaggagaagccaaagctcgtgacctaaatgttatgttcattgaaaccagtgccaaggctggcttcaatatcaaggctctctttcggaagattgcggcagccctacctggaatggagacactttcttctacaaagcaagaggatatggttgatgtaaacctcaagtcctccaatccaaatgcatcacagtcacagggacagtcaggaggctgtgcatgttgatccttgaatcacatggatttcaaactcaacttttaccccccattcttatatgcttcggtgatccagctctttgtaaagcttagttatcatcccaattctgagttccgcctttttgtagctttggatgagttttgtgtttggttgattgttttacgatatatgaactgtttagaataccacagacttccagaccttaagttaaaagtgatagaagaaacatctttatatggttgtaatttatgcccccagtgtctgataaacgctagttatccctattccagcaatttgagttc

SEQ ID NO: 3990 - DNA, 953 bp, Sarracenia psittacina
ttgacgaccaaaacgagttcacaaattcctctccaacacctgaagttcggagaagacatctcgcgcatcgaaatctccggtgacacctcctagcatcatccggcgagatatcggcaacttccgatccgattcgaccgccggttcaggaggatagatcggagcgatggctccggtttcagctctcgcaaagtacaagctcgtgttcttgggcgatcaatcagttggcaaaaccagcatcatcactcgattcatgtacgataagttcgacaacacgtatcaggctactattggtattgattttctatcgaagacaatgtatctcgaagatcgaacagttcggttgcagctctgggatacggctggacaagaaaggtttaggagtcttattccaagctatattagggattcatctgttgcagttattgtatttgatgttgcaagcagacaatcattcctgaacacttcaaaatggattgaggaggttcgaactgagcggggcagtgatgttataattgtacttgttgggaacaaaactgatcttgtggataagaggcaagtctcaatcgaggaaggagaagccaaagctcgcgatctaaatgtcatgtttattgagactagtgcgaaggccggattcaatataaaggcgctatttcggaagattgctgcagccttaccgggaatggaaacactatcttcaacaaaacaagaagacatggtcgatgtcaacctcaaatctagcaacacgaccgcatctcagtcgcaaccgcagtcaggaggatgtgcctgctgatacatagttgattggagcttgcaaactcattcccatatcgttccgcatccctacgatgcatctgtaagtaaaactgttgattcttaatagctatttttaattttggtgcggttggttaaatttcaactctaagacagtatggtttctctagtttggtaggtag

SEQ ID NO: 3991 - DNA, 1004 bp, Nicotiana tabacum
tccgtgatcattttccggcgagatctctgatactccgtcggaaaatcctgatcggatccgctatctctgaactgcgattcaattggcgatttcgaaagatccgattagatatggctccagtttcggctcttgcgaagtacaagctcgtcttcttaggagatcaatctgtcggcaaaaccagtattatcacgcgattcatgtatgataaattcgataacacttatcaggctacaattggtattgacttcctgtctaagactatgtaccttgaagatcgtacagtacgattgcagctatgggatactgcaggtcaagagagatttaggagtctcataccaagctatattagggactcctctgttgctgtcattgtgtttgatgttgcaagcaggcagtccttcttaaatacttcaaagtggattgaggaggttcgaactgagaggggcagcgatgttattattgtccttgttggtaacaaaactgatctagttgacaaaaggcaagtttcaatcgaggaaggagaagcaaaagctcgcgaactaaatgtgatgttcattgaaaccagtgcaaaggccggcttcaatattaaacctctttttagaaaaatcgcagcagcattgccaggaatggaaacactgtcttcagctaagcaagaagacatggttgatgtcaacctcaagtcaagcaacccaaatgcatcccaatcacaaccacagtcaggaggatgtgcttgttaatttaatggtttgcaattctatagctttcaactcaagttcttacattttgttttccataacaaatgtgtctgtaaatttctttcgactttcgaaacatttgagtactttgagttttgttatttgttaaagttggatacaggaggttgtcgtcctagttgagtaagacctagcatgtgtcacttatttgtattagtctctagacctatgcaatttagcagttctccttttggggaacaactcttctaagtgcatactatcagttgatac

SEQ ID NO: 3992 - DNA, 981 bp, Fagus grandifolia
aaaagaagaagaaagagagccccgggaacaacagtgtcgttgtgatccaaaccacttcacgcgcaaaaaacactctaaaaaaagcacaatacaaaaacccacatatacaacccaaggcaccgagatctccaacagcgcgcccaaatctccgatatataaactctgtgccgatacgagatctcgattccggagtcgtggaataatctagatcctgaaaaatggctccggtatcggctctagcgaaatacaagcttgtgttcttgggggaccagtccgtgggtaaaaccagcatcattactcgcttcatgtacgacaagttcgacaacacctatcaggctaccattggtatcgatttcctgtcaaagactatgtaccttgaagatcgaactgtccgattgcagctctgggatactgctggacaggaaaggttcaggagtctcattccgagctatatcagggattcctctgtggccgtcattgtgttcgatgttgcaagcagacagtccttcttaaacacttccaaatggattgaagaggttcgcacagagcgaggcagtgatgttatcattgtacttgttggcaacaaaacagatcttgtggagaaaaggcaagtttctatagaggaaggagaagccaaagctcgtgacctgaatgttatgtttattgaaactagtgccaaggccggatttaatattaaggcactgtttcggaagattgcagcagccttacctggaatggaaacactttcttcgaccaagcaagaagacatggttgatgtcaatcttaagtctagcaatgcagctgcgatgcagtcacaacaacagtcaggaggatgtgcatgttaatacatgctatggacctgagctccaacttctttgccccatccttaatgcctttccaatcatataaagtgtttgtaaagtcctcgttggtcttttttgttgtatcgttcgttccttttgttggttgttagtaagtagt

SEQ ID NO: 3993 - DNA, 1233 bp, Manihot esculenta
cgcggatagtcagctgacgtcaatccctctccggctctctcaaagtgtaaacacatcagactatcggagagggattctctgatctcgcgatctatctagcgacatcatcgataaattctcggcgagatttcgacttcggatactgtgatagatccgcaagatggctccagtttcggcactggccaagtacaagttggtgttcttgggtgatcagtctgtgggcaaaaccagtatcatcactcgcttcatgtacgacaagttcgataatacttaccaggctactattggtatcgattttctatcaaagacaatgtaccttgaagatcgaacagttagattgcagctctgggacactgctggacaggaaaggttcagaagtcttattccaagctatattagggattcctcagtggcagttattgtttatgatgttgcaagcaggcaatcattccttaacacttctaagtggattgaggaggttcgaaccgagcggggcagtgatgtcattattgtactagttgggaataagacagaccttgtagacaaaaggcaagtttcaatagaggaaggagaagccaaagctcgtgatcttaatgtcatgtttattgaaactagtgcaaaggctggctttaatataaaggcactgtttcggaagattgcagcagccttgccaggaatggaaacactttcttcaactaagcaagaggaaatggtggatgtcaatctgaagtccaacacaaatgcatcacagtctcagccacaatctggaggatgtgcctgttgatatacaaaattgggatctaagcttactcttttggaagcattttgtttgcatgcttctgtaatcctacacatataaagtttgtgtcatccctttgtagcatctggtgtttgactgtttgtttgattgttaaagagaacttgccaacaggagactatacagatatgaattgtggaaaatcatgtgttattgcaaatgtttttgcttagtgtatttgttttatagactatttaatccctagttttgcctttattccacatttaggttattcagtatgccattagtattataggataaattactagttacttctagatattgtttattttttagttttgtaacttttgacaatttaattagttaattttatatctttatttctcctctctcctctatagtgaagggggagggagagagagaggagagatgaatattgggaatgacattctagc

SEQ ID NO: 3994 - DNA, 1092 bp, Gossypium hirsutum
gaggggcaagggatctcgatttcaatctcgttctctccggcagcaccgtctacttgtttccggtgagatctcgacgttggatccgatctcgacccgttccatagcatctcactgaactagatccgattaaccatggctccagtttcagctctggccaaatacaagctggttttcttgggggatcaatctgttgggaagaccagtatcatcactcgcttcatgtacgataaattcgataacacctaccaggctaccattggaattgactttttatcgaaaacaatgtaccttgaagatcgaacagttcgattgcagctttgggatactgctgggcaggaaagattcaggagtcttataccaagttatattagggattcctctgtggcagtcattgtctatgatgttgcaagcaggcagtccttccaaaatacttcaaagtggattgaagaggtgcggactgaacggggtagtgatgttatcattgtgcttgttgggaacaaaacggatcttgtggacaaaaggcaagtctcaatagaggaagcagaagccaaggctcgtgatctccatgttatgtttattgaaactagtgccaaggctggcttcaatatcaaggctttgtttcggaagattgcagctgctttgcctggaatggaaaccctttcttcaacaaagcaagaagacatggttgatgtcaatctcaagtctaccaacgctaatgcatcacagtcgcagcaacagtctggaggatgcgcttgctgatatgaacatcctgatctgagctcatcttttcgacatttcttttacgcttccgagatcctgcaaagtgattgtaaaaaatctatcctcccccctttttatgctgtattgggctttttggatttggtatgtttaagcatatacaacttcacagagatttgttatggtagttaggctagccctaagctgtcctatatgtgtaaggttcttgtgatctcaaaaaactgccaaaatttatggtagtaatagtcatcatggttttgtttttgaaaggagtttagtcaaataaatagtggatttgctctaaaccatgtaaagaatgtttagcttcacatt

SEQ ID NO: 3995 - DNA, 1175 bp, Panax ginseng
acgtccaactagtcgaagaccaaatattatactcccatataatcttgcttcgacatctcctaaatccttgatcattttccggcgagatcttcacctcgttgtcggaaaagtcgtattcgatccgtacattgttatgctgatctacttgtagatcctacttatggctccggtttcggctcttgcgaagtacaaactcgtcttcttaggggatcaatcagttggaaaaacaagtattattactcgattcatgtacgataagttcgataacacttatcaggctacaattggcatcgattttttgtccaagactatgtacctagaagatcgaactgttcgattgcaactctgggatacagctggacaagaaaggtttaggagtctcattccaagctatattagggattcctctgttgctgtcattgtatatgatgttgcaagcaggcaatcattcctgaacacttcaaaatggattgaggaggttcgcaccgagcggggcagtgacgtcatcattgtccttgttgggaataaaactgaccttgtggataagaggcaagtgtctatagaggaagcagaagccaaagctcgcgaccttaacgttatgtttattgaaactagcgctaaagcaggattcaatataaaggcattatttcgaaagattgctgcagccttaccaggaatggaaacattatcttctgccaagcaggaagacatggtcgatgtcaatctgaagtcaaccacgagctcatctcagtcacaaccgcagtcaggaggatgtgcctgttaataccttgaacagtaatcttcacctctgcttggttctcatacttccccgaccatgaaacatatttgtaaaaattcgttgttgaccctagtagtatctaaagtttgagggtttacacaatatgtgaaattaatatattagtagtagtcgggtgtatactgtgttctctgtattaattttttggactattacactatagttcttcaggttcttcttcccagaaattttggtaggcgtattttgaaaatttctattgttggtcattgataattttgagtggttaaaaatttggataaattatggccattgcatatttaagtattatttgtcctacttgaggagcgtttgtattgggtatttgtttttggtaatagaagtactgatgatatgttag

SEQ ID NO: 3996 - DNA, 1125 bp, Gossypium raimondii
aaaggaaaaaaagagagaggggcaagggatctcgatttcaatctcgttctctccggcagcaccgtctacttgtttccggtgagatctcgacgttggatctgatctcgacccgttccatagcatctcactgaactagatccgattaaccatggctccagtttcagctctggccaaatacaagctggttttcttgggggatcaatctgttgggaagaccagtatcatcactcgcttcatgtacgataaattcgataacacctaccaggctaccattggaattgactttttatcgaaaacaatgtaccttgaagatcgaacagttcgattgcagctttgggatactgctgggcaggaaagattcaggagtcttataccaagttatattagggattcctctgtggcagtcattgtctatgatgttgcaagcaggcagtcattccaaaatacttcaaagtggattgaagaggtgcggactgaacggggtagtgatgttatcattgtgcttgttgggaacaaaacggatcttgtggacaaaaggcaagtctcaatagaggaagcagaagccaaggctcgtgatctccatgttatgtttattgaaactagtgccaaggctggcttcaatatcaaggctttgtttcggaagattgcagctgctttgcctggaatggaaaccctttcttcaacaaagcaagaagacatggttgatgtcaatctcaagtctaccaacgctaatgcatcacagtcgcagcaacagtctggaggatgcgcttgctgatatgaacatcctgatctgagctcatcttttcgacatttcttttacgcttctgagatcctgcaaagtgattgtaaaaaatctatcctcccccctttttatgctgtattgggctttttggatttggtatgtttaagcatatacaacttcacagagatttgttatggtagttaggctagccctaacctgtcctatatgtgtaaggttcttgtgatctcaaaaaactgggccaaaatttatggtagtaatagtcatcatggttttgtttttgaaagtttagtcaaataaatagtggatttgctctaaaccatgtaaagaatgtttagcttcacattaagaaattttccttgtcc

SEQ ID NO: 3997 - DNA, 1042 bp, Actinidia deliciosa
agaaaaagcgcacacctacactgtttagcgaccgacatcgaaatctccggcgacgtctacgatcgttttctggcgaggtcttccgattcgaacatccggcttattgtttgatccgagcgatggctccggtttcggctctcgccaagtacaagctcgtgttcttgggggatcaatcggtcggcaaaaccagcatcatcactcgattcatgtacgataagttcgacaacacgtatcaggctactattggtatcgattttctatcaaagacaatgtatcttgaagatcgaacagttcggttgcaactctgggacactgctggacaagaaaggtttaggagtcttattccaagctatattagggattcctctgttgcagttattgtatttgatgttgcaagcagacaatcattcctgaacactgcaaaatggattgaggaggttcgcactgagcggggcagtgatgttattattgtcctcgttgggaacaaaactgacctcgtggataagaggcaagtctcgatagaggaaggagaagccaaagctcgtgatctaaatgttatgttcattgagaccagtgcaaaggccggcttcaatataaaggcactatttcggaagattgcttcagccttgccgggaatggaaacactatcttccgcgaagcaagaagacatggtcgatgtcaatctcaagtcaaccaaccctggggcatcccagtcacaaccacagtcgggagggtgtgcctgctgatacattctcgaagcctcttccttgtatcattcttcgaccctaggatgcatctgtaaagctcttgttctcaatagagattacgtttcgggtgtggttggttaaagggtttagcttaaaacagtttttttttttttttttattgtaaccaaactagttataagatgtgttatctgtacgattttttgggaccaagagcgagtgagacatttttatttggtgaaaggcgtgtgtttggattcaatgcgggttttgttagtgaaattttgcttggaaattctatgaaataaattgatttg

SEQ ID NO: 3998 - DNA, 1181 bp, Nicotiana benthamiana
ttacggaacacagactgcgtgtttcgccgaagcctaacccctcttcaaaacacttatcacgcgctctgctacctccccatacaaaacacacacacacactcttaatttctctcgctaaacccacgatccatactcccatttgctttccccgtgatcattttccggcgagatctctgatactccgtcggaaaatcctgatcggatccgctatctctgaactacgacttagcgatttcgaaagatccgattagatatggctccagtttcggctcttgcgaagtacaagctcgtcttcttaggagatcagtctgtcggcaaaaccagtattatcacgcgattcatgtatgataaattcgataatacttatcaggctacaattggtattgacttcctgtctaagactatgtacctcgaagatcgtacagtacgattgcagctatgggatactgcaggtcaagagagatttaggagtctcataccaagctatattagggactcctctgttgctgtcattgtgtttgatgttgctagcaggcagtccttcttaaatacttcaaagtggattgaggaggttcgaactgagaggggcagcgatgttattattgtccttgttggtaacaaaactgatctagttgacaaaaggcaagtttcaatcgaggaaggagaagcaaaagctcgcgaattaaatgtgatgttcattgaaaccagtgcgaaggctggcttcaatattaaacctctttttagaaaaatcgcagcagcattgccaggaatggaaacactgtcttcagctaagcaagaagacatggttgatgtcaacctcaagtcaagcaacccaaatgcgtcccaagcacaaccacagtcaggaggatgtgcttgttaattttatggtttgcaattctatagctttcaactcaagttcttaaaatttgttttccataacaaatgtgtctgtaaatttctttcgactttcaaaacatttgaatactttgagttttgttatttgttaaagttggatacaggaggttgtcgtcctagttgagtaagacctagcatgtgtcacttatttgtattagtctctagacctatgcaatttagcagttttccttttggggaaaaactcttctaagtgcatactatcagttgattcattgtggttctttaataggaaattttggttggac

SEQ ID NO: 3999 - DNA, 1373 bp, Elaeis guineensis
gaaacctctcggcttcttgttttttcgccggacgcccctcactctcctctccgtgcttccgccctcgagtttgattcggtcgagagatcgctctctcttcggtgatggctccggtctccgcccttgcgaagtacaagctggtgttcttgggggatcaatcggtggggaagaccagcatcatcaccagattcatgtacgacaagttcgacaacacctaccaggctacaattggcattgattttctatctaaaactatgtaccttgaagatcgaactgtcagactgcaactttgggatacagctgggcaggagagatttaggagcttaattccaagctacattcgggattcttctgttgccgtcattgtgtatgatgtcgcaagccgacaatctttcttaaatacttcaaagtggattgaagaggttcgcacagagaggggtagtgacgttatcattgtccttgttggaaacaaaacagaccttgttgacaagaggcaagtctcaatagaggaagcagaagccaaagctcgagatcttggtgtcatgtttattgaaacaagtgccaaagctggcttcaacataaaggcattgttccggaagattgctgctgcactgccagggatggagactctctcgtctacaaagcaggaagacatggttgatgtgaacttgaaggctaccaatgtaaattcatcccagtcacaggggtcatctggaggatgcaattgctgatgctaatcgatgatctgctatgaagtttcaagtgcttcagctggatttgcattgacacttatcaccttctttatagaactgcacggaccttctcagaaaagaaatgggcgacttaggttgtgctgggtgaatcactcttgtctatttgtgtcatagtgtagtttatttctagcatttcatatataatttctagttcatgaagagatcttttagtattgtaattgcagagagtggtaccaagaggactatcagaaacatataaaacaattgtaggtacaggtgcagcagttatttcttgtcttcaggagtataggcagaaaatatgtagttagatcattgacattttcatatttattacctgaattgctggtagtgacatcattgcatccattactggtagttctggcactggactatgtgaaggtgttgatctctgctgccgttcatcatagtggaagattctggctagttcagtaaagagaattttgatttaaactagtgcgatgcaaaagagtgattagttgctgaaagtgagaatttgttattgctgttggtgctctgttagacacttcttgatgtttcaaataaagctatatgcttaattacaatttttgaattgtttttattagactaaaaaaaaaa

SEQ ID NO: 4000 - DNA, 1009 bp, Orobanche aegyptiaca
ctcttccccccaagatcctggttttacccgtcggggaactggggccctatccaaattcgaagatccgataccatttgcttttcatctgacccgaatttgaccgatggctccagtttcggctctggcgaagtataagttagtgtttttgggagatcagtccgtagggaaaacgagtatcattactcgcttcatgtacgataaattcgacaacacgtatcaggctactattggcattgatttcctttcgaaaactatgtaccttgaagatcgaactgtacgtttgcagttgtgggatactgccggacaagaaaggtttaggagtctcatcccgagctatataagggactcctcggttgcagtcatagtatttgatgtggcaagcagacaatcttttctcaatacatcaaaatggattgaggaggttcgtactgagagaggtagtgatgttattgtcgtgctagttggaaacaaaactgacctggtggataagaggcaggtttcgatagaggaaggagagaccaaagctcgtgaacttaacgtcatgtttattgaaactagtgccaaggctggcttcaatataaaggcactattcagaaaaattgctgctgccttgcctggaatggaaactttatcgtcagctaagcaagaggatatggttgacgtcaatctcaaacctaccaatgcaaatgcatctcaatcacaacagcagtcgggatgtgcctgctgataatgtaagaatctcattttgtgcatttatcatattttgatcggaccatgaaaagcatctgtaaagttcttgtccttgacatgaatttctgtattcaaatgttagattgtctttgtagaccctatattctgtttttatatccatacctgtatcattttgtgcacctatttctattgagaccataggtagcttccaccccccacccactgcttgatatgcagggcaaagtttctgtcagatttatttggttttggtatctaagttctgtcagaagtcacaaaa

SEQ ID NO: 4001 - DNA, 822 bp, Plantago ovata
ccaatttcgaataccagtaacgcgcaaaaccgcggcattcacaaaagcttccggccgtcttctccggcgagatcctcaatctcccgtcggcgaaaaaccgaagatccgatccgattcagaataggtacacacaaattcagctcaattcgattgatccatggctccagtttcagctctcgcgaagtacaagttagtgttcctgggcgatcaatccgttggaaaaaccagcattatcactcgattcatgtacgacaaattcgataacacttatcaggctactattggtattgatttcctctccaagacgatgtatctagaagaccgaactgtgagattgcagctctgggatacagctggacaagaaagatttagaagtctcatcccgagctatattagagactcctctgttgcagtcatcgtattcgatgttgcaagcagacagtcctttctgaatactgcaaaatggattgaggaggttcgcactgagagaggaagcgacgtcattattgtcttagttggcaacaaaacagatctagtggataagaggcaagtttcaatagaggaaggagaagcgaaagcacgtgatctcaatgtcatgtttattgaaaccagtgccaaggcagggtttaacatcaaggcactattcaggaagatagcagcagcattaccgggaatggaaactctatcatctgcaaagcatgaagatatggtcgatgtcaacctcaagtctagcaatgcgaatacagctaattcacaacagtcgggaggatgtgcatgctgaatatgtgaactgaaatccatataccatctggtgatattttg

SEQ ID NO: 4002 - DNA, 1020 bp, Tabernaemontana elegans
tcttcctcaccatttgatacgcttagtccacccttgcagacgaaggaaacacgtcagacttctctgatcgttttccggcgagatctcaaaactttggtcgtcggaaaatattggtggcgatccgtttacaaaagttctaatcgattgtttggttgattcattagatccgatttatggctccggtttcggctttggcaaagtataagttagtgttcttaggggatcaatccgtcggcaaaaccagtattattactcgattcatgtacgataagttcgataatacttatcaggctactattggtattgattttttatcaaagacaatgtatcttgaagaccgaactgtacgattgcaactctgggatactgctggacaagaaagattccgaagccttattccaagctatattagggactcgtcagttgccgtcattgtgtatgacgttgcaagcagacagtctttcctgaatacttcaaagtggattgaggaagttcgcaccgagagaggtagtgatgtcatcattgtccttgtcggcaacaaaactgaccttgtggataagaggcaagtatcaatcgaagaaggagaagccaaagctcgtgaccttaatgtgatgttcattgaaaccagtgccaaggcagggttcaatataaaggcgctatttaggaaaatcgctgcagccttacccggaatggagacactttcttctgccaagcaggaggacatggttgatgtcaacctgaagtctagcaacacaagtgcatctcagacacagcaacaatcaggtggatgtgcctgttgatgatgttcgactgaagatgatgtcatctgcttcagcgatatacattttctttcatctggctcgagtatctgtaaagtttcacttgctgatagctcttaaattttgggtgtggtttgttgtcaggatattggaacagggaggttgttattttagttgattagctagcctctgtaatctcttatatgtatgattatgcggatctgtagctttatgttaagat

SEQ ID NO: 4003 - DNA, 1247 bp, Solanum lycopersicum
aaaaaaatttatgagagccagcaaatcaccacaatgcaaccatgttactgaatacagactccgtgtttcgccaaacctattcaaaaacactactcacgcgcaccgcaccctcccaatacacacactctccccctctctgtttctcgctaaagcccacgaatccacactcccctttgctctctccgtgatcattttccggcgagatccctggtactccgtcggaaaatcctgatcggatccgccatctctttttttttgttactggattcagtttctcgtaccgaaagatccaattagatggctccggtttcggctctcgcaaagtacaagctcgttttcttaggagatcaatccgtcggcaagaccagtattatcacgcgattcatgtatgataaattcgataacacctatcaggccacaattggtattgacttcctatcgaagactatgtacctggaagatcgtacagtaagattgcagctatgggatactgcaggtcaagagagatttaggagtctcattcccagctatattagggactcctctgttgctgtcattgtgtatgatgttgcaagcaggcagtcctttttaaacacttcaaagtggattgaggaggtccgaactgagaggggcagtgatgttattattgtccttgttggtaacaaaactgatcttgttgagaaaaggcaagtttcaattgaggaaggagaagcgaaagctcgcgaactaaatgtgatgtttattgaaaccagtgcaaaggctggcttcaatattaaacctctttttaggaaaattgcagcagcattgccaggaatggagacactatcttcggctaagcaagaagacatggttgatgtcaatctcaagtcaagcaactcaaatgcatcccaatcacaggcacaatcaggaggatgtgcttgttaattttatggtttgcaattctatagtttttcgactcagttttatattttgcttttgacaacaagtattatctgtaaagttctttgttgactttggtaaaatttgattttttttgtttttggtgtttgttgaagttggacacaggttgtcatcctagttgcgtaagacttttagtatgttttcacttatttgtatcagtctctagacctatgcaatttagcagcccccttatggaacaagtctttttaagtgcatgttatcagttttgtaatcagaaattttggttggacgttcttgagtgagtaatggttgaacgcattgaaact

SEQ ID NO: 4004 - DNA, 981 bp, Zostera marina
ggttaataaaagagttgaatcggactccatttcatttttgttcaaaatagatctagtgagagagaaagggcggagagtgagtgagagtttgtctttggatccatcgatctgtgagtagtagtggtggtgtttgatctgagatggcaccggtttcggcccttgcgaagtacaagttagtgtttttgggagaccaatcggtggggaaaacaagcatcatcactagattcatgtacgacaagttcgacaacacttatcaggctacaattggtatcgattttctatcaaaaacaatgtatctcgaagacagaacggtccgactgcagctctgggatacagcagggcaggaaagattcagaagtctcattccaagctatataagagactcttctgttgctgttattgtatatgatgttgcaagccgattgtcttttttgaacaccttgaaatggatagaagaggttcgtactgagagaggaagtgatgtcatcattgtgctggttgggaacaaaactgacctcgtggacaaaaggcaagtatcaattgaggagggagagggaaaagcccgtgaacttggtgttatgtttattgaaacaagtgctaaagctgggtttaatataaaggcattgttcaggaaaattgctggtgcattgcctggaatggagactctttcttccacaaaacaagaagatatggttgatgttaatctgaaaacaactaattcaaattcttcacagacacaggcatcagctggaggatgcagttgctagtgtgctgttgcttatagggtagactataatgtcagagtctcggagatggtttaaagagatatggtttcaaaaatttaaacatgatttgatagttaaatatttgtgtgctctctgtaatcaactgatcatgaagatttgttatttttgttattaattttcctccaatgcttattaatatgtttctagatgatccatcgtaaataaattattcttg

SEQ ID NO: 4005 - DNA, 1141 bp, Sarracenia psittacina
aaactcaaattcgaattagtcgaacagttgcattgtgtccgtttctggcgagacactgcctgtgaaatccatctgcctacgaagacgcatgaacgatctggaaacgataccacaattattgaattatctagcgatccccgaccgttttccggcgagatatcggcactttcaaactcgatcagctggcttattgcggtagatctgagcgatggctcccgtgtcagctctcgccaagtacaagttagtgttcttgggcgatcaatcggttggcaaaaccagcatcataactcgattcatgtacgataagttcgataacacgtaccaggctactattggtatcgattttctatcaaaacgatgtatctggaagatcggacagttcgattgcagctctgggatactgctggtcaagaaaggtttaggagtcttattccaagctatatcagggattcctctgtagcagttactgtgtacgatgttgcaagtaggcaatcattcttgaacacctcaaaatggattgaggaggttcgctctgagcggggcagtgacgttataattgtccttgttggcaacaaaactgaccttgttgataagaggcaagtctcaatagaggaagcagaagctaaagcccgtgacttgaatgttatgtttatcgaaaccagtgcaaaggctggcttcaatataaaggcattatttcgaaagatcgcagcagccctaccgggaatggaaacgctatcttcagcaaagcaagaagacatggtcgatgtcaatctgaagtctagcaatgcagcttcgtctcagtcacaacagcagtcgggaggatgttcctgttgatatagagccggccaaggattcctgcctcattatctgttaaaacagcgtttggttttggccttttgaatttggtaagtaatttaaactgtttagctcaaatgaggtagttaacgttatagagtttgtttggtttgttagtaaaagtaaactattatagataagatcaataatacagtttgtcatgtactaaaagagtattgattgagagtagtagaacttatgaataaatagtttttctacgaaaattcgaaaaaacttatgggacggtaaccagtccggacctatccaaaccatgcaaatatgttgg

SEQ ID NO: 4006 - DNA, 751 bp, Triphysaria pusilla
ttacttttgaagtttcctggcgatctccgatcattttccggcgagatcggtaaactcccgtcggaagagaaagaagcaacccatctgataccaaacctccgatctgctacaaatctgactatggctccagtttcagctctcgcgaagtacaaattagtctttctgggagatcaatctgtttgggaaaaccagtattattactcgattcatgtacgataaattcgataacacttatcaggctactattggtattgatttcctgtccaagacaatgtatcttgaagatcgaactgtacgtttgcagctctgggatacagctggacaagaaagattcaggagtctcattcccagctacatacgggactcctcggttgcagtcatagtatacgacgttgcaagtcgacagtcgtttcttaacactacaaagtggatcgaagaggttcgtactgagagaggaagtgatgttattattgtcgttgttggtaataaaaccgatcttgtcgataagaggcaagtttcgatagaagaaggtgaagctaaatctcgtgatcttaatgtgatgttcatcgaaactagtgctaaagctggcttcaacataaagccattgtttcggaagattgcagcagctttgccgggaatggaaactttgtcatcggcaaaacaagaagatatggttgatgtaaacttaaagtctagcaatgctaattcgtctcagtcacaacagaatgccggtggatgtgcttgctgatga

SEQ ID NO: 4007 - DNA, 948 bp, Musa acuminata
tctctctctctctctctctccgtcttccgctcttttgaattcccaggtctctttagatcgagctcctcgtccttgttccgttcttcgcgttcgatctcccgggaggaacatcatggccccagtgtcggcgctcgccaagtacaagctagtgttcctgggggatcagtccgtggggaagacgagcatcatcacccggttcatgtacgacaagttcgacaacacctatcaggctacaattggcatcgattttctgtcaaagactatgtaccttgaagaccgaacagtcagactgcagctatgggacacagctgggcaggagagattcaggagcctaatcccaagttacatacgggactcttcggttgcagtcattgtatatgatgttgcaagtcggcaatctttcttaaatacttcaaaatggattgaagaagttcgaacggagaggggaagtgatgtcatcattgtcgttgttgggaataaaacagacctggttgacaaaaggcaagtctctatagaggaaggagaagctaaagcacaggaacttggtgtcatgttcattgagacaagcgcaaaagctggcttcaatataaaggctctgtttcgaaagattgctgctgctctcccagggatggaaaatctttcttcaactaggcaggaagacatggtcgatgtaaatctgaaggccacaaatgcgaattcatatcagtcgcagcaacagtctggaggttgtagctgttgaatttatcatatttatagaggtgttgtatttactcagattccatcgacttataaaactgcatcagcaaaattaggatgggatggtttatggtagttttgcctgcgcaagtcttctgttatttcctggtgtgtgctaaacattattttctgcattttcagattattttttcttgttagagggatcatgtattcttcaattgcagagagagg

SEQ ID NO: 4008 - DNA, 1003 bp, Ricinus communis
agcaaaactgcgctctcttccctctttttggagtcgaacccaacaaaaatcaaaaccaatctcatcaatttaaaattattacgactaacttagaaggatcagagattggttaattacagagagagatctgagaaatggcaccagtctcagctctcgcaaagtataagcttgtatttctgggcgatcaatctgtcgggaaaacaagcattattactcgcttcatgtatgataaatttgataacacctatcaggctacaattggtattgattttctatcaaaaaccatgtaccttgaagatcgaactgttcgtttgcagctgtgggatacagctggacaggaaagatttagaagtctcataccaagctacattagggattcatcagttgcagtcattgtgttcgatgttgcaagtcggcaaactttcctgaatacttcaaaatggattgaagaggttcgcactgaaaggggtagtgatgtgatcattgtccttgttgggaataagactgaccttgtggagaaaaggcaagtctctatagaagaaggagaagctaaagctcgtgaccttaatgtcatgtttatagaaactagtgcaaaggctggttttaatatcaaggcattgttccgaaaaattgctgctgccttaccaggcatggagacactttcttcaacaaagcaagaagacatggttgacgtgaatctgaagtctaccagtaaaactgcatcgcagtctcaggcccagtcaggtggatgtgcttgttgattcttggaaactttggcttaccaattctctgattgttgctattagaaatctcaaaacagtttttgctctggatttgtaaatgtttagtttgctttccatttgtctttcctgtttgcttgaggaacttcattttcacaaatggctgaagagcttcggactataaagagctgtgattcactctcgtgtttcttaggttggtcatagcttccaggatatgcagttcagtcgaacacattgtttcg

SEQ ID NO: 4009 - DNA, 1598 bp, Cocos nucifera
cacaaacagtccccatacacggtctcgctgtcctggcgtccctggaacaaaatcaggcaataaaaggccagctaggtaatcagctttcgaggcctaaacgattctggcggaacatcaaacgagtatagccgacgcagttcaccgtgcgccaccgaaggtgcctaaaaacgaattggaagtggagaagaactgcgaaaaagaaaataagaaggaccggcggagcaaaagagaaacctctcggcttcttgttgtcgccggacgcccctcactctcctctccgtgcttccgccctcgagtttgattcggtcgagagatctttctctcttcggtgatggctccggtctccgcccttgcgaagtacaagctggtgttcttgggggatcaatcggtggggaagaccagcatcatcaccagattcatgtacgacaagttcgacaacacctaccaggctacaattggcattgattttctatctaagactatgtaccttgaagatcgaactgtcagactgcaactttgggatacagctgggcaggagagatttaggagcttaattccgagctacattcgggattcttctgttgctgtcattgtgtatgatgttgcaagccgacaatctttcttaaatacttcaaagtggattgaagaggttcgtacagagaggggtagcgacgttatcattgtccttgttggaaacaaaacagaccttgttgacaagaggcaagtctcaatagaggaaggagaagccaaagctcgagatcttggtgtcatgtttattgaaacaagtgccaaagctggcttcaacataaaggcattgttccggaagattgctgctgcactgccggggatggagactctctcgactacaaagcaggaaggcatggttgatgtgaatttgaaggctaccaatgtaaattcatcccagtcacagggaccatctggaggatgcaattgctgatactaatccatgatctgctatcaagtttcaagtgcttcagctggatttgcattgacacttatcaccttctttatagaactgcatggacctacttggaaaagaaatgggtgactgaggttgtgctgggtgaatcactcttgtcaatttgtgtcatggtatagtttatttctagcatttcatatataatttctagttcatgaagagatcttttagtattgtaattgcagagggtggtaccaagtggactaccggaaacatataaaacaattgtaggtacaggcgctgcagttaattcttgtcttcaggagtataggtagaaatatgtagttagatcattgacattttcatatttattacctgaattactggtagtgacatcattgcatccattaccggtagttctggcactggccgaccatgtgaaggtgttgatctctgctgccgttcatcacaatggaagattctggctggtgcggtaaagagaattttgatttaaactattcgtgcgatgcaaaagagtgaatacatagttgctgaaagtgagaatttggtattgctgttggttctctgtcagagacttcttgatgtttcaaacaaagctatatgcttaattataatttttgaatatttttattaaaaa

SEQ ID NO: 4010 - DNA, 1112 bp, Gossypium hirsutum
aaaataaaagacgctagggatctcgatctcgatctcgatcccgatcccaatctcattctctccggcgacacctttctctaaccgtttccggtgagatctcgaggttggatccgatctcgacccgattcatagtgtctctttgacctagatccgaaccaccatggctccagtttctgctttggccaaatacaaacttgttttcttgggagatcaatctgtcgggaaaaccagtatcatcactcgctttatgtacgataaattcgataatacttaccaggctaccattggtattgactttctatcgaaaacaatgtacctcgaagatcggacagttcggttgcagctctgggatactgctggacaggaaagattcaggagtcttattccaagttacattagggattcctccgtggcagtcatcgtctatgatgttgccagtaggcagtccttccaaaatactacaaaatggattgaagaggtacgaaccgagcgcggtagtgatgttattattgtgcttgttgggaacaaaactgatcttgtggacaaaaggcaagtctcagttgaggaagccgaagccaaggctcgtgacctcaacgtaatgtttattgaaactagtgccaaggctggcttcaatatcaaggctctttttcggaagatcgcagccgctttacctggaatggaaacactttcttcaacaaaacaagaagacatggtcgacgtcaatcttaagtctacaaacgcaaattcatctcagtcgcagcaagaagccggaggatgtgcctgctgaggatacatacatacattacactcactcacacacatcatttgatccgaggtatgtatggttttctcaacatttagtgttttctgtaaaaagaaaaaaagaaatctgttctctcccaccccctttttggtagcattgggcatatttggatttgatggaatgttttgaagcataaaagttgcttgagagagaaggttcttaaattttaccaatggtagttaggctcgtcctaacctgtcctatatgtgtacggttcttgttatctcttacaattgtgccaaatttgatgttactcgtatatttcaaaaaaaaaaaaaaaccgaacctc

SEQ ID NO: 4011 - DNA, 1091 bp, Gossypium hirsutum
aaataagacgctagggatctcgatcccgatcccgatcccaatctcattctctccggcgacacctttctctaaccgtttccggtgagatctcgaggttggatccgatctcgacccgattcatagtgtctctttgacctagatccgaaccaccatggctccagtttcggctttggccaaatacaagcttgttttcttgggagatcaatctgtcgggaaaaccagtatcatcactcgctttatgtacgataaattcgataatacttaccaggctaccattggtattgactttctatcgaaaaccatgtacctcgaagatcggacagttcggttgcagctctgggatactgctggacaggaaaggttcaggagtcttattccaagttacattagggattcctccgtggcagtcatcgtctatgatgttgccagtaggcagtccttccaaaatactacaaaatggattgaagaggtacgaaccgagcgcggtagtgatgttattattgtgcttgttgggaacaaaaccgatcttgtggacaaaaggcaagtctcagttgaggaagccgaagccaaggctcgtgacctcaatgtaatgtttattgaaactagtgccaaggctggcttcaatatcaaggctctttttcggaagatcgcagccgctttacctggaatggaaacactttcttcaacaaaacaagaagacatggtcgacgtcaatcttaagtctacaaacgcaaattcatctcagtcgcagcaagaagccggaggatgtgcctgctgaggatacatacatacattacactcactcacacacatcttttgatccgaggtatgtatggttttctcaacatttagtgttttctgtaaaaaggagaaaaagaaatctgttctctcccaccccctttttggtagcattgggcatatttggatttgatggaatgttttgaagcataagagttgcttgagagagaagattcttaaattttaccaatggtagttaggctcgtcctaacctgtcctatatgtgtacggttcttgacaattgtgccaaatttgatgttactcgtatatttcagttttgtggctttttactt

SEQ ID NO: 4012 - DNA, 932 bp, Solanum melongena
ctcttcaaaaacgctcctcacgcgcatcgctccctcccgatacacacacactccctctctgtttctcgctaaagcccacgaatccacactcccctttgctctctccgtgatcattttccggcgagatctctgataatccgtcggaaaatcctgatcggatccaccatctcttttttactggattcactttgtcataccaaaagatccgattagatggctccggtttcggctctcgcgaagtacaagctcgttttcttaggagatcaatctgtcggcaagaccagtattatcacgcgattcatgtatgataaattcgataacacctatcaggccacaattggtattgacttcctgtcgaagactatgtacctggaagatcgtacagtaaggttgcagctatgggatactgccggtcaagagagatttaggagtctcataccaagctatattagggattcctctgttgctgtcattgtgtatgatgttgcgagcaggcagtccttcttaaacacttcaaagtggattgaggaggttcgaactgagaggggcagtgatgttattattgtccttgttggtaacaaaactgatcttgttgagaaaaggcaagtttcaatcgaggaaggagaagccaaagctcgcgaactaaatgtgatgttcattgaaaccagtgcaaaggctggcttcaatattaaaccactttttaggaaaattgcagcagcattgccaggaatggagacactatcttcagctaagcaggaagacatggttgatgtcaatctcaagtcaagcaacacaaatgcagcacaatcacaggcacaatcaggaggatgtgcatgttaattttatggtgtgcaattccatagttttcgactcagttttacattttgttttttggcaagtattgtctgtaaagtttttttgttgacttccgc

SEQ ID NO: 4013 - DNA, 994 bp, Fagopyrum esculentum
acgaacgcagccatcagcgttttgcctttgtcgtctcatctctccacctcaaaggagcgaagagagacaaccgaaatcacttggattcaattcatccaagaactgtatttcttcagaatcgtgaactaactgcaggatcatttcaagttatttcgattttggttcgcatcaatggcgccggtttcagccctcgccaagtataagctcgttttcttaggagatcaatccgtcggtaaaacaagcattattactcgattcatgtacgacaaattcgataacacataccaggctacaattggaattgattttctatcaaagacgatgtatcttgaagatcggactgtacgtttgcagttgtgggatacagctgggcaagaaagatttaggagtcttatacccagttacataagggattcatctgttgcagtcattgtatatgatgttgcaagtcggcaatcttttctcaatacacaaaaatggattgaggaggttcgaactgagagagggagtgatgttatcattgtccttgttggaaataaaactgaccttgtggataaaagacaagtatccattgaagaaggagaaggcaaagctcgtgatctcaatgtcatgttcattgaaaccagtgcgaaggctggatttaacattaagccactcttccgaaagattgctgctgcattacctggaatggaaacactttcatcaacgaagcaagaggacatggtcgacgtaaacctgaagcctgatccaaactcatcacagtcacagcctcaatcaggcggatgcgcttgctaaacaacattgttagtcgtaaagtgccttcttttgcttcttttcctgtacccttcttttgttttgtatttctttgaatctagaagacatgtgtgctcttatatttttctttctcagggactatagccataattttaaggatctagaaatgattgtcatattcatttttgttggtggtaaatggcattatgtgtgatggtgt

SEQ ID NO: 4014 - DNA, 1121 bp, Gossypium raimondii
aaaaaatattattaaaaatataaaataaaataagacgctagggatctcgatcccgatcccgatcccaatctcattctctccggcgacacctttctctaaccgtttccggtgagatctcgaggttggatccgatctcgacccgattcatagtgtctctttgacctagatccgaaccaccatggctccagtttcggctttggccaaatacaagcttgttttcttgggagatcaatctgtcgggaaaaccagtatcatcactcgctttatgtacgataaattcgataatacttaccaggctaccattggtattgactttctatcgaaaaccatgtacctcgaagatcggacagttcggttgcagctctgggatactgctggacaggaaaggttcaggagtcttattccaagttacattagggattcctccgtggcagtcatcgtctatgatgttgccagtaggcagtccttccaaaatactacaaaatggattgaagaggtacgaaccgagcgcggtagtgatgttattattgtgcttgttgggaacaaaaccgatcttgtggacaaaaggcaagtctcagttgaggaagccgaagccaaggctcgtgacctcaacgtaatgtttattgaaactagtgccaaggctggcttcaatatcaaggctctttttcggaagatcgcagccgctttacctggaatggaaacactttcttcaacaaaacaagaagacatggtcgacgtcaatcttaagtctacaaacgcaaattcatctcagtcgcagcaagaagccggaggatgtgcctgctgaggatacatacatacattacactcactcacacacatcatttgatccgaggtatgtatggttttctcaacatttagtgttttctgtaaaaaggagaaaaagaaatctgttctctcccaccccctttttggtagcattgggcatatttggatttgatggaatgttttgaagcataaaagttgcttgagagagaagattcttaaattttaccaatggtagttaggctcgtcctaacctgtcctatatgtgtacggttcttgacaattgtgccaaatttgatgttactcgtatatttcagttttgtggctttttactttgt

SEQ ID NO: 4015 - DNA, 933 bp, Vitis vinifera
aaagattcaaaattcaaagccttctctctctcgcaactcataattcgaaaacaaacagatccatctctctcccatacgaatcgaatctaaccaaaccctaaccctaatcctggattaaactaagctataccctgtaatttgaagaaatcaggccggttctggttccatcgtgatccctacaaatggctccagtttctgctctggccaaatacaagcttgtcttcttaggggatcagtctgtcgggaaaaccagcatcatcactcgattcatgtacgacaaattcgataatacctatcaggctacaattggtattgatttcctatcaaagaccatgtatcttgaagatcgaaccgttcgtctgcagttgtgggatacagccgggcaggaaagattcaggagtctcattccgagctacattagggattcatctgttgcagtcattgtatatgatgttgcaagtcggcaatctttcctaaacacttcaaagtggattgaagaggttcgcactgagagaggtagtgatgttattatcgtccttgttggaaacaagactgaccttgtggagaaaaggcaagtctcaatagaggaaggagaagccaaagctcgtgaacttaacgtcatgttcattgaaacaagtgccaaagctggcttcaatataaaggcactgtttcggaaaattgcagcagctttaccaggaatggaaacactttcttcagcaaagcaagaagacatggttgatgtgaatctgaagtcgtcaagtggcagtgcatcacagtcccaaactcaggcacgtggatgctcttgttgacaacgttgcctcaaagccttgcaatctatatgcccaatctcaccccagatctgtaaaggtttcattttgttgccttcttttgttaccattttgtatgaggaactccttttgagacagaagtggc

SEQ ID NO: 4016 - DNA, 1070 bp, Olea europaea
ctcatttcgaggaagcaaacacgcaagcccgcagagggactagccttacgaagccatatcgatttctccggcggaatctcccgatacatttttcctgcgagaccttaaacctcaatcggaaaatccgatccgctccatttacagaagatccgaattcaattcattggacatttctggatttgattgatggctccggtttcagctctcgcgaagtacaaattagtgttcttaggagatcaatcggtcggaaagactagtattatcacaagattcatgtacgataaattcgataacacttatcaggctactattggtatcgacttcctttcaaagacaatgtaccttgaagatcgaacagtaagattgcagctttgggatactgcgggacaagaaagattcaggagtctaattccaagctacataagggactcctctgttgcagtcattgtatacgatgttgcaagcaggcagtccttcctcaacacttcaaagtggattgaggaggttcgcactgagagaggcagtgatgtcatcattgtggtagttggcaataaaactgacctagtggaaaagaggcaagtctcaatagaggaaggagaggccaaagctcgtgacctaaatgtcatgtttattgaaacaagtgccaaggctggcttcaatataaaggcactatttcgcaagattgctgcagccttgccaggaatggagacgctatcctcagcaaagcaagaggacatggttgatgtcaacctcaagtcgagcaacacaaatgcgtctgtgtcacaacaacagtcaggaggatgcgcatgttgattgaaggaccgtatgattcattattatgttttgggatcgacccttcaatccggctgtaaagttcttccttctcactggttgcatttgagtttacgttgtagttcactactactgtgttatctcgtacctgtatcactttgtggacatgtagttatcaaggccttaaatagtcagattatttttgtcagcgagttatatttgtagtgtattacattacttgtggtgtctttcagatttgttacaggaaattttgattt

SEQ ID NO: 4017 - DNA, 1375 bp, Phalaenopsis aphrodite
aggaagaaaagccagcaggggtggactcgcagggcagcacacgcaggcggcccgaaagaacagaatcaaaatgaaaacctaaattaacggaagcagcgagagcctcgatcggagatctccgattatcgcccgcctgttctttctgattctccttccgttggatcttgtaggtggaaccggcggcgatggctccggtgtcggccctcgccaagtacaagctggtgttcctaggcgatcagtctgtggggaagaccagcatcatcactcgatttatgtacgataagtttgacaacacctaccaggctactatagggattgattttctttcgaagacgatgtatttggaagatcgaactgttcggctgcagctttgggatactgcagggcaggagaggttcaggagtctcattcctagctatattcgtgactcctctgtcgcggtcattgtgtatgatgttgcgagtcgtcaatctttcctgaacacagcaaagtggatagatgaggtccgcacggagaggggcagtgatgttattattgttcttgttgggaacaaaaccgatcttgttgataaaagacaagtttcgatagaggaaggcgaagctaaagcacaagaacttggtgttatgttcattgaaacaagcgccaaagctggtttcaacattaaggcactgttccgaaagatcgcggcagccttgccggggatggagaatctgtcatcaacaaagcaggaagacatggtcgaggtgaatctgaaatcgagcaatgcaagttcttctcagtcacagccacagtctggtggatgcagttgttgatgtcagaaacagactgttcagctaaattgtgagggaagttttcatatatagcacataattttaggtatttatatatctcacgttgaaactttcatatttgcatatatgacacttaaatgttttaaatttatgcatgaaaatgtgtatttcacttttaaaaaccaatataatgttatttttgatgttataataaagatttgagtgctgtgtgtaaatatgaaagtttagttgtgagatatgtagatacataagaattgtttgctatgcatgtagatgccccagctgtgttttaatttcttttggttctcttataatacaataactgaagcatcgtccttatgtttgatcactaagatctcagctctttccaagtaagaactccaatgtctctcctactttgttgtattattaatatgttggtcttggtttctgtaactatttgtgtaggttttaattgtttttctttgagatttttacattatattttcacttgtaatggtaacatttgagtagcagcccaatgctacaatgttatggatattctatgcatagagaaactactt

SEQ ID NO: 4018 - DNA, 1324 bp, Cajanus cajan
gagataggcttgaatttcattttatttaatattttggtgctgcgtggatgcaatcccattaaataagacataaagtgcaatagttaaatctctccgcgtcttcttgttcctttcgccgagaatccgagatcaacccctgccttcgtcggggtttttctcggcttcttctgattcctctttcgcttcgaaatggcgccagtttcagctttggccaagtacaagcttgtgttcttgggtgaccaatccgtcggcaagaccagcatcatcactcgtttcatgtacgataaattcgacaacacctatcaggctacaattggtattgattttctatcaaaaactatgtatcttgaagaccggactgttcgactgcaattgtgggatacagctggacaggaaagatttagaagtcttattccaagctacatcagggactcatctgtagctgttattgtatttgacgttgcaagtcggcagactttcttaaatacatcaaagtggattgaagaggtgcgaacagagagaggcagtgatgtcattattgttcttgttgggaacaaaactgatcttgttgaaaaaagacaagtctctatagaggaaggggaagcaaaagcacgtgagctcaatgtcatgttcattgaaactagtgctaaggctgggtttaacataaaggccctttttcgaaaaattgcagcagcattacccggaatggaaacattatcttctgcaaaacaagaagacatggttgatgtaaacttaaagtctacaagtggcagttctcaatctcaaccccagtcaagtggatgttcttgttaaatatgccttatattgtgcggtgcacctttttgtgtcatgcctttgttttatgcaggttttactttagtcttctacagcattatatgaaagatgaaagaatatacaagtggtgcagggtaggggttgatacaagttctgtctagaatgttgttgttagttgattatgcctgcgataatgtactagagagtagtaaagctggccaaccaagaattgaattatgttcattgtaccctataaaacgtgtgataagattagaagttaacttgttcatttggattgtgacatatgtttctgtttaacttgttcatttggatttacttgttcatggtaccatgattttccatcttgctagggctttctagccaagtgtccacaacaataatgataattctgacaatggtggccggggaagaccgagtctagtagttttagatctattatgttcttagcaattagcccctctgcaaaatatggaaatacataaccaaaacaattttcattgaatgtcta

SEQ ID NO: 4019 - DNA, 1190 bp, Solanum tuberosum
tgaagacagactccgtgtttcgccaaacctcttcaaaaacactactcacgcgcaccgcaccctcccaatacacagactctcccctctccgtttctcgctaaaagcccacgaatccacactcccctttgctttctccgtgatcattttccggcgagatccctggtactccgtcggaaaatcctgatcggatccgccatcacttttttttactggattcactttctcataccaaaagatccaattagatggctccggtttcggctctcgcaaagtacaagctcgttttcttaggagatcaatccgtcggcaagaccagtattatcacgcgattcatgtatgataaattcgataacacctatcaggccacaattggtattgacttcctgtcgaagactatgtacctggaagatcgtacagtaagattgcagctatgggatactgcaggtcaagagagatttaggagtctcattcccagctacattagggactcctctgttgctgtcattgtgtatgatgttgcaagcaggcagtcctttttaaacacttcaaagtggattgaggaggttcgaactgagaggggcagtgatgttattattgtccttgttggtaacaaaactgatcttgttgagaaaaggcaagtttcaattgaggaaggagaagcgaaagctcgcgaactaaatgtgatgtttattgaaaccagtgcaaaggctggcttcaatattaaacctctttttaggaaaattgcagcagcattgccaggaatggagacactatcttcagctaagcaagaagacatggttgatgtcaatctcaagtcaagcaactcaagtgcatcccaatcacaggcacaatcaggaggatgtgcttgttaattttatggtttgcaactctatagttttcgactcagttttatattttgtttttgacaacaaagtattatctgtaaagttctttgttgactttcgtaaaatttgaattttttgtttttgtttttggtgtttgttaaagttggacacagaggttgtcatcctagttgagtaaagacttagtatgttttcacttatttgtatcagtctctagacctatgcaatttagcagcccccttatggaacaagtctgttatcagctgattcattgcagttttgtaatcagaaatttttggttggacgttcttgagtgagtaatggttg

SEQ ID NO: 4020 - DNA, 1218 bp, Solanum phureja
ttactgaagacagactccgtgtttcgccaaacctcttcaaaaacactactcacgcgcaccgcacccgcccaatacacacactctcccctctccgtttctcgctaaaagcccacgaatccacactcccctttgctttctccgtgatcattttccggcgagatccctggtactccgtcggaaaatcctgatcggatccaccatcacttttttttactggattcactttctcataccaaaagatccaattagatggctccggtttcggctctcgcaaagtacaagctcgttttcttaggagatcaatccgtcggcaagaccagtattatcacgcgattcatgtatgataaattcgataacacctatcaggccacaattggtattgacttcctgtcgaagactatgtacctggaagatcgtacagtaagattgcagctatgggatactgcaggtcaagagagatttaggagtctcattcccagctacattagggactcctctgttgctgtcattgtgtatgatgttgcaagcaggcagtcctttttaaacacttcaaagtggattgaggaggttcgaactgagaggggcagtgatgttattattgtccttgttggtaacaaaactgatcttgttgagaaaaggcaagtttcaattgaggaaggagaagcgaaagctcgcgaactaaatgtgatgtttattgaaaccagtgcaaaagctggcttcaatattaaacctctttttaggaaaattgcagcagcattgccaggaatggagacactatcttcagctaagcaagaagacatggttgatgtcaatctcaagtcaagcaactcaagtgcatcccaatcacaggcacaatcaggaggatgtgcttgttaattttatggtttgctgcaactctatagttttcgactcagttttatattttgtttttgacaacaaagtattatctgtaaagttctttgttgactttcgtaaaatttgaattttttgtttttgtttttggtgtttgttaaagttggacacagaggttgtcatcctagttgagtaagacttagtatgttttcacttatttgtatcagtctctagacctatgcaatttagcagcccccttatggaacaagtctatgttatcagctgattcattgcagttttgtaatcagaaatttttggttggacgttcttgagtgagtaatggttgatcgcattgaaactttattt

SEQ ID NO: 4021 - DNA, 1364 bp, Fragaria vesca
tgtaaaaggctcttcaaaccaatttcacgcggtctctctccgtctccgtctccgtctccgtctctggaaacagatcatagtataaatacgcacccaaaccgaaatcagcgaggagaaaacaaagcagcgaatttaattcccaaccgaggctccgagatctcgatctgtccgattcatctccggcgagatctcgacctagatccatggctcccgtctccgctctcgccaagtacaagctcgtcttcctcggcgaccagtccgtcggcaaaaccagcatcatcactcgcttcatgtacgacaagttcgacaacacctatcaggctaccatcggcattgattttctgtcaaagacaatgtaccttgaagatcgaactgttcgattgcagctctgggatactgctgggcaggaaagattcaggagtctgattccaagttatatccgggattcctctgtggcggtcattgtatatgatgttgccagcaggcagtcattcctaaacacttccaagtggattgaagaggttcgcactgagcggggaagtgatgtcatcattgtacttgttggaaacaaaacagatcttgtagataaaaggcaagtttcaatagaggaaggagaagccaaagctcgtgaaatgaatgttatgttcatcgaaaccagtgccaaggctggtttcaatatcaaggcactctttcggaagattgcagcagccctacctggaatggagacactttcttctacaaagcaagaggatatggttgatgtaaacctcaagtcctccaatccaaatgcttcacagtcacagggacagtccggagggtgcgcatgctagatccttgaattacatgggtttcaaactccactttttcgcaccattcttatgtgctttggtgatccagctctttgtaaagcttagttgccccagttctgagttccgcctttttgtagctttggaggagtattgtgtttggttgattgttttacgatatttgcactgtttagaataccagagacttacagatcttaagttaaaagtaatagaagacacctctttatatgattgtaatttatgtccgcagtgtctgaaacgctagtctatccctattccagcagtttgagttacaattttctgtcttcgatattgattgggatatcacagtgcataagtgtccactttggcagtagtggtaaatcaagagattattgtaccagaagtcaagggatctgaatttgattcattgattcattacaacttgaatatctgagacaactggtttttactatttttatagagaaaaccttctctattattgtggcgcttattctgaatctgcgattaaactcgcgataacgagttgtaggaaga

SEQ ID NO: 4022 - DNA, 1009 bp, Nicotiana tabacum
cttttttctctctcaaatccaacttttgctttctccgattactttccggcgagatctctcataaaaccgtcggaaaatcctgatcggatccgttatcaggttatttcgaaagatcgatagatggctccggtttcggcgcttgcaaagtataagctcgttttcttaggagatcaatctgtcggtaaaactagtattatcacgcgatttatgtatgataaattcgacaatacttatcaggctacaattggtattgacttcctgtcaaagacaatgtatcttgaagatcgtacagtagcattgcaactttgggacactgcggggcaagagagatttcggagtcttataccaagctatattagggactcctctgttgctgtcattgtttatgatgttgcaagtaggcagtccttcttaaacacctcgaagtggattgaggaggttcgtactgagcgcggcagtgacgttatcattgtgcttgttggtaacaaaactgatcttgttgaaaaaaggcaagtttcaatagaggaagcagaagcaaaagctcgtgaactaaatgtcatgtttattgaaaccagtgctaaggctggctttaatataaaacccctatttagaaaaattgccgcggcattgccaggaatggagacattatcttctgctaagcaagaagacatggtcgatgtcaacctcaagtcaagcaacgcgaatgcatcccagtcacaagcacagtcaggaggatgtgcctgttaactttaatggttagaagttccttggtctacgattttgttcttatagtcaacaacaaatgtgtgtaaagttctttacctttcataccatctgaattttgattttgcttttttgggacggacttttgacttcgatgcaggagattgtcatcatagttcactaccacctagtatgtgtcagctatctctttctagatatatgcagttttggctattccctgttggaacaagaattttaagcacatatatccgttgatttactcgag

SEQ ID NO: 4023 - DNA, 906 bp, Triphysaria pusilla
tgaagtttcctggcgatctccgatcattttccggcgagatcgtgaaactcccgtcggaagagaaagaagcaacccatctgattccaaacctccgatctgctacaaatctgactgatggctccagtttcagctcttgcgaagtacaaattagtctttctgggagatcaatccgttgggaaaacgagtattattactcgattcatgtacgataaattcgataacacttatcaggctactattggtatcgattttctgtccaagacaatgtatcttgaagatcgaactgttcgtttgcagctctgggatactgctggacaagaaagattcaggagtctcattcccagctacatacgggactcctcggttgcagtcatcgtatacgatgttgcaagtcgacagtcgtttcttaacactacaaagtggatcgaggaggtccgcaccgagagaggaagtgatgttattattgtcgttgttggtaacaaaaccgatcttgtcgataagaggcaagtttcgatagaagaaggtgaagctaaatctcgtgatcttaatgtgatgttcatcgaaactagtgcgaaagctggcttcaacataaagccattgtttcggaagattgcagcagctttgccgggaatggaaactttgtcatcggcaaagcaagaagatatggttgatgtaaacttaaagtctagcaatgctaacggatctcagtcacaacagaatgccggaggatgtgcttgctgatgatgatcgggatgtcgttttgtgctcttattatgatctgtaaagtacttgttggtagcaatgaattttggttgtgaacgattggttgtcgaaaaatgttttaagctggattagtgttttctgtctttgttgttctgtgtttctcatctcatctgtataattttg

SEQ ID NO: 4024 - DNA, 1058 bp, Vinca minor
ctgtttgattcacagaatccatcttggctcaattaagaaaaaaaacgtcagatttcttcgattattttccggcgagatctcaatcgttagtcatcggaaaatactgtagtgcaatctcaatcgcctgcactaggttttgatcgattgctttttgtttgtttaattcattattagatccgaattatggctccggtttcggctttggcgaagtataaattggtgttcttaggagatcaatctgttggtaaaaccagtattattactcgattcatgtacgataagttcgataatacttatcaggctacaattggtattgattttttatcaaagacaatgtatcttgaggaccgaactgtacgattgcagctctgggatactgcaggacaagaaagattccgaagtcttattccaagctatattagggactcatcagtcgccgtcatcgtatatgatgttgcaagcagacattccttcctgaacacatcaaagtggattgaagaagttcgcactgagagaggcagtgatgtcatcattgtccttgtcggcaacaaaactgaccttgtggataagaggcaagtatcaatcgaagaagcagaagccaaagctcgtgaccttaatgtgatgttcattgaaaccagtgcaaaggctgggttcaacatcaaggcactatttaggaaaattgctgcagccttaccaggaatggagacactttcttctgcgaagcaagaagacatggtcgatgtcaacctcaagtctagcaacacgaatgcatctcaggcacaacaacaatcaggcggatgtgcctgttgatgatgctctacttgggacgttgttacctgcttcgttggtatacattttctttgatctggctcgagtatctatctgtaaagtttacgcttgctgatagcatttacgttttgggtgtggttgattgtcaggatattggaactcataaatcaggaatttgtcagtttagttgactagctctagtttctgtaatctttatatgtatgattatgcgaatttgtagttttctgttaagattttgtccccctttt

SEQ ID NO: 4025 - DNA, 843 bp, Vinca minor
tagatccgatttatggctccggtttcggctttggcgaagtataagttggtgttcttaggtgatcaatctgttggtaaaactagtattattacgagattcatgtacgataagtttgataatacttatcaggctacaattggtattgattttttatcaaagactatgtatcttgaggaccgaactgtacgattgcagctctgggatactgcaggacaagaaagattccgtagtcttattccaagctatattagggactcatcagttgctgtcattgtgtatgatgttgcaagcagacagtctttcctgaacacatcaaagtggattgaggaggttcgcactgagagaggcagtgatgtcatcattgtccttgtcggcaacaagactgaccttgtggataagaggcaagtatcaatcgaagaagcagaagccaaagctcgtgacctcaatgtgatgttcattgaaaccagtgcaaaggctgggttcaacatcaaggcattatttaggaagattgctgcagctttacctggaatggagacactttcttctgccaagcaagaagacatggttgatgtcaacctcaagtctagcaacaccaatgcatctcaagcacagcagcaatccagcggatgtgcctgttgactatgcttggctgaggacgttgttatctgctttgttggtatacagtgtcttttatctggctcaactatatctatctgtaaagtttacgcttgctgatagcatttaaattttgggtgtggttgattgtcaggatattggaacttagaaatcaggaatttttcactttagttgactaactctagtctctgtaatcctttatatgta

SEQ ID NO: 4026 - DNA, 983 bp, Lippia dulcis
cgcaaacctaccaatctcaccgattttttttctcgggctaaatctccggccatttttccggcgagatcttgaccttcgtcgggaaaactgctctctattcaaggttgtgaagatcctcttggtttgtattcaattgactcgatcttaatcgatggctccggtttcggctctcgcgaagtacaaattagtgtttctgggagatcaatcaggtcgggaaaacgagtattattactcgatttatgtatgataaattcgacaacacttatcaggctactattggtattgactttctctcaaagactatgtatcttgaagatcgaactgtacgattgcagttgtgggatactgctggacaagaaagatttaggagtcttatcccgagttatataagggactcgtctgttgcagttattgtatatgatgttgcaagcagacaatcctttcttaatactacaaaatggattgaggaggttcgcactgagagaggcagtgatgttattatcgtgctagttggcaacaaaactgacctggtagataagaggcaagtgtcaatagaggaaggtgaagccaaagctcgtgaccttaatgtcatgtttattgaaactagcgccaaagccggcttcaatataaagccactgtttaggaagattgctgcagccttgcctggaatggaaactctatcgtcaactaagcaagaggatatggtcgacgtcaatctaaagtcgagcaacacaaatgcatctcaatcacaacagcagtcaggagggtgtgcctgctgatatatcgcaaaaccgaaacatccctcgttttgtcatcatagtttttggaccataaaacgcatctgtaaatttcttccttgtctttgataatattgaattttgggtgtgatttgatcaagaggatttttaagccgtataactagaattgtctagtttagtttactgtattctggttgtcattgcatatttgtatcattttggtgg

SEQ ID NO: 4027 - DNA, 801 bp, Triphysaria pusilla
gccaaaaggagagggttagagatgcgcggagggtttcgatcgagtcggctgattgacgggcttttacttttgaagtttcctggcgatcgccgatcattttccggcgagatctgtcggaagagaaataagcaacccatctggtaccaaatctccgatctgctacaaatctgactgatggctccagtttcagctctcgcgaagtacaaattagtgtttctgggagatcaatccgttgggaaaacgagtattattactcgattcatgtacgataaattcgataacacttatcaggctactattggtatcgattttctgtccaagacaatgtatcttgaagatcgaactgttgtttgcagctctgggatactgctggacaagaaagattcaggagtctcattcccagctatataagggactcctcggttgcagtcatagtatacgacgttgcaagtcgacagtcgtttcttaacactacaaagtggatcgaagaggttcgtactgagagaggaagtgatgttattattgtcgttgttggtaacaaaaccgatcttgtcgataagaggcaagtttcgatagaagaaggtgaagctaaatctcgtgatcttaatgtcatgttcatcgaaactagtgctaaagctggcttcaatataaagccattgtttcggaagattgcagcagctttgccgggaatggaaactttgtcatcggcgaagcaagaagatatggttgacgtaaacttaaagtctagcaatgctaactcgtctcagtcacaacagaatgccggtggatgtgcttgctgat

SEQ ID NO: 4028 - DNA, 1220 bp, Rosmarinus officinalis
cggccggggggactcggacgaacaaatcctaaaacccaattagttctcacgtgcgcgcaactgcaagcctacagctttctcctcatcgattcgtacggttaatcccccggtcatttttccggcgagatctcgatcttccgtcggaaaaatctcctcttggcggaagtcgaagatccaatactatttcgcattaaacccaccctaacttgattgatggctccggtttcggctctcgcgaagtacaaattagtgtttttgggagatcaatccgtcggtaaaacgagcatcattacacgattcatgtacgataaatttgacaacacttatcaggctactattggaattgatttcctttccaagactatgtatcttgaagaccggactgtacgtttgcaattgtgggatactgcaggacaagagagatttaggagtctcatccctagctatataagagactcctctgttgcagtcatagtttatgatgttgcaagcagacagtcctttcttaataccacaaaatggattgaggaggttcgaactgagagaggaagtgatgttattattgtgctagttggaaacaagactgatctggtcgacaagaggcaagtttcaatagaggaagcagaggccaaagctcgtgaccttaatgtgatgtttatcgaaactagtgctaaggctggcttcaatattaagccattattcaggaagattgctgcagccttgcctggaatggaaactctatcaacagctaaacaagaggatatggttgatgtgaacctaaagtctggctacaataatgcatctcaatcacaagagcaatccggagggtgtgcttgctgataattcgaaccgtggtcgtttcgggcattcatattttgattggatcaaccctttatgtatctgtaaagttgttccttggcgttggtagtattgaattttggttgtgattaatagtgagaattctcagccgggtatatcagattgttgttttatagttccttgtatttgttaattgtagttcctattttcttcatattgtctacagtatgctcttatcagttgctacatcctttcgaagttttacagcaaaacttagggacaaggtgttgcttttatatatttgtttcctttacatgcttttggaactgggtaaacaattaatttctgcttcaggcgagactttgttccagctgctggttatttacaaattactagacagg

SEQ ID NO: 4029 - DNA, 1028 bp, Arnica chamissonis
caactttactgaacaaaccctttttttctctccgccacgatctcaaaagattttccggcgagatctctcatatccgtcggaaaatcttcactctttgataacaactacggccggattgatctgattgttgtattgtatttaatttcaaaacaatggccccggtgtcggctttggcgaagtacaagctcgtgttcttaggagatcaatcagtcggaaaaacaagcatcatcactcgattcatgtacgataagttcgacaacacttatcaggctactattggtattgattttttatccaaaaccatgtatcttgaagatcgaacagttcgcttgcagctttgggacacagctggacaagaaaggttcaggagtctcattcctagttacattagggactcctctgttgctgtcatcgtttttgatgttgcaagccgacaatcatttctgaacactgtaaaatggatcgaggaggttcgtacagagcgaggtagtgatgtcatcatcgtccttgttggaaataaaactgaccttgtagataagaggcaagtttccatagaggaaggagaagccaaagctcgtgactttaacgtaatgttcattgaaactagtgccaaggctggcttcaatataaaggctttatttaggaaaatagcttctgcattaccaggaatggaaaccttatcttcaacaaagcaggaagatatggttgatgtaaatctcaagtccagcaatgcaagtgggtcccagcagcaaccgcagtctggagggtgtgcatgctgatgtgtaagattctcaaaatactaaactagtctcggatatctttgaaggttagttacttataccgacagaaagggttttgctatgcttgaattacttttagcgcgatatgtgtctttttatgcttccgtgtttacaatttgaaatgttggaggttttcttgaatcttaaagtttctattgggactcgagttagttggcagttttgaaccgttcggattttggtgttcaatcctttctcatattgctaggg

SEQ ID NO: 4030 - DNA, 1021 bp, Chrysanthemum coronarium
atactcatattttcttgttaccgagagacagacacggccctgtatctccggcgatagatcacgccggaaggaaaatcatatctccgatcagaagataaaaatggctccagtgtcggcattagcaaagtataagctagtgtttttaggagatcaatcagttggtaaaactagtatcattactcgttttatgtatgataaatttgacaacacttatcaggctactattggtattgattttttatccaagacaatgtaccttgaagatcgcacagtacgcttgcagctttgggacacagctgggcaagaaaggttcaggagtctcattccaagttatattagggattcctctgttgcagtcattgtgtttgatgttgcaagccggcaatcatttatgaacacagcaaaatggattgaggaggttcgaactgagcgaggcagtgatgttatcattgttcttgttggaaacaaaactgaccttgtggataagaggcaagtttccatagaggaaggagaagctaaagctcgtgacttcaatgtaatgttcattgaaaccagtgccaaggcaggattcaatattaaggcattgttcaggaaaatagcttctgcattaccagggatggaaactctatcttcaacaaagcaggaagacatggtcgatgtaaatctcaagtccagcaatgcaagtggatcccagcagcaagcccagtctggaggctgtgcatgctgatgctaaacctaaacctctctctccgttaccccatatactcatccaaccttggatgatctgtgtgtatgattcttcataaaccataccagtatcgatatttttgaaggttagtgcttatatggaaagggctttgtcatgcttggccgtagttgaattagaatatagtgcaatagttgtgcaatttgctatgcattagtggttactgtttgaaaatgttcttatgtttgaggttgtttccgaattgtaaggttaaattgtagtcagactcgaacagttgacatatttgaattgctt

SEQ ID NO: 4031 - DNA, 772 bp, Cleome spinosa
ccctccatttggcgagaggcgagcggatctcccggcggatccctccggacaatctccattactcccggcgagatcccgacgtgttcgttctctcttcagtagatcttccaaactatggctccggtgtcggctcttgccaagtacaagctcgtgttcttgggagatcagtccgtcggaaagaccagtatcatcactcgctttatgtacgacaaattcgacaacacataccaggccacaatcggtattgattttctatccaagacaatgtatcttgaagatcgaactgtcagattgcagctctgggatactgctgggcaggagagattcaggagtcttattccaagctatattagggactcgtctgttgccgtcattgtgtttgatgttgcaagcaggcagtccttcctaaacacttctaagtggatcgaggaggttaggagtgagcgtggcagtgatgtcatagttgtgcttgtgggaaacaaaacagaccttgtggacaagaggcaagtatcaatagaggaaggagaagccaaggctcgggagcttaatgtaatgtttatcgaaaccagtgccaaagcaggcttcaacataaaggcgcttttccgcaagatagcgggagctttgcccggaatggagacattgtcttcaacgaagcaagaagacatggtcgatgtcaatctcaagtcttccaacgcaaatgcctctcaggcacatcaacaacccggaggatgttcttgttaatggcacaaacaaatcaataacaagggaaaaa

SEQ ID NO: 4032 - DNA, 879 bp, Taraxacum officinale
cacgcagagtggccattacggccgggattttccggcgagatctccaccacatccgtcggaaaaccttcactctccgatcacaaccgccgccgtttgatccgattgtcgcactgtattcatattcactctcaaaacaatggctccggtgtcggctttagcgaaatacaagctcgtgttcttaggagatcagtcagttggaaaaacgagcatcatcactcgattcatgtatgataagttcgataatacctatcaggctactattggtattgattttttatccaaaaccatgtatcttgaagatcgaaccgttcgcctgcagctttgggacacagctggacaagaaaggttccggagtctcattcctagttacatccgcgactcctctgtcgctgtcattgtttttgatgtcgcaagccgacaatcatttctgaacactgcaaaatggatcgaggaggttcgtactgaacggggtagtgatgtcatcatcgtccttgttggaaataaaactgaccttgtagataagaggcaagtttccatagaggaaggagaagctaaagctcgtgaatttaacgtaatgttcattgaaactagtgccaaagctggattcaatataaaggctttatttcggaaaatagcttctgcgctaccaggaatggaaaccttatcttcagcaaagcaggaggacatggttgatgtaaatctcaagtccagcaatgcaagtgggtcccaacagcaaccgcaatcgggcgggtgtgcatgttgattagtcagattcttagtataccaagctagtctcggatatcttggaaggttagtcgcttatacagaaatcggttttgctatgcttgaattgcttttagcgcgatatgtgtgcctgtg

SEQ ID NO: 4033 - DNA, 1080 bp, Euonymus alatus
atggacagaagtctggcagaatcaacctcaacgaggggaggcaatatttccgattagcgaggttcccccgagatctccattttcccggcaatatttccggttgattctcggccagatctcgagcttgattgaaatacctgtctgatccggtgagggtttcgattagatcctaatcgtcatggctccggtatcggctctggccaagtacaaactcgtcttcttgggagatcagtccgtggggaagaccagtatcatcacccgcttcatgtacgataaattcgataacacatatcaggctactatcggtattgattttctgtcaaagacaatgtatcttgaagatcggacagttcgattgcagctctgggatactgcggggcaggaaagattcaggagtctcattccgagttacatcagggattcctctgtggctgttattgtatatgacgttgcaagcaggcagtcatttctgaacacatccaagtggattgaagaggtccgcactgagcgaggcagcgatgttatcattgtggtggttggcaacaaaacagatcttgtggaaaaaaggcaagtttcaatagaggaaggagaagccaaagctcgtgagctcaatgttatgtttattgaaactagtgccaaggccggtttcaatataaaggcattgtttcggaagattgcagcagccttgccaggaatggaaacactttcatctacaaagcaagaagatatggtcgatgtcaatctcaagtcttccaatactaacgcatctcagtcacaaccacagtcgggagggtgtgcctgttgatagaaacattgagatctaagctcttctttcgtcatctcattcccttacctgcttgattcccttcaaggctgcctgtaaattttctatgttcgcattttgtagcatttggctattgagcttgtttcatttttgtgagatttaacattgagcttttgtggtcctggaattgggcttgggttcagatttgggttttggtcatggttatccacttggccatttcaccaatttgtagtcatactgtgctgattgcgtgaacgtttaattcatctctcttt

SEQ ID NO: 4034 - DNA, 1024 bp, Euonymus alatus
gacaaaccccataagcgagtgttccctgagatctcgaattctccggcggtattaccggttgattctcggcgagatcttgaacgtgattgaaatttgtgtttcgattagatccgaatcgtcatggctccagtctcggctctggccaagtacaagctcgtcttcttgggagatcagtccgtcggcaagaccagtatcatcacccgcttcatgtacgacaaattcgataacacatatcaggctactatcggtattgattttctgtcaaagacaatgtatcttgaagatcgaacagttcgattgcagctctgggatactgcagggcaggaaagattcaggagtctcattccaagttacatcagggattcctctgtggctgttattgtatatgacgttgcaagcaggcagtcatttctgaacacatccaagtggattgaagaggtacgcactgaacgaggcagtgatgttatcattgtggttgttggcaacaaaacagatctcgtggacaaaaggcaagtttcaatagaggaaggtgaagccaaagcacgtgagcttaatgttatgtttattgaaactagtgccaaggctggtttcaatataaaggcattgtttcggaagattgcagcagccttgccaggaatggaaacactttcatcgacaaagcaagaggatatggtcgatgtcaatctcaagtcttccaacactaatgcatctcagtcaccacagtcaggagggtgtgcctgttgatagaatcattgagagctaagctcttctttggtcgtcttattcccttgcgtgcttttatgaccttcaaggctgtctgtaaattttccatgtcaacattttgtagcattggcttttgggattggttcatttttacgaggtttattttttacgaggacaatgttgtggtatataggctagtcctagcctgtcttacatgtactgttcttttgtggtcctggagagccttgtgccaatatgactgtcaggcatatagcaagtttttcccctcttatcttataag

SEQ ID NO: 4035 - DNA, 757 bp, Euphorbia peplus
attcccggcaagatctttgtttactatacgagcgttatacggtcttcacgtatatccgaataatggctccagtttcggcactggccaagtacaagctggtgttcttgggtgatcaatctgtaggcaaaaccagcatcataactcgcttcatgtatgacaaatttgacaacacatatcaggctactataggtattgatttcctatcaaagacgatgtacctcgaagatcgaactgttagattgcagctctgggatactgctggacaggaaaggtttaggagccttattccaagctatatccgggattcctcagtggcagtaattgtttatgatgttgcaagcagacaaacattcctcaacacttctaagtggattgaagaggttcggactgaacggggcagtgatgttatcatcgtactcgttggaaataagacagatcttgtggataaaaggcaagtttcaatcgaggatggagaagctaaagctcatagcatgaatgtcatgtttattgaaacaagcgcaaaggcaggcttcaatataaaggcattgttccggaaaattgcagcagccttgccaggaatggaaactctttcctcagctaagcaagaggatatggtggatgtgaatctcaagtcttccaatacaaatgcttcctcctctcaagctcaatcaggatgtagctgttgatatacgaaaaacacagaagaaaaaacctttttgccgccatgttcttgtcatccttcacatgtaaagtttcc

SEQ ID NO: 4036 - DNA, 928 bp, Fagopyrum esculentum
ttttgcctttgtcgtctcatctcccccctcaaagagaacgaagagagacaaccgaaatcacttggattcaattcatccaagaactgtatttcttcagaatcgtgaactaactgcaagatcattccaagttatttcgattttggtccgcatcaatggcgccggtttcagccctcgccaagtataagctcgtttttttaggagatcaatccgtcggtaaaacaagcattattactcgattcatgtacgacaaattcgataacacataccaggctacaattggaattgattttctatcaaagacgatgtatcttgaagatcggactgtacgtttgcagttatgggatacagctgggcaagaaagatttaggagtcttatacccagttacataagggattcatctgttgcagtcattgtatatgatgttgcaagtcggcaatcttttctcaatacacaaaaatggattgaggaggttcgaactgagagagggagtgatgttatcattgtccttgttggaaataaaactgaccttgtggataaaagacaagtatccattgaagaaggagaagccaaagcacgtgatctcaatgtcatgttcattgaaaccagtgcaaaggctggatttaacattaagccactcttccgaaagattgctgctgcattacctggaatggaaacactttcatcaacgaagcaagaggacatggtcgacgtaaacttgaagcctgatccaaattcatcacagtcacagcctcaatcaggcggatgcgcttgctaaacaacattgttagtcgtaaagtgccttcttctgcttcttttcctgtacccttctttttgttttgtatttctttgaatctagaagacctgtctgctcttttattttctttcttagggaccatagccataattttacggatctagaaatgattg

SEQ ID NO: 4037 - DNA, 1139 bp, Humulus lupulus
ctctaatctgacccatactcacgcggattacagtctgtttttccatttctctctctacgaaaattaatggtataaatccaaaagcagagagagaaagagaacgagtaagaagaagaaagcaaagcataacattttccaaacaaaaattgatttaaactcttcggtctcgatcttgatctgtatcggaattggtagatccatcggaatcaaatggctccggtgtcggctctggcgaagtacaagctcgtattcttgggagatcagtccgtcggtaaaaccagtatcatcacccgcttcatgtatgacaagttcgacaacacttaccaggctactattggtatcgattttctgtcaaagacaatgtatcttgaagaccgcactgttcgattgcagctctgggatactgctgggcaggaaagatttaggagtctcattccaagctatatcagggattcctctgtagcagttattgtatatgatgttgcaagcagacaatcatttctaaatactgccaagtggattgaggaggttcgtactgagcgagggagtgatgttatcattgtactcgttggaaacaaaacagaccttgtagagaaaaggcaagtttcaatagaggaaggagaagccaaatctcgtgaactcaatgttatgtttattgaaactagtgcgaaggctggttttaacatcaaggcgttattcaggaagattgcagctgccttaccagggatggaaacactctcatcaacgaaacaagaggatatggttgacgtcaatctcatgtcttccaacgcaaatacatcgcaatcacaacaacagtcaggcggatgtgcctgttgattttttaccctgttgaatgcaagctgtagtttctgttgcaccatttcgatcctgttgtttgtaaagttaagcccctgcttcaccttttctttcttttcttttttttaatagaactttgatcgttggtatattattgattgtcgaaaaggtttagtaggcccttgttgggctataatgattagaaactgaaagctatttgagataaagttttcacatgagaactcttcgcataaagtggtttattttacaatatcgtttttgcggttgaccttactttttcactgctttttggcctttacaag

SEQ ID NO: 4038 - DNA, 946 bp, Olea europaea
cacagagacaaaccttgcgaagttaatatcgatttttccggcggataccgcagatatatattttctccaagaccttaaacctccataggaaaacccgatccactccatttagagaagatccggattcagttgatttgatatttccgtatttgattgatggctccggtttcagctctcgcgaagtataaattagtgttcttaggagatcaatcggtcggaaaaactagtattatcacaagattcatgtacgataaattcgataacacttatcaggctactattggcattgacttcctctcaaagaccatgtaccttgaagaccgaacagtaagattgcagctttgggatactgctggacaagaaagatttaggagtctaattccaagctatataagggactcttctgttgcagtcattgtatatgatgttgcaaacaggcagtctttcctcaacacttcaaagtggattgaggaggttcgcactgagagaggcagtgatgtcatcattgtggtcgttggcaataaaactgacctagtggataagaggcaagtctcaatagaggaagcagaggccaaagctcgtgaactaaatgtcatgtttattgaaacgagtgccaaggctggcttcaatataaaggcgttatttcgcaagattgctgcagcgttgccaggaatggagactctatccgcagcaaagcaagaggacatggttgatgtcaacctcaagtcgagcaacacaaatgcgtctcagtcacaacagtcaggaggatgctcctgttgattgaaggcctttttataatgcattattatgtttcgtcttcaacccttcaatccggctgtaaagttcttccgtctccttgcttgcatttgaatttacgatgtagttcactatttatgtgtgatcggttacctgtatcactatgtgggcctgtagttatcgaggcttt

SEQ ID NO: 4039 - DNA, 1061 bp, Olea europaea
tccttctcactctcgtctcgtttcaaggaaacacgcacgacggagataaaccttgcgaagctaatatcgatttatccggcgggaacttcagatacatatttactgcgacaccttaaacctcatcggaaaacccgatccactccatttacagaagatccgaattcaattgattgggtatttccgtatttgattgatggctccagtttcagctctcgcgaagtacaagttagtgttcctgggagatcagtcggtcggaaaaactagtattatcacaagatttatgtacgataaattcgataacacttatcaggctactattggcattgacttcctttcgaagaccatgtaccttgaagatcgaacagtaagattgcagctttgggatactgctggacaagaaagatttaggagtctaattccgagctatataagggactcttctgtcgcagtcattgtatatgatgttgcaagcaggcaatcttttctcaacacttcaaagtggattgaggaggttcgcactgagaggggcagtgatgtcatcatcgtggtcgttggcaataaaactgacctggtggataagaggcaagtctcaatagaggaagcagaggccaaagctcgtgaattaaatgtcatgtttattgaaacgagtgccaaggctggctttaatataaaggcactatttcgcaagattgctgcagccttgccaggaatggagacgctatcctcggcaaagcaagaggacatggttgatgtcaacctcaagtcgagcaacacaaatgcttctcagtcacaaccttcaggaggatgcgcatgttgatagaaggcctcgtatgatgcattactatgtttcggcttcgacccttcaatccaactgtaaagttcatccgtctcattggttgcttttgaatttacattttggttcactagttctgtgtcaatctcttacctgtatcacttgtgtggacctgtaattatcaaggctttagatagtctcatagacagattatttttatcggcgagttatatttgtagcgggttggtgtcgtctttcgggatttttt

SEQ ID NO: 4040 - DNA, 1078 bp, Platanus occidentalis
gaagaagagcggaaacacagcaaagtgaggatttttggtagcagagacagctcctcgaatcctccggcgaaatttctgtacgttttccggcgattttccgataggctgcaggggatcgtgaattgattctctctgtgatttctctggttagttgagagatctctcttatggctccagtttctgctctcgcgaaatataagctcgtgttcttgggagatcaatctgtcgggaagacgagcattatcactcggttcatgtacgataaattcgataacacatatcaggccacaattggtatcgattttctatcaaagacgatgtaccttgaagatcgaacagttcgattgcagctctgggatacagctggacaggaaagattcaggagtctcattccaagctacattagggattcctctgttgcagtcattgtatacgatgttgcaagtcggcaatctttcctaaacacttcaaagtggattgaagaagttcgcactgagcggggtagcgatgttattattgttgtcgttgggaacaaaacagatcttgtcgacaaaaggcaagtttccattgaggaaggagaagccaaagctcgtgacctaaatgttatgtttatagagactagtgctaaagctggcttcaatataaaggcactttttcggaagattgcagctgcattgccaggaatggaaacactttcttcaacgaagcaagatgacatggttgacgtcaatctgaagtctaccactgggagtgcatcacagtcgcagccacagtctgggggatgttcctgttgatgcacaaattgggtctgaactcctaatgctctgctgtatttccttctttataagtttgtaatcagctcatctgtaaaggtttcatcactttttcttttgaaatagttggcttttggtagagaaagttgattgctcggcatgacaaacctccttttgtaagaagctggttattgaccttctagtattagagagattgttgtggtggtcgaaccagtcttggtctgtgatttgtaataagaaattttaagaaacttcaatagagccagtttgtagggtactttatg

SEQ ID NO: 4041 - DNA, 1286 bp, Papaver somniferum
cggtgaagcaaattaatatgacctgcgcatgtacacacgcagaagttgccactattttgtaaatttgtattcgaagaaaagcagatctttaaaaaccatttaaaaccttcaattcaattcttcttctctctcttttctttctctctctaacagatcccccaaataatttcaatctcgagagagaaagaatttgatttctacacagagagaagcaaattcaatttttcttccatttcaaacgagtttgttcggcgatctctttttcttggtgttttggttgatttgaagataaatcaataataatggctccagtttcagctcttgcgaaatataagttggtgtttttgggagatcaatctgttggtaaaaccagtattattactcgttttatgtacgataaattcgataatacataccaggctactattggtatcgattttctatctaagacaatgtaccttgaagatcgaacagtccgactgcaactttgggatactgctggccaggagagattcagaagtctcattcccagttacatcagggattcctctgttgccgtcattgtttatgatgttgcaagccggcagtctttcctaaacacttcaaagtggattgaggaggttcgaactgagcgtggtagtgatgttattattgtccttgttggaaacaagacagatcttgtggacaaaaggcaagtctcaatagaggaaggagaggctaaagctcgtgagctcaatgttatgtttatcgaaaccagtgctaaagctggctttaacataaaggctctttttaggaagattgcagctgcattgccaggaatggaaactctttcttcaacaaaaaacgaagacatggttgatgtgaacttgaagtcaactaatgcaagcaataaccagtcacaaccccagggtggaggatgtgcttgttaatcaactcacaagtcttacttgcaatactcgtaatggcccttctttctcttttcgttgctttatcgacttttgatctacttccccgtaccatctgtaaaggtttgaactttttttttagggtctttcttttcctagtccttttggtatagttagccatctgtagctaactcccttttgctatatattcaaaagaaaaaaaagacattagggggaacccaaccgaggtagttggtggacaacgtggtccttcgagtctgtttgtattaagattttttaagaacaaattaatagagtttttagtaagtcaattttacatttgattttgggaatcttaaaccaatttatagagatattcat

SEQ ID NO: 4042 - DNA, 1133 bp, Papaver somniferum
aatagatcccccaaataatttcaatctcgagagagaaagaacttgatttctacacagagagaagcaagattttgattttttgcatttcaaacgagtttgttcgacgatctccttttcttggtgttttgattgatttgaaaataaatcaataataatggctccagtttcagctcttgcgaaatataagttggtgtttttgggagatcaatctgttggtaaaacaagtattattactcgttttatgtacgataaattcgataatacataccaggctactattggtatcgattttctatctaagacaatgtaccttgaagatcgaacagtccgactgcaactttgggatactgctggccaggagagattcagaagtctcattcccagttacatcagggattcctctgttgccgtcattgtttatgatgttgcaagccggcagtctttcctaaacacttcaaagtggattgaggaggttcgaactgagcgtggtagtgatgttattattgtccttgttggaaacaagacagatcttgtggacaaaaggcaagtctcaatagaggaaggagaggctaaagctcgtgagctcaatgttatgtttatcgaaaccagtgctaaagctggctttaacataaaggctctttttaggaagattgcagctgcattgccaggaatggaaactctttcttcaacaaaaaacgaagacatggttgatgtgaacttgaagtcaactaatgcaagcaataaccagtcacaaccccagggtggaggatgtgcttgttaatcaactcacaaatcttatttgcaatactcgtaatggcccttctttctctttttgttgctttatcgacttttgatctacttccccgttccatctgtaaaggtttgaactttttttttagggtctttcttttctgagtccttttggtatagttagccatctgtagctaactcccttttgctatatattcaaaagaagaaaaagacatgagggggaacccaactgaggtggttggtggacaacgtggtccttgagtctgtgtttgtattaagattttttaagaacaaattaatagagtttttagtaagtcgattttacatttgacatttgattttgggaatcttaaaccaatttt

SEQ ID NO: 4043 - DNA, 674 bp, Euphorbia esula
tttactatacgagcgttatacggtcttcacgtatatccgaataatggctccagtttcggcactggccaagtacaagctggtgttcttgggtgatcaatctgtaggcaaaaccagcatcataactcgcttcatgtatgacaaatttgacaacacatatcaggctactataggtattgatttcctatcaaagacgatgtacctcgaagatcgaactgttagattgcagctctgggatactgctggacaggaaaggtttaggagccttattccaagctatatccgggattcctcagtggcagtaattgtttatgatgttgcaagcagacaaacattcctcaacacttctaagtggattgaagaggttcggactgaacggggcagtgatgttatcatcgtactcgttggaaataagacagatcttgtggataaaaggcaagtttcaatcgaggatggagaagctaaagctcatagcatgaatgtcatgtttattgaaacaagcgcaaaggcaggcttcaatataaaggcattgttccggaaaattgcagcagccttgccaggaatggaaactctttcctcagctaagcaagaggatatggtggatgtgaatctcaagtcttccaatacaaatgcttcctcctctcaagctcaatcaggatgtagctgttgatatacga

SEQ ID NO: 4044 - DNA, 1046 bp, Tripterygium wilfordii
aaggttctccgagatctcgatttttccggcgatattaccggttgattctcggcgagttttggaacttgattgaaatatctgtcggatccggagagtggttcgattagatccgaatcgtcatggctccggtctcagctctggccaagtacaagctcgtcttcttgggagatcagtccgtcggcaagaccagtatcatcacccgcttcatgtacgacaaattcgataacacatatcaggctactatcggtattgattttctgtcaaagacaatgtatcttgaagatcgaacagttcgattgcagctctgggatactgcagggcaggaaagattcaggagtctcattccaagttacatcagggattcctctgtggctgttattgtatatgacgttgcaagcaggcagtcatttctgaacacatccaagtggatcgaagaggttcgcactgagcgaggcagtgatgttatcattgtgcttgttggcaacaaaacagatcttgtggacaaaaggcaagtttcaatagaggagggagaagccaaagctcgtgagctcaatgttatgtttattgaaactagtgccaaggccggtttcaatataaaggcattgtttcggaagattgcagcagccttgccaggaatggaaacactttcatcaacaaagcaagaggatatggtcgatgtcaatctcaagtcttccaacactaacgcatctcagtcaaatccagagtcaggagggtgtgcctgttgatagaaacattgagatctaagatcttctctcgtcctcttgttccctgtaatgctttaatgatcttcaagtctgcctgtaaattttccatgtcaacattttgtagcattggcttttgagattggttcattttaatgaggtttatttttttttttacgtaggacaatgttgtggtatataggctagtcctagcctgtctaacatgtattgctcttgtggccctggagagccttgtgccaatatgactaacatgtacggtttgatacaaaattgccgattcacacggttcattctggtgacaaa

SEQ ID NO: 4045 - DNA, 1196 bp, Rosmarinus officinalis
aacaatattttggttcattcactccattacttcacgcgctggaagcctgtgacggacacagctccttcatttcgaaaatacaaacgcgcaaatctatagattcaccacatcgacatctcaggcaactaatcattttccgaagagatccggcaccttctccgtcgtaaagaaagtagttgattccgactccaaagaagtgatctgccttgtgtttgattcggttgacctgattttgactgatggctccggtttcggctctcgccaagtacaagttagtgttcctgggagatcaatccgtcggaaaaacgagtatcatcactcggtttatgtacgacaaattcgataatacttatcaggcaactatcggtattgattttctttcaaagacaatgtatcttgaagatcggacagtacgtctgcagctgtgggatactgctggacaagaaagatttagaagtctcataccaagctatataagggattcctctgttgcagtcatagtatatgatgttgcaagccgacaatcctttcttaacaccgcaaagtggatcgaggaggttcgcactgagagaggaagtgatgttataattgtcctggttggcaacaaaactgatctggtcgataagaggcaagtttcaatcgaggaagcagaggctaaagctcgtgattttaatgtcatgtttattgaaacaagtgcgaaggctggcttcaatataaaggctctattcaggaagatcgctgcagccttgccaggaatggaaactctatcatcaacaaagcaagatgagatggttgatgtcaacctcaagtctagcaacgcaaacgcatctcagtcacaacagcagtcgggaggatgcgcttgctaaacaggtgaacttggaacatgggtttgtgcttaagatatacttttattggacggaatatgaatctgtaaagagctttctgccttgagcattgaattttgtttgtcattgtcgagaggatttcaagtcgtcggatacgtagattgtcgctgttgttcacttttttatgtttctcatgttacagttgtacccatgctgattgagactgcaaaatactctactattactcgcttagtttctgctgtaagtcatatttgagcttcaatttttatatcaatgcattattgaattagggtatactagtgtataacccgtcgaatttcgacgggaatc

SEQ ID NO: 4046 - DNA, 1077 bp, Ambrosia trifida
attcaaagaatcgtcaaaacccatttcttgtttacccacacagattccactcttcagctcaaccaaacccttaataataatattattattattattgttattatcattctctccgctcgatctcaaccatcttccgcctcgatctccgtcacaaccgtcgaataataataataataatctccagtctccgatcataaccgccaccgttcgatccactctcaaaacaatggctccggtatcagctttagctaaatataagctcgtcttcttaggagaccaatcagttggtaaaaccagcatcatcactcgcttcatgtacgataagttcgacaacacttatcaggctactattggtattgattttttatccaaaaccatgtatcttgaagatcgaaccgttcgcttgcagctttgggacacagctggacaagaaaggttcaggagtctcattcctagttacatcagagactcctctgttgctgtcattgtatttgatgttgcaagtagacaatcatttctgaacactgcaaaatggatcgaggaggttcgtacggaacgaggtagtgatgtcatcatcgtccttgttggaaataaaaccgaccttgtagataagaggcaagtttctatcgaggaaggagaagctaaagctcgtgaatttaacgtaatgttcatagaaaccagtgccaaagctggctttaatataaaggctttatttcggaaaatagcttctgcattaccaggaatggaaaccttatcttcaacaaagcaagaggacatggttgatgtaaatctcaagtccaacgcaagtgggtcccaacagcaacctcagtcgggagggtgtgcatgctgatgcttcagattcttaaataccaggctagtctcggggatatcttggaaggttagtcgcttatacagaatggattttgcaattattgaactgcttttagcgtgatatgtgtgccatttacattttgaaaacggtctttatgttattggagtttagattttaaagattttggagttatattcgagacacgagttagttgtcaggtttgaatgtgtgagtttttcatgtca

SEQ ID NO: 4047 - DNA, 1088 bp, Ambrosia trifida
tgcctacagagattccactttcaactcaaccaaacccttaataataataatattattattgtcattctctccgctcgatctcaaccattctccgccccgatctccgtcacaaccgtcgaataataataataatatccactctccgatcacaaccgccaccgttcgatccactctcaaaacaatggctccggtatcagctttagctaaatataagctcgtcttcttaggagaccaatcagttggtaaaacaagcatcatcactcgcttcatgtacgataagtttgataatacttatcaggctaccattggtattgattttttatccaaaaccatgtatcttgaagatcgaaccgttcgcttgcagctttgggacacagccggacaagaaaggttcaggagtctcattcctagttacatcagggactcctctgttgctgtcattgtctttgatgttgcaagtagacaatcatttctgaacactgtaaaatggatcgaggaggttcgtacggaacgaggtagtgatgtcatcatcgtccttgttggaaataaaactgaccttgtagataagaggcaagtttctattgaggaaggagaagctaaagctcgcgaatttaacgtaatgttcatagaaaccagtgccaaagctggctttaatataaaggctttatttcggaaaatagcttctgcattaccaggaatggaaaccttatcttcaacaaagcaggaggacatggttgatgtaaatctcaagtccaacgcaagtgggtcccaacagcaaccacagtcgggagggtgtgcatgctgatgcttcagattattaaataccaggctagtctcggggatatcttggaaggttagtctcttatacagaatggattttgcgattcttgaattgcttttagcgtgatatgtgtgcccttgtttacattttgaaaacggtctttatgttattggagtttagattttaaagattttggagttatattcgagacacaagttagttgtcaggtttgaatgtgtgtagtttttcattgtcacttatagttgtctagtttttcaattgtgttatgtgctattcttatttaagc

SEQ ID NO: 4048 - DNA, 758 bp, Antirrhinum majus
cggcacgagttccggtcattttccggcgagatcctgaaccttccgtcgtaaccgaactcgatccgatccggcttgcgattcacaaatttgaattgagatggctccggtttcggctctcgcgaagtacaaattagtgttcttaggagatcaatccgtcggaaagacgagtattattactcgattcatgtacgataaattcgacaacacttatcaggctactattggtattgattttctctccaagacaatgtatctcgaagatcgaactgtgcgtttacagctctgggatactgccggacaagaaaggttcaggagtctcatcccgagctatataagggactcttcagtggcagtcattgtatatgatgttgcaagtagacaatcttttctgaacacttcaaaatggattgaggaggttcgaactgagaggggaagtgacgttattattgtgctagttggcaacaaaactgatctggtggaaaagaggcaagtttcgatagaggaagcagaggccaaagcacatgaacttaatgtcatgtttattgaaaccagtgctaaggctggcttcaatataaaggcactattcaggaagattgctgcagccttgcctggaatggagactctgtcatcaactaagcaggaagacatggttgacgtccacctcaagtctagcaacgcaaatgcagctcagtcacagcagcagtcgggtggatgtgcctgctgataatatgaatgtaaacctttttttgtgcgtctca

SEQ ID NO: 4049 - DNA, 1054 bp, Vaccinium corymbosum
tttcgagcaaatcaagcaaatctctccctctccctctctcagtgatccgtcagtgtacgacgtcggagcataaccggaaagacttcgaatttcccggcaagaagtccgaccatttccctgcgggatctcggcacttcacaacacgatccgccgcgtcattcgagtagatccgagtgatggctccggtttcagccctcgccaagtacaagctcgttttcttgggcgatcaatcggtcgggaaaaccagcatcatcactcgattcatgtacgacaagttcgataacacatatcaggctactattggtatcgactttctatcaaagaccatgtatttggaagatcgtacagttcggttacagctatgggatactgccggtcaagaaaggtttaggagtcttattccaagttatattagggactcctctgttgcagttattgtgtatgatgttgcaagcaggcaatcattcttaaacactgcaaaatggattgaggaggttcgcaccgagcgagggagtgatgttataattgtccttgttggcaataaaactgaccttgtcgataagaggcaagtctcaatagaggaagctgaagccaaagctcgtgacatgaatgttatgttcatagaaaccagcgcaaaggctggctttaacataaaggccttatttcggaagattgctgcagccctgccgggaatggaaacactgtcttcaacaaagcaagaagacatggttgatgtcaatctcaaagctagcaatcctaatgcatctcagtcacaacaacagtccggaggatgtgcttgttgaggattgctgtgtcattatctgtaaagctcttctcgttataaaattaaaattttgggtttcgttgcttttttgaggtttaacttaaaacaggtggttatctttatactcgaaccagtctaaacccttgttatgtgttattcgtgtggtacgattagggagaatgagtgaatgactattattttgtctgggtttatgttaggcactcgttcggattccattaagctttattagtgaaattttcgcgttcaatt

SEQ ID NO: 4050 - DNA, 1030 bp, Chrysanthemum coronarium
caaatatttgttaccgacacgcatttcactcttctttcaaataaaaccccctttatctccggcgatagatctcactcatcgtcgccggaaaatcaccagataaactttaagcaatggctccagtgtcagcattagcaaagtataagcttgtgtttttaggagatcaatcagttggtaaaactagtatcattactcgttttatgtatgataagtttgataacacttatcaggctactattggtattgattttttatccaaaacaatgtaccttgaagatcgaacagtacgcttgcagctttgggacacagctgggcaagaaaggttcaggagtctcattccaagttatattagggattcctctgttgcagtcattgtgtttgatgttgcaagccgacaatcatttatgaacacggcaaaatggattgaggaggttcgaactgagcgaggcagtgatgttatcattgtccttgttggaaacaaaactgaccttgtggataagagacaagtttccattgaggaaggagaagctaaagctcgtgactttaatgtaatgttcattgaaaccagtgccaaggcaggcttcaatataaagccattgtttcggaaaatagcttctgcgttaccagggatggaaactttatcttcaacaaagcaggaagacatggtcgatgtaaatctgaagtccagtaatgcaagtggatcccagcagcaagcccagtctggaggctgtgcatgctgatactaaaccacctctctctcggttaccccatatactcatccaaccttggatgatttgtgtgtatgattctacataaaccataccagtatcgatatttttgaaggttagtgcttatatggaaaaggttttgtcatgcttggctgtagttgaattagttatagtgtagttttgcaatttgctatgcaatagtggttactgattgaaactgttctttgtttgaggttgtatccgaatttaaagttgaattgtagtcttgacttgaatcacttaacgtatttgaatcgtttagc

SEQ ID NO: 4051 - DNA, 1344 bp, Citrus clementina
aaaaagcctgaggggttatgtaaaggaaaacagaaaatgtggagaaaacggtgtacatggtgagaggctggctctgccagagccactgagccagagccagcgccagcgcccgcgcacgcgtgcagaaaattcgtacatacacacacctgcagagaattacttctattctatgcataaataaataaagggggcaggcaggcaggcaggcaggcatcaaaggcaaatcccgaaaatccgaggcccccgagatctcgtcctccatctccttctctccgttgaatacacccggccgagatctcgtgtaattgcaccaaaactgttgatttttgttgtagatccgaaaaaatggctccggtttcagctctagccaagtacaagttggtgtttttaggggatcagtccgtgggcaaaactagtatcatcactcgcttcatgtacgataaattcgacaacacttatcaggctaccattggtatcgatttcctgtcgaagacaatgtatcttgaagaccgaacggttcgtttgcagctctgggataccgcaggacaagagagattcaggagtctcattcctagctacatcagagattcctctgtcgcagtcattgtatatgatgttgcaagtaggcagtctttcctaaacaccaccaagtgggttgaagaggttcgaactgagcggggcagtgatgtaatcattgtcctcgttgggaacaaaactgatcttgtggacaaaaggcaagtttcaatagaggagggagaggctaaagctcgtgagctcaatgttatgtttattgagactagtgccaaggctggcttcaatataaaggcactcttccggaaaattgcagcagcattacctggaatggaaacactttcttcaacaaagcaagaagatttggtcgatgtcaatctgaagtcttccaacacaaatacatctcaatcacaaccacaatcaggaggatgtgcttgctgagataatacatcttctgggcccttctttgcaacatttccataatgcttctgtaatctcttttaagtgtctgtaaagttttgtcctccccttctatagcattgacgttttgggtttgtttgactttgttaagaaagttaaatcttgaagaggatattattgtggtagtcagctagccctaacctgtctcatatatacaaatacatgatgtatggttcttgtggcctcacagagatttgtgccaaattccctctttaggaatgtatttagtttcattttcaaaactagtattccattgaacaaagtggatttttgtaccatctcatattccattttgttgtggtgcttttacccggtggaaattaaactattggt

SEQ ID NO: 4052 - DNA, 784 bp, Cleome gynandra
gggcaagaggcgacgggatctctaaagcttccggtgatctctccggtaaatctttacagctcctgcgagatcccgacgcgttcgctctctctctctctcagatccattttggtagattgtcgaaattatggcgccggtctctgcccttgccaagtacaagctggtgttcttgggagatcagtccgtcggcaagaccagtatcatcactcgcttcatgtacgacaaatttgacaacacatatcaggcgactatcggtattgattttctatccaagacaatgtatcttgaagatagaactgtcagattgcagctctgggacacagccgggcaggagagattcaggagtctcattccgagctatatcagggactcgtctgttgctgtcattgtgtatgatgttgcaagtaggctgtctttcctaaatacttctaagtggatcgaggaggttagaactgagcgtggcagtgatgtcatagttatgcttgtgggaaacaaaacagacctcgtggacaaaaggcaagtatcaatagaggaaggagaaggcaaggcacgtgaactcgatgtaatgtttattgaaaccagtgccaaagcaggcttcaacataaaggcgctctttcggaagatagctgcagcattgccaggaatggagacactttcgtcaacaaagcaagaagatttggtcgatgtcaatctcaggtcttccaacacaaatgcatctcaggcacatcagcaatccggaggatgttcttgttagtggcaccacacacaaatccaacagaacaac

SEQ ID NO: 4053 - DNA, 798 bp, Cleome gynandra
atccatttggtagatcctccgaatcatggctccagtgtcggctctcgccaagtacaaactcgtgttcttgggagatcaatccgtcggaaagaccagcatcatcactcgcttcatgtacgacaaattcgacaacacataccaggccaccattggtattgattttctatccaagaccatgtatcttgaagatcgaactgtcagattgcagctctgggacacggctgggcaggagagatttaggagtcttattcccagctacgtcagggactcttctgttgctgtcattgtgtatgatgttgcaagtaggcaatccttccttaacacttctaagtggatcgaggaagttaggactgaacgtggcagcgatgtcatagttgtgcttgtgggaaacaaaactgaccttgttgacaaaaggcaagtgtcaatagaggaagcagaagccaaggctcgtgagcttaatgtaatgtttattgaaaccagtgccaaagcaggcttcaacattaaggcgctctttcgcaagattgcggcagctttaccaggaatggagacactgtcttcaactaagcaagaagatatggtggacgtcaatctcaagtcctccaatgcaaatgcatctcagacacagcagcaatctggaggatgtgcttgttaatggcttcaatcaaatccatataaagaaagaaagaaaaaagaaaaacattcctcacatgcttcgtaagtcttacatgacatcccatctgtaaaattttgtctgcatccgattcccaacttatattcaactttgtcttttgttccatt

SEQ ID NO: 4054 - DNA, 1085 bp, Echinacea purpurea
cacggattccactcttcaaacaaacccttattctctccgccggattcgaaacattttccggcgagatctccgtcacattagtcgaaaatactctactctcccatcacatctgctgccgtttgatctgatcgtcgtactgtatcaattctaaaacaatggctccggtgtccgctttagcgaagtacaagctcgtgttcttaggagatcaatccgttggaaagacgagcatcatcactcgattcatgtacgataagttcgacaatacttatcaggctactattggtattgattttttatccaaaaccatgtatcttgaagatcgaacagttcgcttgcagctttgggacacagctgggcaagaaaggttcaggagtctaattcctagctacatcagggactcctctgttgctgtcattgttttcgatgttgcaagtcgtcaatcatttctgaacactgcaaaatggatcgaggaggttcgtactgaacgaggtagtgatgttatcattgtccttgttggaaataaaactgaccttgtagataaaaggcaagtttccatagaggaaggagaagctaaagctcgagagttcaatgtaatgttcattgaaactagtgccaaagctggcttcaatataaaggctttgtttcggaaaatagcttctgcgttacccggaatggaaaccttatcttcaacaaagcaggaggacatggttgatgtaaatctcaagtccagcaatgcaagtgggtcccaacagcaaccacagtcgggagggtgtgcatgctgatgtgtcagattcttaatacaccaagctagacgcggatatcttggaaggttagtcgcttatacagaaacggttttgctatgcttgaattgcttttagcgcgatatgtgttcccgtgtttacattatgaaaaggtgttgggagtttgaattattaatgtttttggagttttattcgagactcgagttagttggcagttttgaaccgtctgaatttcgctagtcgctatagttgtcaattggttaattttttagctgtgatgctgatatatttgagactcatattattgtgcatcattttttacac

SEQ ID NO: 4055 - DNA, 1259 bp, Echinacea purpurea
aagttttgttcaactccggtctaagtcatgattattcaaagaaacgtcaaaaccatcccttgttaccaacacggattccactcttcaaacaaacccttattctctccgccggattcgaaacattttccggcgagatctccgtcacattagtcggaatatctctactctcccatcacatctgttgccgtttgatctgatcgtcgtactgtatcaattctaaaacaatggctccggtgtccgctttagcgaagtacaagctcgtgttcttaggagatcaatccgttggaaaaacgagcatcatcactcgattcatgtacgataagttcgacaatacttatcaggctactattggtattgattttttatccaaaaccatgtatcttgaagatcgaacagttcgcttgcagctttgggacacagctgggcaagaaaggttcaggagtctaattcctagctacatcagggactcctctgttgctgtcattgtttttgatgttgcaagtcgtcaatcatttctgaacactgcaaaatggatcgaggaggttcgtactgaacgaggtagtgatgtcatcatcgtccttgttggaaataaaactgaccttgtagataaaaggcaagtttccatagaggaaggagaagctaaagctcgagagttcaatgtaatgttcattgaaactagtgccaaagctggcttcaatataaaggctttatttcggaaaatagcttctgcgttacccggaatggaaaccttgtcttcaacaaagcaggaggacatggttgatgtaaatctcaagtccagcaatgcaagtgggtcccaacagcaaccacagtcgggagggtgtgcatgctgatgtgtcagattcttgaaacaccaagctagacgcggatatcttggaaggttagtcgcttatacagaaacggttttgctatgcttgaattgcttttagcgcgatatgtgtgcccgtgtttacattatgaaaaggtgttgggagtttgaattattaatgtttttggagttttattcgagactcgagttagttggcagttttgaaccgtctgaatttcgcaagtcgctatagttgtcaattggttaattttttagctgtgatgctgatatatttgagactcgtattattgtgcatcattttttacacgtctaggcatcatttgttatggctaacaccattttatggttacaaatccaaacacgatcaactaaataatgtcacatataatattatttgtgtgaaataatatat

SEQ ID NO: 4056 - DNA, 712 bp, Euphorbia peplus
tttcaatttcctatacgatcttcatacgatccttggatagatccgatcaatggctccggtttctgcactagccaagtacaagctggtcttcttgggggatcaatctgtggggaaaaccagtatcatcactcgattcatgtacgataagttcgacaacacctatcaggctactataggtatagattttctatcaaagacaatgtaccttgaagatcgaactgttagattgcagctctgggatactgctgggcaggaaaggtttcggagccttattccaagctatatccgggattcctcagttgcagtaattgtgtatgatgttgcaagcagacagacattcctcaacacttctaagtggattgaagaggttcgctctgagcggggcagtgatgttatcatcgtactcgttggaaataagactgatctcgtggagaaaaggcaagtttccatagaggacggagaagctaaagctcatgagctcaaggtcatgtttatcgaaacaagtgcaaaggcaggctttaatataaaggcactgttcagaaagattgcagcagccttgccgggaatggaaacactttcctcagccaagcaagaggatatggtggatgtgaatctcaagtcttccaatacaaatgcttcctcgtctcaagctcaatctggatgtagctgttgatatacgaaacacagaagaagaaacctttttccagccatt

SEQ ID NO: 4057 - DNA, 1262 bp, Euphorbia peplus
accttactttacttgtactatttgaaatcaaaattcaacatctccctacaaacatcgggatcggagattccaattccgagaggatccatccatcgtcgattagcttccggcgagatttcaatttcgtacacgatcttcatacgatccttggatagatccgatcaatggctccggtttctgcactagccaagtacaagcttgtcttcttgggggatcaatctgtggggaagacgagtatcatcactcgtttcatgtatgataagttcgacaacacctatcaggctactataggtattgattttctatcgaagacaatgtaccttgaagatcgaactgttagattgcagctctgggatactgctggacaggaaaggtttcggagccttattcccagctatattcgggattcctcagtggcagtaattgtttatgatgttgcaagcagacagacattcctcaacacttctaagtggattgaagaggttcgctctgagcgaggcagtgatgttatcatcgtactcgttggaaataagacagatcttgtggagaaaaggcaagtttccatagaggatggagaaactaaagctcatgagcttaaggtcatgtttattgaaacaagtgcaaaggcaggcttcaatataaaggcactgtttcgaaagattgcagcagccttgccaggaatggaaacactttcctcagctaagcaagaggatatggtggatgtcaatctcaagtcttccaatacaaatgcttcctcgtctcaagcacaatctggatgtagctgttgatatacaaaatacagaagaagaaacctttttgcagccattatcacatgtaaagtttcgacagtttctactacactcctggagtagtataccgcaaccattgaaaaagagggatctaatctataaccatttcaaaggagatgattggtatcaagaaataaatttatgcaggtggtattaatcaattaattggttgggtatattactctgggagttgtgtagaattttttccgtaaagtttacgacttccatttgtatcattgggtatttggctttagtttgtggatgagtgattagtctaagaggagacagtattgtagttagactggtaagtatgtagtgccagaaatcatcttttgaacaaactatcctgtttcaacttataatttttgtcacttgaactttactcagccgagttcagatttcattcggatcagatatgggggatgaaagagttcccatcctctttccatgttt

SEQ ID NO: 4058 - DNA, 949 bp, Euphorbia peplus
accggagattctccgatttgtcggcattcgtcgccggcgagatctccgtttcctgcacgatcttcttcatatagatccgagaaatggctccggtgtcggcactagctaagtataagctggtgttcttgggagatcaatctgtaggcaaaacgagcatcatcactcgattcatgtacgacaagttcgataatacctatcaggctacaataggtattgattttctatcaaagacgatgtaccttgaagatcgaactgtcagattgcagctctgggatacagctggacaggaaaggtttaggagccttattccaagctatattcgggattcctcggtggcagtaattgtttatgatgttgcaagcagacaaacattcgtcaacacttctaagtggattgaagaggttcgcactgagcggggcagtgatgttatcatcgtactcgttggaaataagacagatcttgtggacaaaaggcaagtttcaatcgaggatggagaagctaaagctcataacatgaatgtcatgtttattgaaacaagcgcaaaggcaggcttcaatataaaggcattgtttcggaaaattgcagcagccttgccaggaatggaaacactttcctcagctaagcaagaggatatggtggatgtcaatctcaagtcttccaatacaaatgcttcctcgtctcaagcacaatccggatgtagctgttgatatacgaaacacagaagaaaaagaactttttgcagccgtgttcttgtcatccttcacatgtaaagtttccgacatccattttgtaccatttggtgtttggcttttgtttgtcgatgagagattagtcaaaggagattatgttgtagttcagaattaagaagggtggtatcgattagacttgtattaatatggaactagagtttagctttttgcaaaatattgtattgttgtgatacaaaatt

SEQ ID NO: 4059 - DNA, 1145 bp, Fagopyrum esculentum
gttgtactttggttggatctaaaccgagtcacaactaaactcagcctctccagaaggcccagaatcgttctctttcatttggccgtctcatctctctcccctcaaagggaacgaaagagagacaactgagaaaaccaccctccgattcaatttcctgacacgactacctcacttttgccatcaccaaacacaatcctttccggtgctctcgattgcgatccacatcaatggcgccagtttcagctctcgccaagtataaactcgtttttttgggggatcaatccgtcggcaaaactagtattataactcgatttatgtacgacaagttcgacaatacatatcaggctacaattggaattgattttctatcgaagacaatgtatcttgaagatcgaactgtacgtttgcagttgtgggatacagcaggtcaagaaagatttaggagtcttattcccagctatataagggattcatctgttgctgtgattgtttatgatgttgcaagtcgtcagtcctttctaaacacatcaaaatggattgaggaggtccgtactgagagaggcagtgatgttattattgtacttgttggaaataaaaccgaccttgttgacaaaaggcaagtatccatcgaggaaggagaagccaaggcccgtgatctcaatgttatgttcatcgaaacaagtgcaaaggctggattcaacattaagcctctcttcaggaagattgctgctgctttacccggaatggaaacgctttcctcaacaaagcaagaggacatggttgacgtgagtctgaagtcatcatctaccgcaccacagtcacagccacaggcaggtggatgtgcttgctaacaaattcatacatgtcaaaaggtgcattcttccgcttcatttactgtaccctttttttgtacttccttgaatctagaagacatctgctctttttatattgtttcctaatggccatatagccatattattactactagcattctgaggactcaacaattttatgggtataggcaatggttgtcatctttttttgtctattaaatgggattgtatggtgtgatgtaagacgacttcttagttgtacgtggaatttttgcaacctcttatggtagttcggatcctattcttgtatga

SEQ ID NO: 4060 - DNA, 1098 bp, Panax ginseng
cattgcccaaattaagcactaaaaaaatacaaacagatccactgccaccttctaaaccagtatcaaattgacgctgcctcctctctctataatcgaaatccaccagcacgccacaaaaagcgatctgaaaattgaaaacagtgttaatttttccacttccaattacttggatttcattagatggcaccagtatcagcacttgccaaatacaaactcgttttcttaggggatcaatcagtgggcaaaacaagcattatcactcgctttatgtatgataaattcgataatacttatcaggctacaattggtatcgattttttgtcaaagaccatgtatctggaagatagaacagttcgtttacagttgtgggatacagctgggcaggaaagatttaggagtctcattccaagttatattagggattcatctgttgcagtcattgtatatgacgtcgcaagtcgacagtctttcctgaatacctcaaagtggattgaggaggttcgcacggagagaggcagtgatgttattattgtcttggttggaaacaaaactgaccttgtggagaaaaggcaagtctctatagaggaagcagaagagaaagctcgtgatcttaacgtcatgtttatcgaaactagtgctaaagctggcttcaacataaaggctttgtttcgaaaaattgctgcagcattaccgggaatggaaaatctttcttccacaaagcaagaagacatggttgacgtgaatttgaggtctaccaatgggactgcatcacaatcccaacctcagtcacgtggatgtgcttgctgatgaatccatgttttaagcttcactcaccatactccatcacacagagtcttttgtgtttggttatctttgccctttgtgacatgtaaaggttttctatccgcttttcctttttctattgtgatatctgtaactattatatccctgtttgtcacgagattcatctatctgagacataactgatgggaaagaagcctcgctgtagaaacggttgtcatggtcattaacactcatagtttgtgcttgcagcaaggtttattgagagcagaaagattttgactcctttgcatttta

SEQ ID NO: 4061 - DNA, 1129 bp, Panax ginseng
attcacgcacacaaatacccccataaaactacacctctctctctcccctgtccaagcgaaatacgcctacagtgtgaagacgaaactatacgtcttgcaccgacttacccttcgaaatcctcgatcattttccggcgagatcgtcatctgatcgtcggaaagtttgtttccgtccgtatattgagtccgatccaactctagatccgaataatggctccggtttcggctctcgcgaagtacaaactcgtgttcttaggggatcaatcagtcggcaaaacaagtatcattactcgattcatgtacgataagttcgataacacctatcaggctacaattgggatcgactttttgtccaagacgatgtacctagaagatcgcactgttcgattgcagctctgggatacagctggacaagaaaggttcaggagtctcattccaagttacattagggattcctctgttgctgtcattgtatatgatgttgcaagcaggcaatcattcctgaacactgtaaaatggattgaggaggttcgcactgagaggggcagtgatgtcatcattgtccttgttgggaataaaactgaccttgtggataagaggcaagtctctattgaggaagcagaagccaaagctcatgacttaaacgttatgtttattgaaaccagtgccaaagcgggcttcaatataaaggcactatttcgaaagatcgctgcagccttgccaggaatggaaacgttatcttccgctaagcaggaagacatggtcgatgtcaatcttaagccaaccctgagctcatctcagtcagaaccgcaatcgggaggatgtgcctgttgatagtcttgatcagaagtcttccatgaccctaaaacatgtttgtaaaaattctttctcgctcttattaatatctaaacttttgaggatttacgcaatacaggagataatagtgatagtcctgacatcttttctctgttctcagaatttttcctttggacctagagttctttcaggttcttcttttctagaaattttgttaggcataatatacttgggaaattttctttggtttgttattgagaattttgagtggtgaaataaattggtttaatattattcgcacgaagcacatttt

SEQ ID NO: 4062 - DNA, 944 bp, Humulus lupulus
ctcttctctctctctctctcatattcttgatccattacaatggctccagtctcagctctcgccaagtacaagctcgtcttcttgggagaccaatcagtcggcaagaccagcattatcacccgcttcatgtacgataaatttgacaacacttatcaggctacaattggtattgattttctatcaaaaaccatgtatcttgaagatcgaactgttcgactgcaattgtgggacacggctggacaggaaagattcagaagtctcattccaagctacatcagagattcgtctgttgcagttattgtatatgatgttgcaagtcgacaatctttcctgaacactctgaagtggatagaagaggtgcgcagtgaaaggggcagtgatgttattattgtacttgttggaaacaagacagatcttgttgaaaagagacaagtgtctatagaggaaggagaagccaaagctcgtgatcttaatgtcatgtttattgaaaccagtgctaaggctggttttaatataaaggcactctttaggaaaattgccgctgctttaccaggaatggaaacactttcctcaacgaagcaagaagacatggttgatgtgaacctgaagtcaatgagtgcatcaactcaatcccaacctcaatctggtggatgtgcctgttgatgcatcctcatgccagcattctttgtacacccaatgtttcatctctttggcagttgggttcctctagtttctttgcatcaaatctgtaaagagttttcgtctgcattttcttttggttgagtggttttctgtaggtatattctgctttgtttggaaacctttttcaggacaagactaactgaggagatagaaatagatgagttatgatcagggggtaatctgttggtgaattcagaaaccatagtctgtctcatattttgtcctctcgaatagattttggt

SEQ ID NO: 4063 - DNA, 1218 bp, Elaeis guineensis
gtgtaacgtgtagaaatcctctgggctgctggtgcttctcgcccgaagccccctctcctctctcgatctcttctcgctctcctcttcgtgcttcgggttccgtcaaaagctctcactcgcttcggcgatggctccggtctccgccctcgccaagtacaagctggtgttcttgggggatcagtcggtggggaagaccagcatcatcactagattcatgtacgataagttcgacaacacctaccaggctacaattggcattgattttctgtcgaagaccatgtaccttgaagatcgaactgtcagactacagctttgggacacagctgggcaggagagatttaggagcctaattccaagctacattcgagactcctctgttgcggtcattgtttatgatgtctcaagccgacagtctttcctaaatacttcaaagtggatcgaagaggttcgcacagagaggggtagtgatgttatcattgtccttgttgggaacaagactgaccttgttgacaagaggcaagtctcaatagaagaaggagaagccaaagcacgagagcttggtgtcatgtttattgaaacaagtgccaaagctggcttcaacgtaaaggcattgttccggaaaattgctgctgcactgccagggatggagactctctcatcaacaaagcaggaagacatggttgatgtgaacttgaaggctaccagtgcgaattcaacccagtcacagggaccatctggaggatgcaactgttgacgcttatccaggtcccgttacattgctcttagcctcttactaatgcatgtgagctactatcaaattttgtctgcttcagctcggttccatagacactgtcacctttctttgtagagctgcatggaccaacttggaaaaggaaaaggtggctgaggttctggtgggtgaatcggtctcttgtcaatgtgtttttctattttttgtatttatttcttgcgtgttcatatagaatttttagttcatcaagagatcttgtagtgttgtgtcaaatggaccatcagaaacacttcaaacaattgtaggtacaggtgctgcagtttattcctggcttcagtgatatagatagagaatgcgtagtgagatcgttgttgacatgcttatactgtatttcctgaattgctggtgttgacatccttgcatctattattggaagtttctggtcctggactaccaaaaaaaaaaaa

SEQ ID NO: 4064 - DNA, 1545 bp, Elaeis guineensis
aaaaaactaaccaccattcaaatccataacctaacaaacccaatccaacccaatcccatcctacagctaggccaaactccactaggttaggctgaagtaggtcaagcttcactacgagaaaaagtaggttagaagtcggaggggaatcagattagactgtgtgattaaccaaacccagctcaattttatgaagaactccaacgcaacccagctgagaaacgatatattggcaagtcccaaatccaaatccaaattaaataatttctaggtaggctcccaataaagaccgcctgagctgcactctcaagtgtgcgcaagggagaaggatcgaaaggggatcgaagccggactcactctccggaaatccggacgctttttctctcggctttgtcgccagatctccggcaatggctccggtctccgccctcgccaagtacaagctggtgttcctcggcgaccagtccgtcggcaagaccagcatcattactcgattcatgtacgacaagttcgacaacacctatcaggcgacgattggtattgattttctatcaaagacaatgtaccttgaagatcggacagttaggctgcaactttgggatacagctggccaggagagattcagaagtctaattcctagctacattagggattcctctgttgcagtaattgtgtatgatgttgcaagccgacaaactttcctgaacacctcaaagtggattgaagaggttcgaactgagaggggtggtgatgttatcattgtcctcgttgggaacaaaactgaccttgttgacaaaaggcaagtctcgatagaggaaggagaggctaaagctcaggatcttggtgttatgtttatagaaacaagtgccaaggctggcttcaatgtcaaggcactgtttcggaaaattgctgcagcattgccaggtatggagaatctttcctcagcaaaacaggaagatatggttgatgtgaatctcaagacaaccactacaagtgcatcccaatcacagcagcaatctggaggttgcagttgctaatgccagcccaaagtctgttagtggcgtgagattacttcatctgtaaggagttggtggaattagcttgtcctatcatttgatcagtggcactagtttttccctcaaagcatgcagcctggtcaataaaagggcatctgctagaggttagggttatggtggctaaatcagtttccagacttcatgattcaaagtaaagattctctcaagcatgtaaatagaattcccttttttctattcataattgactatccaaagaatcttgtgtagaggtgtgttttggactagagtcaagcttttagattttttggtgaactcctctctttcttcagtactgtataagagagttgaataatggtatacttacaaacttgggtcattgatgataaatattttgggaattgccagcagcaacagcattatgaactgtatgtgcttcctagaccaaaaaaaaaaaaactacgagacgtagacaacggaacgacaaccgaaggggaggtaagggggggggggg

SEQ ID NO: 4065 - DNA, 1350 bp, Citrus sinensis
aaaaagcctgaggggttatgtaaaggaaaacagaaaatgtggagaaaacggtgtacatggtgagaggctggctctttcccagagccactgagccagagccagctcccgcgcccgcgcacgcgtgcagaaaattcgtacatacacacacctgcagagaattacttccattctatgcataaataaataaagggggcaggcaggcaggcaggcaggcaggcatcaaaggcaaatcccgaaaatccgaggcccccgagatctcgtcctccatctccttctctccgttgaatacacccggccgagatctcgtgtaattgcaccaaaactgttgatttttgttgtagatccgaaaaaatggctccggtttcagctctagccaagtacaagttggtgtttttaggggatcagtccgtgggcaaaactagtatcatcactcgcttcatgtacgataaattcgacaacacttatcaggctaccattggtatcgatttcctgtcgaagacaatgtatcttgaagaccgaacggttcgtttgcagctctgggataccgcaggacaagagagattcaggagtctcattcctagctacatcagagattcctctgtcgcagtcattgtatatgatgttgcaagtaggcagtctttcctaaacaccaccaagtgggttgaagaggttcgaactgagcggggcagtgatgtaatcattgtcctcgttgggaacaaaactgatcttgtggacaaaaggcaagtttcaatagaggagggagaggctaaagctcgtgagctcaatgttatgtttattgagactagtgccaaggctggcttcaatataaaggcactcttccggaaaattgcagcagcattacctggaatggaaactctttcttcaacaaagcaagaagatttggtcgatgtcaatctgaagtcttccaacacaaatacatctcaatcacaaccacaatcaggaggttgtgcttgctgagataatacatcttctgggcccttctttgcaacatttccctaatgcttctgtaatctcttttaagtgtctgtaaagttttgtcctccccttctatagcattgatgttttgggtttgtttgactttgttaagaaagttaaatcttgaagaggatattattgtggtagtcagctagccctaacctgtctcatatatacaaatacatgatgtatggttcttgtggcctcacagagatttgtgccaaattccctctttaggaatgtatttagtttcattttcaaaactagtattccattgaacaaagtggatttttgtaccatctcatattccattttgttgtggtgcttttacccggtggaaattaaactattggt

SEQ ID NO: 4066 - DNA, 1257 bp, Petroselinum crispum
cttccgatcttttattttttagctcctcggttaaagtgtttttgtttgtttgtgggagctgccaggcattttctctcactctgcatatataaacacagatcatacacaatacacacaaatattcaaatctgcgatcgttttccggccagatcttcccaatctccgtcggaaaatcgtcgttgatccggttaattaagccctaattcaacctcgatttgatcaatggcgcctgtttcagctttagccaagtataaactggtgtttttgggcgatcaatctgttggtaaaacaagtatcatcactcgattcatgtacgataagtttgataacacttatcaggctactattggcattgactttctgtccaaaactatgtacctcgaggatcgaactgttcgattgcaactctgggacacagcaggacaggaaaggttcaggagtctcattccaagctacattagggactcctctgttgcagtcgttgtatatgatgttgcaagtaggcaatcattcctgaacactgtaaaatggattgaggaggttcgtagtgagcgaggcagtgatgtcattatagtccttgttgggaataaaactgaccttgtggataagagacaagtctcaatagaggaagcagaagccaaagctggtgaccaaaatgttatgttcattgaaaccagtgccaaagcgggattcaacattaaggcactatttcgaaagattgctgcagccttaccaggaatggaaacattatcttctgcaaagcaagaagatatggttgatgtcaatctgaagtcaaatgcaaattcgtctcagacacaatcagaatcaggaggatgttactgctgatagctttgaacagtaggcttctcttacatgttggttccttttctcttttgcaatctttgtgcatgtttgtgtaatttcagaatattgagctttatgacatatagaacattaacattttagtaatggtaggttgatctattttatgtttcacatttgattgttttggaacttttttgagaaatttcatttggcatatagtttgaatgtttattcttgtctgttgaatgagtggggaaataaatatgcctaattgtgaccaattatgtgtatctgaggattatcatctcagagttgatcaatgcacaagttttaaatggcatattatgttctggggatagggttgcatttttccggggtttgactatttgtgctaaatgctggcctgaattgctttagtggaagatctaattt

SEQ ID NO: 4067 - DNA, 1104 bp, Silene vulgaris
caaactccttgggtgcgatcagtgcctggccattcccaaactccattgttctctctccaacatcactctcgtaacaattcaaccgatcttccccaattttccacctaaattcaaattattcactgtcaattttcctcgattgcgacgaatttcagtgatctgatcccttaacaatggcgccagtatctgctctcgcgaaatacaagcttgtgttcttaggtgatcaatccgtcggtaaaactagtatcatcactcgattcatgtacgacaagttcgataatacttatcaggctacaattggtattgattttctatcaaagaccatgtatcttgaagatcgtactgtacgtcttcaattgtgggatactgctgggcaggagaggttccggagtcttatacctagttacataagggattcatcagttgcagtcattgtatatgatgttgctagccgacaatcctttctaaacactattaagtggattgaagaggtccgcactgagaggggcagtgatgttattattgttcttgttggaaacaagactgatcttgtggacaaaaggcaagtctcaattgaggaaggtgaagcaaaagctaaggatctcaatgtcatgttcattgaaactagtgctaaagctggcttcaacataaaggcactctttcggaaaatcgctgcagctttgcctggaatggagacactctcttcaacaaagcaagaggacatggttgatgtaagtctcaagtccacctcaagtgcaccgcagtccggtgctcagtctggtgggtgtgcttgctgaccgccaacagggtccccatggaagcctcacctaattaactcgtgtgtacttttatttccttgcatccttgaggctacaaagattttgctcgttcaccgaagtatcatattcatagtcatagactcgtagtgttgctttttcgtgctagacttcttcacccagaatttaagagagttagaatttttgaggatatgtcggagttcatgccattatttgtctaaatgttgtcgtatgtgaatatgcttggccgctcaaagtgacagtcaggtttttcatctgtgccccttccctgccagaaccatgtaga

SEQ ID NO: 4068 - DNA, 862 bp, Euphorbia esula
ctttacccctgttatttgaaatcagaatttatacaaacatcgggatcggagaattcgattcccagaggatccatccggagtcatcgtcgataaattctcgggaagtttcaatttcctatacgatcttcatacgatccttggatagatccgatcaatggctccggtttctgcactagccaagtacaagctggtcttcttgggggatcaatctgtggggaaaaccagtatcatcactcgattcatgtacgataagttcgacaacacctatcaggctactataggtatcgattttctatcaaagacaatgtaccttgaagatcgaactgttagattgcagctctgggatactgctgggcaggaaaggtttcggagccttattccaagctatatccgggattcctcagttgcagtaattgtgtatgatgttgcaagcagacagacattcctcaacacttctaagtggattgaagaggttcgctctgagcggggcagtgatgttatcatcgtactcgttggaaataagactgatctcgtggagaaaaggcaagtttccatagaggacggagaagctaaagctcatgagctcaaggtcatgtttatcgaaacaagtgcaaaggcaggctttaatataaaggcactgttcagaaagattgcagcagccttgccgggaatggaaacactttcctcagccaagcaagaggatatggtggatgtgaatctcaagtcttccaatacaaatgcttcctcgtctcaagctcaatctggatgtagctgttgatatacgaaacacagaagaagaaacctttttccagccattttcttggcatcttttacatgtaaagtttcaacagtaactactata

SEQ ID NO: 4069 - DNA, 1114 bp, Helianthus annuus
cggaatccactcttcaactcaaccaaacaaacccttattattattatcattgtctccgcccgatctcaaccattttccggcgagatctccaccacatccgtcggaaaaccttcactctccgatcacaaccgccgccgtttgatccgattgtcgcactgtattcatattcactctcaaaacaatggctccggtgtcggctttagcgaaatacaagctcgtgttcttaggagatcagtcagttggaaaaacgagcatcatcactcgattcatgtatgataagttcgataatacttatcaggctactattggtattgattttttatccaaaaccatgtatcttgaagatcgaaccgttcgcttgcagctttgggacacagctggacaagaaaggttccggagtctcattcctagttacatccgcgactcctctgtcgctgtcattgtttttgatgtcgcaagccgacaatcatttctgaacactgcaaaatggatcgaggaggttcgtactgaacggggtagtgatgtcatcatcgtccttgttggaaataaaactgaccttgtagataagaggcaagtttccatagaggaaggagaagctaaagctcgtgaatttaacgtaatgttcattgaaactagtgccaaagctggattcaatataaaggctttatttcggaaaatagcttctgcgctaccgggaatggaaaccttatcttcaacaaagcaggaggacatggttgatgtaaatctcaagtccagcaatgcaagtgggtcccaacagcaaccgcaatcgggcgggtgtgcatgttgattagtcagattcttaatataccaagctagtctcggatatcttggaaggttagttgtttcgcttatacagaaagggttttgctatgcttgaattgcttttagcgcgatatgtgtgcctgtgtttacaatttgaaaacgttctttatgttgggagtttgaactctaaagttcttggaattttatttgagactcgagttagttggcagttttgattatctgaatttctcatgtcgctatggttgttgattggttaattttttcgttgtcatgccggttagttatattccagactctgttattgtgtatt

SEQ ID NO: 4070 - DNA, 834 bp, Centaurea maculosa
tttccggcgagatctcgaagattttccggcgagatctctaaatattcgtcggagaatcttcactcttatctgaatctagtagtggtatattcgaatctatggctccggtgtcggctttagccaagtacaagctcgtcttcttaggagatcaatcagttggaaaaaccagcatcatcactcgattcatgtatgataagtttgacaacacttatcaggctactattggtattgattttttatcaaagactatgtaccttgaggatcgaacagtacgcttgcagctttgggacacagctggacaagaacggttcaggagtctaattccaagttacatcagggattcctctgttgctgtcattgttttcgatgttgcaagccgacaatcatttatgaacacggcaaaatggatcgaggaggttcgaaccgagagaggtagtgatgtcatcatcgtccttgttggaaacaaaactgaccttgtggataagaggcaagtttctatagaggagggagaagctaaagctcgtgagtttaacgtaatgtttattgaaactagtgccaaagcgggcttcaatataaaggctttgtttcgaaagatagcttcagctttaccgggaatggaaacattatcttcttcaacgaagcaggaagacatggtggatgtaaatctcaagtccaacaattcaaatggatctcagcagcaaccccagtctggaggatgctcatgctgatcattatatttttgaaaggttagtaagtgccctactatgcctacctacttatgctttcaatttagtatttgaatcaattagtttttagttgtgcaatttgcttttc

SEQ ID NO: 4071 - DNA, 882 bp, Centaurea maculosa
acctttttccggcccgatctcgaagattttccggcgagatctctaaatattcgtcggagaatcttcacctttaactgaatctagtagtggtatattcgaatctatggctccggtgtcggctttagccaagtacaagctggtcttcttaggagatcaatcagttggaaaaaccagcatcatcactcgattcatgtatgataagtttgacaacacttatcaggctactattggtattgattttttatcgaagactatgtatcttgaggatcgaacagtacgcttgcagctttgggacacagctggacaagaacggttcaggagtctaattccaagttatatcagggattcctctgttgctgtcattgttttcgatgttgcaagccgacaatcatttatgaacacggcaaaatggatcgaggaggttcgaaccgagagaggtagcgatgttatcatcgtgcttgttggaaacaaaactgaccttgtggataagaggcaagtttctatagaggaaggagaagctaaagctcgtgagtttaacgtaatgtttattgaaactagtgccaaggcgggcttcaatataaaggctttgtttcgaaagatagcttcagcattaccgggaatggaaacattatcttcttcaacaaagcaggaagacatggtggatgtaaatctcaagtccaacaattcaaatggatctcagcagcaaccccagtctggaggatgctcatgctgatcacattatatttttgaaggttagtgagtgccctactatgcctacctacttatgctttcattttagtatttgaatcaattagtttttagttgtgcaatttgcttttcagtctttacttttctcaaagtgttgttatgttgttgatgatg

SEQ ID NO: 4072 - DNA, 981 bp, Centaurea maculosa
tgggaatccgaacctttttccggcgagatctcgaagattttccggcgagatctctaaatattcgtcggagaatcttcaactcttcgatctgaatctagtagtggtatattcgaatctatggctccggtgtcggctttagccaagtacaagctggtgttcttaggagatcaatcagttggaaaaaccagcatcatcactcgattcatgtatgataagttcgacaacacttatcaggctactattggtattgattttttatcaaagactatgtatcttgaggatcgaacagtacgcttgcagctttgggacacggctggacaagaaaggttcaggagtctaattccaagttacatcagggattcctctgttgctgtcattgtttttgatgttgcaagccgacaatcatttatgaacacagcaaaatggatcgaggaggttcgcactgagcgaggtagcgatgttatcatcgtccttgttggaaataaaactgaccttgtggataagaggcaagtttctatagaggaaggagaagctaaagctcgtgagtttaatgtaatgttcattgaaactagtgccaaggcgggcttcaatataaaggctttgtttcgaaagatagcttcagcattaccgggaatggaaacattatcttcttcaacaaagcaggaagacatggtggatgtaaatctcaagtccaacaattcaaatggatctcagcagcaaccccagtctggaggatgctcatgctgatcattatatttttgaaggttagtaagtgccctatgcctacctacttatcctttcaattgagtagttgaatcaaattagtttttagttgtgcaatttgctttttctgtgcttcagtctttacttttctcaaagtgttgtcatgttgttgatgatgaggttatttttgaattttaaacttgatttgtgagtcagttgacgattattgttatagaccctattcacatattgaaaatg

SEQ ID NO: 4073 - DNA, 1006 bp, Cirsium arvense
ttcaatacaaacagacctttttctcctttgggaatctgaaccttttttccggcgagatctccaagattttccggcgagatctctaaaacattcgtcggagaatcttcagcttttgatctgaatctagtagtggtatattcgaatctatggctccggtgtcggctttagccaagtacaagctggtgttcttaggagatcaatcagttggaaaaaccagcatcatcactcgattcatgtatgataagtttgacaacacttatcaggctactattggtattgattttttatcaaagactatgtaccttgaggatcgaactgtacgcttgcagctttgggacacagctggacaagaacggttcaggagtttaattccaagttatatcagggattcctctgttgctgtcattgttttcgatgttgcaagccggcaatcatttatgaacacagcaaaatggatcgaggaggttcgaaccgagagaggcagcgatgttatcatcgtgcttgttggaaacaaaactgaccttgtggataagaggcaagtttctatagaggaaggagaagctaaagctcgtgagtttaacgtaatgtttattgaaactagtgccaaggcgggtttcaatataaaggctttgtttcgaaagatagcttcagcgttaccgggaatggaaacattatcttcttcaacaaagcaggaagacatggtggatgtaaatctcaagtccaacaattcaaatggatctcagcagcaaccccagtctggaggatgctcatgctgatcattatatttttgaaggttagtaagtgccctatgccttacctacttatgctttcaattgattagttgaatcaattagttttagttctgcaattttcttttctgtgcttcagtctttacttttctcaaagtgttgttatgttgttgatgatgaggttatttttgaattttaaacatgatttgtcagttagttgatgattattgttctagaccctattcacatattgaaaa

SEQ ID NO: 4074 - DNA, 959 bp, Cirsium arvense
aacctttttccggcgagatctcgaagattttccggcgagatctctaaacattcgtcggagaatcttcaactcttcgatctgaatctagtagtggtatattcgaatctatggctccggtgtcggctttagccaagtacaagctggtgttcttaggagatcaatcagttggaaaaaccagcatcatcactcgattcatgtatgataagtttgacaacacttatcaggctactattggtattgattttttatcaaagactatgtatcttgaggatcgaacagtacgcttgcagctttgggacacggctggacaagaaaggttcaggagtctaattccaagttacatcagggattcctctgttgctgtcattgtttttgatgttgcaagccggcaatcatttatgaacacagcaaaatggattgaggaggttcgcactgagcgaggcagcgatgttatcatcgttcttgttggaaataaaactgaccttgtggataagaggcaagtttctatagaggaaggagaagctaaagctcgtgagtttaatgtaatgttcattgaaactagtgccaaggcgggcttcaatataaaggctttgtttcgaaagatagcttcagcattaccaggaatggaaacattatcttcttcaacaaagcaggaagacatggtggatgtaaatctcaaatccaacaattcaaatggatctcagcagcaaccccagtctggaggatgctcatgctgatcattatatttttgaaggttagtaagtgccctatgcctacctacttatcctttcaattgagtagttgaatcaaattagtttttagttgtgcaatttgcttttctgtgcttcagtctttacttttctcaaagtgttgtcatgttgttgatgatgaggttatttttgaattttaacttgattgtcagtcagttgatgattattgttctagaccctattctacat

SEQ ID NO: 4075 - DNA, 860 bp, Carthamus tinctorius
cgctaggcggggaatcatacaacacaccctttttctttccttccttcctttgggaatctgaacctttttccggcccgatctcgaagattttccggcgagatctctaaatattcgtcggagaatcttcacttttttcgatcggtcttatttgaatctactagtggtatattcggattaattttcacatctatggctccggtgtcggctctagccaagtacaagctcgtcttcttaggagatcaatcagttggaaaaaccagcatcatcactcgattcatgtatgataagtttgacaacacttatcaggctactattggtattgatttcttatcaaaaactatgtatcttgaggatcgaacagtacgcttgcagctttgggacacggctggacaagaaaggttcaggagtctaattccaagttacatcagggattcctctgttgctgtcattgttttcgatgtcgcaagccgacaatcatttatgaacacggcaaaatggatcgaggaggttcgaaccgagagaggtagcgatgttatcatcgtgcttgttggaaacaaaactgaccttgtggataagaggcaagtttctatagaggaaggagaagctaaagctcgtgagtttaacgtaatgtttattgaaactagtgccaaggctggcttcaatataaaggctttgtttcgaaagatagcctcagctttaccgggaatggaaacattatcttcttcaacaaagcaggaagacatggtggatgtaaatctcaagtccaacaattcaaatggatctcagcagcaaccccagtctggaggatgctcatgctgatcattatatttttgaaggttagtaagtgccctatgcctacc

SEQ ID NO: 4076 - DNA, 2235 bp, Brassica napus
ccggccaccgtggcgagctccagctctccggcgttgctcttgccacctccttcgctaacgtctccggcttcagcatcatgtttgggttagtgggtgcccttgagactctgtgtggccaagcttatggagccaaacaatactccaaactcggaaccttcacgtactctgcaatcgcctccaacgtacccatttgcgttctcatttcgattctctggatttacatggacaaattattgatttccatcggacaagaccatgacatctccaaagtagctggttcctatgcggtttggcttataccgggtttgttcgctcaagcggtgcaacaacctgtaactcggtttctccagactcagggtttagttctacctcttctctactgtgctttaagcacactgttgttccatatacctgtttgctggattctggtctacacttttggtctcggaagcaatggagcagccttggctattagcctgtcttactggtttaacgtattgagtctcgcttgttatgtgagattctccagttcttgcgagaagactcgtggcttcgtgtccgatgatttcgtatctggcgtcaaacagtttttccagtatggaataccatcagcagcaatgacttgcttagagtggtggttgtttgagctccttatattgtcctcaggactcctccctaatccgaaactcgagacctctgttctttcggtttgtctttcaacaggatctttacactatgtcataccaatgggtatcgcggctgctgtgagcacaaggattgcaaacgaattgggtgctgggaatccggaggttgctaggcttgcagtgttcgctggtatttgcctttggctcctagaggctgccatttgtagcacaattctcttcatttccaggaatattttcggctacgcctttagcaacagcaaagaagttgtggactatgtgacagagctagctcctttactctgtctctcgtttattgtagacgggttttcagcagttcttggtggtgttgctaggggaagtgggtggcaacatattggagcttgggcaaatgtggtggcttattatctcattggagctccggttggatttttcttagcgttttggtgtcacatgaatggtaaagggctatggatcggtgtgatctttggttcttcatcgcaaggcatcatacttgctatagtcactgcttgcatgagttggaacgaacaggcttccaaggcaagaaaaagaatagttgtagggacttcttcgtttggcaatggaattgcttgaatggttctttatgtatttttgatacaattcagggagattttgcttttcttcgaatatgggatattatcatgggcagctgtttcgcaagagaagagaacatcggagggtgataatgtaggaatactatgatattatgtcacacccttagtccctcacacactatactgataattgcaattccaagcgcgacgggatctctctctcaccggcgaatactggaaactacttcctccgcgagatctcgacggattctcagatccgtgcggctagtttgatatcgaggaaccatggctccagtctcggcgctcgccaagtataagctggtgtttctgggagatcaatccgtgggaaagacgagcatcatcactcgattcatgtacgacaaattcgacaacacttaccaggccacgattggtattgattttctatcaaagacaatgtaccttgaagatcgaactgtcagacttcagttgtgggatacagctgggcaagagagattcaggagtcttattcccagctatatcagggactcttctgttgctgttattgtctatgatgttgcaagcaggcagtccttcctaaacactactaagtggatcgatgaggttaggacagagcgtggtagtgatgtcatagttgtccttgtgggaaataaaaccgaccttgtggacaaaaggcaagtgtcgatagaggaagcagaagctaaggctcgtgagcttagtgtaatgtttatcgaaaccagtgccaaagcaggcttcaacataaaggctctattccgtaagatagcagcagctttgcccggtatggaaacactgtcttcaaccaagcaagaggacatggttgatgtcaatctcaagtcttccaatgccaatgcatcattggctcagcagcaatcaggaggatgctcttgttagatctggcaacaaacaaactgataaaaaacaacaacaaaaacacg

SEQ ID NO: 4077 - DNA, 1716 bp, Cocos nucifera
cttgaaggtcgctcatttactttgatgtatggaggcaacacgagtggatcgattcagctagatcaatagctaatctatattcccctcgatctctaaaaagttagccaccattcaaattcgtaacctaacaaacccaatccaacctaatcctaccctacagctaggccaaacttcaccaggttagggtgaattaggtcaagcttcagtctgcgggaagtaggttagaagtgggagggaatcagattagactacgcgtgataaacccaaacccagctcgattttatgaactccaacgcaaccagctgagaaacgatatattggcaagtcccaaattccaatccaaatgaaacagttactagctgggctccccattaacaccgcctgagctgcactccaagcgcgcgcaaaagaaaaggaacgaaaggggatcgaagccggactcgttctctagaaatcctgacgccttagctctcggctctgtcaccagatctccggcaatggctccggtctccgccctcgccaagtacaagctggtgttcctcggcgaccagtccgtcggcaagaccagcatcatcactcgattcatgtacgacaagttcgacaacacctatcaggcaacaattggtattgattttctatcaaagacaatgtaccttgaagatcggactgttaggctgcaactctgggatacagctggccaggagattcagaagtctaattcctagctacataagggattcctctgttgcagtaattgtatatgatgttgcaagccgacaaactttcctgaacacctcaaagtggattgaagaggttcgaactgagaggggtggtgatgttatcattgtccttgttgggaacaaaactgaccttgttgacaaaagacaagtctcaatagaagaaggagaggctaaagcccaggatcttggtgtcatgtttatagaaacaagtgccaaagctggcttcaacgtcaaggcactgtttcggaaaattgctgcagcattgccaggtatggagaatctttcctcagcaaaacaggaagatatggttgatgtgaatctcaaaacaaccactacaagtgcatcccaatcacagcagcaatctggaggttgcagttgttaacgccagcccaaaatctgttagcgcataagattacttcatctttaaggagttggtggaattagcttgtcctataatttgatcagtggcactcgtttttctctcaaagcatgcaacctggtcaagaaaaaggcatttgctagaggttatggttatggtggctaaatcagtttccaaacttcataattctaagtaaagattctctcaagcatgtatatagaattcccttttttctattcataattgaccatccaaagaatcttgtgtagaggtgtgttttggactagaatcaagcttttagatttttggtgaactcctctctttctttagtaccgtataagagcgttgaataatggtttacttactaactttggtcattgatgataaatatttttgggcattgccagcagcaacagcattatgaactatatatgcttcctgtcaagactggtttgtgatgggtgttttggtttgtgttaatgtctcaatgctgctggtcttaggagcctagccttcaaaggcttccgcagagtaagattgtgtggctggatgtattcttattttgcatgaaagcttgattctttggagttaccagag

SEQ ID NO: 4078 - DNA, 998 bp, Rosmarinus officinalis
gaaaatacaaacgcgcaaatctatagattcaccacatcgacatctcaggcaactaatcattttccgaagagatccggcaccttctccgtcgtaaagaaagtagttgattccgactccaaagaagtgatctgccttgtgtttgattcggttgacctgattttgactgatggctccggtttcggctctcgccaagtacaagttagtgttcctgggagatcaatccgtcggaaaaacgagtatcatcactcggtttatgtacgacaaattcgataatacttatcaggcaactatcggtattgattttctttcaaagacaatgtatcttgaagagcggacagtacgtctgcagcggtgggatactgctggacaagaaagatttagaagtctcataccaagctatataagggattcctctgttgcagtcatagtatatgatgttgcaagccgacaatcctttcttaacaccgcaaagtggatcgaggaggttcgcactgagagaggaagtgatgttataattgtcctagttggcaacaaaactgatctggtggataagaggcaagtttcaatagaggaagcagaggctaaagctcgtgattttagtgtcatgtttattgaaacaagtgccaaggctggcttcaatataaaggctctattcaggaagatcgctgcagccttgccagggatggaaactctatcatcaacgaagcaagacgagatggttgatgtgaacctcaagtctagcaacgcaaactcatctcagtcacaacagcagtcaggaggatgcgcttgctaaaaaggtaatctggaacatttgtttgtgcttaagatatatctttattggacggaaaatgcatctgtaaagagctttctaccttgagcattgaattttgtttgtaactgtcgagagtatttcaagtcatcggataagtagattgtcgttgttctcttttttctgtttctcatcttactgttggacccatggtaattgagactgcaaa

SEQ ID NO: 4079 - DNA, 1197 bp, Spinacia oleracea
ccaaggccgtaataaagtcctattaggcgttagccggctggttggctcccaaactcactgctgtgctgtctgtccctcacttcggcagcctgcagttcccctccctccctcaaacgtgaaagcgacgagtttcccgcactctccatttcgatccaatctcaaaattcaatcaaatttctcaatctattcaattgaatttccaccagatttgcgatttcttttttgttaatttgaaatcctgttcaaaatccacaccaaaatggcgccagtttcagcattagcaaagtacaagctcgtcttcttaggagatcaatccgttggaaaaaccagtattatcactcgatttatgtatgacaagttcgataatacttatcaggctacaattggtattgattttctatcaaagaccatgtatcttgaagatcgtactgtacggctgcagttgtgggatactgctgggcaggagagattcaggagtcttataccaagttacataagggattcatctgtggcagtcattgtatacgacgtcgcaagccgacagtccttccttaacacagcaaagtggattgaggaagtccgcactgagaggggcagtgatgttattattgttcttgttggaaacaaaactgatcttgtggataagaggcaagtctccatagaggaaggagaagtgaaagcccgtgatctcaatgtcatgtttattgaaactagtgcaaaggctggcttcaacataaaggcactatttaggaaaatcgctgctgctttacctggaatggagacactctcttcaacaaagcaagaagacatggttgatgtaagtctcaagtccacatcgagtgcacctcagtcacagtctcagggcagtggatgttcatgttaaccttgcctcatagttctccatggaaatcacatgctgcttaattttgtgtaccttttttgtacttttggccttttgaatctagaaagattttgtcctcttatctgaagtagttatagtcataatgttgtgatcttcccctctagagtaaaagattgttatttgagaatttgagggactgaaatgtagaaagatccataagatttttatgttataatttgtctgaattccaaagtatgtcaaatgtgaatatgaacttatcatctcaaagagacactcagttccctttgccgtactcccttttaaggaagcataca

SEQ ID NO: 4080 - DNA, 1141 bp, Arabidopsis lyrata
ataaatgacccaattggttactcgaggaataacaaacacactaatacagtatttgcaattccacagcgacgggatctctctccggtaaatatcggaaactttttttctcagcaaagcgagatctcgacgtttctcagatccgtccggcgagttagatccttgagaaatcatggctccggtctcggcactcgccaagtataagctggtgtttctgggagatcaatccgtcggcaaaaccagtatcatcactcgattcatgtacgacaaattcgacaatacttaccaggccacaattggtattgattttctatcgaagacaatgtaccttgaagatcgaacggtcagacttcagttgtgggatacggctgggcaagagcgattcaggagtctaattccgagctatatcagggattcctctgttgctgttattgtgtatgatgttgcaagcaggcaatccttcctaaacactactaagtggatcgatgaggttaggacagagcgtggtagtgatgtcatagttgtgcttgtgggaaacaaaactgaccttgtggacaaaaggcaagtgtcaatagaggaagcagaagctaaggctcgtgaacttaatgtaatgttcattgaaaccagtgccaaagcgggtttcaacattaaggcgctcttccgcaagatagcagcagctttgccgggaatggagacattgtcttcaacaaagcaagaggatatggttgatgtcaatctcaagtcttccaatgcaaatgcatctctcgctcagcagcaatcaggaggatgctcttgttagatttggcaacaacaaatcgatagagaccaacaaaacacactactaaaatcgaagtcctcaagcctttgcatgattcgatcattatcgtcttccatctgtaaaatttttgcctgctttttcaactttttttcttcatcagattgttttaagaaagacttttttttttcttattattttagctgtggtttgtccctaactctgatcttttgcggtctttcgagttgcaaatgctctctgcttcggtacttttgtttacttttatctcaaaactgtgatttgtcagcctatgaatttaattatataaaacttgtgagttgctaataaacacacttatctcgtttcttc

SEQ ID NO: 4081 - DNA, 1000 bp, Arabidopsis thaliana
aatacagtatttgcaattccagagcgacgggatctctctccggtaaatatcggaaacttttattctcagcaaagcgagatctcgacgtttctcagatccgtccggcgagttagatccttgagaaatcatggctccggtctcggcactcgctaagtataagctggtgtttctgggagatcaatccgtcggcaaaaccagtatcattactcgattcatgtacgacaaattcgacaacacttaccaggccacaattggtattgattttctatcaaagacaatgtaccttgaagatcgaacggtcagacttcagttgtgggatacagctgggcaagagcgattcaggagtctaattccgagctatatcagggattcctccgttgctgttattgtgtatgatgttgcaagcaggcagtccttcctaaacactactaagtggatcgatgaggttaggacagaacgtggtagtgatgtcatagtcgtgcttgtgggaaacaaaactgatctagtggacaaaaggcaagtgtcaatagaggaagcagaagctaaggcacgcgaacttaatgtaatgttcatcgaaaccagtgccaaagcgggcttcaacattaaggcgctcttccgcaagatagcagcagctttgccgggaatggagacattgtcttcaacaaagcaagaggatatggttgatgtcaatctcaagtcttccaatgcaaatgcatctctcgctcagcagcaatcaggaggatgctcttgttagatttggcaacaacaacacaacaacaaatcgatagagaacaacaaaacacactactaaaaaatgtcctcaagcccctttgcatgattcgatcagttatcgtcttccatctgtaaaatttttgcctgtttttcaactttttttcttcatcggattgtttttaaagaagactctgttttagctatggtttgtccctaactgtgatcttttgtggtctttggagtttcaaatgctcgctgcttcagtact

SEQ ID NO: 4082 - DNA, 889 bp, Brassica juncea
acgaatacactaatctctccggcgaagattggaaactctttccccgcgacgtatctaagatccgtccagctagtttgatctctcgaggaatcatggctccggtctcggcactcgccaagtataagctggtgtttctgggagatcaatccgtcgggaagacgagcatcatcactcgattcatgtacgacaagttcgacaacacttatcaggccacaattggtattgattttctgtcaaagacaatgtaccttgaagatcgaactgtcagactgcagttgtgggatacagcagggcaagagagattcaggagtcttattccgagctatattagggattcttctgttgctgttattgtctatgatgttgcaagcaggcaatccttcctaaacactactaagtggatcgatgaggttaggacagagcgtggtagtgatgtcattgtcgttcttgtgggaaataaaaccgaccttgtcgacaaaaggcaagtgtcaatagaggaagcagaagccaaggctcgtgagcttaatgtaatgtttatcgaaaccagtgccaaagcaggcttcaacataaaggcgcttttccgcaagatcgcagcagctttgccaggaatggaaacactgtcttcgacaaagcaagaggatatggttgatgtcaatctcaagtcttccaacgccaatgcatctttggctcagcagcaatcaggaggatgttcttgttaaaatttgcaacaacccacaacaagttgatagagaacaagagaaaaacacacagatttaaaagtcctcgagcctcttttttttcccccatcagattgttttagtttatggtttggccctagctctgaattgttatggtctttggattttcgaatgctctctgcttcagtacc

SEQ ID NO: 4083 - DNA, 791 bp, Brassica oleracea
ctcagatccgtctcgatctcgaggttttcaatggctccggtctcggcgctcgccaagtataagctcgtgtttctgggagatcaatccgtcgggaagacgagtatcatcactcgattcatgtacgacaagttcgacaacacttaccaggccacaattggtattgattttctatcaaagacaatgtaccttgaagatcgaactgtcagactgcagttgtgggatacagctgggcaagagaggtttaggagtcttattccgagctatatcagggactcttctgttgctgttattgtctatgatgttgcaagcaggcaatcgtttctgaacactgctaagtggatcgatgaggttaggacagagcgtggtagtgatgtcatagttgtgctcgtgggaaataaaaccgaccttgtggacaaaaggcaagtgtcaatagaggaagcagaagccaaggctcgtgagcttaatgtaatgttcatcgaaaccagtgccaaagctggcttcaacataaaggctcttttccgcaagatagcagcagctttacccggaatggaaacactgtcttcaacaaagcaagaggatatggttgatgtgaatctcaagtcttccaatgccaatgcatcttcggctcagcagcaatcaggaggatgctcttgttaaaaaaaaatttggcaacaaacattatagagaacaaaagaacatactcgaaaaaagccctcgcacgatcttgatctgctattatcttcttctttgtgtaaaatttttgccttcttcttcatcagattgtttttaaa

SEQ ID NO: 4084 - DNA, 719 bp, Brassica oleracea
cgtccagctagtttgatctcgaggaatcatggcgccggtctcggcactcgccaagtataagctcgtgtttctgggagatcaatccgtggggaagacgagtatcatcactcggttcatgtacgacaaattcgataacacttaccaggccacgattggtattgattttctgtcaaagacaatgtacctcgaagatcggactgtcagactgcagttgtgggatacagcagggcaagagagattcaggagtcttattccgagctatattagggattcttctgttgctgttattgtctatgatgttgccagcaggcaatctttcctaaacactactaagtggatcgatgaggttaggacagagcgtggtagtgatgtcattgtcgttcttgtgggaaataaaaccgaccttgtggacaaaaggcaagtgtcaatagaggaagcagaagccaaggctcgtgagcttaatgtaatgtttatcgaaaccagtgccaaagcaggcttcaacataaaggcgcttttccgcaagatcgcagcagctttgccaggaatggaaacactgtcttcgacaaagcaagaggatatggttgatgtcaatctcaagtcttccaacgccaatgcatctttggctcagcagcaatcaggaggatgttcttgttaaaatttccaacaatcaccgcaaattgatagagaacaagaaaaaaaatacacagatatcaaagtcc

SEQ ID NO: 4085 - DNA, 1059 bp, Brassica rapa
aaacgaccccttctctcttcgaataaacattctcagcgacggcatctctctctctctctcaatctccggcttatattgggaagttaacgccctcctccgcgacgtatctcagatccgtctcaggctagtttcgatctcgaggttttcaatggctccggtctcggcgctcgccaagtataagctggtgtttctgggagatcaatccgtcgggaagacgagcatcatcactcgattcatgtacgacaagttcgacaacacttatcaggccacaattggtattgattttctgtcaaagactatgtaccttgaagatcgaactgtcagactgcagttgtgggatacagctgggcaagagaggtttaggagtcttattccgagctatatcagggactcttctgttgctgttattgtctatgatgttgcaagcaggcaatcgtttctaaacactgctaagtggatagatgaggttaggacagagcgtggtagtgatgtcatagttgtgctcgtgggaaataaaaccgaccttgtagacaaaaggcaagtgtcaatagaggaagcagaagccaaggctcgtgagcttaatgtaatgttcatcgaaaccagtgccaaagctggcttcaacataaaggctcttttccgcaagatagcagcagctttacccggaatggaaacactgtcttcaacaaagcaagaggatatggttgatgtgaatctcaagtcttccaatgccaatgcatcttcggctcagcagcaatcaggaggatgctcttgttaaaaaaaaatttggcaacaaacattatagagaacaaaagaacatactcgaaaaaagccctcgcacgatcttgatctgctattaccttcttctttgtgtaaaatttttgccttcttcttcatcagattgtttttaaagagagtctccttgctttagtttattggtttgtccctaactctaaattgttgttgtcttttggagttttaaaggctattcagtacttttttaaatattgtgatttatctgtctccgaaattgaatcatataactttaagctatctatacta

SEQ ID NO: 4086 - DNA, 1060 bp, Fagus grandifolia
acaactcggctggcataattcatttccatttcaatttaattgcccaaaaccaaaactctctctctcatctctcagatcaaacccaatcaaaccaaaccaaaacccagtcttgttcataatcaaattctatctctctgatctccaagaagaagaaaaatggcaccagtttcggctctggcaaagtacaagctggtgtttttgggagatcagtcagtgggcaagaccagcatcatcacccgcttcatgtatgacaaattcgacaacacctatcaggctacaattggtattgattttctatcaaaaactatgtatcttgaagatcgaacagttcggttgcagttgtgggatacagctggacaggaaagattcagaagtctcattccgagctacattagagattcatctgttgctgtcattgtgtttgatgttgcaagcaggcaaacatttctaaacacttcaaagtggattgaagaggtgcgcactgagaggggcagtgatgttataattgttcttgttgggaacaagactgaccttgtggaaaagaggcaagtctccatagaggaaggagaagccaaagctcgtgagcttaatgtcatgtttattgaaaccagtgcaaaagctggctttaatataaaggcattgtttcggaaaattgctgcagctttaccaggaatggaaacactctcttcgacaaagcaagaagacatggttgatgtgaacttgaagtctactactagtggtgcaacacagtctcagccccagtcaggtggatgctattgttgagtgcagcattgttttaaaatttcgagcaactatactctatttcttgctgtttgggttttcagctatctttgccccagatctgtaaaggttttatttagattcttttcccttcgaaatacttgttaccggtataatcttttactgcattgcttgggaaattctcttagggggcacgtgggtctgaagagctaggagtagaactagcattggggaatttgttgtgttggttagatggttataacctctgagatgtgtagtaagatttactgacttgaat

SEQ ID NO: 4087 - DNA, 1114 bp, Vaccinium corymbosum
atagcaaatactaggagaaagcacaacggtgcagacgacagcaagctcgacatccgaacactcgccagtgagatcaggcaacttccgatccgcctgctcattagtgtttgatccggctcgatccgtctgcttattagtattcgatccgacccgatccgccgattagatccgactccctgtgatggctccggtttcagctcttgccaagtacaagctcgtcttcttgggggatcaatcagttgggaaaaccagcatcatcactcgattcatgtacgataagttcgacaacacgtaccaggctactattggtattgattttctatcaaagacaatgtatcttgaagatcgaacagttcggttgcagctctgggatactgctggacaagaaaggtttaggagccttattccaagctatattcgggattcctctgttgcagttattgtatatgatgtagcaagcaggcaatcattcctgaacactgtaaaatggattgaggaggtccgcaccgaacggggcagtgacgttataattgtcgtggtcgggaacaagactgaccttgtggataagaggcaagtctcaattgaagaaggagaagccaaagctcgtgatctaaatgttatgtttatcgagaccagtgccaaggccggcttcaatataaaggcactatttcggaagattgctgcagccttaccaggaatggaaacactatcttctacaaagcaagaagacatggttgatgtcaatctcaagtctagcaaccctagtgcatcgcaggcaccgtcccagtccggaggatgtgcctgttgatatatctattggcgattgaaagctagctgcttccttccttatatatcattctgcgacccccacgatgcatctgtaaagctcttattctcaatagcatttaaattttgtgtggtttgttcaaagttcaacccagaacaggtggttatgaatgtagaaatagttctaaattttttccgggtgtattgattcttatggacgaagtagttctttaattttggccaaagcttatggtcgggaataggcatatgtttggattctatgcggcatcgttgatgaaattttgctcggaaattcaataaatatggg

SEQ ID NO: 4088 - DNA, 1025 bp, Brassica napus
tcagtcagtaattgcaattccaagcgcgacgggatctctctctcaccggcgaatactggaaaactacttcctccgcgagatctcggatacgtgcggctagtttgatctcgaggaaccatggctccggtctcggcgctcgccaagtataagctggtgtttctgggagatcaatccgtggggaagacgagcatcatcactcgattcatgtacgacaaattcgacaacacttaccaggccacgattggtattgattttctatcaaagacaatgtaccttgaagatcgaactgtcagactgcagttgtgggatacagctgggcaagagagattcaggagtcttattcccagctatatcagggactcttctgttgctgttattgtctacgatgttgcaagcaggcagtccttcctaaacactactaagtggatcgatgaggttaggacagagcgtggtagtgatgtcatagttgtccttgtgggaaataaaaccgaccttgtggacaaaaggcaagtgtcgatagaggaagcagaagctaaggctcgtgagcttaatgtaatgtttatcgaaaccagtgccaaagcaggcttcaacataaaggctctattccgtaagatagcagcagctttgcccggtatggaaacactgtcttcaaccaagcaagaggacatggttgatgtcaatctcaagtcttccaatgccaatgcatcattggctcagcagcaatcaggaggatgctcttgttagatctggcaacaaacaaactgatagagaacaacaacaaaaacacgcaccaaaagttatcgagccttctagcatgatcttatccgcaattatcttccccgtctgtaaaatttttgcctgcctttgtcaatcagattgttttgaaactgactttgttttagtttatggtttgtcccaaactctaaacttttcagttctttggagtttcgaatgctctgcttcagtactgtgatttgtatgtcaatgagttgaaattgaatgatataactgtgagctatgtgaat

SEQ ID NO: 4089 - DNA, 875 bp, Brassica napus
acacactaatctctccggcgaatattggaaactccttcccccgcgacgtacctcagatccgatccgtccagctagtttgatctcgaggaatcatggcgccggtctcggcactcgccaagtataagctcgtgtttctgggagatcaatccgtggggaagacgagtatcatcactcggttcatgtacgacaaattcgataacacttaccaggccacgattggtattgattttctgtcaaagacaatgtacctcgaagatcggactgttagactgcagttgtgggatacggcagggcaagagagattcaggagtcttattccgagctatattagggattcttctgttgctgttattgtctatgatgttgcaagcaggcaatctttcctaaacactactaagtggatcgatgaggttaggacagagcgtggtagtgatgtcattgtcgttcttgtgggaaataaaaccgaccttgtcgacaaaaggcaagtgtcaatagaggaagcagaagccaaggctcgtgagcttaatgtaatgtttatcgaaaccagtgccaaagcaggcttcaacataaaggcgcttttccgcaagatcgcagcagctttgccaggaatggaaacactgtcttcgacaaagcaagaggatatggttgatgtcaatctcaagtcttccaacgccaatgcatctttggctcagcagcaatcaggaggatgttcttgttaaaattggtaacaatcacaacaaactgatacagaacaagaaaaaaacacacagatatcaaagtcctcgaggagccttttttttttattccatcagattgttttagtttatggtttgtccctagctctgaactgttatatggtctttggattttcaaat

SEQ ID NO: 4090 - DNA, 971 bp, Brassica napus
acattctcagcgacggggatctctctctctctctggcttagattgggaaactgcttcctccgcgacgtatctcagatccgtctcgatctcgaggttttcaatggctccggtctcggcgctcgccaagtataagctcgtgtttctgggagatcaatccgtcgggaagacgagtatcatcactcgattcatgtacgacaagttcgacaacacttaccaggccacaattggtattgattttctatcaaagacaatgtaccttgaagatcgaactgtcagactgcagttgtgggatacagctgggcaagagaggtttaggagtcttattccgagctatatcagggactcttctgttgctgttattgtctatgatgttgcaagcaggcaatcgtttctgaacactgctaagtggatcgatgaggttaggacagagcgtggtagtgatgtcatagttgtgctcgtgggaaataaaaccgaccttgtggacaaaaggcaagtgtcaatagaggaagcagaagccaaggctcgtgagcttaatgtaatgttcatcgaaaccagtgccaaagcgggcttcaacataaaggctcttttccgcaagatagcagcagctttgcccggaatggaaacactgtcttcaacaaagcaagaagatatggttgatgtgaatcttaagtcttccaatgccaatgcatcgtcggctcagcagcaatcaggaggatgctcttgttaaaaaaaaaaagaattggcaacaaacattatagagaacaaaagaacatactcggaaaaagccctcgcatgatcttgatctgttattatcttcttctctgtgtaaaatttttgccttcttcatcagattgttttaaaagggagtctccttgcttttagtgtgtggtttgtccctaactctaaaactgttgttgtcttttggagttttaaagactatgtatgcttcactacttttgttaaatattgtg

SEQ ID NO: 4091 - DNA, 1042 bp, Brassica napus
ctcttcgaataaacattctcagcgacggcatctctctctcctctctccaatctccggcttatattgggaagttaacgccttccaccgcgacgtatctcagatccgtctcaggctagtttcgatctcgaggtttttcaatggctccagtctcggcgctcgccaagtataagctggtgtttctgggagatcaatccgtcgggaagacgagtatcatcactcgattcatgtacgacaagttcgacaacacttaccaggccacaattggtattgattttctgtcaaagacaatgtaccttgaagatcgaactgtcagactgcagttgtgggatacagctgggcaagagaggtttaggagtcttattccgagctatatcagggactcttctgttgctgttattgtctatgatgttgcaagcaggcaatcgtttctaaacactgctaagtggatcgatgaggttaggacagagcgtggtagtgatgtcattgttgtgctcgtgggtaataaaaccgaccttgtggacaaaaggcaagtgtcaatagaggaagcagaagccaaggctcgtgagcttaatgtaatgttcatcgaaaccagtgccaaagctggcttcaacataaaggctcttttccgcaagatagcagcagctttgcccggaatggaaacactttcttcaacaaagcaagaggatatggttgatgtgaatctcaagtcttccaatgccaatgcatcttcggctcagcagcaatcaggaggatgctcttgttaaaaaaaaaaaaaattggcaacaaacattatagagaacaaaagaacatactcagaaaaagccctcgcatgatctgatccgctattatcttcttctatgtgtaaaatttttgccttcttcttcatcagattgtttttaaagagagtatccttgctttagtttattggtttgtccctaactctaaattgttgttgtcttttggagttttaaagctattcagtacttttttaaatattgtgatttatccgttccaaaattgaatcatataactttgagctatc

SEQ ID NO: 4092 - DNA, 1102 bp, Cocos nucifera
aagcagccagccaggcaatctccttccgagagctaaacggttatggcggaacatcaaacgggtacagccgacgtggagttcactgccctgcaaccggaacggcattcggtgcctacggaacgaatttaaaatagaaaaaaccatacaaaaagccagtgaagacggcgtgtgacctgtagaaatcctcggggctgccggtgcttctcgcccgaagccccttgctctctctcgctctcctctcgctctcccgttcgtgcttccgattccgtcaaaagcgctctctcgcttcggcgatggctccggtctccgccctcgccaagtacaagctggtgttcttgggggatcagtcggtggggaagaccagcatcatcactagattcatgtacgataagttcgacaacacctaccaggctacaattggcattgattttctgtcgaagactatgtaccttgaagatcgaactgtcagactacaactttgggatacagctgggcaggagagatttaggagcctaattccaagctacattcgagactcctccgttgcggtcattgtatatgatgtctcaagccgacagtctttcctaaatacttcaaagtggatcgaagaggttcgcacagagaggggtagtgatgttatcattgtccttgttgggaacaagactgaccttgttgacaagaggcaagtctcaatagaggaaggagaagccaaagcacgagagcttggtgtcatgtttattgaaacaagtgccaaagctggcttcaatgtaaaggcattgttccggaagattgctgctgcgctgccggggatggagactctctcattgacgaagcaggaagacatggttgacgtgaacttgaaggctaccagtgtaaattcatcccagtcacagggaccatctggaggatgcaactgttgacactcatccgggtcctgttacattgctcttactaacgcatgtgagctactatcaaattttgtctgcttcatctcagctccagaccatgtcacctttctttatagagctgcatgaacctacttagaaaaggaaaaggtggctgaggttctggcgggtgaatcagtctcttgtcaatgtgtttg

SEQ ID NO: 4093 - DNA, 860 bp, Flaveria ramosissima
gcgagatctccgtcggataatcttcactctccgatcactacggccgccggagttatctgatcatcgtaccgtattatcttcaacacaatggctccggtgtcggctttggccaagtacaagctcgtgttcttaggagatcaatcggttggaaaaacgagcatcatcactcgattcatgtacgataagttcgacaatacttatcaggctactattggtattgattttttgtccaaaaccatgtatcttgaagatcgaacggttcgcttgcagctttgggacacagctggacaagaaaggttcaggagtctaattcctagttacattagggattcctctgttgctgtcattgtttttgatgttacaagccgccaatcatttctgaacactgcaaaatggattgaggaggttcgtactgagcgaggtagtgatgtcatcattgtccttgttggaaataaaactgaccttgtagataagaggcaagtttccatagaggaaggagaagctaaagctcgtgactttaacgttatgttcattgaaaccagtgccaaggctggtttcaacataaaggctttatttaggaaaatagcttctgcattaccaggaatggagaccttatcttcaacaaagccagaagacatggttgatgtaaatctcaagtccagcaatgcaagtgggtcccaacagcaaccgcagtcgggagggtgtgcatgctgatgtgtcagatttataatataccaagctagtctcagatggatatcttcgaaggttagttgcttatacagaaagggctttgctatgcttggattactattagcgtgatatgtcttcgtatgcttccgtatttaccttttataaatgtt

SEQ ID NO: 4094 - DNA, 1109 bp, Panax ginseng
ctcgtattcgatccgtacattgttatgccgatctacttgtagatcctactaatggctccggtttcggctcttgcgaagtacaaactcgtcttcttaggggatcaatcagttggaaaaacaagtattattactcgattcatgtacgataagttcgataacacttatcaggctacaattggcatcgattttttgtccaagactatgtacctagaagatcgaactgttcgattgcaactctgggatacagctggacaagaaaggttcaggagtctcattccaagctatattagggattcctctgttgctatcattgtatatgatgttgcaagcaggcaatcattcctgaacacttcaaaatggattgatgaggttcgcagcgagcggggcagtgacgtcatcattgtccttgtcgggaataaaactgaccttgtggataagaggcaagtgtctatagaggaagcggaagccaaagctcgcgaccttaacgttatgtttattgaaactagcgctaaagcaggattcaatataaaggcattatttcgaaagattgctgcagccttaccaggaatggaaacattatcttctgccaagcaggaagacatggtcgatgtcaatctgaagtcaaccacaagcgcatctcagtcacaaccgcagtcaggaggatgtgcctgttgatagcttgaacagtagtcttcccctctgcttggttctcatacttccccgacccatgaaacatatttgtaaaaattcgttgttgaccctagtagtatctaaagtttgagggtcaatatgtgaaattaatatattagtagtagtagtcgggtgtgtactgtgttctcatccgtgttctctgtattaattttttggactattacactatagttcttcaggttcttcttcccagaaattttggtaggcgtattttgaaaatttctattgttggttattgataattttgagtggttaaaaatttgggtaaattatggccattgcatattgaagtattatttgtcctacttgaggagcgtttgtattgggtgtttgtttgtggtaatagaagtactgatgttatgttaggatcgaaggaatgaaatggatgaagaaatgaa

SEQ ID NO: 4095 - DNA, 1126 bp, Quercus alba
atggggacattggccaaagccatacctctctctctctctctctcatttcatctctcagatcgaatcaaaaccaaaaccaaaacccaatcaaattctctctaacaccttactcaacctttcttctctctaagaaaccaaaaaaatggcaccagtgtcagccctggcaaagtacaagctggtgttcttaggggaccagtcagttggcaagaccagcatcatcacccgcttcatgtatgacaaattcgacaacacctatcaggctacaatcggtattgattttctatcgaaaactatgtatcttgaagatcgaacagttcggttgcagttgtgggatacagctggacaggaaagatttagaagtctcattccgagctacattagagattcatctgttgctgtcatcgtgtatgatgttgcaagccggcaaacattcctaaacacttcaaaatggattgaagaggtgcgcactgagaggggcagtgatgtcatcattgtccttgttgggaacaaaactgaccttgtggaaaaaaggcaagtctccatagaggaaggagaagccaaagctcgtgagcttaatgtaatgtttattgaaaccagtgcaaaagctggctttaatataaaggcactgtttcggaaaattgctgctgctttaccaggaatggaaacactctcttcaacaaaacaagaagacatggttgatgtgaacttgaagtctactagtggtggtgcaacacaatcccagccccagtcaggtggatgctcgtgttgagtgaggcattgttttaaaatttcgagcaactatgctctatttcttgctgtttgggttttcagccatcttcgccccagatctgtaaaggtttcatttagattcttttttccttcaaaatacttgttgtcggttataatcttttactgcattgcttgggagattctcttagggaacacatgggtctgaagagctaggtgtagaactagcattggggaatttgttgtgttggttagacggtcataacctctgagatatttagtaagatttactgacttgaatagattttggtattaagcatttgtaaaatgaatattgggtacattctgcactcttcttgcctttttgtatgagagattt

SEQ ID NO: 4096 - DNA, 1023 bp, Raphanus sativus
gggaattaaacaaacatcagatcagctttactcagagtaattgaaatctggcagatacatatactcggcgtatctgagatcgttccggctagcttgatcatcggaggaataatggctccggtgtcggcgctggccaagtataagctggtgtttctgggagatcaatccgtgggaaagacgagcatcatcactcgattcatgtacgacaaattcgacaacacttaccaggccacgattggtattgattttctatcgaaaacaatgtaccttgaagaccgaactgtcaggctgcagctatgggatacagctgggcaagagaggttcaggagtcttattcccagttacattagggattcttctgttgctgttattgtctatgatgttgcaagcaggcaatccttcctaaacactactaagtggatcgatgaggttaggaccgagcgtggtagtgatgtcattgttgtacttgtgggaaataaaaccgaccttgtggacaaaaggcaagtgtcgatagaggaagcagaagctaaggctcgtgagcttaatgtaatgtttatcgaaaccagtgccaaagcaggcttcaacattaaggcgcttttccgtaagatagcagcagctttgccaggaatggaaacactgtcttcgacaaagcaagaggacatggttgatgtcaatctcaaatcttccaatgcaaatgcatctttggctcaacagcaatcaggaggatgctcttgttagaacaacaactaaacacacacacacaaaactcctcgagccttcgcatgatcccaaacactatcatcgtccgtctctgtaaaatttttgcctgctttataatcagattttttttagagtgactttgtctttggagtttcaaatactctgcttcagcactgtgatttgtatgtctatgattttaattatataactgtgagcacactcatctcgtttcttccttcgatgtgaagacatgtggatagagaaagcaaagcagcatagaatagtctttttgtgttttaccca

SEQ ID NO: 4097 - DNA, 1095 bp, Raphanus sativus
ggatgatttaacataaagacccccattggtccttcttgcttcgaataaacaacatttcagcgacgagatctctctttctttctctctccggctttatattgggaaactgcttggacgtattctcagatccgtcaagtgtagtttgatcgatctcgaggaatcaatggctccagtatcggcactcgcaaagtataagctggtgtttctgggagatcaatcggtggggaagacgagtatcatcactcgattcatgtacgacaaattcgacaacacttaccaggccacaattggtattgattttctatccaagactatgtaccttgaagatcgaactgtcagacttcagttgtgggatacagctgggcaagagagattcaggagtcttattcctagctatatcagggactcttctgttgctgttattgtctatgatgttgcaagcaggcaatcgtttctaaacactgctaagtggatcgatgaggttaggacagagcgtggtagtgatgtcatagttgtgctcgtggggaataagaccgaccttgtagacaaaaggcaagtgtcaatagaggaagcagaagccaaggctcgtgagcttaatgtaatgttcatcgaaaccagtgccaaagcgggcttcaacataaaggctcttttccgcaagatagcagcagctttgcccggaatggaaacactgtcttcaacaaagcaagaggatatggttgatgttaatctcaagtcgtccaacgccaatgcatcttcgggtcagcagcaatcaggaggatgctcttgttaaaaacaaaataggcaacaaaacgttatagagaacaaaagaacatactcagaaaaagccgccctcgcatcatctgatccgctattatcttcttctgtgtgtaaaatttttgccttctccttcatcagattgtttttttaaaaaagagagtctacttgcaaagtttatggtttgtccctaactcttaaaactgttttcgtcttttggagttttaaatactgtgattttgtgtgtcgccaaaattgaattatataacattgagctattatataaagtaaagagtagacggatactcttcttgttctcca

SEQ ID NO: 4098 - DNA, 1014 bp, Raphanus sativus
gaataaacaacatttcagcgacgagatctctctttctctctctctccggctttatattgggaaactgcttggacgtattctcagatccgtcaagtgtagtttgatagatcttggaggaatcaatggctccggtatcggcactcgcaaagtataagctggtgtttctgggagatcaatccgtggggaagacgagtatcatcactcgattcatgtacgacaaattcgacaacacttaccaggccacaattggtattgattttctatccaagactatgtaccttgaagatcgaactgtcagactgcagttatgggataccgctgggcaagagaggtttaggagtcttattccgagctatatcagggactcttctgttgctgttatcgtgtatgatgttgcaagcaggcaatcgtttctaaacactgctaagtggatcgatgaggttaggacagagcgtggtagcgatgtcatagttgtgctcgtggggaataaaaccgaccttgtagacaaaaggcaagtgtcaatagaggaagcagaagccaaggctcgtgagcttaatgtaatgttcatcgaaaccagtgccaaagcgggcttcaacataaaggctcttttccgcaagatagcagcagctttgcccgggatggaaacactgtcttcaacaaagcaagaggacatggttgatgttaatctcaagtcgtccaacgccaatgcatcttcggctcagcagcaatcaggaggatgctcttgttaaaaccaaaatttggtaacaaaacattatagagaacaaaagaacatactcagagaaaaagcagccctcgcatcatctgatccgctattatcttcttatgtgtaaaatttttgcctctctccttcatcagattgtttttaaaaaagagtctacttgcaaagtttatggtttgcccctaactctgaactgttttcgtctttggagttttaaatactgtgattttgtgtgtcgccaaaattgaattatataacattgagctattatataa

SEQ ID NO: 4099 - DNA, 1047 bp, Eutrema halophilum
agaggcacagagcgacgggatctctccggcatatattggaaactcttcacagcgagatctcgacgtatctcagatccgttaggctagtttgatcttgaggaatcatggctccggtctcggcactcgccaagtataagctggtgtttttgggagatcaatccgtcggaaagacgagtatcatcactcgattcatgtacgacaaattcgacaacacttaccaggcgacaattggcattgattttctatcaaagacaatgtaccttgaagatcgaactgtcagactgcagctgtgggatacagcagggcaagagagattcaggagtcttattccgagctatatcagggattcatctgttgctgttattgtgtatgatgttgcgagcaggcaatccttcttgaacacgactaaatggatcgatgaagttaggacagagcgtggtagtgatgtcatagttgtgcttgtgggaaacaaaactgaccttgttgacaaaaggcaagtgtcaatagaggaagcagaagccaaggctcgtgagcttaatgtaatgtttatcgaaaccagtgccaaagcaggcttcaacataaaggcgcttttccgcaagatagcagcagctttgcccggaatggaaacactgtcttcgacaaagcaagaggatatggttgatgtcaatctcaagtcttctaatgcaaatgcatcttcggctcagcagcaatcaggaggatgctcttgttaaaattggcaacaaccacaacaaattgatatggaacaaaacacacacaaaagaagtcctcgagcctccgcataatcagatccgttactatctaccatctgtaaaatttttgcctgctttatctttcttttcatcagattgttttaaaaggaagaggctttgtttttagtttatggtttgtccttaactctaaacttttgtggtctttggagtttcaaatgttctgcattagtacttttgtttgctcttttttattaaacaactataaaattgtgattttgcccgtctttgaattgaattatatatttgagagctatgc

SEQ ID NO: 4100 - DNA, 1076 bp, Eutrema parvulum
gaattaataacacactaatacagtatttgcaattccagagcgacgggatctctctccggcaaatattggaaactcttcacagcgagatctcgacgtatctcagatccgtcaggctagtttgatcctgaggaatcatggctccggtctcggcactcgccaagtataagctggtgtttttgggagatcaatccgtcggaaagaccagtatcatcactcgattcatgtacgacaaattcgacaacacttaccaggccacaattggtattgattttctatcaaagacaatgtacctggaagatcgaactgtcagactgcagctgtgggatacagctgggcaagagagattcaggagtcttattccgagctacattagggattcttctgttgctgttattgtgtatgatgttgcaagcaggcaatccttcctaaacactactaagtggattgatgaggttaggacagagcgtggtagtgatgtcatagttgtgcttgtgggaaataaaaccgaccttgtggacaaaaggcaagtgtcaatagaggaagcagaagccaaggctcgtgagcttaatgtaatgtttatcgaaaccagtgccaaagcgggcttcaacataaaggcgcttttccgcaagatagcagcagctttgcccgggatggaaacactgtcttcgacaaagcaagaggatatggttgatgtcaatctcaagtcttccaatgcaaatgcatctttggctcagcagcaatcgggaggatgctcttgttaaaattggcaacaaccacaacaaattgataaagaacaaaacagacacaaaaaaagtcgtcgagccttccttcgcataatcagatccgctactatctaccatctgtaaaatttttgcctgctttatatttcttcatcagattgttttaaaaagggttcggttttagtttacaatttgtccctaactctaaacttttgtggtctttggagatttaagtgttgctgcttcagtactttcgttatttttaacaacttttttcaaaactgtgatttgtctgtctacgaattaaattatataagggctgtgagctatataaaa

SEQ ID NO: 4101 - DNA, 952 bp, Utricularia gibba
gctgaattccggtcatagaggctcgatctgatctgtattttccaaaggtctccggcgtagagttaaattcatggctcctgtttctgcccttgcgaagtacaagctggtgtttttaggggatcaatcagtcggaaaaacaagtatcataacccgttttatgtacgataaatttgataatacgtatcaggctactattggcattgatttcctgtccaagacgatgtatcttgaagatcgaactgtacgcttgcaactctgggatactgctgggcaggagaggtttagaagtcttattcccagttatataagagattcctcggttgctgttatagtatatgatgttgcgagcaggcaatcctttctaaacacgttgaaatggattgaggaagttcgcaccgagagagggagtgatgttataattgtcctggttggcaataaaactgatctggttgagaagaggcaagtttcaatagaggagggagaggcaaaagctcgtgatctgaatgtcatgtttattgaaactagtgctaaagctggttttaatgtaaaggcattgttcaggaagatagctgctgccctcccagggatggaaaccctttcgacatccaagcaagaagacatggtggacgtcaacctcaagtccagcaacccaaacgcacagtcccagcagcaatcaggaggatgcgcctgctgatgagaaaaagccgcgggcagtcgttggtacattttggtgctgaaaacgttatatgcttctgtaaagcttctatcattgatgtagtctctgcgttggttccttgaaaacgtactcgagatggtgtagaattccgttgtttgatgttcctgcgtctgtctcattagaccctcagtgccctcagcactgcgtgtgagtgattgtttttgaccttgtttctccttttctctgtagaaccatgcactgttcaatttcctttta

SEQ ID NO: 4102 - DNA, 915 bp, Glycine max
agatttctgaaatggcgcctgtttcagctttagccaagtacaagctcgtcttcctgggtgaccaatccgtgggcaaaaccagcatcatcactcgcttcatgtatgataaattcgataacacctatcaggctacaattggtattgattttctatcaaaaactatgtatcttgaagatcgaactgttcgactgcagttgtgggatacagctgggcaggaaagatttagaagtcttattccaagctacatcagggactcatctgtagctgttattgtatatgatgttgcaagccggcagactttcttaaatactgctaagtggattgaagaggtgcgaacagaaagaggcagtgatgtcattattgttcttgttgggaacaaaactgatcttgttgagaaaagacaagtctctatagaggaaggagaagcaaaagcacgtgagctcaatgtcatgtttattgaaactagtgctaaggctgggtttaatataaaggccctatttcgaaaaattgctgcagcattacctggaatggaaacactatcttctgcaaaacaagaagacatggttgatgtaaacttaaagtctacaactggcagtgcgcagtctcaacctcagccaagtggatgtgcttgttaaatatactttatcatgtgcggtccacctttttgtgtcattccttttgttttatgcagatttttctagtcttctacatcattatatgaaaagatgaaagaatatataagcgatcggggtaggggttgatacaagttgtgtctagaaaatttctgttgttagttggttttgcccgtgatactgtgtactaaagtagtaaagctgcccaaccaaagattgaattatgttcattgtaaccctgtaaaacgtgttataagtttaaaatttaacttgttcatttgga

SEQ ID NO: 4103 - DNA, 789 bp, Glycine max
cttcttgttcctctcgcccagaatccgagatcaaccctgacccctaaggccaggggtttttctcggcttcttcagattcctgaaatggcgtctgtttcagctttagccaagtacaagctcgtcttcttgggtgaccaatccgtgggcaaaaccagcatcatcactcgcttcatgtacgataaattcgataacacctatcaggctacaattggtattgattttctatcaaaaactatgtatctcgaagatcgaactgttcgactgcagttgtgggatacagctggccaggaaagatttagaagtcttattccaagctacattagggactcatctgtagctgttattgtatatgatgttgcaagccggcagactttcctaaatactgcaaagtggattgaagaggtgcgaacagagagaggcagtgatgtcattattgttcttgttgggaacaaaactgatcttgtcgagaaaagacaagtctctatagaggaaggggaagcaaaagcacgtgagctcaatgtcatgttcattgaaactagtgctaaggctgggtttaatataaaggccctatttcgaaaaattgctgcagcactacctggaatggaaacactatcttctgcaaaacaagaagacatggttgatgtaaacttaaagtctacaaatggcagtgctcagtctcaacctcagtcaagtggatgtgcttgttaagtatactttatcatgtgcggtccacctttttgtgtcatgctttttgttttatgcgggtttttctatagtcttctacagcat

SEQ ID NO: 4104 - DNA, 1338 bp, Brassica rapa
aaatgagccattggtctgctttttatcatttgtccgctagttcaagcccagcccaagttaatacgtgggccttgttataaagcccataattttctgatcagcttacgcacacactaactacagtaattgcaattccaagcgcgacgggatctctctctcaccggcgaatactggaaactacttcctccgcgagatctcgacggattctcagatccgtgcggctagtttgatatcgaggaaccatggctccagtctcggcgctcgccaagtataagctgctgtttctgggagatcaatccgtgggaaagacgagcatcatcactcgattcatgtacgacaaattcgacaacacttaccaggccacgattggtattgattttctatcaaagacaatgtaccttgaagatcgaactgtcagactgcagttgtgggatacagctgggcaagagagattcaggagtcttattcccagctatatcagggactcttctgttgctgttattgtctacgatgttgcaagcaggcaatccttcctaaacactactaagtggatcgatgaggttaggacagagcgtggtagtgatgtcatagttgtccttgtgggaaataaaaccgaccttgtggacaaaaggcaagtgtcgatagaggaagcagaagctaaggctcgtgagcttagtgtaatgtttatcgaaaccagtgccaaagcaggcttcaacataaaggctctattccgtaagatagcagcagctttgcccggtatggaaacactgtcttcaaccaagcaagaggacatggttgatgtcaatctcaagtcttccaatgccaatgcatcattggctcagcagcaatcaggaggatgctcttgttagatctggcaacaaacaaactgataaaaaacaacaacaaaaacacgcaccaaaaagttatcgagccttctagcatgatcatatccgcaattatcttccccgtctgtaaaatttttgcctgcctttatcaatcagattgttttaaaactgactttgttttagtttatggtttgtcccaaactcctaaacgtttcaggtctttggagtttcgaatgctctgcttcagtactgtgatttgtatgtttatgagttgaaattgaatgatataactgtgagctatgtgaattaaacacactctacttgtttctaccttccatgtgaagacaggtgaatagagaatataatattttgttttctttttgttttacccataaagaaacatagaattaagttcgaacacatgtctcttggtcagactgctttaatgagctaattaaatgcaaagtcccactgttcccaggtattccccttg

SEQ ID NO: 4105 - DNA, 923 bp, Bupleurum chinense
gtcattttccggccagatcttcgaaatattcgtcggaaatcatcgttgattgagcctgattcgacttagatttccagaatggcgcctgtttcggccttagctaagtataaactcgtgtttttgggcgatcaatcggtcggtaaaacaagtattattactcgattcatgtacgataagtttgataacacatatcaggctacaattggcattgactttttgtccaaaactatgtatcttgaggatcgaactgttcgattgcaactctgggatacagctggacaggaaaggttcaggagtctcattccaagctacattagggattcttctgttgcagtcattgtatatgatgttgcaagcaggcaatcattcctaaacactgtaaaatggatcgaggaggttcgcagtgagcgaggcaatgatgtcatcattgtccttgtgggaaacaaaactgaccttgtggataagaggcaagtctctatagaagaagcagaatccaaagctggtgacctaaatgttatgtttattgaaaccagtgccaaagcgggattcaatataaaggcattattccgtaagattgctgcagccttaccaggaatggaaactttatcttctacaaagcaagaagacatggtcgacgtcaatcttaagtcaaccacaagttcatctcagtcacaatcagaatcaggaggatgtgcttgctgatagctatgaacagtatgcttcccctccatcttggcattgcttacctttttgcgatttttgtgcatgtatgtgtattcattgaaagattgtggttctacaagatactgaacattgacattttagttaaaatgcaggtttaattaaaattactgtaatttcctgtatgattctcttcgaacttcaagactttttttttatttaaatacgtctggtcactggtc

SEQ ID NO: 4106 - DNA, 1667 bp, Cannabis sativa
ttttttttttttttttttttttttctaatttatttatatataaaaaacgtgtttcttctcgtttctccgtcaccttgggttttcttatttggtgctggctcaaacggtgtcgtttagtgttagagttacagacatagtgtatcattcaattctcttattggtcgttaaggaacacggagctccgtttcgtcgaaacatcttcttcttcttcctctaatccaacccaaactcacgcgcattacagtctgttttttcatctctctctctacaaaaattaatggtataaatacgaagctagagagataaagagaaagagtgaacgaggaagaagaattttcaatacaataaatttgatctctaactcttctgtctcgatctggatcggacttggtagatccatcggaatcaaatggccccggtatcggctctagctaagtacaagctcgtcttcttgggagatcagtctgtcggtaaaaccagtatcatcacccgcttcatgtatgacaagttcgacaacacctatcaggctactattggtatcgattttttgtcaaagacaatgtatcttgaagaccgcactgttcgattgcaactctgggatactgctggacaggaaagatttaggagtctcattccaagctatatcagggattcctctgtagctgtcattgtatatgatgttgcaagcaggcaatcatttctaaatactgccaagtgggtcgaggaggttcgtactgaacgagggagtgatgttatcattgtacttgttggaaacaaaacggatcttgtagagaaaaggcaagtttcaatagaggaaggagaagccaaatcgagtgaactcaatgttatgtttattgaaactagtgccaaggctggttttaacatcaaggcattattccgtaagattgctgctgccttaccagggatggaaacactctcctcaacgaaacaagaggacatggtcgacgtcaatctcaagccttccaatgcaaatacattgcaatctcaacaacagtcaggcggatgtgcttgttgattttacccaattgaattcaagctgtagtgtctattgcaccatttagatcctgttctctgtaaagctaagcccctgcttcaccttccattttttttttaatagaacttggattgttggtataatgttgattgttaaaaaggtttaggaggcccttgttgggctataaagaatatagaaactgaagaaactatttgggaaaaagttcacttgtgaactcttcacataaaatggttatttttcaatataggctatgtggttgaccttactttttcactgctttttggcctttacaagttagaaaggacaatggtacatcatacagttcccatgtttctgtatatttattcctctttaatgcagactgatgaaaagggtatttggtggactttcttgagaaattatgtcagtgcttcatcctctacaacaagaattcgataaaaaagtgaccttttagatttggtgctttcttctatactttttttggtctgtttagtatcttttgtgttaaacgagcttttttcttttatcttttttgctataatgtgtatttatatatttttttttaggggaatcatccatatatgtacatttatacttttttttcttctaattttataatttgtatttttct

SEQ ID NO: 4107 - DNA, 963 bp, Brassica napus
gaaactccttcctccgcgacgtatctcagatccgtctcgatctcgaggttttcaatggctccggtctcggcgctcgccaagtataagctcgtgtttctgggagatcaatccgtcgggaagacgagtatcatcactcgattcatgtacgacaagttcgacaacacttaccaggccacaattggtattgattttctatcaaagacaatgtaccttgaagatcgaactgtcagactgcagttgtgggatacagctgggcaagagaggtttaggagtcttattccgagctatatcagggactcttctgttgctgttattgtctatgatgttgcaagcaggcaatcgtttctgaacactgctaagtggatcgatgaggttaggacagagcgtggtagtgatgtcatagttgtgctcgtgggaaataaaaccgaccttgtggacaaaaggcaagtgtcaatagaggaagcagaagccaaggctcgtgagcttaatgtaattttcatcgaaaccagtgccaaagcgggcttcaacataaaggctcttttccgcaagatagcagcagctttgcccggaatggaaacactgtcttcaacaaagcaagaagatatggttgatgtgaatctcaagtcttccaatgccaatgcatcgtcggctcagcagcaatcaggaggatgctcttgttaaaaaaaaaagaattggcaacaaacattatagagaacaaaagaacatactcagaaaaagccctcgcatgatcttgatctgttattatcttcttctttgtgtaaaatttttgccttcttcttcatcagattgttttaaaagggagtctccttgcttttagtgtatggtttgtccctcactctaaaactgttgttgtcttttggagttttaaagactatgcttcactacttttgttaaatattgtgatttattggtctccgaaattaaattatataactttgagcc

SEQ ID NO: 4108 - DNA, 1058 bp, Daucus carota
gtttttgtttgtttttgggaggcgtgacgcattctctctactctgcatatataccaaatcgtatacaactaagacccaccaaattttaaatctgcgatcattttccggccagatctttgtaacatccgtcggaaaatcgtcgttgatccggtccgattcaatcgcgatggcgcctgtttcggcattagccaagtataaactggtgtttctgggcgatcaatctgtgggtaaaacgagtatcatcactcgattcatgtacgataagtttgataacacttatcaggctacgattgggatagactttttgtccaaaactatgtaccttgaggatcgaactgtccgattgcagctctgggatacagcaggacaggaaagattcaggagtctcattccaagctacattagggattcctctgttgcagttgttgtatatgatgttgcaagtaggcaatcattcctgaacactgccaaatggattgaggaggttcgcagtgagcgaggcagtgatgtcatcatagtacttgttgggaataaaactgaccttgtggataagagacaagtctctatagaggaagcagaagccaaagctggtgaccaaaatgtcatgtttattgaaaccagtgccaaagcaggattcaatataaaggcactatttcgaaagattgctgcagccttgccaggaatggaaacattatcttctgctaagcaagaagatatggttgatgtcaatctgaagtcaacggtaagttcatctcagtcacaaggagaatcaggaggatgtttctgctgatagctataaaaaatagccttccccgacagactggttccttttattttttgcaatccttgtgcatgtttgtgtaatcatcagaatgttgaggctttatgagatatagaacattagcagtttgtaatggtaggttgaaatctatatgtttcttgtatgattctttggaactcctttgagaaattttgtttggcctatagattgaatttttaaacttgtctgtcagatcaatggggaaataaatttggttaaatgttactctctttgtcct

SEQ ID NO: 4109 - DNA, 1002 bp, Vigna unguiculata
gctccgcgtcttattgtttgttccttttcctctagtccgagatcaaccccgacgaacctccggggtttttctcggcttcttccgattcttctttttgctttcgttttcgattttgcaatggcgcctgtttcagctttagctaagtacaagttggtgttcttgggtgaccaatccgtgggcaaaaccagcatcatcactcgcttcatgtacgataaattcgataacacctaccaggctacaattggtattgattttctatcgaaaacaatgtatcttgaagatcgaacagttcgattgcagttgtgggatacagctggccaggaaaggtttagaagtcttattccaagctacattagggactcatccgtagctgttattgtatatgatgttgcaagccgacagactttcctaaatacagccaagtggattgaagaggtgcgaacagagagaggcagtgatgtcattattgttcttgttgggaacaaaactgatcttgttgaaaaaagacaagtctctatagaggaaggggaagcaaaagcacgcgagctcaatgtcatgttcattgaaactagcgcaaaggctgggtttaatataaaagccctctttcgaaaaattgctgcagcattaccaggaatggaaacactatcctctgccaagcaagaagacatggtcgatgtaaacttgaagtctacaactggcaacgcacaatctcaaccccagtcaagtggatgtgcatgttaattgtagtttgtcatgtgttgtccaccttttgttgtgtttttgattttatgcaggttttttctctagttttctacagcattatatgaaaaaagatgaaagaatatatataagcagtgcagggtaggggttggatataagttctgtccaaaagaattattgttgttaattggatatgtttgctataatgtattaaagtagttaagctccccaacccaaaattggattttattcgttgtactttataaatggtgtgataagttt

SEQ ID NO: 4110 - DNA, 1033 bp, Cucurbita pepo
atcaaagaaagaaagaaggaactgggccaaaagggagagtttccattgcagctgacctcgaccgaaatctccatctccattctgtaattcttcctctgtcggaaaggtaaaccagagatctctccggaaatggcaccgacgtcggctctggcgaagtataagctggtctttctcggagaccagtctgttgggaaaaccagcatcattacacgcttcatgtacgacaaattcgataatacatatcaggctacaattggcattgattttctctcaaaaaccatgtatctggaagatcgtaccgttcgactgcagttgtgggacactgctggacaggaaagattcagaagtctaataccaagctatatcagggactcatctgtcgctgtcattgtttttgatgttgcaagccggcaaactttcgtaaacacttcaaaatggattgaggaggtgcgcactgagaggggcagtgatgtcattatagtgcttgttgggaacaaaacggaccttgtggagaagaggcaagtctccatagaggaaggagaagccaaagctcgtgaactaaatgtcatgtttatcgaaacaagtgctaaagctggattcaatatcaaggcactgttccgaaaaatcgctgcagctttgccgggaatggaaactctctcatcagcaaaacaagaagacatggttgatgttaacctgaagtcctcaggcagtggtgctgcacaatcccagcagcagtcgggtggatgtgcctgctaatgatgcccgatacgaatcgttgacggaatcactctttcttgctttttgctttcaacgtctcaaccttctagaactgtgagcatattcaggtacaagattggttatatctaatatgaatgccttgcttgagcagagactaaattggtaaaatgaaattggtggcaagagtagacgattgttattttatggagtaatttgatgtattggtggagtcattatttgggtcttgggatttgtaaaaaaaaaaggaagttttgttgtcggactcgattacaaa

SEQ ID NO: 4111 - DNA, 1701 bp, Panax ginseng
tatagatttctatgtaattttggtttcttaacaccatttggatttgattttgaattgcatatgctacagagcatgttctgaaacttgggtttgaatcatatctttatgtttgtaatgccttaattcatatgttaatgtgtatacctcatgtaatgatttgcgttttgctatatgtttgacaaaatgtttgatagaaaattagtttcctggaattcattaattttaaaatttgattctgtaagtgatctttttaatatatgcagaatttgctgttatttttttctaatttaaaatgtggattgtatttagaaacttggcttttatacccaatttgagatctgcaatgttgaatctttatatgatcgttgaggaattgcaaataatgtgaagtaggtattatatattttttttgtatttttagtcaaagtaactaactttataatgacatgggaattaggaaggtcaatgactgttgcaatctgaaagggtagttgatcttgtaagttgtatggattggtaggtgggcaatgttgataaaatttatacagatgtgggattttgatttcatggttagactccgagtcattgatattgggtggaaatggtttcagaaaatgattgcatagttaacttaatcgctagttcataaaattcttacctacatcccttttttgataaagagaagttcgaattacttggatttcattagatggcaccagtatcagcacttgccaaatacaaactcgttttcttaggggatcaatcagtgggcaaaacaagcattatcactcgctttatgtatgataaattcgataatacttatcaggctacaattggtatcgattttttgtcaaagaccatgtatctggaagatagaacagttcgtttacagttgtgggatacagctgggcaggaaagatttaggagtctcattccaagttatattagggattcatctgttgcagtcattgtatatgacgtcgcaagtcgacagtctttcctgaatacctcaaagtggattgaggaggttcgcacggagagaggcagtgatgttattattgtcttggttggaaacaaaactgaccttgtggagaaaaggcaagtctctatagaggaagcagaagagaaagctcgtgatcttaacgtcatgtttatcgaaactagtgctaaagttggcttcaacataaaggctttgtttcgaaaaattgctgcagcattaccgggaatggaaaatctttcttccacaaagcaagaagacatggttgacgtgaatttgaggtctaccagtgggactgcatcacaatcccagcctcagtcacgtggatgtgcttgctgatgaatccatgttttaagcttcacccaccatactccatcacacagagtcttctgtgtttggttatctttgccctttgtgacatgtaaaggttttctatctgcttttccttttttattgtgatatctgtaactattgtatccctatttgtcacgagattcatccatctgagacataactgatgggaaagaagcctcgctgtagaaacggttgtcatggtcattaacactcatagtttgtgcttgcagcaaggtttattgagagcagaaagattttgactcctttgcattttatgttgaacccatttgataccgagtgtgagtccactaatttttttcgttgtagcaattgaacttcaggttacagcc

SEQ ID NO: 4112 - DNA, 1001 bp, Glycyrrhiza uralensis
tggctctccgtctccgtcttcttgttccgttcaccgagaacccgagatcaaccccaactgaagcaggggtttttctcggcttcttctgtttccttcctctgcttttgtgctttgcttctgcgatttgaaaatggcgccggtttcagctttagcgaagtacaagctggtgttcttgggtgaccagtccgtgggcaagaccagcataatcactcgcttcatgtatgataaattcgacaacacctatcaggctacaattggtattgattttctatcaaaaactatgtatcttgaagatcgaactgttcgactgcagttgtgggatacagctggacaggaaagatttagaagtcttattccaagctacattagggactcatctgtagctgttattgtatatgatgttgcaagtcggcagactttcctaaacacaacaaagtggattgaagaggtgcgaacagagagaggcagtgatgtcattattgttcttgttgggaacaaaactgatcttgttgaaaagagacaagtctctatagaggaaggggaagcaaaagcgcgtgaggtcaatgtcatgtttattgaaactagcgctaaagctgggtttaatattaaggctctctttcggaaaattgccgcggcattacctggaatggaaacactatcttctgcaaaacaagaagacatggttgatgtaaacttaaagtcttcaactggcagtgctcaatctcaacctcagtcaagtggatgctcttgttgaatatgctttatcctgtgttcgtgtacttttctgtgtcatgctttttgttttatgcaggtttctctatagtcttttacagcatttatatcaaaaggtcaaagaatatataagcagtgcgggggagggtttgatagaagttgtgtctagaaaaattctgttagttggttatgcctgctataatgcactaatgtagtaaaattgccaaacataacattgaattatgttcattgtattgtaccctcaaacg

SEQ ID NO: 4113 - DNA, 1135 bp, Momordica charantia
acaaacgcgggccaaaaagccagagtttccattgccagggacctcggccttctcgtctcattgagaagctctccaatttccattgataattattcctcaatccgaaaggtaaatcagagatctctgggggaaatggcaccagtgtcagctctcgcgaagtataagctggtctttctcggagaccagtctgttgggaaaaccagcatcatcacacgcttcatgtacgacaaattcgacaatacgtatcaggctacaatcggtattgattttctctcaaagactatgtatcttgaagatcgcactgtccgactacagttgtgggacactgctggacaggaaagattcagaagtctaatacccagctatatcagggactcatccgtcgctgtcattgtttatgatgttgcaagccggcagacttttctaaacacttcaaaatggattgaggaggtgcgcactgagaggggaagtgatgtcattatagtgcttgttggaaacaaaaccgacctcgtggagaagaggcaagtctctatagaggaaggagaagccaaagcccgtgaactaaatgtcatgtttatcgaaacaagtgcaaaagctggattcaatattaaggcactttttaggaaaattgctgcagcgttgccgggaatggaaactctctcttcaacaaaacaagaagacatggttgatgttaacctgaagtcctccggcagtggcgctgcacagtcccagccgcagtccggtgggtgcgcctgctaacgagagtacggatgtgaactgttgaaggaatcactctttcttgccttttgctttaagttgctcaaccttgtagagaactgtaagcattcaggtacaagatgtggttatgactatcaatgcctgtcttttgagcaaactaaattcgtagaaagtaattggtgggcagagtagacaactgctattttatgaagttatttgatgtattggtggagtcattatttgggatttgggagaatgtgtaaagattagaagaattatctgggactcgaatacagaattttgctttgttctttgtgtaagttgtaattcatgtctagggggaattctgaaaattttcgtctggttttgcaatggattgttgcgttggttcatatta

SEQ ID NO: 4114 - DNA, 1156 bp, Orobanche aegyptiaca
tcaattttggcaggtgtctaattgtttccctcgtcctccatctgatacctcactcacgtgcagaaacacgcaatgttgctggtaaatggtaatgagcaaaccctctaacttccagaacttagacgcacacatcggtaaattacactttgttctattctccgatcgttttccggcgagaccttaaaatctcagtcggaaagtaaaaaaccaatccgtctgatccgaagacccgatccgcgaccggatttgatcgatggctccggtttcagctctcgcgaagtacaaattagtgtttttgggcgatcagtccgttggaaaaacgagtatcattactcggtttatgtacgataaattcgacaacacttatcaggctactattgggattgatttcctctccaagacaatgtatcttgaagatcgaactgttcgtttgcagctctgggatactgctggacaagaaagatttaggagtctcatccctagctatatacgagactcttcagttgcagttatagtatatgatgttgcaagcagacaatcctttcttaacacttcaaagtgggttgaggaggtccgcactgagagaggaacagacgttattattgtccttgttggcaacaaaactgatcttgtggataagaggcaagtttcgatagatgaaggagaggctaaatctcgtgaccttaatgtcttgttcattgaaactagtgctaaagctggcttcaacataaagccattgtttcggaaaatcgcggcagctttgccgggaatggaaacactctcatcggcgaagcaagaagatatggtcgacgtaaacattaagtctaccaacgcgaatgaatcttcgtcacaacagcagtctggaggatgtgcttgctgattttttttcaaagaattaaaaagaaaacgaaccgggattttgcttttgttggataatgtatgtatctgtaaagttttatgttgggagcgatgagcataatgttgatcatattgtgtttctcatctactatcttctgagacatatgtagacttttgaagatttcgaaagtcttgtattaaattggacattttagaagtttttgaaaaagttatggtgtatctgaatgaaacaaatcaattgttttgaaattcttgatgtatttgaatcacacatttc

SEQ ID NO: 4115 - DNA, 1059 bp, Arachis hypogaea
atcttcttcctcttttcttcgtcgcaaccagaaccggagatcaatctcgaccgtgtctgtgtgtgtggggtttctctcctttgaatcaggtctcgttccgatttcacagtcaaatctcactgtgttgctctgttgacttcaaaaaatggcgccggtttcagctcttgcgaagtacaagctcgtcttcttgggagaccagtccgtcggcaaaaccagcatcatcactcgcttcatgtacgacaagttcgacaacacctatcaggctacaattggtattgattttctatcaaaaacaatgtatcttgaagatcgaactgtacgactgcagctatgggatacagccggacaggagagattcagaagtcttattccaagctacattagggactcatctgttgctgttattgtatatgatgttgcaagccggcagactttcctaaacacagcaaagtggattgaagaggtgcgaacagagagaggcagtgatgtcattattgttcttgttggtaacaagactgatcttgttgaaaagaggcaagtctcaatagaggaaggagaagcaaaagcacgcgaactcaatgttatgtttattgaaactagtgcaaaagctgggtttaatataaaggccctatttcgaaaaattgctgcagcattacctgggatggaaacactatctgctgcaaaacaagaagacatggttgatgttaacttgaaatcctcaacagccaatcctcagtcccaaccccagtcaagtggatgtgcttgctgaatgtgctttatcttgtgcttgcactttttctgtgtcatgctttttgttttatgcagggttctttagtcttttacagcattgtttgaaaagagtaaggatataaaagtcgggcgggttagggttgaaagaagtttcatctagtatctagcagaaatatgttgttagctggttatgccttcaacaatgtactaatgtagtgaaagttggccaacttaatattgaattgttcattgtattgtaccctataaaacgtgtgataaatttaaattttgtatgttcgtttggattga

SEQ ID NO: 4116 - DNA, 1542 bp, Populus trichocarpa
ttttttttttttttcattttggtaaagaccctcgaggatccgaacagccaaaactctaacccgactcgacctgttagcaataaatcaaataccaaaatcgggcttctcttcctaggtaacttctcccctgctccatcaccaatcacagacacaaaatattaaaaagcacatacccactcctatagatctcctcctctctccgatttggctgatcaactattatacagatccctgaaaatattaaataaataatggcaccagtctcagctcttgcaaagtacaaactggtcttcttgggagaccaatcagtcggtaaaacaagcatcatcactcgcttcatgtatgataaattcgataacacctaccaggctaccattggcattgattttctatcaaagaccatgtacctcgaagacagaactattcgtttgcagttgtgggatacagctggacaagaaagattcagaagcctcattccaagttacattagagattcctcagttgctgtcattgtatttgacgttgcaagtcggcaatcctttctgaatacttcaaaatggattgaagaggttcgcactgagaggggcagcgacgtcatcattgtccttgttgggaacaaaactgaccttgtggagaaaaggcaagtttctatagaagaaggagaagctaaagctcgtgaacttaacgtcatgtttattgaaactagtgcaaaagctggttttaatatcaagcctttgttccgaaaaattgctgcagcgttgccaggaatggaggcactttcttcaacaaagcaagaggacatggttgatgtgaacctaaagtctactggtggatctgcctcccagaatcaggcgcagtcaggtggatgtgcttgttgatgccctgaaactttgcaccgttgctatgacaccgtccctgccggaattgtctacaatatttcactaatatgtaaatgactgacttatttcttcatcctttttttcccattctatttgggtagcgtttccattgtgtttgaggaactctctggtaacacttgagtagttgaaaactaggaatagaaagacttgtgattggggttttcttgtgtttcttaggttggttatagagtcatgttgtggaatacgcagtggaattacaggcttcaataggcttttctttctttgttatgttaaacgatctggtaatattatccgtacatcacatgcatattggagttatgatttcctctctgagttcaacaacttgatggcccgatgggtctgtggtggatagcaatgccacctcactctcccaaaaggctaatggcagcttcgtctttcttgtaaacaaggtggcgttttagatcattgaaccatgttttgcagatagctcaaatttgcttcttgatcaactgtgattccagtcctgtataacttcgtcctgataaaaattatgatcgtcgttgaagttgtcgagaacaaacctgcaccttgtactgtagggaccgttctaatatttaataagagggcacggactgcttacagtaagcttgtgttcgct

SEQ ID NO: 4117 - DNA, 1139 bp, Prunus mume
ggttttagttgtttcttcgtccttgaacatttgatgcggaaagcacagaattacaagcatacaagttacaacccaggcgaagccacactccaattctccgataccaaattttaataccagaaaccctcttaagctgagttacccttcaattcattcagtttttttccctctccatctctgtgtatctgatctgggaaaaaatggcaccagtgtcagctttggcaaaatacaagctggttttcttaggggaccagtcagtgggcaaaacgagcatcatcacccgcttcatgtacgacaaattcgacaacacctatcaggctacaattggtattgactttttatcaaaaactatgtatcttgaagatcgaactattcgactgcagttatgggatacagctggacaggaaagatttagaagtctcattccaagctacattagggattcttctgttgctgtaattgtatacgatgttgcaagcagacaaactttcctaaacacttcaaagtggattgatgaggtgcgcactgagaggggaagtgatgttattattgttctggttggaaacaaaaccgacctcgttgacaagaggcaagtctctgtagaggaaggagaagctaagggtcgcgacctcaatgtcatgttcattgaaactagtgcaaaagctggttttaatataaaggcactgtttaggaaaattgctgcagctttaccaggaatggaaacactgtcatcaacaaagcaagaagacatggttgatgtgaatctgaagtctacaggcggcagtgcatcacagtcgcaagctcagtctggatgctcttgttaatgcagcctttgccatgaatgttttgcgtgctcgtgctttgtactttgctctttgattttgcagcctgatctgtaaaggtttcatttataatttcgcatttatttggaagtatttgtcataggtataaatattactggtttgcttgacaaaaatcataaaaccctcataggtacacatgtagctggaagagactttaggggtgtaaaaagaacgtgattggggattttgttgtttcagttacataataattttgctacctgaatttcgttgatgcacattcagtagaacgagttttagtgaccaagtataatgact

SEQ ID NO: 4118 - DNA, 661 bp, Prunus persica
tgtatctgatctgggaaaaaatggcaccagtgtcagctttggcaaaatacaagctggttttcttaggggaccagtcagtgggcaaaaccagcatcatcacccgcttcatgtacgacaaattcgacaacacctatcaggctacaattggtattgactttttatcaaaaactatgtatcttgaagatcgaactattcgactgcagttatgggatacagctggacaggaaagatttagaagtctcattccaagctacattagggattcttctgttgcagtaattgtatacgatgttgcaagcagacaaactttcctaaacacttcaaagtggattgatgaggtgcgtactgagaggggaagtgatgttattattgttctggttggaaacaaaaccgacctcgttgacaagaggcaagtctctgtagaggaaggagaagctaagggtcgcgacctcaatgtcatgttcattgaaactagtgcaaaagctggttttaatataaaggcactgtttaggaaaattgctgcagctttaccaggaatggaaacactgtcatcaacaaagcaagaagacatggttgatgtgaatctgaagtctacgggcggcagtgcatcacagtcgcaagctcagtctggatgctcttgttaatgcagcctttgccatga

SEQ ID NO: 4119 - DNA, 1262 bp, Chenopodium quinoa
ataaagtccactttgaggcgttagccgggctggttagcttcctaactcactgctgtctctccctcacttcggcagctctttctctctcctcccctccaacccgaaaacgacaaatttcccacactccaatcttccaatcgccatcttattttttctgggattcatctcaaattcaaacaaatttctcaaacgattcaatcgaatttcatcttgatttgcggaaattgtgtttttattcacttgaattcaccttcaaaatccccaaaaatggcgccagtttcagctttagcaaaatacaagctcgtcttcttaggagatcaatctgttggtaaaaccagtataatcactcgttttatgtatgacaagttcgataatacctatcaggctacaattggtattgattttctatcaaagaccatgtatcttgaagatcgtactgtacgactacagttgtgggatactgctgggcaagagagattcaggagtcttataccaagttacataagggattcgtctgtggcagtcattgtatatgatgttgcaagccgacaatccttccttaacactgcgaagtggattgaggaagtccgcactgagaggggtagtgatgtcattattgtccttgttggaaacaagactgatcttgtggataagaggcaagtctccatagaagaaggagaagcaaaagctcgtgatctcaatgtcatgtttattgaaactagtgcaaaagctggctttaacataaaggcgctgtttaggaaaattgctgctgcattaccgggaatggagacactctcttcgacgaagcaagaggatatggttgatgtaagtctcaagtccacgtctagtgcaccccagtcgcagtcccagggaagtggatgtgcttgctgaccttacctcataaatctccatggaagttgcattctacttagttttgtgtacctttttgtactttcggccttgaactctagaaagattttgctctcttctctgaagtaatcatagtgataatgttgtgctgttcctgctagagtaaaagattgttctttgagaatttgagggactaaaggacgtagaaatattcgatttattatgctattatttgtctgaactccaacgtatttcagatatgaatatgacttgttagctcaaagagacggttagcttcctttgccacactctgtcttttggaagcatacggagctaatgcttgctagcatgattcacatcctccattctcaagatatgtatttttttcactt

SEQ ID NO: 4120 - DNA, 925 bp, Raphanus sativus
ctcgagacgtatcacagatccgtcaggctagtttgatctctcgaggcaatcaatggctccggtatcggcactggccaagtataagctggtgtttctgggagatcaatccgtcggcaagacgagtatcatcactcgattcatgtacgacaaattcgacaacacttaccaggccacaattggtattgattttttgtcaaagacaatgtacctcgaagatcggactgttagactgcagttgtgggatacggcagggcaagagagattcaggagtcttattccgagctatattagggattcttctgtcgctgttattgtctatgatgttgcaagcaggcaatccttcctaaacactactaagtggatcgatgaggttaggacagagcgtggtagtgatgtcatagttgtgcttgttggaaataaaaccgaccttgtcgacaaaaggcaagtgtcaatagaggaagcagaagccaaggctcgtgagcttaatgtaatgtttatcgaaaccagtgccaaagcaggcttcaacataaaggcgcttttccgcaagatcgcagcagctttgcccggaatggaaacactgttttcgacaaagcaagaggatatggttgatgttaatctcaagtcttccaacgccaatgcatctttggctcagcagcaatcaggaggatgttcttgttaaaatttgcaacaaccacaacaaattgacagagaacaagaaaaaaaaaacacagatataaaagtcctcgagcctttttttcatcagattgttttagtttatggtctttggattttcaaatgctctctgcttcagtactttttgttagttttcaacaacttttcccaaaactgtgatttgtctatgtattggattttataactgtaatcttttataaactagacagacgcttcttgtttaaaaaaaaaa

SEQ ID NO: 4121 - DNA, 1003 bp, Glycine max
cttctgctccgcgtcttcttgttcctctcgcccagaatccgagatcaaccccgacgaaggcaaggggtttttctcggcttcttcagatttctgaaatggcgcctgtttcagctttagccaagtacaagctcgtcttcctgggtgaccaatccgtgggaaaaaccagcatcatcactcgcttcatgtatgataaattcgataacacctatcaggctacaattggtattgattttctatcaaaaactatgtatcttgaagatcgaactgttcgactgcagttgtgggatacagctgggcaggaaagatttagaagtcttattccaagctacatcagggactcatctgtagctgttattgtatatgatgttgcaagccggcagactttcttaaatactgctaagtggattgaagaggtgcgaacagaaagaggcagtgatgtcattattgttcttgttgggaacaaaactgatcttgttgagaaaagacaagtctctatagaggaaggagaagcaaaagcacgtgagctcaatgtcatgtttattgaaactagtgctaaggctgggtttaatataaaggccctatttcgaaaaattgctgcagcattacctggaatggaaacactatcttctgcaaaacaagaagacatggttgatgtaaacttaaagtctacaactggcagtgcgcagtctcaacctcagccaagtggatgtgcttgttaagtatactttatcatgtgcggtccacctttttgtgtcattccttttgttttatgcagatttttctagtcttctacatcattatatgaaaagatgaaagaatatataagcgatcggggtaggggttgatacaagttgtgtctagaaaatttctgttgttagttggttttgcccgtgatactgtgtactaaagtagtaaagctgcccaaccaaagattgaattatgttcattgtaaccctgtaaaacgtgttataagtttaaaatttaacttgttcatttggattga

SEQ ID NO: 4122 - DNA, 1052 bp, Glycine max
tgcattagttaaatccttctgctctgcgtcttcttgttcctctcgcccagaatccgagatcaaccctgacccctaaggccaggggtttttctcggcttcttcagattcctgaaatggcgtctgtttcagctttagccaagtacaagctcgtcttcttgggtgaccaatccgtgggcaaaaccagcatcatcactcgcttcatgtacgataaattcgataacacctatcaggctacaattggtattgattttctatcaaaaactatgtatctcgaagatcgaactgttcgactgcagttgtgggatacagctggccaggaaagatttagaagtcttattccaagctacattagggactcatctgtagctgttattgtatatgatgttgcaagccggcagactttcctaaatactgcaaagtggattgaagaggtgcgaacagagagaggcagtgatgtcattattgttcttgttgggaacaaaactgatcttgtcgagaaaagacaagtctctatagaggaaggggaagcaaaagcacgtgagctcaatgtcatgttcattgaaactagtgctaaggctgggtttaatataaaggccctatttcgaaaaattgctgcagcactacctggaatggaaacactatcttctgcaaaacaagaagacatggttgatgtaaacttaaagtctacaaatggcagtgctcagtctcaacctcagtcaagtggatgtgcttgttaagtatactttatcatgtgcggtccacctttttgtgtcatgctttttgttttatgcgggtttttctatagtcttctacagcattatatgaaaagatgaaagaatatataagcggatcagggtaggggttgataaaagttctgtctagacaatttctgttgttagttggttttttgcctataatgtgtactaatgaattttttttttttgaacggcataatgtagtaaaggtacccaacccaaaattgaattgtgttcattgtaccctgtaaaacgtgtgatatgtttaaaatttaacttgttcatctggattgacgt

SEQ ID NO: 4123 - DNA, 1120 bp, Trigonella foenum-graecum
ataatttgattcgaaaatggcgccagtatcagctttagcaaagtacaaactggtattcttgggtgatcaatccgttggcaaaaccagcatcatcactcgcttcatgtacgataaattcgacaacacctatcaggcaacaattggtattgattttctatcgaaaactatgtatcttgaagatcgaactgttcgactacagttgtgggatacagctggacaggaaagatttagaagtcttataccaagctacatcagagactcatctgtagctgttatcgtttatgatgttgcaagccggcagactttcctaaatacaacaaagtggattgaagaggtgcgaacagagagaggcagtgatgtcattattgttcttgttgggaacaaaactgatcttgttgaaaagagacaagtctccatagaggacggggaagcaaaagcacgtgagctcaatgtcatgtttattgaaactagtgctaaagctggatttaatattaaggccctttttcggaaaattgctgctgcattacctggaatggaaacactgtcttctgcaaaacaagaagacatggttgatgtaaacttaaagtcttcatctggcaatgctcaatctcaaactcaatcaagtggatgttcttgttgaacatgctttatcttgtacccgtgctgccgtgtaccattctgtgttgtgcttttttgctctatgtaggtttcttctacagcattatatgaaaaagttacagtttacatagaagttatgtgtagaaaaattctggtagttggttatgcctgcgataatgtactattgtagtaaaattgtcaaacttgtcattgaattatgttcgttgtaccctttaagatgatatggttgatgtgaacctaacatcttccggtggcgatgaatctcaacctcaatctggtgggttcttgctgaagttgccttatttagatgttctttgatctttatgcttcattttatttgtttcgaattgtacgtgcctcaaatatgtaaagattctcttgcgttttagacttttacatcattatttgagaggaattagagaaaataaatagaactactattagtatcaaaaaaaaaaactaagagaactagccaacggac

SEQ ID NO: 4124 - DNA, 1071 bp, Amaranthus tuberculatus
ttcttttgggaagttcgcccgctggctggcaccttcccttccttctcttccctccctcattgttctttgtctctctttctctctcctcgaacaccataattttctttcaatattctctaggatctgctacatttctatcagtttctcaataaattcaattcaattttccccagattcgtaaaaacacctctggtaattcaaatttttctcaaaacccaccaaaatggcgccagtttcagcccttgctaaatacaaactcgtgttcttaggtgatcaatcagttggtaaaactagtatcatcactcgtttcatgtatgacaaatttgataacacatatcaggctacaattggaattgattttctatcaaagaccatgtatcttgaagatcgtactgtacgtttacagttgtgggatactgctggacaagagaggttcagaagtcttataccaagctacataagggattcttctgtggcggttattgtatatgatgttgcaagtagacaatcctttcttaacacagctaaatggatcgaagaagtccgtactgagaggggtagtgatgttataattgtccttgttggaaacaaaaccgatcttgtggataagaggcaagtgtctatagaggaaggagaagctaaagctcgggatctcaatgttatgtttatcgaaactagtgcaaaagctggtttcaacattaaggcactgtttaggaaaattgctgctgcgttacccggaatggagacactgtcgtcgacaaaacaggaggacatggttgatgtaagtttgaagtcgacttcgactgcacctcagcagcaacagtctggtggatgtgcttgctgagcctgcacattctacttaattctgtgtaccattttgtactttcggctttgggatcgatctacaaagattttgctctccgcttctatgaacaaattacagtcagaatatggtggttttcctgctagagttgaagattttctttggaaatttgagggacacaagaatgtagaaagtttttcatgagttttttttatgttattttgtttgtctgcacttcaaaatatgtc

SEQ ID NO: 4125 - DNA, 1077 bp, Brassica rapa
aatttatccctaatagtttctaattttcacataaataacccattggtcttcgttttctccagcttacgaatacactaatctctccggcgaagattggaaactctttccccgcgacgtatctaagatccgtccagctagtttgatctctcgaggaatcatggcgccggtatcggcactcgccaagtataagctggtgtttctgggagatcaatccgtggggaagacgagtatcatcactcgattcatgtacgacaaattcgacaacacttaccaggctacaattggtattgattttttgtcaaagacaatgtacctcgaagatcggactgttagactgcagttgtgggatacagcagggcaagagagattcaggagtcttattccgagctatattagggattcttctgttgctgttattgtctatgatgttgccagcaggcaatctttcctaaacactactaagtggatcgatgaggttaggacagagcgtggtagtgatgtcattgtcgttcttgtgggaaataaaaccgaccttgtggacaaaaggcaagtgtcaatagaggaagcagaagccaaggctcgtgagcttaatgtaatgtttatcgaaaccagtgccaaagcaggcttcaacataaaggcgcttttccgcaatatcgcagcatctttgccaggaatggaaacactttcttcgacaaagcaagaggatatggttgatgtcaatctcaagtcttccaacgccaatgcatctttggctcagcagcaatcaggaggatgttcttgttaaaatttccaacaatcaccgcaaattgatagagaacaagaaaaaaaatacacagatataaaagtcctcgagccttttttttttttttttttctatcagattgttttagtttatggtttgtccctagctctgaactgttatggtctttggattttcaaatgctctctgcttcagtactttttgttagtttttaacaacttttcccaaaactgtgatttgtctatgtattggattatataattgtaagttatataaactagaaacactcttcttgtttcttcctttcatgttaagac

SEQ ID NO: 4126 - DNA, 1093 bp, Phaseolus vulgaris
ccgtccagtgatctcgttacgatcccattaaataacgttttcacagcaatagccaactctctccgcgtcttattgtttgttcttttccctcagaatccgagatcaaccccgacgaacctccggggtttttctcggcttcttccgattcctcttttgctttcgtttcgattttccaatggcgcctgtttcagctttagccaagtacaagttggtgttcttgggcgaccaatccgtcggcaaaaccagcatcatcactcgcttcatgtatgacaaattcgataacacctatcaggctacaattggtattgattttctatcaaaaactatgtatcttgaagatcgaactgttcgattgcagttgtgggatacagctggccaggaaaggtttagaagtcttattccaagctacattagggactcatctgtagctgtcattgtatatgatgttgcaagcaggcagactttcctaaataccgccaagtggattgaagaagttcgaacagagagaggcagtgatgtcattattgttcttgttgggaacaaaactgatcttgttgaaaaaagacaagtctctatagaggaaggggaagcaaaagcacgtgagctcaatgtcatgttcattgaaactagcgcaaaggctggatttaatataaaagccctatttcgaaaaattgctgcagcattacctggaatggaagcactatcctctgcaaaacaagaagacatggttgatgtaaacttagtgtctacaacgggcaacgctcagtctcaacctcagtcaagtggatgtgcatgttaattattcatgtgctgtccagctttttgtgtcgtgcttttttgttttaagaaggtttttctatatgtttctacagcattatatgaaaatagatgaaagaatatataagttgtaatgttaggggttggatataagttctgtccaaaagaattattattgttaattggttatgtttgggataatgtattaaagtagttaagctccccaacccaaaattggattttgttcattgtactttataaacggtgttataagtttaaaatttaacctgccttaactttgtatttaattttggac

SEQ ID NO: 4127 - DNA, 895 bp, Daucus carota
cggatccgtagcatagtttcatcacaccgatctgccaccgccttgctctaaatctaccattctccgatcattttccggccagatcttcaattcctcgtcggaaattgacatttctgcggtgaatcaagcctggttcgacatagatttcaacaatggcgcctgtatcggccctggccaagtacaaattagtgtttctgggagatcaatcagtgggtaaaacaagcatcatcacgagattcatgtacgataagtttgataacacttatcaggctaccattggcattgactttttgtccaaaactatgtacctcgaggatcggactgttagattgcaactttgggatacagctggacaggaaaggttcaggagcctcattccaagctacattcgggattcctctgttgctgtcatcgtatatgatgttgcaagcagacaatcattcattaacactgtaaaatggattgaggaggttcgcagtgagcgaggcagtgatgtcatcatagtacttgttgggaataaaactgaccttgtggataagagacaagtctctatagaggaagcagaagccaaagctggtgaccaaaatgtcatgtttattgaaaccagtgccaaagcaggattcaatataaaggcactatttcgaaagattgctgcagccttgccaggaatggaaacattatcttctgctaagcaagaagatatggttgatgtcaatctcaagtcaagtgtaagctcatctcagtcatcagaatccggagggtgtccatgctaataggcaatagctatgaacagcaggcttcccctccgtgctggttccttgcagttttgctatttgtgtaatcatcagaatttgagggttttatatgaacattaatatgttagtaatgataggtc

SEQ ID NO: 4128 - DNA, 922 bp, Daucus carota
gatccgtagcatagtttcatcacaccgatctgccatcgacttgctctaaatctaccattctcggatcattttccggccagatcttcaattcctcgtcggaaattgacatttctgcggtgaatcaagcctggttcgacatagatttcaacaatggcgcctgtatcggccctggccaagtacaaattagtgtttctgggagatcaatcagtgggtaaaacaagcattatcacgagattcatgtacgataagtttgataacacttatcaggctaccattggcattgactttttgtccaaaactatgtacctcgaggatcggactgttagattgcaactttgggatacagctggacaggaaaggttcaggagcctcattccaagctacattcgggattcctctgttgctgtcatcgtatatgatgttgcaagcagacaatcattcattaacactgtaaaatggattgaggaggttcgcagtgagcgaggcagtgatgtcattattgtccttgttgggaacaaaactgaccttgtggataagaggcaagtctctatagaggaagcagaagccaaagctggagaccaaaatgttatgtttattgaaaccagtgccaaagccggattcaatataaaggcactattccggaagattgctgcagcattaccaggaatggaaactctatcttctgctaagcaagaagatatggtagacgtcaatctcaagtcaagtgtaagctcatctcagtcatcagaatccggagggtgtccatgctaataggcaatagctatgaacagcaggcttccccgtgctggttccttacagttttgctatttgtgtaatcatcagaatttgagggttttatatgaacattaatatgttagtaatgataggtctgaatttattctattttttctgtatgattttt

SEQ ID NO: 4129 - DNA, 934 bp, Daucus carota
aaaaaatgtatacatcggatccgtagcagagtttcatcacaccgatctgctaccgccttgctctaaatctaccattctccgatcattttccggccagatcttcaattcctcttcagaaattgacatttctgcggtgaatcaagcctggttcgacatagatttcaacaatggcgcctgtatcggccctggccaagtacaaattagtgtttctgggagatcaatcagtgggtaaaacaagcatcatcacgagattcatgtacgataagtttgataacacttatcaggctaccattggcattgactttttgtccaaaactatgtacctcgaggatcggactgttagattgcaactctgggatacagctggacaggaaaggttcaggagcctcattccaagctacattcgggattcctctgttgctgtcattgtatatgatgttgcaagcagacaatcattcattaacactgtaaaatggattgaggaggttcgcagtgagcgaggcagtgatgtcattattgtccttgttgggaacaaaactgacctcgtggataagaggcaagtctctatagaggaagcagaagccaaagctggagaccaaaatgttatgtttattgaaaccagtgccaaagccggattcaatataaaggcactattccggaagattgctgcagcattaccaggaatggaaactctatcttctgctaagcaagaagatatggtagacgtcaatctcaagtcaagtgtaagctcatctcagtcatcagaatccggagggtgtccatgctaataggcaatagctatgaacagcaggcttccccgtgctggttccttacagttttgctatttgtgtaatcatcagaatttgagggttttatatgaacattaatatgttagtaatgataggtctgaatttattctatattttctgtatga

SEQ ID NO: 4130 - DNA, 1037 bp, Cichorium intybus
atacaaactcatttttgttgccgacacggattcaactcttaaacaaagttacaaacccttttctctcgcacgtctacctgggagtcctaacatctctccgcgtcgatctccaagattttccggcgagatctccgtcatacctgtcggaaaatcttcatccttcgatcgcaacgttctcgccgatatatctgtaggtatatcctaattaatttcaaacaaaatggctccggtgtcggctctagccaagtacaagctcgtgttcttaggagatcaatcagttggaaaaacaagcatcattactcgattcatgtatgataaattcgacaacacttatcaggctacaattggaattgattttttatcaaaaactatgtatcttgaagatcgaacagttcgtttgcagctttgggacacagctggacaagaaagattcagaagtctcattccaagttatatcagggactcctctgttgctgtcattgttttcgatgttgcaagccgccagtcatttctaaacacagcaaaatggattgaggaggttcgtactgagagaggcagtgatgtcatcatagtccttgttggaaataaaactgaccttgtggataagaggcaagtttccatagaagaaggggaagctaaagctcgtgaatttaatgtaatgtttattgaaacaagtgccaaggcgggcttcaatataaaggctttatttcgaaaaatagcttcagcattaccaggaatggaaaatttatccacaacaaagcaagaagacatggtggatgtaaatctcaagtccaacaacacaagtgggtcccagcaaccccagtccggagggtgtgcatgctaatttactattttacccctctacaagattcttcattatataccaaattagtctcatatatttttgaaggtttagtggttattatatggaaagggttttgccatgtttgactttagttgacttagttttagtgccatatttggttttctgtttgcttcttgagaacgttttttttatttaatttcttatgttgttg

SEQ ID NO: 4131 - DNA, 1101 bp, Cichorium intybus
tacaaactcatttttgttgccgacacggattcaactcttaaacaaagttacaaacccttttctctcgcacgtctacctgggagtcctaacatctctccgcgtcgatctccaagattttccggcgagatctccgtcatacccgtcggaaaatcttcatccttcgatcgcaacgttctcgccgatatatctgtaggtatatcctaattaatttcaaacaaaatggctccggtgtcggctctagccaagtacaagctcgtgttcttaggagatcaatcagttggaaaaacaagcatcattactcgattcatgtatgataagttcgacaacacttatcaggctacaattggaattgattttttatcaaaaactatgtatcttgaagaccgaacagttcgtttgcagctttgggacacagctggacaagaaagattcagaagtctcattccaagttatatcagggactcctctgttgctgtcattgttttcgatgttgcaagccgccagtcatttctaaacacagcaaaatggattgaggaggttcgtactgagagaggcagtgatgtcatcatagtccttgttggaaataaaactgaccttgtggataagaggcaagtttccatagaagaaggagaagctaaagctcgtgaatttaatgtaatgtttattgaaacaagtgccaaggcaggcttcaatataaaggctttatttcgaaaaatagcatctgcattaccaggaatggaaaatttatccacgacaaaacaagaagacatggtcgatgtaaatctcaagtccaacaacacaagtgggtcccagcaaccccagtccggagggtgtgcatgctaatttacctttttacccctctacaagattcttcattatataccaaattagtctcatatatttttgaaggtttagtggttattatatggaaagggttttgccatgtttgactttagttgacttagttttagtgccatatttggttttgtgagaacgtttttaatttcttatgttattggttttatatttttatttttattttttttatcgaatctttaagttgaattaaattcgagacttgagtttgttgggaatattgaa

SEQ ID NO: 4132 - DNA, 1467 bp, Citrus clementina
aacactgaacagagtcttggctttactaaaattgcttcagcttattaaacaaatcaactcaccgtctcttactgatctttcccagtttgttgactctgaaaatggcgccggtgtcggctctcgcaaagtacaagctggtgtttttaggagatcaatctgtgggcaaaacaagtatcatcactcgcttcatgtatgataaattcgataacacctatcaggctacaattggtattgatttcctttcaaaaactatgtaccttgaagatcgaactgttcgtctgcagctgtgggatacagctggacaggaaagatttagaagtctcattccaagctacatcagggattcttctgttgctgttgttgtatatgatgttgcaagccggcaatctttcttgaacacttcaaaatggattgatgaggttcgaaccgagaggggtagtgatgtcatcattgtccttgttgggaacaaaactgaccttgtggaaaaaaggcaagtctccatagaggaaggagaagccaaatctcgggaactcaacgtcatgttcattgaaacgagtgctaaagctggttttaatataaagcctttgtttcggaaaattgctgcagcattgccagggatggaaacactttcttcaacaaagcaagaagaaatggttgacgtgaatctgaggtctacaactggcaatgcatcacagtcccagtctcagtcaagtggatgctcttgttgatgcaatcctggacgtcttggtgcctattgtctctctcatgctattaggttctttcgacctttttaaactccagatctgtaaaggttaccacagcctctgagtatttttcttcttttatatttttccccattgctgtttggaagtattttactgctgttgtctagttagtcctaaggcattatatgtgtggtaatatttactgagttttcccggtacaattcatagtcctcagggttgcaaacaaagaaatgatacatttataagattcggattcttggaaatgattttgtaaaattgaaaatctggattcttcgaaatgattttgtaacattgaaatgctgtagaactacttctctacacttctgcagtctacaagtattcaatctgtctctggactcaattaagtaaacaaagatagattatatatccagttttatgaattattatgcaaatggttgatatcattttttggaggctgcaatttggatgcccaatctgctcgctctcttaacgtgatattagatggactataatgcataggggcattgatgtatactgtctataagcagagaagataagcgtgaaggcgtgagttggctcaacttttaggcaggagcaagtgtttctgctctttagttgttgtttgggggagtactaggttcttgtggatggtatctattatggaacaggcagctgatgacagctttgatttgatgttgctacaagagtctttctattg

SEQ ID NO: 4133 - DNA, 982 bp, Flaveria ramosissima
accgacacacaccccacccttcactcttcagcttcaccaaacaaaccctttttctctccgctccgatctctaagattttacggcgagatctccgccggataatctgatcatcgtaccgtatcatcttcaacacaatggctccggtgtcggctttggcgaagtacaagctcgtgttcttaggagatcaatcggttggaaaaacgagcatcatcactcgattcatgtactataagttcgacaacacttatcaggctactattggaattgattttttgtccaaaaccatgtatcttgaagatcgaacagttcgcttgcagctttgggacacagctggacaagaaaggttcaggagtctaattcctagttacattagggattcctctgttgctgtcattgtttttgatgttacaagccgacagtcatttatgaacactgcaaaatggattgaggaggttcgtactgagcgaggtagtgatgtcatcatcgtccttgttggaaataaaactgaccttgtagataagaggcaagtttccatagaggaaggagaagctaaagctcgtgactttaacgttatgttcattgaaaccagtgccaaggctggtttcaacataaaggctttatttaggaaaatagcttctgcattacctggaatggaaaccttatcttcaacaaagccggaagacatggttgatgtaaatctcaagtccagcaatgcaagtgggtcccaacagcaaccgcagtcgggagggtgtgcatgctgatgtgtcagattcataatataccaaactagtctcagatggatatcttcgaaggttagttgcttatacagaaagggttttgctatgcttgaattacttttagcgtgatatgtgtcctcgtatgcttccttgtttacctttcgaaaatgttggaggttttcttgaatttcaaaatttctacgagttatattcaagactcgagttagttggcagttttgaactgt

SEQ ID NO: 4134 - DNA, 1052 bp, Ipomoea nil
ggattaggaatacagcggacgtagacaagctctcctgttctgatttccctcaaacgcgtctcgtcattttccgacgagatctcaaatcctccgtcggaaaatcctgatccgatccgatcctagcggttcgagaagctactcccgttgatcagattgatggctccggtttccgccctcgctaagtacaagctcgtcttcttaggagaccagtctgtcggcaaaaccagtatcatcactcgctttatgtacgacaagttcgataacacataccaggcaacaattggcattgatttcctgtcaaagacaatgtaccttgaagatcgtacagtaagactgcagctttgggatactgcagggcaagagagatttaggagtcttataccaagctacatcagggactcatctgttgctgttattgtgtatgatgttgcaagtaggcagtccttccttaatactgcaaagtggattgaggaggttcgaactgagcgtgggagtgatgttatcattgttcttgttgggaataaaactgaccttgttgaaaaaaggcaagtttcaatagaggagggagaagctaaatcgcgggaactaaatgtcatgtttattgaaaccagtgcaaaggctggcttcaatataaagccactatttaggaaaattgctgcagccctgccaggaatggagacattatcgtcagctaagcaagacgacatggttgatgtgaacctcaagtcaagcagtacaaatcctgcacagtcacaacagtcaggaggatgtgcctgttaacaacatgtttgaacatctcaatcccgtgtctggatcttacatgctgcctttgaacctaaagcggatctgtaaagcctgtccttgattgcatttgagtcctagccattgttgatctatcagaaagtgttgaacatatagtagattaccattatagtttacttgcgagtcatttctatatcagttatagacctatgccaccccttttggtcaaaatttgtatggatttttgcagttttgtataacaaaaagcagttttattagattcaaggata

SEQ ID NO: 4135 - DNA, 1470 bp, Citrus sinensis
aacactgaacagagtcttggctttactaaaattgcttcagcttattaaacaaatcaactcaccgtctcttactgatctttcccagtttgttgactctgaaaatggcgccggtgtcggctctcgcaaagtacaagctggtgtttttaggagatcaatctgtgggcaaaacaagtatcatcactcgcttcatgtatgataaattcgataacacctatcaggctacaattggtattgatttcctttcaaaaactatgtaccttgaagatcgaactgttcgtctgcagctgtgggatacagctggacaggaaagatttagaagtctcattccaagctacatcagggattcttctgttgctgttgttgtatatgatgttgcaagccggcaatctttcttgaacacttcaaaatggattgatgaggttcgaaccgagaggggtagtgatgtcatcattgtccttgttgggaacaaaactgaccttgtggaaaaaaggcaagtctccatagaggaaggagaagccaaatctcgggaactcaacgtcatgttcattgaaacgagtgctaaagctggttttaatataaagcctttgtttcggaaaattgctgcagcattgccagggatggaaacactttcttcaacaaagcaagaagaaatggttgacgtgaatctgaggtctacaactggcaatgcatcacagtcccagtctcagtcaagtggatgctcttgttgatgcaatcctggacgtcttggtgcctattgtctctctcatgctattaggttctttcgacctttttaaactccagatctgtaaaggttaccacagcctctgagtatttttcttcttttatatttttccccattgctgtttggaagtattttactgctgttgtctagttagtcctaaggcattatatgtgtggtaatatttactgagttttcccggtacaattcatagtcctcaggtttgcaaacaaagaaatgatacatttataagatttggattcttggaaatgattttgtaaaattgaaaatctggattcttcgaaatgattttgtaacattgaaatgctgtagaactacttctctacacttctgcagtctacaagtattcaatatgtctctggactcgggactcaattaagtaaacaaagatagattatatatccagttttatgaattattatgcaaacggttgatatcattttttggaggctgcgatttggatgcccaatctgctcgctctcttaacgtgatattagatggactataatgcataagggcattgatatgtactgtctataagcagagaagataagcatgaaggtgtgagttggctcaacttttaggcaggagcaagtgtttctgctctttagttgttgtatgggggagtactaggttcttgtggatggtgtcttttacggaacacgcagctgatgacagctttgatttgatgttgctacaagagtctttct

SEQ ID NO: 4136 - DNA, 949 bp, Valeriana officinalis
aacagcatcgataacctttgctctattctcggcgagatctcgcagttttcgttggcaactcgaacagcatcgtatcatataaatagagctgcttattcgaactgatcatagatccgattgatggctccggtttctgctcttgcgaagtttaagctcgtcttcttaggcgatcaatcagttggcaaaacaagcattattactagatttatgtacgataaattcgataacacctatcaggcaacgattggaattgattttctgtcaaagacaatgtaccttgaagatcggacagttcgtttgcagctctgggacactgcaggacaagaaagattcaggagtctaattccaagctatatccgagattcctcggttgcagtcattgtatacgacgtagcaagtaggcaatcattcttgaacactatgaagtggattgaaggcgttcgtaccgaacgcggcagtgatgtcatcattgtccttgttggaaataaaactgatcttgttgataagaggcaagtttctattgaagaaggagaatccaaagcacgcgaactcgatgttatgtttattgaaactagtgccaaagcaggctttaacattaaggcattgttccggaagatagccgctgccttaccaggaatggaaaccttatcctccacaaagaaagatgatatggtcgatgtcaaccttaatgcaaatgcgtctcagcaacagtcacaatccggcggttgtgcttgttgatactatatatatatacacacacctatacacacacgcatacacgtctggtttttcatcgtcgttaatagtagtgtgtacatcttgagggttaaaacaatatagaagatgttttgttatatttgtagttacaactagttcttagttttttgatgttagagtatttatatattggtatttactttcggatgtctttgcgatgatatgcttatat

SEQ ID NO: 4137 - DNA, 719 bp, Juglans hindsii x Juglans regia
ggggactcccgcgaacctcccgataagtcagcggccgagatatcgacgtcgattccgatccgaacaaatggctccggtatcggctctagccaaatacaagctcgtgttcttgggtgaccagtcggtcggtaaaaccagcatcatcacccgtttcatgtacgacaagttcgacaacacttatcaggccacaattggtatcgattttctctcaaagactatgtaccttgaagatcgaacagttcggttgcagctctgggatactgctggacaggaaaggttcaggagtctcattccaagctatatcagggattcctctgttgcagtcatcgtctacgatgttgcaagtagagagtccttcttaaacagttccaaatggattgaagaggttcgcacagagcgaggcgaagatgtaatcgttgtacttgttggcaacaaaactgatcttgtggagaagaggcaagtttctacagaggaagcagaagcaaaagctcatgacctcaacgttttgttcattgaaacaagtgccaaggctggtttcaatataaaggcgctgttccgtaagattgcagcagccttaccaggaatggaaacactttcttcagcaaagcaagaagacatggttgatgtcaatctcaagtctagcaatgcatctgcgagtcagtcacaaccacagtcaggaggatgtgcctgttgatacccggcatggaactatgcttgct

SEQ ID NO: 4138 - DNA, 1242 bp, Citrullus lanatus
gatccgacccgtttgtacagaatttagatccttaaggagtcttagtgcgaaactgaaagcagaatccacagatcaaagaaagaacaaactgggccaaaccaaaatccagagtttcttccattgcaactcatcttctccctccgaaatctccatctccatctccatcccataattcttcctctctctgaattctcaatcagagatctctccggaaatggcacccacctcagctctcgccaagtataagctcgtctttctcggcgaccagtctgttggcaaaaccagcatcattacacgcttcatgtacgataaattcgacaatacatatcaggctaccattggtattgattttctctcaaaaacaatgtatctggaagatcgtaccgttcgactgcagttgtgggacactgctggacaggaaagattcagaagtctgattccaagctatatcagggactcatctgtcgctgtcatcgtttatgatgttgcaagccggcaaactttcctaaacacttcaaaatggattgaggaggtgcgcactgagaggggcagtgatgtcattatagtgcttgttgggaacaaaacggacctcgtggagaagagacaagtctccatagaggaaggagaagccaaagcccgtgaactaaatgtcatgtttatcgaaacaagtgctaaagctggattcaatatcaaggcacttttccgaaaaattgctgcagcattgcctggaatggaaactctctcatcaacaaaacaagaagacatggttgatgttaacctgaagtccacaggcagtggtgctgcacaatcgcagccgcagtccggtggatgcgcgtgctaatgaaggatggaggatacaagctgctgtcaaaggaatccactgtttcttggtttttgctttgaacacctcaacctcctacaactgttagcattcaggtacaagatgtggcttatattcttcgaatggctgcttgagcagaactaaattcgtaaaatgtaattggtggcaaagagtagactgactgttattttatggagtaatttgatgtattggttggtggagtcattatttgggttttgggatttgggagatgtgtaaaaaatagaaaatttatgtgttggactcgattacagaattttgcttttgtcttgtaagtggtaattcatctctagaaattctccaaaattttatctgtttatccaatggattttattgccttgcttcatattacggtttggctt

SEQ ID NO: 4139 - DNA, 924 bp, Fraxinus spp
cttaaacctacaatcgaaataccgatccgcccatttacataagattcctaattcaattcattggttcattttcggatttttattgatggtctccggtttctgctctcgcgaagtacaaattagtgttcttaggtgatcaatcggtcgaaagactagtattatcacaagattcatgtacgataaattcgataacacttatcaggctactattggtattgacttctttcaaagacaatgtaccttgaagatcgaacagtaagattgcagctttgggatactgccggacaagaaagattcaggagtctaattccaagctacataagggactcctctgttgctgtcattgtatatgacgttgcaagcaggcagtccttcctcaacacttcaaagtggattgaggaggttcgcactgagagaggcagtgatgtcatcattgtggtagttggcaataaaactgacctagtggataagaggcaagtctcaatagaggaagcagaggccaaagctcgtgaactaaatgtcatgtttattgaaacgagtgccaaggctggcttcaatataaaggcactatttcgcaagattgctgcagccttgccaggaatggagacgctatcctcagcaaagcaagaggacatggttgatgtcaacctcaagtcgagcaacacaaatgcgtctcagtcacaaacgtcaggaggatgcgcatgttgatagaaggcctcgtatgatgcattattatgtttcggcttcgacccttcaatccgactgtaaagttcttccgtctcattggttgcatttggatttacattgtagttcactagttctgtgtcatctcttacctgcatcacttgtgtggacctgtaattatcaaggctttagatagtctcatagacagattatttttatcggcgagttatatttgttagg

SEQ ID NO: 4140 - DNA, 998 bp, Rosmarinus officinalis
gaaaatacaaacgcgcaaatcaatagattcaccgaatcgatatctcaggcaaatcctcattttcctgcgagatctggaactttcaccatcggaaagaaagtagctgattccgactccgaagaggtgatctgccttgtgtttgtttcggttgacctgattttgactgatggctccggtttcggctctcgccaagtacaagttagtgttccggggagatcaatccgtcggaaaaacgagcatcatcactcggtttatgtacgacaaattcgataatactcatcaggcaactatcggtattgattttccttcaaagacaatgtatcatgaagaccggacagtacgtctgcagccgtgggatactgctggacaagaaagatttagaagtctcataccaagctatataagggattcctctgttgcagtcatagtatatgatgttgcaagccgacaatcctttcttaacaccgcaaagtggatcgaggaggttcgcactgagagaggaagtgatgttataattgtcctagttggcaacaaaactgatctggtggataagaggcaagtttcaatagaggaagcagaggctaaagctcgtgattttagtgtcatgtttattgaaacaagtgccaaggctggcttcaatataaaggctctattcaggaagatcgctgcagccttgccaggaatggaaactctatcatcaacaaagcaagacgagatggttgatgtgaacctcaagtctagcaacgcaaactcatctcagtcacaacagcagtcaggaggatgtgcttgctaaaaaggtaaactggaacatttgtttgtgcttaagatatatctttattggacggaaaatgcatctgtaaagagctttctaccttgagcattgaattttgtttgtaactgtcgagagtatttcaagtcatcggataagtagattgtcgttgttctcttttttctgtttctcatcttactgttggacccatggtaattgagactgcaaa

SEQ ID NO: 4141 - DNA, 642 bp, Aquilegia formosa
aaaatcaatggctgttgtttctccacttgcgaaatacaaattagttttcttaggtgatcaatcggttggaaaaaccagcatcattactcgcttcatgtacgataaattcgataccacgtatcaggctacaattggcattgattttctttcaaagacgatgtaccttgaagatcggacagttcgtttgcagctttgggatactgctgggcaggaaaggtttaggagtctaattccaagctacattagagattcttctgttgctgtaattgtttatgatgttgcaaatcgtcaatcatttctaaacacatccaagtggatcgaggaagtacgtacagaaagaggcagtgatgtcattattgttcttgttgggaacaaaacggaccttgttgacaagaggcaagtttcaatagaggaaggggatgccaagtcccgtgatgatggtgttatgttcattgaaacaagtgctaaagcaggatttaacatcaagccattattccgtaagattgctgctgccttacctggaatggagaccctctcttctgcaaaacaggaagatatggttgatgtaaacctgaaatctactgtcaattcttcacagccagaacaacaaggaggcggttgccgatgttaaacacacactta

SEQ ID NO: 4142 - DNA, 1156 bp, Cucumis sativus
atcaacacaaagaacaaaccaaaatccatagtttcttccatttgcaactcatttcatttcattcccaaatcttcttctccatcccttaattcttcctctctcggaattttcaatcacagatctctccagaaatggctcccacctcagctctggcgaagtataagctcgtctttctcggcgaccagtctgttggcaaaaccagcatcattacacgcttcatgtacgataaattcgacaatacatatcaggctaccattgggattgattttctctcaaaaaccatgtatctggaagatcgtaccgttcgactgcagttgtgggacactgctggacaggaaagattcagaagtttaataccaagctatatcagggactcatctgttgctgtcattgtttatgatgttgcaagccggcaaactttcctaaacacttcaaagtggattgaggaggtgcgcactgagagaggcagtgatgtcattatagtgcttgttgggaacaaaacggacctcgtggagaagaggcaagtctccatagaggaaggagaagccaaagcccgtgaactaaatgtcatgtttatcgaaacaagtgctaaagctggattcaatatcaaggcacttttccgaaaaattgctgcagcattgccgggaatggaaactctctcatcaacaaaacaagaagacatggtggatgttaacctgaagtccacaggaagtggtgccgcacaatcccagccgcagtcgagtggatgcgcgtgctaatgaaggacaaatacgagcggggttattgaaggaattcagcgtttcttggtttttgctttgaacacctcgaccttcttgaactgttagccattcaggtaacaaagatgaggttttatatctatgaatgccttcttgagcagaactaaattcgtaaaatgtaatcggtggcaaagagaagactgagttgttattttatggagtcatttgacgtattggtggttggtggagtcattatttgggttttgggattcgggagatgtgtaaaaaatagaaaaaaaaaatattattatgtgttggactcgattacagaattttgcttttttcttgtaagttgtaattcatctctagaatattttgtttttccattggatttttgttatgttctgccttgttctttg

SEQ ID NO: 4143 - DNA, 1088 bp, Lupinus angustifolius
tagatgggtgagggtctgagagtgggggtggagtgagggtttgagagtgggggtggtaatgtgactttttttgaaagtttgatgcaaattttggaataattagcgttttatcggtccttccttgtgaagtgaaaatggcggcggtttcagctttagcaaagtacaagctagtgttcttgggtgaccaatccgttgggaagaccagcatcatcactcgcttcatgtacgacaaattcgacaacacttatcaggccacaattggtattgattttctatcaaaaactatgtatcttgaagatcgaactgttcgactgcagttgtgggatacagctggacaggaaagatttagaagtcttattccaagctacattagggattcatctgtagctgttattgtatatgatgttgcaagccgacagactttcctaaacacaacaaagtggattgaagaggtgcaaacggagagaggcggtgatgttattattgttcttgttgggaacaaaactgatcttgttgaaaagaggcaagtctctatagaagaaggggaagcaaaagctcatgaactcaatgtcatgtttattgaaactagtgctaaagctgggtttaacataaaggctctgtttcgaaaaattgctgcagctttacctggaatggaaactctatcttctgcaaaacaagaagacatggttgatgtcaacttgaagtcttcaagtggcaatgctcaatctcaaccacagtcaggtgggtgtgcttgttgaagaagcttcatgctgtcctcgttcacctttgtgtcatgctttttgttttaagcagatttatctatagtcctctatcacattatctataagggtaaagaatatataaggggttgaaagaagttctatgtagaaaaaattgattactggttttgccagcaatagtataccaatgtagacaatatgtagtgaagttggccaagttaactttgaattatgctcgttgtaccaatgtaccttataaaaggtgtgatataattaaagttgtacagtgcagcttgttcatttggatttcaacattgttatatgtacacccaacgttgtgttataatc

SEQ ID NO: 4144 - DNA, 1449 bp, Pinus pinaster
cctgttacttgacggtaacaaatcctcaatttttgacgccaactgactcgatctacccgaaacatcttccacaccaaggtcatcattttctcttgttttctcggcccgcgatctgttagtgggcacattcgtttccgatctcccgcccctcttccagatctgggtcgttgcaattgtgggaaaacactattttcaggtgcagaatctgctcccctcccctgaagaccatcgattgcagaaattcctaactcttcaaaacgcagttggagaatcccggaatagggtttgagattggatatcagaatggctactgtgtcgccacttgccaaatacaaattggttttcctgggagatcagtctgtggggaagactagcattatcactcgcttcatgtacgacaagttcgacaatacttaccaggctactattggtattgattttctatcgaagacgatgtaccttgaggatcggacggttcgattgcagttgtgggatactgctggtcaagaacggtttcgaagtctgattcctagttatattcgcgactcatctgttgccgtaattgttttcgatgttgcaaacagacaatcctttttaaacactgcacggtggattgaagaagtacgtactgaacgtggtagtgatgtgattattgtccttgttggcaacaaaacagaccttgtagacaagaggcaagtttctattgaggaaggtgacgccaaagcacgggagtttggggtcatgtttattgaaaccagtgcaaaagcaggttttaacatcaaggcattgttccggaagatagctgctgcattgccaggaatggagactctctcatcaacaaagcaggaggacatggttgatgttaatttgaaacctacagttaattcttctcaagcagagcaaaaagcgggaggatgctcttgctaaagtgtaaagtatggcacaatccgcaaccttcctagtggctgtattctttgtagttctttggaatgttgagtttttgggaaaatatgaatgcatcgacattgttggtttagctgtagatcaagatgatcttgagttaattcaataaacaggattcatattgacgttaatgtttgtaggcctcatctattcgaagatttgtaattacataatttttagtttagtagtcacgtgtttgaggttctagggatttttttgatttttgaatttaccatatagattgctgcaccttttgatttccactcgagatgctgttgagagataggacattgatttctaatgtacatgaatctctggtataatataacaaattccttgatgatggattaatcgttactccacatcactctctctcaaggacaggaaataaattgtgcttcttagtccgttgtactagtaacatttacagctgcatgttccactgttatttaccaacaaaggaatgttaagaatgtaagagaggac

SEQ ID NO: 4145 - DNA, 1140 bp, Cucumis melo
aagaaatttagatccttgaggagttagtgcgaaactgaaagcaaatcaacacaaagaacaaaccaaaatccagagtttcttccatttgcaactcatttcatttcattcccaaaccttcttctccatcccttaattcttcctctctcggaattttcaatcacagatctccccggaaatggctcccacctcagctctggcgaagtataagctcgtctttctcggtgaccagtctgttggcaaaaccagcatcattacacgcttcatgtacgacaaattcgataatacatatcaggctaccattggtattgattttctctcaaaaaccatgtatctggaagatcgtaccgttcgactgcagttgtgggacactgctggacaggaaagattcagaagtttaataccaagctatatcagggactcatctgtcgctgtcatcgtttatgatgttgcaagccggcaaactttcctaaacacttcaaagtggattgaggaggtgcgcactgagagaggcagtgatgtcattatagtgcttgttgggaacaaaacggaccttgtggagaagaggcaagtctccatagaggaaggagaagccaaagcccgtgaactaaatgtcatgtttatcgaaacaagtgctaaagctggattcaatatcaaggcacttttccgaaaaattgctgcagcattgccgggaatggaaactctgtcgtcaacaaaacaagaagacatggtcgatgttaacttgaagtccacaggaagtggtgccgcacaatcccagccgcagtcgagcggatgcgcgtgctaatgaaggacaatacgaggggttattgaaggaatccagtgtttcttggtttttgctttgaacacctcaaccttcttgaactgtcagcccattcaggtaacaaagatgaggttttatatctatgaatgccttcttgagcagaactaaattcgtaaaaatgtaatcggtggcaaagagtagactgagttgttattttattgagtaatttgatgtattggttggtggagtcattgtttgggttttgggattcaggagattgtaaaaaatagaaaaaaaattatgtgttggactcgattacagaattttgcttttatcttgtaagttgtaattcatctctagaa

SEQ ID NO: 4146 - DNA, 1185 bp, Elaeis guineensis
ctcgtcttctggatcggtggatccgttctttctcttcttcctcgccatcagagatctagaaagagagaaagagagagggaaagaggagaaaccctaatggcggtggtatcggctctggcgaagtataagctggtcttcttgggggatcaatcggtggggaagactagcatcatcacccgattcatgtacgacaaattcgataccacctaccaggccacaattgggattgattttctgtcaaagacaatgtaccttgaagatcgcacagttcgcttgcaactttgggatactgctggacaggagagatttaggagtcttattccaagctacatcagagattcttctgttgcagtaattgtttatgatgtagccaatcggcaatcatttttaaacacttcaaagtggattgaagaagtgcgaacagaacggggaagtgatgttattattgtcctagtaggaaacaagacggatcttgttgacaaaaggcaagtttctattgaagaaggagaagccaaggcccgtgaatttggggtcatgttcatagaaaccagtgcaaaagcaggattcaacattaagcctctcttccgcaagattgctgcagccttaccagggatggagactctttcttcgaccaaacaagaagacatggttgacgtcaacttgaagcccactgtcagtgcctcgcagtcagaacagcaatcaggaggatgttcgtgctagagaaaatacctgcagagtatacaggcagaagtaattattggccaaggagaactttcagatgttaatacaagtgcaatttgagggtttcatatacatgaggatggacaagcgtcattcttttgcattttgcagtaggctaccaaatgatctcctaattgatggagactctttttctgtcttgtttgtatagtaaaagccttctcttcaggatctgtttctttttctcctttcacagaacttcttgttttgttgagggtataatttaaaacaataccgggactttgcttcttttttgggtgggaaccactggtttgaattatatgtatcgttacaatttttccaactctagaatatgactaggggctacattatttgattgtcaggggtgtttcattagttcttgtacttgctatggtgtttaataaacttcataaagagctgcattctttataaaaaaaaaaaaaa

SEQ ID NO: 4147 - DNA, 1451 bp, Pinus taeda
atcattttcttttgttttctcggcccgcgatctgttagtgggcacattcgtttccgatctcccgcccctcttccagatctgggtcgttgcaattgtgcgaaaacactattttcaggtgcagaatctgctccccttccccctgaagaccatcgatcgcagaactttcctaactcttcaaaacgcagttggagaaatcctggaatagggtttgagattggatatcagaatggctactgtgtcgccacttgccaaatacaaattggttttcctgggagatcagtctgtggggaagactagcattatcactcgcttcatgtacgacaagttcgacaatacttaccaggctactattggtattgattttctatcgaagacgatgtaccttgaggatcggacagttcgattgcagttgtgggatactgctggtcaagaacggtttcgaagtctgattcctagttatattcgcgactcatctgttgccgtaattgttttcgatgttgcaaacagacaatcctttttaaacactgcacggtggattgaagaagtacgtactgaacgtggtagtgatgtgattattgtccttgttggcaacaaaacagaccttgtagacaagaggcaagtttctattgaggaaggtgacgccaaagcacgggagtttggggtcatgtttattgaaaccagtgcaaaagcagggtttaacatcaaggcattgttccggaagatagctgctgcattgccaggaatggagactctctcatcaacaaagcaggaggacatggttgatgttaatttgaaacctacagtcaattcttctcaagcagagcaaaaagcgggaggatgctcttgctaaagtgtaaagtatggcacgatccgcaaccttcctagtggctgtattctttgtagttctttgggatgttgagtttttgggaaaatatgaatgcatcgacattgttggtttagctgtagatcaagatgatctgttgagttaattcaataaacaggattcatattgacgttaatgtttgtaggcctcatctattggaagatttgtaattacataatttttagtttagtagtcgtgtttgaggttctagggatttttttgatttttgaatttaccatatagattgctgcaccttttgatttccctcgagatgctgttgagagataggacattgatttctaatgtacatgtatctctggtataatataacaaattccttgatgatggattaatcgttactccacatcactctctctcaaggacaggaaataaattgtgcttcttagtctgttgttgtactagtaacattcacagctgcatgttgcactgttatttacccacaaaggaaatgttatgaacgtaagagaggcaaagtgaactgtagtgttgtttagaggatgctgtcattcatatacaaataattgagattaaaataagttttgttggg

SEQ ID NO: 4148 - DNA, 1263 bp, Populus trichocarpa
aaacttcaacccgacccgttaacaagacgtcaaataccgataatcagtcttctcttcataagaatttctcagctatttgcacagctcaatcaccaagcacaaacactgtacaatttaaaggcaaatacttacacctataaatctccatttctctccgatttggttaatcgaccattttacggatctctgaaaaaataatagaaaaaaatggcaccagtctcagctcttgcaaagtacaagctggtcttcttgggagaccaatcagtcggtaaaaccagcatcatcactcgcttcatgtatgataaattcgataacacctaccaggctaccattggcatggattttctatcaaaaaccatgtatcttgaagacagaactattcatttgcagttgtgggatacagctggacaggaaagattcaaaagcctcattccaagttacattagagattcctcagttgctgtcattgtatttgatgttgcaagtcggcaatctttcctgaacacttcaaaatggattgaagaggttcgcactgagaggggcagcgatgtcatcattgtccttgttgggaacaaaaccaaccttgtggaaaagaggcaagtttctatagaagaaggagaagctaaagctcgtgaccttaacgtcatgtttatcgaaactagtgcaaaagctggttttaatatcaagccattgttccgaaaaatcgctgcagccttaccaggaatggaggcactttcttcaacaaagcaagaggacatggttgatgtgaacctaaagtcttccggtggagcttcatcccagacacagcctcaggcagggggatgtgcttgttgataccttgaaactcttaaccattggtacgattgtccctgttggaacaatatttcactaatatgtaaatgactgactgacttatttctgtccttttccttttctatttgccatcctatttgggaagcatttcctctgtgcctggggaactctttggtaaaacttgagtggttgagaactaggactagaaagattcgtggttgggatattcttgtatttcttaggttggttatagggtcataggttgtgggatatgcagtggaattacagttttcaatagacttttctttctttgttatgtcaaacgacctaataatattctccgtgcaacacatgcatattgtagttatgatttcttcctcctctgagttcaacaacttgatggcctggtgggtctatggcggatatcaacggcactcccccctcccaaaa

SEQ ID NO: 4149 - DNA, 1132 bp, Pseudotsuga menziesii
gccaattgactcgagctacgcgaaacatattgcacaccaaactcgtggtgttcttttgttttctcgaccccgcgatctgtttgtgggcacattcgtttccgacctctcgccccccttccagatctgggtcgctgtaattttgcgaaaacgatattctcaggtgcagattccgccccttaaaggccatcaatcgcataaactccatctcttcaaaactcagtagcagaaattctggaatagggtttgagattggatatcacaatggctactgtgtcacctcttgccaaatacaaattggttttcttgggagatcagtctgtggggaagaccagcattatcactcgcttcatgtacgacaagttcgacaatacttaccaggctactattggtattgactttttatcgaagacgatgtaccttgaggatcggacagttcgattgcaattgtgggatactgctggtcaagaacgatttcgaagtctgattcctagttatattcgggattcatctgttgctgttattgtcttcgatgttgcaaaccgacaatcctttttaaacactgcacggtggattgaagaagtacgcactgagcgcggtagcgatgtgattattgtccttgttggcaacaaaacagatcttgtagacaagaggcaagtttctatcgaggaaggtgatgccaaagcacgggagtttggggtcatgtttattgaaaccagtgcaaaagcaggctttaacatcaaggcattattccggaagatagctgctgcattgccaggaatggagactctctcatcaacaaagcaggaagacatggttgatgttaatttgaagccaacagtcaattcttctcaagcagagcaaaaagcaggaggatgctcttgctaaagtgtaaagtatggcacactccacaaccttcctagtggctgtattctttttagttctttgggatgttgagttcatggcaaaatatgagtgcattaataacgttggtttagctatagctcaagattatctttttagagttaattcaataaacaggattcatatggacattaatattgcaggttttgtctagttgaagatttgtaattacacagttttcaatttactaatcatgtatttgaggttccgg

SEQ ID NO: 4150 - DNA, 894 bp, Silene vulgaris
tcaaattaattaaatggcgccagtatcagctctcgcgaaatacaaattggtgtttttaggcgatcaatccgtcggaaaaactagtatcatcactcgattcatgtatgataagttcgatactacttatcaggctaccattggtattgattttctatcgaagaccatgtatcttgaagatcgtaccgtgcgtcttcaactgtgggatacagctgggcaggagaggttcaggagtcttatacctagctacataagggactcatcggttgcagtaatagtatatgatgttgcaagccgacagtccttcctaaacacaattaagtggatagaagaggtccgcactgaaaggggaagtgatgtcataattgtccttgttggaaacaaaactgatcttgtggataaaaggcaagtgtcaattgaggaaggggaagccaaaggcaaggaactcaatgtcatgttcatcgaaactagtgcaaaagccggcttcaacataaaggcactcttccggaaaattgcagctgctttacctggaatggaaacactctcttcaacaaagcaagaggacatggttgatgtaagtttgaagtccacctcaagtgcaccacagtcaggcgctcagtccgatggttgtgcttgctgacgacacacatctccgatatggaagtccttcctagttaaagtgctgctgtacttttctgtacctccatcctttgagctagaaagattttgaaagatttcgaagtgtcatagtcttaatatcatcttgtttctccgagttcagtgttgcagaatttcagggatttacaatgttgatcgatcgattctgatttctgagttatgcatccaacccaaatcgactaataaacgtcatgtataaatttatcaacagaaatattc

SEQ ID NO: 4151 - DNA, 1301 bp, Picea glauca
acggaaacaaatcctcacgttttgacgctaattgactctaactacgcgaatcatcttgcacaccaagctcataattttcttttgttttctcggccccgcgatctgtttgtgggaacattcgtttccgatctctcgcccccccttccagatctgggtcgctctaattgtgcgaaaacgctattcttaggtgcagattctgcctccccgaagaccatcgatcgcataaagcccaactcttcagaacgcagaaatccttgaatagggtttgagattggatatcagaatggctactgtgtcgcctcttgccaaatacaaattggttttcttgggagatcagtctgtggggaagaccagcattatcactcgcttcatgtacgacaagttcgacaatacttatcaggctactattggtattgactttttatcgaagacgatgtaccttgaggatcggacagttcgattgcagttgtgggatactgctggtcaagaacgttttcgaagtctgattcctagttatattcgcgattcctctgttgccgtaattgttttcgatgttgcaaaccgacaatcctttttaaacactgcacggtggattgaagaagtacgtactgagcgcggtagtgatgtgattattgttcttgttggcaacaaaacagaccttgtagacaagaggcaagtttctattgaggaaggtgatgccaaagcacgggagtttggggtcatgtttattgaaaccagtgcaaaagcagggtttaatatcaaggcattgtttcggaagatagctgctgcattgccaggaatggagactctctcatcaacaaagcaggaagacatggttgatgttaatttgaaacctacagtcaattcttctcaagcagagcaaaaggcaggaggatgctcttgctaaagtgtaaagtatggcatgctccacaaccttcctagtggctgtattctttttagttctttgggatgttgagttcttggcaaaatatgaatgcatcaacaacactggtttagctgtagctcaagatgatctgttgagagttaattcaataaacaggattcagattgacattaatgttgtagtcttcatctagttgaagatttgtaattacataatttctaatttactagtcatgtatttgaggttctagggaaattttttgatttttgaatttaccataaagattgctggacattttgctttttctattcgagatgctgttgagagatagaacattgatttctaagttacatgtatctctggtataatataacaaattccttgatgaaggattaat

SEQ ID NO: 4152 - DNA, 1013 bp, Flaveria ramosissima
tttctctccgccccgatctctaagattttccggcgagatctccgccggataatcttcactctccgatcacaacgaccgccggagttatctgatcatcgtaccgtatcatcttcaacacaatggctccggtgtcggctttggcgaagtacaagctcgtgttcttaggagatcaatcggttgaaaaacgagcatcatcactcgattcatgtacgataagttcgacaacacttatcaggctactattggaattgattttttgtccaaaaccatgtatcttgaagatcgaacggttcgcttgcagctttgggacacagctggacaagaaaggttcaggagtctaattcctagttacattagggattcctctgttgctgtcattgtttttgatgttacaagccgacagtcatttatgaacactgcaaaatggattgaggaggttcgtactgaacgaggtagtgatgtcatcattgtccttgttggaaataaaactgaccttgtagataagaggcaagtttccatagaggaaggagaagctaaagctcgtgaatttaatgtaatgttcattgaaaccagtgccaaggctggtttcaatataaaggctttatttaggaaaatagcttctgcattaccaggaatggagaccttatcttcaacaaagccagaagacatggttgatgtaaatctcaagtccagcaatgcaagtgggtcccaacagcaaccgcagtcaggagggtgtgcatgctgatgtgtcagattcataatataccaaactagtctcagatggatatcttcgaaggttagttgcttatacaaaaagggttttgctatgcttgaattacttttagcgtgacgtgtgtctttgtatgcttccgtgtttaccttttgaaaatgttggaggttttcttgaagttcaaaatatctcgagttatattcaagactcgagttagttggcagttttgaaccgtctgaattttggcattcgaccctttctcatatggatatggttgtcgatt

SEQ ID NO: 4153 - DNA, 579 bp, Rosmarinus officinalis
atggctccggtttcggctttggcaaagtataagttggtgttcttaggggatcaatcggtcggcaaaaccagcattattactcgattcatgtatgataagttcgataatacttatcaggctacaattggtattgattttttgtcaaagactatgtatcttgaagaccgaactgtccgattgcagctttgggatactgcaggacaagaaagattccgaagtcttattccaagctatattagggactcttctgttgccgtcattgtctatgatgttgcaagcagacagtccttcctgaacacttcaaagtggattgaggaggttcgcactgagagaggcagtgatgtcatcattgtccttgttggcaacaaaactgatcttgttgataagaggcaagtctcgattgaggaaggagaagccaaagctcgtgaccttaatgtaatgttcattgaaaccagtgcaaaggctgggttcaatataaaggcactatttaggaaaattgctgcagccttaccaggaatggagacactttcttctgccaaacaagaagacatggttgatgtcaacctcaagtctagcaac

SEQ ID NO: 4154 - DNA, 776 bp, Glycine max
gctagctgaagagagaaaagcaaaatcgaattatcatagaaagaagtgaattgaatttcattgacagagtcagagtgaagtgttgcgcaaatctgaggtgcgcattgcattgtggttgatttgtaagaatggcgccagtgtcggctctcgcaaagtacaagctggtgttcttgggtgatcagtccgttgggaaaaccagcatcatcactcgcttcatgtacgacaaattcgacaacacttatcaggctacaatcggtatcgattttctgtcaaaaactatgtatcttgaagatcgaactgttcgactgcagttgtgggatacagctggacaggaaagatttagaagtcttattccaagctacattagggactcatctgttgctgtcattgtttatgatgttgcaagccgtcagactttcctaaacacatcaaagtggattgaagaggtgcgcagtgaaagaggcagcgatgttattgtggttcttgttgggaacaaaactgatcttgtggataaaaggcaagtctctacagaggaaggggaagcaaagtcccgagagctaaacgttatgtttattgaggctagtgcaaaagccggctttaatataaaggccctctttcgaaaaattgctgctgcattacccggaatggaaacactatctacaacaaaacaggaagatatggtcgacgtgaacctgaggtcttctggtagccatgattcccaacctcagtcagggggatgttcttgctgaatgaatgtgccttgccctgaagttttg

SEQ ID NO: 4155 - DNA, 768 bp, Glycine max
cagtgcttttctttccttccttctgagattgctgaagagagaaaagcaaaatcgaaagaactgaattggatttcattggcggagtgaaagtgaagtgttgcgcaaatctgattggcaagaatggcgccagtgtcggctctcgcaaagtacaagctggtgttcttgggcgatcaatccgttgggaaaaccagcatcatcactcgcttcatgtacgacaaattcgacaacacttatcaggctacaatcggtatcgattttctgtcaaaaactatgtatcttgaagatcgaactgttcgactgcaattgtgggatacagctggccaggaaagatttagaagtcttattccaagctacattagggactcatctgttgctgtcattgtttatgatgttgcaagccgtcagactttcctaaacacatcaaagtggattgaagaggtgcgcagtgaaagaggcagcgatgttattgttgttcttgttgggaacaaaactgatcttgtggataaaaggcaagtctctacagaggaaggggaagcaaagtcccgagagctaaacgttatgtttattgaagctagtgcaaaagctggctttaatataaaggccctctttcgaaaaattgctgctgcattacccggaatggaaacattatctacaacaaaacaggaagatatggttgacgtgaacctgaggtcttctggtagccatgattcccaacctcagtcgggtggatgttcttgctgaatgaatgtgccttgtcctaaagttttg

SEQ ID NO: 4156 - DNA, 1123 bp, Abies balsamea
ttcgcattacgagaaacatcttgcacacttaactcattattttcttttgttttctcggcccgcgatctgtttgtgggcactttcgtttcccacctttcgccccccttccagatctgggtcgccgtaattgtgcgaaatcgcgattctcaggtgtagaatctgcccccaaaaggacgtcaatcgcagaaagtccaactcattcaacactcagaaatcctggaatagggtttgagattggatatcaaaatggctactgtgtcgcctctcgctaaatacaaattggttttcttgggagatcaatctgtggggaaaaccagcattatcactcgcttcatgtacgacaagttcgataatacttaccaggctactattggtattgactttttatcgaagacgatgtaccttgaggatcggacggttcgattgcaattgtgggatactgctggtcaagaacgatttcgaagtctgatccctagttacattcgggattcatctgttgctgtcattgtctacgatgttgcaaaccgacaatcctttttaaacactgcccggtggattgaagaagtacgcactgagcgtggtagtgatgtgattattgtccttgttggcaacaaaacagatcttgtagacaagaggcaagtttctattgaggaaggtgatgccaaagcgcgggagtttggggtcatgttcattgaaaccagtgcaaaagcaggctttaacatcaaggcattgttccggaagatagctgccgcactgccaggaatggagaccctctcatcaacaaagcaggaagacatggtcgatgttaatttaaaacctacagtcaattcttctcaagcagagcaaaaagcaggaggatgctcttgctaaagtgtaaagtatggcacactccacaactcttactggctatattctttgtagttctttgggatgctagagttcttggcaaaacatgaatgcatcaataacgttgttttagctgtagctcaagatgatccgttgagagttaattcaataaacaggattcatattgacattaatgttgtaggcttcgtctagttgaagatttgtaattacatagttttcaatttagtaatttaccaatcatgtatttgaggttccc

SEQ ID NO: 4157 - DNA, 1148 bp, Cedrus atlantica
gcgaaaacgcgattcgcagttgcagagtttgcctcctctaaaggacgtcaatcacagaaagtccaactcacccaaactcagttgcagaaatcctggaatagggtttgagatcggatatcagaatggctactgtgtcgcctcttgccaaatacaaattggttttcttgggagatcaatctgtgggaaagactagcattatcactcgcttcatgtacgacaagttcgataatacttaccaggctaccatcggtattgacttcttatcaaagacgatgtacctcgaggatcggacggttcgattgcaattatgggatactgctggtcaagaacgatttcgaagtctgattccaagttatattcgggattcatctgttgctgtcattgtctatgatgttgcaaaccgacaatcctttttaaacaccgcacggtggattgaagaagtacgcactgagcgtggtagtgatgtgattattgtccttgttggcaacaaaacagaccttgtagacaagaggcaagtttctattgaggaaggtgatgccaaagcacgagagtttggggtcatgtttattgaaaccagtgcaaaagcagggttcaacatcaaggcattgttccggaagatagctgctgcattgcctggaatggagaccctctcatcaacaaagcaggaagacatggttgatgttaatttgaaacctacagttaattcttctcaagcagagcaaaaagcaggaggatgctcttgctaaagtgtaatgtatgggacattccacaatcttcctagtggctgtattctttgtagttctttgggatgttgagttcttggcaaaatatgaaagcatcaacaacgttggtttagatgtagctcaagatcatctgttgagagttaattcaataaacaggattcatattgacacttacgttgtaggcttcatctgattgaagatctgtatttacgtagttttcaatttgctaatcacgtatttgagtttccagggaattttaggattttgaatctgccatataggtgcacattttgctatatctatttgagatatttttgagagataggacattgatttgtaaggcacatatatctctgatataatatatcaagttctgtgatgaaggattaatcgttactaccaaaa

SEQ ID NO: 4158 - DNA, 1295 bp, Cicer arietinum
agttgccaaaataatccacataaacatgcactaaaaaaattaaaataaaaaataatgccagccagcagccagaatggtttttttcccttttcttaaccgtagtgccttagagaggtaccatttatgagatcgcgaaagagaggaaaataaagaaaaaagagagagttgaatttggttgatccattacattacagtgaagcaaatctgaatcggaatcggaatcagaaggtggtgtttggtgaagtgaagtaaatggcgccagtttcagctcttgctaagtacaaattggttttcttaggcgatcaatccgtcggtaaaaccagcatcatcactcgcttcatgtacgacaaattcgataacacctatcaggctacaatcggcattgattttctatcaaaaaccatgtatcttgaagatcgaactgttcgactgcagttatgggatacagctggacaggagagatttagaagtctaattccaagctacattagggactcatctgttgctgtcattgtgtatgatgttgcaagtcgtcagacttttctaaacacatcaaagtggattgaagaggtgcgcagtgagagaggaagtgatgttattgttgttcttgttgggaacaaaactgaccttgtggataagaggcaagtctccacagaagaaggggaagcgaagtctcgggagctaaacgttatgtttattgaagctagtgccaaagccggctttaatataaaagctctctttcgaaaaattgctgctgcattacctggaatggaaacactatctacaacaaaacaagaagacatggtcgatgtgaacctgaggtcttctgccagccatgactctcaacctcagtctggtggttgttcttgctgattgagccttgtagttgtcttgaaaagttttgtatcttttccgcttcatgctatttgttttgggttgtgggtttttcttcagatgtgtaaaggttctctagtcttctagacttcaacaacattgcatgagaaatattatagaaaaagtggagaggtagtaactgatttattgtttagttttattgaaagataaacatggagttcaacacatttactttcttcattaagattgtgaaaaacttgttaggaatttgttgcaacttacagaagaaaaggttccaatccctttagagatacttgagtatgcaaggtaatcaaaacaaactcgacatctgttcaaggttcaaggatctgattaccaaggattggacccgtaatataaaataatgttttttatattataataccataaaactcttaagt

SEQ ID NO: 4159 - DNA, 877 bp, Cichorium intybus
tggtgtcgttggcggtttgatccctcctactcgtatatacaacccgattcaattttaaatccgctctttttctttcgtctccttcatctctccgaatttttagttttctctctgcgtttcaccgaaattacaaacatagattcagatctgatcctcgtgagagatttgaatacacctaaaaatgtcggtggtctcagctcttgccaaatacaaattggtatttttgggagatcaatccgtcggcaaaaccagcatcatcaccagattcatgtatgacaaattcgataccacatatcaggctacaatcggcattgatttcttgtcaaaaacaatgtaccttgaagatagaacagttcggttacagctttgggatactgctggacaagagagatttaggagtctgattccaagttatataagagattcatcagttgcagtgattgtctatgatgttgccaatcgtcagtcattcttgaacactacaaaatggatagaagaagtgcgtactgaacgtggcactgatgtcatcatagtccttgttggcaacaaaaccgatcttgttgacaaaaggcaggtttcaattgaggaaggagatgggaaagctcgtgaacttggagtaatgttcttagaaaccagtgcaaaagccggatttaacatcaagcctttatttcggaagattgctgcagccttgccaggaatggagactctttcatccacaaaacaggaggatatggtggatgtcaatttgaaatcttccaacaacgcgtctcaatcggataagcaaggtggaggctgtgcatgttagatctggtgaaattacgtttatacccttgtattgttaaaacatgaaatatttgggccatgttagaaaggtttg

SEQ ID NO: 4160 - DNA, 861 bp, Trifolium pratense
cgggatcgggatcggaatcgtaatcgtaatcagaacgaaccgttaatattaatggcgccggtttcagctctcgctaagtacaagcttgttttcttgggcgatcaatccgtcggtaaaaccagcatcatcactcgcttcatgtacgacaaattcgacaatacctatcaggctacaatcggcattgattttctatcaaaaactatgtatcttgaagatcgaactgttcggctgcagttatgggatacggctggacaggagagatttagaagtcttattccaagttacattagggattcgtctgttgcggtcattgtttatgatgttgcaagtcgtcagactttcttaaacacatcaaagtggattgaagaggtgcgcagtgagagaggaagtgatgttattgttgttcttgttgggaacaaaactgaccttgtggataagaggcaagtctccacggaggaaggggaagcgaagtctagggagctcaacgttatgtttattgaagctagtgccaaagccggctttaatataaaggccctctttcgaaaaattgctgctgcattacctggaatggaaacactatcaaccacaaaacaagaagacatggtggatgtgaacctgaggtcttctgccagccatgattctcaacctcagtctggtggatgttcttgctgaatgagcctcgttgttatcttgaaaagttttgtatcatttctgctttatgctatttattttgggttgtgggttgcttcagttgtgtaaaggttctttagttttctagacttcaacatcatttcattgcgtgagataaattatagaaaacaagtggagacgtagcagtaactgatttattgtttagttttt

SEQ ID NO: 4161 - DNA, 1162 bp, Cucurbita pepo
cagaatcagatcaaaggaagaaagacaaactgagccaaaagccagagttccattgcaactggcctcggcttcatcgtctcattcagaaatctccatcttaatccgataattgttcctctgttggaaacgaaaaccagagatctctgcggatatggcaccgacgtcagctctggcgaagtacaagctggtctttctcggagaccagtctgttggaaaaaccagtatcattacacgcttcatgtacgacaaattcgataatacgtatcaggctacaattggtatcgattttctctcaaaaactatgtatcttgaagatcgcactgttcgactgcagttgtgggacactgctggacaggaaagattcagaagtttaataccaagctatatcagggactcatctgtcgcggtcatcgtttatgatgttgcaagccggcagactttcgtaaacacttcgaaatggattgaagaggtgcgcactgagaggggcagtgatgttattatagtgcttgttgggaacaaaacggaccttgtggagaagaggcaagtctccgtagaggaaggagaagccaaagcccgtgaactaaatgtcatgtttatcgaaacaagtgcaaaagctggattcaatatcaaggcactattccgaaaaattgctgcagcattgcccggaatggaaactctctcttcgacaaagcaagaagacatggttgatgtcaacctgaagtcatcaggcagtggtgctgcacaatcccagccgcagtccggtggatgcgcctgctagtgaagctcgacattgaggaatcgctcgctctttcttgccttttgttttcaacacctcaatcttctagaactgtggcattcaggtacaaggtgtggttatatctatcaatgcctgcttgagcaattcgtaaaatgtaataggtggcaagagtaggcggctgttattttatggagtaatttgatgtattggtggagtcattatttgggttttgggatttgggagatgtgtaaaaattagaaaatttatctgtcggactcgattacagaattttgcttgtcttgtaagttgtaattcatctttagaaattctgcaaattttatttgcttttacaatgatttgttgagttggttcatattatgctttggttaacaaattggcatctta

SEQ ID NO: 4162 - DNA, 1175 bp, Euonymus alatus
tttcttctctctacgtttttattgaagactagagagagaattgtcgagattcagatctacagcgtcccttcagcttcgcaactctcaaaaatggctacggtgtcccctctcgccaagtacaagcttgttttcttgggcgatcagtcggtcggtaaaaccagtatcatcactcgcttcatgtacgataaattcgacaccacttaccaggccaccatcggaatagactttttgtcgaaaacaatgtatcttgaagatagaaccgtccgtttgcagctttgggatactgctgggcaagagaggtttaggagtctcatcccaagctacataagagattcttctgttgctgtaattgtctatgatgtagcaaacaggcaatcatttttaaacacttctaagtggatagaagaggtgcgaacagaaagaggtggtgatgtcattattgtacttgttgggaacaaaactgatcttgttgataaaaggcaagtctcaattgaggaaggagagagtaaagctcgggattccggagtcatgtttatagaaaccagtgcaaaagcaggatttaatatcaagcctcttttccgcaagattgctgctgccttgccaggaatggaaactctttcttccacgaaacaagaagacatggttgatgttaacctgaagccctcagtcaattcatcacagacagaacagcaaggagggggttgtgcgtgttagtgatgtgaaacactctataaatgaccagatattatttcacatgagtcgactaaatttgtcaaacatgctggaaaaaatggattctgatattagtcaccgaagaccgagcttacggcatcatgatctgaggcaatctgttagctgaaccgtatcagggtttaagtgcttatgatgcagaagttaggaattttccgcttgtagccttgtaggtttatggaaattgacaatttggatgtttttgttagtttcttttcactcttttttgaagcgctcttttgcactttcttttataaccagtgttactggagatttacttttttttttttgaccattggagattactgattttgtcacaagttgtcttggaccatggcgtatttacgcaacattgatatggtaagtgatggtatatgttagtgcagatgacattcacagcattgttgtaatagaaagttacgttc

SEQ ID NO: 4163 - DNA, 945 bp, Euonymus alatus
ccttacggttttcttctctctacgtttttattgaagactagagagagaattgtcgagattcagatctacagcgtcccctgagcttcgcaactctcaaaaatggctacggtgtcccctctcgccaagtacaagcttgttttcttgggcgatcagtcggtcggtaaaaccagtatcatcactcgcttcatgtacgataaattcgacaccacttaccaggccaccatcggaatagactttttgtcgaaaacaatgtatcttgaagatagaaccgtccgtttgcagctttgggatactgctgggcaagagaggtttaggagtctcatcccaagctacataagagattcttctgttgctgtaattgtctatgatgtagcaaacaggcaatcatttttaaatacttctaagtggatagaagaggtgcgaacagaaagaggtggtgatgtcattattgtacttgttgggaacaaaactgatcttgttgataaaaggcaagtctcaatcgaggaaggagagagtaaagctcgggattccggagtcatgtttatagaaaccagtgcaaaagcaggatttaatatcaagcctcttttccgcaagattgctgctgccttgccaggaatggaaactctttcttccacgaaacaagaagacatggttgatgttaacctgaagccctcagtcaattcatcacagacagaacagcaaggagggggttgtgcgtgttagtgacgtgaaacactctataaatttgtcaaacatgctggaaaaaatggattctgatattagtcaccgaagactgagcttacggcatcatgatctgaggcaatcggttagctgaaccgtatcagggtttaagtgcttatgatgcagaagttaggaattttctcttgtagccttgtaggtttatggaaattgacaatttggatgtttttgttagtttcttctcac

SEQ ID NO: 4164 - DNA, 1054 bp, Carica papaya
ctctctctctctctctctctctctttaacatttcttttggaaagagaacagatatacaatcccatttagattcagatctgaacctttctcatctctgatttgacgcaaaaatcttcaaaatggcgactgtctctcctttggccaaatacaagctcgtcttcttgggtgatcagtccgttggcaaaaccagtatcatcactcgcttcatgtacgacaaattcgacacgacttaccaggctacaattggaatcgattttttgtcaaaaactatgtatcttgaggatcggacagttcgtttgcagctttgggatactgctgggcaagagagatttagaagtcttattccaagctacatcagggattcttctgttgcagtaattgtttatgacgttgctaataggcaatcatttttgaatacttccaagtggattgaggaggtacggacagaaagaggcagtgatgtcattattgttcttgttggcaacaaaactgatcttgttgataaaaggcaagtatcgatagaggaaggagataacaaggcccgtgagtttggagtaatgtttatagagaccagtgcaaaagcaggattcaacatcaagcctttattccgtaagatcgctgctgccttgccgggcatggagacactttcctcaacaaaacaggaagacatggtcgatgtcaacctgaagccaactgtcaattcatcccagtcagagcaacaaggagggggttgtgcatgttaacaaaatgtacttaaccaacagggtagataagaatcaaatactctggactacacaatggggcaggtaattgatacgttcaatcatatgattgcaaggaaaagaaaaagttacatctcgtagcaagaaattgttggcagataaaaatgctatttgttcagtatgccatccagtttttgaatattttaggggagcagtaagtggcccatcttctccaagatactaaaatatagaccttttggtattctgttaacttatgtattacagtattagtgattcttatacttgtttctttttctgatacatattaagat

SEQ ID NO: 4165 - DNA, 985 bp, Arachis hypogaea
ggggaaataaaaagtggctacatttttttttctttttttggtattgataaagaaaacagtagtaacgaagataaaaagggaaatctgaatcagaaggagggttggagttgagattggtggagaaatggcgccagtgtcagctcttgcaaagtacaagctggttttcttgggtgatcagtctgttggcaaaaccagcatcatcactcgcttcatgtacgataaattcgataacacttatcaggctacaattggtattgattttctatcaaaaactatgtatcttgaagatcgaactgttcggctgcaattgtgggatacagctggacaggaaagatttagaagtcttattccgagctacataagggactcatctgttgctgtcattgtttacgatgttgcaagccgtcagactttcctaaatacatcaaagtggattgaagaggtgcgcagtgagagaggcagtgatgttattattgttcttgttgggaacaaaactgaccttgtggataagaggcaagtctcgacagaggaaggggaagctaagtctcgcgagctaaatgtcatgtttattgaagctagtgccaaagctggctttaatattaaggccctctttcggaaaattgccgctgcattacctggaatggaaacactatcttcttcaaaacaagaagatatggttgatgtgaaccttaaatctggtggtggagctgattctcaaacccaggagggtggatgtgcttgctgaatgtgcctggccttgaagttttgtatctttctgcttcatgctatttgttttgtgatgtacttccctcagatctgtaaagtttctttagttttttagaatttgaatagcagcattatatgagaaaaaattagtcaaagccagtggcggagctagtactaatgcggttggttgtttaattaattagtattcattattatattattcattttgtttggaaactgaaacataaacattgagaaa

SEQ ID NO: 4166 - DNA, 1000 bp, Glycine max
ttttctttctttccttctgagattgctagctgaagagagaaaagcaaaatcgaattatcatagaaagaagtgaattgaatttcattgacagagtcagagtgaagtgttgcgcaaatctgaggtgcgcattgcattgtggttgatttgtaagaatggcgccagtgtcggctctcgcaaagtacaagctggtgttcttgggtgatcagtccgttgggaaaaccagcatcatcactcgcttcatgtacgacaaattcgacaacacttatcaggctacaatcggtatcgattttctgtcaaaaactatgtatcttgaagatcgaactgttcgactgcagttgtgggatacagctggacaggaaagatttagaagtcttattccaagctacattagggactcatctgttgctgtcattgtttatgatgttgcaagccgtcagactttcctaaacacatcaaagtggattgaagaggtgcgcagtgaaagaggcagcgatgttattgtggttcttgttgggaacaaaactgatcttgtggataaaaggcaagtctctacagaggaaggggaagcaaagtcccgagagctaaacgttatgtttattgaggctagtgcaaaagccggctttaatataaaggccctctttcgaaaaattgctgctgcattacccggaatggaaacactatctacaacaaaacaggaagatatggtcgacgtgaacctgaggtcttctggtagccatgattcccaacctcagtcagggggatgttcttgctgaatgaatgtgccttgccctgaagttttgtattattgtgtctcttgctatttattttggaatgtgtttgcctcagatctgtaaagattaattagtcctttagacttaaacaactttatgtgagagaaattataggaaacaagtggagaggtaacaattgaagaactaatgtaatacagctctttggttagttggttattcattattgtttactttgattgaaagataaa

SEQ ID NO: 4167 - DNA, 1087 bp, Glycine max
acccacacaccctcgcatccatcgtaatcaaaacttaattcacatttttgtttgggttttttcatcacagtgcttttctttccttccttctgagattgctgaagagagaaaagcaaaatcgaaagaactgaattggatttcattggcggagtgaaagtgaagtgttgcgcaaatctgattggcaagaatggcgccagtgtcggctctcgcaaagtacaagctggtgttcttgggcgatcaatccgttgggaaaaccagcatcatcactcgcttcatgtacgacaaattcgacaacacttatcaggctacaatcggtatcgattttctgtcaaaaactatgtatcttgaagatcgaactgttcgactgcaattgtgggatacagctggccaggaaagatttagaagtcttattccaagctacattagggactcatctgttgctgtcattgtttatgatgttgcaagccgtcagactttcctaaacacatcaaagtggattgaagaggtgcgcagtgaaagaggcagcgatgttattgttgttcttgttgggaacaaaactgatcttgtggataaaaggcaagtctctacagaggaaggggaagcaaagtcccgagagctaaacgttatgtttattgaagctagtgcaaaagctggctttaatataaaggccctctttcgaaaaattgctgctgcattacccggaatggaaacattatctacaacaaaacaggaagatatggttgacgtgaacctgaggtcttctggtagccatgattcccaacctcagtcgggtggatgttcttgctgaatgaatgtgccttgtcctaaagttttgtatctttttgcttcatgctatttattttggaatgtgtttgtctcagatctgtaaagattcattagtcctttagacttaaacaactttatgtgagagaaactattgaaaacaagtggagaggtagcaatggaagaacaaatgtaatacagctcattggttagttggctattcattattatttactttgataaagataaaagtctacatttaccttcttcgtcctatatttgatctagtgttactacaatactt

SEQ ID NO: 4168 - DNA, 986 bp, Trigonella foenum-graecum
gagaaagaaagaaaaatgaatacagagacagttgaattgaattgatccattattacacagtgaagaagcaggaagcaaatctcgggtggtgacggaatcgggatcggaatcggaatcggaatcggaaccgttatcggaatcgcgtttcgtgaagcaataatagtctaaatggcgccagtttcagctcttgcgaagtacaaattggttttcctcggcgatcaatccgtcggtaaaaccagcatcatcactcgcttcatgtacgacaaattcgataacacctatcaggctacaatcggcattgattttctatcaaaaactatgtatcttgaagatcgaactgttcggctgcagttatgggatacagctggacaggagagatttagaagtcttattccaagctacattagggactcatctgttgctgtcattgtttatgatgttgcaagtcgtcagactttcctaaacacatcaaagtggattgaagaggtgcgcagtgagagaggaagtgatgttattgttgttcttgttgggaacaaaactgaccttgtggataagaggcaagtctccacggaggaaggggaagcaaagtcccgtgagctaaatgttatgtttattgaagctagtgccaaagccggcttcaatataaaggccctgtttcgaaaaattgctgctgcactacctggaatggaaacactatcaaccacaaaacaagaagacatggtcgatgtgaacctgaggtcttctaccagccatgactctcaacctcagtctggtggatgttcttgctgaacgagctttgtcgttgtcttgaaaagttttgtatctcgtctgctttatgctatttttttgggttgtggggggttgctttagatgtgtaaaggttcttttgtcttctagacttcaacagcattgcgtgagaaaaattatagaaaacaagtggagacgtagcagtaactgatttattgtttagttttttttctttcttt

SEQ ID NO: 4169 - DNA, 920 bp, Fraxinus spp
accggtcgaacacccatatatattccctagtcgagaccttaaacctaccactagaaaacccgaactccactccagttacagaagatctgaattcaatccattgatattccgttatttgattgatggctccggtttcagctctcgccaagtacaaattagtgttcttaggagatcaatacggtcggaaaaactagtattatcactagattcatgtacgataaattcgataacacttatcagctactattggtattgacttcctctcaaagaccatgtaccttgaagaccgaacagtaagattgcagcttttgggatactgctggacaggaaagatttaggagtctaattccaagctatataagggactcttctgttgcagtcattgtatatgatgttgcaaacaggcagtctttcctcaatacttcaaagtggattgaggaggttcgcaatgagagaggcagtgatgtcatcattgtggtcgttggcaataaaactgacttagtggaaaagaggcaagtctcaatagaggaagcagaggccaaagctcgtgaacttaatgtcatgtttattgaaacgagtgccaaggctggcttcaatataaaggcactatttcgcaagattgctgcagccttgccaggaatggagacactatcctcatcgaagcaagaggacatggttgatgtcaacctcaaagtcgagcaacacaaatgcgtctcagtcacagtcgtcaggaggatgcgcatgttgatagaagcttgtatgatgatggattattatgtttaggcttcgacccttcaatccgactgtaaagttcttcgtctcattggttgcatttggatttacattgtagttcactagttctgtgtcatctcacttgtgtggacctgtaattatcaaggctttagatagtcattagacag

SEQ ID NO: 4170 - DNA, 1406 bp, Chenopodium quinoa
ggggggggggggggggggggtcctgtcccctgtgtgcctttgctcccacgacttgtgctgtctctccctcacttcggcagctctttctctctcctcccctccatcccgaaaacgacaaatttcccacactcaaaattttccaatcgccatcttattttttctgggattcatctcaaattcaaacaaatttctcaaacgattcaattgaatttcatctagatttgccaaaattgtgtttttattcacttgaattcaccttcaaaatccccaaaaatggcgccagtttcagccttagcaaaatacaagctcgtcttcttaggagatcaatctgttggaaaaaactgtataatcactcgttttatgtatgactagttcgataatacctatcaggctacaattggtattgattttctatcaaagaccatgtatcttgaagatcgtactgtacgactacagttgtgggatactgctgggcaagagagattcaggagtcttataccaagttacataagggattcatctgtggcagtcattgtatatgatgttgcaagccgacaatccttccttaacactgtgaagtggattgaggaagttcgcactgagaggggtagtgatgttataattgtccttgttggaaacaagactgatcttgtggataagaggcaagtctccatagaagaaggagaagcaaaagctcgtgatctcaatgtcatgtttattgaaactagtgcaaaagctggctttaacataaaggcgctgtttaggaaaattgctgctgcattaccgggaatggagacactctcttcgacgaagcaagaagatatggttgatgtaagtctcaagtccacgtctagtgcaccccagtcgcagtcccagggaagtggatgtgcttgctgaccttacctcataattctccatggaagttgcattctgcttagttttgtgtacctttttgtactttcggccttgaactctagaaagattttgctctcttctctgaagtaatcatagtgataatgttgtgctgttcctgctagagtaaaagattgttctttgagaatttgagggactaaaggacgtagaaatattcgatttattatgctattatttgtctgaactcctacgtatttcagatatgaatatgacttgttagctcaaagagacagttagcttcctttgccacactctgttttttggaagcatacggagctaatgcttgctagcgtgattcacatcctcaattctcaagatatgtatttttttcaattttgtttttgttgtatacttcgtatatgttatgtatatcaggtttaattataacagtcggtgagataaattccctcctcttctaaatagcaggtgtgatattcatctgatgttttaatgttctcgatgttgttggttgt

SEQ ID NO: 4171 - DNA, 832 bp, Rosmarinus officinalis
cctttgttttcctttgccgttattgatcaagagaaagaagatactcagatctgattagaaattgcataaaatggcagtggtttcgccgctagctaagtataaattggtgttcttaggcgatcaatcggtcggaaaaactagcatcattactcgttttatgtatgataaatttgataccacttatcaggctaccattggtattgattttctgtcaaaaacaatgtaccttgaagatcgaacagttcgcttgcagctttgggatactgctggtcaagaaagattcagaagtcttattccgagctatattagggattcttcagtggctgtgattgtatatgatgttgccaatcgacagtcattcctgaatacatcaaagtggattgaggaagtgcgcactgaacgtggaagtgatgtcattattgttcttgttggcaataaaactgatcttgttgaaaagaggcaagtttctatagaagaaggagatgccaaggctcgtgaggttggggttatgtttatagagacaagcgccaaagcaggtttcaacattaagcctttgtttcgaaaaatcgctgctgccttgcctgggatggaaactctttcttccaccaaacaggaagacatggttgatgtgaatttgaagcctaccacaaattcttcacagtcggagcagcaaggaggaggttgtgcatgctagtttttgtattcataaagtagcagtagctggaaatctcattcattacagaaatcactatgctattgttttgagtgctaattcgaatctatggtgaggttagaggtctttcagaattcctcttagtacacactgcagggt

SEQ ID NO: 4172 - DNA, 930 bp, Glycine max
taaattacactaacaaaaaaaacttgatcatggttgagagagaaagaaggaaatctgaatgagaagcggcattttgttgaattgaggtgtgttgtgttgtgttgtgttgggggcatcagtgaaaaatggcgtcagtgtcagctcttgcaaagtacaagctggtgttcttgggtgatcagtctgtgggaaaaactagcatcatcactcgcttcatgtatgacaaatttgacaacacttatcaggccacgattggtattgattttttatcaaaaactatgtatcttgaagatcgaactgttcggctgcagctgtgggacacagctggacaggaaagatttagaagtcttattccaagctacattagggactcatctgttgctgtcatcgcttatgatgttgcaagccgtcaaactttcctgaacacatcaaagtggattgaagaggtgcgcagtgagagaggcagtgatgttattattgttcttgttgggaacaaaactgaccttgtcgataagaggcaagtctctacagaggaaggggaagctaagtctcgtgaactaaacgtcatgtttattgaagctagtgccaaagctgggtttaatataaaggccctctttcgaaaaattgctgctgcattacctggaatggaaacactatcctccacaaaacaagaagatatggttgacgtgaacctaagatcttctggtggctatcaatctcaacctcagtccggcggatgtgcttgctgaatgtgccttatgttgaagttctgcacctttttgctttgtgatatttgtttttaaatgtacgtttctcagatctgtaaaggttcattgtcttttagacttttaacggcattttatgataaaacacttaatcaagattcaagaactaagaactaatattgatacagtcagttggctgtttagttga

SEQ ID NO: 4173 - DNA, 935 bp, Arabidopsis lyrata
ctcaaacctgacctgagaaaccgcaaaagtcgtcagatctgctacctcaaattatacggtgaagaaagaacatcatttcaaatcggaaaaaaatggcgagtgtgtcacctttagccaagtacaagctcgtgttccttggagatcaatccgttggcaagaccagcatcatcactcgtttcatgtacgacaaattcgataccacttatcaggcaacaattggaattgattttttgtcaaaaacaatgtaccttgaggataggactgttcgtctgcaactatgggatactgcaggacaggagagatttcgaagtctaataccaagttatatccgagattcttctgttgctgttattgtctatgatgttgcaaataggcagtcattcttgaacacctccaagtggattgaggatgttcgtacagagagaggtagcgatgtcattattgttctggttggtaacaaaacagatctcgttgacaaaaggcaagtgtcgattgaggaaggtgataacaaagctcgtgattatggagtcatattcatagagaccagtgcaaaagcaggatttaacatcaagccactattccgaaagattgcagcagcattaccaggaatggaaacactttcttcaacgaaacaagaagatatggttgatgtgaaccttaagacttcgaccaattcgtctcaaggggagcaacagcgaggtggttgttcgtgttaatcaattttatatatatacgtttgacagcaacagaataggaagattttaaaacaaaagattcataatttgatggaacaaataaatcctggtatgaggaaaggagattacactttgagactctagttttctttggagaggttttgttttcaatatagagttgtgtaataatgacgtgtgaaagcttatgaagaagaatggcgatgttttgctctgttctca

SEQ ID NO: 4174 - DNA, 970 bp, Phaseolus vulgaris
tgtgcattgcattgtggtttatttgtgagaatggcgccagtgtcggctctcgcaaagtacaagctagtgttcttgggcgatcagtccgttggtaaaaccagcatcatcactcgcttcatgtacgacaaattcgacaacacttatcaggctacaattggtatcgactttctgtcaaaaactatgtatcttgaagatcgaactgttagactgcagttgtgggatacggccgggcaggaaagatttagaagtcttattccaagctacattagggattcatctgtagctgttattgtttatgatgttgcaagccgtcagactttcttaaacacatcaaagtggatagaagaggtgcgtagtgaaagaggcagtgatgttattgttgttcttgttgggaacaaaactgatcttgtggacaaaaggcaagtgtctacagaggagggggaagcaaagtcccgagagctgaacgttatgtttattgaagctagtgcaaaagcgggctttaatataaaggccctctttcgaaaaattgctgctgcattacccggaatggagacactatctgccacaaaacaggaagatatggtcgacgtgaacctaaggtcttctggtaaccatgattcccaatctcagtcgggtggatgtgcttgctaaatgtgccttgtcctaaagttttgtatctttctgcttcatgctatttatttgggaatgtgtttgcctcagttctgtaaagattcattagtccttaagacttgaacaactttatgtgagagaaattactgaaaacaagtggagaggtagcaatgaatgaactaatattacacgtatcattggttagttggttattcattattgtttggtttgactaaaagacagaagtccacattgacgccttctactactgttctttatcataactatgaaagctagctaggaatgtattcaaatttagaagaaacattctcagtttcca

SEQ ID NO: 4175 - DNA, 641 bp, Manihot esculenta
attctgaaccgaaatggcgacagtgtctccactggctaaatacaagctggtgttcttgggagatcaatcggtaggcaaaaccagcatcatcactcgtttcatgtacgataaattcgacactacttaccaggcaaccattgggattgattttttgtccaaaacaatgtatcttgaagatcggactgttcgtttgcagctctgggatactgctggacaagagagatttaggagtctcataccaagctatatcagggattcttctgttgccgtgattgtctacgatgtggccaataggcaatcatttgtgaacacttctaagtggattgaagaggtacgaacagaacgaggcagtgacgtcatcattgtccttgttggaaacaaaactgatcttgttgataaaaggcaagtttcaatagaagaaggtgataacaaggcaaaagaggttggagtgatgtttatagaaacgagcgcaaaagcagggttcaatattaagcctttattccggaaaatcgcttctgccttaccgggaatggaaacactttcttcaacaaaacaagaagacatggttgatgtgaaccttaagcccactgtgaattcatcccagagtgagcagcaaggaggaggttgcgcatgttagagat

SEQ ID NO: 4176 - DNA, 992 bp, Centaurea maculosa
tttccgtcgtctctttctctccgatttttctgtcttttctctctctctctctgcatttcccccaaaatttacaaacacaaattcagatttgatcttcgagaaaaaagaagaagatttgattgaagaaaatggcggtggtatcacctcttgccaaatacaaattggtgtttttgggagatcaatccgttggcaaaaccagcatcattaccagattcatgtatgacaaattcgataccacatatcaggctaccatcggcatcgatttcttgtcaaaaacaatgtaccttgaagatagaacagtccggttacagctttgggatactgctgggcaggagaggtttaggagtctcattccaagctatataagagattcatcagttgcagtaattgtctatgatgttgccaatcgacaatcattcttaaacactgcaaaatggatagaagaagtgcgcacagaacgtggtagcgatgtcattatagtcctggttgggaacaaaactgatcttgttgataaaaggcaggtttccattgaagaaggagatggcaaggctcgtgaactcggagtaatgttcatagaaactagtgcaaaagctggattcaacataaagcctttatttcgcaagattgctgcggccctgccgggaatggacaatctttcgtcaacaaaacaagaagacatggttgatgtgaatttgaaatcttccagcaacacgtctcaatcggataaacaaggcggagggtgtgcatgttagatctttgcatacagagggaattatatttttgtaacatttcgttcaacattttgtatcaaaacaatcgttttgtagttggaaactatccccaaaaccctctctacttacatacaacaacattcttactcaaaatttgcctgttatataatcgtgggtatctagaccagctcgtgtgcaccttgattactgccaggaccctagaaatctctagtggctttgtgggactcgaactagtgaccc

SEQ ID NO: 4177 - DNA, 1515 bp, Centaurea maculosa
agcttatggccatggtggcatggtgttcatctcctcttggttattatatattaattcggtcttttccgtcgtctctttctctccgatttttctgtcttattttctctctctgcatttcccccaaagttacaaacacaatttcagatttgatcttattgattgaagaaaatggcggtggtgtcacctcttgccaaatacaaattggtgtttctgggagatcaatccgtcggcaaaaccagcatcattaccagattcatgtatgacaaattcgataccacatatcaggctaccatcggcatcgatttcttgtcaaaaacaatgtaccttgaagatagaacagttcggttacagctttgggatactgctgggcaggagaggtttaggagtctcattccaagctatataagagattcatcagttgcagtaattgtctatgatgttgccaatcgacagtcattcttaaacactgcaaaatggatagaagaagtgcgcacagaacgtggtagcgatgtcattatagtcctggttgggaacaaaactgatcttgttgataaaaggcaggtttccattgaagaaggagatggcaaggctcgtgaactcggagtaatgttcatagaaactagtgcaaaagctggattcaacataaagcctttatttcgcaagattgctgcggccctgccgggaatggacaatctttcgtcaacaaaacaagaagacatggttgatgtgaatttgaaatcttccagcaacacgtctcaatcggataaacaaggcggagggtgtgcatgttagatctttgcatacagagggaattatatttttgtaacatttcgttcaacattttgtatcaaaacaatcgttttgtagttggaaactatccccaaaaccctctctacttacatacaacaacattcttactcaaaatttgcctgttatataatcgtgggtatctagaccagctcgtgtgcaccttgattactgccaggaccctagaaatctctagtggctttgtgggactcgaactagtgacccttgaaaaggatacccgtccaaaattgtctttctcgccactacaaagttaaacacaatggtcatgttttggaaactaatgtaggttttgcagatatttccaattacagttgtttatttttgtgcaaaatatcggacacgggggttgggggttacaaaagtaatttactcgaagaagattagggattggtgtttgacatataccattaatcgttgtagcaactactttcacgcacatcgataaaaggataccttggccctgaaataaaaatacaaaaatatcagttgtctagatggaatgactcacattctccctatgagttgaataaccgttggtacaaatggacctatgtcggataaggttccgagcaggaaaaaaccctgcaggggcgacctgagaacacataataaacatacacatgttatgaattacgtatgtgttctcatgtcacacctgttgggtatttctgcttagtattcgcattt

SEQ ID NO: 4178 - DNA, 869 bp, Chrysanthemum coronarium
tttagagatctgaatctgaatagtaataaaaatggcggtagtgtcacctctagcgaaatataagctggtatttttgggggatcaatcagttggtaaaacaagtatcatcaccagattcatgtatgacaaattcgataccacttatcaggctactattggcatcgatttcttgtctaaaacaatgtacctggaagatagaacagttcgattacagctttgggacactgctgggcaagagagatttagaagtcttatcccaagttatataagagattcatcagttgcggtgattgtctatgatgttgccaatcgacagtcatttttgaacacttcaaagtggatagaagaagtacgcaccgagcgaggcagcgatgtgattatagtccttgttgggaacaaaactgatcttgttgataaaagacaagtttctatcgaagaaggagatgccaaagctcgtgaatatggagttatgtttatagagaccagtgcaaaagctgggttcaacatcaagcccttattccgaaagattgctgctgccttgccagggatggaacaactttcctctacaaaacaggaagacatggttgatgtgaatttgaaatctgcagcaaatacaaaccagtcagatcaacaaagtggaggctgtgcatgctagacgcttcaacatcaattactcacattacctgtatttatttaattttggaacgtattcgtgcaccatttattttctaaatttcttttctttttcgcgttggaatgaactttgtgcctcaggttttgattagtttattattgggggcgataaaaccagttctatgttaacagatcatattttcatcatatatatggattagagtttgcctttgaaa

SEQ ID NO: 4179 - DNA, 779 bp, Cirsium arvense
ttgcgatcatggtggttgctcgtatatattaaatccgatctttcccgtcgtctctttctctccgatttttctgtcttctctttctgcatttccccaaaaattacaaacacagattcagatctgatcttcgagaaagatttttgaagaaaatggcggtggtgtcacctcttgccaaatacaaattggtatttttgggagatcaatccgtcggcaaaaccagcatcattaccagattcatgtatgacaaattcgataccacatatcaggctaccatcggcatcgatttcttgtcaaaaacaatgtaccttgaagatagaacagtccggttacagctttgggatactgctgggcaggagaggtttaggagtctcattccaagctatataagagattcatcagttgcagtaattgtctatgatgttgccaatcgacagtcattcttaaacactgcaaaatggatagaagaagtgcgtacagaacgtggtagcgatgtcattatagtcctggttgggaacaaaactgatcttgttgataaaaggcaggtttccatcgaagaaggagatggcaaggctcgtgaactcggagtaatgttcatagaaactagtgcaaaagctggattcaacatcaagcctttatttcgcaagattgctgcggccttgccgggaatggacaatctttcgtcaacaaaacaggaagacatggttgatgtgaatttgaaatcttccggtaacacgtcccaatcggatcaacaaggcggagggtgtgcatgttagatcttt

SEQ ID NO: 4180 - DNA, 818 bp, Cirsium arvense
agaagtgaaaagtgaaagtcaatgttggtcaaattggcggtttcttctccgtgtcgtatatatgtgacccgattgaaaaataaaacccagtgttcttcgatttctcccctttctctctcctccaattcctctttattctctctctacgatttcacagattcagatctgacacctcaagtaatggcggtggtgtcacctcttgccaaatacaaactggtatttttgggtgatcaatccgtaggcaaaaccagtatcattacaagattcatgtatgacaaattcgataccacctatcaggctaccattggcattgatttcttgtcaaaaacaatgtaccttgaagatagaacagttcggttacagctttgggatactgcagggcaggagagatttaggagtctaattccaagctatataagagattcatcagttgcagtgattgtctatgatgtcgctaatcgacagtcgttcttgaacactgcaaagtggatagaagaagtacgtactgagcgaggcactgatgtcattattgtccttgttgggaacaaaaccgatcttgttgacaaaaggcaagtttcgattgaagaaggagatggaaaagctcgtgaattcggagtcatgtttatagaaactagtgcaaaagctggatttaacatcaagcctctattccgaaagattgctgccgcattgccggggatggagactctttcgtctacaaaacaagaagacatggttgatgtgaatttgaaatcttcgggtaatgcttcacagtcggagcagcaaggtggaggttgtgcgtgttaacgacttaatttgta

SEQ ID NO: 4181 - DNA, 1050 bp, Cirsium arvense
tagaggtggtgggtttgaccttgccgtctatagttggcggtttcttctcccactcactttcctatgtgtatatatatatgacccgattgaaaatcaaaccctttttttgatttcatctttatctctctctcctccctaatttttctcacatttcagttttcaccaaaaaactttcactcaaaagattcagatctgatcggcgatttgaagcaattgaattgtgaataatggcggtggtgtcgccccttgccaaatacaagttagtgtttctaggagatcaatccgtcggcaaaaccagcatcatcaccagattcatgtacgacaaattcgatacaacctatcaggctaccatcggcattgatttcttgtcaaaaacaatgtaccttgaagatagaacagttcggttgcagctttgggatactgctgggcaggagagatttaggagtctaattccaagttatataagagattcatcggttgcggtgattgtctatgatgttgccaatcggcagtcatttttgaacacttcaaagtggatagaggaagtacgtactgagcgaggcagtgatgtgattatagtccttgttggaaacaaaactgatcttgttgacaaaaggcaagtttcaattgaagaaggagatggcaaggctcgagaatttggggtcatgtttgtagaaaccagtgcaaaagctggatttaacattaagcctttattccgaaagattgctgctgcattgccggggatggagactctttcatccacgaaacaagaagacatggtggatgtgaatttgaaatcttcatcaaatccgaaccagtcggataaacaaggtggaggttgcgcctgctaaatatgatcgggttcacttcacttgtattaattatttgattttgaatcctattattagttttcttgctcctttttattattaccagaagttcgagtttttatgctttcaaatgacagctttgtgcctcagacaggttatatggattagagtttcccttttaacagcttaatgtaaagtcagtggcagctgcataaaatta

SEQ ID NO: 4182 - DNA, 1452 bp, Cirsium arvense
aagaaagcttggagctttatggccatggtggcatggtgttcatctcttcttggttgtatatatattaaattcggtcttttccgtcgtctctttctctccgaatttttctgtcttttctctctctctctgcatttccccaaaattcacaaacacaaattcagatttgatcttggacagaagaaaaaagaaagaagatttgattgaagaaaatggcggtggtatcacctcttgccaaatacaaattggtatttttgggagatcaatccgtcggcaaaaccagcatcattaccagattcatgtatgacaaattcgataccacatatcaggctaccataggcatcgatttcttgtcaaaaacaatgtaccttgaagatagaacagttcggttacagctttgggatactgctgggcaggagaggtttaggagtcttattccaagctatataagagattcatcagttgcagtaattgtctatgatgttgccaatcgacagtcattcttaaacactgcaaaatggatagaagaagtgcgcacagaacgtggtagtgatgtcattatagtcctggttgggaacaaaactgatcttgttgataaaaggcaggtttccatcgaagaaggagatggcaaggctcgtgagctcggagtaatgttcatagaaactagtgcaaaggctggattcaacatcaagcctttatttcgcaagattgctgcggccttgcctggaatggacaatctttcgtcaacaaaacaagaagacatggttgatgtgaatttgaaatcttccagcaacacgtctcaatcggataaacaaggcggagggtgtgcatgttagatctttgcatacagagaaaattatatttttgtaacatttcgttcaacattttgtatcaaaacaatcgttttgtagttggaaagtatccccaaaaccctctactttcatacaagaacattcttactcaaaatttgccatgtttttataaccgtgggtgtccagcccagctcgtgtgcaccttgattactcccacgaccctagaaatctctagtggccttgcggtcattgtcgtcccattaatgcaccccttttgatttataattggtgtagcaactactttcacatgaataattacatacatcttcttgctgttgatattagatacacttgaagaaaagttttgcaaaaagaccttggcgctgaaaaataaaaataaacccatgagttggaataatcgtctgtacaaatgcgcttattctggtaatgttttgagcagaagaaaaccctgcaggggcgacctgagaacacataataaacatcacatgttatgcattacatatgtgttctcatgtcacacctgccgggtatttctgccggtattagcatttgcataaatcaaaccaaatgtatctcaaaaagtaggataactactttattaagaatagcaaatatttgtgta

SEQ ID NO: 4183 - DNA, 1129 bp, Citrus clementina
aacggattgaatgaaaactcattttcgcttcatttcattttcttcttctctctctctcttctcttcattttcattttcatttggaaaaaaaaaaaagaaagagagatttgagatctatattgtaaacaaaaaaaatggcgtcagtgtcccctttggcgaagtataagctggtttttttgggcgatcaatcggtgggcaaaaccagcatcatcacgcgtttcatgtacgataaattcgacaccacttaccaggctacaattgggattgattttttgtcaaaaactatgtaccttgaagatcgaacggttcgtttgcaactttgggatactgctgggcaagagagatttcggagtcttattccaagctacatcagagattcttctgtggcagtaatcgtctatgatgtggctaataggcaatcgttcttgaatacttctaggtggattgaggaggttcgtacagagcgaggaggtgatgttatcattgtccttgttggtaacaaaactgatcttgttgataaaaggcaagtgtctatagaggagggcgatggcaaggctaaagagtttggagtcatgtttatagaaaccagtgcaaaagcaggattcaatattaagcctctctttcggaagattgcagctgcgttgccaggaatggaaacactttcctccacgaagcaggaagacatggtggatgtaaacctaaagccgactgtaaattcatctcagacagagcagcaaggaggaggttgtgcttgttaaagaaatgtatttgaacaaaaagatagagagaatagccacagccattgaaccacccaacaatcgagcaaattcagctaacatgatggatgatgaatctgagtttatgctattttcagagcaacaaatcccggcaaattcggtgttataaatttgttcaacataccggcaagttttgagtgttaatttagagagcagaagcagctcatctcctgttctggaattctgaaattaatagacagtactcggatatgtgcttttactcttctttgtttggttttcgttttgcttgtttccttcactgaagaacatctcccaaattatgtcagcgattcttttcaatgtgcattattcgttaatttttattagtgtgc

SEQ ID NO: 4184 - DNA, 1137 bp, Trifolium pratense
tatccatgaacgcaaagcagtggtacaacgcagtacatggggaaagacagttgaataattgtaatcgattgatccatcaaatcaaattacatacagtgaagcaggaagcaaatctgaggtggtgacggaatcgagatcggaatcggaatcggaatcacaacgaaccgttgttaatcttaatggcgccggtttcagctctcgctaagtacaagcttgttttcttgggcgatcaatccgtcggtaaaaccagcatcatcactcgcttcatgtacgacaaattcgacaatacctatcaggctacaatcggcattgattttctatcaaaaactatgtatctcgaagatcgaactgttcggctgcagttatgggatacggctggacaggagagatttagaagtcttattccaagctacattagggattcatctgttgcggtcattgtctatgatgttgcaagtcgtcagactttcctaaacacatcaaggtggattgaagaggtgcgcagtgagagaggaagtgatgttattgttgttcttgttgggaacaaaactgaccttgtggataagaggcaagtctccacagaggaaggagaagcgaagtctagggagctcaacgttatgtttattgaagctagtgccaaagccggctttaatataaaggccctctttcgaaaaattgctgctgcattacctggaatggaaacactatcaaccacaaaacaagaagacatggtggatgtgaacctgaggtcttctgccagccatgattctcaacctcagtctggtggatgttcttgctgaatgagcctcgttgttatcttgaaaagttttgtatcatttctgctttatgctatttattttgggttgtgggttgcttcagttgtgtaaaggttctttagttttctagacttcaacatcatttcattgcgtgagataaattatagaaaacaagtggagacgtagcagtaactgatttattgtttagtctttttgaaaggtaaacatgggattggacatatttactttcttcattagaactgtgaaaagcttgagaggaatttgttgcaatttacagaagaatattttgagtctaaataacagcatgctttgtgtaatatatatgtttaaatacattttt

SEQ ID NO: 4185 - DNA, 861 bp, Cynara scolymus
ctcgcggggcacgttttttgattatcttatctctcctcccattttctctcacatttcagttttcaccaaaactttcactcaaagattgagatctgatcggcgatttcaagcaattcactcatggcggtggtgtcaccccttgccaaatacaagttggtatttttgggagatcaatccgtcggcaaaaccagcatcatcaccagattcatgtacgacaaattcgataccacctatcaggccaccatcggcatcgatttcttgtctaaaacaatgtaccttgaagatagaacagtacggttgcagctttgggatacagctggccaggagagatttaggagtctcattccaagttatataagagattcatcggttgcggtaattgtctatgatgttgccaatcgacagtcatttttgaacacttcaaagtggatagaggaagtacgtactgagcgaggcagcgatgtgattatagtccttgttgggaacaaaactgatcttgttgacaaaaggcaagtttcaattgaagaaggagacggtaaggctcgtgaattcggggtcatgtttgtagaaaccagtgcaaaagctggatttaacattaagcctttattccgaaagattgcagctgcgttgccagggatggagactctttcgtcaacgaaacaagaagacatggttgatgtgaatttgaaatcttcatcaaatacgaaccagtcagatcagcaaggcggaggctgcgcatgctaatcgtcatcaatcatattcacttcacttgtattaatgatttgatttttaaacctattaattttcttgctccattattttttccagaaactcgaattttgtgctttcaaatgacacatc

SEQ ID NO: 4186 - DNA, 764 bp, Cynara scolymus
ttacagatcagatctgatcgccgagaggagtctgagatcacctcaataatggcggtggtgtcacctcttgccaaatacaaactggtatttttgggtgatcaatccgtcgggaaaaccagtatcattacaagattcatgtatgacaaattcgatacaacctatcaggctaccattggcattgatttcttgtcaaaaacaatgtaccttgaagatagaacagttcggttacagctttgggatactgctgggcaggagagatttaggagtctcattccgagctatataagagattcatcagttgcagtgattgtctatgatgtcgctaatcgacaatcgttcttgaacactgcaaagtggatagaagaagtacgtactgagcgaggcactgatgtcattattgttcttgttgggaacaaaaccgatcttgttgacaaaaggcaagtttcaattgaagaaggagatggcaaagctcgtgaattcggagtcatgtttatagaaaccagtgcaaaagctggattcaacatcaagcctctgttccgaaagattgctgctgcgttgccggggatggagactctttcgtctacaaaacaagaagacatggttgatgtgaacttgaaatcttcaggtaatacttcacagtcggagcagcaaggtggaggttgtgcgtgttaacgacacagtttgtaatggggttagtaaacttattttgttcataatttatgaacttgtagtaaacagatatgatgatggtatcttcaatatac

SEQ ID NO: 4187 - DNA, 1256 bp, Echinacea purpurea
ccgggggagaattatatcgaattaccaatagtctaggcaggcacacaagggaggcacgaagtttggcggtttcttctccaactcgtcttctctctctccaaattcctcccatcgttcacctttcactacgcacagatctcaatctcatctgatctgatcaccttgattcattgtgatctcaaattattcaccaatggcgggggtgtcacctctcgccaaatacaagctcgtttttctcggcgaccaatccgtcggcaaaaccagcatcatcaccagattcatgtacgacaaattcgacaccacatatcaggctactattggcattgattttttgtctaaaacaatgtaccttgaagatagaacagttcggttacagctttgggatactgctgggcaggagagatttaggagtcttattccaagttatataagagattcatcagttgcagtaattgtctatgatgttgccaatcgacagtcatttttgaacacttcaaagtggatagaagaagtgcgtactgagcgaggcagcgacgtgatcatagtccttgttggcaacaaaacggatcttgttgacaaaaggcaagtgtcaattgaagaaggagatggcaaagctcgtgaacatggagtcatgtttgttgaaacaagtgcaaaagctggatttaacattaagcctttgtttagaaagattgctgctgccttgccagggatggagacactttcctccacaaaacaagaagacatggttgatgtgaacttgaaatctagctcaaatacaaaccagtcaaatcaacaaggtggaggttgtgcatgctagatcattaattacttgtattcacttgcgccttttgttttctataatccctagttttatgcttcaaaatgataacattatgcctcacatcatatcatcttatatggattcggttagttggtttgaactaacaagttttaaactggaattggaacaaagcgagctggctaggttagttatttggtcttgtattcttagttttcctgtttcggtttggtccaatagatgatatgaagtgatgaagaacacatggtttatagtatttatggtggatgttaaaaaatccaactttttgatcttggtaataaccatcaataagtcgtcttactcggttttccggtccctgccccataaactcttgcatttccgggagctctctcttaccactttgtcaccactttgttcccctctatcgaaacgagcaaagcaattgtggaacctg

SEQ ID NO: 4188 - DNA, 677 bp, Heritiera littoralis
ccaaatacaagttggttttcttgggggatcaatcggtcgggaagaccagcatcatcactcgcttcatgtacgataaattcgataatacctaccgggctaccatcggtattgactttctatcaaaaacaatgtacctcgaagatcgaacagttcgattgcaactctgggatactgctggacaggaaagattcaggagtcttattccaagttacattagggattcctctgttgcagtcattgtctatgatgttgcaagcaggcagtcattcctaaatacttcaaagtggattgaagaggtgcggactgagcggggtagtgatgttattattgtgcttgttggtaacaaaacggatcttgtggacaaaaggcaagtctcaatagaggaaggagaagccaaggctcgtgatctcagtgttatgtttattgaaactagtgccaaggctggcttcaatatcaagcctctgtttcggaagattgccgctgctttacctggaatggaaacactttcttcaacaaagcaagaagacatggttgatgtcaatcttaagtctaccaacacaaatgcatctcagtcacagcaacagtctggaggatgtgcctgctgatacgccatcattgatctgagctctgcttttcaacatttcttttgtgttttagttgatcctacagagtgttag

SEQ ID NO: 4189 - DNA, 925 bp, Lupinus angustifolius
gacataattgaatgaaaggaaagtgaaagggaattgttgagttaaggagcatcagtgaaaggaaaatggcgccagtatcagctcttgcaaagtacaagttagtgttcttaggtgatcaatctgttggcaaaaccagcatcatcactcgcttcatgtatgataaatttgataacacatatcaggctacaattggtattgattttctatcaaaaactatgtatcttgaagatcgaactgttcggctgcagttatgggatacagctggacaggaaagattcagaagtcttattccaagctacattagggactcgtctgttgctgtcattgtttatgatgttgcaagccgtcaaactttcctaaatacatcaaagtggattgaagaggtgcgcagtgagagaggcagtgatgttattgttgttcttgttgggaacaaaactgacctcgtagataagaggcaagtctctacagaggaaggggaagctaagtctcgcgagctaaatgtcatgtttattgaagctagtgccaaagccggctttaacataaaggcactctttcgaaaaattgctgctgcattacctggaatggaaactctatcttccacaaaacaagaagatatggttgatgtgaacctaagatcttctgcaggccatgattctcaacctcagtcaggtggatgcgcttgctgaatgtgcctgcctcgtcttcaatttttgtaactttctgctttttgctatttgttttgaaatgtacttgactcagatttgtaaagattcattactgctttagttttttaacagattatattagaaaaattagagaaaacaagctgatgaacccatattaatatggttgttaaatgcatttgtgagttgtgactatcccaatcaactaccccattgggagtttgggaccaattgttaaaagt

SEQ ID NO: 4190 - DNA, 900 bp, Medicago truncatula
tacagagacagttgaattgaattgatccattcttacattacatcgcatgcacagtgaagaagcaaatctttgattgtttcttcttcttcctcaaccgaatcggaatctgaatcacgttaatctaaatggcgccagtttcagctctcgcgaagtacaaattggttttcctcggcgatcaatccgtcggtaaaaccagcatcatcactcgctttatgtacgacaaattcgataacacttatcaggctacaatcggcattgattttctatcaaaaactatgtatcttgaagatcgaactgttcggctgcagttatgggatactgctggacaggagagatttagaagtcttattccaagctacattagggactcatctgttgctgtcatcgtttatgatgttgcaagtcgtcagactttcctaaacacatcaaagtggattgaagaggtgcgcagtgagagaggaagtgatgttattgttgttcttgttgggaacaaaactgaccttgtggaaaagaggcaagtctccacggaggaaggggaagcaaagtctcgtgagctaaatgttatgtttattgaagctagtgccaaagccggcttcaatataaaggccctgtttcgaaaaattgctgctgcgttacctggaatggaaacactatcaaccacaaagcaagaagacatggttgatgtgaacctgaggtcttctactagccatgactctcaacctcagtctggcggatgttcttgctaaacgagctttgttgttgtcttgaaaagttttgtatcttgtctgttttatgctttattttttttttggttgtgggttgctttagatgtgtaaaggttcttttgtcttctagacttcaacagcgttgcgtgagaacaattatagaaaacaagtggag

SEQ ID NO: 4191 - DNA, 1101 bp, Allium cepa
gcagagtgggccattacggcctagttacgggacggaagacaatattacagtttgcacttcttcctcattgtcctgtaatccaacttcattcctaatttattacatttctaagtaacgattattatctaattaaataatatttttgctcccgatcgcgatcttgtctctcgtgaaaaacccagtgaaataaagcgttaagatctagagagaaaaggctcatactctaacaataatggcggtggtttcagctctagccaagtacaaacttgtgtttttgggagatcaatccgtggggaaaacgagtattattactcgatttatgtatgacaaatttgatacaacttatcaggctacaatcggaattgatttcttgtcgaagaccatgtaccttgaagatcgcacagttcgcttacagctatgggacactgctgggcaggagagattcagaagtcttattccaagctacattagggattcctcggtggcagtgattgtgtatgatgtagcaaacagacagtcctttttaaacacttcaaagtggatcgacgaagtacgtacagaacgaggtggtgatgtcattattgtgcttgttggaaacaaaacagatcttgttgataaaaggcaagtttcgatagaagaaggagaagctaaatcccgtgaacacagtgttatgttcattgaaactagtgctaaagcaggattcaatatcaagccattgtttcgcaagattgctgctgctttgcctggaatggagactctttcctcaacaaaacaagaggacatggttgatgtaaatttgaaaccaactgcaagttcatctcagggtcaacaacaatcaggaggctgttcttgctaaaactgttatatttacatcattccatcattagctagatgaaacccgtatattaattacatcttatagtaaaactttatgtttttggaagtcggtgttgctccttttcttttaaaaatgttttttcttcttcttacagtatattttgatgcttatttgttcccattctgtgtgtttttctttgagaaataatgataacatggtgtgctgtagttttcgttgtgaaatataatactttcaacttcttt

SEQ ID NO: 4192 - DNA, 1018 bp, Allium cepa
cgagtgctcaaagttgtaggcttttttagagcttacggaaaacaatattacagtttgcgcttcttcctcattgtcttgtaatccaacttcattcctaatttattacatttctaagtaacgattattatctaattaaataatatttttgctcccgatcgcgatcttgtctctcgtgaaaaacccagtgaaataaagcgttaagatctagagagaaaaggctcatactctaacaataatggcggtggtttcagctctagccaagtacaaacttgtgtttttgggagatcaatccgtggggaaaacgagtattattactcgatttatgtatgacaaatttgatacaacttatcaggctacaatcggaattgatttcttgtcgaagaccatgtaccttgaagatcgcacagttcgcttacagctatgggacactgctgggcaggagagattcagaagtcttattccaagctacattagggattcctcggtggcagtgattgtgtatgatgtagcaaacagacagtcctttttaaacacttcaaagtggatcgacgaagtacgtacagaacgaggtggtgatgtcattattgtgcttgttggaaacaaaacagatcttgttgataaaaggcaagtttcgatagaagaaggagaagctaaatctcgtgaacacagtgttatgttcattgaaactagtgctaaagcaggattcaatatcaagccattgtttcgcaagattgctgctgctttacctggaatggagactctttcatcgacaaaacaagaggacatggttgatgtaaatttgaaaccaactgcaagttcatctcagggtcaacaacaatcaggaggctgttcttgctaaaactgttatatttacatcattccatcattagctagatgaaatccgtatattaattacatcttatagtaaaactttatgtttttggaagtcggtgttgctccttttcttttaaaaatgtttttacttcttcttacagtatattttgatacttatttgttc

SEQ ID NO: 4193 - DNA, 1118 bp, Citrus sinensis
acggattgaatgaaaactcattttcgcttcatttcattttcttcttctctctctctcttctcttcattttcatttgaaaaaaaaaaagagagagatttgagatctatattgtaaacaaaaaaaatggcgtcagtgtcccctttggcgaagtataagctggtttttttgggcgatcaatcggtgggcaaaaccagcatcatcacgcgtttcatgtacgataaattcgacaccacttaccaggctacaattgggattgattttttgtcaaaaactatgtaccttgaagatcgaacggttcgtttgcaactttgggatactgctgggcaagagagatttcggagtcttattccaagctacatcagagattcttctgtggcagtaatcgtctatgatgtggctaataggcaatcgttcttgaatacttctaggtggattgaggaggttcgtacagagcgaggaggtgatgttatcattgtccttgttggtaacaaaactgatcttgttgataaaaggcaagtgtctatagaggagggcgatggcaaggctaaagagtttggagtcatgtttatagaaaccagtgcaaaagcaggattcaatattaagcctctctttcggaagattgcagctgcgttgccaggaatggaaacactttcctccacgaagcaggaagacatggtggatgtaaacctaaagccgactgtaaattcatctcagacagagcagcaaggaggaggttgtgcttgttaaagaaatgtatttgaacaaaaagatagagagaatagccacagccattgaaccacccaacaatcgagcaaattcagctaacatgatggatgatgaatctgagtttatgctattttcagagcaacaaatcccggcaaattcggtgttataaatttgttcaacataccggcaagttttgagtgttaatttagagagcagaagcagctcatctcctgttctggaattctgaaattaatagacagtactcggatatgtgcttttactcttctttgtttggttttcgttttgcttgtttccttcactgaagaacatctcccaaattatgtcagcgattcttttcaatgtgcattattcgttaatttttattagtgtgc

SEQ ID NO: 4194 - DNA, 952 bp, Cajanus cajan
tatatttttggttaaatttgagtaacacaaaatgttgagcatgatggagagaaaggaggaaatctgaatgagaagggcgttttgttgaattgaggtgtgttgtgttgtgttgtgttgtgaaaatggcgccagtgtcggctcttgcaaagtacaagctggtgttcttgggtgatcagtctgtgggcaaaaccagcatcatcactcgcttcatgtatgacaaatttgacaacacttatcaggctacgattggtattgattttttatccaaaactatgtatcttgaagatcgaactgttcggctgcagctatgggatacagctggacaggaaagatttagaagtcttattccaagctacatcagggactcatctgttgcagtcattgcttatgatgttgcaagccgtcaaactttcctaaacacatcaaagtggattgaagaggtgcgcagtgagagaggcagtgatgttattattgttcttgttgggaacaaaactgatctcgtggataagaggcaagtctctacagaggaaggagaagctaagtctcgtgaactaaatgtcatgttcattgaagctagtgccaaagctggctttaatataaaggccctctttcgaaaaattgctgctgcattacctggaatggaaacactatcttccacaaaacaagaagatatggttgacgtgaacctaagatcttctggtggccatcaatctcaacctgagtctggcggatgtgcttgctgaatttgccttatctttttgctttgtgctatttattttgaaatgtacgtttctcaaatctgtaaaggttcattatgtttgacttttaacagcattctatgataaaaagttagagaagaactaatatcgatacaatcgggtgattgtttagttcactattcattattattttaatatgattgtaatttgaaatataaacattgacagattca

SEQ ID NO: 4195 - DNA, 711 bp, Raphanus sativus
ggaatctctccggcgagtattggaaactgcttcccctcgcgagatctcgagacgtatctcagatccgtcaggctagtttgatcgctcgaggaatcatggctccggtctctgcactggccaagtataagctggtgtttctgggagatcaatcggtggggaagacgagtatcatcactcgattcatgtacgacaaattcgacaacacttaccaggccacaattggtattgattttttgtcaaagacaatgtacctcgaagatcggactgttagactgcagttgtgggatacggcagggcaagagagattcaggagtcttattccgagctatattagggattcttctgtcgctgttattgtctatgatgttgcaagcaggcaatccttcctaaacactactaagtggatcgatgaggttaggacagagcgtggtagtgatgtcatagttgtgcttgttggaaataaaaccgaccttgtcgacaaaaggcaagtgtcaatagaggaagcagaagccaaggctcgtgagcttaatgtaatgtttatcgaaaccagtgccaaagcaggcttcaacataaaggcgcttttccgcaagatcgcagcagctttgcccggaatggaaacactgtcttcgacaaagcaagaggatatggttgatgttaatctcaagtcttccaacgccaatgcatctttggctcagcagcaatcagaggatg

SEQ ID NO: 4196 - DNA, 900 bp, Carthamus tinctorius
tcgtatatatatattaaattcggtcttttccgtcgtctctttctctccgatttttctgtcttctctctctctctctctgcatttcccccaaatttacaaacacaaattcaggtttgatcttcgacaaacaaaagatttgattgaagaaaatggcggtggtgtcacctcttgccaaatacaaattggtatttttgggagatcaatccgtcggcaaaaccagcatcattaccagattcatgtatgacaaattcgataccacatatcaggctaccatcggtattgatttcttgtcaaaaacaatgtaccttgaagatagaacagttcggttacagctttgggacactgctgggcaggagaggtttaggagtctcattccaagctatataagagattcatcagttgcagtaattgtctatgatgttgccaatcgacagtcgttcttaaacactgcaaaatggatagaagaagtgcgtacagaacgtggtagcgatgtcattatagtcttggttgggaacaaaactgatcttgttgataaaaggcaggtttcaatcgaagaaggagatggcaaggctcgtgaactcggagtaatgttcatagaaactagtgcaaaagcaggattcaacatcaagcctttatttcgcaagatcgctgcggccttgccaggaatggacaatctttcgtcaacaaaacaagaagacatggttgatgtgaatttgaaatcttccagcaacacgtctcaatcggatcaacaaggtggagggtgtgcatgttagatctttgcatacagagggaattatatttttgtaccatttcattcaacattttgtatcaaaacaatcgttgtagatggaaaactatccccaaaaccctctactttcatacaacattcttactcgaaaa

SEQ ID NO: 4197 - DNA, 2759 bp, Glycine max
tgttgtataggccggcagactttcttaaatactgctaagtggattgaagaggtgcgaacagaaagaggcagtgatgtcattattgttcttgttgggaacaaaactgatcttgttgagaaaagacaagtctctatagaggaaggagaagcaaaagcacgtgagctcaatgtcatgtttattgaaactagtgctaaggctgggtttaatataaaggccctatttcgaaaaattgctgcagcattacctggaatggaaacactatcttctgcaaaacaagaagacatggttgatgtaaacttaaagtctacaactggcagtgcgcagtctcaacctcagccaagtggatgtgcttgttaaatatactttatcatgtgcggtccacctttttgtgtcattccttttgttttatgcagatttttctagtcttctacatcattatatgaaaagatgaaagaatatataagcgatcggggtaggggttgatacaagttgtgtctagaaaatttctgttgttagttggttttgcccgtgatactgtgtactaaagtagtaaagctgcccaaccaaagattgaattatgttcattgtaaccctgtaaaacgtgttataagtttaaaatttaacttgttcatttggattgacatgtttgtgtttaacttgttcatttgtgtcacgatttttcatcttgctagcgctttctatccataaataataatgatgatgctgcttcaaggcaagggtacattgtaagcttgaatacactataaagtaccgactattttttaacggcagaatctgaccaaaatgacaactgatcttgcgtcgatgcaattacaatacttaaatggacgttccccggggaaaacagtgattgaatttattattagatactatggtccgattgaatctaaaagactgagtaacaactcagtttaattgaatccagtactgaatcctgaatctctgatatatagctgcgcacgggactagagcccagtcccagtcccatatgactatgactattgtcatagaacaattaccataggaaccaaggatccggatatcagttatgaatctaaaattgattttgtaagattaatttcgattaaaattgattttcattcaaatgatgtaatttatatttaaatgtgttgttataaaatttattataaaattttaatcaaacgcaaaaattatttaaatttattttaactcaaaatcaattttgtatttagaatcaaaatttttcaacttgtgaaaatttatctaaaattaattatcaactcaattatttttctaacgtgaaattaaacacaaacttatattttaaggagcaaaagtaatataataactcaataaattctgctattaaagagctgctactgtaccaaaagaaatacgagagttttgctacagttagtttttaggtctttagacacattaagtgagagggaatgagagttttgtcgtcattatgtgcaaataaatgtaaataatttttatatcgttaattcaaataaaattcgacacatacacatacaaaaataaagtttagttttaacatgatttttgatttgttgatgatttaggttacggtgcatataaattaaacattattattattattattattattattattattattattattctctacgcatagcaaaaagaagtttaattatagtgaaaagttagatatttcatatttggttaaattacacttaacaaaaaaaacttgatcatggttgagagagaaagaaggaaatctgaatgagaagcggcattttgttgaattgaggtgtgttgtgttgtgttgtgttgggggcatcagtgaaaaatggcgtcagtgtcagctcttgcaaagtacaagctggtgttcttgggtgatcagtctgtgggaaaaactagcatcatcactcgcttcatgtatgacaaatttgacaacacttatcaggccacgattggtattgattttttatcaaaaactatgtatcttgaagatcgaactgttcggctgcagctgtgggacacagctggacaggaaagatttagaagtcttattccaagctacattagggactcatctgttgctgtcatcgcttatgatgttgcaagccgccaaactttcctgaacacatcaaagtggattgaagaggtgcgcagtgagagaggcagtgatgttattattgttcttgttgggaacaaaactgaccttgtcgataagaggcaagtctctacagaggaaggggaagctaagtctcgtgaactaaacgtcatgtttattgaagctagtgccaaagctgggtttaatataaaggccctctttcgaaaaattgctgctgcattacctggaatggaaacactatcctccacaaaacaagaagatatggttgacgtgaacctaagatcttctggtggctatcaatctcaacctcagtccggcggatgtgcttgctgaatgtgtcttatgttgaagttctgcacctttttgctttgtgatatttgtttttaaatgtacgtttctcagatctgtaaaggttcattgtcttttagacttttaacggcattttatgataaaacacttaatcaagattcaagaactaagaactaatattgatacagtcagttggctgtttagttgactgttcattataattttattatgcttgtaatttgaaatataaaccttgagaaattcactttcttcttcatgactgcttgaagacagctatagatgcttaaacattgtaaataag

SEQ ID NO: 4198 - DNA, 1834 bp, Centaurea maculosa
gaggtggtgggtttgaccttgccgtctatagttggcggtttcttctcccactcacattcctatgtgtatatatatatgacccgattgaaaatcaaaccctttttttgatttcatcttatctctctcttccctaatttttctcatttttcagttttcaccaaaaaactttcactcaaaagattcagatctgatcggcgatttgaagcaattgaattctgaataatggcggtggtgtcgccccttgccaaatacaagttagtgtttctaggagatcaatccgtcggcaaaaccagcatcatcaccagattcatgtacgacaaattcgatacaacctatcaggctaccatcggcattgatttcttgtctaaaacaatgtaccttgaagatagaacagttcggttgcagctttgggatactgctgggcaggagagatttaggagtctaattccaagttatataagagattcatcggttgcggtgattgtctatgatgttgccaatcggcagtcatttttgaacacttcaaagtggatagaggaagtacgtactgagcgaggcagcgatgtgattatagtccttgttgggaacaaaactgatcttgttgacaaaaggcaagtttcaattgaagaaggagacggcaaggctcgagaatttggggtcatgtttgtagaaaccagtgcaaaagctggatttaacattaagcctttattccgaaagattgctgctgcattgccggggatggagactctttcatccacgaaacaagaagacatggtggatgtgaatttgaaatcttcatcaaatccgaaccagtcggataaacaaggcggaggttgcgcatgctaaatacgttcgtgttcacttcacttgtattaattatttgattttgaaacctattattagttttcttgctcctttttattatttccagaaattcgtaatttatgctttcaaatgactccttttgtgcctcagacaggttatatggattagagtttaccttttaaaacagtttaatgtaaagtcaatggcagctgcataagattatttcatttagaattttaaaaagaaaaaatcatgcatccataggtagtatcaaaaatccaaaacttcagtcattacaaaaaggacgaaatcaaactaacatgtttgtgctcccattaataagctagcataaaggactcagactttgtaatttgtaaccgaaaaagcttctgataaagaacgacaccataataaatgaagcaaacacggattacttgatcaatcagtcacccttccttcggaaagagcatccctcagtgagtctggcacgaccaccagtcggctggcacaacacggtctggcagtttccgcaaaccaccacggtttgagagtggctaaatacagttgttatgttgaaacagccctggcacttaacatccatgaagaaagagtttggcgactgcacaagacgcttgagcttatgcttcctcttctccaactcagctggtgggttaagcagatcaacatcgtttgacaaaaccatcttgtttagataagaatcgactgattatggtcttggaaagcgaaagatgcagctcgattgggagagtgttggctgctgaatgcttacactgcagagtacgcgggggggttatgtgagagacgggtcattggaccgtgagactatccgcaattctacaaaccctacttatagtcttattccatttgaggaactagactagttaattattgtattgtctttataattacaattgatgtaattgcatattacttatacccctttttgggaagagctcgcgctatggcgttggaatacatgtaccacctt

SEQ ID NO: 4199 - DNA, 1242 bp, Theobroma cacao
tctcctgctccctatataaaagggattaaactcaaagctttccttcattttcttcctctccctcatttccatttccattttcatttccatctccatctaaataataatagtaataataactacaatttcagtttctttcgagattcagatctgaaactttcgcgtttacgagcaaattgaaaaatggcgacggtgtctcctctggcgaaatacaagctggtattcttaggcgatcaatccgttggtaaaaccagcatcattacccgcttcatgtacgataaattcgacacgacttaccaggctaccatcggaattgattttttgtcaaaaacaatgtatcttgaagatcgaacagttcgtttgcagctttgggatactgctgggcaggagaggttcaggagtcttatcccaagctacatcagagattcttctgttgcagtaatcgtctatgatgtagctaataggcaatcatttttgaacacttcaaagtggattgaggaggtacgcacagaacgaggcagtgacgtcattattgtccttgtcgggaacaaaactgatctggttgataaaaggcaggtatctatagaggaaggagataacaaggctcgtgaatttggagtcatgtttatagaaaccagtgcaaaagcaggattcaatatcaagcctctcttccgcaagattgctgctgccttacctgggatggaaactctttcttcaacaaaacaggaagacatggttgatgtgaacttgaagcctactgtcaattcatcccagaagacagaacaacaaggagggggttgtgcatgttaagagaaatgtatttactaaaagcttaagagagaaaaagtagcattcaagcacttttttcagctaccaaatacacaagtgaatttagcaaacagccgtaaaagattgttccagagcaaaatcttttttgctcttcagtttacgatccaatttctggatatttcaggaagctggcctacgcttctggtcctacggtaggttgtttcacatctcttattgttattttcctcgtagtttatggagcttttcttccatgcgtcgtggtaactaagttcaattgtgttgagtattttatttgtctcagaaaattccttctagtatatagccattcattgtgtgacttgaattgggagctttaatactcgtaatgatttttttatgagaattttctacagattccattctttatataaatcatactgaaaataaaagtac

SEQ ID NO: 4200 - DNA, 930 bp, Gossypium hirsutum
aaagctttccatcctttttcatctccattaaatttccatttccatctatagtattcatcataataatttgagaaccatatttcttccatatatcagatctgaatctctctcgtttaccataaaaaatcgagagaacaaattgcaaagaaaatggcgacagtgtcccctctcgccaaatacaagctggtcttcttaggcgatcaatccgttggcaaaaccagcatcatcacccgcttcatgtacgataaattcgacaccacttatcaggccactataggaattgattttttgtcaaaaacaatgtatcttgaagatagaacggttcgattgcagctttgggatacggctggccaggagagatttaggagtctgattccaagttatattagagattcttctgttgcagtaattgtctatgatgtagctaataggcaatcatttttgaacacttcaaagtgggttgaagaggtacgcacagaacgaggcagtgatgtcattattgtcctagttggcaacaaaactgatcttgttgataaaaggcaggtttccatagaggaaggagataacaaggcaaaagaatttggaatcatgttcattgaaaccagtgccaaagccggattcaacatcaagccactgttccgcaagatagcagcagcattaccagggatggaaaccctttcttcaacaaaacaggaagacatggttgatgtgaacttgaagtcgagcggcaattcatcccagaatacagagcagcaaggaggcggttgtgcatgttaaaacagatagtgttttactaaacaagaaagcatttaagcatttttatttaaccacacaagtaaaacttagcagacacggtaaaagcattgtgattcattttgtttgtggtagttcgtgaagtctttttatattattccatgcatttgggtggga

SEQ ID NO: 4201 - DNA, 981 bp, Echinacea purpurea
tttaaacttaaatacggatcggagactccatcaataacattgcgactctatttcaaatcaattcaaaatcgactgctcaaaacagtaaattctgcaatatcattcactagatcagcaattcagcacaacccagtacaacttccttgttctgatccgatcaaatcaggttgaagatcaagaaaatggcaaaaccagtatcagcactagcgaaatacaagctggtgttcttgggggatcaatccgttggcaaaaccagcatcattacccgattcatgtatgacaaattcgataccacctatcaggctaccatcggtatagatttcttgtcaaaaactatgtaccttgaagatagaacagtccggttacaactttgggatactgctgggcaggaaaggtttaggagtctcattccaagctacataagagattcatcagttgcagtcattgtctatgatgttgccaatcgacagtcattcttgaacactgcaaaatggatagaagaagtgcgtacagagcgaggcactgatgtcattatagtccttgttggaaacaaaaccgatcttgttgacaaaagacaagtttcaattgaagaaggagatggcaaagctcgtgaatttggcgtcatgtttatagaaaccagtgcaaaagctggatttaatatcaagcctttattccgaaagatagctgctgcattacccgggatggagactctttcttccaccaaacaagaagacatggttgatgtgaatttgaaatcttcagggaacgctttgcattcagagcagcaaggtggaggatgcgcgtgctagagatgctttatagattgtaatgttgataattttgatttgtaagtgacgtgatcaaagtaatatcatgcatctttagaataccttttcacaaaacaaagatttgtgctacttcctttttaactttgtgggctttagttatgctacttggggcacgaggtaataaagagtccca

SEQ ID NO: 4202 - DNA, 1127 bp, Gossypium raimondii
tttctcaaagctttccatcctttttcatctccattaaatttccatttccatctatagtattcatcataataatttgagaaccatatttcttccatatatcagatctgaatctctctcgtttaccataaaaaatcgagagaacaaattgcaaagaaaatggcgacagtgtcccctctcgccaaatacaagctggtcttcctaggcgatcaatccgttggcaaaaccagcatcatcacccgcttcatgtacgataaattcgacaccacttatcaggccactataggaattgattttttgtcaaaaacaatgtatcttgaagatagaacggttcgattgcagctttgggatacggctggccaggagagatttaggagtctgattccaagttatattagagattcttctgttgcagtaattgtctatgatgtagctaatagacaatcatttttgaacacttcaaagtgggttgaagaggtacgcacagaacgaggcagtgatgtcattattgtccttgttggcaacaaaactgatcttgttgataaaaggcaggtttctatagaggaaggagataacaaggcaaaagaatttggaatcatgttcattgaaaccagtgccaaagccggattcaacatcaagccactgttccgcaagatagcagcagcattaccagggatggaaaccctttcttcaacaaaacaggaagacatggttgatgtgaacttgaagtcgagcggtaattcatcccagaatacagagcagcaaggagggggttgtgcatgttaaaacagataatgtgttttactaaacaagaaagcatttaagcatttttatttaaccacacaagtaaaacttagcagacacggtaaaagcattgtgattcattttgtttgtggtagttcgtgaggtctttttatattattccatgcatttgggtgggaagtagagttccaactctcttttttttttttttgtctcggaaaattacattctaggaatagtcatttattgggagttggggatctttaatgttcatgatgtcagattaatattctatattaaaatgaaagcttcattttcattttcccctccttctggggggtcgtgggaacggacagcgcagccgttaa

SEQ ID NO: 4203 - DNA, 974 bp, Beta vulgaris
actcatttcttctctctccccctccaacgcgaaaacgacagcttacccaaactccattttcccttaggccttactcgctcttctctctcctaggatccgttacactcaaacggaacttctgctaggatccatctgaactcgaacaaaattcacaaacgattctatcaaattcccccagatttacaaaaatagggtcgatcatttgaatcctcttcaaaaatcccctaaaaatggcgccagtttcagctcttgctaaatacaagctcgtatttttaggggatcaatccgatggtaaaaccagaatcatcactcgttagatgtatgacaagttggataacacttatcaggctacaattggtattgattttctatcaaagaccatgtatcttgaagatcgaactgtacgtctacagttgtgggatactgctgggcaagagagattcaggagtcttataccaagttacataaaggattcatctgtggcagtcattgtatatgatgttgcaagtcgacaatctttccttaatacagcaaagtggatcgaagaagtccgcactgagaggggtagtgatgtcataatagtccttgttggaaacaaaactgatcttgtggataaaaggcaagtctccatagaggaaggagaagctaaagctcgtgatcttaatgtcatgttcattgaaaccagtgcaaaagctgggttcaacataaaggcattgttccgaaaaattgctgctgcattgcctggaatggagacactctcttctacaaagcaagaggacatggttgatgtaagtctgaagtcgacatcaagtgcaccccagtcgcagcctcagggcagtggatgtgcttgctgaccctgccttatcttgctccatggaagtcacattctccttaattgtgtaccctttttgtactttcggcctctgaatctagaaagattttgctccctttctctgaagtaattatagtcataa

SEQ ID NO: 4204 - DNA, 1066 bp, Cycas rumphii
aaaaagaccaacatagaaattgtccgaattgccatgggtttttcggtgaacagaacagggtcaaatcccaatggttcataatcctaaacatggttattagctttattttcagatccattgtttcaggcttgattggctttgccttcgaaatctgatcagatttgactgcagtcagtgagggatttttggataaggatggctacggtgtcacctcttgccaagtacaagctggttttcttgggagatcaatctgtggggaagaccagcattattacacgttttatgtatgataagttcgacaatacttaccaggctaccattggtattgactttttgtcaaagacaatgtaccttgaagatcggaccgttcgattgcaactttgggatactgctggtcaggagcgattccggagtctcattccaagctacattagagattcatctgttgctgtcatcgtctatgatgttgcaaaccgacaatcctttttaaacactgcacgatggattgaagaagtgcgtacagagcgtggcagtgatgtaattattgtccttgttggaaacaagacagaccttgtggacaaaaggcaagtttcaattgaggaaggtgatgccaaatcacgggaattcggggtcatgtttattgaaaccagtgcaaaagcagggttcaacattaaggccttgttccggaaaatagctgctgccttgccagggatggagaccctctcatcaacaaagcaggaagacatggttgatgttaatttgaaacctactgtaaatacttctcaagcggttcaaaaaggaggatgctcttgttgagtgtagagtacaacacatgttgtcctttctttgtgactgcattctttatagtcctttggttagggcccatgggaaaagatggatgcactaataaagttggttcacttgtgtttcaagattctctgttcagagtgtaactcaataaataggatggggcattcatatcactcttgtaggctttacatcacaatttgtactggatagctttattactgttctaaaggatcttagagcatttgtctttcccccc

SEQ ID NO: 4205 - DNA, 579 bp, Rosmarinus officinalis
atggctccggtttcggctttggcaaagtataagttggtgttcttaggggatcaatcggtcggcaaaaccagcattattactcgattcatgtatgataagttcgataatacttatcaggctacaattggtattgattttttgtcaaagactatgtatcttgaagaccgaactgtccgattgcagctttgggatactgcaggacaagaaagatttcgaagtcttattccaagctatattagggactcctcagttgctgtcattgtgtatgatgttgccagccagcagtctttcctgaacacattaaagtggattgaggaggttcgcactgaaagaggcagtgatgtcatcattgtccttgttggcaacaaaactgaccttgtggataagagacaagtatcaattgaggaaggagaagccaaagctcgggaccttaatgtcatgttcattgaaaccagtgcaaaggctgggttcaatataaaggcactatttaggaaaattgctgcagccttaccaggaatggagacactttcttctgccaaacaagaagacatggttgatgtcaacctcaagtctagcaac

SEQ ID NO: 4206 - DNA, 1112 bp, Aristolochia fimbriata
actgcgtttccgcgtcttaattggcggttagtggcaccctctcccggttctcctgatataaaacccctgggatttcgttcgcttgctctttgaaagcctcgtccatttcagatcttggttttttttctctgcggagaagggaagaagaaaccaatggcgactgtttcacctctggcgaagtataagctggttttcttgggggatcagtccgttggtaagaccagcatcatcactcgattcatgtacgataaattcgataccacgtatcaggccactattggcattgattttctctctaagacaatgtacctggaagatcgaacagttcgtttgcagctttgggatactgctggacaggagagatttaggagtctcattcctagttatatcagagattcttccgttgcagtgattgtctatgatgttgcaaatcggcaatcgtttttgaatacttccaagtggatcgaggaagtccgcactgagcgtggcagtgatgttattattgtgttggtgggaaacaaaactgatcttgtggataagaggcaagtgtcaattgaggaaggtgatgctaaggcccgtgattttggtgttatgttcattgagaccagtgctaaagcaggatttaacataaagccactatttcgtaagatagctgctgccttgcccggaatggagacactgtcatcaacaaagcaggaagagatggtcgatgttaatctcaaacccacagtgaatgcatcacacacagagcagcaatctggcggatgtagttgctaaacatgaacgaataagttccacctcaacacaaaatagaaaaaggtgattcatgtcatgagaattttgcagtagctggccaagatgtgaagatatatgggtgctttcctcacttgatgtttagttgtaatatgaaggtttttatcgtggtataagtatcaattttttggtttattgtccagtttttacgtggatgtattgttagttaattttatttcatctggttccattctttaagttttaagttttactggaaatccttattttaaatttatcaaactaaaatcaattccgtcgcatacgtagtcaaagaaatcttataaaggtcaatatatttt

SEQ ID NO: 4207 - DNA, 928 bp, Artemisia annua
attcagttatttttttcacacacacacacgcatttagagatttagagatctgaatctgatcagatctgatatttgtgatttgtgaataataataataataataaaaagggaatggcggtagtgtcacctctagcgaaatataagttggtatttttgggggatcaatcagttggtaaaaccagtatcattaccagattcatgtatgacaaattcgataccacttatcaggctactattggcatcgatttcttgtctaaaactatgtaccttgaagatagaacagttcggttacagctttgggacactgctgggcaagagagatttagaagtcttattccaagttatataagagattcatcagttgcggtgattgtctatgatgttgccaatcgacagtcatttttgaacacttcaaagtggatagaagaagtacgcactgagcgaggcagcgatgtgattatagtccttgttggaaacaaaactgatcttgttgacaaaaggcaagtatcaattgaagaaggggatgcaaaagctcgtgaacatggagtcatgtttgtagaaaccagtgcaaaagcaggatttaacatcaagccattattccgaaagattgctgctgccttgccagggatggaacaactttcctctacaaaacaggaagacatggttgatgtgaatttaaaatctgcagcaaatacaaaccagtcagatcaacaaagtggaggctgtgcatgctagaccgcttcaacatcaattaatcacattacctgtatttatttaattttggaacgtatttgtgcaccatttgttttctttttcgctttggaatgaactttgtgcctcaggttttgattagtttattattgggggcgatgaaaccagttctatgttaacagatcatattttcatcatatatatggattagagtttg

SEQ ID NO: 4208 - DNA, 929 bp, Phaseolus vulgaris
gaaaaaaaagaatgtttgaagtgcaccaaaaacgttagatttctgtttaaattacactaacacaaatgtgttgaacatggttgagagagaaaggaggaaatctgaatgagaagtggcattttgttaaggtgtgttgtgttgtgtgaggggcagtgaaaatggcgccagtatcagctcttgcaaagtacaaactggtgttcttgggtgatcagtctgtgggaaaaaccagcatcatcacacgtttcatgtatgacaaatttgacaacacttatcaggccacgataggtattgattttttatcaaaaactatgtatcttgaagatcgaactgttcggctacagctgtgggatacagctggacaggaaagatttagaagtcttattccaagctacattagggactcatcggttgctgtcattgcttatgatgttgcaagccgtcagactttcctaaacacatcaaagtggattgaagaggtgcgcagtgagagaggcagtgatgttattattgtacttgttggcaacaaaactgatcttgtggataagaggcaagtctctacagaggaaggggaagccaagtctcgtgaactcaacgtcatgtttattgaagctagtgccaaagctggctttaatattaaggccctctttcgaaaaattgctgctgcattgcctggaatggaaacactatcttccacaaaacaagaagacatggttgacgtgaacctgagatcttctgctggtcatgactctcaacctgattcagggggatgtgcttgctgaatgtgccttatcttgaaagttctgtatctttttgctttgaaatgtaaaggttcatttgtgttttagactttctacagcattttataacagaaactacatatggcagattgaacaactaatattgttaaagttggttgtttagttgttggc

SEQ ID NO: 4209 - DNA, 4529 bp, Cannabis sativa
gtttcttctcccctatgctaattaatacattacatcctcatatataaattacgctaaactcaaaaataaataaataatatatacaattatatagtgatcctttttttcctttgaacacagaatttttctgagattcagatccaaacccgctttgtgttcttaatttccgccattgttgccaatttgaaattagcttaaaagaaaaatcaaagaacctgacaaaaatggcaacggtgtctcctttggccaaatacaagctcgtctttctcggtgatcaatccgtaggcaagaccagcatcattacacgcttcatgtacgacaaattcgataccacctatcaggccacaataggcatcgactttttgtccaaaacaatgtatcttgaagatcggacagttcgtttgcagctttgggatactgcaggacaagaaaggttcaggagtttaattccaagctacatcagggattcatctgtagcagtaatagtttatgacgtcgcaaatagacaatcatttcttaacacaagcaaatggattgaggaagtacgtacagagcggggtactgatgtcattatcgttcttgtcggaaacaaaactgatctcgttgataaaaggcaagtttctatagaggaaggagacgccaagtcccgtgagtttggagttatgttcatagagactagtgcaaaagcaggatttaatatcaagcctctttttcgtaaaatcgcggctgccttgcctgggatggagacgctttcttccacaaaacaggaagacatggtcgacgtaaaccttaagccgacagttaactcatcacagatggaacagcaaggaggaggttgctcatgctagcctctttcattctctattgaagaagaatactatgaaaattggttcaacatatctctcagctggatataaacttttttctttttgtttcttactaagtaattcgttttctcagcgcataaaacacattactcaagttctaacaaaatcacagttacaatttttgatgtatttattttgttttagatgcattgtcttggaactttaaccttttcactttagttatattttacaatataaatttattcattacatatcaaaagatacttagatgcccacaaacactgttaagctagaagaatcagggaacaaaaggaaaagttaaagtctacttgcaatccgtgatgcgttatgggttttatctaaaataaaagtttaggattagaaataaattttaatggtttcagactgctcagatggatctgctaaacatgtgaacaaaagcaccaatttacatagaaagcctaaccaagaattatgaatatttacatcataaaaagaaggttcgttcaacattaatttctagaagagagctcaaaaaagcatgcatctgaggaaaacaaataaaaattcattaaacctaaatattataataaaagccatcatcactctgcaactctagacactataccaatatcaatatatacaatctgaagggatcctttttaactctagttatcaggagacaactcagaaaaataaaaaaacaaaggtgatgcgtgtgaaacaagtagccgagagagacacacgatcttcagacatgaacaatgctatcagcactctgcctgactttgagcgtgagaaatatcaaaattaatgtgcccaaaattgacctggaaaagaaagagtggttgttgaattactaatagagacaaatcaaaattacccaaaacaaggctagggaaaataaaagctgaagacaacaatctcgttgctaacagttatgaagattttagaccttcactgaaaagatgatgtactgcatatatatgggtgcacagaattctttggaagtaaacttgtattgtatcatatttacaaaaccatttagaacttacaagattgagaacagaagaaccacttttcttgaatcgaacgaggcagctcgtttgtaccttctccattggttatttggtgtttcatgaaccctctcaacccctgttttatctattgagaatgtgataatgagatcccactttaagacagtttttatagacaaggggaaagtacaagtgataagctaaatataatcatttttctagtgaagaaagcaaattgaaattaagtaaattatatccacgccttacatactagaaatgctaaaaatgtgcaagtattcagatcagaatgccagtgtaactatgtcagccttgaactgtctttagatgactttttttaagaataagggaagattttacatgagaagagcacttgtgaagaatattatcaaagtatggttactagacaaacttttgagccagtattgctacgaattgtataaaaatgtttatgtacctctggaagttccgtaattcatgagaagttggatcagttttgcaccaacagttacacttgcttgcctccacaaaaccctctgcaagtactataagcaacagaaacattagagacccagaaaaaatatgtttccttaattaacttaatgctatactacatgaagatgaagtgaaaacttactagcaaaacactctcgcttttcaaactttccacagctttctcattagattcaggcactttcaaggacatcttttcaacatctatgtcaacaacacaagaagaaaaggtctgtgtactgttcatttttaaatcagtgctgttctgggagttcagttttgcttccatgtagacctgatcgttcttaggattagtaacttctagaaatcttaagaaagccaaatgagaagaacaatgtagatcatcgctctcttggggcaagacagaaatgctaaagagatcttggacctgcaggaatgaagagagaaagagaagaaaaagaaaaattaagttgagaaccttgggacatcaagccatgtacaattagcaatgaaatggtgcattacagcaagcatgtcttacaaagaggtatcaacaaagaaaaccaacaacagccacttaaagatgtaccataggcaatacaacaaggcacttacatgtgagccatccgaggggagttctaaacttcctgcacacgaagcctcttcaacaagaagggggaaattacctgaatcaaaacctgacttcagcatttggaaacctgaatagctgacaggtaggttacagcttccatccacagttccctcaaccaatggatttgcctgcaacttttgcaaaacattttagcacatacaccaaatgccaaaactgcaatgggaaactactcctgaaagagaacgctgacgattcaaaataaacagagcacaacaagcctctctcactcttacgtggggaaactctttaccaaaacaaaagaaaactaactacaaaataaagttacttgacgaaatgtgatttgcatcccaagaatcatgtctcacaaacttggtatctgacaactaagcagaaatgcttacacttactcaccattacaaaattcaacaagctggtctcaagttaaagtaaaaggaatatatatctgtcacttttaaatgcttactttttctgtcctgctcttagttctagaatcctgagcttttttatcacacagtaactggactataactaatttattcctttttaagatggatggggaaggggaagagggtttatggagttgaacatttaagaatctctacatgttaatagacattcaagcaaaccattaatgttagaaggctatatttattgatccactcctattaaacatcacttaagcaagctagtacttacagcttacactcttaattgctaagatgtgcaataatctgagtaattaactctatgaaattgttactgccatgagactgaaccataaaatcatgcaagacaaacacgacaaacatgcacaaaaaaaattaagaaagaaaaatactagaaatccccagttattatacaagactgaatagcatgcaaatctagaagtttttggtaggtgtctagaaagaaagaaaaaaaaagattttaaaatatattcttcccattgttcaacctagaaattaacgacaattggatcaaaactcgaaagagccagaagattttgtactttcttttatatccaccccttatataatccgcgacaaggtcaatgaagttcataaattggattcaaaattttctcttcttgctacaaagcaagtgggttttcaacataaaagctaaaaccttcaaatgcaaatgaaatcagaacaacaaatcttcagaaaatctgtcaaatacatacaaaatagctcaattgagaactaaaatgagccaaaagcacagaacacagagttggtacctcctcggagggcttagcagccatcgcaggcagttgcagagaatctgtgaaatgcagtttctttcttcactgattcagctgagcctagagagagaagtaatctcagaagaagaagtgtggatgtgaacgttgcatcgaagaagaagaagcttatttattttatatttttagtttttattttattaattttatataattggcgcgattcgccagaaaaggctcctgactacgac

SEQ ID NO: 4210 - DNA, 878 bp, Chrysanthemum coronarium
tcgatctgatccctagaatttaaaaatggcggtggtttcaccattagcgaaatataagttggtatttttgggagatcaatcagttggtaaaacaagtatcattaccagattcatgtatgacaaattcgataccacctatcaggccaccattggaattgatttcttgtcaaaaacaatgtaccttgaagacagaactgttcgcttacagctttgggatactgccggtcaggaaagattcaggagtctcattccaagctatataagagattcatcagttgcagtgattgtctatgatgttgcaaatcgacaatcattcttgaacactgcaaagtggatagaagaagtacgtaccgagcgaggcactgatgtgattatagtccttgttgggaacaaaactgatcttgttgataaaagacaagtttctatcgaagaaggagatgccaaagctcgtgaattcggagttatgtttatagagaccagcgcaaaagctggatttaacatcaagcctttattccgaaagattgctgctgccttgccggggatggagactctatcctctaccaaacaagaagacatggttgatgtgaatttgaaatcttcgggtaatgcttcacagtcggagcagcaaggtggaggatgcgcttgctagatcatttagtgatggtttacagaggaaggctatagagtcaagagatgatgcattttgtaattggttggtcgataagttaaatttgttgataattttgattcggaagtgacatgaaagtaagaagatattgtgtgtatcttcagtatacccttttagcttttacagtattatttatctcatagagcaagacattggtggttgaccgaaacagaagtttgtgctatttttt

SEQ ID NO: 4211 - DNA, 912 bp, Chrysanthemum coronarium
acgcatttagagatttagagatctgaatctgatctgatctgatagtaataaaaatggcggtagtgtcacctctagcgaaatataagttagtatttctgggggatcaatcagttggtaaaacaagtatcattaccagattcatgtatgacaaattcgataccacttatcaggctactattggcatcgatttcttgtctaaaacaatgtacctggaagatagaacagttcgattacagctttgggacactgctgggcaagagagatttagaagtcttatcccaagttatataagagattcatcagtggcggtgattgtctatgatgttgccaaccgccagtcatttttgaacacttcaaagtggatagaagaagtacgcactgagcgaggcagtgatgtgattatagtccttgttggaaacaaaactgatcttgttgacaaaaggcaagtatcaattgaagaaggggatgcaaaagctcgtgaacatggagtcatgtttgtagaaaccagtgcaaaagcaggatttaacatcaagccattatttcgaaagattgctgctgccttgccaggaatggaacaactttcctctacaaaacaggaagacatggttgatgtgaatttgaaatctgcagcaaatacaaaccagtcagatcaacaaagtggaggctgtgcatgctagaccgcttcaacatcagttagccgcattacctgtatttatttaattttggaacgtattcgtgcaccatttattttctacatttcttttctttttcacttcggaaggaatattgtgccttaggttttgattagtttattgtcgggggtgatgaagccagttctatgtttatcacattacctcctgtatttatttaattttggaacatcttttgtgaagtagatagtatatgtgtcgt

SEQ ID NO: 4212 - DNA, 858 bp, Cichorium intybus
tgttggtgtcgttggcggtttgatccctcctactcgtatatacaacccgattcaattttaaatccgctctttttctttcgtctccttcatctctccgaatttttagttttctctctgcgtttcaccgaaattacaaacatagattcagatctgatcctcgtgagagatttgaatacacctaaaaatgtcggtggtctcagctcttgccaaatacaaattggtatttttgggagatcaatccgtcggcaaaaccagcatcatcaccagattcatgtatgacaaattcgataccacatatcaggctacaatcggcattgatttcttgtcaaaaacaatgtaccttgaagatagaacagttcggttacagctttgggatactgctggacaagagagatttaggagtctgattccaagttatataagagattcatcagtcgcagtgattgtctatgatgttgctaatcgacagtcattcttgaatactgcaaagtggatagaagaagtacgtactgagaggggcactgatgtcattatcgtccttgttggtaacaaaacagatcttgttgacaaaagacaagtgtcaattgaagaaggagatggcaaagctcgtgaatttggagtcatatttatagaaacaagtgcaaaagctggattcaacatcaagcctttattccggaagattgcggctgcgttaccggggatggagacactgtcgtcgacaaaacaagaagacatggttgacgtgaatttgaaatcttccggtaatgcttcacagtcaaaccaacaaggtggaggatgcgcgtgctagattcggtttttaaccaatagaaagaggaagagaatgagaatgagaatgag

SEQ ID NO: 4213 - DNA, 742 bp, Cichorium intybus
ctctctctcaaacctttcacagattcagatctgatcgtcgagcgagccaccggaaaacagctcaataatggcgacggtgtcacctcttgctaaatacaaactggtgtttttgggcgatcaatccgtcggcaaaaccagcatcattaccagattcatgtatgacaaattcgataccacctatcaggctaccattggcattgatttcttgtcaaaaacaatgtatcttgaagatagaacagttcggttacagctttgggatactgctgggcaggagagatttaggagtctaattccaagttatataagagattcatcagttgcagtgattgtctatgatgttgctaatcgacagtcattcttgaatactgcaaagtggatagaagaagtacgtactgagaggggcactgatgtcattatcgtccttgttggtaacaaaacagatcttgttgacaaaagacaagtgtcaattgaagaaggagatggcaaagctcgtgaatttggagtcatatttatagaaacaagtgcaaaagctggattcaacatcaagcctttattccggaagattgcggctgcgttaccggggatggagacactgtcgtcgacaaaacaagaagacatggttgacgtgaatttgaaatcttccggtaatgcttcacagtcaaaccaacaaggtggaggatgcgcgtgctagattcgctttttaaccaatagaaagaggaagagaatgagaatgagaatgaga

SEQ ID NO: 4214 - DNA, 874 bp, Cirsium arvense
agggcgtctcagtcgtatagttgtcggtttcttctccacacttatgtatatatatgacccgattgaaaatcaaacccaaccgtctaccgttttttattcatcttatctctcctccgaatttctctcacatttcagttttcactcaaactttgagatctgatcggcgatttcaagcaattcactaatggcggtggtgtcacccctcgccaaatacaagttggtatttttgggagatcaatccgtcggcaaaaccagcatcatcaccagattcatgtacgacaaattcgataccacttaccaggctaccatcggcatcgatttcttgtctaaaacaatgtaccttgaagatagaacagttcggttgcagctttgggatactgctgggcaggagagatttaggagtctcattccaagttatataagagattcatcggttgcggttattgtctatgatgttgccaatcggcagtcatttttaaacacttcaaagtggatagaggaagtacgtactgagcgaggtagcgatgtgattatagttcttgttggcaacaaaactgatcttgttgacaaaaggcaagtttcaattgaagaaggagatggtaaggctcgtgaattcggggtcatgtttgtagaaaccagtgcaaaagctggatttaacattaagcctttatttcgaaagatagctgctgcgttgccagggatggagactctttcatcgacaaaaaacgaagacatggttgatgtgaatttgaaatcttcttcaaatacgaaccagtcagatcaacaaggcggaggctgcgcatgctaatgctaattaaatcatcaatcatattcatttcacttgtattaaatatttgatatttttgtaagccta

SEQ ID NO: 4215 - DNA, 1065 bp, Trifolium pratense
atcaaatcaaattacatacagtgaagcaggaagcaaatctgaggtggtgacggaatcgagatcggaatcggaatcggaatcacaacgaaccgttgttaatcttaatggcgccggtttcagctctcgctaagtacaagcttgttttcttgggcgatcaatccgtcggtaaaaccagcatcatcactcgcttcatgtacgacaaattcgacaatacctatcaggctacaatcggcattgattttctatcaaaaactatgtatctcgaagatcgaactgttcggctgcagttatgggatacggctggacaggagagatttagaagtcttattccaagctacattagggactcatctgttgcggtcattgtttatgatgttgcaagtcgtcagactttcctaaacacatcaaggtggattgaagaggtgcgcagtgagagaggaagtgatgttattgttgttcttgttgggaacaaaactgaccttgtggataagaggcaagtctccacagaggaaggagaagcgaagtctagggagctcaacgttatgtttattgaagctagtgccaaagccggctttaatataaaggccctctttcgaaaaattgctgctgcattacctggaatggaaacactatcatccacaaaacaagaagacatggtggatgtgaacctgaggtcttctgctggccatgactctcaacctcagtctggtggatgtgcttgctgaatgagccttgttgttatcttgaaaagttttgtatcttttctgatttatgctatttattttgggttgtgggttgcttcagatgtgtaaaggttctttagttttctagacttcaacagcattgcattgggtgagataaattatagaaaacaaatggagacgtagcagtaactgatttattgtttagtctttttgaaaggtaaacatgggattggacatatttactttcttcattagaactgtgaaaagcttgagaggaatttgttgcaatttacagaagaatatttggagtctaaataacagcatgctttatataatatataggtttaaatacatttttggc

SEQ ID NO: 4216 - DNA, 1044 bp, Trifolium pratense
atttatggactggagcagatctcaactcatccagtgagtttatagttaaataacgtaaacactgaaatgaccgaatctctcacaagtctctcagtcaccaccagcgagcgagatcaacccaaagtcaggggtttttctcgtcgtcttcttcttcttatcttctgcttcgattttgtaatcatcatttgattcaaaaatggcgccagtttcagctttagcaaaatacaagttggtgttcttgggtgaccaatccgttggcaaaaccagcatcatcactcgattcatgtacgataaattcgacaatacttatcaggcaacaattggcattgattttctatcgaaaaccatgtatctcgaagatcgaacggttcgactacaattgtgggatacagctggacaggaaagatttagaagtcttattccgagctacatcagggactcatctgtagctgttgttgtgtatgatgttgcaagtcggcagactttcctaaacacaacaaattggattgaagaggtgcgaacagaaagaggcagtgatgtcattattgttcttgttgggaacaaaactgatctcgttgagaagagacaagtctccatagaggaaggggaagcaaaagcacgcgagctgaatgtcatgtatattgaaactagcgctaaagctggatttaatattaaggccctttttcggaaaattgctgctgcattacctggaatggaaacagtatcttctgcaaaacaagagggcatggttgatgtaaacttaaagtcttcatctggcaatgctcaagctcaatcaagtggatgttcttgttgaacatgctttatcttgtacttatgctgccatgcaccattctgtgttgtgcttgttgtaaaattttcaaacttgacattaaattatgttattttgttagttgtccttaagtcctagctcaactggcaatgccgatattgctaggctggacgtcttcactcgggttcgaacccgaacctcgtagtgtctttgagtttcagtggtatttccacttcgcttatcgacccaatttt

SEQ ID NO: 4217 - DNA, 1499 bp, Gossypium hirsutum
gttggaaagtgagaagcggtccaaaggttttcacaaaggcgtcatcgtcatagttgctgtttctcgtgccctctatttatggaagggattaaactcaacctttcctttcattttcttccgtctctttgaatatttccatttccatccaaataataataacgataataaacataatttcaaattttcttcattgcagaatcagatctgcaactctctgtttacaattttttcttaaaaaaagtagagtgaagaaatttgaaaaaaaatggcgacagtctctcctttggcgaaatacaagctggtattcttaggcgatcaatccgtcggcaaaaccagcattatcacccgcttcatgtacgacaaattcgacaccacttaccaggccaccattggaattgattttttatcaaaaacaatgtatcttgaagatcgaacggttcgtttgcagctttgggatactgctgggcaggagaggtttaggagtcttattccgagttatatcagagattcttctgttgcagtaattgtctatgatgtagctaataggcaatcatttttgaacacctccaaatggatggaggaggtacgcacagaacgaggcagtgatgtcattattgttcttgttgggaacaaaactgatctagttgataaaaggcaggtctctatagaggaaggagatagcaaagctcgtgaattaggagtcatgtttatagaaaccagtgcaaaagcgggattcaatatcaagcctctattccggaaaatcgcggctgccttaccggggatggaaagactttcttcaacaaaacaagacgacatggtggatgtgaacttgaaatccaccgtcaattcttcccagatagagcaacaaggaggtggttgtgcatgttaaagacaaatatgtaaaaaaaagaagcattcaaacattgttttatttcaaccaccaaatacaaaggtaaacgaagaacagaatccctcaatttaaaaaaaaaaatttcaggaatctagtctttgattttgatagtagtttatggaagtaatgtatcgtagaaattagagttaaaatatattttccagtattttattgatctcaggaaattacttctaggattgacatttggagatctttaatgcttaaactgattctttcgttagaatttcctgccctccataatcaaaatgaaagtattgtttctgaatgatgacttgcattactcgaagattaaagacaggtttggtatttattgaattcatttccgcttttttaccctaataatgtaagtacattataaattatttatgaaaataagcaaaataaacactgcaaaattggtgctactccctcaacttcccagtcatcattacaagttatataaaaacaatttttttggtgctgtaattgtattaggagatatttgtacatattttttaaaaaatacttacaaaaaatacgagtattttgggtttatatattttaatggtgtcgcgtatgtgttaggctt

SEQ ID NO: 4218 - DNA, 1122 bp, Gossypium hirsutum
catctctctccatcaccatggctcctatttcagctctggcgaaatacaagctggttttcttgggggatcaatctgtggggaagaccagtatcatcagtcgcttcatgtatgataaattcgataacaattaccaggctaccattggtatcgactttctatccaaaacaatgtacctcgaagatcgaactgttcgattgcagctttgggatactgcagggcaggaaaggttcaggagtcttataccaagctacattagggattcctcggtggcagtcattgtctatgatgtagcaagcaggcagtccttcttaaatacttcaaattggattgaagaggtgcgggctgaacggggaagtgatgttatcattatgcttgtggggaacaaaacagatcttgtggacaaaaggcaagtctcggtggaggaaggagaagccaaggctcgtgacatcaatgttatgtttattgaagctagtgccaaggctggtttcaatatcaaggctctatttcggaagattgcagctgcattgcctggaatggaaacactatcttcaacaaagcatgaagacatggtggatgtgaatcttaagtcgagcaattcaaatggatcgcagtcacaacaagagtcaggaggatgtgcctgctaatacccaaaatcattcatctcagcatttcttttgtgcttccatgatcctactaagtgcatgtaagaaatcttgttttgaagcactgggtgtggttgaatatttgagcatataacttgagagagaagatatttggtatggtagttaggctagtcctaagtcctaaccagtcatatatgagtagggttcttgtgatctcaagcaattatgccagtttgattttgcttatttatattaatagaggatttgctttgctcttgactatgtaaagaatattattagcttcactttaagcgattttcctcgtcagtgatggttaatgcactattccatttttttccttcttccaatatatatagattaagctttagttttgttcgtatttagttttgttcgtactattgttgatgtaacaagacattggttcaaatgtacttaaatgcatgttatctttcaatttaaaaattttgaggcgaaaaaa

SEQ ID NO: 4219 - DNA, 796 bp, Euphorbia peplus
cttttgagagagagagattcattcattcttccattattcagattcagatctgaaagctttttctaatactaacaatgtcgacagtatctccactcgccaaatacaagctcgttttcttgggggatcaatcggttggcaaaaccagcatcattactcgcttcatgtacgataaattcgataccacttaccaggccaccattgggattgattttctatccaagacaatgtaccttgaagatcgaactgttcgtttgcagctctgggataccgctgggcaggagagatttaggagtcttataccaagttatattagagattcttctgttgcagtaattgtctatgatgtggctaatagacaatcatttctgaacacttctaagtggattgaggaggtaagaacggaacggggcagtgatgtcattattgttcttgttgggaacaaaactgatcttgttgataaaaggcaggtttccatagaggaaggtgataacaaggctaaagagtttggagtgatgttcatagaaaccagtgcaaaagcaggattcaatattaagccattattccggaaaattgcttctgccttgccggggatggaaacactttcttccacaaaacaagaagacatggttgatgtgaacttgaagcccactgtaaattcatcccagaatgaacagcaaggagggggttgcgcctgttagggttaaaaaaaaacatacagaaaccgaagcatttttatatagacaggttttcagtgtcccatgggacttctaatgcaagatgatggtttagtaattag

SEQ ID NO: 4220 - DNA, 795 bp, Flaveria ramosissima
gttcttcactttctctctcctccgtcattctctctgttctctaacatttcatagattcagatctgatcaccgaaaaacttctgaaacaacaactccataagataatggcggtggtctcacctcttgccaaatacaaactcgtctttttgggcgatcaatctgtcggcaaaaccagcatcatcaccagattcatgtatgacaaattcgatactacctatcaggctactattggcatcgatttcttgtcgaaaacaatgtacctggaagatagaacagttcgattacagctttgggatactgccgggcaagaaagatttaggagtctcattcctagttatataagagattcctcggttgcagtcattgtctatgacgttgctaatcgacagtcatttttgaacactgcgaagtggatagaagaagtacgcactgaacgtggcactgatgtcatcattgttcttgttggaaacaaaaccgatcttgttgacaaaaggcaagtttcaattgaagaaggagatggaaaagctcgtgaatttggagtcatgtttatagaaaccagtgcaaaagcgggattcaacattaagcctttgttccgaaagattgctggtgcattaccggggatggagactctttcctccacaaaacaagaagacatggttgacgtgaatttgaaatcttcgggtaacgcatcacaatcagagcaacaaggtggaggatgcgcatgctagagcttatagcgatgagaaatgatgcattttgtaatggattggttggttggtaagttaatatgttaga

SEQ ID NO: 4221 - DNA, 906 bp, Flaveria ramosissima
actttctctctcctccgtcattctctctgttctctctctaacatttcacagattcagatctgatcaccgaaaaacgtctgaaacaacagctcaataatggcggtggtctcacctcttgccaaatacaaactcgtctttttgggcgatcaatctgtcggcaaaaccagcatcatcaccagattcatgtatgacaaattcgatactacctatcaggctactatcggcatcgatttcttgtcgaaaacaatgtacctggaagatagaacagttcgattacagctttgggatactgctggtcaagaaagatttaggagtctcattccaagctatataagagattcatcagttgcagtcattgtctatgacgtcgctaatcgacagtcatttttgaacactgcgaagtggatagaagaagtacgtactgaacgtggcactgatgtcatcatagttcttgttggaaacaaaaccgatcttgttgacaaaaggcaagtttcaattgaagaaggagatggaaaagctcgtgaatttggagtcatgtttatagaaaccagtgcaaaagcgggattcaacattaagcctttgttccgaaagattgctggtgcattaccggggatggagactctttcctccacaaaacaagaagacatggttgacgtgaatttgaaatcttcgggtaacgcatcacaatcagagcaacaaggtggaggatgcgcatgctagagcttatagcgatgagaaatgatgcattttgtaatggattggtcggttggtaagttaatatgttagataattttggtttgtaagtgacatgatgaaaggaagaagatatgatgtgtcttcattatacatttctagctttatcattcatttccatagagcaggacattcatgactgacgtgataatg

SEQ ID NO: 4222 - DNA, 975 bp, Gossypium raimondii
tcgcatctctctccatcaccatggctcctatttcagctctggcgaaatacaagctggttttcttgggggatcaatctgtggggaagaccagtatcatcagtcgcttcatgtatgataaattcgataacaattaccaggctaccattggtatcgactttctatccaaaacaatgtacctcgaagatcgaactgttcgattgcagctttgggatactgcagggcaggaaaggttcaggagtcttataccaagctacattagggattcctcggtggcagtcattgtctatgatgtagcaagcaggcagtccttcttaaatacttcaaattggattgaagaggtgcgggctgaacggggaagtgatgttatcattatgcttgtggggaacaaaacagatcttgtggacaaaaggcaagtctcggtggaggaaggagaagccaaggctcgtgacatcaatgttatgtttattgaagctagtgccaaggctggtttcaatatcaaggctctatttcggaagattgcagctgcattgcctggaatggaaacactatcttcaacaaagcatgaagacatggtggatgtgaatcttaagtcgagcaattcaaatggatcgcagtcacaacaagagtcaggaggatgtgcctgctaatacccaaaatcattcatctcagcatttcttttgtgcttccatgatcctactaagtgcatgtaagaaatcttgttttgaagcactgggtgtggttgaatatttgagtatataacttgagagagaagatatttggtatggtagttaggctagtcctaagtcctaaccagtcatatatgagtagggttcttgtgatctcaagcaattatgccagtttgattttgcttatttatattaatagaggatttgctttgctcttgactatgtaaagaatattattagcttcactttaagcgattttcctcgtcagtgatggttaatgcaccattcc

SEQ ID NO: 4223 - DNA, 950 bp, Humulus lupulus
acggccggggcctctatatataattatattgtttctctctttgaacagagaatttttttgagattcagatccaacccgtcttctttatttccgccattgttgccaatttggaattagcttcagacctgacaaaaatggcaacggtgtcgcctttggccaaatacaagctcgtcttcctcggcgatcaatccgtaggcaagaccagtatcattacacgcttcatgtacgacaaattcgacaccacttatcaggctacaataggcatcgactttttgtcgaaaacaatgtatcttgaagatcggacagttcgtttgcagctttgggatactgcaggacaagaaaggttcaggagtttaattccaagctacatcagggattcttccgtggcagtaatagtttatgacgtggctaataggcagtcattcctcaacacaagtaaatggattgaggaagtgcgcacagagcggggtactgatgtcatcatcgtccttgtcggaaacaaaactgatcttgttgataaaaggcaggtttctatagaagaaggagacgccaagtctcgtgagtttggagttatgttcatagagaccagtgcaaaagcaggatttaatatcaagcctctcttccgtaaaatcgcggctgccttgcctgggatggaaacgctttcttccacaaaacaggaagacatggtcgacgtaaaccttaagccgacagtcaactcatcacagacggaacagcaaggaggaggttgctcatgctagcctctatactcgtttgtcatgaaaattggctcaacattatggaagatttaaacccttttttttcctcactaagcaattcatttgtcataaaccagtatagcattgctcaattctttacaaaatctcggttacaatttttgtctgtatttcaactccattttgtttttagatgcattgtcttcgaacttcaac

SEQ ID NO: 4224 - DNA, 1240 bp, Mimulus guttatus
tgaaacgctttcatttctcacatttcctataaatactcaatcagttatttcgcgatcaaatcccctctcaccccacccccaatttctctctctccttaattttctctgacttctctctccaaacaacagattcagatctgatcattatcgtcatcgtcgatcaatcgtctcctgcaaataagaactcttctccaattttaatggcggtgtcaccattagcgaagtacaaactggtttttctcggtgatcagtccgtcggtaaaaccagcatcatcacccgtttcatgtacgataaattcgacaccacctatcaggcgaccataggtatcgatttcttgtcaaagactatgtaccttgaagatcgaacagttcgcttgcaactctgggatactgctggtcaagagaggttcagaagtcttataccaagctacattagagactcttcagtagcagtcattgtttacgatgttgccaaccggcagtcgttcttgaacacttcaaagtggatcgaggaagtcagaaccgaacgaggcagtgatgttattatcgttcttgtagggaacaaaactgatcttgttgataaaaggcaagtttcaatcgaagaaggagatggtaaggctcgtgaattcggtgtaatgttcatagaaactagtgcaaaagcaggtttcaatatcaagcccctatttaggaaaattgcagcagcgttaccgggaatggaaacactgtcgtcgactaataaagaggatatggttgatgtgaatttgaaaccgacttcgaattcgtctcaaatggaacagcaaggaggaggttgtgcatgctaataagacactctaccaaaagagggagaaacaaaatgtagtggctaagggagggggaaaaaaacaatgaactctttccatgttgaaaggagtttctgaagttttaggcatcagattattattattattattattgaattcaggagtttggtaatttttgtttgtttggaaattgtatttttccactagttgtacttgtgacattgtttttttttggggttgaatttaggattggaagttcaaacttatgtttgaaccttgattcaacttaacaagtgtgtttctatttaataattgttactaggatgtctttttctttcattttttttttaattttaaaataccaaccccaagtcttgttcgattatttggggaaaacgaacaaaatgaattctccatattggagatattaatattaaacg

SEQ ID NO: 4225 - DNA, 1219 bp, Cajanus cajan
tgcaaaattatttactaaccagctaagaacgaatccttaacatgcgtaaatacataaatagcgatctgttttagaaataaataattaagagttcttaaaaccagggagacatgcactgacaataattttaaaatttgagccacccaccctcccatccatcatgattcataatcaatcaaaagttaattaacgttgctttgctttggttgttgcagtgcttttctttctcagattgtcaaaggaattatcgaaacacttgaattggattcacagagtgaaagtgttccgcaaatctgggttgatttgtgagaatggcgccagtttcagctctcgcaaagtacaagctagtgttcttgggcgatcagtccgttggcaaaaccagcatcatcactcgcttcatgtacgacaaattcgacaacacttatcaggctacaattggtatagattttctgtcaaaaactatgtaccttgaagatcgaactgttcgactgcagttgtgggatacagctggacaggaaagatttagaagtcttattccaagctacattagggattcatctgttgctgtcattgtttatgatgttgcaagccgtcagacttttctaaacacatcaaaatggattgaagaggtgcgcagtgaaagaggcagtgatgtaattgttgttcttgttgggaacaaaactgatcttgtggataaaaggcaagtctctacagaggaaggggaagcaaagtcccgagagttaaacgttatgtttattgaagctagtgcaaaagctggctttaatataaaggccctctttcgaaaaattgcggctgcattgcccggaatggagacattatctacctcaaaacaggaagacatggtcgacgtgaacctgaggtcttcgggtggccatgactctcaacctcaagagggtggatgtgcttgctgaatgtgccttccttgtcctaaagttttgtatctttctgcttcatgctatttatttggaatgtgtttgcctcagatatgtaaaggtttattagtcctttagacttgaacaactttatttgagagaaattactgaaaacaagtggagagggagcattgaaagaactgatatgatataacacagcttattggttagtcgattattcattatttttagtttggttaaagatacaagtctgcgtttaccttcatccaaattatgaaaagctagctaggaatgtattcaagttt

SEQ ID NO: 4226 - DNA, 746 bp, Euphorbia esula
cttttgagagagagagattcattcattcttccattattcagattcagatctgaaagctttttctaatactaacaatgtcgacagtatctccactcgccaaatacaagctcgttttcttgggggatcaatcggttggcaaaaccagcatcattactcgcttcatgtacgataaattcgataccacttaccaggccaccattgggattgattttctatcaaagacaatgtacctagaagatcgaactgttcgtttgcagctctgggataccgctgggcaggagagatttaggagtcttataccaagttatattagagattcttctgttgcagtaattgtctatgatgtggctaatagacaatcatttctgaacacttctaagtggattgaggaggtaagaacggaacggggcagtgatgtcattattgttcttgttgggaacaaaactgatcttgtggataaaaggcaggtttccatagaggaaggtgataacaaggctaaagagtttggagtgatgttcatagaaaccagtgcaaaagcaggattcaatattaagccattatttcggaaaattgcttctgccttgccggggatggaaacactttcttccacaaaacaagaagacatggttgatgtgaacttgaagcccactgtaaattcatcccagaatgaacagcaaggagggggttgcgcctgttagggttaaaaaaaaacatacagaaaccgaagcatttttatatagacaggt

SEQ ID NO: 4227 - DNA, 872 bp, Helianthus annuus
ctctcctcccaaatttctcttcattctttctctctctaactatttttcacagatctgatctgaatctgatcaccgatacgacaatggctggggtctcacctcttgccaaatacaaactcgtctttttgggcgatcaatccgtcggcaaaaccagcatcatcaccagattcatgtacgacaaattcgatactacatatcaggctaccattggcatcgatttcttgtcaaagacaatgtacctggaagatagaacagttcgattacagctttgggatactgctggtcaggaaagatttaggagtctcattccaagctatataagagattcatcagttgcagtcattgtctatgacgtcgctaatcgacagtcattcttgaacactgcaaagtggatagaagaagtacgtactgaacgtggcactgatgtcatcatagttcttgttggaaacaaaaccgatcttgttgacaaaaggcaagtttcaattgaagaaggagatggcaaagctcgggaatttggagtcatgtttatagaaaccagtgcaaaagccggattcaacatcaagcctttatttcgaaagattgcgggtgcattaccggggatggagactctttcttccacaaaacaagaagacatggttgacgtgaatttgaaatcttccggtaacacgtcacagtcagaacaacaaggcggaggctgcgcgtgctagagatgctttttgtaacgggttggttggttggttggtaagttaatttgttgataattttgatttgtaagtgacatgatgaaagtaagaagatatgttgcattttcaatatacatttctagatatatatcattctatcaccatagagcaatgcattcatgatgatga

SEQ ID NO: 4228 - DNA, 814 bp, Helianthus annuus
cataataataatggcgggtgtatcacctcttgccaaatacaaacttgtctttttgggcgatcaatccgtcggcaaaaccagcatcattacccgattcatgtacgacaaattcgataccacctatcaggctaccattggtatagatttcttgtcaaagactatgtaccttgaagatagaacagttcggttacagctttgggatactgctgggcaggaaagatttaggagtctcattccaagctacataagagattcatcagtcgcggtcattgtgtatgatgttgctaatcgacagtcattcttgaacactgcaaaatggatagaagaagtgcgtacagagcgaggcactgatgtcattatagtccttgttggaaacaaaaccgatcttgttgacaaaaggcaagtttcaattgaagaaggagatggcaaagctcgtgaattcggcgtcatgtttatagaaaccagtgcaaaggctggattcaatatcaagcctttattccgaaagattgctgctgcattaccggggatggagactatttcttccacaaaacaagaagacatggttgatgtgaacttgaaatcttcaggaaacgcttcgcagtcagagcagcaaggtggagggtgcgcgtgctagagatgctttatagattgtaatgttgataattttgatatgtaagttacatgatcaaagtatgcatctttagaatacctttttgagctttgacaaaccaaagatttgtgttacttccttttatctgtcggctttagttatgttacttggagcacaaggtaataaatgtttccctgggtctta

SEQ ID NO: 4229 - DNA, 1028 bp, Tabernaemontana elegans
tatattgacaattcaaagccagcgcccattcggtcgcatatctctctccttctctcccttctatctctccccttctctctcttctctgtttgttttgccaattcttgatcaagagaaagaaaatactcagatctgaacagaaattgcaaaaaatggcagtggtttcaccgctagcgaagtataaattggtgttcttgggcgatcaatcggttggaaaaaccagcatcatcactcgtttcatgtatgataaatttgacaccacttatcaggctacaattggtattgattttctgtcaaaaacaatgtaccttgaagatcgaacagttcgcttgcagctttgggatactgctggtcaagagagatttagaagtcttattccaagctacattagggattcttcagtggctgtgattgtatatgatgttgccaatcgacagtcattccttaatacatcaaagtggattgaggaagtgcgtactgaacgtggaagtgatgtcattattgttcttgttggcaataaaactgatcttgttgataagaggcaagtttcgatagaagaaggagatgcaaaggctcgtgaggttggggttatgtttatagagaccagtgctaaagcaggttttaacattaagcctttgtttcgaaaaattgctgccgccttgccaggaatggaaaccctttcttccaccaaacaggaagacatggttgatgtgaacttgaaacctacaacacattcttcacagacagagcaacaaggcggaggttgtgcttgctagatattgtacttataaagtagtgtagccagaaaaagatgaaaaatctcatttattacagaaattggctgtcattgttttgggtgctagtcctcatagatgggggaggttagggcgctttcagaagttttctcaatacactgcagtgatgagttgagcttaaaggaggacattggcaagttcattttctagtctagttaggtcaattagggagacatttgatattgttactactgtttctccaattttttaata

SEQ ID NO: 4230 - DNA, 897 bp, Arabidopsis thaliana
gtcagatctattaccttacattttacggtggaagaacatttgatctcaaatcgggaaaaatggcgagtgtgtcaccattagcaaagtacaagctcgtgttccttggagatcaatccgttggcaagaccagcatcatcactcgtttcatgtacgacaaattcgataccacttatcaggcaaccattggaattgattttttgtcaaaaacaatgtaccttgaggataggactgttcgtctccaactatgggatactgcaggacaggagagatttcgaagtctaataccaagttatatcagagattcttctgttgctgtaattgtctatgatgttgcaaataggcagtcattcttgaacacatccaagtggattgaggatgttcgtacagagagaggtagcgatgtcatcattgttctggttggtaacaaaacagatctcgtcgacaaaaggcaagtgtcgattgaggaaggtgataacaaagctcgtgattatggagtaatattcattgagaccagtgcaaaagcaggatttaacatcaagccactttttcgcaagattgcagcagcgttaccaggaatggaaacactttcttcaacgaaacaagaggatatggttgatgtgaatctaaagacttcgagcaattcggctcaaggggagcaacaacgaggtggttgtgcttgttaatcagttttaaatatatacacagcagcagaataggaagatttttaaacgaaagattcataattttatggaacaaataaatcctggtatgaggaaaggtgattacacttggagactctagtttttctttggagaggttttgttttcaatatagagttgtgtaataaagacgtctgaaagcttatgaagaagaatggcatgttttgctctgttctca

SEQ ID NO: 4231 - DNA, 1504 bp, Cicer arietinum
ggaggaaatctgaaagtgaaggggaatattggtgaggcgagtagtgagtagtgagtagtgaggcgcatcattgattcagtgaaaatggcgccagtgtcagctcttgcaaagtacaagctggtttttttaggtgatcaatctgtgggtaaaaccagcatcattactcgcttcatgtatgataaatttgacaacacttatcaggctacaattggtattgattttctgtcgaaaactatgtatcttgaagatcgaactgttcggctgcagttgtgggatacagctgggcaggaaagatttagaagtcttattccaagctacatcagggactcgtctgttgctgtcatagtttatgatgttgcaagccgtcaaactttccttaacacgtcaaagtggattgaagaggttcgcagtgagagaggcagtgatgttattgttgtgcttgttgggaacaaaactgaccttgttgaaaagaggcaagtctctacagaggaaggggaagctaaatctcgtgagcttaatgtcatgttcattgaagctagtgcaaaagccggctttaatataaaggctctctttcgaaaaattgctgctgcattacctggaatggaaaccctatcttccacaaaacaagaagatctggttgatgtgaacctaaaatcttctggtggccatgattctcaaactcagtctggtggatgttcttgctgaatgtgcgttatcttgatgttccttgatcttcatgcttcatttcatttgttttgaactgtgtgcctcaaacttgtaaaggttctctagtattttagacttttgacagcattatttgagtaaaaaaagaagagagaaaacagatagaagaactactattagtaattgattaaaaaaatagaactactattagtattaatagtgttggttggatgattagttggctattcttcatcattgtttacttcgtttgaaatatatacatggacaaatcatcatgattgttaaaagcctgctggtgatacacgagtctgaagacggaagatttgctgcatcaaaaaaccatgaagttagacaccttttttttttttaaaaaaaaatttaattttaatctcggactttgaatctttattgaacagtgtagattataactatgccaaactcttatcttgtgatatactaacctcttatcttgtgatatactaagttgatactactatggagatcaaaattgtgtggcgcaataactgcaccaaatctgtttccttattggatttcatctgaaataaataatctttcatgtgagaaattattcaggtgttacataaaccaccgacaatgtaagcataatgcaagtcagagcctatttatacattgtatggatgttttgaaatcaggtaaaatttaaagagtatgttaaaaaaaaaaaatggtgtttgctaaattgattcatgtagtgttgaaggcagaaaaaaaaaattaaattatcatagaacaagcggatatgaaaattgttaccggc

SEQ ID NO: 4232 - DNA, 1006 bp, Chrysanthemum coronarium
aaactaaaatccaaatttgttgttttgtttagatagatagatctaaaaagaaattaggctaagaatggcggtggtgtcaccattagcgaaatataagcttgtatttttgggggatcaatcagttggtaaaacaagtatcatcaccagatttatgtatgacaaattcgataccacctatcaggccaccattggaattgatttcttgtcaaaaacaatgtaccttgaagacagaactgttcgcttacagctttgggatactgccggtcaggaaagattcaggagtctcattccaagctatataagagattcatcagttgcagtgattgtctatgacgttgcaaatcgacaatcattcttgaacactgcaaagtggatagaagaagtacgtaccgagcgaggcactgatgtgattatagtccttgttgggaacaaaactgatcttgttgataaaagacaagtttcaatcgaagaaggagatgccaaagctcgcgaattcggagttatgtttatagagaccagcgcaaaagctggatttaacatcaagcctttattccgaaagattgctgctgccttgccggggatggagactctatcctctaccaaacaagaagacatggttgatgtgaatttgaaatcttcgggtaatgcttcacagttggagcagcaaggtggaggatgcgcttgctagatcatttagcgatggtttacagaggaaggctatagagtcaagagatgatgcattttgtaatgggttggttgttaagttaaatttgttgataattttgattcggaagtgacattaaagtaagaagatattgtgtttatcttcagtatacccttttagcttttacagtattatttatctcatagagcaagacattggtggttgaccgaaacagaagtttgtgctattttttgtgactcaattgctgttatttttaatttgtaataccttagcgttttgcagtgacacattatttgttttgacgtctttgttgcagtggta

SEQ ID NO: 4233 - DNA, 1144 bp, Trifolium pratense
caaaaatggcgactgtgtcccctctcgccaaatacaaactcgttttcttaggtgatcaatcggttggtaaaaccagcatcatcactcgcttcatgtatgacaaattcgacaatacctatcaggccactatcggtattgactttttgtcaaaaacaatgtaccttgaagatcgaacggttcgtttgcagctttgggatactgcaggacaagaaaggtttagaagtctaattccaagctatataagagattcttcggttgcagttattgtatatgacgtagccaatcgacaatcatttcttaatactaacaagtgggttgaggaggtacgcacagaacgaggcagtgatgttattatcgttttggttggaaacaaaactgatcttgttgaaaaaagacaagtctctatagaggaaggagaagccaagtcgcgtgagaccgggatcatgtttatagaaaccagtgctaaagcaggatttaatatcaagcctttatttcgcaagattgctggagccttgcctgggatggaaactctttcttcaacaaagaatgaagacatggttgatgtaaatttaaaatccactgtgaattcatcccagtcagatcagcaaggaggaggttgctcgtgctaaacaagtgctattcacaacaaagccagcacgaatcttttcacttagcatagttattggcttggcaactaaaatggaaagatgcgcctaggccagatgtgcttttgtaccaatgctcttcagcttagtttggtagggttagcacttagcagtaacggtttcgatgtaagataaaataagaaactacaaataatttgataattagttgttttattttcttatgcagttagtcgctttatgtaagaatgcatataataaacactgatctaaacattgtttaccggttggcatggaggagacatcatcaagtaatggatactttagataaagcttcaaaatggagctttgttggaagcattttattgaccaaacgtaatcatgcttcattgcagaaactaagtactacatacatttaatttttatagattttctccactgataataatcctatttgatgtaacagacagtaagtgtaatgtaagtacattttatgattggaattttagttttgattcacc

SEQ ID NO: 4234 - DNA, 1184 bp, Eucalyptus grandis
ggccggcttcgtcgtgcatggcggtttctcctctttttcacgaacttacaaggaagccacgaataacgaccgcatacatttctccgtccctcgctccctcgcgtgcgtgattttcttgctcctcagattcagatctgaaaccgcggccgggaatcgaaacgccagcccccgatccgatccccgacgacggcgacgaaggaaggaaggagaagatggcgaacgtgtcccctctggccaagtacaagctcgtcttcctcggggaccaatccgtcggcaagaccagcatcatcacccgcttcatgtacgacaagttcgacaccacttaccaggccaccatcgggatcgattttttgtcgaagacaatgtaccttgaggatcggacagtgcgattgcagctttgggatactgctggacaggagagattccgtagtctcatcccgagttacattagagattcatcagttgcagttatcgtgtatgacgtagccaataggcaatcctttctgaacacttccaagtggattgaggaagttcggactgaaagagggagtgatgtaatcatcgtccttgttgggaacaaaactgatcttgttgataagaggcaagtctcgatagaggacggagatgccaaagcccgtgagtttggagttatgttcattgaaacgagtgcaaaagcaggatttaatattaagcctctattccgaaagatcgctgccgccttgccggggatggagacacttaactctacaaagcaggaagacatggttgatgtaaatctgaagcccaccgtaaattcttcccagaacgagaatcaaggaggaggttgcccttgctaagtgcacttttgttattactagaaggcagttcacaggtttttttttttttttttcttcctttttcattcaatttttaatgtcattgtgttcatgtctccccaccttacttggtccatgatgaaagcgatctggacagcaggtgaaattgaataggaaacggcgaacttgctttgcttatgcttgtaaaagggagcttagtcagatggagtgcattctcatttttgttctgtggattacaaccgaatcataaaattctccatttgtagtctcagaaaatcctctcttctgtctaccggaaaacttgaaaatgcaatgtttttcctctcttgttacttcgtttcttttaca

SEQ ID NO: 4235 - DNA, 1116 bp, Gnetum gnemon
gcaagatctagagcctgatctgcagtgtgtaggtgctgcagatttttccgtgcaaacccttcagcaaggatcaggattcccagttaggccttaatttggcaggatctctgggtcataagctttcgagatctaacagaattttagggttaaaacttataattgaagaagaatggccactgtatcgccgcttgccaagtacaagttagtttttcttggggatcagtccgttggcaagaccagcatcatcactcgattcatgtacgacaagtttgataacacttatcaggcaacaattggcattgattttttgtcaaaaacgatgtatcttgaggatcggacagttaggctgcaactctgggatactgcaggccaggagaggtttcgaagtttgatccctagttatattcgagattcttcagttgctgtcattgtgtatgatgttgcaaataggcagtcatttttgaacactgctagatggattgaggaagtgcgcactgagcgtggcagtgatgtgatcattgttcttgttgggaacaaaacagatcttgtagacaagaggcaagtctctatagaggaaggcgatgccaaatcacgagaatatggtgtgatgttcattgaaaccagtgcaaaagcaggcttcaacatcaaggctttgttccggaagatagctgcagcattgccagggatggagacactctcttctacaaaacaggaggacatggttgatgttaatttgaaacctgctgctaatgcttctcagggggagcaaaaaactggaggatgctattgttgaaaacttaaaatttttgagatgtgcaatctttgtagctattacattccttgtagttctttggttgattttgggttgctgctgataggatgagttgatgatgatctttgacagatgaatttgacaagaagcttcagcagattatatgttttgtagttataatattgtattcctctcttccatgctgtgcaccaaaccctcacattggttactttttggagttgccatattggtttagggatcttggttatgtttgttttgttcaattctattaatcattaggagtcttatacgatccacataataatagatcaaggaaatttgtt

SEQ ID NO: 4236 - DNA, 1022 bp, Gossypium raimondii
ttggaaagtgagaagcggtccaaagattttcacaaaggcgtcatcgtcatagttggcggtttctcgtgccctctatttatggaagggattaaactcaacctttcctttcattttcttctgtctctttgaatatttccatttccatccaaataataataacgataataaacataatttcaatttttcttcattgcagaatcagatctgcaactctctgtttacaattttttctaaaaaaaagtagagtgaagaaatttgaaaaaaaaatggcgacagtctctcctttggcgaaatacaagctggtattcttaggcgatcaatccatcggcaaaaccagcattatcacccgcttcatgtacgacaaattcgacaccacttaccaggccaccattggaattgattttttatcaaaaacaatgtatcttgaagatcgaacggttcgtttgcagctttgggatactgctgggcaggagaggtttaggagtcttattccgagttatatcagagattcttctgttgcagtaattgtctatgatgtagctaataggcaatcatttttgaacacctccaaatggatggaggaggtacgcacagaacgaggcagtgatgtcattattgttcttgttgggaacaaaactgatctagttgataaaaggcaggtctctatagaggaaggagatagcaaagctcgtgaattaggagtcatgtttatagaaaccagtgcaaaagcgggattcaatatcaagcctctattccggaaaatcgcggctgccttaccggggatggaaagactttcttcaacaaaacaagacgacatggtggatgtgaacttgaaatccaccgtcaattcttcccagatagagcaacaaggaggtggttgtgcatgttaaagacaaatatgtagaaaaaagaagcattcaaacatggttttatttcaaccaccaaatacaaagtggtgggggatgcatcgattcaactttacatcgtcggagtttctagattctccaactgtgttttacagg

SEQ ID NO: 4237 - DNA, 754 bp, Guizotia abyssinica
gctttctctctctctcctccgaagtccgctcgattctctattctctctctaacgtttcacagattcagatccgatcgccgagagaaacaattccataatggcggtggtgtcacctcttgccaaatacaaactggtctttttgggcgatcaatccgtcggcaaaaccagcatcattaccagattcatgtatgacaaattcgataccacatatcaggctaccattggcatagatttcttgtcaaaaactatgtaccttgaagatagaacagttcggttacagctttgggatactgctgggcaggaaagatttaggagtctcattccaagctacataagagattcatctgttgcggtcattgtctatgatgttgctaatcgacagtcattcttgaacactgcaaaatggatagaagaagtacgtactgagcgaggcactgatgtcattatagtccttgttggaaacaaaacggatctcgttgacaaaaggcaagtttcaattgaagaaggagatggaaaagcccgtgaattcggagtcatgttcatagaaaccagtgcaaaagctggattcaatatcaagcctttgttccgaaagatagctgctgcattaccggggatggagactctttcttcccacaaaacagaagacatggttgatgtcgaattgaaatcgtcaggtaatgcttcacagtcagagcagcaaggaggagggtgcgcatgctagagagttatgggggccgcttatagattgtacggg

SEQ ID NO: 4238 - DNA, 1147 bp, Tropaeolum majus
gtaaaacaataagctcataaacttggactaggccgtgctggtctgggttggcggtttttttttttttgtccatatataaataaactccacctttctgtctattgtcttcttctaatctctcttttaccatttctttctggagaaacgcaatgatatagttctttccacatttcagatctaaacctctactattacatacaccatttcttccatggcgactgtttcacctttagccaaatacaagctcgttttcttgggggatcaatccgttggcaaaaccagtattatcactcgcttcatgtacgataaattcgacaccacttaccaggcaacaattggaattgattttttgtcaaagacaatgtaccttgaagatcggacagttagattgcagctttgggatactgctgggcaagagagatttaggagtcttattccaagttacattagagattcttcagttgcagttatagtctatgatgtagctaataggcaatcatttttgaacacttctaagtgggttgaggaggtacgtacagagagaggcagtgatgtcattattgttcttgttggaaataaaactgatcttgttgaaaagaggcaagtttcgatagaggaaggagataacagggctcgtgaatctggagtaatgtttatagagaccagcgcaaaagcaggcttcaatataaagcctttattccgcaagatagccgctgccttgccaggtatggagactctttcttctacaaaacaggaagacatggttgatgtgaacttgaagccaacagtgaattcatctcaatcggagcaacaaggaggcggctgtgcatgttaaaaaggaatgtactttacgcagatgatacccgaaaacgaagcactctaaaccatatgataggaaatccggaaaaaaatgatgaatccggaatgctactccctgtagcaagattttggtggcagattagaaggctatttgtttagtttattgtcctgctttgagtgcttttgtagccatagacgactaaaggttctgcttcaaaacttttaaaaactgaccttttggatatgggttccaacttttgctatgataacttattttgttaaacatttttctacgttatacgtgatttaaatatatcatgattttgtt

SEQ ID NO: 4239 - DNA, 1134 bp, Podocarpus macrophillus
tgtaagtaaaattagttaggtgttgttcggagtgctgcagatgcactccttcctcattcttgtggtaaataaaatgaaataaaattagagtatgatgaggaaggatgatattattgcatagcaggtaattctttctcaatttgctaaatttgggaaagaatattatcagggtttgagattgggagaagaagacgaagatggcgagcatatcacctctggccaaatacaagctcgtatttctgggagatcaatcggtgggaaagaccagcattatcactcgcttcatgtacgacaaattcgacaacacttaccaggctacaattggtattgatttcttatcaaaaacaatgtaccttgaggatcgaactgtgcgcttacagctttgggatactgctggccaagaacgatttcgaagtctcattcccagctatattcgagattcatctgttgctgtgattgtgtatgatgtcgcaaatcgacaatcctttatcaacacttcacgatggattgaagaagtacgtacagaacgtggtagtgatgttattattgtccttgttggaaacaaaacagatcttgtggacaagaggcaagtttctatcgaggaaggggatgccaaagggcgtgagtttggggtcatgttcattgaaaccagtgcaaaagctgggtttaacatcaaggccttgttccggaagatagctgccgcattgccaggaatggagactctctcatcaacgaagcaagaagacatggttgatgtcaatttgaaacctgcagctaatgcttctcaagctgaacagaaggcaggagcatgctcttgctgactgtaaaaagggcattttatgacgtgttctttacatgctgtgttgatatagctgcataattttctgtttgcgggaagatgaatctatttacaaggcatgtggatgtcaggccatagagattcttccagcatctatcaagaaaaggaattgcatattcttttgaacttctagattggcctgtgatttggaaaaagacagaacactctacagtaaagatagtcaaatcaacactagatgttccccagacaaggatgtttcaatgctgtgtttatgtttatgaaaggaaatgcattgtgaggcatatttgagtcgg

SEQ ID NO: 4240 - DNA, 1300 bp, Populus trichocarpa
ggcggtttctttcattcccttaaaagagtctccctcctccatataaaccgaagcatcattctgccatcgcttctgcgtaatttcgttgcgtttttctcaacagttgtttcagggaggaaaattaaatatatatcggatgagacagatctgatatatattgataaatagaagaaagaagaaggagaagaaatggcaacagtatcccctctggcgaaatacaagctggtattccttggcgatcaatccgttggtaaaaccagcattatcactcgctttatgtatgataaattcgacaccacttaccaggctactattggaattgattttttgtccaaaacaatgtaccttgaagatcggaccattcggttgcaactttgggatactgctggtcaagagagatttaggagtcttataccgagctacatccgggattcttctgtagctgtaattgtctatgatgtagctaatagacaatcattcttaaacacctctaaatggattgaggaggtacggacagagcgaggtggtgatgtcattgttgtccttgttggaaacaaaaccgatcttgttgataagaggcaagtttcaatagaggaaggagacggcaaggctcgtgaatttggagttatgtttatagaaaccagtgcgaaagcaggatttaatataaagcctctattccgcaagattgctgctgccttgccagggatggaaaccctttcttccacaaaacaggaagacatggttgatgtgaacctcaagccgactgtcaattcttcccaggcagagcagcaaggagggggttgtgcatgttagagaagtggatttgaggaagatcgaggaaaggaagcaccttcaataccaggttataccaactgaattaaaatccgacaaatgatgatttttatttgagctatttcagatcaataagacgtagttgcagattcctgctatttgttgaataggaaaattgaccgttcagatatattccatttaacatctctcctcttttcttcttctttttttttgtattttggaaaatctttgatatgtttgtgaaaaccattatcagatattaactgaataggaggtaatctctaggttacccattttgtgattcaagaaaattgatggctgtaatttgaaattttgaattcattgtataaagtttctttggatcttggtggagcaaaattcatgacatggatatatgttgatatgatcattggcgaatttggttacgagaaaatcagacaagtataatagccagttgaagtctcaaaaccaatattgtttctggatt

SEQ ID NO: 4241 - DNA, 900 bp, Rhizophora mangle
gttaaaggaaatggcgacggtgtccccactagcgaagtacaagctcgtgttcctgggcgatcagtcggttggtaaaaccagcatcattactcgctttatgtacgataaattcgacaccacctaccaggccaccattggaattgactttttgtccaaaacaatgtacctcgaagaccgaactgttcgtctgcagctttgggatactgctggccaagaaagatttagaagcctaataccaagttacatcagggactcgtctgttgctgttattgtctatgatgtggcgaatagacaatcatttttaaacacttctaagtggattgaggaggtgcgaacagaacgaggcagtgatgtcataattgtccttgttggcaacaagaccgatctagttgacaaaaggcaagtttcaatagacgaaggagacaataaggctcgagagtttggagttatgtttatagagaccagtgcaaaagcaggatttaatgttaagcctctgttccgcaagattgctgctgccttgccaggaatggaaagactttcctcagcaaaacaagaagacatggttgacgtgaacctgaagcccacagccagttcgtcccagacagagcagcaacgagggggttgtgcatgttaagagaactttatacctcacatatgttaaaaatcgaaaacaaaaagatggtggagaaatgccgcattctcaaattcattgcctgtttatacgctttgaaatctcaaatatatcggcaacgatgatgttgacagcagatacaggtttgtttaactcgatatcagatcttcaggtgttcggagacagaaagttgtagtttacggtcagtggagtgcaaaatctgataaactttgatgtttgggcttgctttttcattactttctctgttt

SEQ ID NO: 4242 - DNA, 886 bp, Vaccinium corymbosum
aaaagccaatccaataatggcggtggtatcacctctggcgaagtacaagctggtgttcctcggcgatcagtccgtaggaaaaaccagcatcatcactcgattcatgtacgacaaattcgacaccacctatcaggctaccattggcattgatttcctgtcaaagacaatgtatcttgaagatcggacagtccggttgcagctttgggacactgctggacaagagagatttaggagtcttattccaagctacattagagattcttccgttgcagtgatcgtctatgatgttgccaatcggcaatcttttctaaacacttcgaagtggattgaggaagtacgtactgagcgaggcagtgatgtcattattgttcttgttggcaacaagactgaccttgttgataaaaaggcaagtgtccatcgaagaaggagatggcaaggctcgtgagtttggagtcatgttcatagaaaccagtgctaaagcaggattcaacatcaagcctctcttccgaaagatcgcagctgccttgccaggggatggaagccctttcctccacgaaacaggaagacatggttgacgttaatttgaaacctactgtgaatacgtccagcacagaacagcaagggggaggttgtgcatgctagggcatatatttaggagagacggagagaatgaaagcaatttgaatagccaaatagtgatatggatacaaaaaatacacaagaaatatgattttgaatttagataatttggaagttatatgagattgcggctgttttggcaatttgttcttcttccatgtaacaactgtttaaactctcgggggagagcgtcgctgtgatcttgcctaaagatacaatataactcatctctttttctttttggtcg

SEQ ID NO: 4243 - DNA, 1364 bp, Panicum virgatum
cgggctcgtacgcccgaacctctgacaatccgcggcaatgggccttggctctccgtcaaaacgccttcccctttttctctctcgtccaccgcgtccctccagggaggagcactgacgtgcgcgcgtcgtggtggccgcggcctgcgttccacttcctcctcggctctcgccagaacaacggggagatctcggggtcgcgggcgggccggccgtccgccggagtccggatcgagaggatcggagcagaatccgatcgcctagccgacgcggggaggcgaggcggcgtggcgcggggaggcgatggcaccggtggtgtcggcgctggccaagtacaagctggtgttcctcggcgaccagtccgtgggcaagaccagcatcatcacccggttcatgtacgacaagttcgacaacacctaccaggctacgattggcattgacttcttgtcaaagaccatgtatcttgaagaccgcactgttcgtctacagctttgggatactgcaggacaggagagatttaggagtcttattccaagctacatcagggactcatctgttgcagtggttgtttatgatgtagccaataggcagtcttttctgaacacctcaaagtggatcgacgaagtccgcaccgagaggggtggcgatgtgatcgtcgtgctcgttgggaacaaaaccgatcttgttgacaagagacaagtgtccacagaggaaggagagagcaagtccaaagaactcaacgtcatgttcatcgaaaccagcgcgaaagccgggttcaacatcaagccgctgttccgcaagatcgctgcggcgctgccggggatggagacgctctcggcggcgaagcaggaggacatggtggacgtgaacctgaagccgacctccggccagtccaactcgcagcagcaggcgggcagtggatgcgcctgctaggaacaaacagtgcaagctctgcacatacgcgcgcctgacaaccttgatatcgttacgcagttttcgttagtgttgataccgcccttaatttccttatgcttcttctgtagtgaatgaatctgaaggctacctttagtttttttttcctctcatttccatctcgattttgtgtacggcgaaagaccagacgatttcttacagtttcacgtgtcctgctctgtatggttctggttcagaaataagctcttgtagtcttgtgcatttcttttttataacatgtaatcttgtgcattgttctttgttgagcaactagggaccatgactcactgtcatgcggggccacaagaatagctttgcagattgcagctcattgacaagcgggcccaacatacaatcgatgacgtggcagttcatccctcccctcgaacgacaag

SEQ ID NO: 4244 - DNA, 894 bp, Glycine max
tctctttctctctcttttttcatctgaattttgttgtgagaagagaatttaggagattcagatctgcgttgcgttgggtatcttagaggagaaaaagtgagaaatggcgacggtgtcccctctcgccaaatacaagctcgttttcttgggcgatcaatccgttggcaaaaccagcatcatcacccgcttcatgtacgacaaattcgacaccacctaccaggcaactattggtattgactttttgtcaaaaacaatgtaccttgaagatagaactgttcgcctgcagctttgggatactgcagggcaagaaagatttagaagtctcattccaagctacataagagattcttctgttgcggttatagtatatgatgttgctaacaggcaatcatttctgaacactaacaagtgggttgaggaggttcgtacagaacgtggcagtgatgttattattgtattggttggaaacaaaactgatcttgtagataagaggcaagtttcaatagaggaaggagatgcaaagtcccgtgagttcggaatcatgttcatagaaaccagtgcaaaagcaggcttcaatatcaagcctttgtttcgtaagattgctgctgccttgccagggatggaaactctttcttctacaaagcaggaagacatggtcgatgtaaatttaaaacccacggtgaattcatcccagacagagcaacaaggaggaggttgctcatgctagagaagaatattctcaaaacagccaataatttgttcactgatataattctgggattggctgcttaaatggaaggaatgatggagctgaaggaaaagtgctttcatatcaatgatccttcagtttttgggtgagggggacaaattgcagtataatggttttgatgtacg

SEQ ID NO: 4245 - DNA, 1083 bp, Amborella trichopoda
actgaaacggaaatctctctctctaagaatccgttctctctctctctggattcctgaccacccattcatttgatttgtacagagattgcacagaattgaaagatagagagcgagagggtgaaagaatcagtcatggttactgtttctcctctagcgaaatacaaactggttttcttgggggatcaatcggttgggaaaaccagcattatcacccgatttatgtatgacaagttcgacaacacttaccaggctacaattgggattgactttctgtcaaagacgatgtaccttgaagataggacagtccgcctgcaactttgggatactgctgggcaggagaggtttaggagcctcattccaagctacattcgggattcttctgttgctgttatcgcgtatgacgttgcaaatcgccagtcttttctaaacactccgaagtggattgaggaagtacgtactgagcgtggtagtgatgtcattattgtcctagttggaaacaaaaccgatcttgttgacaaaaggcaagtttctgtagaggaaggggatgccaaggcccatgacctcggggtgatgttcattgagaccagtgccaaagcaggtttaaatatcaagccactctttcgtaagattgctgctgcactgccggggatggagactctgtcttctacaaaacaagaggacatggtagatgtgaatctgaagactacaataaatgcatctcaaatggagcaacagccagggggctgtaattgctaaatttaaagtgccatctgaagcttctatgttgggcagagagaacattggtgactgccaagagatttgccaatagttgatcttaagttcgtactgcagttcgacttgtagattttggctgtttatgagcaccacttgggttgtagtggttgatagagaggttagttgattggttcattcttttagttaaatgaagcctgagggcctcactatagatgtaagatgctttatctttttgggaattgttagatgtgattttattttttccatgttgaatgccatattcctcataatcaggtgctactctaagactagaggccaataatacat

SEQ ID NO: 4246 - DNA, 1225 bp, Phaseolus vulgaris
gttggcggttcgtgacccccacacattccttcacacataacgcattgcattccaaattacgttaaatttggtaatccttcatttgttgcgatcgaaaagaagagaattcgggagattcagatctgcttgcgtctctgagagagaagaagaaagagattctcggaaatggcgacggtgtcccctctcgccaaatacaagctcgttttcttgggcgatcaatccgtcgggaaaaccagcatcatcacccgcttcatgtacgacaaattcgacaccacctaccaggcaaccattggtattgactttttgtcaaaaacaatgtacctggaagatagaactgttcgcttgcagctttgggacacggccgggcaagaaagatttagaagtctcattccaagctacataagagattcttctgttgcagttatagtatatgacgttgctaacaggcaatcatttctgaacactaacaagtgggttgaggaggttcgtacagaacgtggcagtgatgttattattgtcttggttggaaacaaaactgatcttgttgataaaaggcaagtttcaatagaggaaggagatgcaaagtcccgtgagtttggaatcatgttcatagaaaccagtgcaaaagcaggcttcaatatcaagcctttgtttcgtaagattgctgctgccttgccagggatggaaactctttcttctacaaagcaggaagacatggtcgatgtaaatttaaagcccactgtgaattcatcccagacagagcagcaaggaggaggttgctcgtgctagagaagtctattctcaaaagtgccaatagtaaggtagttcactgaatataattctgggattggctgcttaaatggattaatgatggtgctggaggaacgtgctttcgtagcaatgatccttcagtttttgggtggggggacaaattgcagtaatggttttgatgtacgacacattattctttttttttgttatacaattagtcccttgatgtaagaatacaggtaataaacaagctccctcaattgtccgtcataggtttatggttacactttagaaatgcatagtctgtgttgaaggcaagacgtatataatatagccctccatctgaccattttggtggcatcggtgatcatatccaaagcagaattgattggtttgttggtgtaatttggatctctttaactcagaccctactcatacaattcccttactggaa

SEQ ID NO: 4247 - DNA, 1064 bp, Trifolium pratense
ttcttcttcttcttcatttttgtaatcaccatttgattcaaaaatggcgccagtttcagctctagcgaaatacaagctggtattcttgggtgaccaatccgttggcaaaaccagcatcatcactcgcttcatgtacgataagttcgacaatacgtatcaggcaacaattggcattgattttctatcgaaaaccatgtatcttgaagatcgaactattcgactacagttgtgggatacagctggacaggaaagatttagaagtcttattccaagctacatcagggactcaactgtagctgttgttgtgtatgatgttgcgagtcggcagactttcctgaacacaacaaattggattgaagaggtgcgaacagaaagaggcagtgatgtcattattgttcttgttgggaacaaaactgatcttgttgagaagagacaagtctccatagaggaaggggaagcaaaagcacgagagctgaatgtcatgtatattgaaactagcgctaaagctggatttaatattaaggccctttttcggaaaattgctgctgcattacctggaatggaaacagtatcttctgcaaaacaagagggcatggttgatgtaaacttaaagtcttcatctggcaatgctcaagctcagtcaagtggatgttcttgttgaacatgctttatctcgtactcgtgctgccgtgcaccattctgtgtcgtgcttgttgtaaaattttcaaacttgacattaaattatgttcattttgttagttgtccttaagtcctagctcaactagcaatgccaatattgctaggctggacgtcttcactcgggttcgaacccgaacctcgcagtgtctttgagtttcggtggtatttcccacttcgtttatggacccaattaacaatcttctggtggccatgaatttcaacctcagtttggtggatgtgatgttcttgctgaatgtgccttatcatgatcatgatgttcgtggatatttatgctttattttatttgctttgaactgtattaatactaaaatgttgtaattgtctggtggatgttcttgctgaat

SEQ ID NO: 4248 - DNA, 1052 bp, Vigna unguiculata
gaataatttaaagagtaagtaacaccagcacacacccatcataattaacacttaatttcctttgtattctttttctcgcagtgcttttctttctttgtgagattgctgaagagagaaaagcaaaatcgaattatcgaaagaattgaattggattcattgacagagtgaagcgttccacaaatctgaggtgcacattgcattgtggttgatttgtgagaatggcgccagtatcggctctcgcaaagtacaagctagtgttcttgggcgatcagtccgttgggaaaaccagcattatcactcgcttcatgtacgacaaattcgacaacacgtatcaggctacaatcggtattgacttcctgtcaaaaactatgtatcttgaagatcgaactgttagactgcagttgtgggatacagctggacaggaaagatttagaagtcttattccaagctacattagggattcatctgttgctgttattgtttatgacgttgcaagtcgccagactttcctaaacacaccaaagtggatagaagaggtgcgcagtgaaagaggcagcgacgttattgttgttcttgttgggaacaaaactgatcttgtggacaaaaggcaagtgtctacggaggagggggaagcaaagtcccgagagctgaacgttatgtttattgaagctagtgcaaaagcgggcttcaatataaaggccctctttcgaaaaattgctgctgcattacccggaatggagacactatctaccacaaaacaggaagatatggtcgacgtgaacctgaggtcttctggtaaccatgattcccaatctgagtcggatggatgtgcttgctaaatgtgccttgtcctaaagttttgtatctttctgcttcacgctatttattttggaatgtatttgcctgagttctgtaaagatttatcagtccttacgacttaaacaactttatgtgagaaaaattactaaaaacaagtggagaggtagcaaggaaagaactaatattacacatatcattggttagttggttattcattattgtttggtttgact

SEQ ID NO: 4249 - DNA, 982 bp, Fagopyrum esculentum
gtatcgagtcgagtgacagctcagccataagcgttttgcttttgtcgtttgatctctccccctcaaagagaacgaagatagacagccgaaatcacttcgattcaattcctccacgaactgtatttcttcagaatcgtgaactaactgcaagatcatttcaagttatttagattttggtccgcatcaatggcgccggtgtcagccctcgccaagtataagctcgttttcttaggagatcaatccgtcggtaaaacaagcattattactcgattcatgtacgacaaattcgataacacataccaggctacaattggaattgattttctatcaaagacaatgtatcttgaagatcgaactgtacgtttgcagttgtgggatacagctgggcaagaaagatttaggagtcttatacccagttacataagggattcatctgttgcagtcattgtatatgatgttgcaagtcggcaatcttttctcaatacacaaaaatggattgaggaggttcgcactgagagagggagtgacgttatcattgtccttgttggaaataaaactgaccttgttgataaaagacaagtatccattgaagaaggagaagccaaagctcgtgatctcaatgtcatgttcattgaaaccagtgcaaaggcaggattcaacattaagccactcttccgaagattgctgctgcattacccggaatggaacacttcatcaacgaagcaagaggacatggtcgatgtaaacctgaagcctgatccaaactcatcacagtcacagcctcaatcaggcggatgcgcttgctaaacaacgttgttagtcgtaaagtgatttcttctgcttcatttcctgtacccttccttttgtttttgtatttctttgaatctagaagacctatctttctttctcagggaccatagccataattttaaggatctagaaatgattgtcatcttcatttttgttggtagtaaagggcatt

SEQ ID NO: 4250 - DNA, 853 bp, Flaveria ramosissima
tttctcccttcctctctcctccgagttcctctattctctctaacatttcacagattcagatctgatcgccgggagaagcacctgaataatattatcattaatggcggtggtctcacctcttgccaaatacaagcttgtatttttgggcgatcaatccgtcggcaaaaccagcatcattaccagattcatgtatgacaaattcgataccacctatcaggctactattggcatagatttcttgtcaaaaactatgtaccttgaagatagaacagttcggttacagctttgggatactgcagggcaggaaaggtttaggagtctcattccaagctacgtaagagattcatcagttgcagtcattgtctatgatgttgctaatcgacagtcgttcttgaatactgcaaaatggatagaagaagtacgtactgaacgaggcactgatgtcattatagtccttgttggtaacaaaacggatcttgttgacaaaaggcaagtttcaattgaagaaggagatggcaaagctcgtgaattcggcgtcatgtttatagaaactagcgcaaaagctggattcaacatcaagcctttattccgaaagattgctggtgcattaccggggatggagactctttcttccacaaaacaagaagacatggttgatgtgaatttgaaatcttcgggcaatgcctcgcagtcagagcagaaaggtggaggctgtgcgtgctagagcgctgcaacgtttaatagattgtaatggttgggttggttggttggttaatttgttgataattttgatttgtaagtgacattatcaaagtaagaaggtcttatgcatcttcagactacctttttaact

SEQ ID NO: 4251 - DNA, 1730 bp, Panax ginseng
ttttttggcctaattgttttctctctcctctgagccatttctttctctctccacatatatacagatttcagatccgatcgtcgactcatagcaaaaagaagcaattaagtaattaataagcatggcggtggtgtcacctttggccaagtacaagcttgtttttttgggagatcaatccgtcggtaaaacaagcattatcactcgcttcatgtacgataaattcgacaccacttatcaggctaccattggaattgatttcttgtcaaaaacaatgtaccttgaagatcgaacagttcgtttgcaactttgggatactgccgggcaagagaggtttaggagtctcattcccagctacatccgagattcttctgttgcagtgattgtttatgatgttgcaaatcgacaatcatttttgaacacgtctaagtgggttgaagaagtacgtacggaacgaggcagtgatgtcattatagtccttgttgggaacaaaactgatcttgttgataaaaggcaagtttcaattgaagaaggagatgctaaagctcgcgagtctggaatcatgtttatagagacaagtgcaaaagctggatttaatatcaagcctctatttcgaaagattgctgctgccttgccagggatggaaaccctttcatcaacaagacaggaagacatggttgacgtgaatctgaagcctactattaattcttcccagacagagcagcaagggggaggctgcgcatgctagagaaagcagttaaaaggaagatagccaaaaaaaagctccttcaatcacataatacccgaactgaagctccagtcaatggtgttcatatcagttgatttcagaatctgaagggagatgaaaatgctgtaggtaattcgtgctacctcttcaaatatagtgtttagttgtttccagtctctagacagaagaagttggcagcaatcatatcaaagacatttaatcgacagtataaatgtgttattgttttttatattacttcctattttttattcctttccctgacttcctatatgccggtatctgatatttaaactttatttgaaaccttaaatgccgtagatccttttaggctaaatacttgctgaaagtgactaatatttccttgccatgcacctctcatttgcacaattcctccaatttcactggtgtatttgccctaaattagattcacggtagcatcagtcttttttactgtactaacaaaccaaaataagatataaatgagaattgatggaatagtaaactactatgccttcaattgcagttctctagtcttacttgtgatggatggtggaggtgttcagaaatctggtgataacaaacttgattgcttgatagacggcagtggaagttctttctttgccatttcttgttttggttttataaagagacatagctgctcatcagtaaacaatattactctgttgcatattttcatttgtatgttataatccagtacttttcctcaagtattaattcaatttttattgtgcatggaagggatttttatttattttcttctaattttctgtcttgaatacttatggaactaattgtctgttttgatagtataactacttttgttggtatctaagtttgattattaaatggtacgtaattattggcatggatgttgctagattataattagactttgtcaagtcataaacttgttaaggattagttaatttgttgttgctacggg

SEQ ID NO: 4252 - DNA, 1287 bp, Lotus japonicus
gggggctgcatttggtcaccgtgaatttcgtctctttcttcgttctctctctctctcgaagagaactcgttcttctcagattcagatctgaaaccccattcgagagagaagaaaaacgattttctgagaaacaatggcgacggtgtcccctctcgccaaatacaagctcgttttcctcggcgatcaatcggttggcaaaaccagcatcatcacccgcttcatgtacgacaaattcgacacaacctatcaggctactattggtattgactttttgtcaaagacaatgtaccttgaagatagaactgttcgcttgcagctttgggatactgcagggcaagaaagatttagaagtctcattccaagctacataagagattcttctgttgcagttattgtatatgatgtagctaacaggcaatcatttctgaacactaacaagtgggttgaggaggtacgtacagagcgcggcagtgacgttattattgtcttggttggaaacaaaactgatcttgttgataaaaggcaagtttctatagaggaaggagatgccaagtctcgtgagtttggaatcatgttcatagaaaccagtgcaaaagcaggcttcaatatcaagcctttgtttcgtaaaattgctgctgcgttgcctggaatggaaacactttcttctacaaaacaggaagacatggtcgacgtaaatttaaaaccgacggtgaattcatcccagacagagcagcaaggaggaggttgctcatgctagagaagattatattgaaagagccaatagatctctgtttactgagtataatactaaatgactgtttaaatggaaagatgaagctggaggaagcgcgctttcatatcaatgatcctttattttatttttggggagggggacaaattgcagtgatggttttgttgatgtactgcataaaaattgatagttattttttatttgttatacagttagtcccttcatgtaagaatacaggtaataacaagcctgcgttctaaattgtttgtcttaggtgtatgttatccttgaaaaaatgcatatgaacggacaaggctagcaatatatatagctctcaactctgcctcttacttttggggcacccatggtcctatctttaagtagaattgctttctatgtagggtgaccgtgaaatttcataacattcttctcaactacaattcgtcctatcttaaccttttgtcgatatgaaattgtattgagtatgtatcgggtgaaattttcatgtcaacaagaggtttttgtctcattttaca

SEQ ID NO: 4253 - DNA, 993 bp, Lotus japonicus
ggaagaatcaaatcaaatcaaatcaaatctggggttgctggctcgttctctctgttgtctctagcaatttgcaatccttcatcgaattttgatttgaaatggcgccagtgtcagctcttgccaagtacaagcaggtgttcttgggcgatcaatccgtcggcaaaaccagcatcatcactcgcttcatgtacgacaaattcgacaacacctatcaggctactataggtattgattttctgtcaaaaactatgtatcttgaagatcgaacagttcggctgcagttgtgggatactgctggacaggaaagattcagaagtcttattccaagttacattagggactcatctgttgctgtcatcgtttatgatattgcaagccgtcagactttcctaaacacatcaaaatggattgaagaagtccgcagtgagagaggcagcgatgtaattattgttctcgttgggaacaagactgaccttgtggagaagaggcaagtctctacagaggaagcagaagcgaaggcgcgggagctcaatgttatgtttattgaagctagtgccaaagctggctttaatataaaggccctctttcgaaaaattgctgctgcattacctggaatggaaaccttatcaaccacaaaacaagaagatatggtcgatgtgaacctcaggtcttctggtagcaatgaatctaatcctcagtccggtggatgcgcttgctgaacatgctttgtcttaaagttttgtagctttctgcttcatgctattatttgttttgtgatatgtttgcgtcagatctgtaaaggttctttagtatttcagacttcaacagtattcttgagaaaaattagagaaaacaagtggagagttagcagtgaaagaactaattcaatccagcatgttggatagttggctatttgttattgtttagtattattaaaagtaaacatcgacattgactcatttatttcatcatagctgtgaaaagcttgctggg

SEQ ID NO: 4254 - DNA, 1022 bp, Lupinus angustifolius
gagaagaggaagaatcaaataaaataaaataaaataaaataaaatcaaatctaagcattcttcttcttctttgattctcacgtaacaaaaatggcgccagtatcagcacttgcaaagtacaaattggtgttcttaggtgatcaatctgtgggcaaaaccagcatcatcactcgcttcatgtacgataaattcgataacacttatcaggctacaattggtattgattttctatcaaaaactatgtatcttgaagatcgaactgttcgactgcagttatgggatacagctggacaggaaagatttagaagtcttattccaagctacattagggactcatctgttgctgtcatcgtttatgatgttgcaagtcgtcagactttcctaaatacattaaagtggattgaagaggtgcgcagtgagagaggcagcgatgtcattgttgttctcgttgggaacaaaactgaccttgtggataagaggcaagtctctacagaggaaggggaaacaaaggcccgtgaactgaacgttatgtttattgaagctagtgccaaagctggctttaatataaaggccctctttcgaaaaattgctgctgcattacctggaatggaaacactatcttccaccaaacaagaagaattggttgatgtgaacctgtcttctgctggccgtgattctcaatcatctggtggatgtgcttgctgaatgtgctcataaaagttgttatctttctgcttcattgatatttgttttggaatgtgtttgtttgagatatgtaaaggttcagttagtctttttaggcttggacagcagcattacgtgagaaaaattaaagaaaacaaggggagaaatagcattgaaagaactattgttaatgcagcttgttggtagtttgatattctttattgtgttgttaaattagaagataaacatttaattgagaatgtatgattggaacattttggttcaacaattgagtttcagttatagcaatgttaagcagatgcagctgatttgtgtca

SEQ ID NO: 4255 - DNA, 1168 bp, Nicotiana benthamiana
gtacgtagtacaaattgacaattcgaaaacattgttgccttctttccttttgttgcttctcttttttttctcttcctcaattttctctcttctctctctttccaccgattcagatctcattttcgagagagtgaagaagaagaagaagagaaagagaattcaataatggcggcagtttcgccattagcaaagtacaagctggttttcctgggagatcaatctgtaggaaaaaccagcattattactcgtttcatgtacgataaattcgacaccacctaccaggctaccattggtattgattttttgtccaagacaatgtaccttgaagatcgaacagttcgcttgcagctctgggatactgctggtcaggagagatttaggagtcttattccgagctacatcagagattcttctgtcgctgtaattgtgtacgatgttgccaaccgccaatcatttctaaacacttcaaagtggattgaggaagtacgtaccgaacggggaagtgatgtcataatcgttcttgttgggaacaaaactgatcttgttgataaaaggcaagtatccattgaagaaggtgaaaccaaggctcgggaatttaacgtaatgttcatagaaaccagtgctaaagctggattcaatatcaagcctctgttccgaaagattgctgctgctttaccaggaatggaagcactttcgtccacaaagcaagaagatatggttgatgtgaatttgaagcctacctcaagttcatctcacacagagcagcaaggaggaggttgcgcttgctagattttatacgtaacaagagtgataagaagttgaacatacacaaagatgaagttgcatcaattatacaataatagatgttcaattagctcatttgctagatgttgatgaggtttggaacaattttgggtttttattcacgtcgtatgacaagttctttcaatttctgatggtgcggtagctgataaatttgtgctctagaaaaccattaaagattcagtttttactattaaaacttgtgattatatatcttgtgattcctagttcaggaatccttttctttttaaccatttcttagcagaataacaatgaaatggcatttgtaattgtcgtcatttcagtttttgtgctaccaccttatgttgattttcttcagttgcta

SEQ ID NO: 4256 - DNA, 969 bp, Nicotiana benthamiana
ttgacatttcaaaaacattgttccttctttccttttgttccttctctttttttctcttcctcaattttctctcttctctctctttccgccgattccagatctcattttcgagagagtgaagaagaagaagagaaccagaattgaataaaatggcggcagtatcgccattagcaaaatacaagttggtttttttgggagatcaatctgttggaaaaactagcatcattactcgcttcatgtacgataaattcgacaccacctaccaggctacaattggtatcgattttttgtcgaagacaatgtaccttgaagatcgaacagttcgcttgcagctctgggatactgctggtcaggagagatttaggagtcttattccgagctacatcagagattcttctgttgctgtaattgtctatgatgttgccaaccgccaatcatttctaaacacttcaaagtggattgaggaagtacgtactgaacggggcagtgatgtcataatcgttcttgttgggaacaaaactgatcttgttgataaaaggcaagtatccatcgaagaaggcgaaaccaaggctcgtgaatttaacgtaatgttcatagaaaccagtgctaaagctggattcaatatcaagcctctgttccgaaagattgctgctgctttaccgggaatggaagccctttcgtccacaaagcaagaagatatggttgatgtgaatttgaagcctacctcaagttcatctcacacagagcagcaaggaggaggttgcacttgctagattttgtacgtaacaagaaagagataagaagttggacacacacacaaagatgcagttgcatccaattatacagttatatatgttcaattagctcatttattagatcttgatgaggtttgaaacagttttgggtttttattcacgtcgtaccacaagttctttcaatttctgatggtgaggtagctgataactctgt

SEQ ID NO: 4257 - DNA, 982 bp, Phalaenopsis aphrodite
cagatccacgctttcggaaatcggtttatgtaggggccgacttgcagtccgcgccagcacgcgggttctcctacctcgtcacattgtcgtttgtaattcctctagatctcttcttcctccttattctagcctacgtattggattgatcgagggataaggacagggttgatagcgaatccctaatggcggtcgtttcagccctggcgaagtacaagcttgtcttcttgggagatcaatccgtcgggaagactagcatcattacccggtttatgtatgacaagtttgacaccacctatcaggctacaatcggcattgattttctttcaaaaacaatgtaccttgaagatcggacaatccgcctgcagctatgggacactgctggacaagaaagatttagaagtttaattccaagttacatcagggattcatctgttgcggttattgtttatgatgtagccaatcgacaatcatttttaaacacatcaaagtggattgaggaagttcgcacggaacgtggtggtgatgttatcattgtccttgtgggaaacaaaactgatcttgtggaccaaagacaagtctctatagaagaaggtgaaggcaagtctcgagaactcggagtcatgttcatagagaccagtgccaaagcaggattcaacataaagccactattcaggaaaattgctgcagctctaccagggatggagaacttgtcttctaccaaacaagaagacatggttgacgtgaatctgaaacccaccgtcagttcgtcccacaccgagcagcaatccggtggatgcgcctgctagaacttatgaactacatggttaaaccagcactaaccagcagagatcgtttacaagccttgtacctttgctggcttagaaacctagttcctctttcattcctctttgattgcatcatggggaacttgaatatttttgtttacttgcgagttttcttaaaatgggacattcatttattc

SEQ ID NO: 4258 - DNA, 1366 bp, Cajanus cajan
gggggcgaaatgaaataaaataaaaggttcgcgtgacgcggtcctctcctgggcggtttctaactccatatatgtatgtatatatagtgcattgcattgcattgtaattgtattgcagtggaaattacgttaaatttggcgatccttcatttcctctctctctttgtgaggtgcgataagagaattcgggggattcagatctgcgttgcgtctctgactccgagagagaagaaataagaaaatggcgacggtgtcccctctcgccaaatacaagctcgttttcttgggcgatcaatccgttggcaaaaccagcatcatcacccgcttcatgtacgacaaattcgacaccacctaccaggcaactattggtattgactttttgtcaaaaacaatgtatcttgaagatagaactgttcgcttgcagctttgggatactgcagggcaagaaagatttagaagtctcattccaagctacataagagattcttctgttgcagttattgtatatgatgttgctaacaggcaatcatttctgaacactaacaagtgggttgaggaggttcgtacagaacgtggcagtgatgttattattgtcttggttggaaacaaaactgatcttgttgataaaaggcaagtttctatagaggaaggagatgcaaagtcccgtgagttcggaatcatgtttatagaaaccagtgcaaaagcaggcttcaacatcaagcctttgtttcgtaagattgctgctgccttgccagggatggaaactctttcttctacaaagcaggaagacatggtcgatgtaaatttaaaacccacggtgaattcatcccagacagagcagcaaggaggaggttgctcgtgctagagaaaactattctcaatagaagccggtgtttgtgattcactgaatataggattggcttcttaaatgcaatgatggagcaggaggagacttgctttcataccaatgatccttcagtttacttgggcgagggggacaaattgcattaatggttttgatgcacgacacaaatattgatagtttttttttttttttttaatttgttatacaattagtcccttgatgtaagaatacaggtaataaacaagctctctaagttgtccgtcttaggtatatgttttactttagatatctgttaaaggcaagaaatatataaccctccatctggcccttttctttttgtggcacctatcgtcctatacaaagcacaattgcccggtttgtaggggtgattatggatcttgttgaactcaaagaccctacctaccaaaccgagaactgaccgaaccattctgtgaaacttggtttattgtgctgcatcgaaaaattgattttcatttaacc

SEQ ID NO: 4259 - DNA, 1079 bp, Glycine max
ccctatatatatataaaacgcattgcactcgacattacgttaaatttggtcgtcctctctttctctctcttttttcatctgaattttgttgtgagaagagaatttaggagattcagatctgcgttgcgttgggtatcttagaggagaaaaagtgagaaatggcgacggtgtcccctctcgccaaatacaagctcgttttcttgggcgatcaatccgttggcaaaaccagcatcatcacccgcttcatgtacgacaaattcgacaccacctaccaggcaactattggtattgactttttgtcaaaaacaatgtaccttgaagatagaactgttcgcctgcagctttgggatactgcagggcaagaaagatttagaagtctcattccaagctacataagagattcttctgttgcggttatagtatatgatgttgctaacaggcaatcatttctgaacactaacaagtgggttgaggaggttcgtacagaacgtggcagtgatgttattattgtattggttggaaacaaaactgatcttgtagataagaggcaagtttcaatagaggaaggagatgcaaagtcccgtgagttcggaatcatgttcatagaaaccagtgcaaaagcaggcttcaatatcaagcctttgtttcgtaagattgctgctgccttgccagggatggaaactctttcttctacaaagcaggaagacatggtcgatgtaaatttaaaacccacggtgaattcatcccagacagagcaacaaggaggaggttgctcatgctagagaagaatattctcaaaacagccaataatttgttcactgatataattctgggattggctgcttaaatggaaggaatgatggagctgaaggaaaagtgctttcatatcaatgatccttcagtttttgggtgagggggacaaattgcagtataatggttttgatgtacgacacaaatattgatagttaatataaaatattattgtatgtttttaagaaattctaatattggatcatgttattttgataaaattctttttttaaaagattattaattgagtggagcttttaatagtacaa

SEQ ID NO: 4260 - DNA, 1161 bp, Triphysaria pusilla
tatcaattcctctctctactctacaccgctcctatttctctctcttctctatttcccccacaatttcatctaaccgcatttcgcagactcagatccctatcatcttcttcctcatcatctctctctctcactcaatacgtgcttctccaatggcggtggtgtcaccattagcgaagtacaaactggtgtttctcggtgatcaatccgtcgggaaaaccagcatcatcacgcgtttcatgtacgataaattcgacaccacctatcaggcgactataggcattgacttcttgtcaaaaactatgtaccttgaagatcgaacagttcgcttgcaactctgggacactgctggtcaagaaagatttaggagtcttattccaagctacattagagattcatctgtggcagtgatcgtctacgacgttgccaaccggcagtcatttttgaacacttcaaagtggattgaggaagtaagaaccgaaagaggaagtgatgtaattattgttcttgtagggaacaaaactgaccttgttgataaaaggcaagtttcaattgaagaaggagatgctaaggctcgtgaatttggtgtcatgttcattgaaaccagtgcaaaagcaggtttcaatatcaagccactattccggaaaattgctgctgcattaccgggaatggaaactctttcgtccacaaagaatgaggatatggtggacgtgaacttgaagccgtcttctaacgcatcccacatggagcagcaaggaggagggtgtgcatgttagagattcttttttcttttgttctgaaaaaaaataataataataaaagaaaggaaaaagaggagcgagggagagggtgaaatgtttagaaagtaaatgttttgataacatagtgtgttgtcaatcttttggagttttgagaagttataggaaacagattaattttcaatcaggatatttcagtgcaggaacgcctaggtccaaaaactttggaacttgtatgtttcccactgatgttgtgtacttaaatctttgattttatttttattctttagagaatgtgatttctaatttagaaattgtgactagatggttttctttttaatccttattttgcatttataattaaacaataaaagccaatttatcaatttactttttagttccaaaa

SEQ ID NO: 4261 - DNA, 999 bp, Setaria italica
gtgcgcgcgtcgtggtgaccggcctgcgttccttccacttcctcctcggccctcgccagaacagcgggagatctcggaatcgcgggaggccgtcctccggttcccggatcgagaggatcggaggctcggagcagaacccgatcgcctagccgacgcggggaagcgaggcggcgtggcgcggggagacgatggcaccggtggtgtcggcgctggccaagtacaagctcgtgttcctcggcgaccagtccgtaggaaagaccagcatcatcaccaggttcatgtacgacaagttcgacaccacctaccaggctacgattggcattgactttttgtcaaagacgatgtatcttgaggaccgcactgttcgtctacagctttgggatactgcgggacaggagagatttaggagtcttattccaagctacatcagggactcatctgttgcagtggttgtttatgatgtatccaataggcagtcttttctgaacacctcaaaatggatcgacgaagtccgcaccgagaggggtggtgatgtgattgtcgtgctcgttgggaacaaaactgatcttgtcgacaagagacaagtgtccacagaggaaggggagagcaagtcgaaagaactcaacgttatgttcatcgaaaccagcgcgaaagccgggttcaacatcaagccgctgttccgcaagatcgccgcggcgctgccggggatggagacgctctcgtcggcgaagcaggaggacatggtggacgtgaacctgaagccgacctccagccagtccaactcgcagcagcaggcggggagtggatgcgcatgctagaaacagcgctagctctgcacatacgctcgcctgacagacgtgttgttactgttacgcagtttttcggtagtgttgatactgccctttaatttcctgatgcttcttctgtactgaacctgaagtccatctttagtttgcttttttttttcatttccatctcgattttgtgtacggcgaaaga

SEQ ID NO: 4262 - DNA, 1142 bp, Lactuca sativa
ctaaagtgatagagtcttgggtcaagttggcggtttcttctccatgtcgtatatatgtaacccgattgaaaaattaaacccagccttccttgatttctcccctttctctctcctccgaatttctctctattctctctctctctctcttcaacattctacagatttagatctgatcgccgagagagagcccccggaactgctcaataatgtcggtggtgtcacctcttgccaaatacaaactggtatttttgggcgatcaatccgtcggcaaaaccagcatcattaccagattcatgtatgacaaattcgataccacctatcaggctaccattggtattgatttcttgtcaaaaacaatgtaccttgaagatagaacagttcggttacagctttgggatactgccggacaggagagatttaggagtctaattccaagttacataagagattcatcagttgcagtcattgtctatgatgttgctaatcgacaatcattcttgaacactgcaaaatggatagaagaagtacgtactgagcgaggcactgatgtcatcatagtccttgttggcaacaaaacagatcttgttgacaaaaggcaagtttcaattgaagaaggagatggaaaagctcgtgaatttggagttatgtttatagaaacaagtgcaaaagctggattcaacatcaagccattattccggaagattgctgctgctttaccaggaatggatacgatgtcatccacaaaacaagaagatatggttgacgtcaatttgaagtcttctggtaatgcttcccattcagaccaaggtggaggctgcgcatgttagaaagactcgactcactttcgatcaatagaaagcagacagtcagacagacagacagaattggattttgtaatggattttgattattcgtaacttaatttgttgatagttttggtttcttattagcgagtgacatcctttaaattaaagtaagaagatatggtgtttgtatctatcttcggtatacttattttttaggttttctaatctctatgttctactctcttgttccattttggtagctctatttgttacaagagatattttgggccccactttgtttttacctttttaggtaagacaaaaatatggtaaatc

SEQ ID NO: 4263 - DNA, 981 bp, Spinacia oleracea
gaagaagagagagagaaacacgaatcaatggcggttgtgtcaccattagccaaatacaagctcgtcttcttaggcgatcaatccgtcggtaaaaccagcatcatcactcgcttcatgtacgataaattcgataccacttaccaggcaaccattgggattgacttcttgtcgaaaactatgtatcttgaagaccgaacagtacgcttgcaactctgggatactgcaggacaggaaagatttcgaagtctcattcctagctacatcagagactcttcagttgctgtaatcgtttatgacgtgtctaatcggcaatcatttctaagcacttcaaagtggatcgaggaagtacggacagaacgtggtggtgatgtgattattgtccttgttggaaataaaactgatttagttgataaaaggcaagtctctatagaggaaggagatagcaaggctcgtgatgctggggtaatattcctggagaccagtgccaaagcaggattcaatataaagcctttatttcgcaagatcgcctcatccttaccagggatggaaactctctcatccgccaggcaagaggacatggttgatgtgaatttgaaacctcacaataattcatcccagtcagaacaacagggaggtggttgtgcgtgttaatttgtaatgaatcgagattgcctgaagtacaagaagctgttaataaaaaggaaaaagaggaggtgaacataaatggccaaactcgacaattaagggtctaagtttgttgcacagaccccattcctgtcctacgtatatctatcaacttgttgctgttcttcgaaggtacattttgtaaaaggtttggctttcactttcccaggtttatagttaaccatttcgatcaccttttgtagtgattagagttccatttctttcatgtgtttctctccttgccttttcattacacaggttcatgtcctacctactgtaatagtatgtattttgctg

SEQ ID NO: 4264 - DNA, 1076 bp, Artemisia annua
aattccaaatctaataatttcacatttcacaacaatccgttaactgattcatcataatcacattcaacacaaacaaacaaaataagaaaaaaatgccgccagtatcagcactagcaaagtacaaactagtcttcttaggcgatcaatccgtgggcaaaaccagcattatcactcgcttcatgtacgataagttcgacacctcttatcaggcaactattggaattgatttcttgtcgaagacgatgtatcttgaagatcgtactgttcgtctgcagttatgggatacagctgggcaagagagatttaggagtctgattccaagctatataagggattcttctgttgcagtcatcacctatgacgttgcaagtcggcagacttttcttaacactattaagtggattgaggaagtccgtgctgagaggggtagtgatgttatcattgttctggttgggaacaaaactgaccttgtggacaaaagacaagtctctgttgaggaaggagaagcgaaagctaatgagctaaaggtcatgtttattgaaacaagtgctaaagctgggttcaacataaaggctttgtttagaaaaatcgcagctgcgttaccaggaatggaaacactttcctcaacaaaacatgaagaaatggtcgatgtcaatttgaagtcttcaagcgctagctcatcccagcctgaatctggtggttgtgcttgctgatcaaacgccaagccacggcttattgtcatatctccactccgaatcaatgatggtggttaatcttgttactggttcaacaattttgcttccaactcgtgttaagttccaggtgcaatttcaaaatgctggaaacaaaagtattcaactagaacccttatgtttattgctttggttttatcatttactacaggtgtatgtaacgatttcatttttttgccctttcaatcaattgatttgtagacggtgctcttgaggtgtagtttgtctatgtgtaaaaagatttatgtagtatcgccaatattttgacctccttttatatcgattaatgatcaatcaagatacgtgattgaaatttaaactaaa

SEQ ID NO: 4265 - DNA, 763 bp, Brassica juncea
aatggcggcggtgacaccattagcaaagtacaagctcgtcttcctcggagatcaatccgtcggcaagaccagcatcatcactcgtttcatgtacgacaaattcgataccacttatcaggcaactattgggattgatttcttgtcaaagacaatgtaccttgaggataggactcttcgtctccagctatgggatactgccgggcaggaaagatttcgaagtctgataccaagttatatcagagattcctctgttgctgtcattgtctatgatgttgcaaataggcagtcattcttgaacacctcgaagtggattgaggatgttcgtacagagagagggaacgatgtcataattgttctggtgggtaacaaaacagatctcgttgacaagaggcaagtgtcgatagaggaaggggataacaaagctcgtgattttggagtaatattcatagagaccagtgcaaaagcaggatttaacatcaagccactattccgcaagatttcagcggcattaccaggaatggatacactttcttcagcgaaacaaggcgatatggttgatgtcaacctaaagtcatcgaaccattcgtctcaagcggagcaacaaagtggtggctgttcgtgttgattaattttttttattaaatatacttttaacagcaactgagtaaggagtttttttttaaaaagattcataactttgatggtataaataaattttggtgtaaggaaagagatttttacttgggatctccagtattctact

SEQ ID NO: 4266 - DNA, 1016 bp, Centaurea maculosa
tgggcaacgaagaaagaactcaaaaatccactgcgaaaaacagtgaatctattcaaactcaaaatctgcaaatttcttcacaaaatcatcaaattgcagtagtactactcgattgctgtgatttgatcaaaatcaaagttcaataaaaatggcaccagtatcagcactagcaaagtacaagctggtgttcttaggcgatcaatccgtcggcaaaaccagcattatcactcgctttatgtatgataagttcgatacatcttatcaggcaaccattggaattgacttcttgtcgaagacgatgtatcttgaagataggacagttcgtctgcagttgtgggatacagctgggcaagagagatttaggagtctcattccaagttatataagggattcttctgttgctgtcattacatacgacgttgcaagcaggcagacttttcttaacactataaaatggattgaggaagtccgtgcagaaagaggtagtgatgttatcattgtgctggttggaaacaagactgaccttgtggacaagaggcaagtctcggtagaggaaggagaagcgaaagctggtgagctcaaagtcatgtttatcgaaacgagtgctaaagctgggttcaacataaaggctttatttcggaaaatagcagcagcattaccaggaatggaaacactttcctcaacaaaacatgaagagatggtcgatgtgaacttgaagtcttcaagcgtgacttcttcccagcctgcatccggtggttgcgcttgctgattatacgatgcctgttactgttgctatctgcttcaaccgaactcgtgtaaagttccaggtgcacgctactcaactggttcggaacccttatgtttattgctttgttatatcaatctaccacaaatgtatgtaacgttttcgttttctttttcgccttttcaattggttcatttgtaacagaagtagaccccctttgcgtttttgaggtttagtttgtcgtgtagaaaaggatttgccaagattttga

SEQ ID NO: 4267 - DNA, 1025 bp, Centaurea maculosa
attttgggcaacgaaagaagactcaaaatcaactgcgaaaaacagtgatttgatcaaattcaaactcaaaatctgcaaatttcttcaccaaatcatcaaattcaaacaccactcgattgctgtgatttgatcaaatcgaagttcaataacaatggcaccagtatcagcactagcgaagtataagctggtgttcttaggcgatcaatccgtcggcaaaaccagcattatcactcgatttatgtatgataagttcgatacatcttatcaggcaaccattggaattgacttcttgtcaaagacgatgtatcttgaagatcggacagttcgtctgcagttgtgggatacggctgggcaagagagatttaggagtctcattccaagttatataagggattcttctgtggctgtcattacgtacgatgttgcaagtcggcagacttttcttaacactataaagtggattgaggaggtccgtgcagaaagaggcagtgatgttatcattgttctggttggaaacaagactgaccttgtggacaaaaggcaagtctcggtagaggaaggagaagcgaaagctgttgagctcaaagtcatgtttatcgaaaccagtgctaaagctgggttcaacataaaggctttatttcggaaaatagcagcagcattaccaggaatggaaacactttcctcaacaaaacacgaagagatggtcgatgtgaacttgaagtcttcaagcgtgacttcttcccagcctgcatccggtggttgcgcttgctgatacgatgcctgttaccgttgctatctgcttcaaccgaactcgtgtaaagttccagatgcacgctattcaactggttcggaacccttatgtttattgctttgttatatcatctatcacaaatgtatgtaacgttttctttttctttttcgtcctttcaattggtacattagtaaacggaagtagaccccccttgcgtttttgaggtttagtttgttgtgtagaaaaggattttccaagattttgactcggtttt

SEQ ID NO: 4268 - DNA, 905 bp, Centaurea maculosa
gagtacgacgggggggcgaacgaagaagaactcaaaatccactgcgaaaaacagtgaatctattcaaactcaaaatctgcaaatttcttcacaaaatcatcaaattctagcactactccattgctgtgatttgatcaaaatcaaagttcaaaaaaatggcaccagtatcagcactagcaaagtacaagctggtgttcttaggcgatcaatccgtcggcaaaaccagcattatcactcgctttatgtacgataagttcgatacatcttatcaggcaaccattggaattgacttcttgtcgaagacgatgtatcttgaagataggacagtccgtctgcagttgtgggatacggctgggcaagagagatttaggagtctcattccaagttatataagggattcttctgttgctgtcattacatacgacgttgcaagtaggcagacttttcttaacactataaaatggattgaggaagtccgtgcagaaagaggtagtgatgttatcattgtgctggttggaaacaagactgaccttgtggacaagaggcaagtctcggtagaggaaggagaagcgaaggctggtgagcttaaagtcatgtttatcgaaacgagtgctaaagctgggttcaacataaaggctttatttcggaaaatagcagcagcgttaccaggaatggaaacactttcctcaacaaaacacgaagagatggtcgatgtgaacttgaagtcttcaagcgtgacttcttcccagcctgcatccggtggttgtgcttgctgatacgatgcctgttaccgttgctatctgcttcaacccgactcgtgtaaagttccagatgcacgctattcaactggttcggtacccttatgtttattgctttgttatatcatctacaacaaatgtatgtaa

SEQ ID NO: 4269 - DNA, 1268 bp, Cephalotaxus harringtonia
tatttgaatagggttcatgcccattacacaacagcatgggaaattagaaattaaatttgtgacttcgggggaacgaatctgagggagtgcgacaccgaataaatcagtttaaattttgagtaggaagggaaaaatgagtacaaccatggcgactgtatcgcctcttgccaaatacaagctcgtgttcttgggagatcagtccgttgggaagaccagcattatcactcgtttcatgtacgacaagtttgacaatacctatcaagctacaattggtattgactttttgtcaaagacaatgtaccttgaggatcgaactgttcgtttgcagctatgggatactgcaggacaggagcggttccggagtctcatcccgagttacattcgggactcatctgttgctgtcatagtctatgatgtttcaaatcgacagtcatttctgaatactgccagatggattgaagaggtccgcacagagcgaggtagtgatgtaattattgtacttgttggaaacaaaacagacctggttgacaaaaggcaagtttcaattgaggaaggtgatgcaaagtcacgggagtttggggtgatgttcattgaaacgagtgcaaaagcgggttttaacattaaggcattgtttcgtaagatagcagctgcattacctggaatggaagctctttcatcaaccaaacaggaagacatggttgatgtgaatttaaaacccacagtgtctgcatcccaagcagagaagaaggcaggaggatgctcttgttaagagtgaatgatgctttattccttcatggttgatacttttttgtaggggcttagttggatgttgggtctgtcttcaaagctcttggagcatcatctgaataagatgcatttttttatggtgtcctagcagcaagtcatgtatatgaggaaatagaagattggaatgtgcaatatttttgtacgaattaattaatttttttagaagattgtatgggtatatcttgccttggagaaaataaattttagtgaactttttcaaagtgatgaataacatattactctaggggtgtctctgatgttctgagacaggtgtctctgatgttttgagataggtgtctctgatgttctgagtcaaactaatgggtgtcatccataatttcctctccatattgcacaatattttctgtacttttgtctggtaagaagttttgattttcatagatttgggatcagcttcttgaaagtggtattggaaattgagtgctcatattgtatgtggg

SEQ ID NO: 4270 - DNA, 934 bp, Chrysanthemum coronarium
caatcaaaattccggtaactaactagggtttaatatcattcagatcacatacgattctgaatcaatcaatcatttccgtgatctgatcaaataaacaacaaaatgccgccagtatccgcgttagccaagtacaaactagtctttttaggcgatcaatccgtcgggaaaaccagcattatcactcgcttcatgtacgataagttcgacacctcttatcaggcaactattggaattgatttcttgtcgaagacgatgtatcttgaagatcggacagttcgtctgcagttgtgggatactgctgggcaagagagatttaggagtctgattccaagctatataagggattcttctgttgcagtcatcacctatgatgtcgcaagtcgtcagacttttcttaacactattaagtggattgaggaagtccgtgctgagaggggtagtgatgttatcattgttctggttgggaacaaaactgaccttgtggacaaaaggcaagtctcggttgaggaaggagaagcgaaagctactgagctaaaggtcatgtttatcgaaacaagtgctaaagctgggttcaacataaaggcattgtttcggaaaatcgcagctgcattaccaggaatggaaacactttcctcaacaaaacatgaagaaatggtcgatgtgaatttgaagtcctcaagcgctagctcatcccagcctgcatctggtggttgcgcttgctgatcagaggccaagtcacgccttattgtcatttctccgctccaaatctccaatcatggtggttaatcttgttaatggttcaacaattttgcttccaactcgtggcaagttccaggtgcattttcaaaaggctggaaacaaaaatattcaactaagacgataatgtttattgctttggttttatcatttactacaggtgtatgtaacgatttcc

SEQ ID NO: 4271 - DNA, 726 bp, Chrysanthemum coronarium
aaaatgccgccagtatcagcgttagcaaagtacaaactagtcttcttaggcgaccaatccgtcggcaaaaccagcattatcactcgtttcatgtacgataagttcgacacctcttatcaggccactattggaattgatttcttgtcgaagacgatgtatcttgaagatcggacagttcgtctgcagttgtgggatacggctgggcaagagagatttaggagtctgattccaagctatataagggattcttctgttgcagtcatcacctatgacgttgcaagtcggcagacttttcttaacactataaagtggattgaggaagtccgtgctgagaggggtagcgatgttatcattgttctggttgggaacaaaactgaccttgtggacaaaagacaagtatctgttgaggaaggagaagcaaaagctactgagctaaaggtcatgtttattgagacaagtgctaaagctgggttcaacataaaggctttgtttcgaaaaattgcagctgcgttaccaggaatggaaacactttcctcaacaaaacatgaagaaatggtcgatgtgaatttgaagtcctcaagcgctagctcatcccagcctgaatctggtggttgtgcttgctgatcaaacgccaagccacggcttattgtcatttctccactccgaatctccaatgatggtggttaatcttgttactggttcaacaattttgcttccagctcgtgt

SEQ ID NO: 4272 - DNA, 778 bp, Chrysanthemum coronarium
agtgaaaaatgccgccagtatcagcactagcaaagtacaaactagtcttcttaggcgatcaatcagtcggtaaaaccagcattatcactcgcttcatgtacgataagttcgacacatcttatcaggcaactattggaattgatttcttgtcgaagacgatgtatcttgaagatcgcactgttcgtctgcagttgtgggatacggctgggcaagagagatttaggagtctgattccaagctatataagggattcttctgttgcagtcatcacctatgacgttgcaagtcggcagacttttcttaacactataaagtggattgaggaagtccgtgctgagaggggtagtgatgttatcattgttctggttgggaacaaaactgaccttgtggacaaaagacaagtctctgttgaggaaggagaagcgaaagctactgagctaaaggtcatgtttattgagacaagtgctaaagctggcttcaacataaaggctttgtttcgaaaaatcgcagctgcgttaccaggaatggaaacactttcctcaacgaaacatgaagaaatggtcgatgtgaatttgaagtcctcaagcgctggctcatcccagccagaatctggtggttgtgcttgctgatcaaaggctaagccacggcttattgtcatttctccactccgaatctccaatgatggtggttaatcttgttactggttcaacaattttgcttccagctcgtgtcaagttccaggtgcaatttcaaaatgctggaaacaaaagtattcaac

SEQ ID NO: 4273 - DNA, 1019 bp, Chrysanthemum coronarium
caaatataaatagtgtgattgacgttttgaaatgcaaatataaatagtgtgaaaggggaaattggcgactccatttcaaatcaactcaatcataattccggtaactaactagggtttaatatcattcagatcacatacgattctgaatcagttattcatttccgtgatccgatcaaataaaccacaaaatgccgccagtatccgcgttagcaaagtacaaactagtcttcttaggcgatcaatccgtcgggaaaaccagcattatcactcgcttcatgtacgataagttcgacacctcttatcaggcaactattggaattgatttcttgtcgaagacgatgtatcttgaagatcggacagttcgtctgcagttgtgggatactgctgggcaagagagatttaggagtctgattccaagctatataagggattcttctgttgcagtcatcacctatgatgtcgcaagtcgtcagacttttcttaacactataaagtggattgaggaagtccgcgctgagaggggtagtgatgttatcattgttctggttgggaacaaaactgaccttgtggacaaaaggcaagtctctgttgaggaaggagaagcgaaagctactgagctaaaggtcatgtttatcgaaacaagtgctaaagctgggttcaacataaaggcattgtttcggaaaatcgcagctgcattaccaggaatggaaacactttcctcaacaaaacatgaagaaatggtcgatgtgaatttgaagtcctcaagcgctagctcatcccagcctgcatctggtggttgcgcttgctgatcagaggccaagtcacgccttattgtcatttctccgctccaaatctccaatcatggtggttaatcttgttactggttcaacaattttgcttccaactcgtggcaagttccaggtgcattttcaaaaggctggaaacaaaaatattcaactagaaccataatgtttattgctttggttttatcatttactacaggtgtatgtaacgatttc

SEQ ID NO: 4274 - DNA, 942 bp, Chrysanthemum coronarium
atcgtatctctaatttcaaatcaattctaaatctgatttcacaattcacaataatcctctagttagggtttataagtggatcataatcacattcaacaccaacgtacaccttcattttttgtgaaaaatgccgccagtatcagcattagcaaagtacaaactagtgttcttaggcgatcaatcagtggggaaaaccagcattatcactcgcttcatgtacgataagtttgacacatcttatcaggcaactattggaattgacttcttgtcgaagacgatgtatcttgaagatcgtactgttcgtctgcagttgtgggatacggctgggcaagagagatttaggagtctgattccaagttatataagggattcttctgttgcagtcatcacctatgacgttgcaagtcggcagacttttcttaacactataaagtggattgaggaagtccgtgctgagaggggtagcgatgttatcattgttctggttgggaacaaaactgaccttgtggacaaaagacaagtatctgttgaggaaggagaagcaaaagctactgagctaaaggtcatgtttatcgaaacaagtgctaaagctggcttcaacataaaggctttgtttcgaaaaatcgcagctgcgttaccaggaatggaaacactttcctcaacgaaacatgaagaaatggtcgatgtcaatttgaagtcctcaagcgctagctcatcccagcctgaatctggtggttgtgcttgctgatcaaacgccaagccacggcttattgtcatttctccactccgaatctccaatgatggtggttaatcttgttactggttcaacaattttgcttccagctcgtgttaagttccaggtgcaatttcaaaatgctggaaacaaaagtattcaactagaacccttatgtttattgctttggttttatcatttactacagg

SEQ ID NO: 4275 - DNA, 994 bp, Cirsium arvense
ctcaaattccactgcgaaaaacagtgaatctattcaaactcaaaatctgcaaatttctacgccaaatcatcaaattcaaacactactcgattgctgtgatttgatcaaatcgaagttcaataacaatggcaccagtatcagcactagcgaagtataagctggtgttcttaggcgatcaatcggtcggcaaaaccagcattatcactcgatttatgtatgataagttcgatacatcttatcaggcaaccattggaattgacttcttgtcaaagacgatgtatcttgaagatcggacagttcgtctgcagttgtgggatacggctgggcaagagagatttaggagtctcattccaagttatataagggattcttctgtggctgtcattacgtacgatgttgcaagtcggcagacttttcttaacactataaagtggattgaggaggtccgtgcagaaagaggcagtgatgttatcattgttctggttggaaacaagactgaccttgtggacaaaaggcaagtctcggtagaggaaggagaagcgaaagctgttgagctcaaagtcatgtttatcgaaaccagtgctaaagctgggttcaacataaaggctttatttcggaaaatagcagcagcattaccaggaatggaaacactttcctcaacaaaacacgaagagatggtcgatgtgaacttgaagtcttcaagcgtgacttcttcccagcctgcatccggtggttgcgcttgctgatacgatgcctgttaccgttgctatctgcttcaaccgaactcgtgtaaagttccagatgcacgctattcaactggttcggaacccttatgtttattgctttgttatatcatctatcacaaatgtatgtaacgttttcttttttctttttcgtcctttctaattggtacattagtaaacggaagtagaccccccttgcgtttttgtaggtttagtttgttgtgtagaaaggatttcctaagattttgtac

SEQ ID NO: 4276 - DNA, 1148 bp, Vitis vinifera
gttttttctgcttgcttatatataaacaggaattgaaatcaaaacgtgagctctcgctttctctctctctttcttccttctcttcctcttttctctctgtaaattgagattcagatctgccggcatggcggtggtatcccctctggccaaatacaagctcgtgttcttgggcgatcaatccgtcggcaaaactagcatcatcactcgcttcatgtacgataaatttgatgccacctaccaggctaccattgggattgattttttgtctaaaacgatgtaccttgaggatcgaacaattcgtttgcagctttgggatactgctggccaagaaagatttaggagtcttataccaagctacataagagattcttcagttgctgtgattgtttatgatgttggaaatcggcaatcatttctgaacacgtccaagtggattgaggaagtgcgtacagaacgaggcactgatgtcattattgttcttgttgggaataaaaccgatcttgttgataaaaggcaagtgtcaatagaggaaggtgataccaaatctcgtgattttggagtcatgttcatagaaaccagtgctaaagcaggattcaatatcaagcctctattccggaagattgcttctgctttgccaggaatggaaaccctttcctccacaaaacaggaagacatggtcgacgtgaacctgaagcccagtgtcaattcatctcagacagaacagcagggaggaggttgtgcttgctagagaatgtatttatactgaagataaagagaaaacaagcagttagaatgaaccaataccgagatcaaatccaaagctaattttaaaccaatgagacggctacagatgtgttggtttctgttcaacataccaccaagtcattttaagtctgcaggaggcaggtggtggcaatggctctgctctaaggtactcagcttgacaattggatgtgttctgttattgttgttactaatactatttctttttttcattctccatgagattttctcctatttggttgtattggatccttagattgcattcaggaattcaatttttgtgcaagattctttccagagtcaacacctatagtaagagtggagacactgatggatgctctcataaatgttcacttattagtttc

SEQ ID NO: 4277 - DNA, 1126 bp, Lupinus angustifolius
acgttgtagttggcggtttctgctgccatatgtattcgaaaatacagcgtttcatttggcgattattcatttccctcaatttgtctctttcttcttcttcttcttctctctctctcaaccttgagaagttatgagattcagatctgaaattgtatcaatctgagaagaaagaggttcgtgatttgtgaaataataagaaaatggcaacggtttctcctctcgctaaatataagctggttttccttggtgatcaatctgttggtaaaaccagcatcatcacacgcttcatgtatgacaaattcgacactacctatcaggctacgattggtattgactttttgtcaaaaacaatgtaccttgaagatcgaacagttcgtttgcagctttgggatactgcagggcaagaaagatttagaagtctcattccaagctacataagagattcttctgttgcagttattgtatatgatgtagctaacaggcaatcatttctgaacactagcaaatgggttgaggaggtacgacaagaacggggaagtgatgttattatagtcttggttggaaacaaaactgatcttgttgacaaaaggcaagtttccatagaggaaggagatgccaaatcccgtgagttcggaatcatgtttatagaaaccagtgcaaaagcaggcttcaatatcaagcctttgtttcgtaagatcgctgctgccttgccaggaatggaaactctttcttctacaaaacaggaagacatggttgatgtaaatttaaaacccacagtgaattcatccaattcagagcagcaaggaggaggttgtgcatgctagagaagactattctcaaaagagcccatgtatgtcttttcacttacaatggtttcttaaatggaaagatgaaggtggaggaaacatgctttcataccaatgatccttcactttacttcatgagggagacaaattgcagtaatggttttgatgtatgattgatagtattcttttggttttctattaatttgttatacaaactagacccttgatgaaagaaaacaattaataaacaggctgctatatgaaagtctttttttcataactaatgtatctcttcgtcctattggtaaagaactaatctc

SEQ ID NO: 4278 - DNA, 683 bp, Ananas comosus
cgaaacccgaaccctaatggcggtcgtatcggccctagcgaagtataagttggtgttcctcggggatcaatcggtggggaaaaccagcatcatcacccgattcatgtacgacaaattcgacaccacatatcaggctactattggcattgattttctttcgaagacaatgtatctcgaagatcgaacagttcgcctgcagctctgggacactgccgggcaagaaagatttaggagcctcattccaagctacatcagagattcttctgttgcagtaattgtctatgatgtatctaataggcaatcatttctgaacaccacaaactggatcgaggaagttcgcacagaacggggtggtgatgttatcatagtcctagttggaaacaagacagatcttgttgataaaaggcaagtttcaactgaagaaggagaagccaaggcccgagaatttggtgtcatgtttattgaaaccagtgcaaaagcaggattgaacatcaagccactgttccgcaaaattgctgcagccttgcctgggatggagactctctcatcagccaagcaggaagacatggtggacgtgaacttgaagcccacagtcagttcatcgcaaactgtgcagcagtcagggggatgtgcatgctagactcatcaagctcggattataatgtcatacatagaaagacaaa

SEQ ID NO: 4279 - DNA, 1087 bp, Pteridium aquilinum
agtacccggggcagatccacgatttcacgtacgtgcaaagcctgcaggcccatagctgtgagctcggccaaagctctcatttcacgatgccacagtaaaggccaaaagccttggattgctccttgcatttcactcagaggggatgatcagtcgatccctagggtttcgcctgcagccttcctccgccattaaacctgcttgcaagccatgagcacccccatggctactgtctcccccctcgccaaatataagctcgtctttctgggagatcaatctgtcggaaaaaccagcatcatcaccagattcatgtacgacaagttcgataacacttaccaggcaaccattggtattgattttttatcaaagacaatgtatctggaggatcgaactgttcgcttgcaattatgggatactgcaggacaagagcgctttcgcagtcttattcccagctatattcgtgattcttctgtagctgttattgtgtatgatgtcgccaataggcagtcctttttgaatactgccaggtgggtagaggaggtacgaactgagcgtgggagtgatgtgataattgtcctagtgggaaacaagacagacttagttgacaaaaggcaagtatccattgaagaaggtgatgctaaatctcgggaatttggagtcatgtttatagagacaagtgccaaagctgggtttaatatcaaggccttgttccgaaaaattgcagcagccttgcctggtatggaagcgctctccacaaagcaggacgatatggttgatgtgaacctgaagtctacaacagctacttcccagtcagctcagaaagcagggggctgcgcgtgttgatcatgttcaaataggtttgatccagcgtaatgtagctgcctgtttcatagcagataaagatttttgcttcttttatattgttttttttcgtattagtcgaaagtagcctccgaatacagctgccttgattccgcagctgtgtaaattgcaaagatgcactgggaagtataaaggccctgattgggttatttttgtatcaaagcattgacttgtaaacactagttctggaagacttgtgctagactaa

SEQ ID NO: 4280 - DNA, 885 bp, Carthamus tinctorius
tgattttgggcacgaagaagactcaaaatcgactgctaaaaacagtgaatctatacaaactcgaaatctgcaagtttcttcaccgaatcatcaaattctagcaccactcggttgctgtgatttgatcaaatcaaagtgaagaagatggcaccagtatcagcactagcgaagtacaagctggtgttcttgggcgatcaatccgtcggcaaaaccagcattatcactcggtttatgtatgataagttcgatacctcttatcaggcaaccatcggaattgacttcttgtcgaagacgatgtatcttgaagataggacagttcgtctgcagttgtgggatacggctgggcaagagagatttaggagtctcattccaagttatataagggattcttctgttgctgtcattacatacgacgttgcaagtcggcagacttttcttaacactataaagtggattgaggaagtccgtgcagaaagaggtagtgatgttatcattgtgctggttggaaacaagactgaccttgtggataagaggcaagtctcagtagaggaaggagaagcgaaagctggtgagctcaaagtcatgtttatcgaaaccagtgctaaagctgggttcaacataaaggctttatttcggaaaatagcagcggcattaccaggaatggaaacactttcctcaacaaaacacgaagagatggtcgatgtgaatttaaagtcttcaagcgtgacttcttcccagcctgaatctggtggttgtgcttgctgatacgatgcctgttaccgactgctatctgcttcaacccgactcgtgtaaagtgttccagatgcacgctattcgactggttcggaaccctcccctatgtttatgctttgttatatcatctac

SEQ ID NO: 4281 - DNA, 1693 bp, Sequoia sempervirens
gttatttgaattgggtccatttccattgcaagttcgcggataaattttcaaattaactttgtgacgtcgttggatcgaatctgaggggaacaaatcagtatatattttgaggagtaaaggatgagtacaaccatggcgactgtttcgcctcttgccaaatacaagctcgtgtttttgggggatcaatctgttgggaagaccagcattatcactcgtttcatgtatgacaagtttgacaatacatatcaggctacgattggtattgactttttgtcaaagacaatgtaccttgaggatcgaactgtccgtttgcaattatgggatactgcaggccaggagcggtttaggagtctcatcccaagttacattcgggactcttctgttgctgtcatagtttatgatgtttcaaatcggcagtcctttctgaacactgccagatggattgaagaagttcgcacagaacgtggtagtgatgtaattattgtacttgttggaaacaaaacagatctggttgacaaaaggcaagtttcgattgaggaaggtgatgcaaagtcacgtgagttcggggtgatgttcattgaaacgagtgcaaaagcaggttttaacatcaaggccttgtttcgtaagatagcagctgcattgcctggaatggaagccctctcatcaaccaaacaggaagacatggttgatgtaaatttaaaacccacggtgtctgcatcccaagcagagaagaaagcaggaggatgttcttgttaagagtgaatgatgctttattccatcttggttgctgcctttttggcttcaaagctcttggagtgtcatttgaataagctatatttcttatggtgccccagcagcaaatcatgtatatcagggaatagaagattggaatgggcaatatttttgtgctaattaatatttttttagaagattgtatgcagtatgttgcctttgagaaaataagttttagtgaacattatcaaagtgatggttaacaacagaatactctagggctgtttctatggttcttagtcaacttatgggatgaaggaagatttaatcgacggtcactgatctatgcaggggtgaaaatggtttgagaggatgttgggagccctcgatacagcgttggagcaggcttatacccagcagttaattccaatttagagtatcttattatggatagggaaatgaaagaaagtgatatagaaaccaagaaattagacaaatgcactcaggaacaaagaaaaatatgaaagtgaaagtactgttctttgccagggcccgtgatcttgccggtgtatctgataaggttttggatatagaagaaggttcaactattttggactgtattaataagcttatactgcaagtaccaagtttaaaagcaatatatgactgcatggcagtggccttaaatgaaatgtacacttctgactctgctgttgtgaaagatggagatgaacttgctcttatccctccaatcagtggaggttgaaattggcttaagctccacatgcgtttattgtggccaagtattctgttattcttggttttctattattattatctaatattaatatgtgtaaggggttaatgtgttgttctaagtgatgattcttagtcttccattgttgacttctactgttaatatgcaatgttgatgtttacctggagctgaataatatggttg

SEQ ID NO: 4282 - DNA, 1044 bp, Solanum phureja
ttttctctctctctttcctcattccaccgatccagatctcaaatcttcgagagagtgaaaaagaagaagaaaattgtataataatggcggccgtatcgccattagcaaagtataagcttgtgtttttgggcgatcaatctgttggaaaaaccagcatcattactcgcttcatgtacgataaattcgataccacctaccaggctaccattggtattgattttttgtccaagacaatgtaccttgaagatcgaacagttcgcttgcagctctgggatactgctggtcaagaaagatttaggagtcttattcccagctacattagagattcttctgtcgctgtaattgtgtttgatgttgccaaccgtcaatcatttctaaacacttcaaagtggattgaggaagtacgtactgaacggggaactgatgtcataatcgttcttgttgggaacaaaactgatcttgtcgagaaaaggcaagtatccatcgaagaaggcgaaaccaaggctcgtgaatttaacgtaatgtttatagaaactagtgctaaagctggattcaatatcaagcctctgttccgaaagattgctgctgctttaccaggaatggaagccctttcatccacgaagcaagaagatatggtggatgtgaatttgaagcctaccacaagttcatctaatgcagagcagcaaggtggaggttgcgcgtgctagattttgtacgtaacaagagagataagaagttggacatacacaaagatgcagttgcatcaaattatgtcataatatatagagatgttcaattagctcattttgttagatcattatgaagtttggaacaattttgggtttttgttcatgttgtacaacaagttctttcaattctgatggtgagatagctgacaattatgttgttactattaaaacttgtgattatatattatgtgatgtgattcctagttcaggaatctttttttcttttttcccattctctgagcaaaatatatagtatgatgaaatggtatttattgtatcatttcaatttgttgtg

SEQ ID NO: 4283 - DNA, 1262 bp, Taxus baccata
gtttattcgaggaaaaaagaattaagtgccttgattccgtccatcactgcggatttttcaaattcagcttccatttgcccattgcaaaaccgcatgcgaaattagtaactaaaacgaatctgagggagtgccggcactgaataaatcagtttatattttgagcaggaaggaaaaaaaatgagtacaaccatggcgactgtatcgcctcttgccaaatacaagctcgtgttcttaggagatcagtccgttgggaagacaagcattatcactcgtttcatgtatgacaagtttgacaatacctatcaggctacgattggtatcgactttttgtcaaagacaatgtaccttgaggaccgaactgttcgtttacagctttgggatactgcaggccaggagcggttccggagtcttatcccaagttacattcgagattcttctgttgctgtcatagtctatgatgtatcaaaccggcagtcatttctgaatactgccagatggattgaagaagtccgcacagaacgaggtagtgatgtaattattgtactcgttggaaacaaaacagacctagttgacaaaaggcaagtttcaattgaggaaggtgatgcaaagtcacgggagttcggggtaatgttcattgaaacaagtgcaaaagcgggttttaacataaaggccttgtttcgtaagatagcagctgcattacctggaatggaagctctctcatcaaccaaacaggaagacatggttgatgtgaatttaaaacccacagtgtctgcatcccaagcagacaagaaagcaggaggatgctcttgttaagagtaaatgatgctttattcctttttggttgctacctttttgtatgacttggtcggatgttgggtttgtcttcacagctcttggtgcatcatctgaataagatagctttcctatggtgtcctagcagcaagtcatgtatatcaggaaatagaagattggaatgtgtaatatttttgtgcaaattaattaattttttagagattgtatggcatatcttgcctttgagaaaataaatattagcaaactttatgaaagcgatggtgaataatataataatctaggggtgtctctgatgttctgagtcaacttatgcttgtcatcgttaattttctttaattatgccacaatatgttgacaacatagatttgggatgaaagtggtgttggaaatttggacttcatattgtctatggttaccagtctatgagaatgaattatttgctcttgttc

SEQ ID NO: 4284 - DNA, 1131 bp, Solanum lycopersicum
tatgtattctacaaattgacatttcaaaaacgttgatctctctctcccttccttgcctattttcttcctcaattttctctcttctctttttctctctctctttcttcattccaccgatccagatctcaaatctccgagagagtgaagaagacgaagaagaaaattgattagtaatggcggccgtatcgccattagcaaagtataagcttgtgtttttgggcgatcaatctgttggaaaaaccagcatcattactcgcttcatgtacgataaattcgataccacctaccaggctaccattggtatcgattttttgtccaagacaatgtaccttgaagatcgtacagttcgcttgcagctctgggatactgctggtcaagagagatttaggagtcttattcccagctacattagagattcttctgtcgctgtaattgtgtttgatgttgccaaccgtcaatcatttctaaacacttcaaagtggattgaggaagtacgtactgaacggggaactgatgtcataatcgttcttgttgggaacaaaactgatcttgttgagaaaaggcaagtatccatcgaagaaggtgaatccaaggctcgtgagtttaatgtaatgtttatagaaactagtgctaaagcaggattcaatatcaagcctctgttccgaaagattgctgctgctttacctggaatggaagccctttcgtccacgaagcaagaagatatggtggatgtgaatttgaagcctaccacaagttcatctaacgcagagcagcaaggtggaggttgtgcatgctagattttgtacgtaacaagagagagataacaagttggacatacacaaagatgcagttgcatcaaattatatcataatatatatagatgttcaattagctcattttgttagatcattatgagttttggaacaattttgggtttttattcatgttgtacaacaagttctttcaattctgatggtgaggtagctgacaactctgttgttactatgaaaacttgtgattatatattatgtgatgtgattcctagttcaggaatctttcttttttcttctgaatatatatatatatagtatgatgaaatggtatttgtagtatcatttcaatttgttgtga

SEQ ID NO: 4285 - DNA, 1003 bp, Ambrosia trifida
cccccttcgtcgttggccttggtcagttcctcagtacgagtaggtccacgtattcaacgcacgagttactcggggagttttctttctttcttccctttccttctttctctctccttccgcatttctctccctaaccaatttcccaagagattcagatctaatctgatacgccaaaacaaacaacaactgaataataataataataataatcgtaaaatggcggtggtatctcctcttgccaaatacaaactggtgtttttaggtcgatcaatccgttggcaaaaccagcatcattacccgtttcatgtatgacaaattcgataccacctatcaggctaccatcggtatagatttcttgtcaaaaactatgtaccttgaggatagaacagttcggttacagctttgggatactgctggacaggaaagatttaggagtctcattccaagctacataagagattcatcagttgcagtcattgtctatgatgttgctaatcgacagtcatttttgaacactgcaaaatgggtagaagaagtgcgtactgagcgaggcactgatgtcattatagttcttgttggaaacaaaactgatcttgttgacaaaaggcaagtttcaattgaagaaggagatgccaaagctcgtgaatacggcgtcatgtttatagaaaccagtgcaaaagccggattcaatatcaagcctttattccgaaagattgctgctgcattaccggggatggaggctcattcgtccgcaaaacaagaaggcatggttgatgtgaacttgaaatctgcaggaaacgcttcgcagtcagagaagcaaggtggagggtgcccatgctagagattgatgcttttatagattgtggtgttgataattttgattttaagtgacatgatcaaagtaagatgatatcatgcatcccaattctttaagaatttctttttagaactaaaaacaaagtaattttaattttagtagtttaactttctttactttaatctt

SEQ ID NO: 4286 - DNA, 895 bp, Flaveria ramosissima
ctaacatttcacagattcagatctgatcgccaagagaagcacctgaataataatactattcatggcggtggtgtcacctcttgccaaatacaaacttgtctttttgggcgatcaatccgtcggcaaaaccagcatcattaccagattcatgtatgacaaattcgataccacttatcaggctaccattggcatagatttcttgtcaaaaactatgtaccttgaagatagaacagttcggttacagctttgggatactgcagggcaggaaagatttaggagtctcattccaagctacataagagattcatcagttgcagtcattgtctatgatgttgctaatcgacagtcattcttgaatactgcaaaatggatagaagaagtacgcactgaacgaggcactgatgtcattatagtccttgttggtaacaaaaccgatcttgttgacaaaaggcaagtttcaattgaagaaggagatggcaaagctcgtgaatttggtgtcacgtttatagaaactagtgcaaaagctggattcaacatcaagcctttatttcgaaagattgctggtgcattaccagggatggagactcttcttccacaaaacagaagacatggttgatgtgaatttgaaatcttcgggcaatgcctcgcagtcagagcagcaaggtggaggctgtgcgtgctagagcgctgcaacgtcttatgattgtaatggttggtggttaatttgtgataattttgattttgtaagtgacattatcaaggtaagaggtcttatgcatcttcagagttacctttttaacttctatctatttttgccccttatagagtcaagacattacaatggttagaacaaaacaaagacttagagctactgttccatttctagttacattac

SEQ ID NO: 4287 - DNA, 1102 bp, Glycine max
aaaataggggtaaattgtaagaaggtaggggcgaaaatggtgatatacaaagaatggattgtagtagtcgtggtggttggcgctttctgatgcccgtgtataaaaggcattgttcagatctgatcaacaaaaatggcgactgtgtccctctcgccaaatacaagctcgttttcttaggcgatcaatcggtcggcaaaaccagcatcatcactcgcttcatgtatgacaaattcgacactaactatcaggctactattggtattgacttcttgtcaaaaacaatgtaccttgaagatcgaacagttcgtttgcagctttgggatactgcagggcaagaaaggtttagaagtctcattccaagctacataagagattcttctgttgcagttattgtatatgatgtagccaaccggcaatcatttttgaacactaacaagtggattgaggaggtgcgtacagaacgaggcagtgatgttattattgtattggttgggaataaaactgatcttgttgaaaaaagacaggtttctatagaggaaggagatgccaagtcccgtgagagtggaatcatgttcatagaaaccagtgcaaaagcaggcttcaatattaagcctttatttcgcaagattgctgcagccttgccagggatggaaacactttcttctacaaaacaggaagacatggttgatgtaaatttaaaacccaccgtgaattcatcccagacagagcagcaaggaggaggttgttcttgctaaagaaaggctattcataacgagccaatataagtctgttcactaagcacagtcatgaaagatgcagctgaggcagacatgctttcatacaaatgctcgacagtgtttagttgggggagaggggtttccactttgcagtaatggttttttacgttatatagttgtataaaaattgtataccggatctggatgacgtgaaggaggcatcaccgttttttaacttactagatgttaagataaaggatttaaactggagctttgttggaagcattttcagacaatgatgtcatacttgattgcagaaactcgacctgtcaaaactgcttatataacaaatgtagatctagatc

SEQ ID NO: 4288 - DNA, 910 bp, Cynara scolymus
gggcgaccggattcatacaagcaggccctttccccccttcccgcatatacttgggatctgacctctttccggcccgatctcgaagatattccggcgagatctctaaatattcgtcggaaaatcttcgttctttgatcgatttatttgaatttactgttatattcgaattagtttcacatctatggctccggtgtcggctctagcgaagtacaagctcgtgttcttaggagatcaatcagttggaaaaacgagcatcatcactcgattcatgtatgataagtttgacaacacttatcaggctactattggtattgattttttatcaaaaactatgtatcttgaggatcgaacagtacgcttgcagctttgggatacagctggacaagaaaggtttaggagtctcattccaagttatatcagggattcctctgttgccgtcattgtttttgatgttgcaagccgacaatcatttatgaacacggcaaaatggattgaggaggtccgcactgagcgaggcagtgatgttataatcgttcttgttggaaataaaactgaccttgtggataagaggcaagtttctatagaggaaggggaagctaaagctcgtgattttaatgtaatgtttattgaaactagtgccaaggcgggcttcaatataaaggctttgtttcgaaagatagcttcagcattaccaggaatggaagctttatcgtcttcaacaaagcaggaagacatggtggatgtaaatctcaagtccagcaatttcagtggatcccagcagcaccccagtctggaggatgctcatgctgatggatgatcattaaaccaaaacatatttttgaaaggtagtgatgcttcactttagcagtttgatcatttagttttagttgtgcaattgcttttctatgct

SEQ ID NO: 4289 - DNA, 1129 bp, Flaveria ramosissima
accgacacacactccactcttcactcttcagcttcaccaaacaaaccctttttctctccgccccgatctctaagattttccggcgagatctccgccggataatctttactctccgatcacaacgaccgccggagttatctgatcatcgttccgtatcatcttcaacactatggctccggtgtcggctttggcgaagtacaagctcgtgttcttaggagatcaatcggttggaaaaacgagcatcatcactcgattcatgtacgataagttcgacaacacttatcaggctactattggtattgattttttgtccaaaaccatgtatcttgaagatcgaacggttcgcttgcagctatgggacacagctggacaagaaaggttcaggagtctaattcctagttacattagggattcctctgttgctgtcattgtttttgatgttacaagccgacagtcatttatgaacactgcaaaatggattgaggaggttcgtactgaacgaggtagtgatgtcatcatcgtccttgttggaaataaaactgaccttgtagataagaggcaagtttccatagaggaaggagaagctaaagctcatgaatttaacgtaatgttcattgaaaccagtgccaaggctggttttaatataaaggctttatttaggaaaatagcttctgcattaccaggaatggagaccttatcttcaacaaagccagaagacatggttgatgtaaatctcaagtccagcaatgcaagtgggtcccaacagcaaccgcagtcggagggtgtgcatgctgatgtgtcagattcataatataccaaactagtctcagatggatatcttcgaaggtcagttgcttatacagaaagggttttgctatgcttgaattactattagcgtgatatgtctttgtatgcttccgtatttaccttttaaaaatgttggaggttttcttgaatttcaaaatttctcgagttatattcaagactcgagttagttggcagttttgaaccgtctgaattttggcgttcgaccctttctcatatggatatggttgtcgattagttaattttttcgttgtgatgttttgaatttcaaaagttggtggctaatgtattttgtgtttgtaaa

SEQ ID NO: 4290 - DNA, 1061 bp, Sorghum bicolor
ccgcggagcactgacgtgcgcgcgtcgtggtggcctggcctctgcgttccacttcctccgcggccctcgcctcgccagaacagcgcgggagatctcgggatcgggcggccctcctcctccggcgtccggatcgagaggattggagccgaatccgatcgcctaggcggcgcagcggggcgtgggggcgcgatggcgccggcggtggtgtcggcgctggccaaatacaagctggtgttcctcggcgaccagtccgtgggcaagaccagcatcatcaccaggttcatgtacgacaagttcgacaccacctaccaggcaacgattggcattgactttctgtcaaaaacaatgtatctagaagaccgcactgtacgtttacaactctgggatactgcaggacaggagagatttaggagcctcattccaagctacatcagggactcttccgttgcggtggttgtttatgatgtatccaacagacagtccttcctgaacacctcaaagtggatcgatgaagtccgcaccgagagaggtggcgatgtgataatcgtgcttgttgggaacaaaactgatcttgtcgacaagagacaagtgtccacagaagaaggagagagcaaggcgaaagaactgaacgtcatgttcatcgaaaccagcgcgaaagccggcttcaacatcaagccgctgttccgcaagatcgccgcggccctgccgggaatggagacgctgtcggcgaagtctgaggacatggtggacgtgaacctgaagcccacttccagccagtccaactcgcagcagcaggcggggagtggatgcgcgtgctagaagagtgctaactctgcacatacactggcttgacaaacgtgttgttaactgttaagcagttatatcagttctgttactgctgtccttaattccctgattacctgatgcttcttctgtagtgagtcttactttgttttctcgatcatgtgcatctcgattttttgtacggcgaaagaccagatgttctcttgcagtttaagacatattcgaactcttttgtgctatggaatatctttcgtgag

SEQ ID NO: 4291 - DNA, 982 bp, Gossypium hirsutum
ttaaaaaagtttcatttccatttccataataatagtaattttattttattttccttcctggttcagatctgaaactctcgtttatacaatcgaagagagagagagaagaaattgaaaaatggcgacggtgtcccctctggcgaaatacaagcttgtattcttaggcgatcaatctgtcggcaaaaccagcattatcacccgcttcatgtacgataaattcgacaccacttatcaggccactataggaattgattttttgtcaaagacaatgtatcttgaagatcgaacggttcgattgcagctttgggatactgcagggcaggagagatttaggagtcttattccaagttatatcagagattcttctgttgcagtaattgcctatgatgtagctaatagacaatcatttttgaacacttcaaagtggattgaagaagtacgcacagaacgaggcaccgatgtcattattgtccttgttgggaacaaaaccgatctggttgataaaaggcaggtttctatagaggaaggagatagcaaggctcgtgaacttggagtcatgttcatagaaaccagtgcaaaagcaggattcaacattaagcctctattccgcaagatagctgctgccttaccaggaatgggatctctttcttcaacaaaacaggacgatatggttgatgtaaacctgaaatccagtggaaattcatatcaaaatccagatcagcaaggaggtggttgtgcttgttaaaacaaatactgtatttactacaagcttagcttaagagatagggaaaaagagatccaaattaagtttccgaacttccttcacgttacttaggccctgattttcttagctgggttaatgatcagttagataacttcgtcagttggatgaaggggagcaagacctgcaagcaatgaattaataaggtaaggggaataccggaaatagatttttgagacattttctgatacgtaagtcaac

SEQ ID NO: 4292 - DNA, 1346 bp, Gossypium raimondii
tttgactctcgataattggcggtttctcgtactcactatataaaggattaaagtcaaagctttccttcattttcttctctcttctcaaaattaaaaagtttcatttccatttccataataatagtaattttattttattttccttcccggttctgatctgaaactctcgtttatacaatcgaagagagagagagaagaaattgaaaaatggcgacggtgtcccctctggcgaaatacaagcttgtattcttaggcgatcaatctgtcggcaaaaccagcattatcacccgcttcatgtacgataaattcgacaccacttatcaggccactataggaattgattttttgtcaaagacaatgtatcttgaagatcgaacggttcgattgcagctttgggatactgcagggcaggagagatttaggagtcttattccaagttatatcagagattcttctgttgcagtaattgcctatgatgtagctaatagacaatcatttttgaacacttcaaagtggattgaagaagtacgcacagaacgaggcaccgatgtcattattgtccttgttgggaacaaaaccgatctggttgataaaaggcaggtttctatagaggaaggagatagcaaggctcgtgaacttggagtcatgttcatagaaaccagtgcaaaagcaggattcaacattaagcctctattccgcaagatagctgctgccttaccaggaatgggatctctttcttcaacaaaacaggacgatatggttgatgtaaacctgaaatccagtggaaattcatatcaaaatccagatcagcaaggaggtggttgtgcttgttaaaacaaatactgtatttactacaagcttagcttaagagatagggaaaaagagatccaaatttaagtttccgaacttccttcacgttacttaggccctgattttcttagctgggttaatgatcagttagataacttcgtcagttggatgaaggggagcaagacctgcaagcaatgaattaataaggtaaggggaataccggaaatagatttttgagacattttctgatacgtaagtcaacaaaaatttaagaaaggaaagaggggccaaagaggcagagtgtaaaagtattatggagaattctttcctgaagtcttgcgttacgtactggtattccaagaatttcgatcctatttgtggctcccgactttcttctaccttaatgtgccctgtgtgatcaacttatctatgaacatgttattactctttcttttggtaattgctaatgctttgtctttacagtctcacggactgagtggaaataatctaatgaaaagttgtttttttcaaatttt

SEQ ID NO: 4293 - DNA, 1004 bp, Helianthus annuus
aggaagtttggcggtttttggttcaggttcacctttcattactcactgactcactcacagattgaaatctgagttgatttgatttgatcgtgtgattccaaagtaacaagtgacagacagacagactaatggcgggtgtgtcacctctcgccaaatacaaactggtatttctgggcgatcaatccgtcggcaaaaccagcatcattaccagattcatgtatgacaaattcgacacaacttatcaggctaccattggcatcgatttttgtctaaaacaatgtaccttgaagatagaacagttcggttacagctttgggatactgctgggcaggagagattttaggagtcttattccaagttatataagagattcaactgttgcagtgattgtctatgatgttgccaatcgtgagtcatttttgaacactttaaagtggatagaagaagtacgtactgagcgaggcagcgatgtgatcatagtccttgttggcaacaaaactgatcttgttgacaaaaggcaagtgtcgatcgaagaaggagatggcaaagctcgtgaacatggagtcatgtttgtcgaaacgagtgcaaaagctggatttaacattaagcctttattcagaaagattgctgctgccttgccagggatggagacaatttcctccacaaaacaagaagacatggttgatgtgaacttgaagtctagctcaaatacaaaccagtcaaatcagcaaggtggaggttgtgcatgctagattattaactactcatattcagttgcaccttttgttttcgagttttatgcttcaaaatgaaaacaatatgcctcacatcatatcatcttatatagattgggttggtttggtttggtttgaactaacaagttttaaaatggaattggaacaaagttaacaacttgggttggttatttggtcttgtattctttgtttctagtttcggtttggcccaatggatgagatgaacacatgtgtgatggttaacaatcc

SEQ ID NO: 4294 - DNA, 1338 bp, Conyza canadensis
tatacttcagtattacgattgacaaaaagaatattctaacgatctaaaaagggaaatcaaaacgtaaagttgtaaaaagttgaggattcacgatagacatcaaacccgggtcaaattattatcgaatacaatcaaattatcttcctccgaatttctctcttcttcacacagagggattaaaaatcacatctgattcggcgtgattcttaaagaagaatggcggtgatatcacccttggccaaatataagttaggttttttgggcgatcaatccgtcggtaaaaccagtattattaccagattcatgtatgataaatttgatactacttatcaggctaccattggtatcgattttttgtctaaaacgatgtaccttgaagatagaacagttcggttacagctttgggatactgctgggcaggagagatttaggagtcttattccaagttatataagagattcgtcagttgcggtgattgtctatgatgttgccaatcgacagtcattcttgaacacttcaaaatgggtagaagaagtacgtactgagcgaggcagtgatgtgattatagtccttgttgggaacaaaactgatcttgtggacaaaaggcaagtgtcgattgaagaaggagacgccaaagctcgtgaacatggagtcatgtttgtagaaaccagtgcaaaagctggatttaacataaagcctttattccgaaagattgctgctgcattgccagggatggagacactttcctccacaaaacaggaagacatggtcgatgtgaatttgaaaccttcatcaaatacgaaccagtcagatcagcaaggcggaggctgtgcatgctagattacttttaacttcaaatagtcacattcccttgtacttattggattttggaacatttctttcaccttttatttcctaaaattgcaatgttgtgatttagaataaacctttgttccttaggtttggatgtgtttgttgggggtgaatcggtgataaaaacagcgctgtgttacctgatcatatcatcttatatagatccaagttttttctgaaacggataactgaaacttgatcaagatcctctcaagttgagacttgccttgctgttttgccctctcatcatgatagccaattagccatagatacaaagtgttgcatgtaataaccgtgtatgtccgtggaccacattagctacaagttaacttacgcttgtgacgttaacaattatacgagaatcctttctactttttctcatgaaaatgactctcttttccgtaactagacccaccatattagtgctaatgcttttgtttagggtattagtgttggaaagccaac

SEQ ID NO: 4295 - DNA, 948 bp, Rosmarinus officinalis
ctcttcaatatctcccatacatttctctaacttctcctctgcgcaaatttagatctgatcatcatcgtcgtcgtctttctctccaatggcggtggtgtcaccattagcaaaatacaagctggtctttctgggcgatcagtccgtcggaaagaccagtatcatcacccgttttatgtacgataaattcgatacaacctatcaggctacaattggcatagatttcttgtccaaaacaatgtacctagaagatcgaacggttcgcttgcagctttgggacactgctgggcaagaaagatttagaagtctaatcccgagctacattagagattcttctgtggcggtgattgcctacgatgttgctaacagacagtcatttttgaacacttcaaagtggattgaggaagtaagaacagaacgtggtggcgatgtcatcatcgttctcgttggaaataaaactgatcttgttgacaaacggcaagtttccattgaagaaggcgatatcaaggctcgtgaattcggagtcatgttcgtagaaactagtgctaaagctggtttcaatataaagccactattccggaagatagctgcagcgctgccggggatggaggccctctcctccgcaaagcacgaggatatggttgacgtgaacttgaagccaaccgcaaacgggggccagaacgagcaacaaggcggaggctgcgcgtgctagggttgagatgaagctgaaaatggagaaagttaggagtctaaatgcattggaactcttcaatgtttgttgtcttggagttctgcaggttttgggctgaaaatggagaaagttggaactcttgaatgtttgttgtctaggagttctgcaggtttttgacacagagtgatgaaacagaaaagttttatatatattggttgtaccgcggtgtaaaacgaaaaccaagcacttggaattcatat

SEQ ID NO: 4296 - DNA, 906 bp, Glycine max
attttgttgcgagaagagaatttggtagattcagatctgcgttgtgtgtgtgtgtctgagaaaggagaaaaggtgagaaatggcgacggtgtcccctctcgccaaatacaagctcgttttcttgggcgatcaatccgttggcaaaaccagcatcatcacccgcttcatgtacgacaaatttgacacaacctaccaggcaactattggtattgactttttgtcaaaaacaatgtaccttgaagatagaactgttcgcttgcagctttgggatactgcagggcaagaaagatttagaagtctcattccaagctacataagagattcttctgttgcagttatagtatatgatgttgctaacaggcaatcatttctgaacactaacaagtgggttgaggaggttcgtacagaacgtggcagtgatgttattattgtgttggttggaaacaaaactgatcttgttgaaaaaaggcaagtttctatagaggaaggagatgcaaagtcccgtgagtttggaatcatgttcatagaaaccagtgccaaagcaggcttcaatatcaagcctttgtttcgtaagattgctgctgccttgccagggatggaatctctttcttctacaaagcaggaagacatggtcgatgtaaatttaaaacccacggtgaattcatcccagacagagcaacaaggaggaggttgctcatgctagagaagactattctcaaaacagccaataatttgttcactgaatataattctgagattggctgcttaaatggaatgatggaactggaggaaaagtgctttcatatcaatgatccttcagtttttgggtgagggggacaaattgcagtaggtattgatgtacgacacaaacattgatagttatttcgtttatttgttatacaatta

SEQ ID NO: 4297 - DNA, 878 bp, Glycine max
caactacatttcctccctctcttcgttttttgctctctcgaagtttgagagattcaggttcagatctgagcctattccgtgttactcacactctcaaacaacaaaaccaaaaataaaaaatggcgactgtgtcccctctcgccaaatacaagctcgttttcttaggcgatcaatcggtcggcaaaaccagcatcatcactcgcttcatgtatgacaaattcgacattaattatcaggctactattggtattgacttcttgtcaaaaacaatgtaccttgaagatcgaacagttcgtctgcagctttgggatactgcagggcaagaaagatttagaagtctgattccaagctacataagagattcttctgttgcagttgttgtatacgatgtagccaaccggcaatcatttttgaacactaacaagtggattgaggaggtgcgtacagaacgaggcagtgatgttattattgtattggttgggaataaaactgatcttgttgaaaaaagacaggtttctatagaggaaggagatgccaagtcccgtgagagtggaatcatgttcatagaaaccagtgcaaaagcaggcttcaatattaagcctttatttcgcaagattgctgcagccttgccagggatggaaacactttcttctacaaaacaggaagacatggttgatgtaaatttaaaacccaccgtgaattcatcccaggcagagcagcaaggaggaggttgctcttgctaaagaaaggctattcataacaagccaatataagtgtttcagtaagcacggtcatggaattggctactaaacggaaagatgcagctgaggtagacatgctttcataccaatgctcgtcagtgtttagttgggggagag

SEQ ID NO: 4298 - DNA, 694 bp, Ambrosia trifida
taacatttgatcacagatctaaatctaatcgcgtaggagacaggtctgaacaacaatggcggcggtgtcacctcttgccaaatacaaactggtgtttttgggcgatcaatccgtcggcaaaaccagcatcatcaccagattcatgtacgacaaattcgatactacctatcaggctaccattggcatcgatttcttgtcaaagacaatgtacctggaagatagaactgttcgattgcagctttgggatactgctggtcaggaaagatttagaagtctcattccaagctatataagagattcatcggttgcagtcgtcgtctatgatgtcgctaatcgacaatcattcttgaacactgcaaagtggatagaagaagtacgtactgaacgtggaactgacgtcatcatagttcttgttggaaacaaaactgatcttgttgacaaaaggcaagtttcaattgaagaaggagatggcaaagctcgggaattcggagtcatgtttatagaaaccagtgcaaaagccggattcaacatcaagcctttattccgaaagattgctggtgcattaccggggatggagacttttacctccacaaaacaagaagacatggttgacgtgaatttgaaatcttcgggtagcacatcacagtcagaacaacagggtggaggctgcccgtgctagagatgcattttgaat

SEQ ID NO: 4299 - DNA, 921 bp, Musa acuminata
tctttccccttcgcttcttccccatctgagttctatcgatcgatcgagagagaaagagagaggagaagaggaagaagtggagaaggccctaatggcggtggtctcggctctggcgaaatacaagttggtgttcttgggggaccagtcggtggggaagaccagcatcatcactcggttcatgtacgacaagttcgacaccacttatcaggccaccatcggcattgattttctatccaaaacaatgtaccttgaagaccgtacagttcgtctgcagctctgggacactgcaggacaggagagatttagaagccttattccaagctacattagagactcctctgttgcagttatcgtttatgatgtatctaatcggcaatcatttttaagcacttcaaagtggatcgaggaagtgcatacagaacgaggcggtgatgttatcatagttcttgttggaaataagacggatcttgttgacaaaagacaagtctcgacagaagaaggagaagcaaaagctcgtgaattcggagtaatgttcatcgaaactagtgcaaaggctggcttcaacatcaagcctttgttccgcaagattgctgcatcccttccggggatggagacactcgcttctgcgaaacaggaggacatggttgatgtcaatttgaagcccactgtcagttcaccagagactcagcagcaatctggaggctgctcgtgctgaagatataaccaggtttaagtacttgttcattaactaggggctaagaattcttgtgttcacctatgaaggttttgcaatgacgttatacaatgagggttctcttgattgtagcatctctgttgttccccatcccgcacttgttcgtttgtttgaggtggatatctttgtgcatactcttttgattttgttatttttattattatttc

SEQ ID NO: 4300 - DNA, 2975 bp, Cicer arietinum
taatcacttcaaaaatttaacaaaaggaaaagaatagtgagtttagtcacaaatataaacaaaattgatgtttatataatcaagaaaaataactttcattctacatagttccaactattttcttgaagcaacagtaccaataaaagaaagagtccttgagggggcgggttaaggtttctgtgaggatataagagtaaattgaaagaaagaaggggtgaaattggtcatagaaaagtcgagcgcggtagactagtaatcgtggttggcgcttcggggtgcccgtatatatatatatattcatttcacattcaaatcgcaacaggtggcgatcatcgtcaactgcattttctccctcttttcgttttcgctctaactgtttctctcgaattttgagagattcagatccagatccagatctgagccaaatccgggttactcacgtcacgttcccaaacaacaaagaaaaaaaaacctaaaaaagaaacaaaaatggcaaccgtttcacctctcgccaaatacaaactcgttttcttaggtgatcaatcggttggcaagaccagcatcatcactcgtttcatgtatgacaaattcgatactacctatcaggccactattggtattgattttttgtcaaaaacaatgtaccttgaagatcgaacagttcgattgcagctttgggataccgcaggacaagaaagatttagaagtctgattcctagctatatccgagattcttcggtcgcagttattgtatatgatgtagccaaccggcaatcatttcttaacactaacaggtgggttgaggaagtacgcacagaacgaggcagcgatgttgttatcgttttggttggaaacaaaactgatcttgttgaaaaaaggcaagtctctatagaggaaggagatgccaagtcgcgtgagagcggtatcatgtttatagaaaccagtgcaaaagcaggatttaatatcaagcctttatttcgcaagattgctgcagctttgcccgggatggaaactctttcttcaacaaaacaagaagacatggttgatgtaaatttaaaatccaccacgaattcatcccagacagagcagcaaggtggaggttgctcatgctaaaaaagtgctattcataacaaggccaatatgagtcagttcacttggcacaaattattggtttggctactaaaatggaaagatgcacgtaagccaaacgtgcttttgtaccaatgctcttcagtttagtttggtaggggttagcattgcagtaatggttttgatgtaagatataaaaaaatattttgaaaattatttaattttcttatacagttagtccctttatgtaagaatgcagataataaactgatctacaaattgtttaccagttgacaacttatggaggaggcatcgttagtttctgaagtatcggatgtttagataaagcttcaaacgggagcttttaaatactaaacgatatacaattttgatataatgcttaattgcagaaacagtgcctgtactgacattttatacaattttattagacggaatgttggttttacatcatgatgagttccgtggtttcatctcacgagctttccatagtcgcatctgatcacacccaccgttattccttcctgcaccttgattccaataagaggtctttttgggtacgtttccatataatgataaaattatgcgcatttgaaaatatcattaagtgtaataatgataaaatgaactttaatgactaaaagaccttactaatagagtagttagtaaaataattaaattcaattttgataaaagaaacaaatgttttgttagaaaaatgacgagagcgatagtagtgcactgtaagtgtaaaatgttttacattgacaagcaacatgagccattgacttcataatttttaataaattgaagttataattataaaataaaatcattcgatcaatggtaaccatttactgtcaatgtaaaattaatctacactgacaatacagtatcctttttctcaaataatataaaacaacaaatcaaaagtaacatgattaatatgagacaaagtaaaggatggagggagttttaggataaacgtaatgtacatttttgtgcacttcaacatcagaaggagcactatcacaattacaattaaaatgacatgtttaagctaaacaaccatagaaacttagaagtgtacacttattaagcaggaggcagagaagattggacctttacataagaacaaacccatcagccctttgcctgaccctcagtgtcagatatatcaataccaatgttcccaaacttgacctgcaaggtaattgattcatttagtgaattggtcaaatctagaaaaaagaacaaatgcctgtctttcaacaaaattttgataaaaaaattctcaaaacatagacgctaactagaaaaacatagaaacagttggtaagttttatttatgaagagtcataacataaggcctcctgttgaagctcagagcaattcacatacaaattgaacagccctaagcagggaagtcaattatgcaccttttcttttataattttctaagatgtatcctgtccttgaacaactaactgtgcaatatttcccactgcatggaatccactcttagaatttgttaagagtgttatacagttaatgctttttccattgatttgggcgttgataatagcaatatgtatttgacaaacagttaattggaaaactttcacctaaaatgaaacattgttaactttctggaagttgcatctctcgtaaactccatattttacaagatatgcaacgcataacaacaattcaccctctacattatgaattgcaagtttcaaaatcatatgtataaattcacaacaccaaccatttatcgagctttctgtttaaaataaaattacacaaacataagaaaaaagtttgacatattaggacttctatttgcttattgaacacttcagttg

SEQ ID NO: 4301 - DNA, 1428 bp, Cicer arietinum
agaaactttattttgaggaaaggagggaaagaagagttaagagaaagatgggggacgaaaaaggtaataaaaaaaagttggcatgagctggtactcaacgtggctggcggtttccactctgatatataaatacgacgcagtcgaaaatggcgtgtgtaattggtcatcgtctctcattctctctgtatattcattcttcttgaaaagggattttgagagattcattaattaattcagatctgcgataagagaagaataggatttttttttttggtcataaatggcgacggtttcccctctcgccaaatacaagctcgttttcttaggcgatcaatcggttggtaaaaccagcatcatcacccgtttcatgtacgacaaattcgacacaacctatcaggctactattggtatcgattttttgtcaaaaacaatgtaccttgaagatagaactgttcgtctgcagctttgggatactgcaggccaagaaagatttagaagtcttattccaagctacataagagattcttctgttgcagttattgtatatgatgtagctaacaggcaatcatttctgaacactaacaagtgggttgaggaggtacgtcaagaacgtggcagtgatgttatcattgtattggttggaaacaaaactgatcttgtcgataaaaggcaagtttctatagaggaaggagatgccaagtcccgagagtttggaatcatgtttatagaaaccagtgcaaaagcaggcttcaatatcaagcctttgtttcgtaagattgcttctgccctgccagggatggaaactctttcttccacaaagcaggaagacatggttgacgtaaatttaaaacctacggtgaattcatcccagacagagcagcagggaggaggttgctcatgttagagaagattcttctatgttcggtagatatatatatatatatatatatatgttcacagagtatattactgggaatgactgtttcaatgtaaagtgaaactggaggaagcgtgctttcacagcaatgatccttcagttaattggtgtgagggacaaattgcggcaatgattttgatgtatgacaaaagagattggtagttttttttttttttcatttgttatacaattagccctggatgtaagaatacaggtaataaacaagccctctaagttgtctgtcttaggtgtatgttatcctttgtttttgtcaaatatttcattcttgaagagatgactgtataacactctgatcggacccccttttgctttaggacactcattggccctatcaaaagcagagttgcatactttgtagggatgattgtggattttggggttgacttgataatatgactaatctgaaccgaacaaatctattttttaagggtaaaaatacttcattaacaaacacaaatggaaggaaaaac

SEQ ID NO: 4302 - DNA, 998 bp, Chrysanthemum coronarium
ataaaaaactcagaaaaatatgattggttagtcggaaacacacataaatcaatttcaaatcaattctaaatctgatttcacaattcacaataatcctctagttagggtttataagtggatcataatcacattcaacaccaacgtacaccttcattttttgtgaaaaatgccgccagtatcagcattagcaaagtacaaactagtcttcttaggcgatcaatcagtcggtaaaaccagcattatcactcgcttcatgtacgataagttcgacacctcttatcaggcaactattggaattgatttcttgtcgaagacgatgtatcttgaagatcgcactgttcgtctgcagttgtgggatacagccgggcaagagagatttaggagtctgattccaagctatataagggattcttctgttgcagtcatcacctatgacgttgcaagtcggcagacttttcttaacactataaagtggattgaggaagtccgtgctgagaggggtagcgatgttatcattgttctggttgggaacaaaactgaccttgtggacaaaagacaagtctctgttgaggaaggagaagcgaaagctactgagctaaaggtcatgtttattgagacaagtgctaaagctgggttcaacataaaggctttgtttcgaaaaatcgcagctgcgttaccaggagtggaaacactttcctcaacaaaacatgaagaaatggtcgatgtgaatttgaagtcctcaagcgctagctcatcccagcctgaatctggtggttgtgcttgctgatcaaacgccaagccacggcttattgtcatttctccactccgaatctccaatgatggtggttaatcttgttactggttcaacaattttgcttccagctcgtgttaagttccaggtgcaatttcaaaatgctggaaacaaaagtattcaactagaacccttatgtttattgctttggttttatcatttactacaggtgtatgtaacgatttca

SEQ ID NO: 4303 - DNA, 987 bp, Trifolium pratense
aacaagagagaacaattaaagatctctcataaatggcgacggtttcacctctcgccaaatacaaactcgttttcttaggcgatcaatctgttggcaaaaccagcatcatcacccgtttcatgtacgacaaattcgacaccacctatcaggctactatcggtattgactttttgtcaaaaacaatgtaccttgaagatcgaacggttcgtttgcagctttgggatactgcaggacaagaaagatttagaagtctaattccaagctatataagagattcttcggttgcagttattgtatatgacgtagccaatcgacaatcatttcttaatactaacaagtgggttgaggaggtacgcacagaacgaggcagtgatgttattatcgttttggttggaaacaaaactgatctagttgaaaaaagacaagtctctatagaggaaggagaagccaagtcgcgtgagaccgggatcatgtttatagaaaccagtgctaaagcaggatttaatatcaagcctttatttcgcaagattgctggagccttacctgggatggaaactctttcttcaacaaagaatgacgacatggttgatgtaaatttaaaatccactgtgaattcgtcccaggcagatcagcaaggaggaggttgctcgtgctaaacaagtgctattcacaacaaagccagcatgaatcttttcacttggcacagttattggcttggcaactaaaatggaaacatgcacctaggccagacgtgcttttgtaccaacgctcttcagcttagtttggtagggttagcacttagcagtaatggtttcgatgtaagataaaataagaaactaaaaatactttgataattttgttttattttcttatgcagttagtcactttatgtaagaatgcatataataaactgatctaaacattactggttgacatggagtagacatcatcaagtaatggatacttagataaagcttcaaaatggag

SEQ ID NO: 4304 - DNA, 991 bp, Trifolium pratense
atccccaaaaatggcaactgtatctcctctcgccaaatacaaactcgttttcttaggtgatcaatccgttggtaaaaccagcatcatcactcgcttcatgtatgacaaattcgacaatacctatcaggccactatcggtattgactttttgtcaaaaacaatgtaccttgaagatcgaacggttcgtttgcagctttgggatactgcaggacaagaaagatttagaagtctaattccaagctatataagagattcttcggttgcagttattgtatatgacgtagccaatcgacaatcatttcttaatactaacaagtgggttgaggaggtacgcacagaacgaggcagtgatgttattattgttttggttggaaacaaaactgatctagttgaaaaaaggcaagtctctatagaggaaggagacgccaagtcgcgtgagaccgggatcatgtttatagaaaccagtgctaaagcaggatttaatatcaagcctttatttcgcaagattgctggagccttacctgggatggaaactctttcttcaacaaagaatgacgacatggttgatgtaaatttaaaatccactgtgaattcgtcccaggcagatcagcaaggaggaggttgctcgtgctaaacaagtgctattcacaacaaagccagcatgaatcttttcacttggcacagttattggcttggcaactaaaatggaaacatgcacctaggccagacgtgcttttgtaccaacgctcttcagcttagtttggtagggttagcacttagcagtaatggtttcgatgtaagataaaataagaaactaaaaatactttgataattttgttttattttcttatgcagttagtcactttatgtaagaatgcatataataaactgatctaaacattactggttgacatggagtagacatcatcaagtaatggatacttagataaagcttcaaaatggaggcttttatcgaccaaatgttatcatg

SEQ ID NO: 4305 - DNA, 1128 bp, Cynara scolymus
gcggggtatgtagctgttgattttgggcacggagactcaaaaccgactgcgaaaacagtgactctacaactcaaatctgcaacagtttttcgctgaatcatcaaactctagtaccgcttgattgttgtgatttgatcaaatcaaagtcaagaaaatggcaccagtatcagcactagcaaagtacaagctggtgttcttgggtgatcaatccgtcggcaaaaccagcattatcactcgttttatgtatgataagttcgatacctcttaccaggcaaccattggaattgacttcttgtcaaagacgatgtatcttgaagatcggacagttcgtctgcagttgtgggataccgctggacaagagagatttaggagtctcattccaagttatataagggattcttcggttgctgtcattacatatgatgttgcaagtcggcagacttttcttaacactataaagtggattgaggaagtccgtgcagagagaggcagtgacgttatcattgttctggttggaaacaagactgaccttgtggacaaaaggcaagtctcagtagaggaaggagaaacgagagctagtgagctgaaagtcatgtttatcgaaacaagtgctaaagctgggttcaacataaaggctttatttcggaaaatagcagtggcattaccaggaatggaaacactttcctcaacaaaacatgaagaaatggttgatgtgaatttgaagtcttcaaacatgacttcttcccagccagaatccggtggttgtgcttgctgatacaatgcctgttactgttgctgctactgcttcaacccgactcgtgtaaagttccagatgcatgctattcaactggtctggaacccctatgtttattggtttgttatacttgtcatttaccagaaatgtatgtaacaatttcatttttttccacctttcaatcggtacatttgtaacggaagtagaccccccttgtgagttctcgaggtttagtttgtcatgtataaaaggatttgcgtacaatcgcccagatttcgattcagctttctatcgatcgacgaagatacaatgtggtttgacccgaccaaaaaaaataaaaagggccgcctcgtccaatcgactctaggctcgaa

SEQ ID NO: 4306 - DNA, 873 bp, Nicotiana benthamiana
gtttagtttgtgtgtaaggaaaacccaaaaatggcggtggtgtcgccattagcaaagtacaagcttgtgtttttgggagatcaatctgtgggcaaaaccagcattattactcgcttcatgtacgataaattcgacaccacttatcaggctaccattggtattgattttttatcaaagacaatgtaccttgaagatcgtacagttcgcttgcagctctgggatactgctggtcaagagagatttaggagtcttattccgagctacattagagattcttctgttgctgtcattgtatatgatgttgccaaccgccaatcatttcttaacacttcaaagtggattgacgaagtacgtactgaacgtggcagtgatgtcattattgttcttgttgggaacaaaactgatcttgttgataaaaggcaagtctccacagaagaaggagatgctaaggctcgtgaatttggagtaatgtacatagaaaccagtgctaaagctggattcaatatcaagcctctattccgaaagattgctgctgcgctacctgggatggagacactatcatccacaaaaggggaagatatggtggacgttaatttgaagcctaccacaaatacatcccaaaatgagcagcaagggggaggttgtgcatgctagattttacttaaaagaatgtagactttttcttctatgatgtacaacaacttgttatgactccatcaaagaggtaaccgaagacagtctgaccattgagaacgcgcttgttagtgtcatcgcatttttgtttaaactccttgtgtttatatgtcatggttcctacttcctagctagttcaggaaccttttttgttctggataaatctccgagctcaatata

SEQ ID NO: 4307 - DNA, 689 bp, Capsicum annuum
agaagaagaaattgaataataataataataatggcggccgtatcgccattagcaaaatacaagcttgtgtttttgggagatcaatctgttggaaaaacaagcatcattactcgtttcatgtacgataaattcgacaccacctaccaggctaccatcggtattgactttttgtcgaagacaatgtaccttgaagatcgaacagttcgcttgcagctctgggatactgctggtcaagagagatttaggagtcttattccgagctacattagagattcttctgtcgctgtaattgtgtttgatgttgtcaaccgtcaatcatttctaaatacttcaaagtggattgaggaagtacgtactgaacggggaactgatgtcataatcgttcttgttgggaacaaaactgatcttgttgagaaaagacaagtatccatcgaagaaggagaaaccaaggctcgtgaatttaacgtaatgtttatagagactagtgcaaaagctggattcaatatcaagcctctgttccgaaagattgctgcagctttaccgggaatggaaagcctttcatccacgaagcaagaagatatggtggatgtgaatttgaagcctacctcaagttcatctcacgcagagcagcaaggtggaggttgcgcatgctagactttgtacgtaacaagagagagataagaagttgg

SEQ ID NO: 4308 - DNA, 1149 bp, Cajanus cajan
ggtgttggtcatcgtcaactacattttctccgtctcttcgtttttgctctttctgtctctctcgagctctgagagattcagattcagatctagatcagatctgtaactattccgtgttactcacgtttccgaagaacaaaaccaaaaaaaccaaaaaaaaaaaaagaagaaaaatggcgactgtgtcccctctcgccaagtacaagctcgttttcttaggcgatcaatcggttggaaaaaccagcataatcactcgcttcatgtatgacaaattcgacactacctatcaggctactattggtattgacttcttgtcaaaaacaatgtaccttgaagatcgaacagttcgtctacagctttgggatactgcaggacaagaaagatttagaagtctcattccaagctacataagagattcttctgttgcaattgttgtctatgatgtagccaaccgacaatcatttttgaacactaacaagtggattgaggaggtgcgtacagaacgaggaagtgatgttattattgtcttggttgggaacaaaactgatcttgttgagaaaaggcaggtttctatagaggaaggtgatgccaagtcccgtgagagtggaatcatgttcatagaaaccagtgcaaaagcaggcttcaatattaagcctttatttcgcaagattgctgcagcattgccagggatggaaactctttcttcttcgaaacaggaagacatggttgatgtaaatttaaaacccaccgttaattcatcccagacagagcagcaaggaggaggttgctcgtgctaaagaaagcctattcacaaaaagagccaatacaagtctgtttacttggcacaattatgggattagctcctaaaatggaaagatactgttgaggtagacttgggggagaggggttgccagtaatggttttttgtgtaagataaaaaaaataaaaaataaaaataaaaaaacgttagttatatgtttcattttatttattatgcaattagactctttatgtaagaatgcaggttacaaggttgtataaaaattgtttctggttgacatgattgaggaatcaccagcttttcatttgctatatgttaggataaaggactcaaacaggagcttttaaagaaaacaatatcatggacaa

SEQ ID NO: 4309 - DNA, 1005 bp, Prunus mume
aagaagagaaaaagaaaaaaaagcgttaagtcattttcctctttgctcttctgagattcagatccaaacatccacaaaagaaggaaacctgggagggagctgaacaatcttgaaaatggcgacggtgtctcctctggctaaatacaagctggtcttcctgggcgatcagtccgtcggaaaaaccagcatcatcacccgcttcatgtacgacaaattcgataccacctatcaggctacgattgggattgattttctgtcgaaaacgatgtaccttgaagatcggacagttcgtttgcagctttgggatactgcagggcaagaaagatttaggagtctcattccaagctacatcagggattcctctgttgcagtgattgtttatgatgtagctaatagacagtcatttctgaacactaataagtggatagaggaagtacgaacagaacgaggaactgatgtcattatcgtgcttgtggggaacaaaactgatctcgtggataaaagacaagtctctatagaggaaggggattccaaatctcgtgagtttggagtcatgttcattgaaactagtgcaaaagcaggatttaatatcaagcctttattccgcaagattgctgctgcattaccagggatggaagccctttcctcaacaaaacaggaagacatggtcgatgtaaacctgaagccgacgattaattcatcccacacagagcagcaaggagggtgtgcatgctaggcggccggctattcattattcaaaaggaaaaagagaaagcaattagcataatccaaattcagccaacatagtgatctatattagtataagctatattttgacggcaatgtgaagcgacatatatctaatgctttctgtcccattatgtaatcgtacaatttcagtgttcataggaaactaaaggtagcaactcttgtgttctttctaacctactagaaattaaatgacagcttggatttttcttacaattccatgaccatatttatccc

SEQ ID NO: 4310 - DNA, 684 bp, Prunus persica
gagattcagatccaaacatccacaaaagaaggaaacgtgggagggagctgaacaatcttgaaaatggcgacggtgtctcctctggctaaatacaagctggtcttcctgggcgatcagtccgtcggaaaaaccagcatcatcacccgcttcatgtacgacaaattcgataccacctatcaggctacgattgggattgattttctgtcgaaaacgatgtaccttgaagatcggacagttcgtttgcagctttgggatactgcagggcaagaaagatttaggagtctcattccaagctacatcagggattcctctgttgcagtgattgtttatgatgtagctaatagacagtcatttctgaacactaataagtggatagaggaagtacgaacagaacgaggaactgatgtcattatcgtgcttgtggggaacaaaactgatctcgttgataaaagacaagtctctatagaggaaggggattccaaatctcgtgaatttggagtcatgttcattgaaactagtgcaaaagcaggatttaatatcaagcctttattccgcaagattgctgctgcattaccagggatggaagccctttcttcaacaaaacaggaagacatggtcgatgtaaacctgaagccgacaactaattcatcccacacagagcagcaaggagggtgtgcatgctag

SEQ ID NO: 4311 - DNA, 1148 bp, Sciadopitys verticillata
tctcgggatcgaatttcagaaagtgccggcacccaataaatctatagacatttgaatagaaacaaaaatgagtacgaccatggcgactgtatcgcctctagccaaatataagctagtgttcttaggagatcagtctgttgggaagactagcattatcactcgtttcatgtatgacaaatttgacaatacatatcaggccaccattggtattgactttttgtcaaagacaatgtaccttgaggatcgaactgttcgtttgcagctatgggatactgcaggccaggagcgattccgaagtctcatcccaagttacattcgagattcgtctgttgctgtcatagtttatgatgtttcaaatcgccagtcctttctcaatactgcgagatggattgaagaagtccgtacagagcgtggtagtgatgtaattattgtacttgttggaaacaaaacagatctggttgacaaaaggcaagtttcgattgaggaaggtgatgcaaagtcacgggagtttggggtgatgttcattgaaacaagtgcaaaagcaggttttaatataaaggccttgtttcgcaagatagcagctgctttacctggaatggaagccctctcatcaaccaaacaggaagacatggttgatgtgaatttaaaacctgcagtgtctgtatctcaacaagagaacaaagcaggaggatgcgcttgttaagagtgaatgatgctttattccttcttggttgctacatttttgtacgacttagttggatgtcaggttgtcttcaaagctcttggagcatcatctgaataagatacatttcttatggtgtcctggcggcggcaagtcatgtatattgggaaatagaagattggaatgtccaatattgccgtgcaaatacatctcttatggaagattgtatggaatattctttttgttgagaaaataagttttagtagctttacaaaagtgatggtcaataacataatgctctatggatgttttgaatcaacttatggctgtaagttggagtctttcctccatattacacattactttgtactctttgctaggtgagtgttttcatttttaggacatggatttgggatcatcatcttgaaagttgaactagtaatggaattgagagcttctattgttt

SEQ ID NO: 4312 - DNA, 1066 bp, Senecio madagascariensis
aaacagtgaatagccagccgagattcgatgaatacttgaatagtattacgactccatttcaattccaaatcaaaacaaacacacaaaatttacaaattctcataatccgctacttaatctctgtgaaattgattgataaaaatatctgaaaatgccaccagtttcagcactagcaaagtataaactggtgtttttaggcgatcaatcagtcggtaaaaccagcattatcactcgttttatgtatgataaatttgatacttcttatcaggcaaccattggaattgattttttgtcgaagacaatgtatcttgaagatcgtactgttcgtctacagttgtgggatacagctgggcaagagagatttaggagtttgattccaagctatataagggattcttcagttgcagtcattacctatgatgttgcaagtcggcagacttttcttaacaccataaagtggattgaggaggttcgtgcagagagaggtagtgatgttatcattgttcttgttggaaacaagaccgaccttgtcgacaaaaggcaagtttcggtagaggaaggagaagcaaaagctagtgaactcaaggttatgtttattgaaacaagtgctaaagctgggttcaacataaaggctttatttaggaaaatagcagctgcattaccaggaatggaaacactttccgcaacaaaacatgaagaaatggttgatgtgaacttgaaatcttcaaacatgacttcatctcagcctgaatctggtggctgtgcttgttgatcaaagccgaaccacaactctacaatttgccttcgacctgtgtaaagttccagatacttgtgcggaagattggaaatgaaaatattcaagtggaacccttacgtttattgctttggtattggcatttactacaaatatatctcttttttttctttcaaatcaattccatatgttacggtaatagaattcgtttgtgtgtacttgagcgtagtttctactttctcgtgtgtaaaaagatttttgtagaattgcgattttgatattattttatattgatcaatggttgtttagaaa

SEQ ID NO: 4313 - DNA, 1195 bp, Glycine max
ccaccatacattacgttaaatttggtcatcctttccttctctctctttcttctgaattttgttgcgagaagagaatttggtagattcagatctgcgttgtgtgtgtgtgtctgagaaaggagaaaaggtgagaaatggcgacggtgtcccctctcgccaaatacaagctcgttttcttgggcgatcaatccgttggcaaaaccagcatcatcacccgcttcatgtacgacaaatttgacacaacctaccaggcaactattggtattgactttttgtcaaaaacaatgtaccttgaagatagaactgttcgcttgcagctttgggatactgcagggcaagaaagatttagaagtctcattccaagctacataagagattcttctgttgcagttatagtatatgatgttgctaacaggcaatcatttctgaacactaacaagtgggttgaggaggttcgtacagaacgtggcagtgatgttattattgtgttggttggaaacaaaactgatcttgttgaaaaaaggcaagtttctatagaggaaggagatgcaaagtcccgtgagtttggaatcatgttcatagaaaccagtgccaaagcaggcttcaatatcaagcctttgtttcgtaagattgctgctgccttgccagggatggaatctctttcttctacaaagcaggaagacatggtcgatgtaaatttaaaacccacggtgaattcatcccagacagagcaacaaggaggaggttgctcatgctagagaagactattctcaaaacagccaataatttgttcactgaatataattctgagattggctgcttaaatggaatgatggaactggaggaaaagtgctttcatatcaatgatccttcagtttttgggtgagggggacaaattgcagtaggtattgatgtacgacacaaacattgatagttatttcgtttatttgttatacaattagtcccttgatgtaagaatacaggtaataaacaagctctacaaattgttcctccgtccagcccttttcttttggtggcactcatcgtcctatccaaagcagaattgcctgggttttagggggtgattatggatcttgtttgacttaaaggctcaaccaacctgactactgaccgaaccattctataaaacttatctctttaacacactcgaccataagagcgtcttagagaatcg

SEQ ID NO: 4314 - DNA, 1176 bp, Glycine max
tagtcatcgtggttggcgctttctgacgccgtgtataaaaagcattgtactttgaaattgcaactggtgttggtcatcgtcaactacatttcctccctctcttcgttttttgctctctcgaagtttgagagattcaggttcagatctgagcctattccgtgttactcacactctcaaacaacaaaaccaaaaataaaaaatggcgactgtgtcccctctcgccaaatacaagctcgttttcttaggcgatcaatcggtcggcaaaaccagcatcatcactcgcttcatgtatgacaaattcgacattaattatcaggctactattggtattgacttcttgtcaaaaacaatgtaccttgaagatcgaacagttcgtctgcagctttgggatactgcagggcaagaaagatttagaagtctcattccaagctacataagagattcttctgttgcagttgttgtatacgatgtagccaaccggcaatcatttttgaacactaacaagtggattgaggaggtgcgtacagaacgaggcagtgatgttattattgtattggttgggaataaaactgatcttgttgaaaaaagacaggtttctatagaggaaggagatgccaagtcccgtgagagtggaatcatgttcatagaaaccagtgcaaaagcaggcttcaatattaagcctttatttcgcaagattgctgcagccttgccagggatggaaacactttcttctacaaaacaggaagacatggttgatgtaaatttaaaacccaccgtgaattcatcccaggcagagcagcaaggaggaggttgctcttgctaaagaaaggctattcataacaagccaatataagtgtttcagtaagcacggtcatggaattggctactaaacggaaagatgcagctgaggtagacatgctttcataccaatgctcgtcagtgtttagttgggggagaggggtttgcagtaatagttttttatgtaagataaaaaaaaaatggtattcatctgtttcattttatagttagtccctttatgtaagaatgcacttgcaggttatatacttgtataaaaatttatttactggatgacgtgaaggaggcatcaccgatttttaacttactactagttaagataaaaggatttaaactggagctttgttggaagtattttcg

SEQ ID NO: 4315 - DNA, 1051 bp, Ambrosia trifida
ctcacgagtgtagtataacagtgaggtttgtcccatccgatgcttgatcaatagtatagcgaccccattgtttgaaaatcaattcaaactcgactgcgcaaacagagaatttaacgaccaaattgttcagcatattgttctaattggatcaaataaaagtaaaactcaagatctagattgaaacaaatggcaaagccagtatcagcactagcgaaatacaagctggtgttcttaggtgatcaatccgtaggcaaaaccagcatcatcactcgttttatgtatgacaagttcgatacctcttatcaggcaaccattggaattgacttcttgtcaaagacaatgtatcttgaagatcggaccgttcgcctgcagttgtgggacacggctgggcaagagagatttaggagtctcataccaagctatataagagattcttctgttgcagtgatcatctatgatgttgcaagtcgacagacttttctaaacactataaagtggattgaggaagttcgtgcagagagaggtagtgatgttattattgttctggttgggaacaagaccgatcttgtggaaaaaaggcaagtttctgtagaggaaggagaagcaaaagctaatgagttaaatgtcatgtttatagaaacaagtgctaaagctgggttcaacattaaggctttatttagaaaaatagcagcggcgttaccaggaatggaaacgctttcctcaacaaaacacgaagaattggttgacgtgaatttgaagtcttcaagtgtgacttcatcccagcctgaatctggtggctgttcttgttgatggactcttgatttcggctcaacaatttgcaaggtcagaaacagaaatatatcaaccggaacgctcatattatatttattggtatcatcatttatgattaatgtatgtaaccatttctctctttttgacttttcaatcaattcagtttgttcttgactcgttattcgtcgtgtgtaaaaagattttatgtagaattgccaggatggagttttattcgtattggttaatgatatgtggtttg

SEQ ID NO: 4316 - DNA, 1016 bp, Artemisia annua
ctcgcgtgtcgaaaaatcaaatccaaacacaaacacacgttttctttcttttgtttagatagatctaagaaggaagaataagatgtcaccattagcgaaatataagctagtatttttgggggatcaatcagtgggtaaaacaagtatcatcaccagattcatgtatgacaaattcgataccacctatcaggccaccattggaattgatttcttgtcaaaaacaatgtaccttgaagatacaactgttcgcttacagctttgggatactgccggacaggaaagattcaggagtctcattccaagctatataagagattcatcagttgcagtgattgtctatgacgttgcaaatcgacagtcattcttgaacactgccaagtgggtagaagaagtacgtactgagcgaggcaccgatgtcattatagtccttgttgggaacaaaactgatcttgttgataaaaggcaagtttctattgaagaaggagatgccaaagctcgtgaattcggagttatgtttatagagaccagtgcaaaagctggattcaacatcaagcccttattccgaaagattgctgctgccttgccgggaatggagactctttcctctacaaaacaagaagacatggttgacgtgaatttgaaatcttcaggtaatgcttcacaatcagagcagcaaggtggagggtgtgcttgctagatcatttagcgatgctttaacagaggaagactatagagtcaagagatgatgctttttgcaatcggctggttggtaagttaaatttgttgataattttgatttgcaagtgacatgaaagtaagaagatatgatgtatatcttcagtatacctttttagcttttattatttacttctatagagctagacattggtggtttgacgaaacagaaggttgatttcttcttcttttttcattaagaacctgatgtgtataattaactaagatgattgtttaaactatcgattttatataattgaatatagcagcacattccgaaa

SEQ ID NO: 4317 - DNA, 806 bp, Brassica oleracea
tgacgatcgatctctcgagagcgaaaaaaaatggcggcggtgacaccattagcaaagttcaagctcgtcttcctcggagatcaatccgtcgggaagaccagcatcatcacccgtttcatgtacgacaaattcgataccacttatcaggcaactattgggattgattttttgtcgaagacaatgtaccttgaggataggactcttcgtctccagctatgggatactgccgggcaggaaaggtttcgaagtctgataccaagttatatcagagattcctctgttgctgtcattgtctatgatgttgctaacaggcagtcattcttgaacacctcgaagtgggttgaggatgttcgtacagagagaggtaacgatgtcataattgttctggtgggtaacaaaacagatctcgttgacaagaggcaagtgtcgatagaagaaggggataacaaagctcgggactttggagtgatattcatagagacgagtgcaaaagcaggatttaacatcaagccactattccgaaagatttcagcagcattaccaggaatggatacactttcttcagcgaaacaaggcgatatggttgatgtcaacctaaagtcatccaaccattcgtctcaagcggagcaacaaagtggtggctgttcgtgttgattaatttttgttaaaaaatatacttttaacagcaacagagtaaggaggttcttaaaaaaagattcataacttgattgagtaaataaactctggtgtaaggaaagagaatttttacttggcaactctagtattctttaagatgttttgagttc

SEQ ID NO: 4318 - DNA, 1004 bp, Brassica rapa
ctttatcaataaaaattatattggcggttacttttcgcgtctacagagccataatataaacgcgtcaaactcaaacctcgtcttcgactctcacctgaaaaatcgaaacctctcagatctaatcccctccatcgttacggtgacgatcgatctcttgacagcgagaaatggcggcggtgacaccattagcaaagttcaagctcgtcttcctcggagatcaatccgtcggcaagaccagcatcatcacccgtttcatgtacgacaaattcgacaccacttatcaggcaactattgggattgattttttgtcgaagacaatgtaccttgaggataggactcttcgtctccagctatgggatactgccgggcaggaaaggtttcgaagtctgataccaagttatatcagagattcctctgttgctgtcattgtctatgatgttgctaataggcagtcattcttgaacacctccaagtgggttgaggatgttcgtacagagagaggtaacgatgtcataattgttctggtgggtaacaaaacagatctcgttgacaagaggcaagtgtcgatagaggaaggggataacaaagctcgtgactttggagtgatattcatagagacgagtgcaaaagctggatttaacatcaagccactattccgaaagatttcagcagcattaccaggaatggatacactttcttcagcgaaacaaggcgatatggttgatgtcaacctaaagtcatccaaccattcgtctcaagcggagcaacaaagtggtggctgttcgtgttgattaatttttgttaaaaaatatacttttaacagcaacggagtatggagatttttttaaagattcacaacttgattgagtaaataaactctggtgtaaggaaagagaatttttacttggcaactcctagtattctttaagatgttttgagttcaatattgagctgtgtaataatgacgcttgaaagcttaagacaaaatgttttgctctgttctg

SEQ ID NO: 4319 - DNA, 978 bp, Musa acuminata
ctttcttttgtctcttcgccatctgagatctgccgaacgagaagacagaggagaggagaggagaggcaaaggagggaaaaaagataatggcggtggtatcggctctggcgaaatacaagttggtgttcttgggggatcaatcggtggggaagaccagcatcatcacccggttcatgtacgacaaattcgataccacctatcaggctactatcggcattgattttctatcaaagacgatgtaccttgaagaccgtacagtacgtctgcagctttgggatactgctggccaggagagatttagaagtcttatcccaagctacatcagggactcttctgtcgcagttattgcttatgatgtatctaatcggcaatcgttcttaaatacttcaaagtggatcgaggaagtgcgtacagaacgaggtggcgatgtaatcatagttcttgtcggaaataagacggatcttgttgagaaaaggcaagtctcgacagaagacggagaaaccaaatctcgtgaatttggagtgatgtttattgaaaccagtgcaaaagctggcttcaacatcaagccactgttccgcaagattgctgcatccctgccagggatggagactctcgcttccactaaacaggaggacatggttgatgtcaatttgaagtctacagttagttcaacacagactcagcagcaatctggaggatgttcgtgctagagaggttccaaatcgaaatatcttgaagaaattctttatcaaccaatgtaagttttgattcgtttagcaattgaaattttgatagtagactggagaaccatcgatagtatttatcaagtcgcttgatcgttgattgtagcatctctgttgttccagttcttgtttcttctttcgacatgacttttcattttcctttttgttttgtttttttgtgcgtgtggtcccgtacacattataatgtattatgttgctcgaagttatagcatcc

SEQ ID NO: 4320 - DNA, 902 bp, Brassica napus
ggattctcacctgaaaaatcgcaaaactctcagatctgctaatacatctataccgttacggtgacgatcgatctctcgagagcgaaaaaaaatggcggcggtgacaccattagcgaagttcaagctcgtcttcctcggagatcaatccgtcgggaagaccagcatcatcacccgtttcatgtacgacaaattcgataccacttatcaggcaactattgggattgatttcttgtcgaagacaatgtaccttgaggataggactcttcgtctccagctatgggatactgccgggcaggaaaggtttcgaagtctgataccaagttatatcagagattcctctgttgctgtcattgtctatgatgttgctaacaggcagtcattcttgaacacctcgaagtgggttgaggatgttcgtacagagagaggtaacgatgtcataattgttctggtgggcaacaaaacagatctcgttgacaagaggcaagtgtcgatagaagaaggggataacaaagctcgggactttggagtgatattcatagagacgagtgctaaagcagggtttaacatcaagccactattccgaaagatttcagcagcattaccaggaatggatacactttcttcagcgaaacaaggcgatatggttgatgtcaacctaaagtcatccaaccattcgtctcaagcggagcaacaaagtggaggctgttcctgttgattaatttttattaattatacttttaacagcaacagagtaaggaggttcttaaaaaaagattcataacttgatggagtaaataaactctggtgtaaggaaagataatttttacttggcaactctagtattctttaagatgttttgagttcaatattgagctgtgtaataaagacgcttgaaagcttaa

SEQ ID NO: 4321 - DNA, 814 bp, Brassica napus
aatggcggcggtgacaccattagcaaagttcaagctcgtcttcctcggagatcaatccgtcgggaagaccagcatcatcacccgtttcatgtacgacaaattcgacaccacttatcaggcaactattgggattgattttttgtcgaagacaatgtaccttgaggataggactcttcgtctccagctatgggatactgccgggcaggaaaggtttcgaagtctgataccaagttatatcagagattcctctgttgctgtcattgtctatgatgttgctaataggcagtcattcttgaacacctccaagtgggttgaggatgttcgtacagagagaggtaacgatgtcataattgttctggtgggtaacaaaacagatctcgttgacaagaggcaagtgtcgatagaagaaggggataacaaagctcgtgattttggagtgatattcatagagacgagtgcaaaagctggatttaacatcaagccactattccgaaagatctcagcagcattaccaggaatggatacactttcttcagcgaaacaaggcgatatggttgatgtcaacctaaagtcatccaaccattcgtctcaagcggagcaacaaagtggtggctgttcgtgttgattaatttttattaaaaaatatacttttaacagcaacggagtatggagatttttttaaagattcacaacttgattgagtaaataaactctggtgtaaggaaagataatttttacttggcaactcctagtattctttaagatgttttgagttcaatattgagctgtgtaataatgacgcttgaaagcttaa

SEQ ID NO: 4322 - DNA, 645 bp, Cedrus atlantica
gccatggcgactgtctcgcctcttgcgaaatataagcttgtgtttttgggagatcagtctgtcggcaagaccagcattatcactcgcttcatgtatgacaagtttgacaacacatatcaggctaccattggtattgacttcttgtcgaagacaatgtaccttgaggatcgaactgttcgtttgcagctttgggatactgcaggccaggaacgattccgtagtcttatcccaagttacattcgagactcttctgttgctgtcattgtctatgatgttgcaaaccgacagtccttcttgaacactgccagatggattgaagaagtacgcacagagcgaggtagtgatgtgattattgtgcttgtgggaaacaaaacagatctggttgacaaaaggcaagtctccattgaggaaggtgatgcaaagtctcgggagttaggggtgatgttcattgaaaccagtgcaaaagctggatttaacattaaggccttgtttcgtaagatagcagctgcattacctggaatggaagccctctcatcaaccaataaggaagacatggttgatgtgaatttaaaaaccacagtgcccgcaattcaagcagagaagaaggcaggaggatgctattgctgagtatgaaatattgctttg

SEQ ID NO: 4323 - DNA, 720 bp, Centaurea maculosa
tcagctcaataatggcggtggtatcacctcttgccaaattcaaactggtatttttgggtgatcaatccgtcggcaaaaccagtatcatcacaaggttcatgtatgacaaattcgataccacctatcaggctaccattggcattgatttcttgtcaaaaacaatgtaccttgaagatagaacagttcggttacaactttgggatactgctgggcaggagagatttaagagtctcattccaagctatataagagattcatcggttgcagtggttgtctatgatgtcgctaatcgacagtcattcttgaacactgcaaagtggatagaagaagtacgtaccgagcgaggcactgatgtcattattgtccttggtgggaacaaaaccgatcttgttgacaaaaggcaagtttcgattgaagaaggagatggcaaagctcgtgaattcggagtcatgtttatagaaactagtgcaaaagctggattcaacatcaagtctctatttcgaaagattgctgctgcattgccggggatggagactctttcctctacgaaacaagaagacatggttgatgtaaatttgaaatcttctggtaatgcttcaaagtcagagaaacaaggtggcgtttgtgcgtgttagttagtttgtaatggggttagtaacacggattttgttcatagttttgatttcttagtaacaagatgatcccccaacctttctagaa

SEQ ID NO: 4324 - DNA, 664 bp, Cucumis sativus
gctacactctttttcccttcatggcgacggtttctcctctcgccaaatacaagctcgtcttcctcggcgatcaatccgttggtaaaaccagcattatcacccgcttcatgtacgacaagtttgatactacctatcaggctacaattggaattgactttttatccaaaactatgtaccttgaagatcgaacaattcggttgcagctttgggatactgctggacaagaaagatttaggagtctcattccaagttacataagagattcctctgtcgcagtcgtagtctatgatgtatctaatagacaatcattcttgaacaccaccaagtggattgaggaggtacgaacagaacggggtagtgatgtgataatcgttcttgttgggaacaaaactgatcttgttgagaaaaggcaagtttcaatcgaagaaggtgatgcgaaatctcgtgagtttggagtcatgtttatagaaactagtgccaaagctgggttcaacatcaagcctctctttcgtaagatcgctgcagcactgccagggatggaaactctgtcttcaacaaggcaggaggacatggttgacgtaaatttgaaaccagcagtgaattcatcccagtcggaacagcaaggaggaggttgtgcatgctagagaatgtgtaagttcaatac

SEQ ID NO: 4325 - DNA, 756 bp, Distylium racemosum
tgaagagaagaggaagatgagtacgatggcgactgtatcgcctcttgccaagtacaagcttgtgtttttgggagatcagtctgtcgggaagaccagtattatcactcgcttcatgtatgacaagtttgacaatacttatcaggctaccattggtattgactttttgtcaaagacaatgtacctggaggatcgaacagttcgtttgcagctatgggatactgcagggcaggagcgattccgaagtctcatcccaagctacattcgagactcttctgttgctgtcatagtttatgatgtttcgaatcggcagtcctttctgaatactgccagatggattgaagaagtacgcacagagcgaggtagtgatgtaattattgtacttgttggaaacaaaacagatctggttgacaaaaggcaagtttcaattgaagaaggtgatgcaaagtcacgggaatttggggtgatgttcattgaaacaagtgcaaaagcaggtttcaacatcaaggccttgtttcgtaagatagcagctgcattacctggaatggaagccctctcatcaaccaaacaggaagacatggttgatgtaaatttaaaaccttcagtgactgtatctcaagcagacaataaatcaggaggatgcgcttgttaagagttaatgttgcattaatccttcttggttgctacagttttgtaggacttgtttggatgtcatgttggatattggatttttcttcaaatcattggagcattatccaa

SEQ ID NO: 4326 - DNA, 1010 bp, Flaveria ramosissima
tgggggatcaacagttttgcgacctcatttcaaatcaattcaaaatcgactgcgtgaattcaccactgcaattctacgagattttcaccggatcagcacattcaactgctacttcattgttgtgatttgatcggatcaacttcaagttcaaatggcaccagtatcagcactagcgaaatacaagctggtgttcttaggggatcaatccgtcggcaaaaccagcattatcactcgatttatgtatgataagttcgatacctcatatcaggcaaccattggaattgacttcttatcaaagacaatgtatcttgaagatcgaacagttcgcctgcagttgtgggatacggctgggcaggagagatttaggagtctcataccaagctatataagggattcttcagttgctgtgatcatatatgatgttgcaagtcggcaaacttttctaaacactataaagtggattgaggaagttcgtgcagagagaggtagtgatgttatcattgttctggttgggaacaagactgaccttgttgaaaaaaggcaagtctcagtagaggaaggagaagcaaaagctgctgagctaaatgtcatgtttatagaaacaagtgctaaagctgggttcaacataaaggctttatttcggaaaatagctgcagccttaccaggaatggaaacactttcctcaacaaaacatgaagagctggttgatgtgaacttgaagtcttcaagtgtgacttcatcccagcctgaatctggtggttgtgcttgttgatggatgttaatcttgttacgggttcaacacttggcgagtgcatgtgtagaaggttagaaagtgaaatatatcaaccgcgatcctcatgcttattgctttagtatcatcatttacatcaaatgtatgtaacaagttctctcctttttttgccttttcagtcaatccgtttgttacgtgtgttcttgaattgtcatttgttacgtgtaaaaagatttatgtacatcgtcaagattgagtt

SEQ ID NO: 4327 - DNA, 1021 bp, Flaveria ramosissima
ccgctatgggggatcaacagttttgcgacctcatttcaaatcaattcaaaatcgactgcgtgaaattcaccactgcaattctgcgagattttcaccggatcagcacattcaacagctacttcattgtcgtgatttgatcggatcaacttcagttcaaatggcaccagtatcagcactagcgaaatacaagctggtgttcttaggggatcaatccgtcggcaaaaccagcattatcactcgatttatgtatgataagttcgatacctcatatcaggcaaccattggaattgacttcttgtcaaagacgatgtatcttgaagataggacagttcggctgcagttgtgggatacggctgggcaggagagatttaggagtctcataccaagctatataagggattcttcagttgctgtgatcatatatgatgttgcaagtcggcagacttttctaaacactataaagtggattgaggaagttcgtgcagagagaggtagtgatgttatcattgttctggttgggaacaagactgaccttgttgagaaaaggcaagtatcagtagaggaaggagaagcaaaagctgctgagctaaatgtcatgtttatagaaacaagtgctaaagctgggttcaacataaaggctttatttaggaaaatagctgcagcgttaccaggaatggaaacactttcctcaacaaaacatgaagagcttgttgatgtgaacttgaagtcttcaagtgtgacttcatcccagcctgaatctggtggttgtgcttgttgatggatgttaatcttgttacgggttcaacacttggcgagtgcatgtgtagaaggttagaaactgaaatatatcaaccgcgatcctcatgcttattgctttagtatcatcatttacatcaaatgtatgtactacgttctcttcctttttttgcttcttcagtcaatcgtttgttacgtgtgttcttgtaattgtctatttgttgcgttagtaaaagtatttatgtacatcgtacaagattgagtt

SEQ ID NO: 4328 - DNA, 1058 bp, Flaveria ramosissima
tcaacagttttgcgacctcatttcaaatcaattcaaaatcgactgcgtgaattcaccactgcaattctgcgagattttcaacggatcagcacattccactattacttcattgttgtgatttgatcggatcaacttcaagttcaaatggcaccagtatcagcactagcgaaatacaagctggtgttcttgggggatcaatccgttggcaaaaccagcattatcactcgatttatgtatgataagttcgatacctcttatcaggcaaccattggaattgacttcttgtcaaagacaatgtatcttgaagatcggactgttcgcctgcagttgtgggacacggctgggcaagagagatttaggagtctcataccaagctatataagggattcttcagttgctgtgatcatatatgatgttgcaagtcggcagacttttctaaacactataaagtggattgaggaagttcgtgcagaaagaggtagtgatgttatcattgttctggttgggaacaagactgacctcgttgaaaaaaggcaagtctcagtagaggaaggagaagcaaaagccgctgagctaaatgtcatgtttatagaaacaagtgctaaagctgggttcaacataaaggctttatttcgaaaaatagctgcagccttaccaggaatggaaacactttcctcaacaaaacatgaagagctggttgatgtgaacttgaaatcttcaagtgtgacttcatcccagcctgaatctggtggttgtgcttgttgatggatgttaatcttgttatgggttcaatgatcggcaagtgcatgtgcagaaggttagaaactgaaatatatctaccgcaatcctcatgcttattgctttagtatcatcatttaccgcaaatgtatgtaacaagttctctcctttttactttcaatcaatcagtcttgttacgtgtgttctgtagttgtcatttgttgcttagtaaaaagtctttatgtacaatcgtcaagtattgagtttgtattttatattgattcaatggtaatatcaagtacaaaagtggtttagaaagt

SEQ ID NO: 4329 - DNA, 1452 bp, Quercus alba
ctctttctctctctctctctcttccatattttcagaagagagagaaaattttctgagattcagatctaacaatcctaacctgcacaccccacatacccgaaatacactctctataagaaagaaagaaagaaagaaatggcagctgtgtcccctctagccaaatacaagctggtattcttgggtgaccaatccgtaggcaaaaccagcatcattactcgcttcatgtacgataaattcgacgccacctaccaggctacaattggaatcgatttcttgtcaaaaacaatgtaccttgaagatcggacagttcgtttgcagctttgggatactgctgggcaagaaagatttaggagtctcattccaagctacatcagagattcttctgttgccgtaattgtctatgacgtagcaaataggcagtcattcctgaatattaacaggtgggttgaagaggtacgtacagaacggggcagtgatgtcatcatcgtacttgttgggaacaaaactgatcttgttgataaaaggcaagtatctatagaggagggagatgccaagtctcgtgagtttggaatcatgtttatagaaaccagtgcaaaagcaggattcaatatcaagcctctcttccgtaagattgctgctgccttgccagggatggaaaccctttcttccacaaaacaggaagacatggttgacataaatctaaaacccactgccaattcatcccatcaagagcagcaaggaggttgctggtgctagagaaatgtatctgtttcagaagataaagagtgctgttcagatatgaaagctgagtgagatcaggcgctttatagctagatgaagttgcggcagacttgagtgtttagtgaacaaaggtagtaatgcttttggtctgacaaacaacggttgatattttggaatctttattaccactagcatttgttttctgcagtacttgtcttgaaatttctcccaaatgttattagtgtgacctgcaaattctcttcaggatttcatttattacaaaagaaactctttggatatattgtaagacatcttactatttttttttctttggatcatcttattacatataagaaggtatcagtatgcttcgggtataacatacacataccttgtatttaggtcaatgatatattggaagtggtagatggaattggtagcattaaccatatgtgaagactgataatgtgactattagcaagagtaactgattagcatatgcaattggcagcatcacatagtggtggcatgctagttgttgcatactagttcattgacataataattccccatcagatatgcatagccggtgcccttattgctgaaatatgaacactgagataagctgtgatagttgcatattacagaaaatttagtagaattgtgaatgatagttactacttatgtacagaggacatccaaaacagtttc

SEQ ID NO: 4330 - DNA, 910 bp, Allium cepa
tacatttctaggcaactatgattgtttaattttataatattttcgctcccgatcgcgatcttgtctctctgaaaaaaccagccatataaagcgttaagatctagagagagaaggctcagactctaacaataatggcggtagtttcagctctggccaagtacaaacttgtgtttttgggggatcaatccgtggggaaaacgagtattattactcgatttatgtatgacaaattcgatacgacttatcaggcgacaattgggatagattttttatcgaagactatgtaccttgaagatcgcacagttcgcttgcagctatgggacactgctggccaagagagattcagaagccttataccaagttacattagagattcttcggttgcggtgattgtgtatgatgtagcaaaccgacagtcctttttgaacacttcaaagtgggttgatgaagtccgcacagaaagaggtggtgatgtcatcattgtccttgtcggaaacaaaacagatcttgttgacaaaaggcaagtttccattgaagaaggagaggcaaaatctcgagagcacagcgtcatgtttatagaaacaagtgctaaagcaggattcaatatcaagccattatttcgtaagatagcatctgccttacctggaatggagacgctcacatcaacaaagcaagaagacatggttgatgtaaatttgaaacccactgtgagctcttcgaacgctcagcaacaatcaggtggctgtgcttgctgaatgagtacaagttagagttatggctttgtgagaatgataaaaatacatataattttgagtttgatagagctttatatttggagatcggcatttccattttttctcatatcatttatctgtttattgcgtagtgtataattggaacattccttttt

SEQ ID NO: 4331 - DNA, 1120 bp, Allium cepa
tagttacggggggtcttttatttggtaataacgcttcgtttctaatttatcaaacttctgctttattgaattataaaaattcgtttttgctcttgatcttgtctctttataaacatatagagagagaagagtagagatctagagagaggaagatcgaaccctaatactgatggcggtggtttcagctctagccaagtacaaattagtatttttgggagatcaatctgtggggaaaacgagtattattactcgatttatgtatgacaaattcgatacgacttatcaggcgacaattgggatagattttttatcgaagactatgtaccttgaagatcgcacagttcgcttgcagctatgggacactgctggccaagagagattcagaagccttataccaagttacattagagattcttcggttgcggtgattgtgtatgatgtagcaaaccgacagtcctttttgaacacttcaaagtgggttgatgaagtccgcacagaaagaggtggtgatgtcatcattgtccttgtcggaaacaaaacagatcttgtggacaaaagacaagtttccatagaagaaggagaagcaaaatctcgggagcacagcgtcatgttcatagaaaccagtgctaaagcaggattcaatatcaagccattatttcgtaagatagcatctgccttacctggaatggagacgctcacatcaacaaagcaagaagacatggttgatgtaaatttgaagcccactgtgagctcgtctaacgctcagcagcagtcaggtggttgtgcttgctaaatgagtaaaaattacagttacagcttcgtgaaaattacaaaaatacatatatttttgagtatgatagagcctttatgtttggggtcggcattttttcttctcatatcgtctgtctgtttattccgtagtgtataattggatcattctattcttttttatttcttgtgttccttttttattcaagtgtagcgtgtctgtttcatatacagagtattgtaaatttgatttaattttgctgcggacgatgtaagcatggcacttcggttgcatattgtattccatttaaatactggactttaatgtagaccgtgtatgtttctcagttaa

SEQ ID NO: 4332 - DNA, 1232 bp, Pseudotsuga menziesii
atctgggtcgctgtggtttccctcttatcaacttgaatttcaattgggccaacgcccatttgttttcaaaagagaaacccacggcattagattggatatcaagtttgagaggtcttcggatcgaacctgaggagaaagaaatctgaattggtaagcacctaagcatcgtaaaaaagaatgagtacagccatggcgactgtctctcctcttgccaaatataagcttgtgttcttgggagatcagtccgttggcaagaccagcattatcactcgcttcatgtatgacaagtttgacaacacatatcaggctaccattggtatcgatttcttgtcaaagacaatgtaccttgaggatcgaactgttcgtttgcagctttgggatactgcaggccaagagcgatttcgtagtcttatcccaagttacattcgagattcttctgttgctgtcattgtttatgatgttgcaaatcgacagtccttcttgaacactgccagatggattgaagaagtacgcacagagcgaggtagtgatgtgattattgtgcttgttggaaacaaaacagatctggttgacaaaaggcaagtctcaattgaggaaggtgatgcaaagtctcgggaattaggggtgatgttcattgaaaccagtgcgaaagctggattcaacattaaggccttgttccgtaagatagcagctgcattacctggaatggaagccctctcatcaacccataaggaagacatggttgatgtgaatttaaaatccactgtgcctgcaactgaagcagagaagaaggcaggaggatgctattgctaagtatgaaatattgctttctcttcttggtggctgaatgttttgtagaacttagttggatgtggattcatattcagatctcatggagcatcattctagtagggtacatttctcatgtttccctagcagtaatgtatatcaggaaatgggagattgggatgtgtaagttttatgtaagaattatatatttggtggaagattgtattgcatgcttatcaaagcaagtaagcttcggtaaattttttgaaagggataatcaagaatgtaatgatttaatgcactaatggagatatttgatcttcagcattatatatgtggatagctgatgttttccactctttattgtatggcggcccagtccatacattttccccattggcatgctttgcttgcaatgctgtcatggttctaatgacattcac

SEQ ID NO: 4333 - DNA, 1136 bp, Solanum phureja
ttggatgatattcactacggccttttacaggttttacaaatgacatgaatctaactccattgaagacaacttcagctcccaaattggcttcgaccacaacacctacagatctgagagagagaaattgtattttgaagaagaaggagaagaaagggtaattcaatagaattttggttccaatgtcggtggtatcgccattagcaaaatataagctggtgtttttgggagatcaatctgtgggcaaaaccagcataattactcgctttatgtacgataaattcgacaccacttatcaggctaccattggtattgattttttatcaaagacaatgtaccttgaagatcgaacagttcgcctgcagctctgggatactgctggtcaagaaagatttagaagtcttattccaagctatattagagattcttctgttgctgtaattgtatatgatgttgccaaccgccaatcatttctgaacacttcaaaatggatcgaagaagtacgcactgaacgaggcagtgatgtcattattgttcttgttggaaacaaaactgatcttgttgagaaaaggcaagtttccacagaagagggagatgctaaatctcgtgaatttggagtaatgtatgtagaaaccagtgctaaagctggattcaatatcaagcctctgttccgaaagattgctgcagccttaccgggaatggaaacactttcatccacaaaacaggaagatatggttgacgttaatttgaagcctacaacaaatacatcccaatcagagcagcaaggtggaggttgtgcatgttagatttgtacttgaagaggaggaagagtaagacagaagtttgaaacacacaaagacacagttgcatccagttattagggtgttcacaattagcaaatttcttagtttatgaggtttgcaacatggatttttcttcatgatgtgcaacaatatgttagacttcatcaaggaggtagctgattacaggcttctacgaaacttgttgtgtttatatgtgatggttcctaactagttcagaaaccatttataccggatcaatctcctagttgaatatataatgagatgccatacgtatttcacattcattttagtttgttgcaccaccaatagtttata

SEQ ID NO: 4334 - DNA, 1043 bp, Fragaria vesca
agagtcatattcttcttcttcttgttcctctaagctctgagattcagatccaaaaaaaccattcaagaatctcgaaaatggcgacggtgtcccctctggccaaatacaagctcgtcttcctcggcgatcagtccgtcggcaaaaccagcatcatcacccgcttcatgtatgacaaattcgacacaacctatcaggctacgattggaattgattttctgtccaaaacaatgtaccttgaagatcggacagttcgtttgcagctttgggatactgcagggcaagagagatttaggagtctcattccaagctacatcagggattcttctgttgctgtaatcgtctatgatgtagctaatagacaatcatttttgaacactaataaatggattgaagaagtaaggacagaacggggtactgatgtcattatcgtgcttgttgggaacaaaaccgatcttgtagataagagacaagtttctatagaggaaggagattccaaatctcgggagtttggagtcatgttcatagaaaccagcgccaaagcaggattcaatatcaagcctctattccgtaagattgcttcttcgttgccggggatggaaaccctttcctccacaaaacaggaagatatggttgatgtaaacctgaagcccactgttaattcatccaacgccgatcagcaaggaggaggttgtgcatgctaggctattcattttactgaaaagacaaagaggaagcagttagtataattcatgttcagccaacatagatctgatttgagttttgaggttgtatcgtttaggggcatagtgctttctgttccatttgtgtaatgaggttatgttaaagtgtttataggaacactaaaggtacgtggcaattgttccatttgtgctaacctactaaattgtgacgatttggaattcagtgtgttatatttccattactattatattccattcggatgatgtgaaaagaaccctccatatgattttacatcatttcttacaaactgtgtagaaatccttcctttcaatgtagaactg

SEQ ID NO: 4335 - DNA, 853 bp, Eutrema halophilum
cccaaaaaaaaaagaaaaaaagatttgggtattttactattcttcagaaaagttaattttcgtggcttgcggttacctttgcgtctagccatataaacgcgtctaactcaaacctcgcgttcaattctcacaaatctgtacctgaagaaaacccgcaaactcagatctatacctcaatttcttacggtgaagatcctcgagagggaaaacaaaaatggcgtctgtgtcacctttagccaagtacaagcttgtattcctcggagatcaatccgttggcaagaccagcatcatcactcgtttcatgtacgacaaattcgataccacttatcaggctacgattgggattgattttttgtctaaaacaatgtaccttgaggataggactcttcgtctgcaactatgggatactgccggacaagagagatttcgaagtctgataccaagttatatcagagattcttctgttgctgttattgtctatgatgttgcaaataggcagtcattcttgaacacctccaagtggattgaggatgttcgtacagagagaggtagcgatgtcataattgttctggtgggtaacaaaacagatctcgttgacaagaggcaagtgtcgatagaggaaggggataacaaagctcgtgattttggagtaatattcatggagacgagtgcaaaagcaggatttaacatcaagccgctattccgcaagatttcagcttcattaccaggaatggagtcactttcttcaacgaaacaagatgatatggttgatgtgaacctaaagccatcgactaattcgtctcaagcggagcaacaacgaggtggctgctcgtgttaattaaatttatatata

SEQ ID NO: 4336 - DNA, 1360 bp, Solanum lycopersicum
atcaaccaagaagtaaaaggtctctgtataagagactacaaactactgccgttcatcctcaactccaatacagtgcaaatttcagccaaaccttaaccagattgacaaccacaaagctgagatggggatggttggatgatattcactttggcattttacagattttaccaatgacatgaattcaactccattgaagacttcttcagctcccaaattggcttcgactacaatacctacagatctgagagagagaaattgtattttgaagaagaaagaagaagaaagggtaattcaatagaattttggttccaatgtcggtggtatcgccattagcaaagtataagctggtgtttttgggagatcaatctgtgggcaaaaccagtataattactcgttttatgtacgataaatttgacaccacttatcaggctacgattggtattgattttttatcaaagacaatgtaccttgaagatcgaacagttcgcctgcagctctgggatactgctggtcaagaaagatttagaagtcttattccaagctacattagagattcttctgttgctgtaattgtatatgatgttgccaaccgccaatcatttctgaacacttcaaaatggatcgaagaagtacgcactgaacgaggcagtgatgtcattattgttcttgttgggaacaaaactgatcttgttgagaaaaggcaagtttccacagaagagggagatgctaaatctcgtgaatttggagttatgtatgtagaaaccagtgctaaagctggattcaatatcaagcctctgttccgaaagattgctgcagccttaccggggatggaaacactttcatccacaaaacaggaagatatggttgacgttaatttgaagcctacaacaaatacatcccaatcagagcagcaaggtggaggttgtgcatgttagatttgtactttaagaggaagagtaagacagaagtaggaaacatgcaaagacacagttgcatccagttattttagggtgttcagaatagcgaatttcttagtttagaggtttgcaacatggatttttcttcatgatgtacaacactttgttagactttatcaaggaggtatctgattaaaggcttctacgagatggttcctaacaagttcagaaaccatttatgcttgatcaatctcttagttgaatatatgatgagatgacatgcgtatttcacattcattttagtttgttgcaccacatgtagtttatagatacaccaattacttacaagttacagggagttctttttcattatcaaagttctcataacacctgcatgttatttacagacacactcatgaggtgcagtttttgaatataatgac

SEQ ID NO: 4337 - DNA, 1073 bp, Trigonella foenum-graecum
ccttcatctctttctctctgttttcttcttcgtaacagatttttcagattttcattcattcagatctgaaaaatttcattcaaacagagagaaagattcatttctctcataaatggcgacggtttcacctctcgccaaatacaaactcgttttcttaggtgatcaatccgttggtaaaaccagcatcatcacccgtttcatgtacgacaaattcgacaccacctatcaggctactatcggtattgattttttgtcgaaaacaatgtaccttgaagatagaactgttcgtttgcagctttgggataccgcaggccaagaaagatttagaagtctcattccaagctacataagagattcttctgttgcagttattgtatatgatgtagctaacaggcaatcatttctgaacactaacaagtgggttgaggaggtacgtcaagaacgtggcagtgatgttatcattgtcttggttggaaacaaaactgatcttgttgagaaaaggcaagtttctatagaagaaggagatgccaagtcaaaagagtttggaatcatgtttatagaaaccagtgcaaaagcaggcttcaatatcaagcctttgtttcgtaagattgcttcggccttgccagggatggaaactctttcttctacaaaacaggaagacatggttgacgtaaatttaaaacccacagtgaattcatccaatacagagcagcagggaggaggttgctcatgttagaggatattctcacagaaatcaccataaatacatgttcattgattataatactgggaatgactgcttaaatgtaaagttaaactggaggaaacgtgctttcacatcaatgatccttcagttaattggtgtgtgggacaaattgcggtaatggttttgatgtatgacaaaaagattgaccgttattttttcatttgttatacaattagtccctgaatgtaagaatccatgtaataaacaagccatctgaattgtctgtcttagatagtatatgttattcttttttgtttgtcaaatatctctttcctgatgaaatgaatgtatgtatgtgctagcaaca

SEQ ID NO: 4338 - DNA, 1006 bp, Citrullus lanatus
atcttcttgcgccatattcccttcatggcgacggtttctcctctcgccaaatacaagctcgtcttcctcggcgatcaatccgttggtaaaaccagcattatcacccgcttcatgtacgacaagtttgataccacctatcaggctacaatcggaattgactttttgtccaaaactatgtaccttgaagatcgaacaattcggttgcagctttgggatactgctggacaagaaagatttaggagtctcattccaagttacataagagattcctctgttgcggttgtagtctatgatgtatctaatagacaatcattcttgaacaccactaagtggattgaggaggtacgaacagaacggggtagtgatgtgataattgttcttgttgggaacaaaactgatcttgttgaaaaaaggcaagtttcaatcgaagaaggtgatggcaaatctcgtgagtttggagtcatgttcatagaaactagtgccaaagctgggttcaacatcaagccactctttcgtaagattgctgcagcgctgccagggatggaaactctgtcttcaacaaggcaagaggacatggttgacgtaaatttgaaacccgcagtgaattcctcccagacggaacagcaaggaggaggttgtgcatgctagaggatatgtaagttcaatacataaaaaacaaaaaattgctgcaaaattgaagtagtatacgcaatcattcacggtgagttagttcaacaaattgacattcgaaattttctaacaatatgatgtttgtaatattgtatgtcattagattctttttgggttcccaaagaacaaatcatcattctgtcctctcacatgttgagattttcattttggattattgcgatgcctttctaagagttgaccaactatatctcattgcggagtaattgaaaactgttccattgtttataattatatcaatattcagtgttctttcatagaaaaattctctccttggctagctgttcacgttacaaat

SEQ ID NO: 4339 - DNA, 1458 bp, Cycas rumphii
gggaaatttttgcatttcctccaataccaaggaccatccaacgaggaggagagagaataccatacccaacggtgcctccgcttcgatttggcactgttgtctagcattttctctcctgtttaatgattcagatctgtacagatttcaatttcagtagtccgtagagtacctcaattcaattcaataggccatttgggctcctcaatttcgtccatttgtgggttttcccgatccgttgcagggcagatttgttggatcagatttaaattcaagtgggtgaatcttcattgttcccgaaaagaggcagtggggtcaattttaggggtggtttgatccaacatatatgcctccacatggtttcgccttaagcccgatcgaatttgagtgctcttgtgataaatctgagtagatcgtatctgaggcagcagggttaggcagttgagaattgataatgagtactgcaatggcgacggtctcgcctcttgctaaatacaagcttgttttcttgggggatcaatcagttggcaaaaccagcattattacgcgtttcatgtatgacaagtttgacaatacttatcaggctaccattggcattgactttctttcaaagacaatgtaccttgaggatcgaacagttcggttgcaactatgggatactgcaggccaggaacgatttcgaagtctcatcccaagctatattcgggactcatctgttgctgtcattgtgtatgatgttgcaaaccgacaatccttcttgaacactgcaagatgggttgaggaagtgcgcacagagcgaggtagtgatgtcattattgtgctcgttggaaacaagacagaccttgttgataaaaggcaagtttcaattgaggaaggtgatgccaagtcacgggaatttggggtgatgttcattgagaccagtgcaaaagcaggatttaacattaaggctctatttcggaagatagctgctgcattgcctggaatggaggccctttcatctaccaagcaggaagacatggttgatgtaaacttaaagccaacagtgaatgcatctcaagcggaacaaaaagcaggaggatgctcttgctaactgtaatatattacatgtctttcatccattcttggtaattgcattcattagtatttagttggatgtggggttctgcaattcatatttcattatcatctaaataggtgtgcatttctcaggttgtagtaacatgatatgatctattcgaaggtatattagagaatagaagatggtaggtgtaataattttgtaggcattatagagctgcagaaggttgtactgcatagccttttgagttttcagtgtagcaaaggaacttaagtaggcctttttgaagtcatcactaataatttctactgtatattggtacgactacgccttgttctttttgtaattctgccctgcagtgacgaatcccttgtgcagggagg

SEQ ID NO: 4340 - DNA, 1036 bp, Valeriana officinalis
tcaaaaacattcattttcgtctctctcttacatctacacaatacgcgctgctctgctttgatctgatctacctccttgcatctcccaccgatttccggcgagatctcgactttttcgtcggaaaattatccattacctaaaaagccttgttgtttccttttagatccaattcatggctccggtttccgctctcgccaagtacaagctcgtcttcttaggggatcagtctgtcggcaaaacaagtatcattaccagattcatgtatgataagttcgacaacacctatcaggctaccattggtattgattttctatcaaagacaatgtaccttgaggatcgaacagttcgcttgcagctttgggatacagctggacaagaaaggttcagaagtctgattccgagctatatcagggattcttctgtagctgttatctgttatgatgttgcaagcaggcaatcattccttaacacttcaaaatggattgaggaggtccgcaccgaacgaggtagtgatgtcatcatcgtccttgttggaaacaaaactgatcttgtggacaagaggcaagtctcgatagaggaagcagaagccaaggctcgtgagcttaatgtcatgttcattgaaactagtgcaaaggcgggcttcaatataaagcctctattcagaaagattgcagcagccttacctggaatggaaactttatcatctgctaaatcggaagacatggttgacgtcaatctcaaatcaacaatgccggttcgtctcagtcgcaacaatctggtggttgcgcttgctaaatttattgtataaatttcttcattatttctcctattgctaaagaaagttttattcaaatattgagggcaacttcatattttttccatggttttagattcgaatttagtcttaacagtgtcatctgtatgattcttgcggatgggtagttaattttttgtttcttttttgtttgtttgctcgtactgtattaagaaccggtaatgttttgaaggtatttcaagttctttttcctttcaaaaa

SEQ ID NO: 4341 - DNA, 683 bp, Brassica oleracea
gaatcgcaaaactcagatctggaatggcggcggtgacaccattagcgaagtacaagctcgtcttcctcggagatcaatccgtgggaaagaccagcatcatcactcgtttcatgtacgacaaattcgacaccacttatcaggcaactattgggattgattttttgtcaaagacaatgtacatggaggataggactcttcgtctccagctatgggatactgctggacaggagaggtttcgaagtctgattccaagttatatcagagattcttctgttgctgttattgtctatgatgttgcaaataggcagtcattcttgaacacctctaagtggattgaggatgttcgtacagagagaggtagcgatgtcatcattgttctcgtgggtaacaaaacagatctcgttgacaagaggcaagtgtcaatagaggaaggggataacaaagctcgtgactttggagtaatattcattgagacgagtgcaaaggcaggatttaacatcaagccactcttccgcaagatttcagcagcattaccaggaatggacacactttcaacgagacaaggtgatatggttgatgtcaacctaaggtcatcgaccaatgcgtctcaaggggagcaacaaggaggtggctgttcgtgttaaattcaattttaatatactttttaacagcaacagagtaga

SEQ ID NO: 4342 - DNA, 2111 bp, Brassica rapa
gtctagagagcccgatcaaataaacgcgtctaacatcacatcaaacctcaggggccttggaatcgcgaaactcagatctggaatggcggcggtgacaccattagcaaagtacaagctcgtattcctcggagatcaatccgtgggaaagaccagcatcatcactcgcttcatgtacgacaaattcgacaccacttatcaggcaacaattgggattgattttttgtcaaagacaatgtacatggaggataggactcttcgtctccagctatgggatactgctggacaggagaggtttcgaagtctgataccgagttatatcagagattcttctgttgctgttattgtctatgatgttgcaaataggcagtcattcttgaacacctccaagtggattgaggatgttcgtacagagagaggtagcgatgtcatcattgttctcgtgggtaacaagacagatctcgttgacaagaggcaagtgtcgatagaggaaggggataacaaagctcgtgactttggagtaatattcattgagacgagtgcaaaggcaggatttaacatcaagccactcttccgcaagatttcagcagcattaccaggaatggacacactttcaacgagacaaggtgatatggttgatgtcaacctaaggtcatcgaccaatgcgtctcaaggggagcaacaaggaggtggctgttcgtgttaaattcaattttaatatactttttaacagcaacagagtagacagatttttaaaagaaaggattcataacctgatgggataaataaattctggtataagaaaagagatttttacttgagaaactcttactattctttaaatgttttttcaatatcgagctgtgtaataatgatgcttaaaaaacttaagaagaattgctctgtttcgattgctcaattttttttcagcatatattgtcaatctcactataataaagtcagaaacagtgtatgaaaagagattcaatatctcatatttatgtttaattacttaactcacatgagttaagatcttagacaaatgacagagagctctttactgttgccatccatattgctggtttctactaccacccattgggttctgacctcttccagagccaccatgctgaccactttgtgtgtagttaggtggtccaaccccgtaggcaccaccactaggccctctaggaccaacgcccacataatgagctccccgtccttgctgatgatatgatccgctgctgctgtaacctcctcggctctgattataacccctgctctggtttccgctaggagggtatcgatttggaccaggtggaccgcgaggcttcccatagtagtggtggcttggtccagcaggtacttgcggtggtgcgttgttggtaggatgggcaggccaatgtggagcagcagcgtgagattggccaccgtgttgtaatggaggcaagcgagagtgctgctgatgtggatgctgcagtttctgtctttttgctgcttcctctctttgtcgctgctcttgcctctttttctttgtctggaactcatgtgatgcctcatatgtaggtagactgtatatatgaaaacattattttagtcagaagaatgataatgcacaaacacactgtcaaaagctaatacctctttgggtcacatggcagaggatcagtccaaaagtactcggcatcaagagcatcctttgcagttattctctacaccagaacaacaccaaaaatctagcttgtaatagggaaagttttaagtattcactgtcaataagaacaaagatctccaatacctgtgatgggtcaagaaccaacattttatccagtagttcaagtgcatggcgatcaaagacttggtacctcaattcaagaaaaaaacgaataaaaccttatcatcaaagtgtttgcgtagaagtgaagttataatattggtaatgattcactctacttactgtccgaagaactctctcacgcgtctcttcaacggccgtgatggcttaaaattgttaaaccaaggcatcttggaaaccccaggccaattattttcatcaggtgatccacaaagctcaaaaatcttgctcaattgttcattctgaaacaatgtaggag

SEQ ID NO: 4343 - DNA, 860 bp, Brassica napus
aaataaacgcgtctaacatcacatcaaacctcaggggccttggaatcgcgaaactcagatctggaatggcggcggtgacaccattagcaaagtacaagctcgtattcctcggagatcaatccgtgggaaagaccagcatcatcactcgcttcatgtacgacaaattcgacaccacttatcaggcaacaattgggattgattttttgtcaaagacaatgtacatggaggataggactcttcgtctccagctatgggatactgctggacaggagaggtttcgaagtctgataccgagttatatcagagattcttctgttgctgttattgtctatgatgttgcaaataggcagtcattcttgaacacctccaagtggattgaggatgttcgtacagagagaggtagcgatgtcatcattgttctcgtgggtaacaagacagatctcgttgacaagaggcaagtgtcgatagaggaaggggataacaaagctcgtgactttggagtaatattcattgagacgagtgcaaaggcaggatttaacatcaagccactcttccgcaagatttcagcagcattaccaggaatggacacactttcaacgagacaaggtgatatggttgatgtcaacctaaggtcatcgaccaatgcgtctcaaggggagcaacaaggaggtggctgttcgtgttaaattcaattttaatatactttttaacagcaacagagtagacagatttttaaaagaaaggattcataacctgatgggataaataaattctggtataagaaaagagatttttacttgagaaactcttactattctttaaatgttttttcaatatcgagctgtgttataatgatgctt

SEQ ID NO: 4344 - DNA, 945 bp, Cichorium intybus
tatatacgtacgcgggggagtggaatttgaacagcgaagagtcgaagactcgatcaactgatttgctattctaccctgcgactccttttcaattcattttcaaaatcgactccgcggaacagaagatttgcaactcaaaatccgcgagatttttcgctggaccatcatacttcgttgttgtgattcgatttaatcaagatcgaaaatggctccagcatcagcactagcaaagtacaagctggtgttcttgggtgatcaatccgtcggcaaaaccagcattatcactcgctttatgtatgataaattcgatacatcctatcaggcaacaattggaattgacttcctgtcaaaaacaatgtatcttgaagatcgaaccgtacgtctacagttgtgggatacagctgggcaagagaggtttaggagtctcattccaagctatataagggattcttctgttgctgtcattacatatgatgttgcaagtaggcagacgtttcttaacactataaagtggattgaggaagttcgtgcagagagaggtagtgatgttattatcgttatggtcgggaacaaaactgaccttgtggacaaaaggcaagtgtcagtagaggaaggtgaagcgaaagctactgagctcaatgtcatgttcattgaaacaagtgctaaagctgggttcaacataaaggctttatttaggaaaatagcagcagcattaccaggaatggaaacactttcggcaacaaaacatgaagaaatggttgatgtgaatttgaagtctacaagcatgacttcatcgcagcctgaatctggtggttgtgcttgctaataaaagttctggttacatgtgcaaaaggttggatttggaaaacaaaatattttgaaggaattcttgtgtctattttggtagcatcatttactacaaatgtatgtaacagtttctttttt

SEQ ID NO: 4345 - DNA, 1442 bp, Cichorium intybus
ggggagtggaatttgaacagcgttgagtcgaagactcgatcaactgatttgctattctaccctgcgactccttttcaattcaatttcaaaatcgactccgcggaacagaagatttgcaacacgaaatccgcgagatatttcgctggatcatcatacttcgttgttgtgattcgatttattcaagatcaaaaatggcaccagcatcagcactagcaaagtacaagctggtgttcttgggtgatcaatccgtcggcaaaaccagcattatcactcgctttatgtatgataaattcgatacatcctatcaggcaacaattggaattgacttcttgtcaaaaacaatgtatctagaagatcgaactgtacgtctacagttgtgggatacagctgggcaagagaggtttaggagtctcattccaagctatataagggattcttctgttgctgtcattacatatgatgttgcaagtagacaaacatttcttaacactataaagtggattgaggaagttcgtgcagagagaggtagtgatgttatcatcgttatggttgggaacaaaactgaccttgtggacaaaaggcaagtgtcagtagaggaaggtgaagcgaaagctactgagctcaatgtcatgttcattgaaacaagtgctaaagctgggttcaacataaaggctttatttaggaaaatagcagcagcattaccaggaatggaaacactttcagcaacaaaacatgaagaaatggttgatgtgaatttgaagtctacaagcatgagttcatcgcagcctgaatctggtggttgtgcttgctgataaaagtgcaaaaggttggatttggaaacaaaatattttgaaggaactgttgtgtctattggtttggtatcatcatttaccacaaatgtatgtaacaatttgtttttgttttttttgtttgtgtttcgattgatatacattcgtaacggaagtagaatcatcctgcgttgctgagttgtagtttgtcatgtataaaaagatttatgaagaattaccaagattttgaatcggttttatattgatctataatgaatcaagatatttatgcttatgggtttgaactagagctttatgtggtagcttgttgttaggtttttgcagttgtcatgttcatggccatgtggaggtgatcgtgttaaatatgtgtattatgcaattattgcaatatataagtgtatttcgcaattcggatggaattcgttaaataatttggtggtcattttgtttatagaatatagaatcccaccttctactctatcagctactctaattttgagttggtcataggttttatatcccaaaaaagttgtcattttcataaatgaccttttcaattttttgttattgtccttttttaaatgtaatataatcattagctagggttaagttcatatgagaccattagatttc

SEQ ID NO: 4346 - DNA, 757 bp, Cirsium arvense
gaaaacatgtaatagtaagctgttgaattttgggcaacggagattcaaaatcgactgcgaaaaacagtgaatctacggagctcaaaatctgcgaagtttttcgctggatcatcaaattctagttgttgtgatttgatcaaatcgaagtgaagaaaatggcaccagtatcagcactagcaaagtacaagctggtgttcttgggtgatcaatccgtcggcaaaaccagcattatcactcgctttatgtatgataagttcgatacttcttatcaggcaaccattggaatagacttcttgtcaaagacgatgtatcttgaagatcgaacagttcgtctgcagttgtgggatactgctgggcaagagagatttaggagtctcattccaagttatataagggattcttccgttgctgtcattacatatgacgttgcaagtcggcagacttttcttaacactataaagtggattgaggaagtccgtgcagagagaggtagtgatgttatcattgttctggttggaaacaagactgaccttgtggacaaaaggcaagtctcagtagaggaaggagaagcgaaagctagtgagctcaaagtcatgtttatcgaaacaagtgctaaagctgggttcaacataaaggctttatttcggaaaatagcagcagcattaccaggaatggaaacactttcctcaacaaaacatgaagaaatggtggatgtgaatttaaagtcttcaaacatgacttcttcccagcctgaatc

SEQ ID NO: 4347 - DNA, 870 bp, Echinacea purpurea
ttcaaatcaattcaaaatcgactgctcaaaacagtaaattctgcaatattatttactagatcagcacaacccagtacaacttccttgttctgatccgatcaaatcaagttgaagatcaagaaaatggcaaaaccagtatcagcactagcgaaatacaagctggtgttcttgggggatcaatccgttggtaaaaccagcatcatcactcgctttatgtacgacaagtttgatacctcatatcaggcaactattggaattgacttcttgtcaaagactatgtatcttgaagatcggacagttcgcctgcagttgtgggatacggctggacaagagagatttaggagtctcataccaagctacataagagattcttcagttgcagtgattatatatgatgttgcaagtcggcagacttttctaaacactataaagtggattgaggaagttcgtgcagaaagaggtagtgatgtcattattgttctggtcggtaacaagactgatcttgtggaaaaaaggcaagtttctgtagaggaaggagaagcaaaagctgctgagctaaacgtcatgtttatagaaacaagtgcgaaggctgggttcaacattaaggctttatttagaaaaatagcagcagcactaccaggaatggaaacgctttcttcgacaaaacatgaagaactggttgatgtgaatttgaagtcttcaagtgtgagttcatcccagcctgaatctggtggctgtgcttgttaatggaaggatgctaatctggttcaacaatttgcaaggtcaaaaacagaaatatatcaaccaaaaccttatgtttattgctttggtatcatcatttgccataaatgtatgtaaccatgtctctct

SEQ ID NO: 4348 - DNA, 933 bp, Echinacea purpurea
aaacaaaaacatttaaaacttaaatacggatcggagactccatcaataacattgcgactctatttcaaatcaattcaaaatcgactgctcaaaacagtgaattctgcaatattattcactagatcagcacaacccagtacaacttccttgttctgatccgatcaaatcaagttgaagatcaagaaaatggcaaaaccagtatcagcactagcgaaatacaagctggtgttcttgggggatcaatccgttggcaaaaccagcatcatcactcgctttatgtacgacaagtttgatacctcatatcaggcaactattggaattgacttcttgtcaaagactatgtatcttgaagatcggacagttcgcctgcagttgtgggatacagctgggcaagagagatttaggagtctcataccaagctacataagagattcttcagttgcagtgattatatatgatgttgcaagtcggcagacttttctaaacactataaagtggattgaggaagttcgtgcagaaagaggtagtgatgtcattattgttctggtcggtaacaagactgatcttgtggaaaaaaggcaagtttctgtagaggaaggagaagcaaaagctgctgagctaaacgtcatgtttatagaaacaagtgcgaaggctgggttcaacattaaggctttatttagaaaaatagcagcggcattaccaggaatggaaacgctttcttcgacaaaacatgaagaactggttgatgtgaatttgaagtcttcaagtgtgagttcatcccagcctgaatctggtggctgtgcttgttgatggaaggatgctaatcgggttcaacaatttgcaaggtcagaaacagaaatatatcaaccgaaaccttatgtttattgctttggtatcatcatttgccataaatgtatgtaaccatgtctctct

SEQ ID NO: 4349 - DNA, 991 bp, Cucumis melo
agatccatccatcttcctttgaattttcatcgctacactcattttcccttcatggcgacggtttctcctctcgccaaatacaagctcgtcttcctcggcgatcaatccgttggtaaaaccagcattatcacccgcttcatgtacgacaagtttgatactacctatcaggctacaattggaattgactttttatctaaaactatgtaccttgaagatcgaacaattcggttgcagctttgggatactgctggacaagaaagatttaggagtctcattccaagttacataagagactcctccgttgcagtcgtagtctatgatgtatctaatagacaatcatttttgaacaccaccaagtggattgaggaggtacgaacagaacggggtagtgatgtgataatcattcttgttgggaacaaaactgatcttgttgagaaaaggcaagtttcaatcgaagaaggtgatgcgaaatctcgcgagtttggagtcatgtttatagaaactagtgccaaagctgggttcaacatcaagcctctctttcgtaagatcgctgcagcactgccagggatggaaactctgtcttcaacaaggcaggaggacatggttgacgtaaatttgaaaccagcagtgaattcatcccagtcggaacagcaaggaggaggttgtgcatgctagacaatgtgtaagttcaatacataaaaggaaaaaattgctacaaaatgaaacagtatacgctatcattcacggtgagttagttcaacaaattgacattggaaattttctaacgatatgatgtttgtaatattgtatgccattagattcttttggggttcctaaagaacaaatatcatcattctgtcctctcacatgttgagattttcgttttggatttgtgattctaagagttgaccaactatatctaattgcggagtaattgaaactgttacattgtctataaattatatcaatgttcagtattgtttcatagaaa

SEQ ID NO: 4350 - DNA, 637 bp, Pennisetum glaucum
ggggaagcgaggcggcggcgtggcgcggggagacgatggccccggtggtgtcggcgctggccaagtacaagctcgtgttcctcggcgaccagtccgtggggaagaccagcatcatcaccaggttcatgtacgacaagttcgacaccacctaccaggctacgattggcattgactttttgtcaaagacgatgtatcttgaggaccgcactgttcgtctacagctttgggatactgcaggacaggagagatttaggagtcttattccaagctacatcagggactcatctgttgcagttgtcgtttatgatgtatccaataggcagtcttttctgaacacctcaaaatggatcgacgaagtccgcaccgagaggggtggtgatgtgatcgttgtgctcgttggtaacaaaactgatcttgtcgacaagagacaagtgtccactgaggaaggggagagcaagtcgaaagaactcaacgtcatgttcatcgaaaccagcgcgaaagccgggttcaacatcaagccgctgttccgcaagatcgccgcggcgctgccggggatggagacgctctcgtcggccaagcaggaggacatggtggacgtgaacctgaagccgacctccagccagtccaactcgcagca

SEQ ID NO: 4351 - DNA, 1070 bp, Raphanus sativus
gattctcaaatctgtacctgaaaaatctcaaactctcagatctgccaatacctctctcttatcgtgacggtgaagagagagagagagagatatatctcgagagcgagaaaaaaatggcggcggtgacaccattagcaaagttcaagctcgtcttcctgggagatcaatccgtcggcaagaccagcatcatcactcgtttcatgtacgacaaattcgataccacctatcaggcaacgattgggattgatttcttgtcaaagacaatgtaccttgaggataggactcttcgtctccagctttgggatactgccgggcaggaaaggtttcgaagtctgataccaagttatatcagagattcctctgttgctgtcattgtctatgacgttgctaataggcagtcgttcttgaacacctcgaagtgggttgaggatgttcgtacagagagaggtaacgatgttataattgttctcgtgggtaacaaaactgatctcgttgacaagaggcaagtgtcgatagaggaaggggataacaaagctcgtgattttggagttatattcatagagacgagtgcaaaagcaggatttaacatcaagccactattccggaagatttcggcagcattaccaggaatggatacactttcttcagcgaaacaaggcgatatggttgatgttaaccttaagtcatcgaaccattcgtctaatgcggagcaacaaagtggtggctgttcgtgctgattaatctttactaaaaaaatatatacttttaacagcaacagagtatggagatttttaaaaatgattcataacttgatggagtaaaataaactctggtgtaaggtaagagatttttacttggagtctctagtattctttaagatgttttgagttcaatatggagatgtgtaataatgacacgcttgcaagcttaagaagaatgtttcgctctgttctggttagtgattcctcagttttctttttacagcatacactgtcaatctctgtctcgacattgtaagagaaagttcgaaaagatatttgtatatctcatattaattttgtttattacca

SEQ ID NO: 4352 - DNA, 1385 bp, Picea glauca
ggctctgcatttcatggtgctgcccgatctgggtcgctgcggtttctctctgatcaccttgaatttcagttgggtgaacgctcatttattttcaatagagaagcccacggcataagattggataacaagtttgagaggtcttgggatcgaatctgagtagaaagaaatctgaattggaaagcatctgaggattgaaaaaagaatgagtacagccatggcgtctgtctctcctcttgccaaatataagcttgtattcttgggagatcagtccgttggcaagaccagcattattactcgcttcatgtatgacaagtttgacaacacatatcaggctaccattggtatcgacttcttgtcaaagacaatgtaccttgaggatcgaactgttcgtttgcagctttgggatactgcaggccaggagcgattccgtagtcttatcccaagttacattcgagactcttctgttgctgtcattgtttatgatgttgcaatccgacagtccttcttgaacactgccagatggattgaagaagtacgcacagagcgaggtagtgatgtgattattgtgcttgttggaaacaaaacagatctggttgacaaaaggcaagtctcaattgaggaaggtgatgcaaaatctcgggaatttggggtgattttcattgaaaccagtgcgaaagctggatttaacattaaggccttgtttcgtaagatagcagctgcattacctggaatggaagctctctcgtcaacccataaggaagacatggttgatgtgaatttaaaatccacagcgcctgcaactgaagcagagaataaggcaggaggatgctattgctaagtatgaaatattgctttgtctcttcttggtggctgagttttttgtagaacttagttggatgaggaatcatcttcagatctcatggagcatcattgaagtaggatacatttctcatgttgccctagcagtaatgtatatcaagaaatgggagatttttatgtaagaattatatatttggtggaagattgttttgcgtgcttgtcattaagcaactaagcatcagtaaattttttgaaagggataatcaagaatgtaatgcattaatggacatatttggtcttcggcatcattcatgcggataactgatgttttccactctttattgtacggcagtgcttactgtactctttgataggcagagaaatttttgagaagattactgatcatctgcttaacacatgagtgtctcttcgaagggagtggaaagtgggagattatactgttagatcaatgtctatccctactagccaggaataaaattattctcattataagctttgttattgtcaatatattcaggactgctttttgttaaaaaaaaaaaaaa

SEQ ID NO: 4353 - DNA, 1100 bp, Helianthus annuus
caaaaacatttatactgaaataaacacacatactacattttacaaatcggagacttgatcaataatattgcgacccatttcaaatcaattcaaaatcgactgcgcaaaacagagtatccacaaccaaattattcacaagatcatcaaaacccaccaacacttgattcttctgattcgatcaaatcaatttcaagatcaagaaaatggcaaaaccagtatccgcactagccaaatacaaactggtgttcttgggagatcaatccgttggcaaaaccagcatcatcactcgctttatgtatgacaagttcgatacctcttatcaggcaaccattggaatcgacttcttgtcgaagacaatgtatcttgaagatcggacagttcgcctgcagttgtgggatacggctgggcaagagagatttaggagtctcataccaagctatattagggactcttcagttgcagtaattatctatgatgtcgcaagtcgacaaacttttctaaacactataaagtggatcgaggaagttcgtgcagagcgaggtagtgatgtcattattgttcttgtcggtaacaagactgatcttgtggaaaaaaggcaagtttctgtagaggaaggagaagcaaaagctaccgagttaaatgtcatgtttatagaaacgagtgctaaagctgggttcaacattaaggctttatttagaaaaatagcagcggcgttaccaggaatggaaacgctttcctcaacaaaacacgaagaactggttgatgtgaatttgaagtcttcgagtgtgagttcatcgcagcctgaatcgggtggctgtgcttgttgattgatggatgctaatcttgataatggttcgacgattttcaaggtcagaaacagaagtatatcaatcggcgccttcatgtttattgctttggtatcatcatttaccacaagtttattatttatgttgggagtttgaattctaaagttcttggaattttatttgagactcgagttagttggcagttttgattatctgaatttctcatgtcgctatggttgttgattggtttaattttttcgtttgtgatgccgattagttattattccagactac

SEQ ID NO: 4354 - DNA, 1053 bp, Tragopogon dubius
gcgggggaccagcggagactcaatcaaaagtattgctactccacccagcgactccatttccattcaattcaaaattgacatctgacagcggaacacggaaaatttgcaactcaaactctgcgacgtttttggctggatcatcatattccagtactacttcattgttgtgacttgatcaaatctagatcaagaacatggcaccagcgtcagcactagcgaagtacaagctggtgttcttgggtgatcaatccgtcggcaaaaccagcattataactcgttttatgtatgataagttcgatacctcatatcaggcaaccattggaatagactttttgtctaagacaatgtatcttgaagatcgaacagtacgtctgcagttatgggatacagctgggcaagagaggtttaggagtctcattccaagctacataagggattcttcagttgctgtcattacatatgatgttgcaagtcggcagacttttctcaacactataaagtggatagaggaagtccgtgcagagagaggcagtgatgttattatcgttatggtcggaaacaaaactgaccttgtggacaaaaggcaagtgtcagtagaggaaggagaagcgaaagccagtgagctgaaggtgatgtttattgaaacaagtgctaaagctgggttcaacattaaggcattatttcggaaaatagcggcggctttaccaggaatggagacactttcagcaacgaaacatgaagaaatggtggatgtgaatttgaagtcttcaagcgtgacttcatctcagcctgcatctggtggctgtgcttgttgatccaacaatttgcttccggatgcatgtgcacaaaatattcaattggaagttggaagtgggaagccttgtgtttattgatcttacgacagatgtatgtaaccattttaatttttgatttcaatttgaatcatttgtaacgggagtagaattttctgaggtctagtttgtgatgtataattagattgttgtggaatcgcctaagattttgaatcagttttatattcatcaatattctaac

SEQ ID NO: 4355 - DNA, 1484 bp, Abies balsamea
catgtttaatattcaattcgcaacgccgaaggcgagagtttacctcaacttattgacgttttgccagactggttttgcacttttataaaaaagacactttccactcgttcaaattatttgtaaaaaaattgcttaaatagcggcaattttgacatcaacacatcgtatatgacctttcgattctttctgcttcaattcgctgcaattgatggcgttgccggatctggtcgctgcggtttccctctggtcaccttgaatttcaattgggtcgatgcccctctgttttcaaaagagaaacccgcggcatgagattggatatcaagtttgagaggtctcgggatcaaatctgagcagaaagatctctgaattgtaagcaactaatcattaaacaaaaaatgagtacaggcatggcgactgtctcgcctcttgccaaatataagcttgtgtttttgggagatcagtccgttggcaagaccagcattatcactcgcttcatgtatgacaagtttgacaacacatatcaggctaccattggtatcgacttcttgtcaaagacaatgtaccttgaggatcgaactgttcgtttgcagctttgggatactgcaggccaggaacgattccgtagtcttatcccaagttacattcgagactcttctgttgcagtcattgtttatgatgtagcaaaccgacagtccttcatgaacactgctagatggattgaagaagtacgcacagagcgaggtagtgatgtgattattgtgattgtgggaaacaaaacagatcttgttgacaaaaggcaagtctcaattgaggaaggtgatgcaacgtctcgggaattaggggtgatgttcattgaaaccagtgcaaaagctggatttaacattaaggccttgtttcgtaagattgctgctgcattaccaggaatggaagccctctcatcaaccaataaggaagacatggttgacgtgaatttaaaatccacagtgcctgcaacccaagcagagaagaaggcaggaggatgctattgctaagtatgaaatattgttttgtcccttcttggtggctgaactttttgtagaatttagttggatgtggtaatcttcttcagatctcatggagcatcattgaattaggatacatttctcatgttgccctagcagtaatgtgtatcatgatccatgaaatgggagattggggatgtgtaacttttatgtaatagttatatatttggtggaagattgtcttgcatgcttgtagttgtcattaagaaaataagcttcagtaaatttttttgaaagggataattaagaatgtaatgccttaatgcattaatggacatatatgatcttctgtgacatatatgtggacaagtgatctttattgtacagcggtgcttacctactctttgttaggcagagtatttttttgagtaagattattgatcatctgcattacacttgcctctctcttcgaaggaagtggaa

SEQ ID NO: 4356 - DNA, 955 bp, Ambrosia trifida
ttttttgaaatcaattcaaaatcgactgtacaaacagagaattgacgaccaaattgttaaccagatcagcatattgttctgattggatcaaataagattcaagatctagattagattagattgaagaacatggcaaagccagtatcagcactagcgaaatacaagctggtgttcttaggtgatcaatccgtaggcaaaaccagcatcatcactcgttttatgtatgacaagttcgatacctcttatcaggcaaccattggaattgacttcttgtcaaagacaatgtatcttgaagatcggaccgttcgcctgcagttgtgggatacggctgggcaagagagatttaggagtctcataccaagctatataagagattcttctgttgcagtgatcatctatgatgttgcaagtcgacagacttttctaaacactataaagtggattgaggaagttcgtgcagagagaggtagtgatgttattattgttctggttgggaacaagaccgatcttgtggaaaaaaggcaagtttctgtagaggaaggagaagcaaaagctaatgaattaaacgtcatgtttatagaaacaagtgctaaagctgggttcaacattaaggctttatttagaaaaatagcagcggcgttaccaggaatggaaacgctttcctcaacaaaacacgaagaactggttgatgtgaatttgaagtcttcaagtgtgacttcatcccggcctgaatctggtggctgtgcttgttgatggactcttgatattggttcaacaatatgcaaggttagaagcagaaatatatcaaccggaaccctcatattttatttatttggtatcatcatttatcattaatgtatgtagccacttctctctttttgacttttcaatcattcagtttgttcttgactcgttatttgtcgtgtgtaaaaagatttatgtagaatgccaagat

SEQ ID NO: 4357 - DNA, 904 bp, Ambrosia trifida
ttttttgaaatcaaatcaaaatcgactgtgcaaacagagaattgacgaccaaattgttaaccagatcaacatattattctgattggatcaaataagattcaagatctagattagattagattgaagaacatggcaaagccagtatcagcactagccaaatacaagctggtgttcttaggtgatcaatccgtaggcaaaaccagcatcatcactcgctttatgtatgacaagttcgatacctcttatcaggcaaccattggaattgacttcttgtcaaagacaatgtatcttgaagatcggaccgttcgcctgcagttatgggatacggctgggcaagagagatttaggagtctcataccaagctatataagagattcttcagttgcagtgatcatctatgatgttgcaagtcgacagacttttctaaacactataaagtggatagaggaagtgcgtgcagagagaggcagtgatgtcattattgttctggttggtaacaagactgatcttgtggaaaaaaggcaagtttctgtagaggaaggagaagcaaaagctaatgagttaaatgtcatgtttatagaaacaagtgctaaagctgggttcaacattaaggctttatttagaaaaatagcagcggcgttaccaggaatggaaacgctttcctcaacaaaacacgaagaactggttgatgtgaatttgaagtcttcaagtgtgacttcatcccggcctgaatctggtggctgtgcttgttgatggactcttgatattggttcaacaatatgcaaggttagaagcagaaatatatcaaccagaaccctcatattttatttatttggtatcatcatttatcattaatgtatgtagccacttctctctttttgacttttcaatcattcagtttgtt

SEQ ID NO: 4358 - DNA, 849 bp, Brassica napus
gagagccgatcataaagacgcgtgtgtggaatcccaaatctgaatcgcaaaactcagatctggaatggcggcggtgacaccattagcgaagtacaagctcgtcttcctcggagatcaatccgtgggaaagaccagcatcatcactcgtttcatgtacgacaaattcgacaccacttatcaggcaactattgggattgattttttgtcaaagacaatgtacatggaggataggactcttcgtctccagctatgggatactgctggacaggagaggtttcgaagtctgattccaagttatatcagagattcttctgttgctgttattgtctatgatgttgcaaataggcagtcattattgaacacctctaagtggattgaggatgttcgtacagagagaggtagcgatgtcatcattgttctcgtgggtaacaaaacagatctcgttgacaagaggcaagtgtcaatagaggaaggggataacaaagctcgtgactttggagtaatattcattgagacgagtgcaaaggcaggatttaacatcaagccactcttccgcaagatttcagcagcattaccaggaatggacacactttcaacaaaacaaggtgatatggttgatgtcaacttaaagtcttcgaccaatgcgtctcaagcggagcaacaaggaggtggctgttcgtgttgattgaaatttaaatatactttaacagcaacagagtagaacaaaggattcattacttgattctggtataaggaaagagatttttacttgagaaactcttactattctttaaatgtttttctaatatcgagctgtgtaataatgatgcttaaaaaacttgacaagaa

SEQ ID NO: 4359 - DNA, 784 bp, Castanea mollissima
tttcttctttcttctctctcatccatattttcagaagagagggaaaattttctgagattcagatctaacgagcctaacctgcacaccccacatacacgaaatacactctataagaaggaaagaaagaaatggcagctgtgtctcctctggccaaatacaagctggtattcttgggtgaccaatccgtaggcaaaaccagcatcattactcgcttcatgtacgataaattcgacgccacctaccaggctacaattggaattgatttcttgtcaaaaacaatgtaccttgaagatcggacagttcgtttgcagctttgggatactgctgggcaagaaagatttaggagtctcattccaagctacatcagagattcttctgttgccgtaattgtctatgacgtagcaaataggcagtcattcctgaatattaacaggtgggttgaagaggtacgtacagaacggggcagtgatgtcatcatcgtacttgttgggaacaaaaccgatcttgttgataaaaggcaagtatctatagaggagggagatgccaagtctcgtgagtttggaatcatgtttatagaaaccagtgcaaaagcaggattcaatatcaagcctctcttccgtaagattgctgctgccttgccagggatggaaaccctttcttccacaaaacaggaagaaatggttgacataaatctaaaaccaactgtcaattcatcccatcaagagcagcaaggaggttgccggtgctagagaaacgtatctgtttcagaagattaagagagaga

SEQ ID NO: 4360 - DNA, 900 bp, Castanea mollissima
tgttcttaggggaccagtcagttggcaagaccagcatcatcacccgcttcatgtatgacaaattcgataacacctatcaggctacaatcggtattgattttctatcgaaaactatgtatcttgaagatcgaacagttcggttgcagttgtgggatacagctggacaggaaagatttagaagtctcattccgagctacattagagattcatctgttgctgtcatcgtgtatgatgttgcaagccggcaaacatttctaaacacttcaaagtggattgaagaggtgcgcactgagaggggcagtgatgtcatcattgtccttgttgggaacaaaactgaccttgtggaaaaaaggcaagtctccatagaggaaggagaagccaaagctcgtgagcttaatgtaatgtttattgaaaccagtgcaaaagctggctttaatataaaggcactgtttcggaaaattgctgctgctttaccaggaatggaaacactctcttcaacaaagcaagaagacatggttgatgtgaacttgaagtctactagtggtggtgcaacacaatcccagccccagtcaggtggatgctcttgttgagtgcggcattgttttaaaatttcaagcaactatgctctatttcttgctgtttgggttttcagccatcttcgccccagatctgtaaaggtttcatttagattcttttttccttcaaagtacttgttgtcggttataatcttttactgcattgcttgggaaattctcttagggaacacatgggtctaaagagctaggtgtagaactagcattggggaatttgttgtgttggttagacggtcataacctccgtgatatttagtaagatttactgactttaatagattttggtattaagcatgtgtaaaatgaa

SEQ ID NO: 4361 - DNA, 936 bp, Echinacea purpurea
caccgacagaagttaacctagtagcaaatcaaatgcgagtgttcatgttaatcatctttggcggtttctttctcggtgtcgtataaatccaacccattttttcttgtttctctctgtttcttccggacttgtctctattaacattttagatctgatctgatctgatcgccgagagaaaaacatctgaataatggcggtggtgtcacctcttgccaaatacaaactcgtgtttttgggcgatcaatccgttggcaaaaccagcatcatcactcgctttatgtacgacaagtttgatacctcatatcaggcaactattggaattgacttcttgtcaaagactatgtatcttgaagatcggacagttcgcctgcagttgtgggatacagctgggcaagagagatttaggagtctcataccaagctacataagagattcttcagttgcagtgattatatatgatgttgcaagtcggcagacttttctaaacactataaagtggattgaggaagttcgtgcagaaagaggtagtgatgtcattattgttctggtcggtaacaagactgatcttgtggaaaaaaggcaagtttctgtagaggaaggagaagcaaaagctgctgagctaaacgtcatgtttatagaaacaagtgcgaaggctgggttcaacattaaggctttatttagaaaaatagcagcagcactaccaggaatggaaacactttcttcgacaaaacatgaagaactggttgatgtgaatttgaagtcttcaagtgtgagttcatcccagcctgaatctggtggctgtgcttgttgatggaaggatgctaatcgggttcaacaatttgcaaggtcagaaacagaaatatatcaaccgaaaccttatgtttattgctttggtatcatcatttgccataaatgtatgtaaccatgtctctctca

SEQ ID NO: 4362 - DNA, 1124 bp, Lactuca sativa
aacaaattttgcagtttaccccataatcaatctaaacaaaaaggagtgaaattttaaacaagggagactcgatcaactgtattgctattccacccagcgactccatttcaaatcaattcaaaattgactgcttaaaacacgatttgcaactcaaaatctgagaggtctctagcaggatcatcatattccagtactacttcattgacgtgattccatcaaatcaacaaaatggcacgagcatcagcactagcaaagtacaagctagtgttcttgggtgatcaatccgtcggcaaaaccagcattattactcgctttatgtatgataagttcgatacctcttatcaggcaaccattgggattgacttcttatctaaaacaatgtatcttgaagatcggacagttcgtctgcagttatgggatacagctgggcaagagaggtttaggagtctcattccaagttacataagggattcttcggttgctgttatcacatatgatgtttcaagccggcaaacttttctgaacactataaaatggatcgaggaagtgcgtgcagagagaggtagtgatgttattattgttatggttgggaacaagactgaccttgtggacaaaaggcaagtgtcagtagaggaaggtgaagccaaagctactgagctcaatgtgatgttcattgaaacaagtgctaaagcggggttcaacatcaaggctttatttaggaaaatagcagcagcgttgccaggaatggaaacactttcatcaacaaaacatgaagaaatggttgatgtgaatttgaagtcaacaagcatgagttcatctcagcctgaatctggtggttgtgcttgttgatgatcaaagttgaaaagtttggaaacaaaatattgtgtttattggtttgttgttatcatttaaccacaaatgtatgtaacaaaattcgtatgtttttcccttttcatttgatattattacatttgtgacgggagtagaatcatcctgcattactgaggtgtagttttttttatgtataaaaggatttatgtggaatcgccaagattttgaattggttttttgtattgatgaatattttaaatcaaggtatttgtgtttgggaatctgcatatttg

SEQ ID NO: 4363 - DNA, 713 bp, Sesamum indicum
gttacttacccatcaaaactgaatcccacctcccccactgctctctttcctcgccatccttcatagattcagatccgatcatcatcatcgtcgtcctcgttgttgtctctctcaatatatactgctcctatggcggtggtgtcaccattagcaaagtacaagctggtgtttctgggcgatcaatccgtcggaaaaaccagcatcatcacccgtttcatgtacgataagttcgacaccacctatcaggccactattggcattgacttcttgtcaaaaactatgtacctcgaggatcgaacggttcgcttgcagctgtgggatactgctggtcaagagagattcaggagtcttattccaagctatatcagagattcttctgttgcagtgattgtctatgatgttgccaatcggcaatcattcttgaacacttcaaagtggattgaggaagtaagaaccgaacgaggcagtgatgttattattgttcttgtagggaacaaaactgatcttgttgataaaaggcaagtttcgattgaagaaggagatggtaaggctcgtgaatttggtgtcatgttcatagaaactagcgctaaagcaggtttcaatattaagcccctattccggaaaatagctgctgcactaccaggaatggaaacgctttcctccacaaagcaggaggacatggtcgatgtgaacttgaagccgacatcaaatgc

SEQ ID NO: 4364 - DNA, 788 bp, Cucurbita pepo
ccttttccgcggtttgctttagatctatcttcttgctccactttcctttgaattttcaccgatacacccttattgccttcatggcgacggtttctcctctcgccaagtacaagctcgtcttcctcggcgatcaatccgttggtaaaccagcattatcacccgcttcatgtacgacaagtttgataccacctatcaggctacaattggaattgactttttgtccaaaacaatgtaccttgaagatcgaacaattcggttgcagctttgggatactgctggacaagaaagatttaggagtctcattccaagttacataagagattcctctgttgcagtagtagtctatgatgtatctaatagacaatcgttcttgaacaccaccaagtggattgaggaggtacgaacagaacggggcagtgatgtgatcattgttcttgttgggaacaaaactgatcttgttgagaaaaggcaagtttcaatcgaagaaggtgatgccaaatcacgggagtttggagtcatgtttatagaaactagtgccaaagctgggttcaacatcaagcctctctttcgtaagattgctgcagcactgccagggatggaaactctgtcatcaacaaggcaggaggacatggttgacgtaaatttgaaacccgcagtgaattcatcccagacggaacagcaaggaggaggttgtgcatgctagaggatatgtaagttcaatacataaagacaaaaaaaaaaaaaaaaataactctgacaagtatagtaagtagtatacgactaactac

SEQ ID NO: 4365 - DNA, 666 bp, Panax ginseng
acagatttcagatccgatcgtcgactcatagcaaaagaagcaattaagtaattaataagcatggcggtggtgtcacctttggccaagtacaagcttgttttttgggagatcaatccgtcggtaaaacaagcattatcactcgcttcatgtacgataaattcgacaccacttatcaggctaccattggaattgatttcttgtcaaaaacaatgtaccttgaagatcgaacagttcgtttgcaactttgggatactgccgggcaagagaggtttaggagtctcattcccagctacatccgagattcttctgttgcagtgattgtttatgatgttgcaaatcgacaatcatttttgaacacgtctaagtgggttgaagaagtacgtacggaacgaggcagtgatgtcattatagtccttgttgggaacaaaactgatcttgttgataaaaggcaagtttcaattgaagaaggagatgctaaagctcgcgagtctggaatcatgtttatagagacaagtgcaaaagctggatttaatatcaagcctctatttcgaaagattgctgctgccttgccagggatggaaaccctttcatcaacaagacaggaagacatggttgacgtgaatctgaagcctactattaattcttcccagacagagcagcaagggg

SEQ ID NO: 4366 - DNA, 893 bp, Papaver somniferum
aataataaagagaatttgatggcagttgtatctcctttagctaagtataagctgtttcttgggcgatcaatctgttgggaaaacgagtatcattactcgtttcatgtatgacaagttcgatactacgtatcaggcgacaattgggattgattttctttcgaagacgatgtatcttgaggatcggacaattcgtttgcagctttgggacactgctggacaggagagatttaggagtctcattccgagttatattagggactcttctgttgcggtaattgtttatgatgtgtcgaatcgacagtcatttttgaacactgccaagtgggttgaggaggtgcggacagaacgaggaagtgatgtcattatcgtccttgtaggcaataaaactgatcttgttgataaaaggcaagtttcaatagaggagggagatgctaagtcacgcgaagatggtgttatgtttatagaaacaagcgctaaagcaggatttaatatcaagcctctattccgcaaaattgcttctgccttgccagggatggaaaccttttcctccacgaaacaagaagatatggtagacgttaacctgaaacctacctcaaatgtatcccaggaacaacagggaggtggctgtgcatgttaatgaagtatacatccataataggagatgaagcgatcagaataattatactgtgcgagcagactcaattcagcaagtaatattgagtatgataagcatgaaagcttattgagaaatggttggtcgataatcatatgaacagcatatttttttttcttgtagctggacctgattgattaaacgttttgtagtggttgctgatgcaaatttctcgtcctacattgtgttgcaaagccgtcccattctgttttatgttttt

SEQ ID NO: 4367 - DNA, 850 bp, Tropaeolum majus
acaacgacagagtgccactacggtccgggtcgtgatatttctttactttggattaacggaatatccaactctttcaagattcagatctaaaacctccccataaatggcgactgtatcacctttagccaaatacaagctggtctttttgggcgatcaatccgtcggcaaaaccagtattatcactcgcttcatgtacgataaattcgacaccacttaccaggcaactattggaattgactttttgtccaaaacaatgtaccttgaagatcggacagttcgtttgcagctttgggatactgctgggcaagagagatttaggagtcttattccgagttacatcagagattcttctgttgcagtaatcgtctacgatgtagctaataggcaatcatttttgaatacttctaagtggattgaggaggtccataccgaaagaggcagtgatgtcattattgttcttgttggaaacaaaactgatcttgtggagaaaagacaggtttcgatagaggaaggagataacaaggctcgtgagtctggagtgatgtttatagagaccagtgcaaaagcaggattcaatatcaagcctttgttccgcaagattgcttctgctttaccaggcatggagaccctttcatctgcgaaacaggaagacatggttgatgtgaacctgaagtcaaccgtgaattcatctcaaacacaggaacaaggaggggttgtgcatgttaaagagatgtatttaacatagactatatacagagattataaatacataatatttagcacaggaattatacaatcgttgaaaaattctacttgtagcaagaattctattacacaataacagcgtctt

SEQ ID NO: 4368 - DNA, 956 bp, Arabidopsis lyrata
cttcactttccaaaaataggctcttcttcttccttcagcttcttctcttaaaacatttctccgaagaatttgagaatctgactccaactttttcgatctttcaaaagaagaatggcgtcggtgtcaccattggcaaaatataaattggtgttcctaggagatcaatctgtcggcaaaaccagcatcatcactcgtttcatgtatgataagttcgacacaacctaccaggctactattggaatagacttcttatctaaaacaatgtaccttgaagatcgcactgttcgtttgcagctatgggatactgctggacaagaaagattcaggagtctaataccaagttacatcagagattcttctgttgctgttgttgtttatgatgtagccaatagactctcatttctcaacacatccaagtggatcgaagaagtccgtactgaaagagctggcgatgttatcattgttcttgtcggtaacaagactgatcttgtcgaaaaaaggcaagtttctattgaagaaggagatagcaaaggtcgtgaatatggagttatgttcatcgagacaagcgcgaaggcaggattcaatattaagcctttgtttcgcaaaatcgctgcggctttaccgggaatggaatcgtattcaaacactaaaaatgaggatatggttgacgtaaacctgaaaccgacttcgaattcatcccaaggtgatcaacaaggaggaggttgttcctgttgatgatcagaagaaagaaaagagatatatatttcccatgaacaagaagaaccttagatcgtccggttttagatcacagactggttccatcaatatcattgtctgtccaaatgctatattcaaagaaatgtagtgaaatgttagttttcaactatgaaacatgtttttgtgaattctgagttgttaccaagactctctctacatgtgagtgtatcttttatttt

SEQ ID NO: 4369 - DNA, 808 bp, Brassica juncea
cggcggtgacaccattagcgaagtacaagctcgtcttcctcggagatcaatccgtgggaaagaccagcatcatcactcgcttcatgtacgacaaattcgacaccacttatcaggcaacaattgggattgattttttgtcaaagacaatgtacatggaggataggactcttcgtctccagctatgggatactgctggacaggagaggtttcgaagtctgattccaagttacatcagagattcttctgttgctgttattgtctatgatgttgcaaataggcagtcattcttgaacacctccaagtggattgaggatgttcgtacagagagaggtagcgatgtcatcattgttctcgtgggtaacaagacagatctcgttgacaagaggcaagtgtcgatagaggaaggggatagcaaagctcgtgactttggagtaatattcattgagacgagtgcaaaggcaggatttaacatcaagccactcttccgcaagatttcagcagcattaccaggaatggacacactttcaacgagacaaggtgatatggttgatgtcaacctaaggtcttcgaccaatgcgtctcaaggggagcaacaaggaggtggctgttcgtgttaaattcaattttaatatactttttaacagcaacagagtagacagatttttaaaagaaaggattcataacctgatgggataaataatttctggtataaggaaatagatttttacttgagaaacacttgctgttctttaatttttgtttcaatatcgagctgtgtaataatgataataatcataccattaaaaca

SEQ ID NO: 4370 - DNA, 835 bp, Lupinus angustifolius
tgcgaatagcgtgttgtgttgtattgtgttggtcatcgtcaacttcttcttcttctatctattattatttgttgagagattgagatctagatctcagaaacatttgaaaatggcgacggtttctccattggcgaaatacaagctagttttcttaggagatcaatctgttggaaaaaccagcatcatcactcgctttatgtacgacaaattcgacactacctatcaggctactattggcattgactttttgtcaaaaacaatgtaccttgaagaccgaacaatccgattgcagctttgggatactgcagggcaagaaagatttagaagtctcattccaagctacataagagattcttctgtagcagttattgtatatgatgtagccaaccgacagtcatttctgaacacgaacaagtggattgatgaagtgcgtacggaacgtggcagtgatgttattattgtcttggttggaaacaaaactgatcttgttgataaaaggcaagtttctatcgaggaaggagacgccaagtcccgtgagagtggaatattgtttatagaaaccagtgcaaaagcaggcttcaatatcaagcctctatttcgtaagattgcttcagccttgccggggatggaaactctttcatctgcaaaacatgaagacatggttgacatcaaattaaaaaccactgcgagttcatcgcagacagagcaacaaggaggaggttgtgcatgctaaagaaagaatgttcacttggtacacaattctgggattgattgctcaaatggaaaaatgcagctgcagaaatgtgctttcattaccaatgctctacttggtaag

SEQ ID NO: 4371 - DNA, 1056 bp, Medicago truncatula
gtatttggtcgttcatttctttcgtctctttctctctgttttcttctttttcataacagatttttcagatattcattcattcattcagatctgaaaaatttcattgaaacagagagaaagaaaagaaaccgatccatttctctcataaatggcgacggtttcacctctcgccaaatacaagctcgttttcttaggcgatcaatccgttggcaaaaccagtatcatcacccgcttcatgtacgacaaatttgacaccacctatcaggctaccatcggtattgattttttgtcgaaaacaatgtaccttgaagatagaactgttcgtttgcagctttgggatactgcaggccaagaaagatttagaagtctcattccaagctacataagagattcttctgttgctgttattgtatatgatgtagccaacaggcaatcatttctgaacactaacaagtgggttgaggaggtgcgtcaagaacgtggtagtgatgttataattgtcttggttggaaacaaaactgatcttgtcgagaaaaggcaagtttctatagaagaaggagatgccaagtcaaaagagtttggaatcatgtttatcgaaaccagtgcaaaagcaggcttcaatatcaagcctttgtttcgtaagattgcttccgccttgccagggatggaaaccctttcttctacaaataaggaagacatggttgacgtaaatttaaaacccacagtgcattcatccaatacagagcagcagggaggaggttgctcatgttagaggagattctccaagaaatcactttatatacattttcactgagtataatactgggaatgacttcttaaatgtaaagtaaagctggaggaaacgtgctttcacatcaattatcctgcagttaattggtgtgtgggacaaattgcggtaatggttttgctgtatgacaaaaagattaaccgttattttttcatttgttatacaattagtccctggatgtaagattacaataataaacaagccctataaattgtctgtcttagatgtatgttattattttttatttg

SEQ ID NO: 4372 - DNA, 1433 bp, Pinus taeda
aaaatttgcttaaattgcggcaattctcacgccagttcattgtataagacctctcaattcgtgctgctcatattctctgtatttcatggtgctgtcggatctctctcgctgcggtttctctctgatcactctgatttcaattgggtggacacccatttatttaaagagagaaacccacgtcataagattggatatcaagtttgacaggtattgggatcgaatctgagtagagaaatcttaattggtaagcatctgagcattgcaaacagaatgagtacagccatggcaagtgtctcgcctcttgccaaatataagcttgtgttcttgggagatcagtccgttggcaagaccagcattatcactcgcttcatgtatgacaagtttgacaacacgtatcaggctaccattggtatcgatttcttgtccaagacaatgtaccttgaggatcgaactgttcgtttgcagctgtgggatactgcaggccaggagcgattccgtagtcttatcccaagttacattcgagactcttctgttgctgtcgttgtttatgatgttgcaatcagacagtcattcctcaacactgccagatggattgaagaagtacgcacggagcgaggtagtgatgtgattattgtgcttgttggaaacaaaacagatctggttgacaaaaggcaagtctcaattgaagaaggtgatgcaaagtctcgggaatttggggtgatttttattgaaaccagtgcaaaagctggatttaacattaaggccttgtttcgtaagatagcagctgcattacctggaatggaagctctctcatcaacccataaggaagacatggttgatgtgaatttaaaatccacagtgactgcaactgaaacagagaagaaggcaggaggatgctattgctaagtatgtagtattgctttgtctcttcttggtggctgagtttttggtagaacttagttggatgtggaaccatcttcagatctcatggagcatcactggagtaggatacatttctcatgtttccctaacagtaatgtatatcgagaaatgggagactgggatgcgcaattttattgtaagaattatatatttggtagacgattattttgcatgcttgtcattaagcaactaagttaaagtaaattttttgaaatggataatcaagaatgtaattccttaatgcatcaatggacttaattggtcttcggcatcgtttgtggataactgatgttttccactctttattgtacgacattggctctttattgtatgagagtgcttactgtactctttgataggtagagattttttttgagaagattattgattacctgcttaaaactgactgtcttcgaagggggtggaaagtgggagcttataccttccgatcattttctatccctactagcaagcaataaaattattttcac

SEQ ID NO: 4373 - DNA, 865 bp, Eutrema parvulum
atcaaaactacaaatattcttcttagtgtcgacagatggcgtctgtgtcaccgttggccaagtataaattggtgttcttaggagatcaatctgtcggaaaaacaagcatcatcacacgtttcatgtatgataagttcgatacaacctaccaggcgactattggaatcgatttcttatcgaaaacaatgtaccttgaagatcgaactgttcgtctacagctttgggatactgctggacaagaaagattcaggagtttaatcccaagttacataagagattcttctgttgctgtagttgtttatgatgtagccaataggctttcatttctcaacacatccaaatggatcgaagaagtccgcactgaaagagccggtgatgttatcattgttcttgtcgggaacaagacagatcttgtcgaaaaacggcaagtctcgattgaagaaggagatagcaaaggtcgtgaatatggagttatgttcattgagacaagcgcgaaagcaggattcaatattaagcctttgtttcgcaaaatcgctgcagcattaccgggaatggaatcgtattcaaacacgaaaactgaggatatggttgatgtaaacttgaaaccgacttcgaattcatctcaaggcgatcaacaaggaggaggctgttcgtgttgatgatcaaagaaagataagagagaaatctttcccacgaacaagaaccttagatcgttcggtttagatctcagactggttccatcaatatcatttatctgtccaaatactatagagaaaagctctgaaaatgtcagtttccacttttaacacatctttttgtgaatccgacttgttactttcactctacatgtgattgttattttttt

SEQ ID NO: 4374 - DNA, 906 bp, Medicago truncatula
ctcctctccgtattgtgcccgtcaatcaccccaacgagatcaaccccgattcgatccagggaggaggaggaggaggagggtttatctcgccatcatctttccctaattgaaacaatattaattggatttgaaaatggcgccagtatcagcattagcaaagtacaaactggtatttttgggtgaccaatctgttggtaaaaccagcatcatcactcgcttcatgtacgataaatttgataacacctatcaggcaacaattggtattgattttctatcaaaaaccatgtatcttgaagatcgaaccgttcgactacagttgtgggatacggctggacaggaaagatttagaagtcttattccaagctacatccgggactcatccgtagccgttattgtatatgatgttgcaagccgacagactttcttaaatacaacaaagtggattgaagaggtgcgaacagagagaggcagtgatgtcattattgttcttgttgggaacaaaactgatctcgttgaaaagagacaagtctccatagaggacggggaagcaaaagcacgtgagctcaatgtcatgtttattgaaactagcgctaaagctggatttaatattaaggccctttttcggaaaattgctgctgcattacctggaatggaaacactatcttctgcaaaacaagaagacttggttgatgtaaacttaaagtcttcatctgggaatgctcaatctcaaactcaatcaaatatggttgatgtgaacctaaaatcttctagctgccatgagtctcaacctcagtctggtggatgttcttgctgaatgtgccttatcttagtgctctttgatctttatgcttcattttatttgttttgaactgtacgtgactgaactatgtaaaggttctatagtgt

SEQ ID NO: 4375 - DNA, 989 bp, Papaver somniferum
ttagaaagagagcaataataaagagaatttaatgcggttgtatctcctttagccaagtataaactggtttcttgggcgatcaatctgttggtaaaacgagtatcattactcgtttcatgtacgacaagtttgatactacgtatcaggcgacaattgggattgattttctttcaaagacgatgtatcttgaggatcggacaattcgtttgcagctttgggacaccgctggacaggagagatttaggagtctcattccaagttatattagggactcttctgttgcagtaatcgtttatgatgtatcaaatcgacagtcatttttgaacactgccaagtgggttgaggaggtacgaacagaacgaggaagtgatgttatcattgtccttgtaggcaataaaactgatcttgttgataaaaggcaagtttcaatagaggagggagatgccaagtcacgcgaagatggtgttatgtttctagaaacaagcgctaaagcagggtttaatatcaagcctctattccgcaaaattgcttctgccttgccagggatggaaaccttttcctcaacgaaacaagaagatatggtagatgttaacctgaaaccaacctcaaatgtatcccaggaacaacagggaggtggctgtgcatgctaatgagtatacatccacaataggagatgaagcgatcagaagaataattatactgtgcgaacagacttaattcagcaagtgatattgagtttgataggcatgaaagcttaattgagaaatggctggtcgataattatatgaacagcatattctttttctgttgtagctggacctgattgattaaagtttggtagtggttgctgatgcaaatatctcgtcctacattgtgttgcgaagctgtccattctgttttatctttttgtttaccttctcttgtgtgcgtttttcatggtgatattttctacttagatttactaaaaagcaatagatcatgatttattt

SEQ ID NO: 4376 - DNA, 946 bp, Trifolium pratense
tctctcataaatggcgacggtttcacctctcgccaaatacaaactcgttttcttaggcgatcaatctgttggcaaaaccagcatcatcacccgtttcatgtacgacaaattcgacaccacctatcaggctactatcggtattgactttttgtcaaaaacaatgtaccttgaagatagaactgttcgtttgcagctttgggatactgcaggtcaagaaagatttagaagtctcattccaagctacataagagattcttctgttgctgttattgtatatgacgtagctaacaggcaatcatttctgaacacaaacaagtgggttgaggaggtacgtcaagaacgtggcagtgatgttatcattgtcttggttggaaacaaaactgatcttgtcgagaaaagacaagtttctatagaggaaggagatgccaagtccaaagaatttggaatcatgtttatagaaaccagtgcgaaagcaggcttcaatatcaagcctttgtttcgtaagattgcttcagccttgccagggatggaaactctttcttctacaaataaggaagacatggttgatgtaaatttaaaacccacagtgaataattccaatacagagcaacagggaggaggttgcgcatgttaaaggatattctcctaagaatcagtagatatatatgttcattgagtattacttggaatgactgcttaaatgtaaagtgaagcggaggaaaagtgctttcacatcaatgatccttcagttaattggtgcgtgggacaaattgcggtaatggttttgatgtatgacaaaaagattgatattattttttcatttgttatacaattagtccctggatgtaagaatacaggtaataaacaagccctctaaattgtctgtcttagatgtatgctatcctttcttctctttttgtcaaaaaagaagaaagtaccggctgcg

SEQ ID NO: 4377 - DNA, 997 bp, Taraxacum officinale
gcggggaggtgtaaatttcgaaaggggagactcgatcaactgtattgcgactctacccagagaccccgtttcaaatcaattcaaaatcgactgcgcaaaacagaaaatttgcagctcaagttttttcccaggttcatcatataccagtactacttcattgcagtgattcaatcagatcaagatcaacaaaatgacacgaccatcagcactagcgaagtacaagctggtgttcttgggtgatcaatccgtcggcaaaaccagcattatcactcgctttatgtatgataagttcgacacctcttatcaggcaaccattggaattgacttcttatctaaaacaatgtatcttgaagacaggacagttcgtctgcagttatgggatacagctggacaagagaggtttaggagtctcattccaagttacataagagactcttcagttgctgtcatcacatatgatgtttcaagtcgacaaactttccttaacactataaaatggatcgaagaagtgcgtgcagagagaggtagtgatgtcatcatagttatggttggcaacaaaactgaccttgtggacaaaaggcaagtgtcagtagaggaaggtgaagctaaagctactgagctcaatgtcatgttcattgaaactagtgctaaagcaggcttcaacataaaggctttatttaggaaaatagcagctgctttaccaggaatggaaacactgtctgcaacaaaacatgaagaaatggtggatgtgaatttgaagtcaacaagcatgagttcatcccagcctgaatctggtggctgtgcttgctgattaaacccttttaaaatcaaaatattcaaatggaccccttgtgtttattggtgtgttgttatcatttaccaaagatgtatgtaacaaattcgtgtcttttcaattggtaaacattagtaacgggagtagaatcatattgtgttactgaggtgtagttttcatgtaaaaaaggatttatgtggagtc

SEQ ID NO: 4378 - DNA, 631 bp, Eragrostis curvula
ggacccacctgactgaccccgccgccgccggaggagggagaagaggaggaaagcggagatggctcccgtgtcggcgctcgccaagtacaagctggtcttcctcggcgaccagtccgtcggcaagaccagcatcatcacccgcttcatgtacgacaagttcgacaacacctaccaggctaccatcggcattgatttcctctcaaagacaatgtaccttgaagatagaactgtgcgactccaactctgggatacagctggtcaggaaagattcaggagtttcattcccagctatatcagagactcttcagtcgctgtcattgtattcgatgttgcaagcagccagtccttcttaaatacttccaagtggatagaggaagtccgcactgagaggggaagtgatgttatcattgtgcttgttgggaacaaaaccgaccttgtcgacaagagccaagtctccatagaagagggggaagccaaggcgaaggacctcggtgtgatgtttattgaaaccagtgctaaagctggttttaacattaaggcactgttccgtaagattggtgctgcacttcctggaatggagaccctgtcatcagcgaaagcaggaagacatggtaaatgtgaacttgagcac

SEQ ID NO: 4379 - DNA, 757 bp, Medicago truncatula
gaacggtttttcagttatcttcaactgaattttctccctttcttcgttttctgtttctcgagaattttgagagattcagattcagatctgagccaaattcgcgttactcaagttcccaaagaaggaagaaacaaaaatggtgactgtatcacctctcgccaaatacaaactcgttttcttaggtgatcaatccgttggtaaaactagcatcatcactcgctttatgtatgataaattcgacactacctatcaggcgacaattggtattgactttttgtcaaaaacaatgtaccttgaagatcgaacagttcgtttgcagctctgggatactgcagggcaagaaagatttagaagcctcattccaagttatataagagattcttcggtcgccgttattgtgtatgacgttgctaatcggcaatcatttcttaacactaacaagtgggttgaggaggtacgtgcagaacgaggcagtgatgttattatcgttttggttggaaacaaaactgatcttgttgaaaaaaggcaagtctctatagaggaaggagatgccaagtcgcgtgagagcgggatcatgtttatagaaactagtgcaaaagcaggatttaatatcaagcctttatttcgcaagattgcttcagccttgcccgggatggaatctctttcaacaaagcaagatgacatggttgatgtaaatttaaaatctaccgcgtattcatccaggacagagcagcaaggtggaggttgttcgtgctaa

SEQ ID NO: 4380 - DNA, 921 bp, Raphanus sativus
gggggggcgtctagagagcgatctaaaatcaaaacctcaggtgccttcgattctcaaatctaaattgcaaactcagatctcgagaggaagaaaatggcggcggtgacaccattagcaaagtacaagctggtcttccttggagatcaatccgtcggcaagaccagcatcatcactcgattcatgtacgacaaattcgacaccacttatcaggcaactattgggattgattttttgtcaaagacaatgtacatggaggataggactcttcgtctccaactatgggatactgctggacaggagaggtttcggagtctgataccaagctatatcagagattcttctgttgctgttattgtctatgatgttgcaaataggcagtcattcttgaacacctccaagtggattgaggatgttcgtacagagagaggtagtgatgtcatcattgttctcgttggtaacaaaactgatctcgttgacaagaggcaagtctcgatagaggaaggagataccaaaggtcgtgactttggagtaatattcatcgagacgagtgcgaaagctggatttaacatcaagccactattccgcaagatatcagctgcattaccaggaatggacacactttcaacgagacaaggtgatatggttgatgtcaaccttaagtcatccactacatctcaagcggagcaacaacaaggtggctgttcgtgttgattggatttacatatactttaacagcaacagagtagacagatcttttaaaaagaaaggattcataacttgatgggataaataaattctggtatgaagaaagagatttttactagtcaaactcttactattctttaagatgttttgagttcaatatcgttctgtgtaatgaatgacgcataaaagcttaagaagaatgttttgctttgttct

SEQ ID NO: 4381 - DNA, 847 bp, Eutrema halophilum
aagattctgagtgtcggagatggcatcggtatcaccattggcgaagtataaattggtgttcttaggagatcagtctgtcggaaaaaccagcatcatcacacgtttcatgtatgataagttcgacacaacctaccaggctactattggaatcgatttcctatcgaaaacaatgtaccttgaagatcgaactgttcgtctgcagctatgggacactgctggacaagaaagattcaggagtttaatcccaagttacataagagattcttctgttgctgtagttgtttatgatgtagccaataggctttcatttctcaacacttcaaagtggatcgaagaagtacgcactgaaagagccggtgatgttatcattgttcttgtcggaaacaagacagatcttgtcgaaaaaaggcaagtctcgattgaagaaggagatagcaaaggtcgtgaatatggagttatgttcattgaaacgagcgccaaagcaggattcaacattaagcctttgtttcgcaaaatcgctgcggcattacctggaatggaatcgtattcaaacactaaaaccgaggatatggttgatgtaaacctgaaaccgacttcgaattcatcccaaggtgatcaacaaggagtaggatgttcgtgttgatgaccaaaagaaagaaaagagagaaatctttcaagaacattataaattgttcggtttagatctcagtccggttccatcaatatcattgtctgtccaaatgctataaagaaagctgtgaaattgttagtttccactttgaatacatctttttgtgaatccaagttgttactttgactatacatgtgagtgtatttttattttctt

SEQ ID NO: 4382 - DNA, 1102 bp, Arachis hypogaea
atagaacgagggccagtatttggagaagagaagaaattgcagacagattcaaatcacgtatacattgattgaatcatttgttaagaactgagaaattaaagagggaaggatgcaaacggaaggcgaattgaattgaatttggaatcttttcgtgtgagataaaaaatggcgggattgtcagtgtccgctcttgcgaaatacaagcttgtgttcttaggtgatcagtccgtcggaaaaaccagcatcattacccgattcatgtacgacaaattcgacaacacctaccaggctacaattggtattgattttctatcaaaaactatgtatcttgaagatcgaaccattcggctgcagttgtgggatactgctggacaagaacgattcagaagtcttattccaagctacattagagattcatctgttgccgtcatcgtctatgatgttgcaagccgtcagacgttcctaaacacagtaaggtggatcgaggaggtgcgcagtgaaagaggcaacgatgttattcttgttcttgttggcaacaaaactgaccttttggacaagaggcaggtctctacagaggatggggaagaaaaggcacgtgagctaaatgttatgtttattgaagctagtgcaaaagctggttttaacataaaggctctctttcgtaaaattgctgctgcgttacccggaatggaaacattatcttcctcgaaacaagatgatatggtcgatgtcaaccttaaaacttctggtggcaatgattctcaagctgagggtggttgttgttgatcctgccttgtcttccagtttttatttatttatttatatttatttattatatttgtgtatctgtctgctccatgctgccttgtttttggatgtgtttgcttcatatttgtagaaaaaaaaggttcattagtctttttagtactttgttagctatattgcaaggggaaaacgaaattaagaacaaaacaagtagaagattcggcagtgaactaatttagttcttctttgttattacgtacttaaattaatttaattagtaaagtaatttttagttaattgttcccggtacgttccttttgtattattagtaagtaaa

SEQ ID NO: 4383 - DNA, 982 bp, Arabidopsis thaliana
attctttcttcttcctccagctttcatcttctcttcaaacatttctccgaggaatttgagaatctgaatccaacattttcgatctttcaaaagaagaagaatggcgtcggtgtcaccattagcgaaatataaactggtgttcttaggagatcaatctgtcggcaaaaccagcatcatcactcgtttcatgtatgataagttcgacacaacctaccaggctactattggaattgacttcttatcgaaaacaatgtaccttgaagatcgaactgttcgtctgcagctatgggatacagctggacaagaaagattcaggagtttaataccaagttacataagagattcttctgttgcagttgttgtttatgatgtagccaatagactctcatttctcaacacatccaagtggatagaagaagtccgtaatgaaagagccggcgatgttatcattgttcttgtcggtaacaagactgatcttgtcgaaaaacggcaagtttctattgaggaaggagatagcaaaggtcgtgaatacggagttatgttcattgagacgagcgcgaaagcaggattcaatattaagcctttgtttcgcaaaatcgctgcggcattaccgggaatggaatcgtattcaaacactaaaaatgaggatatggttgatgtaaacctgaaaccaacttcgaattcatcccaaggtgatcaacaaggaggagcttgttcatgttaatgaccagaagaaagaaaaagagatgtatctttgtcatgaacaagaagaaacttagatcgtccggttatagatctcagaatggttccatcaatatcattgtctgtccaaatgctatataaaaagaaatgttgtgaaaggttagtattcaactatgaacacatgtttttgtgaattctgagttgttaccaacactctctacatgtgatgtgacttgtgagtgtatctttatcttaataagagcagaaaatcattttagtt

SEQ ID NO: 4384 - DNA, 951 bp, Brassica oleracea
agcttctctctcacgatcgaatgcatttttttgcattgtgtcaagaagaagaagaacattgaaatcaagaagatcctctttgagcgttagagatggcttcggtgtcaccattggctaagtataaactggtcttcttaggagatcaatctgtcggaaaaacaagcatcatcacacgtttcatgtatgataagttcgacacaacctaccaggctactattggaatcgatttcttatcgaaaacaatgtaccttgaagatcgaactgttcgtctccagctttgggatactgctggacaagaaagattcagaagtttgattccaagttacataagagactcttctgttgctgtagttgtttatgatgtatccaataggctttcatttctcaacacatctaaatggatcgaagaagttcgtaccgaaagagccggtgatgttatcattgttcttgtcggaaacaagaccgatcttgtcgataaaaggcaagtctcgattgaagaaggagacagcaaaggtcgtgagtacggagttatattcattgagactagtgcaaaagcagggttcaatatcaagcctttgtttcgcaaaatcgctgcggcgttaccagggatggactcgtattcaaacatgaaaactgaggatatggttgatgttaacctaaaagctacttcgaattcatcccaaggcgaccaacaaggaggaggctgctcgtgttgatggttcacaaagacaagagaagagagtaatctttcttacgaacaagagccttagatcgttcggcttgcatctccgactggttatcgtttatctgtctaaatgctataaagaagctgtgagatgtcagtttccactttttaacatatctgtctgtgaatccgagttgttactgtgactttacgtgtgagtgtatttgttttacagtatggttgatgcagttaatttgcagtatatt

SEQ ID NO: 4385 - DNA, 891 bp, Brassica rapa
gcattgtgtcaagaagaagaagaacattgaaatcaagaagatcctctttgagcgttagagatggcttcggtgtcaccattggctaagtataaactggtcttcttaggagatcaatctgtcggaaaaacaagcatcatcacacgtttcatgtatgataagttcgacacaacctaccaggctactattggaatcgatttcttatcgaaaacaatgtaccttgaagatcgaactgttcgtctccagctttgggatactgctggacaagaaagattcagaagtttgattccaagttacataagagactcttctgttgctgtagttgtttatgatgtatccaataggctttcatttctcaacacatctaaatggatcgaagaagttcgtaccgaaagagccggtgatgttatcattgttcttgtcggaaacaagaccgatcttgtcgataaaaggcaagtctcgattgaagaaggagacagcaaaggtcgtgagtacggagttatattcattgagactagtgcaaaagcagggttcaatatcaagcctttgtttcgcaaaatcgctgcggcgttaccagggatggactcgtattcaaacatgaaaactgaggatatggttgatgtcaacctaaaagctacttcgaattcatcgcaaggcgaccaacaaggaggaggctgttcttgttgatgattcacaagaaagacaagagaagatagtaatctttcttacgaacaagagtcttagatcgttcggcttgcatctccgactggttatcgttttatctgactaaatgctataaagaagctgtgagatgtcagtttccatctttaacatatctgtttgtgaatccgagttgttactgtgactttacgtgtgagtgtattgttttacagt

SEQ ID NO: 4386 - DNA, 864 bp, Brassica napus
attgaaatcaagaagatcctctttgagcgttagagatggcttcggtgtcaccattggctaagtataaactggtcttcttaggagatcaatctgtcggaaaaacaagcatcatcacacgtttcatgtatgataagttcgacacaacctaccaggctactattggaatcgatttcttatcgaaaacaatgtaccttgaagatcgaactgttcgtctccagctttgggatactgctggacaagaaagattcagaagtttgattccaagttacataagagactcttctgttgctgtagttgtttatgatgtatccaataggctttcatttctcaacacatctaaatggatcgaagaagttcgtaccgaaagagccggtgatgttatcattgttcttgtcggaaacaagaccgatcttgtcgataaaaggcaagtctcgattgaagaaggagacagcaaaggtcgtgagtacggagttatattcattgagactagtgcaaaagcagggttcaatatcaagcctttgtttcgcaaaatcgctgcggcgttaccagggatggactcgtattcaaacatgaaaactgaggatatggttgatgttaacctaaaagctacttcgaattcatcgcaaggcgaccaacaaggaggaggctgctcgtgttgatggttcacaaagacaagagaagagagtaatctttcttacgaacaagagccttagatcgttcggcttgcatctccgactggttatcgtttatctgtctaaatgctacaaagaagctgtgagatgtcagtttcctctttttaacatatctgtctgggaatccgagttgttactgtgacttttcgtgcgagtgtatttgttttacagt

SEQ ID NO: 4387 - DNA, 778 bp, Brassica napus
gtccggcgaagattggaaactctttccccgcgacgtatctaagatccgtccagctagtttgatctctcgaggaatcatggcgccggtatcggcactcgccaagtataagctggtgtttctgggagatcaatccgtggggaagacgagtatcatcactcggttcatgtacgacaaattcgacaacacttaccaggccacgattggtattgattttctgtcaaagacaatgtacctcgaagatcggactgtcagactgcagttgtgggatacagcagggcaagagagattcaggagtcttattccgagctatattagggattcttctgttgctgttattgtctatgatgttgccagcaggcaatctttcctaaacactactaagtggatcgatgaggttaggacagagcgtggtagtgatgtcattgtcgttcttgtgggaaataaaaccgaccttgtggacaaaaggcaagtgtcaatagaggaagcagaagccaaggctcgtgagcttaatgtaatctttatcgaaaccagtgccaaagcaggcttcaacataaaggcgcttttccgcaagatcgcagcagctttgccaggaatggaaacactgtcttcgacaaagcaagaggatatggttgatgtcaatctcaagtcttccaacgccaatgcatctttggctcagcagcaatcaggaggatgttcttgtaaattccaacaatcaccgcaaattgatagtgaacaagaaaaaaatacacagatataaaagtcctcgagcctttttttt

SEQ ID NO: 4388 - DNA, 1020 bp, Selaginella moellendorffii
gcgcgaaagcattctttcgataatattttgtccacgtggttaacggtatattccgcgttttcgattgacgcgttggctagggtttgtgacggggaggggagcgttggatctgagatccagctcgcgaattcgcgatgatccccgcgtagatccgcgcccagctccttctcggatgtggaatgccgccgttcttgactcgcggatcggagcttttcggggataggttttacgaggtcttagggaaaggtttctaggggaagggattctcgagcgaggatgggagtgccgaccgcgacggtgtccccgcttgcaaagtacaagctcgtctttctcggcgatcagtctgtggggaagacgagcatcatcacgcgattcatgtatgataagtttgacaacacataccaggctacgattgggatcgatttcttatccaagaccatgtatctggaagatcgcacagtccgcttgcagctctgggatactgctggccaggagcgcttccggagtttgattcccagctacatacgggattcgtccgtggcagtcgtcgtgtacgatgtagcgaatcgccagtcgtttctaaacacggccagatgggtggaagaagtccgcacggagcggggtagcgatgtcatcatcgttctcgtcgggaacaagacggatttggttgataaaaggcaagtatcgatcgaggagggcgatgcgaaagcgagagaattcggagttatgtacattgaaaccagtgccaaggccggattcaacatcaaggctctcttcaggaaaatcgctgcggcgttaccgggaatggaagcgctctcgtccgctaagcaagaagatctagtggacgtcagcttgaagacaaatccccctcccagcgagaccaaggctggtggctgcgcttgttaagcttagcaatcttcgatcgacacgactttacgtacgaagaaggttatcttttttggcgatgtggataataatgttcctctcttcctctcttatatagatatgctcctttctatt

SEQ ID NO: 4389 - DNA, 941 bp, Selaginella moellendorffii
gacggggaggggagcgttggatctgagatccagctcgcaaattcgcgatgatccccgcgtagatccgccccgagctccttctcggatgtggaatgccgccgttcttgactcgcgcgatcggagcttttcggggataggttttacggcaagcgcgaggtcttagggaaaggtttctaggggaagggattctcgagcgaggatgggagtgccgaccgcgacggtgtccccgcttgcgaagtacaagctcgtctttctcggcgatcagtctgtggggaagacgagcatcatcacgcgattcatgtatgataagtttgacaacacataccaggctacgattgggatcgatttcttatccaagaccatgtatctggaagatcgcacagtccgcttgcagctctgggatactgctggccaggagcgcttccggagtttgattcccagctacatacgggattcgtccgtggcagtcgtcgtgtacgatgtagcgaatcgccagtcgtttctaaacacggccagatgggtggaagaagtccgcacggagcggggtagcgatgtcatcatcgttctcgtcgggaacaagacggatttggttgataaaaggcaagtatcgatcgaggagggcgatgcgaaagcgagagaattcggagtcatgtacattgaaaccagtgccaaggccggattcaacatcaaggctctcttcaggaaaatcgctgcggcgttaccgggaatggaagcgctctcgtccgctaagcaagaagatctagtggacgtcagcttgaagacaaatccccctcccagcgagaccaaggctggtggctgcgcttgttaagcttagcaatcttcgatcgacacgactttacgtacgaagaaggttatcttttttggcgatgtggataataatgttcctctcttcctctcttatatagatgctcctttctatt

SEQ ID NO: 4390 - DNA, 1204 bp, Ricinus communis
cgcatctctgtttgttcgtatcatttctgagagagaaaattgtatcagattcagatccaaaccattaaacaaaaccaaaaaaaaaaaacaaaaaaaaacaaagaagaagaaaagaagaatggcgacagtatcaccactggcgaaatacaagctggtgttcttaggagatcaatcagtaggcaaaaccagcatcatcactcgtttcatgtacgataaattcgacaccacttaccaggctacaattggaattgactttttgtcaaaaacaatgtaccttgaagatcgaactgttcgcttgcagctttgggatactgctgggcaagaaagatttaggagtcttataccaagttatatcagggattcttccgtcgctgtaattgtctatgatgtagcaaacaggcaatcatttctcaacacttctaagtggattgaggaggtacgaacagaacgaggcagtgatgtcattgtagtccttgtcggaaacaaaactgatcttgttgataaaagatttattttgtttaattcggctgtttatgtatttaacaggcaagtgtccatagaggaaggagataacaaggctaaggagtttggggtgatgtttatagaaaccagtgcaaaagcaggattcaatattaagcctctattcaggaaaattgcttctgccttgccggggatggaaacactttcttcaacgaaacaggaagatatggtcgatgtgaaccttaagccttctgtcaattcatcccagaatgagcagcagggtggcggttgcgcctgttagaaaactgtatttaaaagagacagagaaattgaagcacttacaatactcagttatactcgattcacaatacaatacggatggcaattttgtcataaactacttcgacagcaaagaagatatgtgctcagaatggtgcatctcgcatatgccatcaagttttaagtgtctaagggacagaaaactgtgggtctaatccaagatggtacaatcagcaatttgatgtgtttcttatatttgttttatatatgtactttcccttcaaacttctcttttctctgagtgattttttgaactttttttctcataacttattgctatagaagcatattcttaggttactgggggacatttatgtttgtaagtttagattaagattatggcacataatgtttctttttctcacaagtttgatgaaaccaaatt

SEQ ID NO: 4391 - DNA, 844 bp, Vicia sativa
gttttcttgggcgatcagtccgtcggaaaaaccagcatcatcactcgcttcatgtacgacaaattcgacaatacctatcaggctacaatcggcattgattttctatcaaaaactatgtatctcgaagatcgaactgttcggctgcagttatgggatacagctgggcaggagagatttagaagtcttattccaagctacattagggactcatctgttgctgtgatcgtttatgatgttgcaagtcgtcagactttcctaaacacatcaaagtggattgaagaggtgcgtagtgagagaggaagcgatgttattgttgttcttgttgggaacaaaactgaccttgtggataagaggcaagtctccacagaggaaggggaagcaaagtctcgggagctaaacgttatgtttatagaagctagtgccaaagccggctttaatataaaggccctctttcgaaaaattgctgctgcattacctggaatggaaacactctctaccacaaaacaagaagacatggtagatgtgaacctaaggtcttctgccagccatgattctcaacctcagtctggtggatgtgcttgctgaacaagcctggtagttgtcttaaaaaagttttgtaacttttctgcttcttgctatttgttttgggttgtgggttgcttcagatgtgtaaaggttcttttgtcttctagactttaatagctttgcgtgggaaaaattatagaaaacaagtggagacgtagcagtaactgatttattgtttagtatttattgaaagatattcttcattattattgtgaaaaacttgctaggaatttgttgcaatttacataaggaaggttac

SEQ ID NO: 4392 - DNA, 1311 bp, Pinus taeda
gctgctcatattctctgtatttcatggtgctgtcggatctcggtcgctgcggtttctctctgatcactctgatttcaattgggtggacacccatttatttaaagagagaaacccacgtcataagattggatatcaagtttgacaggtattgggatcgaatctgagtagagaaatcttaattggtaagcatctgagcattgcaaacagaatgagtacagccatggcaagtgtctcgcctcttgccaaatataagcttgtgttcttgggagatcagtccgttggcaagaccagcattatcactcgcttcatgtatgacaagtttgacaacacgtatcaggctaccattggtatcgatttcttgtccaagacaatgtaccttgaggatcgaactgttcgtttgcagctgtgggatactgcaggccaggagcgattccgtagtcttatcccaagttacattcgagactcttctgttgctgtcgttgtttatgatgttgcaatccgacagtcattcctcaacactgccagatggattgaagaagtacgcacagagcgaggtagtgatgtgattattgtgcttgttggaaacaaaacagatctggttgacaaaaggcaagtctcaattgaagaaggtgatgcaaagtctcgggaatttggggtgatttttattgaaaccagtgcaaaagctggatttaacattaaggccttgtttcgtaagatagcagctgcattacctggaatggaagctctctcatcaacccataaggaagacatggttgatgtgaatttaaaatccacagtgactgcaactgaaacagagaagaaggcaggaggatgctattgctaagtatgtagtattgctttgtctcttcttggtggctgagtttttggtagaacttagttggatgtggaaccatcttcagatctcatggagcatcattggagtaggatacatttctcatgtttccctaacagtaatgtatatcgagaaatgggagactgggatgcgcaattttattgtaagaattatatatttggtagacgattattttgcatgcttgtcattaagcaactaagttaaagtaaattttttgaaatggataatcaagaatgtaattccttaatgcatcaatggacttaattggtcttcggcatcgtttgtggataactgatgttttccactctttattgtacgacattggctctttattgtatgagagtgcttactgtactctttgataggtagagatttttttgagaagattattgattacctgcttaaacctgactgtcttcgaagggggtggaaagtgg

SEQ ID NO: 4393 - DNA, 705 bp, Chelidonium majus
ctcgctaaatacaaactcgttttcttgggcgatcaatctgttggcaaaaccagtatcatcactcgttttatgtacgacaaattcgatactacctatcaggctactattggcattgattttctctcgaagacgatgtaccttgaagatcgaacaattcgcttgcagctttgggataccgctggacaggagagatttaggagtctcattccaagctacattagggattcttctgttgcagtaattgtatatgatgtagctaatcgacagtcatttttgaacacttccaagtggattgaggaagtacgaactgagcgaggcagtgatgtcattatcgtccttgttggcaataaaactgatcttcttgagaaacggcaagtttcaatagaggaaggggattccaagtcacgggatgatggggttatgtttattgagaccagcgctaaagcagggttcaatatcaagccattattccgcaagactcgccctgctgccttgccagggatggaatccttttcttcaacaaaacaggaagatatggttgacgtgaacctgaagcctactgtgaattcatctaacacagagcaacaaggaggaggttgtgcgtgctaataacatacataataggaggatgaagtgaatggtatagttagatttacccaaaattctgattggaaattattgagaggaaaagaaagaaaaaactat

SEQ ID NO: 4394 - DNA, 1061 bp, Pteridium aquilinum
cacacacacactcactcagtctcgtccctgtgcatctttttctagcaatgggaaaccgccaccaccacagtctcccccttggctaagtacaagctggtatttctcggggatcaatctgtagggaaaaccagcatcatcaccagattcatgtacgacaagttcgacaacacttaccaggcaacaatcggcatcgactttttgtccaaaaactatgtaccttgaggaccgtacagttcgtttgcaattatgggatacagccggacaagaaaggttccgtagcttgattccaagctatatacgtgattcttctgtggcagtggtggtttatgatgttgcaaatagacagtctttcttgaacactgccaaatggatagaagaagtgcgcacagaacgaggcagtgatgtcatcatcatgctcgtcggaaataaaacagacctcgttgataaaaggcaagtttccgtagaagaaggagatgcaaaatctcgggagtttggtgtgatgtttatagaaacgagtgcaaaggctggcttcaatatcaaggcattgtttcgtaagattgcagcggctttaccgggcatggaagtgctttcttcagcaaagcaagtaggtttagtggatattaagctgaatcctaccgaaagtccagtaccagaaggcgagaaacaagctggaggctgtgcatgctaaatatacagcaagtggctcacacatatcaagcccccacagtgcattacagtagctgactgatctttcaagctcaatggggtgctcaattgatatcatcttgtaatctactatacctaattgcttgtgaattatatggctatatgagggtaagcaatatagagcatttaggcattttttgtgtgcctacaccagtagacaaattcattatgcgggttagattcgtgttcagccggagagcatagagatccttagtatgagtattcatttgattattttcccaagatctgcttgaaagagttggaatattggagtgtacacgaattggaaggactacaatttcaaataaagattttgacagattatatgcctgatc

SEQ ID NO: 4395 - DNA, 1023 bp, Silene vulgaris
ccattagccaaatacaagcttgttttccttggcgatcaatccgttggtaaaactagcatcatcactcgcttcatgtacgataaattcgataccacttatcaggctactattggaatagacttcttgtcaaagaccatgtatcttgaagatcgaacagtacgattgcaactctgggataccgctggacaggaaaggtttcggagtttaattcctagctacatcagagattcttctgttgctgtagtcgtttatgacgttgctactaggcagtcatttctgaacacatcaaagtggattgaggaagttcggacagaacgtggcagcgatgtcattattgtccttgttgggaataaactgatctagttaaaaaaaggcaagtctctatagaggaaggggataacaaggctcgtgaatgtggggtgatcttcattgaaactagtgcaaaagcagggttcaacatcaagcctttgtttcgtaagatagcctcggccttgccagggatggaaagtctttcatcaacaaacaaggaagacatggttgatgtgaacttgaaacctcacagccattcatcccaatcggaacaagaaggaggtggttgtgcatgctaagacgagattccccatgtagcgaatcaagtctgggatcttacgggaccagtggatcacttggtaatgacagtacggtttagaggttgttgcgggctctgttcatatgtcacgtataacaatccgtgctcacttactcaaaaggtagatgctgtaataatttacagtggattttttgagttccgtagttgattttgtctagctctgtactcacaagagctccattttcaacaatagttcctcaacattatgacaactgacaaatgagcatttttagtttgttttagtagcaacattctgtagagtgcttatttctttatgtaatcgaatccgtattcccctttttttaaagtaggccttgtgaaaaaattgatgtgtgaaactatcttcttaaatacaaaaaactgtgtgacatgat

SEQ ID NO: 4396 - DNA, 1874 bp, Physcomitrella patens
aagatccttggaagccttgcatgattgtcaatgctggtcgcatgtcgaatgctagagtgcttgcgaaggccgggagcttctgattgagggatattattgcaatcaggctggggacgcggtgcctgtatcaagcctcgagcttagcattgacctcgttgagccttgttgtgttttttggggttgattccactcaatggtgttagtacttagtttcaaggctctatctcttttggaagagggaggctcagttctcggggcttgattcttggttttcgtttcgggtggattgaggatcaaggtgtttgttggcactctgatagggaggactttcttgggtgggtttgtggcattttgaggtttgagaaagcgggttgaagtggcttttcgatgtcaagttcagtttttattgttttggggaaacttgggtcgagatttttgggattagggttttcttggactaaatagagcagacgggccgagtagatatcgtgtttctttctaagaatccgaaccctacgaggcagagcatctacattccaagagttattggcttcatcttgagacgtgaattctagtttgagaatgtaaggaagagaagctacgggtagaattttttagaattcaaagagagaaagttgcgaggttagatagactgagacaggtgtgattcattcgaaaggatctgatagagcaagacagacaggatgggttccatgggaatggggcaacccgctacagtttcaccactcgctaagtacaagctagtgtttttgggggatcagtcagtaggcaaaacgagtatcatcacgcgatttatgtatgacaagttcgacaatacgtaccaagcaaccatcggtattgattttctctctaagaccatgtaccttgaggatcgtaccgtgcgactacagctctgggataccgctggacaggagaggttcaggagtttaattcctagttacattcgggattcgtccgtggcagtggttgtgtacgatgtttcaaatcggcagtcatttctaaatacatctcgatggattgaagaggtcctaacagagcgtggaagtgatgttatcataatgcttgttggcaacaagactgatcttgttgataagcgccaagtatcaattgaagaaggtgacgccaaagccaaagaggttggtgtcatgtttattgagaccagttcgaaagcaggtttcaacataaaggcactgttccgaaaaattgctgctgcgttgcctggaatggaggctttatcgtctcacaaggatgatctcgttgacgtcaatcttaagccaacaactaacccacagggggagggtaaagcaggaggctgtgcatgctaaatggattgagggagctggcagtcacctcctacacaccacaaagttttggatggtacactttcgaggtaatcttgccatattcggaaactccatcaaggcactgcaagggtgaacactgcgacaaggccttgcttagtttagctggggctggtatcaaatgctcatttaggtgcaaatatgacttcaacggctcatagtttaattgttaggtcaggctgtagctcttaacaaatgtcttcattacaacgctgctgtaaagagatatattgaatgcaagaactacaagctcagaatgcattgacctgcacaagtggatatctgttattccatgcttgcagcgctttaatttaagtaaatttttgtagtttgttattttttgtagcattctctccctacccaatcacgccagatgagtctttcttttacttcacatagatagcattgggctcagtgttttttatttcgatcatttcatttgaaaccttacattacaagtaatcgtatgttacatgtaatagaatacttccc

SEQ ID NO: 4397 - DNA, 1278 bp, Ceratodon purpureus
ggtattggcagcttggaacgattttgaaggaggtgaagaaggtgtggagggatctgagcgggcctgggctgtatgggttctatggggatggggtcacaaactgccacagtgtcgccgttggcgaagtacaagctggtgttcttgggagaccagtcagtggggaaaacgagtattatcacacgattcatgtatgataaatttgacaacacttaccaggcaaccattgggattgatttcctctccaagaccatgtatcttgaggatcgcaccgtgcggctgcaactctgggatacagctggacaagaaaggttcaggagtttgattcctagttacattcgggactcatccgtggccgtggttgtctatgatgtttcaaaccgacagtcttttctgaacaccgctcgatgggttgaagaagttcggacagagcgtggaagtgatgttataataatgcttgttggcaataagaccgatcttgttgataaacgtcaagtatccattgaagaaggtgacgccaaagctaaggactttggagttatgtttattgaaacaagttcaaaagctggttttaacatcaaggctctatttcgaaaaattgctgcagcgttgcccggaatggaggccttgtcttctcataaggataaggatgatctcgttgatgtgaacctgaagccaacgcaaaattcccaagcggagggcaaagcaggaggttgcgcatgctaattggatcgacagaattggcagtcacttactgtattcaacttgcacaaagttttggatggtccacctttcaagagcaaatcttgtaatatttgataactttatcgaggcgagaatatggatcttgctcaggagatctttggcaggtatgaatgcttgattggggcgagtagacgacatcaacggcacatagatcgggtatattattaggtcgggctgtagctcttgttggaagaatgcatttaacgctgctactgcccatggcctcataaagtttaatgttgaactaatttcaagtgtctctctccatagatgagataggtttggtgagattgaaacaagtagcttagtaagttggcagagatagatcttttgagtgcaatgagcctaggattcaagctcacaatgcattgagcctgcacgagtgggtatatataatttgctgttttctggttcttcagagattgggttctgaatggcaccctacttcagcatgtattgctgctagcaatggataagttcactatgttgtacttgtagcagtttctgttatctgac

SEQ ID NO: 4398 - DNA, 1045 bp, Festuca arundinacea
ggacgaagccccccccccccccccccccccccccccccccccccccccccccccccccccccccccccccccccgggaggtccatgtacgaccaagttcgacaacactaccaggccacgattggtattgacttcctgtcgaagacaatgtatcttgaagacagaactgtgagactccaactctgggatacagctggtcaggaaagattcaggagtttaattccaagctacatcagagattcttcagttgctgttattgtattcgatgttgcaagcaggcagtctttcttgaacacatcgaagtggatagaggaagtccggacagagagaggcagtgatgtcatcattgtgcttgtcggaaacaaaactgaccttgttgacaagaggcaagtatccattgaggaaggggaagccaaggcaaaagacctaggcgtgatgtttattgaaacaagtgctaaagctggttttaacattaaggctctgttccgcaagattgctgctgcacttcctggaatggagaccctttcatcagcaaagcaggaagatatggttgatgttaacctgaagtccggcaacgcgaactcatcccagtcacaggcacaggctgggggatgcagttgttagctccagtccctaacattcgcagctcatgatgtcaagacccacatgcccatcaaacaacatctacagtactgctcctctctcagtctaaggaggattgattgtcttacagcagtgagtccatgatccgagtcaatgaacaagaaccatttccgttggaagatccgtttttacgagtttctagtattttgtcagtggcctaagctagcaacagtgtatagttgggttggcactgtgaactcccattgctcgagctgagtattagagttagcgattggtttatgtttcaacttatatttctgttgcccatcttgttgcagtcagcccaagtctgtgttttttctatggtgtattgaatatatatatattggaatttttgcaaactaataagtcctatgttacccccaaaaaaaaaaaaaaaaaaa

SEQ ID NO: 4399 - DNA, 823 bp, Petunia hybrida
attattactcgattcatgtacgataaattcgacaacacttatcaggcaacaattggtatcgatttcctgtcaaagacaatgtatcttgaagatcgtacagtacgattgcagctttgggacactgcggggcaagagagatttcggagtctaataccaagctatattagggactcctctgttgctgtcatcgtttatgatgttgcaagcaggcagtccttcttaaacacttcgaagtggattgaggaggttcgtactgagcggggcagtgacgttatcatcgtggtcgttggtaacaaaactgatcttgttgaaaaaaggcaagtttcaatagaggaagcagaagctaaagctcgtgaactaaatgtcatgtttattgaaactagtgcgaaggccggatttaacataaaacctctatttagaaaaattgcagcggcattgccaggaatggagacattatcttccgctaagcaagaagacatggttgatgtcaacctcaggtcaggcaatgcaaatgcatcccagtcacaaccacagtcaggaggatgtgcctgttagatttaatggttaaagttccttggtttctaattctgttcgtatagccaacgacaaatgtgtttgtagagttctttatctttcataggatctcaattttgtcggacaagtttgaagttgtatgcaggaggttgtcatcttagttgactaagacgtaatctgtttcagttatctgtatgtgtctaggtatatgcagttttgctgattacctgttgggaacaagacttttatgcacacgtatcagttatttcaagttctgcaatttgatttt

SEQ ID NO: 4400 - DNA, 598 bp, Linum usitatissimum
ttaggcgatcaatccgtcggaaaaactagtatcatcactcgcttcatgtacgataaattcgacaccacttatcaggctacgataggaattgactccttgtccaaaacaatgtatctagaagatcgcaccgttaggctgcaactttgggatacagctggacaagagagatttaggagtcttattcctagctacatcagagattcttctgttgctgtggttgtatatgatgttgccaataggcaatcgttcttgaatacttcgaagtggattgaagaggtacggacagaacgaggaagcgatgtcatcattgtccttgttggtaacaagacagatcttgttgataaaaggcaagtgtcgatagaggaaggagacggcaaggctagagactttggagttatgtttatcgaaaccagcgcgaaagcaggattcaacattaaacttatcctttttacagccactatttcggaagatcgctgctgccctaccaggaatggaaaccctttcgtcgacgaaacaagaagacatggttgacgtgaacctcaagccgaccgtgaattcgtctcaggccgagcagcagggaggagggtgcgcttgttag

SEQ ID NO: 4401 - DNA, 831 bp, Fagopyrum esculentum
tagctttcaaattgaccaataaagattcagatctacgcttcaatatccttcgtgaatccatcagtctagatatagaggttttgaatcggaaaggacacacatggctgccgtatcacctctagctaaatacaagctcgtcttcttaggcgatcaatccgtcggcaagaccagcattatcactcgatttatgtatgacaagtttgatgctaattaccagcctacgattgggattgattttctgtcaaagaccatgtatcttgaggatcgaacagtgcgtttgcagctatgggatacagctggacaggaaaggttccgtagtcttattcccagctacatcagagattcttctgttgcaatcattgtatatgatatttcaaatcgacaatcgtttttgagcactaccaagtggatggaagaagtgcgcacagaaagaggcagtgatgttatagttgtccttgttgcaaacaaaaccgacctcgttgataagaggcaagtctcaatagaggaaggagagtcaaaggctcgtgatgctgggatcatgttcttggaaacaagtgctaaagccggatttaatatcaagcctctcttccgaaagattgcttcatcattgcccgggatggaagcgctttcgtcgacgaaacaagaagacatggttgatgttaatctcaaacctgcgaacaatgcttcccagaatgaccagcaaggaggcagcagtggtggttgcatgtgttaggaacgatgataatacggaaaaccctttgaaatcaaagaagccattttttagaaatatatactgggacactaaaatgtcagagagtcgatgctagaata

SEQ ID NO: 4402 - DNA, 918 bp, Oryza sativa
catctgcacgcgttcgtccaaactccgaaacaagaaagctcaaactcgatttcgaaattttcgaagccccaattctctcctcccacacgcggaatcgatcagcgcagcgcagggtaggctaggcgtcggcgtgctgtgatggcgccggtggtgtcggcgctggccaagtacaagctggtgttcctcggcgaccaggcggtggggaagacggccatcatcacccgcttcatgtacgacaagttcgacgccacctaccaggcgacgatcgggatcgatttcctctccaagacgatgtacctcgaagaccgaaccgtacggctgcagctttgggatacagctgggcaggagaggttccggagcttgatcccaagttacatcagggattcttctgtggcagtgattgtttacgatgtgactgacaggcagtcctttttgagtatatcgaagtggattgaagaggtaaatacacaacgaggcggagatgtgatcatcgtccttgttggaaataaaacagaccttgttgacaagaggcaaatatccactgacgaaggagaagccaaggcacaggagcacggcgccatgttcatggaaaccagcgcaaaagctggattcaacatcaagccactgtttcgcaagatcgctgcatcgctgcctggaatggaggcgctctcatcggcaaagcaggaagacatggtggacataaacctacggcctgctgcctccgggcaaataccttcaggggcagaagcacaagaagaacagaaagcaggcggttgttcctgctgagagttttgtattcagggaaatcgaggtcgcttcagagttcagacttcaaattagtacacacagtgaatttcaggtagcttggattgtcagtgccgattcgagtatagagaatatttatgtgtaatttttaac

SEQ ID NO: 4403 - DNA, 1068 bp, Oryza sativa
cttcgaaacgcaaaagtcgcctctttccttctccgttcaaagcaagcccacctcgttcctcctcctttacaccttcctcttttccatcatctgcacgcgttcgtccaaactccgaaacaagaaagctcaaactcgatttcgaaattttcgaagccccaattctctcctcccacacgcggaatcgatcagcgcagcgcagggtaggttaggcgtcggcgtgctgtgatggcaccggtggtgtcggcgctggccaagtacaagctggtgttcctcggcgaccaggcggtggggaagacggccatcatcacccgcttcatgtacgacaagttcgacgccacctaccaggcgacgatcgggatcgatttcctctccaagacgatgtacctcgaggaccgaaccgtacggctgcagctttgggatacagctgggcaggagaggttccggagcttgatcccaagttacatcagggattcttctgtggcagtgattgtttacgatgtgactgacaggcagtcctttttgagtatatcgaagtggattgaagaggtaaatacacaacgaggcggagatgtgatcatcgtccttgttggaaataaaacagaccttgttgacaagaggcaaatatccactgacgaaggagaagccaaggcacaggagcacggcgccatgttcatggaaaccagcgcaaaagctggattcaacatcaagccactgtttcgcaagatcgctgcatcgctgcctggaatggaggcgctctcatcggcaaagcaggaagacatggtggacataaacctacggcctgctgcctccgggcaaataccttcaggggcagaagcacaagaagaacagaaagcaggcggttgttcctgctgagagttttgtattcagggaaatcgaggtcgcttcagagttcagacttcaaattagtacacacagtgaatttcaggtagcttggattgtcagtgccgattcgagtatagagaatatttatgtgtaatttttaacagcggcatctaggtttgaaacagacaaaaattccctgaagtttctatgttttataccgcataa

SEQ ID NO: 4404 - DNA, 1022 bp, Rhizophora mangle
catcactcgattcatgtacgacaagttcgacaacacctatcaggctaccattggtattgattttctttcaaagacgatgcaccttgaagatcgaacagttagattacagctctgggacaccgcaggacaagaaaggttcaggagtctcattccaagctacataagagattcctccgtggcagtcattgtctatgatgtggcaagtaggcagtcattcctgaacacttcgaagtggattgaagaggtccgcacagagcggggaagtgatgttatcattgtacttgttgggaataagactgatcttgtggacaaaaggcaagtttctatagaggaaggagaagctaaagcccatgatctcaatgtcatgtttatcgaaactagtgcaaaggctggttttaatataaaggcactttttaggaagattgcagctgccttacccggaatggaaacactctcttcaactaagcaagaagacatggttgacgtcaatctcaagtcttccaatacaaacacatcgcagtcacaacagcagtcagggggatgtgcctgctgatattcaaaatttgacacccaaagctttttgtatctcagcaacatttcattgcatgcttcggcgttcccgttggatctgtaaagttcatgcccttgcatttgcagcatttggtttctggctttgcttcattgttaaagccatgaatttgcagaggagattttgtggtggtggtcggactagtcttagcctgtctaatactcatggttcttttatggacttggagagatgaattgtgcaaaatttgttcccatctttattagattaggctcggttctatcgtttaaaatagtttgtgctaagtgattggtttgtttattcatgttatcaatgtatactttaagttttgatattacagtacttctcctcctcttctcatccttggtctaaagctagcttcgtgttgctattggttgaattgtgtaaacctttattgctgacttttcttttaaatgaccacatttagaagttg

SEQ ID NO: 4405 - DNA, 1840 bp, Chrysanthemum coronarium
atcaatcagttggtaaaacgagtatcatcaccagatttatgtatgacaaattcgataccacctatcaggccaccattggaattgatttcttgtcaaaaacaatgtaccttgaagacagaactgttcgcttacagctttgggatactgccggtcaggaaagattcaggagtctcattccaagctatataagagattcatcagttgcagtgattgtctatgacgttgcaaatcgacagtcattcttgaacactgccaagtggatagaagaagtacgtactgagcgaggcactgatgtcattatagtccttgttgggaacaaaactgatcttgttgacaaaaggcaagtttctattgaagaaggagatgccaaagctcgtgaattcggagttatgtttatagagaccagtgcaaaagctgggttcaacatcaagcccttattccgaaagatcgctgctgccttgccgggaatggagactctttcctctacaaaacaagaagacatggttgacgtgaatttgaaatcttcaggtaatgcttcacaatcagagcagcaaggtggagggtgcgcttgctagatcatttagcgatgctttaacagagagactgtagagtcaagagatgatgctttttgtaatgggctggttggtaagttaaatttgttgataattttgatttgcaagtgacatgaagtaagaagatatgatgtatatcttcagtatacctttttagcttttattatttacttctatagagcaagacattggtggttgaccgaaacagaagtttgtgctattttttgtgactcaattgctgttatttttaatttgtaataccttagcgttttgcagtgacacattatttgttttgacgtctttgttgcagtggtattgtcaactaatatttacagttttttctgatcaaggtgtggttccacgaaaacttccaccctcattaatccaccttaagaagaaacttgaggcattaagtgaagctagacagtcatatcaccttctatacaaggtagttacaagcgaaggcgcacttgaggcgacctgccttgcatagggactaaagtgaagaataaaaacgattttcccaactgaattcctaaacaattcttgtccgagacggtgtttactataatgaacatgcaatatctgaactcgggatatacaatgcgtatttgaagtataacacactttctgcaacatctgtcgaatgactactatttctgaaataatacttgagtttatcactactatgtacttttaaatgatgcagaaacaaagaggcggtaattagcagcgagcaatgcggttacctgatgtatctccatctcaattccaaacttgtcatctaggggttgtttgacattgtgtatttgaattttatatgggtagattttaatattgttacaagtcccttctttttcatgactgttggggatttatttctgaggttgttcaggatagtgtcatagtaacagtgacaacaagtgaagctgagatggtgttacattggccacaattcttgctggattagttgaaaagtttacagaaaaggtgagtaggatgatgtaaatgttatcgttttgactggaaataatgatcggttttatggtggatttggcgtcatcattttctggaaagttcacaagattggagagatgcctgtcctccctgatgtacctgcagttgctgttgtacaagatcttgcacttaagcgtaacctagaagttgcaatgggatgcaacacctgtattgcagctcccataaatcaacttggaagcatggctcatgcagtgattatataatttagaaccggttatgtaatgtttcgc

SEQ ID NO: 4406 - DNA, 1851 bp, Ceratodon purpureus
agagagagagagctccgagcccagtgccgaagctcatcactcctcactccccatcgccatcgccatcgccatcgccatcgccgctcccctcccgctctgccgtggcctctcgggatccaaatccaccgcctcaccgccacgccctgctcacaacgcatcccaaggggctccactacgggacctcacaccagcgcacttcccacccctggggctggctcaaatttctcctctactttcgccgtcttggagagggggatctagctctcagtctgcaactagtgggctgcaggagggggcaggatctgagggttacaaggctggagctcaccattatacgtgttgttgtgagtgtctgagctgaatttatcgagagggggatctgtgctgcttttccacttctggggtggaggagagaaagagaggaagagaggatctgggagttttgaggtgtttgtggtggtttgggttgaggctggtggagttcgggtttgaggttaggtgttggtttttttttgagttggggttggcgtggttaggttgagttggatctttctgtcagggcgtggaggatgtgagcagggcgaaggagaggaagagcgggagcttgtggtgttgtgatagagaagggggagagagtaggtttgtgttgtggtttgggatctcgggggtagatggggtctatggggatgggtgggcaatccaccacagtgtcgccattggccaagtacaaattggtgtttctcggtgatcagtctgtgggcaagacgagtatcatcacgcgcttcatgtatgacaagttcgataatacataccaggcaaccatcggcattgacttcctctcgaaaaccatgtatcttgaggaccgcactgtgcgccttcagctctgggatactgcaggtcaagagcggtttcggagtctaattcccagctacatccgtgattcatcagttgcggtggtcgtctatgacgtatcaaatcggcaatcatttctcaatacagctcgttgggtggaagaagtacgcacggagcgtggaagtgatgtcattatcatgctagttggcaataagaccgatcttgttgataagaggcaggtatcaatagaggagggggatgccaaggccaaggaatttggagtcatgtttatcgagacaagttctaaagctggattcaatatcaaggctcttttccgcaaaattgctgcagcgctgcctgggatggaagcattgtcttcacacaaagacgatctagttgatgtgaacctcaaaccaacttcgaacgcacaagcggatggcaaagctggaggatgcgcatgctgaatgatgacaggagcaactcacctattggaatccgacgttgaacacggacactcgttttctctttaagttgtaacttttgtactattttcgaaaccctgaaggctcaacttcttgctgggtccaattgagggaccaaggtcccgctttcaaggaggtccgagtctattcagctcacagcacagcagaaatatgctgttagtggtttggacaatcgatattagagggttattctaggaacttggcttccagctgattatgttcaaactggatatgtactgaggaagtgcatagagtttgtcagacgcaacctagttagattttctggaggtaacgaggtaaaggattataaagtattggcgaatgttctatttgccttacgagagggggtcttctgtaggtagtgctgcaggaacacagacaagcgggtagcttttatcaagtttaggtacctactgtacctgtatttttgtagcatttgatcaatagaacgtcaaatttaatctcacactcttggtttggctcaatgatttcttcc

SEQ ID NO: 4407 - DNA, 830 bp, Mimulus guttatus
caatggcggtggtggtatcaccattaacaaagtacaagctggtgtttttgggggatcaatccgtcggcaaaaccagcattatcacccgcttcatgtatgacaaatttgacaccacctatcaggcaacaattggcatagactttttgtcgaagacgatgtacctcgaagatagaacgattcgattgcaactttgggataccgctggacaagaaagatttaggagtcttatcccgagctatattcgagattcttctgtggcagtaatcgtctatgatgttgctaatcgacaatcgttcttgaacacaatgaagtggaccgaggaagtaagaacggaacgtggtcgtgatgttattattgttctcgtgggaaacaaaaccgacattgtcgacaaaagacaagtttcaagtgaagaaggagatcataaggctcgtgagcttggagtaatatttattgaaacaagtgctaaagctggtttcaatattaagcctctattccgaaaaatagcaggtgcactacctggaatggaaattctttcaccaagaaaacaagaaggcatggttgatgtagatttgaagcctgcttcaaacacctactcgaatgaacaacaaccaggaagctgcgcatgttagagatcgatacgtctactcgagatgtatcggaaaatgctaattaattatgtgaaaagaaaaagaaaaaaaattcacaaattttcaatgttttttttttttttttttataaggattcctagctaaaacttggtgtctaattaaatgtaattgaggatgtaattaaatgtgagtgactacataaactacattgttgatttgatc

SEQ ID NO: 4408 - DNA, 1297 bp, Panicum virgatum
cgggatggcgctcgggacggagcagcccacggcttgacgacggttccttggccagttggccccctcccgcccttttgaccggaacctgggttagttccccagttagcgctgaccccacgcgatttctcattctccaccctcgttggcagctggtgcaagcaagaaacgctcctcccccttccttcccctcttcgtcggcccaccccgcgacgacgaaaagccagcctagtttgaaacgccgaaagcgacgcccttcttccccgttcaaagcaatcgccctccccttttctcctccccctttccatcagctgcacgcgtccggacccgccccagacaccaagctcgatcgtggtctccagcataaccagaaaaagaagaaggcgggcctggtgacgtaccggatcccatggcgccggtggtgtcggcgctggccaagtacaagctggtgttcctgggcgaccaggccgtgggcaagacggccatcatcacccgcttcatgtacgacaagttcgacaacacctaccaggcgacgatcgggatcgacttcctctccaagacgatgtacctcgaggatcgcaccgtccgcctccagctctgggacacagctgggcaggagaggttccgcagcctgatcccgagctacatcagagactcctccgtggccgtcatcgtttacgatgtgactgacaggcaatcctttttgaatacgtcaaagtggatcgaggaagtgaatacacaaagaggtggcgatgtgctcatcttccttgtcggaaataaaactgacctcgtcgacaagaggaaagtgtccactgacgaaggagaagccaaagcacaggagcatggcgccatgttcatagaaaccagtgcaaaagctgggttcaacatcaagcctctgttccgcaagatcgctggatcccttcctggaatggacgctctctcgtcagcaaagcaggaagacatggtggacataaacctcaggccttctaccgggtcgtcagcttcaggcgcggcttcgcatgcagagcaaaaatcaggtggttgctcctgttgagacttgcagagttttatgttcagagaagatgcagtagtagggatactacatttgagttaatacttccgtagagatgaagagtgatatccgtggggaagaagccaatttctgtgtataaacatttttgtcaagttgccatacataacttgttttggaacccagggatataatcaaatctgtgaaagctagcatcatctctcttttacaaaataccaaaccaaatcaaaatactcgccgccaatattc

SEQ ID NO: 4409 - DNA, 1695 bp, Physcomitrella patens
ggaagaatgaggtctgagttgctttccgcctcatctggcgaggttcgtcgttttcttctccacagcttgggagcgctagcagtctacaaggccatcgcattttgagattttgacctcttcgttgtgtcggtggttgattcgctgcggcggtctttaagcttgctgcggaactctgtgaatttcatttgaaagttgtgggcacctgtagcgtgaacgagaggatctgggagcttagatcggaggtggaacgtttggtgtgcgaagctggaacaaacctcaccacttggatttgggttgtggcttcttacaaggtgttgtggaggttgagacatgcttttggatcagccgaggtagattttggaagaacttggagaatgtctgtgtgactagttcgacagtgagcactgtgagattcagagcggcagtgattcagaatctagaaagagaccagaaggtttatcattttcgaagtatccgtcaggagccaggcacaggtggggtctatggggagggatgatcaatccacaacagtatcgccattggccaagtacaaattggtgtttctcggggatcagtctgtgggcaagacgagtatcatcacacgctttatgtatgacaagtttgacaattcataccaggcgactattggcattgattttctttcaaaaacaatgtaccttgaagaccgcaccgtgcggctacagctttgggataccgcaggacaagaaagattccggagtctaattcccagctatatccgtgattcatctgttgcggtgatcgtctatgacgtgtcaaatcggcaatcattccttaatacagctcgttgggtggaagaggtgcgaacggagcgcggaaatgatgtcattgttatgctagttgggaataagaccgatctagtcgataaaaggcaggtctcaatagaggaaggagacgccaaggccaaggaattacaagtcatgttcatcgaaacaagttctaaggctggatttaacatcaaggctcttttccgcaaaattgccgtagcgctgcctggaatggaggcattatcttcacacaaagatgaccttgttgatgtgaacctcaagccaacctcgaatgcactggcggaggccaaagaaggtggctgtgcatgctgaacgaggagaggagcaatgtgctgcttgcaatcttttgtaggaacatggacactcttttcctctccttattgtaacttgtgtaccatcttctcaattctctgaagactcgatttcttgctggctccacttgcgggacactgaagtccaaggcaattctacttgaggcacagatgttaactattcagtcttagctgttgcactgagcgccattagtagagatacagcataattatgctagtagcggcttggacaactcgatatctgaggatcaacaaaggagcttattaccatctcactacgtccaacctcgaaacagatttgtattaatgaagtggttagaggttgaaaggattgactggttagaagcactgggattaaagaggtgaagcattatatagtgtttgcgaaggttctgtattccctatgtgcttacctacgtgggggtcctcttgttagttcgtgctgcaccgataatcgacagtcagtaccttaataaatttagcttcacacctgtatttttgtatcattagattaattgagctcagattcagtttcc

SEQ ID NO: 4410 - DNA, 1735 bp, Physcomitrella patens
tgagcgtcttaccgattgtcgttgctgtgcatgtcgaggttcgagatcgaatgattgggagctttttattgacagtttttatttcaattccagaattacacagtggctgttccaagtttaagctcatccgtgttcctcgtagcttctcctgctcggtggtgttagttcctaagctttcaaccctagcggggttgggggggttggtttaagtttccgggtatgattctcgcgcgttttggtttgccgtggtttgaggattacggtggttgtcaagttgactgatcgcgggattcttgacataggtttgtcgactttttttttggagttgggtcctggactgctcgatttggtctagtctcttgttttgtgttgtaaccgcggatcgtgttctgaggggttctggtacttatgggagaacggagggggaaatactgagtggcttcagagttttttgaaatagtcttaaccctaagcgacagcgcctcggcaatcaaaacttgggtgacagatttggtatgaagcacgaattcttgtttgagaatgtggcggagagaagctagtaatattattttgtagaattgagaagcaggatattgcaaggtctgaagcaaggagtccggtttgaggcacaggaagagatctgacatagctggataggcaggatgggtaccatgggtatggggcaaaccaccacagtgtcgccacttgccaagtataagctagtgttcttgggggatcaatcagtgggaaaaacaagtattatcacgcgatttatgtatgacaagttcgacaacacgtaccaggcaactattggaattgactttctctccaagaccatgtaccttgaggatcgcactgtgcgactacagctctgggacacagctggacaagagaggttcaggagtttaattcccagctacattcgagactcgtctgtggcagtagttgtttacgatgtttcgaatcggcagtcgtttctgaacacagctcgatgggttgaagaagtccggaccgagcgtggaagtgatgttatcataatgcttgttggcaataagactgatcttgtcgataaacgtcaagtatcgattgaagaaggtgacgccaaagctaaggaatttggagtcatgtttattgagacgagttcaaaagctggctttaacatcaaggcactgtttcgaaaaattgctgcagcattacctggtatggaggctttgtcatctcacaaggatgatcttgttgatgtcaatctcaagccaacaacaaacccacaggcggagggtaaagcaggaggctgtgcatgttgattgaattgaaggagcgggcattcacttccttctactttcttcacaaagttttggatgctttacttttatagacgtgatcttgcattattcagaaacttcgttaagggcactggaagtatgaacgctgcgaaaatgtccagattcggggacgtggggctggtgtgaaatgctcgtttgggcgagagttgatcattaagatatccgtgttgaacgagtttcatgtctcttgatagatgttagggctaggtgagtaagtggacagagataggtatattgagtgcaagagctttgagcttacaatgagtcgagccgcgcgggtggatatctgatgatttcctgcttgcagcgtttagaatcaaatagttttttctgtaatgtgttatgtatgctgtgttttgcggcaattgcctttctacattcttattctcgat

SEQ ID NO: 4411 - DNA, 674 bp, Tragopogon dubius
agtatttcttgatttctcccctttctctctcctccgaatttctctctattctctctctctctaacatttcacagattcagatctgatcaccgagagaggtcccggaacagctcaataatggcggtggtgtcacctcttgccaaatacaaactggtgtttttgggcgatcaatccgtcggcaaaaccagcatcattaccagattcatgtatgacaaattcgatactacctatcaggctaccattggcactgatttcttgtcaaaaacaatgtaccttgaagatagaacagttcggttacagctttgggatactgctgggcaggagagatttaggagtctaattccaagttatataagagattcatcagttgcagtgattgtctatgatgttgctaatcgacaatcattcttgaacactgcaaagtggatagaagaagtacgtactgagcgaggccaggatgtgattatagtccttgttggcaacaaaacagatctcgttggcaaaaggcaagtgtcaatcgaagaaggagatggcaaagctcgtgaatttggagtcatgtttatagaaacgagtgccaaagctggattcaacatcaagcctttattccggaagattgctgcagccttgccggggatggagacactttcatctacaaagcaagaagacatggctga

SEQ ID NO: 4412 - DNA, 1429 bp, Physcomitrella patens
gttctgacttgcgaatgaggtttgtggatgttttgaggcggggaatgtgtttggatctgtggtcagaacgggacaagtgaccggagtttgctctgtgtcagggtgaggtggatacttccagaggttggaggcttgcttgttggattttggaggatgtgggcacgaggtggtagagaaggagttctgtaggattcagaggggttggttgtgatttcgcaaccaagagaacacagaaggcgaaccttgaagtgacggatctctgaaagaacagggacagatgggttccttggggatgagcggacaatccaccacagtatcgccgttggcaaagtataaactggtgttcctcggtgatcagtccgtgggcaagacgagtgtcatcacacgtttcatgtatgacaagtttgacaacacgtaccaggcaaccatcggcatcgactttctttcaaagacgatgtacctagaggatcgcactgtacgcctacagctctgggatactgcagggcaagaaaggtttcgaagtctaattcctagctatatccgtgattcatcagtcgcagtggtcgtttatgacgtgtcaaatcggcaatcattcctgaatacagctcgttgggtggaagaagtacgaacggagcgtgggagtgatgttattattatgctagttggcaataagactgatcttcttgataagaggcaagtctcaatagaggaaggggatgccaaggcaaaggaatttggagtcatgttcatcgaaactagttctaaagctggatttaacatcaaggccctttttcggaaaatcgcagcagctctgcccgggatggaggcattatcttccagcaaagatgatttggtcgatgtgaacctcaagtccacttcgaatgcacaggcggatagcaaagctggagcatgttcatgctgaacgagtagatagaattcgatattgaaatataggcacacttttcctcctcaagttgcaacttttgtactatctacaaaatctcatgaagactcgatttctaactggctccactttgaggtacagggtcttgcgttcaagggttaattcagctcgagccatggttacggagtttgtaccgttgagacctgatggcatcagatgagacacatcagaattatgctagtagcggattgaacaactaggcattgaaggtttactataggaacttttcgactagattgtgttcgagctcgatatagatgtgttaatgaattggatagaggttgacatatgcgacctagttaggattacttgaggtgaagacgtgaaagaatgagattactgatggtcttgtattttcaatgcgcttacttatctggggggcgtcttgttagggagttttgcagtgataatttacagcgggaaatttttgcaacttagatgtctacctgtgattgtgtagcattt

SEQ ID NO: 4413 - DNA, 1456 bp, Physcomitrella patens
cctccaactgctgctgctggaattaatcaatcagatgcaatcacattctacgacggggtcacttcggatttttcggagccaggtgttggtggtattgtttgccacttagtggggcattctggtgttgccctcgaggcacagcgacacagacagaaagagagagaaagaaagagagggcgtttgttgagaacatatcgggcgtgcgtttttctcgtcacggttttgaagtgacgagggtgacgagaggtagaatcttttagcttcgaaaggggacaacgtcacaaggttagaagtgaaggcactggtggtaccaagtagtagaggggatctgagggaacgagtccagatgggttctatgggggcggggtcgcaaaccgcgacagtatcgcctctggccaaatacaagttggtgtttctgggtgaccagtcagtgggtaaaacaagtatcatcacgcgattcatgtatgacaaatttgacaacacgtaccaggcaactattggtattgattttctctccaagaccatgtatcttgaggatcgcactgttagactacagctctgggacactgctggacaggagaggtttaggagtttgattcccagctacatccgggattcgtccgtggcagtggttgtctatgatgtttccaatcggcaatcgtttatgaatacagctcggtgggttgaagaagtccgaacagagcgtggaagtgatgttattattatgctcgtcggaaataagactgatcttgttgataaacgtcaagtgtctattgaagaaggtgacgctaaagctaaggaatttggagtcatgttcattgagacaagttcaaaagcaggttttaacatcaaggcactgtttcgaaaaattgctgctgcgttgcctggaatggagactatgtcttctcacaaggatgaccttgttgatgttaatcttaaacctacgttaaatacacagacggagggtaaaccaggaggctgtgcttgttaattggattgaaataatttcttttgtaagttatagaatgttttggactattcacttttcaagagatattcttgtactattgtgaaatccaaataaggatgttcaggagttcatgagctcatatctagtgcttatttgagcttgaagagctcaaattggcggcacataggctagctaattttttgaatcgggctgtagcgttttatgaattgacgatgttcaacatcgctattatccatggatagggtaagaataagggttcagtcacattctttagatgagtgcggattgccgggattgggacaagccattgagtgagatgatagaggttacaagccgtaacacatttttctgacctacattttgcgattgtacaaattgatttcgcttgcatgcatcagtcaccaccttccaagcagcctgaaccgggcacattctgatgagaatgacatgtgcttcagagggtat

SEQ ID NO: 4414 - DNA, 978 bp, Eutrema halophilum
gaaatttgatcggtgttgcaaactcttggcgcgtggcgaaaggagatatcagctttgtgtgcgaccgcgtcttcgtcgtcgtcgtgctcgccttctctttctttcttttcgaaagctaagaagaagaaatctgctctaatttcggatctctaccactttctttctcttttccatttccttgtcctttctccttcaaatggcggcggtttctgctttggccaagtttaagctggtgttcttaggtgatcaatctgtcggaaaaaccagcatcatcacccgtttcatgtatgataaattcgataccacttaccagcctaccattgggattgattttctgtcgaaaacaatgtacctcgaagatcgaacagttcgtttgcagctatgggatacggctgggcaagaaagattcaggagtctaatcccaagttacatcagagattcttctgttgccatagttgtatatgatgtagccaataggcaaacgtttctgaatatatcgaaatggatcgatgatgtacacagagaaagaggttcaggggacgttattattgttcttgttggaaacaaaactgatcttgttgagaaaaggcaagtatcgatcagtgaaggggaagacaagggtaaagagcatggagtgatgttcatcgaaaccagcgcgaaagaaaatttcaacattaaggctttgttccggaagattgctgcagcattacctgggatggattcatattcatcggcgacaaaatcagaggacatggtcgatgtgaacctaaagaccacttcaaattcatcgcaaggtgagcaacaaggaggaggtggtggaggaggctgttcttgttgattcaaaaataaacattttctgtttaagaaacatattctgtgaaccaaagaaccaaaaaaaaaaaaaagggaatcaagaaagtttttttgtgattttcatcttattagactagacattgccagaaacagaatataaaacat

SEQ ID NO: 4415 - DNA, 974 bp, Triticum aestivum
ccccttctccgttcaaagcaagccttcttcttcttcttccgtcccctttccactggtttcacgcgtccaaacccggtcgagcacgcacctccacgactcgatccaaatcactccggggagcgtccaactcggagcagaagagatcgcccgacgagctagctccgggccgagcaagcaagctagccatggcgccggcggtgtcggcgctggccaagtacaagctggtgttcctcggcgaccaggcggtgggcaagaccgccatcatcacccgcttcatgtacgacaagttcgacgccacctaccaggccaccatcgggatcgatttcctctccaagaccatgtacctcgaggaccgcacggttcgcctgcagctatgggacacggctgggcaggagaggttccggagtctgattccaagctacatcagagactcttcggtcgcggtcatcgtctacgatgtaactgacacgcaatcgtttcttcatacatcgaagtggatcgatgaggtgaacacggcaagaggcaaagatgtgctgatcgtgctcgtcggaaacaaaacagacctcgttgaccagaggcaagtgcccacggacgaaggggaggccaaggccaaggagcacggcgccttgttcatggagaccagcgccaaggccggcttcaacatcaaggctctgttccgcacgatcgccgcgtccctgcctgggatggacgccctctcgtcggcgaagcaggaggacatggtggacatcaacctgaggcccgcctccgggccagcaggctcaggcgcgcctgggcagcaggagcagaaagcaggaggatgctcttgctgagctttgtgttcttttattagaggagagtttgcgggcagacagagcaagaatgtaattttggccaaaacagattgcggacagagaaatgcaaaatttgttaggcgtgagaagaaaaaaacaacgccgttgccggggatcgaaccc

SEQ ID NO: 4416 - DNA, 759 bp, Avena sativa
ccttctccgttcaaagcaacccctcctcctcctcccttttcccttccttgatctccaaaccgagctactcccaaacacgcacagctcgccggctcgatcagaagaagcaccaggtcgctcgaccagaaaaagctagtaatggcgccggcgatctcggcgctggccaagtacaagctggtgttcctcggcgaccagtcggtgggcaagaccgccatcatcacccgcttcatgtacgacaagttcgacagcacataccaggcaacgatcgggatcgatttcctctccaagacgatgtacctcgaggaccgcaccgtccgcctgcagctatgggacacagctggacaggagaggttcaggagtctgattccaagctacattagagactcttctgtcgcggtgatcgtttacgatgtaactgacaggcaatcatttctgcacacatcgaagtggatcgacgaagtaaacacggaaagaggtggcgacgtgctcatcatcctcgttgggaataaaacagacctcgttgaccagaggcaagtgtccacggacgaaggagaagccaaggccaaggagcacggcgtcatgttcatcgaaaccagcgccaagaatggcttcaacgtcaaggcgctgttccgcacgatcgccacgtctctgcctggaatggaggcactctcgtcggcgaagcaggaagacatggtcgacatcaacctcaggcctgcctccggaccagcaggttcaggcgcgggcggacagcagcaacag

SEQ ID NO: 4417 - DNA, 1430 bp, Hordeum vulgare
agaagaagaaagagaagctttgaaggagtagtagtatgtatgtatgcatttgcatggatgtgccgtcaacacacgcgactcggcagctggcttcggaaacgtccaaagtcgcctccccttctccgttgaaagcaaagcaaagcaaacctcctcctgctcctccttcttccgtcccctttccaccggttgcacgcgtccaaaccccgggcaactactcccgatcgagcacgcgcctcgacgacccgatccaaatcaatcacgcgccaaacagaccgatcgatccatccatctccagcatccgagcagaagatcagatggcgccggtggtgtcggcgctggccaagtacaagctggtgttcctcggcgaccaggcggtgggcaagaccgccatcatcacccgcttcatgtacgacaagttcgacgccacctaccaggcgacgattgggatcgatttcctctccaagaccatgtacctagaggaccgcaccgtccgcctacagctatgggacacggctgggcaggagaggttccggagtctgattccaagctacatcagagactcttctgttgcggtcatcgtctacgacgtaacagacacgcaatcgtttctgcatacatccaagtggatcgacgaagtgaacacggcaagaggcaaagatgtgctgattgtgctcgtcgggaataaaacagacctcgtcgaccagaggcaagtgccgacagacgaaggggaagccaaggccaaggagcacggcgccttgttcatggagaccagcgcaaaggccggcttcaacatcaaggcgttgttccgcacgatcgccgcgtcgctgccggggatggacgctgtctcgtcggcgaagcaggaggacatggtggacatcaacctgaggcctgcctccggaccggcaggctcgggcacggccgggcagcaggaggagaaagcaggcgggtgttcttgctgagggttttggtggtctttttagggggtcgatttgcatcccttgcaggattgcagtagcgcattttggtgggggttttggttacattacagggcaaaaaggtattgtaattgcaggacagagagatgccatgatactgtgattctgacgagacgagtttcatatagaggagcgatttgaatctcttgcaggtttgttgtaatccatcttcgtgagttgctggggacggacggattgtagttttgaccaaacagaggaatgtataaaaaaaatgacgcgtgagggaaaaatatgtatcgccgttgccggggatcgaacccgggtcacccgcgtgacaggcgggaatacttaccactatactacaacgacacttggtgatgatggatggaatgtttggttagtaatctcagtaatttctgttcgcttagtcaagctttgttcagcatgattgcgatggtttttcgggaacacgcg

SEQ ID NO: 4418 - DNA, 1072 bp, Secale cereale
ccccttctccgttcaaagcaatcctcctccttctgccgtcccctttccactggtttcacgcgtccaaacccgaactactcctcccgatcgagcacgcgcctccacgacccgatccaaattactccagcgtccaactccgagcggaagagatcgcctaaccagctccgggccaagctagccagccatggcgccggtggtgtcggcgctggccaagtacaagctggtgttcctcggcgaccaggcggtgggcaagaccgccatcatcacccgcttcatgtacgacaagttcgacgccacctaccaggccaccatcgggatcgacttcctctccaagaccatgtacctcgaggaccgcacggttcgcctccagctatgggacacagccgggcaggagaggttccggagcctgattccaagctacatcagagactcttctgtcgcggtcatcgtctacgatgtaaccgacacgcaatcatttctgcatacatcgaagtggatcgatgaggtgaacacggcaagaggcaaagacgtgctgattgtgctcgtcggaaacaaaacagaccttgttgaccagaggcaagtggccacggacgaaggggaagccaaggcgaaggagcacggcgccttgttcatggagaccagcgccaaggccggcttcaacatcaaggcgttgttccgcacgatcgccacgtccctgccggggatggacgccctgtcgtcggcgaagcaggaggacatggtggacatcaacctgaggcctgcgtccggagcagcgggctcaggcgcggccgcgcagcaggagcagaacgcgggggggtgttcctgctgagctttgtcttcttttattaggggagagatttgcatcgtcttgcagatttgctgtagtgctccagttgctgcgggatacagatttgaccgagattagagcagtacatttttgtggcggttttggggcaggtatcagttgctgcggatgggcagagcaagattgtaattttgaccaaaacagattgtggggcggagaaatgcaaaaataaaaataagcagagcaagattgtaattttgaccagtc

SEQ ID NO: 4419 - DNA, 1036 bp, Secale cereale
gtccaaacccgaactactcctcccgatcaagcacgcgcctccacgacccgatccaaatttctccagcctccagccccgaacacaagagatcacccaactagctccgggccaagcttagcgatggcgccggtggtgtcggcgctggccaagtacaagctggtgttcctcggcgaccaggcggtgggcaagaccgccatcatcacccgcttcatgtacgacaagttcgacgccacctaccaggcgaccatcgggatcgatttcctctccaagaccatgtacctcgaggaccgcacggttcgcctgcagctatgggacacggctgggcaggagaggttccggagcctgatcccaagctacatcagagactcttctgtcgcggtcatcgtctacgatgtaaccgacacgcaatcatttctgcatacatcgaagtggatcgacgaggtgaacacggcaagaggcaaagatgtgctgattgtgctcgtcggaaataaaacagaccttgttgaccagaggcaggtggccacggacgaaggggaagccaaggcgaaggagcacggcgccttgttcatggagaccagcgccaaggccggcttcaacatcaaggcgttgttccgtacgatcgccacgtccctgccggggatggacgctctgtcgtcggccaagcaggaggacatggtggacatcaacctaaggcctgcgtccggagcagcgggctcaggcgcggccgcgcagcaggagcagaacgcgggggggtgttcctgctgagctttgtcttcttttattaggggagagatttgcatcgtcttgcagatttgctgtagtgctccagttgctgcgggatacagatttgaccgagattagagcagtagtacatttttgtggcggttttggggcaggtatcagttgctgcggatgggcagagcaagattgtaattttgaccaaaacagattgtggggcggagaaatgacaaaaaataaaataagcagagcaagaattagtaatttgaccaaaacagattgtgggcggagaaatgac

SEQ ID NO: 4420 - DNA, 1022 bp, Secale cereale
ctgccgtcccctttccactggcttcacgcgtccaaacccgaactgctcctcccgatcgagcacgcgcctccacgacccgatccaaactactccagcgtccgactccgagcagaagagatcacccaactagctccgggccaagccagccagccatggcgccggtggtgtcggcgctggccaagtacaagctggtgttcctcggcgaccaggcggtgggcaagaccgccatcatcacccgcttcatgtacgacaagttcgacgccacctaccaggccaccatcgggatcgattttctctccaagaccatgtacctcgaggaccgcacggttcgcctgcagctatgggacacagccgggcaggagaggttccggagcctgattccaagctacatcagagactcttctgtcgcggtcatcgtctacgatgtaaccgacacgcaatcatttctgcatacatcgaagtggatcgacgaagtgaacacagcaagaggcaaagacgtgctgattgtgctcgtcggaaacaaaacagaccttgttgaccagaggcaggtggccacggacgaaggggaagccaaggcgaaggagcacggcgccttgttcatggagaccagcgccaaggccggcttcaacatcaaggcgttgttccgcacgatcgccacgtccctgccggggatggacgccctgtcgtcggcgaagcaggaggacatggtggacatcaacctgaggcctgcgtccggagcagcgggctcaggcgcggccgcgcagcaggagcagaacgcgggggggtgttcctgctgagctttgtcttcttttattaggggagagatttgcatcgtcttgcagatttgctgtagtgctccagttgctgcgggatacagatttgaccgagattagagcagtacatttttgtggcggttttggggcaggtatcagttgctgcggatgggcagagcaagattgtaattttgaccaaaacagattgtggggcggagaaatgcaaaaataaaaataagcagagcaaga

SEQ ID NO: 4421 - DNA, 1226 bp, Panicum virgatum
ttttttcaaaactaaccaaacacggcctaccattagctgtacgctcaccagcgctgaccccacgcgatttctccacccccgttggcagctggtgcaagcaagaaacgctcctcccttccctcgttcttcttcctcggcccaccccgcgacgacgaaaagcctagtttgaaacgccgaaagcgacgcccttcttccccgttcaaagcaatcgtgctccccttttctcctccccctttccaccagctgcacgcgtacgggcccgccccaaacaccaagctcgatcttggtctccagcataaccagaagaagagggggggggggggggcgctccggatcccatggcgccggtggtgtcggcgctggccaagtacaagctggtgttcctgggcgaccaggccgtgggcaagacggccatcatcacccgattcatgtacgacaagttcgacgacacctaccaggcgacgatcgggatcgacttcctctccaagacgatgtacctcgaggatcgcaccgtccgcctccagctctgggacacagctgggcaggagaggttccgcagcctgatcccgagctacatcagagactcctccgtggccgtcatcgtttacgatgtgactgacacgcaatcctttttgaatacgtcaaagtggatcgaggaagtgaatacacaaagaggcggcgatgtgctcatcttccttgtcggaaataaaactgaccttgtcgacaagaggaaagtgtccactgacgaaggagaagccaaagcacaggagcatggcgccatgttcatagaaaccagtgcaaaagctgggttcaacatcaagcctctgttccgcaagatcgctggatcccttcctggaatggacgctctctcgtcagcaaagcaggaagacatggtggacataaacctcaggccttccactgggtcgtcagcttcaggctcagcttcgcaggcggagcaaaagtcaggtggttgctcttgttgagacttgcagagttttgtgttcagagaagctgcagtagtagggatacaacatttgagttaatacttccgtagagatgaagagtaatattcatggggaagaggccaatttctgtgtacaaatatttttgtgaagttgccatacataactttttttggaacccaggaatatgatcaaatctgtgaaagctaacatcatctctcttttaccaactactaaatcaaaatactcgccgtcgaattcagc

SEQ ID NO: 4422 - DNA, 964 bp, Eutrema parvulum
gctttgtgtgcgaccgcgtcatcgtcgtcgtgctcgccttgtctttcttgttgctaagaagaaaactctgctctttatattcgtcggatcttattaatcactttttcttctcaccggaaaaaatggcggcggtttctcctttggcgaagtttaagttggtcttcttaggtgatcaatccgtcggaaaaaccagcatcatcacccgtttcatgtatgacaaattcgacaccacttaccagcctaccattgggattgattttctgtcgaaaacaatgtacctcgaagatagaacagttcgtttgcagctatgggatacggctgggcaagaaagattcaggagtctaatcccaagttacatcagagattcttctgttgccatagttgtatatgatgtagccaataggcaaacgtttctgaatatatcgaaatggatcgatgatgtacacagagaaagaggttcaggggacgttattattgttcttgttggaaacaaaactgatcttgttgagaaaaggcaagtatcgatcagtgaaggggaagacaagggtaaagagcatggagtgatgttcatcgaaaccagcgcgaaagaaaatttcaacattaaggctttgttccggaagattgctgcagcattacctgggatggattcatattcatcggcgacaaaatcagaggacatggtcgatgtgaacctaaagaccacttcaaattcatcgcaaggtgagcaacaaggaggaggtggtggaggaggctgttcttgttgattcaaaaataaacattttctgtttaagaaacatattctgtgaaccaaagaaacaaaaaaaaagtatcaagaaagtttttttgtttgtgatttttcatcttattagacattgacataaacaaaatatgaagacatcttaatcatacaaacattatattacaaactagaatatgatgatgcaacaccagagaaaggaattaa

SEQ ID NO: 4423 - DNA, 2538 bp, Physcomitrella patens
acgagcactctgctcttgtggctctgtcacccatgtcgtcgtgccgtgctgttactgtattgcgcgcgagagtgattgcagaccgcgctccgcaatagctgaattagctagctgcatgcgggctctaaggcgcggcttctaggatagaaggctaacaattcgtgatcagaaattggccttgtatcaagtttctgtccgtggccatccttgtttccggaatctcttgctcggtgctgttggacttcgaagttgaagcttgtgtccctcgaccactggcctgcttctagacatttgcgtgcgttgttccgactttcgggaggtgctgttggtgacgatcctggcgtctgaatgtggcgaacgaatgcgaggaatagatttttgtaagatttcgatgtgacatcgtcacgagattccgaagtggaggacttggtgtgtgaagttgtagaagagacctgacggaacggaactggatgagatggggtcacagattgcgacagtatcgccactagctaaatacaagctggtgttcctgggtgaccaatcagtgggcaaaacaagtattatcacgcgattcatgtatgataaatttgacaacacttaccaggcaaccatcggtatcgattttctctccaagacaatgtatcttgaagaccgcaccgttagattacaactctgggacacagctggacaagagcggttcaggagtttgattcctagctacattcgggactcgtccgtggcagtggttgtgtatgattcgtttctgaacacagttcgatgggttgaagaagttcgaacagagcgtggaagtgatgttattataatgcttgttggcaataagactgatctcgttgataaacgtcaagtatctgttgaagaaggggacgccaaggctaacgaatttggagtcatgtttattgaaacaagttcaaatgcgggtttcaatataaaggcactgttccgaaaaatcgctgctgcattgcctggaatggaggctttgtcttctcacaaggatgatctcgttgatgtcagtcttaagccaacatcgaatccgcagaccgagggcaaagcaggaggttgtgcatgttgacgaggcgcgagatcaaagcagcgacacataggttggctgaatgattgcgtcgggttgcggttcttttaggctatcagcgccgccactgttcatggttagggtaatcacaagggtttgatctagtttcaagtgcctcttcacagacgagtgcagatatctggaattcggacaaacacctgagtatgttggcagtagaatttattagttctagagctacaagctcacagaacattaagccgcacctgcttctgcttccgattcttagtattcaatatcatccgggcaggctacttctagctggatttccacaagcagcaaaaatgatcacattcatcaagcctaaattaccatatgatatgtgctgttactaatatagtgttgcgactccactccgtatcttggtttcactcgtgagttttgataaacggtttgggtgaactttccacgggttgaatcgtgggttaaaatcccgacatttgctaaatctttttcgaagcgcatgtaccgcctctcttggttgccaatccctgcttgtgatataattggaagagtatgctttttagaactgttcagtatctgggcgaacggtaatagtgatgacttgtgtgtatcttataggttggaattctgagccttgcctggctgacgagaggatgtttacagcaatctcacgagttattcttgggggaagaagagatgtccgattgccgagacagtctggcagttggcttacgagattgtgttggtattaaagtttctagtgtctggattgatccatcgtttgtttgcaggatgatatgtggtgcatgacactaatttgggcacttctggtcatgttcaagcttgagggctgcacaacctgactaagggtatacatagtaagcgctcttaaaggacgacgaagttgcacgaaatgtgatgactccgaccttgttcgaaagagattcgaactttttcatgcggatgttgcgagacattgcaattcctgcatcatcatttgtttatccacaagtatagtacatcgagggaactgaactgcacgtacagcttccggtcgacttcgcaagtgcacaacgatgccggaagtacctctttggtcctggctagttcgaagacctatggtgaacattcaaatgaatctacactcctttttatgagaacgtgtacggtctaataacacggattttcaacgtgtacagatactaatttacactcctacttatgagaacggtgtacccacggattgaaggtcgcggttacatgtgtcaattgcacagactcgctctgcaacggtggaacaatgggaccgtgcttcgaagtccttattaaaaagtcttcgatagtgttcaaatcaattccccgaactacctttaaaccgctgcagcagaggacggtttgagatgttaaagattgttgttcagcttccataatgccagagtgggacccac

SEQ ID NO: 4424 - DNA, 925 bp, Panax ginseng
ctttctctctccacatatatacagatttcagatccgatcgtcgactcatagcaaaaagaagcaattaagtaattaataagcatggcggtggtgtcacctttggccaagtacaagcttgtttttttgggagatcaatccgtcggtaaaacaagcattatcactcgcttcatgtacgataaattcgacaccactatcaggctaccatgaattgattctgtcaaaacatgtagcttgaagatcgaacagttcgtttgcaactttgggatactgccgggcaagagaggtttaggagtctcattcccagctacatccgagattcttctgttgcagtgattgtttatgatgttgcaaatcgacaatcatttttgaacacgtctaagtgggttgaagaagtacgtacggaacgaggcagtgatgtcattatagtccttgttgggaacaaaactgatcttgttgataaaaggcaagtttcaattgaagaaggagatgctaagctcgcgagtctggaatcatatttatagagacaagtgcaaagccggatttaatatcaagcctctatttcgaagattgctgctgccttgctagggatggaaaccctttcatcaacaagacaggaagacatggttgacgtgaatctgaagcctactattaattcttcccagacagagcagcaaggggaggctgcgcatgctagagaaagcagttaaaaggaagatagccaaaaaagaactccttcaatacacataataacccgaacctgaagactccagtcgatggtgttcatatcagttgatttcagaatctgaagggagatgaaaatagctgtaggtaattcgtgctacctcttcaaatatagtgtttagttgtttcctagtctctagacagaagaagttggcagcaatcatatcaaagacatttaatcgac

SEQ ID NO: 4425 - DNA, 829 bp, Echinochloa colona
ccccgttccaagcaatcgtctccttactccctttttctcctcccctttccatctgctgcacgcgtccgaaccccggcccaaacacgaagctagctcttgggtctccagcatctgagaaggcggcagatcgatcaaggaggtgccgggagccatggcgccggtggtgtcggcgctggccaagtacaagctggtgttcctcggcgaccaggccgtcggcaagacggccatcatcacccgcttcatgtacgacaagttcgacgacacctaccaggccacgatcgggatcgacttcctgtccaagaccatgtacctcgaggatcgcaccgttcgcctccagctctgggacacagctgggcaggagaggttccgcagcctcatcccgagctacatcagagactcctccgtggccgtcattgtttacgatgtgactgacaggcaatcctttttgaacacgtcaaagtggatcgacgaagtaaatacgcaaaggggtggcgatgtgctcatcttccttgtcggaaataaaactgaccttgtcgacaagaggaaagtgtccactgacgaaggagaagccaaagcacaggagcatggtgccatgttcatagaaaccagtgcaaaagctggtttcaacatcaagccactgttccgcaagatcgccggatcccttcctggactggacgcgctgtcgtcagcaaagcaggaagacatggtcgacataaacctcagatcttccaccgggtcgtcagtttcaggcgcagctgcgccggcggtatcaggcggttgtgcttgttgagacttccagagttttgtgttcagagaagctacactagta

SEQ ID NO: 4426 - DNA, 2028 bp, Brachypodium distachyon
ccgccccgacccccgatccccaaatctctgatgcccgtggagatcaaatccgctgccgccgcgcgactccgcagtctgccgccgccaccagtttgggttcggggagggagggcgctcgccgcgtcgccggatgtccgtcacgccgctcttcctctccgcagatgacgtctcccacgcagcggcggccgccgccctccttagccgcggaggatgcctccaacagacgcccgcctcccttacccgcagccgcgctgctgttcgtcgcagcctgggacgccatcgcggaggacgccgccgtcgcgcaccgtccgtccatcgccgccatcatatcctgcgctctctcgcgaagctaccagcgcgccgacaccgccgcgttgcaccatcaccatccacgccctggccatgtccttataaggtttcttaggctgtagacacaaaagttattatattcaaggagagaagtattacgctgaacaaagagacattgacaggaactgacaaagttgagatcagccaacagagaaggcatatataagtcatgtctgcaacaagaaggaacggataagtcagggatttgcaagtggaagttctttttgcgggggccggggatcaaatggaaactttgacaatgatgcgtgatctttccaagtttccacttgcaatcacaagcaaagtaacagaatgtgatggaacaacactttgtttccaatatgcagctaggacccaaactctttccatggttggaacaagagacccagcatctaggaaagcaaggagaaaaggggattaatcaggagacaaccatacgacaaggggagaaattcatggagcttaggcgaccaaagtctaccataattttttgtgtgatcttctttctgctatccagattaaattacatgctttatattgcagcatgtatgggagctggaattgcgtgtggtggttctcggggatggaaaaagtgtagggaagacaccaaggtttgtggcgacgcggtgcctgagcggaaagagaggaaagaagggaataaaggcacagtggacttccaagtttttaatgatcgatcgagcagctctgggctatatggcgccggtggtgtcggcgctggccaagtacaagctggtgttcctcggcgaccaggcggtgggcaagaccgccatcatcacccgcttcatgtatgacaagttcgacgccacctaccaggcaacgattgggatcgatttcctctccaagaccatgtacctcgaggatcgcacgattcgcctacagctatgggacacggctggacaggagaggttccggagcctgattccaagctacatcagagactcctctgtcgcggtgatcgtctacgatgtaacggacaggcaatcatttctgcatacatcgacgtggattgatgaagtaaagacagaaagagcaggtaccgatgtgctcatcgtcctcgtcgggaataaaacagatctcgttgacaagaggcaagtacccacagatgaaggagaagccaaggcgcaggagcacggcgtcatgttcatcgaaacaagcgcaaaggccgggttcaacgtcaagccgctgttccgcaagatcgccacgtctctgcctggaatggacgccctctcgtcggcgaagcaggaagacatggtcgacataaacctgaggcctgcctccggatcgaaggctccaggcgcagctgcgcagcaggagcagaaagcaggtggatgttcttgctgagacttctgtgtgctctgagaattcaacgaagcgagtatgcaggattgctgtagcacattgagtcattttcagatagtagttctcacgaagttttgaccatgggaaagacacttatcctagtgtgcaagattgtacttgtcgcgagtgttcttttagaaatagagcaaagtagtcaaaattacgaggggtgacaaaacattagcgccgttgccggggatcgaacccgggtcacccgcgtgacaggcgggaatacttaccactatactacaacgacttgatgactgttatacggagaat

SEQ ID NO: 4427 - DNA, 2802 bp, Zea mays
aagaaattagggagcattctataggagttgaggacatgaaattgaggaagcatttcaggttggcaggacgccaggacacagtaagctccagcgcagcgtgcccagatgctgccaagtgtacgtcttccccgggcagttggataagctcaccttggtctcaagtctcaattccgtcgtcgccactcggcccctacacgcaggcacgcagcacatatcagacacctccgaccgtcgcattcttcacgagtcctccggcccagcgcgcgccttctcaaaccttctagaacacccaccttccttctttcgtccactcctccaccgctccattccgaacctttttaagctctcccatggagtctgacctcatagcttatatagcaaaacaatagaagtagaacaagcacataactgttaagctagctccgcaggctgcagctcgtccccaatgtcgtctgcttctctcttgtgcagcagcagtgcttctactagtagaagcgcaaccgtgccaagagtaaccaggacccctcttttttccaagaaccagtacagaccggctcttcggcctcttaggagtagttcagtagttaggcggtcgttgcagcaggagcaagaggagagggtgggcccggcgtcctctgtctccgtggcctccggcgagcgacaggaggaggcgacggcgtcgcatcatattggaggggtggatgaggccaaggcgtcgggccatgttggagaggcagataaaggaggccaaggagaaggcgacgacgaggagaagaggagcacagacgagcagcaggaggtggactggaagtcagacgaggagttcaagaagttcatgggcaatccctccatcgaggccgccatcaagttggagaagaagcgcgccgacaggaagctccgcgagctggaccgcgagcccgacgccaaccccgtcgccggcctgttccggggcttggtgaaggaccagctggcccgcgagaagcagaggctggagctggcggagcagaccttcaaggcactcgacctcaacaagctgaagagctgtttcgggtacgacacgttcttcgcggtggacgtccggaggttcggcgacggcgggatcttcatcgggaacctgcgtaagcccatcgaggaggtgcggcctaagctggagaagaagatctccgaggcggccggaacagaggtcaccctctggttcatggaggagaagaacgacgacatcacaaagcaggtctgcatggttcagcccaaggcagagatcgacgtccagctcgagatcaccaagctgagcacgccgtggggctacctcagcgccgtggcgttggcggtcacgaccttcgggacgatcgcgctcatgagcggattcttcctcaagcccggcgccacgttcgacgactacgtctctgacgtgcttcctctgttcggcggcttcctcacgatactcggcgtctctgagattgcgactaggctgacggcggcgaagtacggtgtgaagctgagcccgtcattcctcgtgccgtccaactggacggggtgcctcggcgtgataaacaactacgagtcgttgctgcccaacaagaaggccctgttcgacataccagtcgcgcgcacggccagcgcgtacgtcacgtcggtggtgcttgccgtctcggcgttcatcgtcgacggcagcttcaacggcggcgagaacgccctgttcgtgcggccggagttcttctacaacaacccgctgctgtcgttcgtgcagctggtgatcgggccctacgcggacgagctcgggaacgtgctcccgaacgcggtggagggcgtgggcgtgcccgtggacccgctggcgttcgcggggctgctgggcatcgtggtgacgtcgctgaacctgctcccgatcgggcggctggagggcgggcgcatcgcgcaggcgctgttcgggcgcggcacggcggcgctgctgtcgttcggcacgtccgtcctgctgggcgcgggcgccatcagcggcagcgtgctgtgcctggcgtggggcctcttcgccaccttcatccgcggcggggaggagatcccggcgcaggacgagatcacgccgctcggcaacgagcgcctcgcgtgggggttcgtgctcgccttggtctgcctcctcacgctcttccccaacggcggcgggacctactctgcctccttcctcggcgacccgttctttagaggcggcatctagacggaatcatctccttccgtgcagtgtgcgtgtgtttataaagtttttagtaggctaataaccacactactaaccacttgagacgccacggcactcgacctgcagtccgccgatcccgaaacagatcgttgatgtcgccagaactgcatatcgatcgccctctgcagggcctacacccactgtacaatcggacagcaataggtcgacgatcctcgccgcaccgcctgtccaggttttccctccctcaccactgttcatgcctgctgttcatgatctggcacgcgcgggggagtgcggccagcagcacgcgtgatggcccgtggaagagttatttgctactatgatactcagtttggaatggctaggcattcagtctttttaaaactttggtttggtttatcggttttaaaaaaaactttggttacgataggaaccaatcgattttctagaaaatgaagaactgagaagttcggttccggttttttactttggttattgggtaaaaaccgaacaccaaacttatactcaggacaacacatacaataaatttacattatagattacacaatttttaaaagtaaaaattatataggtac

SEQ ID NO: 4428 - DNA, 2405 bp, Panicum virgatum
ccagcgtacccagctgccgccaagtgtccgtctcccccaggcagtcggataagccgaggcctcatcctgggtctcaactccgtcgtcgccactcgccacctccgaccgtcgcattcttcacgagtcctccggcccagcacgcgccttctcaaaccttctggacttcccgccttccttccttcttcccatccattattccaaacctttttaagctctccccatggggcctgacctcctcagatttcgcagcaaaagatcagaggtagaacaagcacaccttcaaagctccacagctcgtcgccaatggcgtctgcttctctcgcgtcttcactcttgtgcagcagcagcggttctaccagtagaagcgcagccgtgccgagggtgatccggatccctctcttctccaagaaccagtacaggccgcctcttcggcctctcaggagtagatcggtagttaggcgatcgttgcagcaggagcaggaggagcggacggacccggcctcctccgtcgccgtagcctccggcgagcagcaggaggaggagacgacgacggcgtcgcatcatgtcggaggggaggatggcgcgaagacatccggtcatgctggaggagcagagggaggcgaaggagaaggcgatggcgaggcgaagaggagcacggatgagcagcaggaggtggactggaagtcggacgaggagttcaagaagttcatgggcaacccctccatcgaggccgccatcaagctggagaagaagcgcgccgaccggaagctccgcgagctggaccgcgagcccgacgccaaccccgtcgccggcctgctccggggcctggccaaggaccagctggcgcgggagaagcagaggctggagctggcggagcagaccttcaaggcgctcgacctcaacaagctcaagagctgtttcgggtacgacacgttcttcgcggtggacgtccggcggttcggcgacggcgggatcttcatcgggaacctgcggaggcccgtggaggaggtgcggccgaagctggagaagaagatcgccgaggccgccgggacggaggtcaccctctggttcatggaggagaaggccgacgacatcaccaagcaggtctgcatggttcagcccaaggcggagatcgacctccagctcgaggtcaccaggctgagcacgacgtggggctacctcagcgccgtggcgctggccgtcacgaccttcgggacgatcgccctcatgagcggcttcttcctcaagcccggcgcgacgttcgacgactacgtctccgacgtgctccctctgttcggcggcttcctcaccattctcggcgtgtccgaggtcgcgacgaggctgacggcggcgaagtacggcgtgaagctgagcccgtcgttcctggtgccgtcgaactggacagggtgccttggcgtgatgaacaactacgagtcgctgctgcccaacaagaaggccctgttcgacatccccgtcgcgcgcacggccagcgcgtacgccacgtcgatcgtgctcgccatctcggcgttcatcgccgacggcagcttcaacggcggcgagaacgccctgttcgtgcggccggagttcttctacaacaacccgctgctgtcgttcgtgcaggtggtgatcgggccgtacgccgacgagctcgggaacgtgctgcccaacgcggtggagggtgtgggagtgcccgtggacccgctggccttcgcggggctcctgggcatcgtggtgacgtcgctgaacctgctcccgatcgggcggctggagggcggccgaatcgcgcaggcgctgttcgggcgcggcacggcggcgctgctctcgttcggcacgtcggtgctcctgggcgccggcgccatcagcggcagcgtgctgtgcctggcgtggggcctcttcgccaccttcatccgcggcggcgaggagatcccggcgcaggacgagatcacgccgctcggcaacgaccgctacgcgtgggggttcgtgctcgccgtcgtctgcctcctcacgctcttccccaacggcggcggcacctactccgcctccttcctcggggaccccttcttcaggggcggcgtctaggcgacgcgccgtggcggacaagtagtagtagaagggtttggatgccgatgcctgtacagacgtacgtagtcactctactaaccagtaaccactatgcaatctccaattctccatatcaaaatccttttcttttatcatatcaaaatgacaaaatcttttggtgatatagcatcacatcctgcaagtagagttgatgtttcaaggagccttgaacacgggggatttcaatgaattttgtaaaatgcacacatgaacgttcaacgtcgtgtattttgttggtttgaaatcaatatacggcagttccatttctgcggaaatagcaaaaa

SEQ ID NO: 4429 - DNA, 2143 bp, Setaria italica
ctcccgtcttccttccttccttccttcctcccctgcgttactccaaacctttttaagctggactgacctcagatctcatagcgaaacgttaattagaggtagaacaagcacaagtgttacaaagctaagctccacagctcgtcgccaatggcgtctgcttccctcgcgtcttctgtcctgtgcagcagcagcggttctaccagtagaagcgcagccgtgccgagggcgatccggatccctctcttccccaagaaccagcacaggccgcctcttcggcctctcaggagtagctcggtagctaggcgatcgctgcagcaggagcaggaggagagggcggacccggcctcctccgtcgccgtagcctccggcgagcggcatgaggagccgacggcgtcgcaccatgttggaggggaggatgatggcacgacggcgtcgggtcacgctggaggagcagagggaggccagggagatggcgacggcgaggagaagaggagcacggatgagcagcaggaggtggactggaagtcggacgaggagttcaagaggttcatggggaacccctccatcgaggccgccatcaagctggagaagaagcgcgccgaccggaagctccgcgagctggaccgcgagcccgacgccaaccccgtcgccggcctgctccggggcctggcaaaggaccagctggcccgggagaagcagaggctggagctggccgagcagaccttcaaggcgctcgacctcaacaagctcaagagctgcttcgggtacgacacgttcttcgcggtggacgtccggaggttcggcgacggcgggatcttcatcgggaacctgcggaggcccgtggaggaggtgcggccgaagctggagaagaagatcgccgaggcggccgggacggaggtcacgctctggttcatggaggagaagggcgacggcgacatcaccaagcaggtctgcatggtccagcccaaggcggagatcgacctccagctggagatcaccaggctgagcacggcgtggggctatctcagcgccgtggcgctggcggtcaccacgttcgggacggtcgccctcatgagcggcttcttcctcaagcccggcgcgaccttcgacgactacgtctccgacgtgcttcctctgttcggcggcttcctcaccatactcggcgtgtctgagatcgcgacaaggttgacggccgcgaagtacggcgtgaagctgagcccgtcgttcctggtgccgtcgaactggacggggtgcctcggcgtgatgaacaactacgagtcgctgctgcccaacaagaaggccctcttcgacatccctgtcgcgcgcacggccagcgcgtacatcacgtccgtcgtgctggccgtctccgcgttcatcgccgacggcagcttcaacggcggcgagaacgccctgttcgtgcggccggagttcttctacaacaacccgctgctgtcgttcgtgcaggtggcgatcggcccctacgccgacgagctcgggaacgtacttcccaacgcggtggagggcgtgggcgttcccgtggaccccctggccttcgcggggctcctgggcatcgtggtgacgtcgctgaaccttctcccgatcgggcggctggagggcgggcgcatcgcacaggcgctgttcgggcggagcacggcggcgctcctgtcgttcggcacgtccgtgctgctgggcttgggcgccatcagcggcagcgtgctgtgcctggcgtggggcctcttcgccaccttcatccgcggcggcgaggagatcccggcgcaggacgagatcacgccgctcggcagcgaccgggtcgcgtgggggttcgtgctcgccgtcgtctgcctcctcacgctcttccccaacggcggcggcacctactccacctcattcctcggggaccccttcttcaggggcggcatctaggcgctgcgccggtggcgtagtagaaggggtctcgtaggaagcggtttggattgcttttcggttcctgtgcagcgtgtgcgtgtatatacggagtagtagtatactgctgtagtcactctactaaccactatgcaatctcaaactctccatatcaaaatcttttctgtttttttgccatacacttcccgcgagtgcgtatgatattgcaagggtaccaggc

SEQ ID NO: 4430 - DNA, 2481 bp, Panicum virgatum
gcagaattgttggaacacgtttttgttgcttatttagctccacagtaagtgtggacccaaaaattgggggagaattgaggaagcctttcagaggccggatccacgcagtaagctccaagccagcgtacccaactgctgccaagtgtccgtctccctcaggcagtcggataagccgaggcctcaccctgggtctcaactccgtcgtcgccactcgccacctccgaccgtcgcattcttcacgagtcctccggcccagcgcgcgccttctcaaaccttctggacctcccgccttccttttccttcttcccatccattattccaaacctttttaagctctccccatggggcctgacctcctcagatttcgaagcgaaagatcagaggtagaacaagcacagcttcaaagctccacggctcgtcgccaatggcgtctgcttctctcgcgtcttctctcttgtgcagcagcggcggttctaccagtagaagcgcagccgtgccgagggtgatccggatccctctcttctccaagaaccagcacaggccgcctcttcggcctctcaggagcagatcggtagttaggcgatcgctgcagcaggagcaggaggagcggacggacccggcctcctccgtcgccgtagcctccggcgagcaggaggaggaggcggcgacgacggcgtcgcatcatgtcggtggggagaatgtcgccaagacatccggtcatgctggaggagcagagggaggccaaggagaaggcgacggcgaggcgaagaggagcacggatgagcagcaggaggtggactggaagtcggacgaggagttcaagaagttcatgggcaacccctccatcgaggccgccatcaagctggagaagaagcgcgccgaccgtaagctccgcgagctggaccgcgagcccgacgccaaccccgtcgccggcctgcttcggggcctggccaaggaccagctggcgcgggagaagcagcggctggaactggcggagcagaccttcaaggcgctcgacctcaacaagctcaagagctgtttcgggtacgacacgttcttcgcggtggacgtccggcggttcggcgacggcgggatcttcatcgggaacctgcggcgccccgtggaggaggtgcggccgaagctggagaagaagatcgccgaggccgccgggacggaggtcaccctctggttcatggaggagaaggccgacgacgtcaccaagcaggtctgcatggttcagcccaaggcggagatcgacctccagctcgaggtcaccaggctgagcacggcgtggggctacctcagcgccgtggcgctggccgtcacgaccttcgggacggtcgccctcatgagcggcttcttcctcaagcccggcgcgacgctcgacgactacgtctccgacgtgctccctctgttcggcggcttcctcaccattctcggcgtgtccgaggtcgcgacgaggctgacggcggccaagtatggcgtgaagctgagcccgtcgttcctggtgccgtccaactggacggggtgcctcggcgtgatgaacaactacgagtcgctgctgcccaacaagaaggccctgttcgacatccccgtcgcgcgcacggccagcgcctacgccacgtcgatcgtgctggccatctcggccttcatcgccgacggcagcttcaacggcggcgagaacgccctggtcgtgcggccggagttcttctacaacaacccgctgctgtcgttcgtgcaggtggtaatcgggccgtacgccgacgagctcgggaacgtgctgcccaacgcggtggagggcgtgggcgtgcccgtggacccgctggccttcgcggggctcctgggaatcgtggtcacgtcgctgaacttgctcccgatcgggcggctggagggcggccgcgtcgcgcaggcgctgttcgggcgcggcacggcggctctgctctcgttcgccacgtcgctgctcctggtcgccggcgccatcggcggcagcgtgctgtgcctggcgtggggcctcttcgccaccttcgtccgcggcggcgaggagatcccggcgcaggacgagatcacgccgctcggcaacgaccgctacgcgtgggggttcgtgctcgccgtcgtctgcctcctcacgctcttccccaacggcggcggcacctactccacctccttcctcggggaccccttcttcaggggcggcatctaggctagggtctcgtggctgtttggattgctgtgctgcctgcctgtgcagcgtgtgcgtgtatatactgacgtagtcacactacttgactaaccagtaaccactatgcaatctccaattctccatatcaaaatctttttccatcatatcaaaatctttttggcgatatagcatcacttcccgcgagtagagtttgatgtttcaagcgggacgcggggattgcacatgaattttgtaaaatccacacatgaacgttcaacgtcacgtggattttgttggtttca

SEQ ID NO: 4431 - DNA, 1829 bp, Triticum aestivum
acaccaaaatcaaagcaccagatcgaacaggcagcaggcaccatcaatcgagcttcacagcagctcgccaccagtaatggcttccacttcgctcgttgcaactatcgtgtgtagcagcatcagcagcactggtgggagagcaaccttaccaagaagcttctgcaagaaccatcacaggccacctctcaggcctctcaggagaagctccctattcaggtgctcgctgcgggagcaaaatcaggcgacggagaaccggccggtctcctccactgccgttgctcctgacgagcaaaaggttgaggaggcgaagaaggtgtcgtcgcatcatgccggaggagggggaggagatcatcaggaaggaggtgatggcgaggacagcgagaagaagagcagggatgagcagcaggaggtggactggaggtcggacgaggagttcaagaagttcatgggcaacccgtccatcgaggccgccatcaagctcgagaagaagcgcgccgaccggaagctccgggagctcgaccgcgagcccgacgccagcccggtcggcggcctgctccgtgggttcatcaagggcacgctggaacgggagaagcagaggctggaggaggccgagcagaccttcaaggcgctcgacctcaacaagctcaagagctgcttcgggtacgacacgttcttcgcggtggacgtgcggaggttcggcgacggtggcatcttcatcggcaacctgaggaagcccatcgaggaggtgaggccgaagctggagaagaagatcgccgaggcggcagggacagaggtcaccctgtggttcatggaggagaggaacgacgacatcaccaagcaggtctgcatggtgcagccgaaagcagagattgagctgcagctggaggtgaccaagctgagcacgccgtggggctacctgagcgccgtggccttggccgtcacgaccttcgggaccatagctctcatgagcggcttcttcctcaagcctggcgcgtccttcgacgactacgtctccgacgtcctccccctcttcggaggcttcctctccatcctcggcgtgtccgagatcgcgacgaggttgacggcggcgaggtacggggtgaagctgagcccatcgttcctggtgccgtcgaactggacggggtgcctgggtgtgatgaacaactacgagtcgctgctgccgagcaagaaggccctgttcgacatccccgtggcccgcacggccagcgcgtacctgacgtcggtggtgctggccgtctcggccttcatcgccgacggcagcttcaacggcggcgagaacgccctgttcatccggccggagttcttctacaacaacccgctgctgtcgttcgtgcagcaggtgatcgggccgtacgcggacgagctggggaacgtgctgccgaacgcggtggagggcgtgggcgtgccggtggacccgctggcgttcgcggggctgctggggatcgtggtgacgtcgctgaacctgctgccggtcgggcggctggagggcggccgggtcgcgcaggcgctgttcgggcggcgcacggcggcgctgctgtcgttcggcacgtcgctgctgctgggggcgggcgccgtcggcggcagcgtgctgtgcctggcgtgggggctcttcgccaccttcatccgcggcggggaggagatcccggcgcaggacgagatcacgccgctggggagcgagcgctacgcgtggggcttcgtgctcgccgtcgtctgcctcctcacgctcttccccaacggcggcggcacctactccagctccttcctcggcgagcccttcttcaggggcggcatctagactagacctgctt

SEQ ID NO: 4432 - DNA, 2466 bp, Hordeum vulgare
gcttcacctccttcgtcgccacccgccactactcgatcacctcatcagctactccggccgtcgcattcttcacgactcctcccggcgcattctccaaccttctagaacgctcaccttcctcctccttccgaaccattttaagctcccccatgagctccaaagatctccacaccaaaatcaaagcaccagatcgaacaggcagcaggcaccataaaccacgctccacagctcgccgtcgccggcagtaatggcttccacttctctcgttgcatctatcgtctgtagcagcagcggcagcagcagcactggcaggagcgcggccttgccaagaagcttctgcagaaaccatcacaggctttctctcaggcctctcaggagcagctccatcgtcaggtgctcgctgcagaagcaagatcaggcgaaggagaaccggccggtctcctccattgccgttgctccggacgagcaaaaggtcgaggagtcgaagaaggcgtcgtcgcatcatgccggaggaggagggggaggagatcatccggaaggaggtgatggcgaggacagcgagaagaagagcagggatgagcagcaagaggtggactggaggtcggacgaggagttcaagaagttcatgggcaacccgtccatcgaggccgccatcaagctcgagaagaagcgcgccgaccggaagctccgggagctcgaccgcgagcccgacgccagcccgatctccggcctgctccgtgggttcatcaagggcacgctggaacgggagaagcagaggctggaggaggccgagcagaccttcaaggcgctcgacctcaacaagctcaagagctgtttcgggtacgacacgttcttcgcggtggacgtgcggcggttcggcgacggcggcatcttcatcggcaacctgaggaagcccatcgaggaggtgaggtcgaagctggagaagaagatcgccgagacggccgggacggaggtcacgctctggttcatggaggagaggaacgaggacatcaccaagcaggtttgcatggtgcagccgaaagcagagatcgagctgcagctcgagatgaccaagctgagcacgccgtggggctacctgagcgccgtggcgctggccgtcacgaccttcgggaccatagctctcatgagcggcttcttcctcaagcccggcgcctccttcgacgactacgtctccgacgtcctccccctcttcggaggcttcctctccatcctcggcgtatccgagattgcgacgaggttgacggcggcgaggtacggcgtgaagctgagcccgtcgttcctggtgccgtccaactggacggggtgcctgggcgtgatgaacaactacgagtcgctgctgccgaacaagaaggcgctgttcgacatccccgtcgcccgcacggccagcgcgtacctgacgtcggtggcgctggccgtgtcggccttcatcgccgacggcagcttcaacggcggcgagaacgccctgttcatccggccggagttcttctacaacaacccgctgctgtcgttcgtgcagcaggtaatcgggccgtacaccgacgagctgggcaacgtgctgcccaacgcggtggagggcgtgggcgtgccggtggacccgctggcgttcgcggggctgctggggatcgtggtcacgtcgctgaacctgctgccgatcgggcggctggagggcggccgggtcgcgcaggcgctcttcggccggcgcacggcggcgctgctgtcgttcggcacgtcgctgctgctgggggcgggcgccgtcggcggcagcgtgctgtgcctggcgtgggggctcttcgccaccttcatccgcggcggcgaggagatcccggcgcaggacgagatcacgccgctggggagcgagcgctacgcgtggggcttcgtgctcgccgtcgtctgcctcctcacgctcttccccaacggcggcggcacctactccagctccttcctcggcgagcccttcttcaggggcggcatctagacctgctcgtgtgagatcctagtagcgtagaagtagtagtgatcacatcaggccttctgcgtctccaccaactaaccagtatttgcactctgataaaatgttttccgttcatgatatagggagataaaatgtaccgttactctgaagccacagcatttgttctctctttcttagtgaggcaattgcatctggaaacatgaagcaacaagtgtttgtgcgtgaagtaggaagagacaaaaaaatcaggatcaagaggcacagtttattcactggtattagaatgattgggtcaggctgcacacagtaattacaagtgattatcagctacatcttaataatattagaatgtgtggcattgcctctgcgatcttgccaaacagtttctccatatgctccgactatgttctattccatgttgggctcttggccttcaaaattgtacttacacaaggttggttggtggtaattct

SEQ ID NO: 4433 - DNA, 2199 bp, Hordeum vulgare
gcttcacctccttcgtcgccacccgccactactcgatcacctcatcagctactccggccgtcgcattcttcacgactcctcccggcgcattctccaaccttctagaacgctcaccttcctcctccttccgaaccattttaagctcccccatgagctccaaagatctccacaccaaaatcaaagcaccagatcgaacaggcagcaggcaccataaaccacgctccacagctcgccgtcgccggcagtaatggcttccacttctctcgttgcatctatcgtctgtagcagcagcggcagcagcagcactggcaggagcgcggccttgccaagaagcttctgcagaaaccatcacaggctttctctcaggcctctcaggagcagctccatcgtcaggtgctcgctgcagaagcaagatcaggcgaaggagaaccggccggtctcctccattgccgttgctccggacgagcaaaaggtcgaggagtcgaagaaggcgtcgtcgcatcatgccggaggaggagggggaggagatcatccggaaggaggtgatggcgaggacagcgagaagaagagcagggatgagcagcaagaggtggactggaggtcggacgaggagttcaagaagttcatgggcaacccgtccatcgaggccgccatcaagctcgagaagaagcgcgccgaccggaagctccgggagctcgaccgcgagcccgacgccagcccgatctccggcctgctccgtgggttcatcaagggcacgctggaacgggagaagcagaggctggaggaggccgagcagaccttcaaggcgctcgacctcaacaagctcaagagctgtttcgggtacgacacgttcttcgcggtggacgtgcggcggttcggcgacggcggcatcttcatcggcaacctgaggaagcccatcgaggaggtgaggtcgaagctggagaagaagatcgccgagacggccgggacggaggtcacgctctggttcatggaggagaggaacgaggacatcaccaagcaggtttgcatggtgcagccgaaagcagagatcgagctgcagctcgagatgaccaagctgagcacgccgtggggctacctgagcgccgtggcgctggccgtcacgaccttcgggaccatagctctcatgagcggcttcttcctcaagcccggcgcctccttcgacgactacgtctccgacgtcctccccctcttcggaggcttcctctccatcctcggcgtatccgagattgcgacgaggttgacggcggcgaggtacggcgtgaagctgagcccgtcgttcctggtgccgtccaactggacggggtgcctgggcgtgatgaacaactacgagtcgctgctgccgaacaagaaggcgctgttcgacatccccgtcgcccgcacggccagcgcgtacctgacgtcggtggcgctggccgtgtcggccttcatcgccgacggcagcttcaacggcggcgagaacgccctgttcatccggccggagttcttctacaacaacccactgctgtcgttcgtgcagcaggtaatcgggccgtacaccgacgagctgggcaacgtgctgcccaacgcggtggagggcgtgggcgtgccggtggacccgctggcgttcgcggggctgctggggatcgtggtcacgtcgctgaacctgctgccgatcgggcggctggagggcggccgggtcgcgcaggcgctcttcggccggcgcacggcggcgctgctgtcgttcggcacgtcgctgctgctgggggcgggcgccgtcggcggcagcgtgctgtgcctggcgtgggggctcttcgccaccttcatccgcggcggcgaggagatcccggcgcaggacgagatcacgccgctggggagcgagcgctacgcgtggggcttcgtgctcgccgtcgtctgcctcctcacgctcttccccaacggcggcggcacctactccagctccttcctcggcgagcccttcttcaggggcggcatctagacctgctcgtgtgagatcctagtagcgtagaagtagtagtgatcacatcaggccttctgcgtctccaccaactaaccagtatttgcactctgataaaatgttttccgttcatgatatagggagataaaatgtaccgttactctgaagccacagcatttgttctctctttcttagtgaggcaattgcatctggaaacatgaagc

SEQ ID NO: 4434 - DNA, 1947 bp, Oryza sativa
aagaaagaacagctagaacaatcacttgcaagcatacacacaccaagctagctagctcgatcgtcgccaatggcgtcgtcctccctcgtcacctctctcttgttcagcagtagcagcagcagtaacactgcaactagtacaagctcaagaagaagcttcagtcttttctccaagaaccagtactgcaagcctaggcctctcaggcgaagcagtagccgcctcctcgtcaggtgctccttgcaacagcagcaggaggagaaggcggcgccggcggcggagtcgcaccacgccggcggcggacaggacgacgccgccacggcgtcgcaccacgccgtggaaggagagaacggtgtcgcagacgccgacggcggcggcgtgaagaagagcaaggaggagttggaggaggaggagcagcaggaggtggactggaggtcggacgaggagttcaagaggttcatggggaacccgtccatcgaggccgccatcaagctggagaagaagcgcgccgaccggaagctccgcgagctcgaccgcgagcccgacgccaacccgctcgccggcctcctccgcggcctcgctaggggccagctcgcccgcgagaaggagaggctcgagctcgccgagaacaccttcaaggcgcttgacctcaacaagctcaagagctgcttcggctacgacacgttcttcgccgtggacgtccggaggttcggcgacggcggcatcttcatcggcaacctgaggaagcccgtggaggaggtgaggccgaagctggagaagaagatcgccgaggcggccggcacagacgtcaccctctggttcatggaggagaagaacgacgacatcacaaaacaggtctgcatggtccagccgaaggcagagatcgacctgcagctggagatcaccaagctgagcacgccgtggggatacctgagcgccgtggcgctggccgtcacgacgttcgggacgatcgccatcatgagcggcttcttcctcaagcccggcgcgacgttcgacgactacgtctccgacgtgctccctctcttcgccggcttcctctccatcctcggcgtatccgagatcgcgacgaggctgacggcggcgaggtacggcgtgaagctgagcccgtctttcctggtgccgtccaactggacggggtgcctcggcgtgatgaacaactacgagtcgctgctgccgaacaagaaggccctgttcgacatcccggtggcgcgcgcggcgagcgcgtacctcacctcggtggcgctcgccgtctccgcgttcgtctccgacggcagcctgaacggcggcaagaacgcgctgttcgtccggccggagttcttctacaacaacccgctgctgtcgttcgtgcaggcggtgatcgggccgtacgccgacgagctcgggaacgtgctgccgaacgcggtggagggcgtcggcgtgccggtggacccgctggcgttcgcggggctgctcgggatcgtggtgacgtcgctgaacctgctgccgtgcgggaggctggagggcgggcggatcgcgcaggcgctgttcgggcgcggcgcggcggcggtgctgtcgttcgcgacgtcggtggcgctcggcgcgggcgccatcatcggcgggagcgtgctgtgcctggcgtgggggctgttcgcgacgttcgtccgcggcggcgaggagatcccggcgcaggacgagatcacgccgctggggagcgagcgctacgcgtgggggctcgtgctcgccgtcgtctgcctcctcacgctcttccccaacggcggcggcacctactccagcgacttcctcggcgcgccattcttccgcggcggcatctaaggcgcccctcgaggcctcgatcgatctctccatccatggcggcgcgagtaggctttagtgggcgaacaagtagctagagggcgattactctgtttatgcttcgacgcgtatgtgtat

SEQ ID NO: 4435 - DNA, 2226 bp, Oryza sativa
cgccgctactcgatcagcagctcagcctcctcaccgtcgcagtcttcacgactcctccccgcgccttctcgacgttctagaactctccctcctcctcctctccatttccgaacctttttaagctcccctacgagcttccattctcagatctgcaagaaagaacagctagaacaatcacttgcaagcatacacacaccaagctagctagctcgatcgtcgccaatgtcgtcgtcctccctcgtcacctctctcttgttcagcagtagcagcagcagtaacactgcaactagtacaagctcaagaagaagcttcagtctcttctccaagaaccagtactgcaagcctagtcctctcaggcgaagcagtagcctcctcctcgtcaggtgctccttgcaacagcagcaggaggagaaggcggcgccggcggcggagtcgcaccacgccggcggcggacaggacgacgccgccacggcgtcgcaccacgccgtggaaggagagaacggtgtcgcagacgccgacggcggcggcgtgaagaagagcaaggaggagttggaggaggaggagcagcaggaggtggactggaggtcggacgaggagttcaagaggttcatggggaacccgtccatcgagggcgccatcaagctggagaagaagcgcgccgaccggaagctccgcgagctcgaccgcgagcccgacgccaacccgctcgccggcctcctccgcggcctcgctaggggccagctcgcccgcgagaaggagaggctcgagctcgccgagaacaccttcaaggcgcttgacctcaacaagctcaagagctgcttcggctacgacacgttcttcgccgtggacgtccggaggttcggcgacggcggcatcttcatcggcaacctgaggaagcccgtggaggaggtgaggccgaagctggagaagaagatcgccgaggcggccggcacagacgtcaccctctggttcatggaggagaagaacgacgacatcacaaaacaggtctgcatggtccagccgaaggcagagatcgacctgcagctggagatcaccaagctgagcacgccgtggggatacctgagcgccgtggcgctggccgtcacgacgttcgggacgatcgccatcatgagcggcttcttcctcaagcccggcgcgacgttcgacgactacgtctccgacgtgctccctctcttcgccggcttcctctccatcctcggcgtatccgagatcgcgacgaggctgacggcggcgaggtacggcgtgaagctgagcccgtctttcctggtgccgtccaactggacggggtgcctcggcgtgatgaacaactacgagtcgctgctgccgaacaagaaggccctgttcgacatcccggtggcgcgcgcggcgagcgcgtacctcacctcggtggcgctcgccgtctccgcgttcgtctccgacggcagcctgaacggcggcaagaacgcgctgttcgtccggccggagttcttctacaacaacccgctgctgtcgttcgtgcaggcggtgatcgggccgtacgccgacgagctcgggaacgtgctgccgaacgcggtggagggcgtcggcgtgccggtggacccgctggcgttcgcggggctgctcgggatcgtggtgacgtcgctgaacctgctgccgtgcgggaggctggagggcgggcggatcgcgcaggcgctgttcgggcgcggcgcggcggcggtgctgtcgttcgcgacgtcggtggcgctcggcgcgggcgccatcatcggcgggagcgtgctgtgcctggcgtgggggctgttcgcgacgttcgtccgcggcggcgaggagatcccggcgcaggacgagatcacgccgctggggagcgagcgctacgcgtgggggctcgtgctcgccgtcgtctgcctcctcacgctcttccccaacggcggcggcacctactccagcgacttcctcggcgcgccattcttccgcggcggcatctaaggcgcccctcgaggcctcgatcgatctctccatccatggcggcgcgagtaggctttagtgggcgaacaagtagctagagggcgattactctgtttatgcttcgacgcgtatgtgtatataacaacataaatcatacgtattactagtacttactaacctctacgaattttgcatttgaagatcttatattgttcttttcggctactttactgaattattatcgctgattatttacaccacgca

SEQ ID NO: 4436 - DNA, 1402 bp, Zea mays
aaaccggacaaggaatcatacggtttataagcaaaggagagtagatgcaggatggagtccgctacacgccactggggatcctataaattcccctgccttttcttctccactccactcatcacaaatctctctctctctctctacaagctccagctagactgtcctgctctgcttcggcgctactgtgcagtgtgcacagccagccagctctgcagcagagcagagtccggctgtgagccctgaccagagaggattcagtgccatggagagacctgcgcaggcgcccacgcagctgccgccggggttccggttccaccccaccgacgaggagctggtagtgctgtacctccgccggaaggccctggctcgcccgctgccggccgccgtcatccccgtcgtccacgacgtcgccgggctcgatccatgggacctccctggggcaagcgaaggggagggttacttctttagcctgcggcgagcgccggcgaccggccgtggcagccgcaggaggagagctgggagcgggtactggaaggccacgggcaaggaggagccggtgttcctgcagtgcggcggcggcggcgtaggcggcaagaggcagctgctcgtgggcggcaagacggcgctcgccttccaccgcagtgagccgtcgccgccgtcgtcgtcgcggacaggctgggtcatgcacgagtaccggctcgccgccgcgtcccgcggcgtggccgagcagaggaagaagaatgcgagccatggttgttgcgatgctgagccgggagagtgggtcgtgtgccgggtctttctgaagaagggagcaagaagaagcaggccgggccgggatggtaaccacagcagagctctgagacaccgcgcatccgctgcgccgccgcagctccgggaaggtgtgggaggacggcagccgttgctgttcccggcgccacagtcgccgtcctcaagctgtgtcaccggcgttaccgacttgtcagacgaagaagacgaagtcagcagcggcagcataacaagagttgcacctcagagagaggcctgatggggattttaagtgttccctcccccctctctcatggtcccgtagcccaacctttttctggtaccatacaatgatgatgagttaagcacgagataatcaggtttaggcatgtccagcgcaggagtgatcccgaaatatcatatcaaatggatctggcaacctgagtttaaatcaggagcaatagtttctacgcttcatctgtgaagcagcatccactttgatttggaactagaaaatgggcgctgcaacctgcaacggcccgatggtgtgtaaaatctaaaaacgtagccaggcattctttaagatgtactatctccatcctaaaatataatttattttagactaaatatattgtta

SEQ ID NO: 4437 - DNA, 2484 bp, Zea mays
aacagatggaacggggctggcactgcatctccgcctacatgatgcttgcacttctttcagacttatttgatatttttttcagagaaaatattaatattactagtgcaacacaaaactaataaatcacatgaaaatactcatattggagcagttaaaatattagctgctaaaaatatctggatgtttttgcttatgtaatagtaccaatattttaaataaaatacccaaacctgtttattgatgatttacttttatttgctttacaatgcaaggtaatggttgctacggttaggtgtgatgaaattgcaaacgagaagtttggatgcataacctcggacacagaatggttagatgtggagagtgctgtccaatctggtccagtacctggttttgggaaaaaacttagcaatatcgtggaagttcacttgcaagagtatgacaaagaagctttctattttgatgaagctgttaggaaaggaaaacgacaacatttggagtccagaatactgaatcttgtccaacctgcattccagaaaatgttgactcatctgcgcatgaaggctttagaaaaatttaaagctggtcttaattcatctttggagagtggaaaagaattcgcgatatctgcaagagacaatactgaatgctctctcaaagactttgaacaaggatgtgctgatgctataatcaagcaggcgaactgggactgctctaaaatactagagaaagtacggcgtgatattgaagatcatgcactttcaattcgtgaaagaaagctatcagaattgacaacccatgctaaggagaaactaagaaaagcactagctgaacctgtggagtctctatttgatgctgcagaccaaacaacctggacatcaataagaaacatttacaaacgcgagacagaggccatcctaccggagtttctgaaaaccatttgtgggtttgaaatggaatatgctcaagcagaagaaatggtatccaaattaagggattatgcccggagtgttgtgcaaagtaaagctaaagaggaatctagcaaagtattgatccatatgaaggagaggttcacaacagtgtttagccatgacaaggattcaattccaagggtctggacaggaaaggaagatgttcacgcgatagcaaaggaagctcgagctgcggctctcaaacttctgtctgtaatggcggccattcgctgggatgatgagccagataggattgaaagcatcatcacttcaacacttctggaaggctctgttgtatcaaagattgcaagtgctgcttctgctgacccacttgcttctaccacttgggaacagattcctccagagcatacaatgattactccttctcagtgcaagttactgtggaagcaattcaaatcagaaactgagttcaccattacacaagcagtatccacacagcaagctcacaggcgtggtaatagtaagctgcctcctccttgggcaattgtggccattgctattcttggtttcaatgagatcatgacgcttcttaggaatcccatttatgtgtttttgctatttgtgggctacttgatggtcaaagctttggcagtacaactagatgtcagcagagaattccaaaatggagtggttcctgggataatctctgtgtcagcgaagctcctgccgacgatacagaacctggtgaacaaagtggcagccgagcagcaggatgagcaccggcaccatcaccagcagcaccctcaggtagcagaacccctacagccacagatgcagccgccgccgctgctcctgagcccgagaagccccatgagcgagctgcggaggctgcacatgccgtcaagcccgcgcaaggtagcgtcgtcctcctcgtcgtcgtcgtcgtcctcctcgtctgccgtatcgtcccctaggcacgttggcgaggatcagaagccaagaccaggggcagctgcgcctgagaaccagtccaccatcgctgactcgatagtgtgatccatcagccatggtggtgtagagactggcattaaaagtacacaaggtattgaggattcatggaccttctgttgtcccctagctatctccacgcatatatgtgtagtgattttcatcatgcttcagtagttaccaagagagaaataatccaggacccttatgttgcaaccctttagtttttgcaagccaaggagggacaatccatagacggacagttggtacctgacgtcatttttcagcatttatacatatgtgtgtatagaaggcagaaccatagaggagctactctagggttttgttcaatgtgtgctagaaaaaatgaccctacgatccacattcagttatttgctgtcaatatctgctgagactgaccaaccaatacgggagacgacgcggcacgtggagaaattcgtccggctgccgctgccctcctcacatggccgctagctgccgtcttctagcatacggtagtagctagctgtgcctgtgggcggccgac

SEQ ID NO: 4438 - DNA, 2909 bp, Setaria italica
cattccgtttccatttcccacacgagccctatgcgaccccccacgacgggatcggagacgatggcggaggagagcgacgcggcggacggcggggtggcggtgcagctgatcgacggcgagggcgagttcgcgggcgagggggccgagcggttcatggcggccgccggcgtcgccggatgcgggctctcctacgccgtcgtctccatcatggggccgcagagcagcggaaagagtaccttgttgaaccaactatttggaaccaattttagggagatggatgcattcaggggaaggagccaaactacaaaaggcatctggatagcacgctgtgttggtgttgagccttgtactgttgtattggatctggaaggtactgatggaagagagagaggagaggatgacactgcatttgagaagcaaagttcgttatttgctcttgcaatttccgatatagttctcattaatatgtggtgccatgatattggccgtgagcaagctgccaataaaccacttctaaagacagtatttcaggtcatgatgcgtttgttcagtcctcggaagacaacactactatttgttatacgtgataaaaccaggactccacttgaacatcttgagccagttctaagggaggatattcaaaagatatggaactcggttgccaagccagaggcacacaaagacacccctatcagtgaatttttcaatgtgcaagttactgcattgtcaagtttcgaagaaaaagaggaacagtttagagaacaggttcaacaacttaggcagagattttcaaactcaattgcaccaggaggtcttgcaggtgatagaagaggagtagttcctgcttcaggttttttgtttagttcacaacagatttggaaagttatccgagagaacaaggatcttgatcttcctgctcacaaggtaatggttgctacagttcggtgtgatgaaattgcaaatgagaagtttggctgcataatgtcggacacagaatggctagatttggagagtgctgtccaatctggtccagtacctggttttgggaaaaagcttggctatatcgtggatgttcacttgcaagagtatgacaaagaagctgtctattttgatgaagctgttaggaaaggaaaacgacaacatttggagtccagaataatgaatcttgtccaacctgcattccagaaaatgttgactcatctgcgcatgaaggctctagaaaaatttaaagctggtcttatttcatctttggagaacggaaaaggttttgcggcatctgttcgagacaatactgaatgctccatcaaagaatttgaacaaggctgtgcagatgctgtaatcaagcaggcaaactgggactgctctaaaatactagagaaagtccgccgtgatattgaagaccatgcactttcaattcgtgaaagcaagctatcagaattgacaacccatgctaaggagaaactaagaaaagctcttgctgaacctgtggagtctctttttgatgcagcagaccaaacaacctgggcatcaataagaaacgtttacagacgtgagacggagtccatcctaccagagtttctgaagaccctttgtgggttcgaaatggaatacgcgccagcagaagaaatggtatcaaaattaagggattatgcccggagtgttgtggaaagtaaagctaaagatgaagctagcaaagtattgatccatatgaaggagaggttcacaacagtgtttagccatgacaaggattcaattccaagggtctggtcaggaaaggaagatgtccgggcaatagcaaaggaggctcgatctgcggctctcaaacttctgtctgtaatggtgggcattcgctgggatgacgagccagatgggatcgaaagcatcctcacttcaacacttctggaaggctctgttgtatcaaagattgcaagtgctgcttctgccgatccacttgcttctactacttggaaagagattcctccaaagcagacgatgattactccttctcagtgcaagtcactgtggaagcagtttaaagcagaaactgagtttaccattacacaagcagtatccacacagcaagctcacaggcgcggtaatagtaaactgcctcctccttgggcaattgttgccatcgctattcttggtttcaatgagatcatggtgcttctgaggaatcccatttatctgttcttgctatttgtgggctacttgatattcaaagcattggcggtgcagctagatgtcagcagagaattccaaaatggggtggttcctgggatcatctctgtgtcggcgaagctcctgccgacgatacagaacctggtgaacaaagtggcagcggagcagcaaccggagcaccatcaccctccgcccatagaacccccacagccgcagatgcagccgccgccgctgctcctgagcccaaggagccccatgagcgagctgagaaggatgcacatgccgccgctgagcccgcgcaaggtagcctcgccgtcaccatcctcatcgtcgtcctccgccgtatcgtctcctaggcacgtcgccgaggaccagaagccaaggacggtggtggcagggcacgagaacgagcccaacatcgctgactccatagtatgatactagatggtatgggcatttttgttgtcccccatttctatgcatattgtagtcctgatcagagtaaacatcactcttcagtaagcatcagagagaggagagaaataatgtagctgctttcccttgcgaagttgccattgttttgcaaggagggatgatctgtagatggacaattgctacctgacacattcttgagcatgtatagaagcaaatatagatggcctattcaaaaatggaaaaaaaacctaggatgttttcaatgtacgtggtaaaaaggaccttttgatcca

SEQ ID NO: 4439 - DNA, 3314 bp, Panicum virgatum
cgggatcggaggagatggaggagagagacgcggtgggcggggtggcggtgcagctcatcgacggcgagggcgagttcgcggccgagggggcggagcggttcatggcggccgcgggcgtcgccggatgcgggctctcctacgccgtcgtctccatcatggggccacagagcagcggaaagagcaccttgttgaaccaactatttggaaccaactttagggagatggatgcattcaggggaaggagccagactactaaaggcatctggatagcacgctgtgttggtgttgagccttgtactgttgtgttggatctggagggtactgatggaagagagagaggagaggatgacactgcatttgaaaagcaaagtgcgttatttgctcttgcaatttcagatatagttctaattaacatgtggtgccatgatattggccgcgagcaagctgccaataaaccacttctaaagacagtatttcaggtcatgatgcgtttgttcagtccgcggaagacaacactactatttgttatacgtgataaaaccaggactccacttgaacatctagagccagttctaagggaggatattcaaaagatatggaactcagttccgaagccagaggcacacaaagacacccctattggtgaatttttcaacgtggaagttactgcactgtcaagttttgaagaaaaagaggaacagtttagagagcaggttcaacaacttaggcagagattttcaaattcaattgcaccaggaggtcttgcaggtgatagaagaggagtagttcctgcttcaggttttttgtttagttcacaacagatttggaaagttatcctagagaacaaggatcttgatcttcctgctcacaaggtaatggttgctacagttcggtgtgatgaaattgcaaacgagaagtttggctgcataacctctgacacagaatggctagatttggagagtgctgtccaatctggtccagtacctggttttgggaaaaaacttggctatattgtggacgttcacttgcaagagtatgataaagaagctgtctattttgatgaagccgttaggaaaggaaaacgacaacatttggagtccagaatagtgaatcttgtccaacctgcattccagaaaatgttgactcatctgcgcatgaaggctctagaaaaatttaaaactggtcttatttcatctttggagagtggaaaaagttttgctgcctcggttcgagacaacacagaatgctctctcaaagaatttgaacaaggctgtgcagatgctgtaatcaagcaggcaaactgggactgcaccaaaatactagagaaagttcggcgtgatattgaagatcatgcactttcagttcgtgaaagcaagctatcagaattgacagcccaagctaaggagaaattaagaaaagcacttgctgaacctgtggagtctcttttcgatgccgcagaccaaacaacctgggcatcaataagaaacgtttacaaacgcgagacagaagccatcctaccagagtttctgaaaactctctgtgggtttgaaatggaatatgcaccagcagaagcaatggtatcaaaattaagggattatgcacggagtattgtggaaagtaaagctaaagatgaagccagtaaagtaatgatccatatgaaggagaggttcacaacagtttttagccatgacaaggattccattccaagggtctggacaggaaaggaagatgtccgtgcaatagcaaaggatgctcgatctgcggctctcaaactactgtctgtaatggtgggcattcgttgggatgatgaaccggatagcatcgaaagcatcctcacttcaacacttctggaaggctctgttgtatcaaagattgcaagtgctgcttctgctgatccacttgcttctactacttgggaagagattcccccaaagcagacaattattactccttctcagtgcaagtcactgtggaagcagtttaaagcagaaactgagttcaccattacacaagcagtatccacccagcaagctcacaggcgcggtaatagcagactgcctcctccttgggcaattgttgccatggctgttcttggtttcaatgagatcatgacgcttctaaggaatcctatttatcttttcttgctatttgtgggttacttgatagttaaagcactggcggtgcagctagatgtcaacagagaattccaaaatggggtggttcctgggatcatctctgtgtcgacaaagctcctgccgacgatacagaacctggtgaacaaagtggcagccgagcagcaagcggagcaccagcaccctcagcctcaggccgccgagcccccacagccgcagatgcagccaccgccgctgctcctgagcccgagaagacccatgagcgagctgcggaggctgcacatgccgtcgagcccacgcaaggtaggctcaccgtcgccatcctcatcgtcgtcctccacggtgtcgtctcctaggcacgtcgccgaggaccagaagccaaggccggtggtagcagggcacgagaacgagaacgagtccaacagcgctgactccatagtgtaatccatcaaccatgatggggtttgattgtggtagatatactgtgaaattagaaggttatatgggccttttgctgccccccatttctatgcatatagtcatgatcaatcatagcaaacatcattcttcagtaagtttcagagacaggagagaaataatgtagccgctttccccttgcaattcctttgcaaggagggatgacctgtatgtagatggacagttactacctgacaccattcctaagcatgtataatagaagcatagagagcctactcaaatgttttcaatgtactacttggtagtaagtaaaaaagaccttatgatagttgtcagtaaattttttttacttctaggccctcgagagggaaaaaaaacagttattatcactaggaacggcacttcgaaacactcgacgcgatgcagaggacagggagccagggagggcactgttctctacatggcgttgcctctgcgacgcctgcaaggggccaagacatgccccgtgctcccagcctcccgagacccgttgttttctccccgtctggcacgggggatcagccaccaccatgtctcgcgtacgagagacggggcacatggagagattcggccggcgtgtacaaccccaacgtgtgtcccctgcgccctgccgcagcctcctcacatggccgctgccgtctcgtatggttgtggctagctgtgcccgactgcgagagatcacacacaataaggctttttttaaac

SEQ ID NO: 4440 - DNA, 2090 bp, Panicum virgatum
actccacttgaacatctagagccagttctaagggaggatattcaaaagatatggaactcggttccgaagccagaggcacacaaagatacccctattggtgaatttttcaatgtggaagttactgcactgtccagtttcgaagaaaaagaggaacagtttagagagcaggttcaacaacttaggcagagattttcaaattcaattgcaccaggaggtcttgcaggtgatagaagaggagtagttcctgcttcaggttttttgtttagttcacaacagatttggaaagttatcctagagaacaaggatcttgatcttcctgctcacaaggtaatggttgctacagttcggtgtgatgaaattgcaaatgagaagtttggctgcataacctctgacacagaatggctagatctggagagtgctgtccaatctggtccagtacctggttttgggaaaaaacttggctatattgtggacgttcacttacaagagtatgacaaagaagctgtctattttgatgaagccgttaggaaaggaaaacgacaacatttggagtccagaatagtgaatgttgtccaacctgcattccagaaaatgttgactcatctgcgcatgaaggctctagaaaaatttaaaactggtcttgtttcatctttggagagtggaaaaagttttgcagcctcggttcgagacaacacagaatgctctctcaaagaatttgaacaaggctgtgcagatgctgtaatcaagcaggcaaactgggactgcactaaaatactggagaaagttcggcgtgatattgaagaccatgcactttcagttcgtgaaagcaagctatcagaattgacagcccaagctaaggagaaattaagaaaagcacttgctgaacctgtggggtctcttttcgatgccgccgaccaaacaacctgggcatcaataagaaacgtttacagacgcgagaccgaagccatcctaccagagtttctgaaaactctgtgtgggtttgagatggaatatgcaccagcagaagaaatggtatcaaaattaagggattatgcccggagtgttgtggaaagtaaagctaaagatgaagccagcaaagtaatgatccatatgaaggagaggttcacaacagtgtttagccatgacaaggattcgattccaagggtctggacaggaaaggaagatgtccgtgcaatagcaaaggatgctcgatctgcggctctcaaactactgtctgtaatggtgggcattcgttgggatgacgaaccggatagcatcgaaagcatcctcacttcaacacttctggaaggctctgttgtatcaaagattgcaagtgccgcttctgctgatccacttgcttctactacttgggaagagattcccccaaagcagacaatgattactcctgctcagtgcaagtcactgtggaagcagtttaaagccgaaactgagttcaccattacacaagcagtatccacccagcaagctcacaggcgcggtaatagtagactgcctcctccttgggcaattgttgccatggctgttcttggtttcaatgagatcatgacgcttctgaggaatcctatttatcttttcttgctatttgtgggttacttgatagttaaagctttggcggtgcagctagatgtcaacagagaattccaaaatggggtggttcctgggatcatctctgtgtcgacaaagctcctgccgacgatacaaaacctggtgaacaaagtggcagccgagcagcaagcggagcaccagcaccctcaggctgccgagcccccgcagccgcagatgcagcaaccaccgccacagatgcagccaccgccgctgctcctgagcccgagaagccccatgagcgagcttcggaggctgcacatgccgtcgagcccacgcaaggtaggctcgccgtcgccatcctcattgtcgtcctccgcggtgtcctctcctaggcacgtcgccgaggaccagaagccaaggccggtggtggcagggcacgagaacgagaacgagtccaacagcgctgactccatagtatgatccattgtggggtttgactggtacatatactgtgaaattaggga

SEQ ID NO: 4441 - DNA, 1252 bp, Pseudoroegneria spicata
ccatgacccccggcgggaaaggggaggagcagcaggggcggaggctgttcggcgtgtcgctcacggacaggcccgtctggcagcagttcctcatctgctcctccggcttcttcttcggctacctcgtcaatggcatctgcgaggaatacgtctacaaccggctgcagttcagctatgggtggtacttcacgttcgtgcaggggttcgtgtacctggggctgatcaggctgcaggggttcacgatgaagcagatggtgaacccgtggcggacctacgtgcgcctctccgcggcgctcatgggatccaacggcctcaccaagggctccctcgccttcctcaactaccccgcccagatcatgttcaagtccaccaaggtgttgccggtgatgataatgggggcatttatcccgggattaagacgcaagtacccgttccacgagtacgtatcggcggtgatgctcgtcatcggcctcatacttttcacgctcgcggacgcgcaaacatcgcctaatttcagcatgatcggcgtggccatggtgtccagtgcgctcatcatggatgcctttctcggcaacctgcaggaagccatcttcaagatgaatccagacaccacacagatggagatgctgttctgctctactgttgttggcctgccttttctcgccgtgccgatggtgttaaccggggagcttacgacggcatggagtgcgtgttctgagcacctgtacgtgtacgccgtgctggtgttcgaggcgatggcgacgttcgtcgggcaggtgtccgtgctgtccctcattgcgctcttcggcgccgccacgacggccatggtgacgacggcgaggaaggcggtgaccctgctcctgtcgtacctgatattcaccaagcccatgacggagcagcacgtcacggggctcctgctcatcaccatggggatcgtgctgaggctcctgccggaggacaaggagaagaagggcacggccgagcgccagcaggcgaaggcgcagcgcggcgaggagaagcggcggggagacggagtagaggaggagacatcgccgttggtatgatctgtgacttggatgagctgaacgaataacaaatcagagtgcaggttaccagctctgcttttgtgaacctttgtccagtttgtgttgtttgatgtcgtggaactgttttggggattgtaacttgtaagttaaagggacaaatcagagtgcaggatggcgatgatcagagatggatttgatgttgttga

SEQ ID NO: 4442 - DNA, 1369 bp, Hordeum vulgare
gcgggagtgaaaaaaggagggcggggaagctgcgcagagactcttcctctcacttcttagtccacacgccagtcagtcgccaatacaaggaagcgttttaaggccgctgagacgactcgtagctattaagccagtgggcgttccgtttcgttctcttccccccctctccggccgacgacacatccctctcccctcggcggccattaattggacgggagattaattccctcctccctccgccggcgatcttgagagagataagtgctgtgtgtttgcgtcgggagagagcgggagaggtgggcagggagccatgaccaccggcggggaggagcagcaggggaggaggctgttcggcgtgtcgctcacggacaggcccgtctggcagcagttcctcatctgctcctccggcttcttcttcggctacctcgtcaatggcatctgcgaggaatacgtctacaaccggctccagttcagctatgggtggtacttcacgttcgtgcaggggttcgtgtatctggggctgatccgactgcaggggttcacgacgaagcagatggtgaacccatggcggacctacgtgcgcctctcggccgtgctcatgggctccaacggcctcaccaagggctcccttgccttcctcaactaccccgcccagatcatgttcaaatccaccaaggtgttgccggtgatgataatgggggcatttatcccaggattaagacgcaagtacccgttccacgagtacgtatcggcggtgatgcttgtcattggcctcatactattcacgctcgcagacgcgcaaacatcgcctaatttcagcatgattggcgtggccatggtgtccagtgcactcatcatggatgccttcctcggcaacctgcaggaagccatcttcaagatgaacccagacaccacacagatggagatgctgttctgctcaactgttgttggcctgccttttctcgctgtgccgatggtgttaaccggggagcttacgaccgcatggagtgcgtgttctcagcacctgtacgtgtacgctgtgctggtgttcgaggcgatggcgacattcgtcgggcaggtgtcggtgctgtcgctcattgcgctcttcggtgccgcaacgacggccatggtgacaacagcaagaaaggcggtgaccctgctcctgtcgtacctgatattcaccaagcccatgacggagcagcacgtcacagggctcctgctcatcaccatggggatcgtgctaaggctcctgccggaggacaaggagaagaagggcaccgccgagcgccagcagcgcggcgaggagaagcggcggggagacggagtagaggaggagaaatcgccgttggtatgatcggggacctgaatg

SEQ ID NO: 4443 - DNA, 1636 bp, Hordeum vulgare
gtggcgggagtgaaaaaaggagggcggggaagctgcgcagagactcttcctctcacttcttagtccacacgccagtcagtcgccaatacaaggaagcgttttaaggccgctgagacgactcgtagctattaagcagtgggcgttccgtttcgttctcttccccccctctccggccgacgacacatccctctcccctcggcggccattaattggacgggagattaattccctcctccctccgccggcgatcttgagagagataagtgctgtgtgtttgcgtcgggagagagagggagaggtaggcaggtagccatgaccaccggcggggaggagcagcaggggaggaggctgttcggcgtgtcgctcacggacaggcccgtctggcagcagttcctcatctgctcctccggcttcttcttcggctacctcgtcaatggcatctgcgaggaatacgtctacaaccggctccagttcagctatgggtggtacttcacgttcgtgcaggggttcgtgtacctggggctgatccggctgcaggggttcacgacgaagcagatggtgaacccatggcggacctacgtgcgcctctcggccgtgctcatgggctccaacggcctcaccaagggctcccttgccttcctcaactaccccgcccagatcatgttcaaatccaccaaggtgctgccggtgatgataatgggggcatttatcccaggattaagacgcaagtacccgttccacgagtacgtatcggcggtgatgcttgtcattggcctcatactattcacgctcgcagacgcgcaaacatcgcctaatttcagcatgattggcgtggccatggtgtccagtgcactcatcatggatgccttcctcggcaacctgcaggaagccatcttcaagatgaacccagacaccacacagatggagatgctgttctgctcaactgttgttggcctgccttttctcgctgtgccgatggtattaactggggagcttacgaccgcatggagtgcgtgttctcagcacctgtacgtgtacgctgtgctggtgttcgaggcgatggcgacattcgtcgggcaggtgtcggtgctgtcgctcattgcgctcttcggtgccgcaacgacggccatggtgacaacagcaagaaaggcggtgaccctgctcctgtcgtacctgatattcaccaagcccatgacggagcagcacgtcacagggctcctgctcatcaccatggggatcgtgctaaggctcctgccggaggacaaggagaagaagggcaccgccgagcgccagcagcgcggcgaggagaagcggcggggagacggagtagaggaggagaaatcgccgttggtatgatcggggacctgaatgagctaaacgaataacaagccagagtgcaggataccagctctgcttttgtgaacctctgtctagtttgtattgtttgatattgtggaactgttttcgggattgtagctcctaagttaaagtgttccaaaggatggcaatgatagagatggattagatgttgttgatcttttccccttaggtctccgtgacaatatatcatggacaactaagataactcatcaagtggaaaatcatataaagttcgtcaaagttatcttctccagac

SEQ ID NO: 4444 - DNA, 1406 bp, Lolium multiflorum
tagttctggggaggagatttcgcaagttggtttctgtctcgtcgtcggagtttcgggcggagccatgactggcggcggggaggagcaggggaggcggctcttcggcgtctcgctcacggacaggcccgtctggcagcagttcctcatctgctcctccgggttcttcttcggctacctcgtcaatggcatctgcgaggaatacgtctacaaccggcttcagttcagctacggatggtacttcacgttcgtgcaggggttcgtgtacctgggcctcatacggctgcaggggttcacgatgaagcagatggtgaacccgtggcggacctacgtgcgcctctctgccgtgctcatgggctccaacggcctcaccaagggctccctcgccttcctcaattacccagcacagatcatgttcaaatccaccaaggttctgccggtgatgataatgggggcattcatccctggtttaagacgcaagtacccattccacgagtacgtatcggcagtgatgctcgtcatcggcctcatacttttcacgctcgcggacgcacaaacatcgcctaatttcagcatgattggtgtgaccatggtgtccgctgcgctcgtcatggatgccttccttggcaacctgcaggaagccatctttaagatgaacccagacaccacgcagatggagatgctgttctgctcaactgttgttgggctaccattccttgccgtgccaatggtgttaaccggggagctcacaacggcatggagtgcgtgttctcagcacttgtacgtgtacgcagtgctggtgttcgaggcgatggcaacgttcgtcgggcaggtgtcggtgctgtccctaattgcgctctttggcgccgcgacgacagccatggtgacgacggcgaggaaggcggtgaccctgctgctgtcgtacctgatattcacgaagcccatgacggagcagcacgtctcagggctcctactgataaccatgggaatcgtgctgaggctcctgccagaggacaaggagaagaagaacctggccgagcgcaagcaggcaaagatggtggcgcagctcggtgaggacaagcggcgaggagatggagtagaggaggagaaatcgccgttagtatgatccatgacttgaacgagctgaaccaaagtgcaggatgggatacaagaataatcacgtctgtttttgttgaactctctgtagtgtgttgttctctctctgtagtgtgctgtttgctgtgctgaagctgttttcgggactgtaacttgtaaaccaaaagggttccaaagtattaaagtgcccatagtcgtagatgtattagccgttcttgctgcattttttccttgctctcccaatcgaattcaccagacttaaaaagcatacacatcggtgacatactgcaacg

SEQ ID NO: 4445 - DNA, 1391 bp, Secale cereale
gtcgagggacgagagagagagagagagagagggggagaggagagggagaggcagggagaaggacggccatgaccaccggcgggaacgggaggagcagcaggggcggaggctgttcggcgtgtcgctcacggacaggcccgtctggcagcagttcctcatctgctcctccggcttcttcttcggctacctcgtcaatggcatctgtgaggaatacgtctacaaccggctccagttcagctacgggtggtacttcacgttcgtgcaggggttcgtgtacctggggctgatccggctgcaggggttcaccacgaagcagatggtgaacccatggcggacctacgtgcggctctccgccgtgctcatgggatccaacggcctcaccaagggctccctcgccttcctcaactaccccgcacagatcatgttcaaatccaccaaggtgttgccggtgatgataatgggggcatttatcccgggattaagacgcaagtacccgttccatgaatacgtatcggcggtgatgctcgtcatcggcctcatacttttcacgctcgcagacgcgcaaacgtcgcctaatttcagcatgatcggcgtggccatggtgtccagtgcgctcatcatggatgccttcctcggcaacctgcaggaagccatcttcaagatgaaccctgacaccacacagatggagatgctgttctgctcaactgttgttggcctgcctttcctcgctgtgccaatggtgttaacaggggagcttacgacggcgtggagtgcgtgttctcagcacttgtacgtgtatgccgtgttggttttcgaggcgatggcgacgttcgtcgggcaggtgtcggtgctgtccctcatcgcgctcttcggcgccgccacgacggccatggtgacgacggcgaggaaggcggtgaccctgctcctgtcatacctgatattcaccaagcccatgacggagcagcacgtcacggggctcctgctgatcaccatggggatcgtgctgaggctcctgccagaggacaaggagaagaagggcacggccgagcgcctgcaggcaaaggcgcagcgcggcgaggagaagcggcggggagacggggtagaggaggagacatcgccgttggtatgatcggggacttggatgagctgaacgaataacaaatcagagtgcaggatttggccaactctgcttttgtgaacctttgtccagtttgatgtcgtggaactgttttggggattgtaacttgtaagttaaagggacaaatcagagtgcaggatggcgatgatcagagatggattagatgttgttaatcctttcccttgggtctccgtgacagtatatcatatggacaactgagattattatctattaagtggaaaatcacatctga

SEQ ID NO: 4446 - DNA, 1444 bp, Setaria italica
gctgacttgctgagagtgaggaggaggactcctacgtagaggccggcttcgttcgtcgtcctcataccgtaactaccagccctccaacccggcggggcggccattgactggatccttccttcattctcggggtgcgccgagactctcgagttgagagagagagagagagggaaggagaacagaggaggcgccatgaccggagcggaggagcaggggaggacgctcttcggcgtgtcgctgacggaccggcccaggtggcagcagttcttgatctgcgcatccggcttcttcttcggctacctcgtcaatggcgtctgcgaggaatacgtgtacaacaggcttcagttcagctacggctggtacttcacgttcgttcaggggttcgtgtacctggcgctgatacgcctgcagggattcacgatgaagcagatggtgaacccctggcggacgtacgtgcgcctctcggccgtgctcatgggctccaatggcctcaccaagggctccctcgccttcctcaattaccctgcacagatcatgttcaagtcaactaaggttctaccagtgatgataatgggggcttttatccctggcttgagacgcaaatacccattccaagagtatgtatcagccgtgatgcttgtcattggcctcatactcttcacgctcgcggatgcgcaaacatcgcctaattttagcatggctggcgtggccatggtgtctggggcgctcgtcatggatgccttccttggcaacctgcaagaagcaatcttcaagatgaatccagacacgacccagatggagatgctattctgctccactgttgttggcctcccattcctagcggtgccaatggtgttaactggggagctcatgacggcatggacttcatgttcccagcacctgtacgtgtacgcggtgctggtgttcgaggcgatggccacgttcgtcggtcaggtctccgtgctctccctcatcgcgcttttcggtgccgcgaccaccgccatggtgacgacggcgaggaaggcggtgacgctgctgctgtcgtacctgatcttcaccaagcctctgacggagcagcacgtcacggggctcctcctgataaccatggcgatcgtgctcaagctcctgccggagaacaaggaaggtggtccgctccggcgggcggcgaaggtggaactctctgacgatgacggcaagccgcgggggagaagagaattagaggagaaaacaaacttggtgtagtgcgacagtgaccccaagcagaactaaggccagctcgatgagcaacaatcccaaaaggaagacagtcctaagaaggatagaatacaggcaggatagcaggaatcgatagtctctttctccctcacgcttctactgttcactgtggtgaaattgttttgtcgacgtgtgtaactaccggacaaggaatgcaaatggaaaacca

SEQ ID NO: 4447 - DNA, 2094 bp, Panicum virgatum
ccaggactccactgccgattccttccttgttcctcgccctcgcaccgtaactactagcccgcgcacccggccgccattgaccggatccttgtttcgttctccttggacttggaggggtgcggcgcctcgccatgaccggaggggaggagcaggggagggcgctcttcggcttgtcactcacggaccgccccaggtggcagcagttcttcatctgcgcctcgggcttcttcttcggctacctcgtcaatggcgtctgcgaggaatacgtctacaacaggcttcagttcagctatgggtggtacttcacgttcgtgcaggggttcgtgtacctggccctcatacgcctgcagggcttcacgatgaagcagatggtgaacccctggcggacgtacgtgcgcctctcggccgtgctcatgggctcccatggcctcaccaagggctccctcgcattcctcaattaccctgcacagatcatgttcaagtcaaccaaggttctaccagtgatgatcatgggggcctttatccccggcttgagacgcaaatacccattccaagagtacgtatcagccgtgatgcttgtcatcggcctcatactcttcacgctcgcggatgcgcaggcatcgcctaattttagcatggttggcgtggccatggtgtctggggcgcttgtcatggatgccttccttggcaatctgcaagaagcaatcttcaagatgaatccggacacgacccagatggagatgcttttctgctccactgttgttggccttccattcctagccctgccaatggtgttaactggggagctcatgacggcatggacttcatgttcccagcacctgtacgtgtacgcggtgctggtgttcgaggcgatggccacgttcgtcggccaagtctccgtcctctccctcatcgcacttttcggagccgcaaccaccgccatggtgacgacggcgaggaaggcggtgacgctgctgctgtcctacctgatcttcaccaagcccctgacggagcagcacgtcacggggctcctcctgataaccatgggtatcgtgctcaagctcgtgccggagaacaaagaaggcggtctgcgccggcaggcgaagaaggtggagcgctcttacgacgacgacgacaagaagcgggtgatcagagaattggaggaggaggaagaaacagccttggtatagtacgagtgccatactgacccaagcaaaacaaggccggctcgttgaacaacaatgccaaaagaaaaccagccctaagaatgatataggatacaaaaaaggataacagtaatcgacagtctctttctccctctcgcttttctcgcatatgtgcaaatgcagactacttctttcattcgccctaaaaattcagcttattttgtacggataagactgaacagacgcgatttctcgtattgcgcatgtaactgccactatgtaacatcatcgctgagcatgttgtataattgatgcaatggctggaatcttccatcttcttggccagctctgaacttgaataggggagaccattctatcagaagactcctattttcctacataatatcaagggtttctctcgatctactcagtaactcagatccgttgtatgacagtaggaacaaacaaagagatgcagatttctattgatatcagtccattaaaatttgagctcatccgatctggtcgccagacttgtgagcctcgctgcagaacacctcctctgcttcggcgcttcgcccatggcctgcttgcgtcgcccggcggagagcccccgagttccggcagtcgcagaccacgcgcaccgcgaacgcaaggaatgaaccagccacgagaggaagcgcatatgctcgctgtctagctcggggcatcggccatggcatcacgaagctcgccgttcagcagaggctgcgtaggagcccgggcgggaacgcgcggagtctatggcatggcatggcggcgctcttcctgtctgccgcgcggcttctcgcctcgccacaaccctgaacccatcgtccctggcttcctgccccgacggagtgcctgcagcgatgcggcaaggatatcggcgagccgtcgtgccatgccg

SEQ ID NO: 4448 - DNA, 1503 bp, Cocos nucifera
agagagagaataagggagaaaggtggttggcatctggtacgagtttcttctttcctcctttgaggtttagaattttgaaatgaatagatatcggggggatccttttcttctcctgtggagaaatcctttttctctttggtgtttgttgttttagtgttttgaatccttagcttcttgttggttttgttgggaatagaggaagggtagaaggagaaatgaaaggagaggagcaggggagggctctgtttgggatatcactgacagaaaggccaaagtggcagcagttccttatatgctcctctgggttcttctttggctacttggtcaatggcatttgtgaggaatatgtctacaatcgtttgcaattcagctatggttggtactttacctttgtgcaggggtttgtctatttggcactcatacgcctgcagggctttaccatgaagcagatggtgaacccatggaggacctatgtcaagctgtcggcggttctcatgggatcgcatggcctcacaaaggggtcccttgccttcttgaactacccggctcagcttatgttcaaatctactaaggtgctaccggttatgataatgggggccttcattcctggtcttcggcgtaaatatccggtgcatgaatacatttctgcagtgcttcttgttgtgggactgatcctcttcaccctggccgatgcccaaacatcacccaactttagtgttatcggtgtcgtgatggtatctggtgctcttgttatggactcatttcttggtaatctccaggaggttatctttaccatgaatcctggaaccactcagatggaaatgctcttctgctctacagttgttggcctacctttcttgatcccacccatggttttaactggggagctattcaaagcctggaattcttgctaccagcatctatatgtctatgccgtgctggtgttcgaagcgatggccacctttgtcggtcagatctctgtgctctccctaattgcaatttttggggcagcgactactgcaatggtaactacagcgaggaaggcagcgacgctactgctatcttatctaattttcacaaagccattgacggagcagcacggcactgggcttatactgatctccatgggaatcctcttgaaacttcttccagaaaacaaagaccctattcctcgtaaattcgagcagcagcagcagcaaggatctcgagagcgagaagaagaaaagaggcccttggtttgaagaagtatagaaatatttgctttaggagtgtaatttccatggatggttgttttattgtttattgttttatttgggggggggggggggggggggggggggggggtattgttttattttttcaccccatccttccatatgtcttttgagcatccatcaatctttacaaccaactaacaaatgagcaaaatttgcgtttgtaccgcagcactggaacctgcttctgatatagtatcgatgcttaacccatttcaacttgttgcaa

SEQ ID NO: 4449 - DNA, 1667 bp, Secale cereale
gactcaacagcatcacacgcccctggacccgtccgcctcacgatctttctcaccccacccttccctccccccccctccctccccgcgtcgtacataaagcagccgtcgcgtcgaggctcgagaggctttcctcagtaccagcagtattccattccattctccgtcctcagatcagcgcggcggagaatcaaatcaatctaggtttggcgagagccgagccgaggggagggaggaggatggtgaaggccatggcggggtgcccggcgaagatgggcttccggatgcccgccgagtgggagccgcacgagcagtgctggatgggctggccggagcgtccagacaactggcgggagcacgctgagccagctcgaaaaacatttgagagaactgcaattgccatttcaaagtttgagcctgtcaccatttgtgcaagtgccaaacagtatcctcgtgttcacgagctgatggaacaccaaccgaacatcagggtggtcgagatgagcatgaatgattcctggtttcgtgacaccggtcccacttttattacccgtgaaggcggatcagatacaggacttgcagagcaaacaatagcggggattgactgggaatttaacgcatggggaggactcggcggtggttgctttgatgattggagtcttgacagaagcattgccaagaagatagtcgagattgagaggatccctaggttcgcacacacaatggttcttgagggtggaagcattcatgtagatggagaaggtacatgcattacaacagaagaatgcttgttgaatcctaacaggaaccctcacatgactaaactagagatagagaatgagctgaaggattttcttggggtcacgaagatcatttggatacctctgggactacacggtgatgaagacacaaatggccatgtggacaatctatgctgtttcatcaaacccggcgtgattctcttgtcatggaccgatgacgagaacgacccgcagtacgaggtatcggtgaaggcactatcagctctcactcaggcggtcgatgcgaaggggcggcagatagaggtggtgaagatccacgtgccagggcctctgtacatcacgaaggaagagggggaaggtgttcttgcaacggggcatgctgtaccgagggtaccaggcaagaggttggccgcctcgtatgtgaacttctacccggcgaacggcgggatcatagcgccggccttcggcgataagaagagggacgaggaagcgcgccaggttctccagaaggcatttcctgatcatgaggttgtgatggtggaaggcgcgagggagatcgtgctgggaggtgggaacatacactgcatcacgcagcagcagccggtgcgcccgtcgtagatgaacgacggtgaggaaaggcggccaagccctgcattggggtgaatggttcaatcatattggttacgcccgcaccggcagcatgttggttgcgctttgaaaccgcgggcgcgggccaatagatatatcttggagaatattgaataatgttgtaggagtgttcaggctgtgacttccgcattcacatccctggagtttattctgttttccttccctattgcctttcgtctctaaaccctgctattatcttggaaaaaaaagataaaatgatgaaaaacaactggatgattt

SEQ ID NO: 4450 - DNA, 1440 bp, Brachypodium distachyon
gacgctgcacctccaccgtctgattagctcaggggacgggattggagttaattaggtttagcgacagtgaagaagcggagcggagaggatggtgaagaccatggcggggtgccccgcgaagatggggttccggatgccggcggagtgggagccgcacgagcagtgctggatgggctggcccgagcgtcctgacaattggcgggagaatgccggtccagctcgaaaaacatttgcgagaaccgcaattgccatttcaaagtttgagcccgtcaccatttgtgcaagtgccgaacagtatccttatgtccacaagctaatgcaacatcagccgaacatcagggtggttgagatgagcatgaatgattcctggtttcgtgatactggtcccacttttattacacgtaaaggcggatcagatataggactcacagatcaaacaatagcaggaattgattgggaatttaatgcctggggaggagttggtggtggttgctacgatgattggagtcttgacagaaacattgccaagaaaataattgatatggagaggatccctaggtttccacacagaatggttctcgagggtggaagcattcatgtagatggagaaggtacatgcattacgaccgaagaatgcttgttgaatcctaacagaaatcccaacatgaccaaactagagatagagaatgagctcaaggattttcttggagtcacaaagatcatttggatacctcggggactttatggtgatgaggatacaaatggacatgttgacaatttatgctgtttcattaaacctggtgttatcctcttgtcatggacggatgacgagaacgacccacagtatgaacggtcggttgaggcactagcaactctctctcaagctgtcgatgcaaaagggcggcacatagaagtggtaaaaatcaacataccaaggcctctatacatcacaaaggaagagggggatggtgttgacgcaacggggcatgctgtaccaagggtacctggtgacagattggctgcctcatacgtgaacttctacgcagcgaacggtggaatcatagcaccagctttcggtgacaagcagcgggatgacgaagcgcgtgaggttctccagaaagcatttcctgaccatgagattgtgatggtcgaaggcgcaagagagatcgtgttgggaggagggaacatacactgcatcacgcagcagcagcccgtgcgcccgtcgtagatgaactgcgtggagaaacgaccatgctcggcactgtggtcatgattcaatcacttattgttgctccccaggcgttgatagattgcccaagtgcaatattggtgaattgtatacatatcaaacgcccgcagcatcttgcacattgaaattgcttcgcaggcaaattgatatatcgtaagatcgatattgaatggagtaatacgtagtagagt

SEQ ID NO: 4451 - DNA, 1520 bp, Avena sativa
tctgaagcagggggcgcctagagtgtaggctgtaggcctgtagaggtgtttgactccaccgtcagattaatccaggtttagcgagagaagaggggaggatggtgaaggccatggcggggtgcccggcgaagatggggttccggatgccggcggagtgggagccgcacgagcagtgctggatgggctggcccgagcgtccagacaactggcgggagaatgctggtccagctcgagtaacatttgcaagaactgcaattgccatatcaaagtttgagcctgtcaccatttgtgcaagtgccgaacagtatcctcatgtccacgagctgatgcaacaccagccgaacatcagggtggtcgagatgagcatgaatgattcctggtttcgtgatactggtcccacttttgttatccgtaaaggtggttcagacataggactcgcagagcaaacaatagcgggaattgattgggaatttaacgcctggggaggagtcgatgatggctgctatgatgactggagtcttgacaaaaatgttgccaagaaaattgtcgagatagagaggatccctaggtttccacacacaatggttcttgagggtggaagcattcatgtagacggagaaggtacatgcattacaacggaagaatgcttgttgaatcctaaccgaaaccccaacatgactagagaagatatagagaatgagctgaaggattttcttggagtgacaaagatcatttggatacctcagggactttatggtgacgaggatacaaatgggcatgttgacaacctatgctgtttcgttaaacccggtgtgattctcttgtcatggaccgacgatgagaacgacccacagtacgagatatctgttaaggcactgtcagttctcactcaggccacggatgcagaagggcggcagatagaggtgataaagatccatgtaccagggcccctttacatcacaaaggaagagggggaaggtgttgatgcaacggggcatgctgtaccgagggaacgaggcaagagattggctgcctcgtacgtgaacttctacctggccaatggtgggatcatagcacccgctttcggcgataagcaacgggacgacgaggcgcgcgaggtcctccagaaggcattccctgattatgaggttgtgatggtggaaggcgcaagagagatcgtgctgggaggtgggaacatacactgcatcacgcagcagcagccggcgcacccgtcttagatcaacggcaagaaacgtaccatgatctacaccgcggtgatgatccaatcatatatttgttgctccccgatgttgatagattgcgtgtggcgaggtctagagaaagaatgcatcccgactgagtaggcagtactcataattgtatctgtatcaatccgcccacagcatctttcattgctactttgaaatcgggtcgcgaggcagtagatatatcatcagagaataatccgattgtatctggctgtcttgtttgttctgtccactcccatctccattcttatt

SEQ ID NO: 4452 - DNA, 1368 bp, Avena sativa
agttcccacatcaagcagccgtcgagttgaggctaggctaggctctcactcatcattatagcagagtgtcccgccgtcagattaatccaggcttagcgagagaagaggggaggatggtgaaggccatggcggggtgcccggcgaagatggggttccggatgccggcggagtgggagccgcacgagcagtgctggatgggctggcccgagcgtccagacaactggcgggagaatgctggtccagctcgaataacatttgcgagaactgcaattgccatatcaaagtttgagccagtcaccatttgtgcaagtgccgaacagtatcctcatgtccacgagctgatgcaacaccagccaaacatcagggtggtcgagatgagcatgaatgattcctggtttcgtgatactggtcccacttttgttatccgtaaaggtggttcagacataggactcgcagagcaaacaatagcgggaattgattgggaatttaacgcctggggaggagtcgatgatggctgctatgatgactggagtcttgacaaaaacgttgccaagaaaattgtcgagatagagaggatccctaggtttccacacacaatggttcttgagggtggaagcattcatgtagacggagaaggtacatgcattacaacggaagaatgcttgttgaatcctaaccgaaaccccaacatgactagagaagatatagagaatgagctgaaggattttcttggagtgacaaagatcatctggatacctcagggactttatggcgacgaggatacaaatgggcatgttgacaacctatgctgtttcgttaaacccggtgtgattctcttgtcatggaccgacgatgagaacgacccacagtatgagatatcggttaaggcactgtcagttctcactcaggccacggatgcagaagggcggcagatagaggtgataaagatccatgtaccagggcctctttacatcacaaaggaagagggggaaggtgttgatgcaacggggcatgctgtaccgagggaacgaggcaagagattggctgcctcgtacgtgaacttctacctggccaatggtgggatcatagcacccgctttcggcgataagcaacgggacgacgaggcgcgcgaggtactccagaaggcattccctgattatgaggttgtgatggtcggaggcgcaagagagatcgtgctgggaggtgggaacatacactgcatcacgcagcaacagccggcgcggccatcttagatcaacagcaagaaaggcgtaccatgatctacactgcggtgatgatctaatcatatattgttgctcctcgatgttgatagattgcgtgtggcgaggtctagagaaagaaatgcat

SEQ ID NO: 4453 - DNA, 1457 bp, Avena sativa
cgggactctcatcccatcactgaagtctgaagcaggggccgcctaggctgtttgactctaccgtcagattaatcaggtctagggagagaggaggagaggatggtgaagcccatggcgggatgtcccgcgaagatggggttccggatgccggcggagtgggagccgcacgagcagtgctggatgggctggcccgagcgtccagacaactggcgggagaatgctggtccagctcgagtaacatttgcgagaactgcaattgccatatcaaagtttgagcctgtcgccatttgtgcaagtgccgaacagtatcctcatgtccacgagctgatgcaacaccagccaaacatcagggtggtcgagatgagcatgaatgattcctggtttcgtgatactggtcccacttttgttatccgtaaaggtggttcagacataggactcgcagagcaaacaatagcgggaattgattgggaatttaacgcctggggaggagtcgatgatggctgctatgatgactggagtcttgacaaaaatgttgccaagaaaattgtcgagatagagaggatccctaggtttccacacacaatggttcttgagggtggaagcattcatgtagacggagaaggtacatgcattacaacggaagaatgcttgttgaatcctaaccgaaaccccaacatgactagagaagatatagagaatgagctgaaggattttcttggagtgacaaagatcatttggatacctcagggactttatggtgacgaggatacaaatgggcatgttgacaacctatgctgtttcgttaaacccggtgtgattctcttgtcatggaccgacgatgagaacgacccacagtacgagatatcggttaaggcactgtcagttctcactcaggccacggatgcagaagggcggcagatagaggtgataaagatccatgtaccagggcctctttacatcacaaaggaagagggggaaggtgttgatgcaacggggcatgctgtaccgagggaacgaggcaagagattggctgcctcgtacgtgaacttctacctggccaatggtgggatcatagcacccgctttcggcgataagcaacgggacgacgatgcgcgcgaggtcctccagaaggcattccctgattatgaggttgtgatggtcgaaggcgcaagagagatcgtgctgggaggtgggaacatacactgcatcacgcagcagcagccggcgcgcccgtcttagatcaatggcaagaaaggcgtaccatgatctacaccgcggtgatgatccaatcatatattgttgctccccaatgtcgatagattgcgtgtggcgaggtctagagaaagaaatgcatcccgactgagcaggcagtactcataattgtatgtgtatcaaacgcccacagcatctttcatcagagaataatccgattgcacctgctgctgtttgttctgtcg

SEQ ID NO: 4454 - DNA, 1313 bp, Avena sativa
gtgaaggccatggcggggtgcccggcgaagatggggttccggatgccggcagagtgggagccgcacgagcagtgctggatgggctggcccgagcgtccagacaactggcgggagaatgctggtccagctcgaataacatttgcgagaactgcaattgccatagcaaagtttgagcccgtcaccatttgtgcaagtgccgaacagtatcctcatgtccatgagctgatgcaacaccagccgaacattagggtggtcgagatgagcatgaatgattcctggttccgtgatactggtcccacttttgttatccgtaaaggtggttcagacataggactcgcagagcaaacgatagcgggaattgattgggaatttaacgcctggggaggagtagatgatggctgctatgatgactggagtcttgacaaaaatgttgccaagaaaattgtcgagatagagaggatccctaggtttccacacacaatggttcttgagggtggaagcattcatgtagacggagaaggtacatgcattacaacggaagaatgcttgttgaatcctaaccgaaaccccaacatgactagagaagatatagagaatgagctaaaggattttcttggagtcacaaagatcatttggatacctcagggactttatggtgacgaggatacaaatgggcatgttgacaacctatgctgtttcgttaaacccggtgtgattctcttgtcatggaccgacgatgagaacgacccacagtacgagatatcggttaaggcactgtcagttctcactcaggccacggatgcagaagggcggcagatagaggtgataaagatccatgtaccagggcctctttacatcacaaaggaagagggggaaggtgttgatgcaacggggcatgctgtaccgagggaacgaggcaagagattggctgcctcgtacgtgaacttctacctggccaatggtgggatcatagcacccgctttcggcgataagcaacgggacgacgatgcgcgcgaggtcctccagaaggcattccctgattatgaggttgtgatggtcgaaggcgcaagagagatcgtgctgggaggtggaaacatacactgcatcacgcagcagcagccggcgcgcccgtcttagatcaatggcaagaaaggcgtaccatgatctacaccgcggtgatgatccaatcatatattgttgctccccaatgttgatagatcgcgtgtggcgaggtgtagagaaagaaatgcatcccgactgagtaggcagtactcataattgtatgtgtatcaaacgcccacagcatctttcat

SEQ ID NO: 4455 - DNA, 1504 bp, Avena sativa
gcagccgccctgctttttcccttcccgaataaagtagccgtcgtcgagtcgaggctctcgcctcatcagtatagcaggggtgcgtaggagcgtcccgccgtcagattaatccaggtttatcgagagaggaggggaggatggtgaaggccatggcggggtgcccggcgaagatggggttccggatgccggcggagtgggagccgcacgagcagtgctggatgggctggcccgagcgtccagacaactggcgggagaatgctggtccagctcgagtaacatttgcgagaactgcaattgccatatcaaagtttgagcccgtcaccatttgtgcaagtgccgaacagtaccctcatgtccacgagctgatgcaacaccagccaaacatcagggtggtcgagatgagcatgaacgattcctggtttcgtgatactggtcccacttttatcatccgtaaaggaggatcagaaacaggacccacagagcaaacaacagcgggaattgattgggaatttaacgcctggggaggagtcgatgatggttgctatgatgattggagtcttgacaagaatgttgccaagaaaattgtcgagatagagaggatccctaggtttccacacacaatggttcttgagggtggaagcattcatgtagacggagagggtacatgcattacaacggaagaatgcttgttgaatcctaaccgaaaccccaacatgactagagaagatatagagaatgagctgaaggattttcttggagtgacaaagatcatttggatacctcagggactttatggtgacgaggatacaaatgggcatgttgacaacctatgctgtttcgttaaacccggtgtgattctcttgtcatggaccgacgatgagaacgacccacagtacgagatatctgttaaggcactgtcagttctcactcaggccacggatgcagaagggcggcagatagaggtgataaagatccacgtaccagggcctctttacatcacaaaggaagagggggaaggtgttgatgcaactgggcatgctgtaccgagggaacgaggcaagagattggctgcctcgtacgtgaacttctacctggccaatggtgggatcatagcacccgctttcggcgataagcaacgggacgatgaggcgcgcgaggtcctccagaaggcattccctgattatgaggttgtgatggtcgaaggcgcaagagagatcgtgctgggaggtgggaacatacactgcatcacgcagcagcagccggcgcgcccgtcttagatcaacagcaagaaaggcgtaccatgatctacaccgcggtgatgatctaatcatatattgttgctccccaatgtcgatagattgggtgtgtggcgaggtctagagaaagaaatgcatgtactcataattgtattgtgtatcaaacgcccacagcatctttcattgcactttgaaattgcgtcgcgaggcagtagatatatcatcagagaataatccgattgtatttg

SEQ ID NO: 4456 - DNA, 1423 bp, Avena sativa
ggggcgcctagactgtaggctgtaggcctgtagaggtgtttgactccaccgtcagattaatccaggtttatcgagagaggacgagaggatggtgaagcccatggcgggatgtcccgcgaagatggggttccggatgccggcggagtgggagccgcacgagcagtgctggatgggctggcccgagcgtccagacaactggcgggagaatgctggtccagctcgaataatatttgcgagaactgcaattgccatatcaaagtttgagccagtcaccatctgtgcaagtgccgaacagtatcctcatgtccacgagctgatgcaacaccagccaaacatcagggtggtcgagatgagcatgaatgattcctggtttcgtgatactggtcccacttttatcatccgtaaaggcggatcagaagcaggacccacggagcaaacaatagcaggaatcgattgggaatttaacgcctggggaggagtcgatgaaggttgctatgatgattggagtcttgacagagatgttgccaagaaaatagtcgagattgagaggatccctaggtttccacacacaatggttcttgagggtggaagcattcatgtagatggagaaggtacatgcattacaacggaagaatgcttgttaaatcccaatagaaaccctgacatgactaagcaagatatagagaatgagctgaaggattttcttgggagtcacaaagatcatttggatacctcagggactttatggtgacgaggatacaaatgggcatgttgacaacctatgctgtttcgttaaacccggtgtgattctcttgtcatggaccgacgatgagaatgaccgacagtacgagatatcggttaaggcactgtcagttctcactcaggccacggatgcaaaagggcggcagattgaggtgataaagatccatgtaccagggcctctttacatcacaaaggaagagggggaaggtgttgatgcaacggggcatgctgtaccgagggaacgaggcaagagattggctgcctcgtacgtgaacttctatctggccaatcgtgggatcatagcacccgctttcggcgataagcaacgggacgacgatgcgcgcgaggtcctccagaaggcattccctgattatgaggttgtgatggtcgaaggcgcaagagagatcgtgctgggaggtgggaacatacactgcatcacgcagcagcagccggcgcgcccgtcttagatcaatggcaagaaaggcgtaccatgatctacaccgcggtgatgatccaatcatatattgttgctccccaatgttgatagatcgcgtgtggcgaggtgtagagaaagaaatgcatcccgactgagtaggcagtactcataattgtatctgtatcaaacgcccacagcatctttcattgcactttgaaattgcgt

SEQ ID NO: 4457 - DNA, 1483 bp, Avena sativa
gggactctcatcccatcactgaagtctgaagcaggggccgcctaggctgtttgactctaccgtcagattaatcaggtctagggagagaggaggagaggatggtgaagcccatggcgggatgtcccgcgaagatggggttccggatgccggcggagtgggagccgcacgagcagtgctggatgggctggcccgagcgtccagacaactggcgggagaatgctggtccagctcgagtaacatttgcgagaactgcaattgccatatcaaagtttgagcctgtcgccatttgtgcaagtgccgaacagtatcctcatgtccacgagctgatgcaacaccagccaaacatcagggtggtcgagatgagcatgaacgattcctggtttcgtgatactggtcccacttttatcatccgtaaaggaggatcagaaacaggacccacggagcaaactatagcgggaattgattgggaatttaacgcttggggaggagtcgatgatggttgctatgatgattggagtcttgacagagatgttgccaagaaaatagtcgagattgagaggatccctaggtttccacacacaatggttcttgagggtggaagcattcatgtagacggagaaggtacatgcattacaacggaagaatgcttgttgaatcctaaccgaaaccccaacatgactagagaagatatagagaatgagctgaaggattttcttggagtgacaaagatcatctggatacctcagggactttatggcgacgaggatacaaatgggcatgttgacaacctatgctgtttcgttaaacccggtgtgattctcttgtcatggaccgacgatgagaacgacccacagtacgagatatcggttaaggcactgtcagttctcactcaggccacggatgcagaagggcggcagatagaggtgataaagatccatgtaccagggcctctttacatcacaaaggaagagggggaaggtgttgatgcaacggggcatgctgtaccgagggaacgaggcaagagattggctgcctcgtacgtgaacttctacctggccaatggtgggatcatagcacccgctttcggcgataagcaacgggacgacgatgcgcgcgaggtcctccagaaggcattccctgattatgaggttgtgatggtcgaaggcgcaagagagatcgtgctgggaggtgggaacatacactgcatcacgcagcaacagccggcgcggccatcttagatcaacagcaagaaaggcgtaccatgatctacactgcggtgatgatctaatcatatattgttgctcctcgatgttgatagattgcgtgtggcgaggtctagagaaagaaatgcatcccgactgagtaggcagtactcataattgtatctgtatcaaacgcccacagcatctttcattgcacttcgaaattgcatcgtaagccggtagatatatcattggagaataatccaactgtatctaccaac

SEQ ID NO: 4458 - DNA, 1377 bp, Hordeum vulgare
ggagcgtccagacaactggcgggagcatgctgggccagctcgaaaaacatttgagagaactgcaattgccatttcaaagtttgagcctgtcaccatttgtgcaagtaccaaacagtatccttatgtccacgagctgatgcaacaccaaccaaacatcagggtggtcgagatgagcatgaatgattcctggttccgtgatactggtcccacttttattacccgtgaaggcggatcagatataggactttcagagcaaacaatagcggggattgactgggaatttaatgcatggggaggactaggtggtggttgctttgatgattggagtcttgacagaagcattgccaggaagatagtcgagattgagaggatcccttggtttgcacacacaatggttctcgagggtggaagcattcatgtagatggagaaggtacatgcattacaacagaagagtgcttgctgaatcctaacaggaaccctcacatgactaaactagagatagagaatgagctgaaggattttcttggagtcacgaagatcatttggatacctctgggactacacggtgatgaggatacaaatggccatgttgacaatttatgctgtttcatcaaacccggtgtgattctcttgtcgtggaccgatgacgagaacgacccacagtacgagatatcggtgaaggcactatcagctctcactcagtccgtggatgcgaaagggcggcagatagaggtggtgaagatccacgtgccagggcctctgtacatcacgaaggaagagggggacggtgttcttgcaacggggcatgctgtaccgagggtaccgggcaagagattggccgcctcgtatgtgaacttgtaccaggcaaacggcgggatcatagcgccggccttcggcgataagaagcgggacgacgcggcgcgtgaggtcctccagaaggcgtttcctgatcacgaggttgtgatggtggagggcgcgagggagatcgtgctgggaggtggcaacatacactgcatcacgcagcagcagccggtgcgcccatcgtagatgaagggcggtgaggaaagtcgaccaagccctgcattggggtttgggggtgaatgaatgattcaacgatgctggttacggccgcggccgcgcccgcagcatattggctgcgctctgaaaccgccggccgatagatataatcttgagaatattgaataatatttgtactagagtgttcaggctgtgacatccgcattcacattcctggagttttagcttacgtttctgaaccctgttgccttaccaaaaaaaaactgaccacaacaaatactaccacgcatgggagggaaaaagcgatgcgggcaagaacgcagggtttagcttgtgcc

SEQ ID NO: 4459 - DNA, 1658 bp, Festuca arundinacea
ggcacgaggcctcactacatttctctacagcggtgccggtgctgccctgccctttcccttcccgcataaagcaaaccctcgaggcgaggctctcatctcatcagtatagcaagggcgggcgcgagcgtaggagtgtcccgccgtcagattaatcaggtttagcgagggaggaggagaggatggtgaaggtcatggcggggtccccggcgaagatggggttccggatgccggcggagtgggagccgcacgagcagtgttggatgggctggcccgagcgtccagacaactggcgggagaatgctggtccagctcgaataacatttgcgagaactgcaattgccatatcaaagtttgagcccgtcaccatttgtgcaagcgccgaacagtatcctcatgtccacgaactgatgcagcaccagccgaacatcagggtggtcgagatgagcatgaatgattcctggtttcgtgatactggtcccccttttattgtccgtaaaggcggaccagaaccaggactcacagagcaaacaatagcgggaattgattgggaatttaatgcctggggaggagtcgatgatggttgctatgatgattggagtcttgataataatgttgccaagaaaatagttgagatagagaggatccctaggtttccacacacaatggttcttgagggtggaagcattcatgtagatggagaaggtacatgcattacaacagaagaatgcttgtaaaccctaaccgaaaccccaacatgactagacaagatatagagaatgagctgaaggattttcttggagtcacaaagatcatttggatacctcagggactttatggtgatgaggatacaaatgggcatgttgacagtttatgctgttttattagacctggtgtcgtcctcttggcatggactaatgatgagaatgacccacagtatgaaatatcagttagggcactatcaactctcactcagtctgtcgatgcgaaaggacggaaaatagaggtggtaaagatccacgtgccagggcctttatacgttacaaaggaagagggggatggtgttgatgcaacggggcatgctgtaccgagggaaccaggcaagagactgcctgcttcatacgtgaacttctacccaacaaatggcgggatcatatcacctgcttttggcgataagcagcgggacgacgaagcgcgtgaggttctccagaaggcatttcctgatcatgaggttgtgatggtggaaggcgcaagagagatcgtgctgggaggtggaaacatacattgcatcacgcagcagcagccggcgtgcccgtcatagttgaacgaggaacagcaaggcaaggaggggtgactggtgtgtgcctgacgatgatgagacacagcagccagccggtgcaggcaaagagaggaaaggccagcaagagctgacgagatggctggctgttcaaacaaggctgggaggaggagcacgtcttcgcgccagcataccagctgattacctaaggctttgaattctgagacatgctaactgagtttcctttctcatgtacacctcattcaggctactcggctcaaaatgtaaaattagtttgctgggcattgtaaggaatgatgaaaacttgtatacgaaccaagcaaattctttcaaaaaaaaaaaa

SEQ ID NO: 4460 - DNA, 1166 bp, Pseudoroegneria spicata
gagaactgcaattgccatttcaaagtttgagccggtcaccatttgtgcaagtgccaaacagtatcctcatgtccacgagctgatgcaacaccaaccgaacatcagggtggtcgagatgagcatgaatgattcctggttccgtgatactggtcccacttttattacccgtgaaggcggatcagatgtaggactcgcagagcaaacaatagcggggattgactgggaatttaacgcatggggaggactcggtggtggttgctttgatgattggagtcttgacagaagcattgccaagaagataatcgagattgagagggtccctaggtttgcacactcgatggttctcgagggtggaagcattcatgtagatggagaaggtacatgcattacaacggaagaatgcttgttgaatcctaacagaaaccctcacatgactaaactagagatagagaatgagctgaaggattttcttggggtcacgaagatcatttggatacctctgggactacacggcgatgaggatacaaatgggcatgttgacaatttatgctgtttcatcaaacccggtgtgattctcttgtcgtggaccgacgacgagaacgacccgcagtatgagatatcggtgaaggcactatcagctctcactcaggctgtcgacgccaaagggcggcagatagaggtggtgaagatccacgtgccagggcctctgtacatcacgaaggaagagggggacggtgttcttgcaacggggcacgctgtaccgagggtaccaggcaagagattggccgcctcatacgtgaacttctacccggcgaacggcgggatcatagcgccggcttttggtgataagaagcgggacgaggaagcgcgcgaggttcttcagaaggcatttcctgatcgtgaggttgtgatggtggaaggcgcaagggagatcgtgctgggaggtgggaacatacactgcatcacgcagcagcagccggtgcgcccgtcatagatgaacggcgaggaaaggcgaccaagccctgcattggggtgatgattcaagataattggttacgcccgcagcatatcggttgcactttgaaactgcgtcgcgggccaatagatgcatctcatttggaaattactgaataatattgtaggtgtgttcagactcccctttcgca

SEQ ID NO: 4461 - DNA, 1597 bp, Oryza sativa
gtttagggaggaggaagaggagaggtggttcatcaggtagaagaggagaaggaggatggcgaaggcgacgacgatggaggggcgcccggcgaagatggggttccggatgccggcggagtgggagccgcacgagcagtgctggatgggctggcctgagcgtcgagacaattggcgagagcttgctggtccagctcgaaaagtatttgcaagaactgctattgccatttcaaagtttgagtctgttactatatgtgcaagtgccaagcagtatccctatgtccatgagctaatgctacatcaaccaaacatcagggtggtcgagatgagcatgaatgattgctggttccgtgatattggtcccacttttattgttcgtaaaggtgcaccagggttaggaatcacagaaaaaaatatagcaggaattgattgggaatttaacgcctggggaggagccactgatggttgctatgttgattggagccttgacagctatgttgccaagaaaatagttgagattgagaggatccctagatttccacacacgatggttcttgaaggtggaagcattcatgtagatggagaaggtacatgcatcacaacagaagaatgcttgttgaatcctaacagaaaccccaacatgaccaaactagagatagagaatgagctgaaggattttcttggagtcgcaaaggtcatctggatacctcatgggctttatggtgatgatgatacaaatggtcatgttgacaatctatgctgcttcattaaacctggggtggtcctcttgtcatggaccgatgatgagaacgacccacagtaccaaaggtccgttgatgcactctcaactctctccaagtccgttgatgcgaaaggacggcagatagaagttgtgaaaatccacgtcccagggcctctgtacatgacaaaggaagagtcagagggtgttgtaaaaacagagcatgctataccgagggaaccaggcacgagattggctgcctcgtacgtaaacttctacatagccaatggcggaattgtagcaccagcttttggcgacaagtgggacgaagaagcgtgtgctgttcttcagaaggcatttcctgatcatgaggtggtgatggtggaaggcgcaagagagatcgtgctggcagggggaaacatacactgcatcacgcagcagcagcctgtacgcccgtcgtagatgatactgcgtatatagtattatgaatttggacatgggactagtccagattcgtagtactatatgtccagggagtagatggcactatagcagccatgccctatcgtgaattcgtgataagctacatcatttgctacccaaaatggcgacccgatcatacaccattgattacccaaaaccaaatgaatgaattgatagattacccaaaaccaaatgaatgagttgatagaataaggccgcagacaaacattgtgatttgtgagcttgtgtgtaggggatgtggttgcaccagcgtgatggatatggttgtaagttgcagtagtgtaagcacgttggaaactgccttatggcctttgccaacgttgaccaggcgaatggaaatgaaaatggctttgaggc

SEQ ID NO: 4462 - DNA, 1834 bp, Oryza sativa
caaacttggtcacgcgaagctgttgggaagggtccccactcccctctctcctccagccacgtggcgcctagccccgccgcctacgtatataaagcaactgatgcgggtgggagtcgtgggacgcccccatttttcccatcgcttttgcttttgctgagcgcagatccttcgccaattgggcgctaatcaggcgggtattttggatatttaggtttagggaggaggaggaggagaggtggttcatcaggtagaagaggaggaggatggcgaaggcgacgacgatggaggggcgcccggcgaagatggggttccggatgccggcggagtgggagccgcacgagcagtgctggatgggctggcctgagcgtcgagacaattggcgagagcttgctggtccagctcgaaaagtatttgcaagaactgctattgccatttcaaagtttgagtctgttactatatgtgcaagtgccaagcagtatccctatgtccatgagctaatgctacatcaaccaaacatcagggtggtcgagatgagcatgaatgattgctggttccgtgatattggtcccacttttattgttcgtaaaggtgcaccagggttaggaatcacagaaaaaaatatagcaggaattgattgggaatttaacgcctggggaggagccactgatggttgctatgttgattggagccttgacagctatgttgccaagaaaatagttgagattgagaggatccctagatttccacacacgatggttcttgaaggtggaagcattcatgtagatggagaaggtacatgcatcacaacagaagaatgcttgttgaatcctaacagaaaccccaacatgaccaaactagagatagagaatgagctgaaggattttcttggagtcgcaaaggtcatctggatacctcatgggctttatggtgatgatgatacaaatggtcatgttgacaatctatgctgcttcattaaacctggggtggtcctcttgtcatggaccgatgatgagaacgacccacagtaccaaaggtccgttgatgcactctcaactctctccaagtccgttgatgcgaaaggacggcagatagaagttgtgaaaatccacgtcccagggcctctgtacatgacaaaggaagagtcagagggtgttgtaaaaacagagcatgctataccgagggaaccaggcacgagattggctgcctcatacgtaaacttctacatagccaatggcggaattgtagcaccagcttttggcgacaagtgggacgaagaagcgtgtgctgttcttcagaaggcatttcctgatcatgaggtggtgatggtggaaggcgcaagagagatcgtgctggcaggtggaaacatacactgcatcacgcagcagcagcctgtacgcccgtcgtagatgatactacgtatatagtattatgaatttggacatgggactagtccagattcgtagtactatatgtccagggagtagatggcactatagcagccatgccctatcgtgaattcgtgataagctacatcatttgctacccaaaatggcgacccgatcgtacaccattgattacccaaaaccaaatgaatgaattgatagattacccaaaaccaattgaatgagttgatagaataaggccgcagacaaacattgtgatttgtgagcttgtgtgtaggggatgtggttgcaccagcgtgatggatatggttgtaagttgcagtagtgtaagcacgttggaaactgccttatggcctttgccaacgttgaccaggcgaatggaaatgaaaatggctttgaggctgtctcggtgaaacaagtatatatgcagg

SEQ ID NO: 4463 - DNA, 1576 bp, Saccharum officinarum
atcgccgcctccctcccagcggccagtgaggctgcggcgccgcgcagcagaaaacgcccagccgcatcggcatcgccgcgggcaacgccgtgtcgccgtcacgtgcctcgcggtcctctcctccaaatcctcctcctccgtctcgtcgcccctgttcctctcaggccgcgctatataaaggcggcccacgggaggacggggcaccgagcaccagcccagcggcagatcagtcgagccggccgattccagggtttagagaggaggagcggagatgttgaaggtcctcgaggggctcccggccaagatggggttccggatgccagcggagtgggagccgcacgagcagtgctggatgggttggcccgagcgtccagataactggagggagaatgctggtccagctcaagaggtatttgcgagagctgcaattgccatttcaaagtttgaacacgtcacgttatgtgcaagtgccaagcagtatcccaaagtccacgagctgatggaacatcagacaaacatcagggtggttgagatgagcatgaatgattcctggttccgcgacatgggacccacttttatcacccgtaaaggtgattcaagaaatggagaacaaacaatagcaggaattgattggcaatttaatgcctggggaggaatctatgacgattggagtcttgatagcgatgttgccaagaaaatagtcgagattgagaggatccctaggtttccgcaaaaaatgatccttgagggtggaagcattcatgtagatggagaaggtacatgcattacaacggaagaatgcttgctgaatcctaacagaaaccccaatatgacgaaattagagatagagaatgagctgaaggattttcttggagtctcaaaggtcatctgggtacctcgtggactctatggtgatgaggatacaaatggccacgttgacaatatgtgctgtttcattaaacctggtgtgatcctactgtcgtggaccgatgatgagaaggaccctcagtatgaacggtcagtcgaggcactgtctgttctctctcagtccgttgacgcgaaaggacggcagctcgaagtggtgaagatccacgtccctgggcctctgtacatgacaaaagaagaggcagagggtgttgtttcaacggggcatgctgtgccgagggaaccgggcacgagattggccgcctcgtatgtcaacttctacatcgccaatggcgggattatagccccttctttcggcgacaacaagtgggacaaggaggcacatgcggttctccagaaggcgtttcctgatcacgaggtggtgatggttgaaggcgcacgcgagatcgtgctgggaggcgggaacattcactgcatcacgcagcagcagcccgtgcgcccgtcctaggtgcaaccaacgtcgacgcgaaggcgataaagagcatgctggtagcatcattttgtatactactagtatttagtaggtgaattgatctctggttggtcgttatcacgctcgccaacatgcgcgagaaataagacccgtcagcagttctttgacgaatagtcaaatactatacgagtactatat

SEQ ID NO: 4464 - DNA, 1463 bp, Sorghum bicolor
gagcaccagcccagcggcagatcagttgaggcggccgattccagggtttagaggagagaggagcggagatgttgaaggtcctcgaggggcggcgcccggccaagatggggttcaggatgccggcggagtgggagccgcacgagcagtgctggatgggatggcccgagcgtccagataactggagggagaatgctggtccagctcaagaggtatttgctagaactgcaattgccatttcaaagtttgaaaacgtcacgttatgtgcaagtgccaagcagtatcccaaagtccacgagctcatggaacatcagaccaacatcagggtggttgagatgagcatgaatgattcctggttccgtgatatgggacccacttttatcactcgtaaaggtgattcaggaaacgcagaaaaaacaattgcaggaattgattggcaatttaatgcctggggaggaatctatgatgattggagtcttgacagcgatgttgccaagaaaatagtcgagattgagaggattcctaggtttctgcataaaatgatccttgagggtggtagcattcatgtagatggagaaggtacatgcataacaacagaagagtgcttgttgaatcctaacagaaaccccaacatgaccaaactggagatagagaatgagctaaaggattttcttggagtctcaaaggtcatctggatacctcatggactttacggtgatgaggatacgaatggccacgttgacaatatgtgctgtttcattaaacccggtgtgatcctactgtcgtggaccgatgatgagaaggaccctcagtatgaacggtcagtcgaggcactgtctgttctctctcagtccattgacgcgaaaggacggcagctcgaagtggtgaagatccacgtccctgggcctctgtacatgacaaaagaagaggcagagggtgttgtttcaacggggcatgctgtgccgagggaaccaggcacgagattggccgcctcgtatgtgaacttctacatcgccaatggcgggattgtagcaccttctttcggcgacaacaagtgggacaaggaggcatatgcggttctccagaaggcgtttcctgatcacgaggtggtgatggttgaaggcgctcgagagatcgtgctgggaggcgggaacattcactgcatcacgcagcagcagcccgtgcgcccgtcgtcctaggtgcaaccgacgtcgacgcgaaggcgatgaagagcatgctggtagcgtcattttgtatactactagtatttagtaggtgaattgatctcgctctagagatacaaaaataattcccgtttcctccaggcccatgtgacgcagaagcgtccaggctgcgctaggagagaaaacggcgatgtaggacgagcgcgtgagtggggtaatcaaacaatttcttcgtgtagcttggctgaaaaaaaaaataagcaaattacccactccattctg

SEQ ID NO: 4465 - DNA, 1129 bp, Echinochloa colona
ggcagggatgatggtgaaggccctggaggggcgcccggcgaagctggggttccggatgccggcggagtgggagccgcacgagcagtgctggatgggatggccggagcgtccagacaactggcgagagaatgctggtccagctcaagagacatttgcgagaactgcaattgccatttcaaagtttgagtccgtcacattatgcgcgagtgccaagcagtacccctatgtccacaacctgatggaacatcagaagaacatcagggtggttgagatgagcatgaatgattcctggtttcgtgacatgggacccacttttatcactcgtaaaggcgagtcaggaatcgcaatagcaggaatcgattggcaattcaacgcttggggaggaatctatgacgattggagtcttgacagcgacgttgccaagaagataatcgagatcgagaggattcctaggtttccgcacaaaatgattctcgagggtggaagcattcatgtagatggagaaggtacctgcatcacaactgaggaatgcttgttgaatcctaacaggaaccccaatatgactaaactagagatagagaatgagctgaaggattatcttggagtctcaaaggtcatctggataccccgcgggctttacggtgatgaggatacaaatggccacgttgacaacctgtgctgcttcgctaaacccggcgtgatcctcctgtcgtggaccgacgatgagaaggacccgcagtacgaacggtcggtcgaggcactgtctgttctctcaaaatcagttgatgccaaagggcggcagctggaagtggtgaagatccacgtcccggggcctctgtacatgacgaaggaagaggcagacggcgttctcacaacagagcatgccgtgccgagggagcccggcacgagactggcggcctcgtacgtgaacttctacatcgccaacggcgggatcgtagcgccggcgttcggcgacaagtgggacaaggaggcgtgtgaggttcttcagaaggcgtttcctgaccacgaggtggtgatggtggagggcgcgcgagagatcgtgctggggggcgggaacgtccactgcatcacgcagcagcagcccctgctcccgtcgtaggtggagtga

SEQ ID NO: 4466 - DNA, 1602 bp, Setaria italica
tagaaatcgattcgagggttaatttagagaggagagggagggacagagacagagcggcagggacgatgatggcgaaggtcatggaggggcgcccggcgaagatggggttccggatgccggcggagtgggaaccgcacgagcagtgttggatgggatggcctgagcgtccagacaactggcgggacaatgctggtccagctcaacagacatttgcgagagctgcaattgccatttcaaaatttgagcctgtcacaatatgtgcaagtaccaagcagtacccgtatgtccacaagctgatggaacatcatacgaacatcagggtgattgaaataaacatgaacgattcctggttccgtgatatgggacccacttttatcactcataaagtcgagtcaggaatcacaaaacaaacaatagcagggatagattggcaatttaacgcctggggaggaatctatgacgattggagtcttgacaatgatattgccaagaaaatagttgagattgagaggatccctaggttttcgcacaaaatggttctcgagggtggaagcattcatgtcgatggagaaggtacatgcataacaaccgaagaatgcttgctggatccaaacagaaaccccaacatgactaaactagagatagagaacgagctgaaggattttctgggagtcacaaaggtcatctggatacctcgtggactttacggtgacgaggacacaaatggccacgtcgacaacctgtgctgtttcattaaacccggcgtcatcctcctgtcgtggacggatgacgagaaggacccccagtacgaacggtcagccgaggcgctgtcggttctgacccaatcggttgacgctaaaggacggcagatagaagtggtgaagatccacgtcccggggcccctgtacatgacgaaggaagaggcggacggcgttctctcaacagggcacgccgtggcgagggagccgggcacgaggctggccgcctcgtacgtgaacttctacatcgcgaatggcggcatcgtagcgccgtctttcggcgacaagtgggacgaggaggcgtacaaggttcttcagaaggcgtttcctgatcgcgaggtggtgatggtcgagggcgggcgggagatcgcgctgggaggcgggaacgtccactgcatcacgcagcagcagcccgtgcgcccgtcgtaggcggacacaccaaggcgatggaaggacatgctattgctatgctagtagtactattgatctctgattctatcttcggtcgttatcgcacttgcccataccaagacgtgcgaggaataagaccggtcagcagttagttgacagatagtttccacccccgcccgcccacctctctctggccgcggcccgcggctgccgtcgagagcacgagacgcctccgcgtgggtgcgcggacgtggtgggttgttgttgggtgggtgacttgtcctgacgcttttgagcgcgttcggcggacgctcgttgcgttgcgatgtgtgccaggacaggacgagtcaaagcctactatgttttgcctctttcgctttgtcgcaactcgcaagcagcagaatttgtaacatcctaattttcatcatttgtg

SEQ ID NO: 4467 - DNA, 1735 bp, Pennisetum glaucum
ctggggaagacgaatcggatgagggcgaggcggtccgctgcagcggcggcggcgaggagcgggccggagggcgcgaggagggagaggagaaggtcggcgagcgccgggtcggcggcggcgaggtcgatgaaggaggcggaggagaggggaacagaagagatcgagcggcggggacgatgatggcgaaggtcatggaggggcgcccggcgaagatggggttccggatgccggcggagtgggagccacacgagcagtgctggatgggttggcccgagcgtccggacaactggcgggacaatgctggtccagctcaacagacatttgcgagagctgcgattgccatttcaaagtttgagccggtcacaatatgtgcaagtaccaagcagtacccctatgtgcacaagctgatggaacatcacacgaacatcagggtggttgagataaacatgaatgactcctggttccgtgatatgggacccacttttatcactcgtaaagttgagtcaggaatcacaaaacaaaccatagcagggatagattggcaatttaacgcctggggaggaatctatgatgattggagtcttgacagcgatattgccaagaaaatagtcgagattgagaggatccctaggttttcgcacaaaatggttcttgagggtggaagcattcatgtcgatggagaaggtacatgcattacaaccgaagaatgcttgttggatcgtaacagaaaccccaacatgactaaactagatatagagaatgagctgaaggattttctgggagtcacaaaggtcatctggatacctcgtggactttacggtgacgaggacacgaatggccacgtcgacaacctgtgctgtttcattaaacccggcgtcgtcctcctgtcatggacggatgacgagaaggacccccagtacgaacggtcagccgaggcgctgtcggtcctcacccaatccgttgacgccaaaggacggcagatagaagtggtgaagatccacgtcccggggcctctgtacatgacgaaggaagaggcgaacggcgttctctcaacagggcacgccgtggagagggagccgggcacgagactggccgcctcgtacgtgaacttctacatcgccaatggcggcatcgtggtgccgtctttcggcgacaattactgggacgaggaggcgtacaaggttctacagaaggcgttccctgaccacgaggtggtgatggtcgagggcgcgcgggagatcgtgctgggaggcgggaacatccactgcatcacgcagcagcagcccctgcgcccgtcgtaggcgatggaaggagatgctatgctaggagtattatattgatctccgattcttcggtcgttatcgcttattaccaataccaggacgtgcgaggaataagaccgttgacagattggaagtattcagacgccacactaattaggctagtgtcagtggaaggggtcatggacacaggtaccaagtttgccacgtcagcttttcagcagatgaccctgtcactctcaatgcacagggtcatgggcaccgtttcttagatagaatccagcatttaacctctcacaaggttcttggtaactgcatttaacctctcacaaggttcttggtaactgtgatgaccctctcatcacctctcacctcattaatttgataccatgtcatcaaacaagcttatgtggcagtgtatttattatccatgacccttccattgagactaggct

SEQ ID NO: 4468 - DNA, 1880 bp, Hordeum vulgare
ctgaaattagcatttaggtcttgtggatgacaagttgcgactgaataatgatatttgtttgaagtattctcagtgttgtcatttagtattgtcaatgttggcgatgttccattcgttctaagaccagtagatcgctgtgttaatttcttgaaaggcctttgtagtttctttttaatattgtgtatcctcctcagcatatgccctgaacaactttgaagtgcatcatcataataaacatgccacttctttgaatcttaggagcgtccagacaactggcgggagcatgctgggccagctcgaaaaacatttgagagaactgcaattgccatttcaaagtttgagcctgtcaccatttgtgcaagtaccaaacagtatccttatgtccacgagctgatgcaacaccaaccaaacatcagggtggtcgagatgagcatgaatgattcctggttccgtgatactggtcccacttttattacccgtgaaggcggatcagatataggacttgcagagcaaacaatagcggggattgactgggaatttaatgcatggggaggactaggtggtggttgctttgatgattggagtcttgacagaagcattgccaggaagatagtcgagattgagaggatcccttggtttgcacacacaatggttctcgagggtggaagcattcatgtagatggagaaggtacatgcattacaacagaagagtgcttgctgaatcctaacaggaaccctcacatgactaaactagagatagagaatgagctgaaggattttcttggagtcacgaagatcatttggatacctctgggactacacggtgatgaggatacaaatggccatgttgacaatttatgctgtttcatcaaacccggtgtgattctcttgtcgtggaccgatgacgagaacgacccacagtacgagatatcggtgaaggcactatcagctctcactcagtccgtggatgcgaaagggcggcagatagaggtggtgaagatccacgtgccagggcctctgtacatcacgaaggaagagggggacggtgttcttgcaacggggcatgctgtaccgagggtaccgggcaagagattggccgcctcgtatgtgaacttgtaccaggcaaacggcgggatcatagcgccggccttcggcgataagaagcgggacgacgcggcgcgtgaggtcctccagaaggcgtttcctgatcacgaggttagactaactgcccgtttcgcctcaaaattcaggcatccatattgtaggaagaaaggggatctcaaggggggcgtgaactgttgggtgcaggttgtgatggtggagggcgcgagggagatcgtgctgggaggtggcaacatacactgcatcacgcagcagcagccggtgcgcccatcgtagatgaagggcggtgaggaaagtcgaccaagccctgcattggggtttgggggtgaatgaatgattcaacgatgctggttacggccgcgcccgcagcatattggctgcgctctgaaaccgccggccgatagatataatcttgagaatattgaataatatttgtactagagtgttcaggctgtgacatccgcattcacattcctggagttttagcttacgtttctgaaccctgttgccttaccaaaaaaaaactgaccacaacaaatactaccacgcatgggagggaaaaagcgatgcgggcaagaacgcagggtttagcttgtgccttttaggtttcgacttgttttttctttttctgaaacggaggtttcgacttgtcgatgagcggctgcgagatgctgtggagaggctctgcaccaccacggtggatgccatgccctcccctccctcatccccctgtccgtggtggatggaagctgagcaag

SEQ ID NO: 4469 - DNA, 1639 bp, Zea mays
cagacacgagcaagtgtgagtgaggaggtttgcctgcccatctccatcggccatcgctgcctccccagtccccacatccgcacacatttttacccctcgcggcggccccaccgaccgccggggcgcagcggcgtcgccgcgggcaacgccgtcacgtcacgtgcatcacgacaatctcctcctccgcctcgtcttcctgccaggccgcgggagcaccagcccagcggcagatcagtcgaggcgggcgattccagggtttagagaggagcggagatggtgaaggtcatccaggggcgcccggccgagatggggttccggatgccggcggagtgggagccgcacgagcagtgctggatgggatggcctgagcgtccagataactggagggagaatgctggtccagctcaagaggtatttgctagaactgcaattgccatttcaaagtttgaacccgtcacgttatgtgcaagtgccaagcagtaccccaaagtccacgagctgatggaacatcaaaccaacatcagggtcgttgagatgagcatgaacgattcctggttccgcgacatgggccccacttttgtcacctgtaaaggggattcaggaattgcagaacaaacaatagcaggaattgattggcaattcaatgcctggggaggaatctatgacgactggagtcttgacagcgatgttgccaagaaaatagtcgagatcgagaggatccctaggtttccccaaaaaattatccttgagggtggaagcattcatgtagatggagaaggtacatgcattacaacggaagaatgcttgctgaatcctaataggaaccccaacatgaccaaactagagatagagaatgagctgaaggattttcttggagtctcgaaggtcatctggatacctcgtggactttatggcgacgaggatacaaacggccacgttgacaacatgtgctgcttcatcaaacccggtgtgatcctgctgtcgtggaccgacgacgagaaggattatcagtacgaacggtcggtcgaggcgctgtctgttctctcccagtccgtcgacgcgaaagggcggcagctccaagtggtgaagatccacgtccccgggcctctgtacatgacagaggaagaggcacagggcgttgtttcatcgggacattctgtgccgaggccagcgggcacgagattggccgcctcgtacgtcaacttctacatcgccaatggtgggatcatagcgccttccttcggcgacaggtgggacgaggaggcgtatgcggttctccagaaggcattccccgatcacgaggtggtgatggtcgaaggcggacgggagatcgcgctgggaggtgggaacattcactgcatcacgcagcagcagcccgtgcgcccgtcctagctgaaaccggcgtcgacgcgaggggcgatgaagagcttgcgagtagtattgttttgtatgctgctcctgtcgttatcacgctcaccaatacgctcgcgaaataagccacgccagcagttcgttgacacatactgtatgagtactattatactatacggcacaaacggccaaacgccacacaggcgtggatcaaaattgtactagttcctgtctacaattcgtggcctttatcatcctgattggctgc

SEQ ID NO: 4470 - DNA, 1045 bp, Hordeum vulgare
cccccacaaaccccgtaacctcgcacccccacccgaaggcacgagaaacaccccgagaagagagagagagagagagctccggagatgtcggcggacgagctgcggatggacctggaggagctgcggcggctggagggcctcgccacgcgcccccgcgtcgtctccctcctctccaacgagatccgcagcgtcgacgccaagctggcctcgcgggctgcgcccgtgccgacgccggcgccgcaggcgctcgcggcggcggcggcccctgctggtccgagctacgtcacgctggggtcgttcagctgggaccaggacaacgagaagatcagggtctatgttttccttgagaatgtcgaccaagagaaggtggagactactttcaagccaatgtcagtggatatcaagtttcatgatgttaaaggcaagaactataggtgtgccatcccaaaactgaacaaagaaatagttcctgagaaatgcaagattgtggtcaagcctacaaagattgtcatcaccctgtggaaagcttcttccggcaattggttggacctacactacaaggaagacaagtttaagccaagcatgggcaaagagaaggatccaatgtcgggaatcatggatttaatgaagggcatgtacgaggaaggtgacgaggatatgaagcgcacaatagccaaagcgtggtctgatgccagatctgggaagacggctgatccaatgaagggattgccttgagctggtagcggttttggtttcgagagctgctgtatgtgctgatgagctagtccgtgcattcagcgtggtttagagtactgtcgtgagtatccgcatcgcatgtgtgagatcaattgatacctgtctgataatgatggggcattatcagaatgcttgtttcctcgggtgttggattggcctaatttgtgcattctcgcattgtgatgtctgtatttgaactgaaaagaaaatgaatgcatgcttgggtgatgagaagagcatgtgtatgcgcgcgcgattcacttgtttttctcgttcaagtcgtttgtgg

SEQ ID NO: 4471 - DNA, 1156 bp, Hordeum vulgare
actggtctcctctggaaccttccccttccttccgccccaaccgaaccgaaccccccacaaaccccgtaacctcgcacccccacccgaaggcacgagaaacaccccgagaagagagagagagagagagagagagagagagctccggagatgtcggcggacgagctgcggatggacctggaggagctgcggcggctggagggcctcgccacgcgcccccgcgtcgtctccctcctctccaacgagatccgcagcgtcgacgccaagctggcctcgcgggctgcgcccgtgccgacgccggcgccgcaggcgctcgcggcggcggcggcccctgctggtccgagctacgtcacgctggggtcgttcagctgggaccaggacaacgagaagatcagggtctatgttttccttgagaatgtcgaccaagagaaggtggagactactttcaagccaatgtcagtggatatcaagtttcatgatgttaaaggcaagaactataggtgtgccatcccaaaactgaacaaagaaatagttcctgagaaatgcaagattgtggtcaagcctacaaagattgtcatcaccctgtggaaagcttcttccggcaattggttggacctacactacaaggaagacaagtttaagccaagcatgggcaaagagaaggatccaatgtcgggaatcatggatttaatgaagggcatgtacgaggaaggtgacgaggatatgaagcgcacaatagccaaagcgtggtctgatgccagatctgggaagacggctgatccaatgaagggattgccttgagctggtagcggttttggtttcgagagctgctgtatgtgctgatgagctagtccgtgcattcagcgtggtttagagtactgtcgtgagtatccgcatcgcatgtgtgagatcaattgatacctgtctgataatgatggggcattatcagaatgcttgtttcctcgggtgttggattggcctaatttgtgcattctcgcattgtgatgtctgtatttgaactgaaaagaaaatgaatgcatgcttgggtgatgagaagagcatgtgtatgcgcgcgcgattcacttgtttttttcgttcaagtcgtttgtggcacaacttctgttggctcaagataatcatatttgtggctttatgcatt

SEQ ID NO: 4472 - DNA, 1038 bp, Secale cereale
ctcagcctccccccacccgaaggcacgagaaacgaaacagagagagagagagagagagagcgctccggagatgtcggcggacgagttgcggctggacctggaggagctgcggcggctggagggcatcgccaagcgccccgcgtcgtctccctcctctccaacgagatccgcagcgtcgacgccaggttggcctcgcgggctgcgcctgtgccgacgccggcgccgcaggcggtggcggtcgcggcacctgctggtctgaactatgtcacgctggggtcgttcagctgggaccaggacaatgagaagatcagggtctacgtattccttgagaatgtcgaccaagagaaggtggagactactttcaagccaatgtcagtggatatcaagttccatgatgttaaaggcaagaactataggtgtgccatcccaaagctgaacaaagagatagttcctgagaaatgcaagattgtggtcaagcctacgaagatcgtcatcaccctgtggaaagcttcttctggcaattggttggacctacactacaaggaagacaagtttaagccaagcatggacaaagagaaggatccaatgtcaggaatcatggatttaatgaagggcatgtatgaggaaggtgacgaagatatgaagcgcacaatagccaaagcgtggtccgacgccagatctgggaagacggctgatccaatgaagggattgccttgagctggttgtagtttttgttccgagagctgctatatttgctgagctagtccgtgcattcagtgtggtttactagagtagtgtgatgagtatccgcatcgcaagtgtgagatcgatacctgtctgacgatgatgggagtgctcgtttcctcaggtgtttgattggcctaatttgcacattctcgcatttgaactgaaaaaagatgaatgcatatgcttgtgcgatgagaaagagaatgtttatttgcgcgattcacgcgttctttgttgtagtcgtttgtggcacaacttctgttggctaaagataattatatttgtggcttg

SEQ ID NO: 4473 - DNA, 844 bp, Pseudoroegneria spicata
agctgcggcggctggagggcctcgccacgcgcccccgcgtcatctccctcctctccaacgagatccgcagcgtcgacgccaagctggcctcgcgggctgcgcctgtggcgacgccggcgccgcaggcggtcgcggcggtggcccctgctggtctgagttacgtcacgctggggtcgttcagctgggaccaggacaatgagaagatcagggtctacgtattccttgagaatgtcgaccaagagaaggtggagactactttcaagccaatgtcagtggacatcaagtttcatgatgttaaaggcaagaactataggtgtgccatcccaaaactgaacaaagaaatagttcctgagaaatgcaaggttgtggtcaagcctacgaagattatcatcaccctgtggaaagcttcttccggcaattggttggacctacactacaaggaagacaagtttaagccaagcatggacaaagagaaggatccaatgtcaggaatcatggatttaatgaagggcatgtatgaggaaggcgacgaagatatgaagcgcacgatagccaaagcgtggtctgacgccagatctgggaagacggctgatccaatgaggggattgccttgagctggtggtagttttggttccgagagctgctatatgtgctgagctagtccgtacattcagtgtggtttactagagtagtgtcatgagtatccgcatcgcatgtgtgagattgatacctgtctgatgatgattgggaatgctcgtttcctcaggtgtttgattggcctaatttgcacattcttgcatttgaactgaagaaagatgaatgcatatgcttgtgcgatgagaaa

SEQ ID NO: 4474 - DNA, 1022 bp, Avena sativa
tcctggcctcctctggaaccttctcctcccttccaccctacaaacatataacccccgcaagagccaaacccgcccgccccaccgaaagccacgagcgagttccagagatagagagtgctccgaagatgtcggcggacgagttgcggctggacctggaggagctgcggcggctggagggcctcgccacccgcccccgcgtcctctccctcctcgccaacgagatccgcagcgtcgacgccaagttggccccgcggattgcgcccgtgccggcgccgcaggcggtcgcagcggcggcccctgctgctgtgagttacgtcacgctgggatcgttcagctgggaccaggacaatgagaagatcagggtctatgtattccttgagaacgttgaccaagagaaggttgagactatctttaagccaatgtcagtggatattaagtttcatgatgttaaaggcaagaactatcggtgtgccataccgaaactgaacaaaaaaattgttcctgagaaatgcaaggttgtggtcaagcctacaaagattgtcatcaccctttggaaagcttctacaggaacttggtttgacctgcattacaaggaagacaagttcaagccaagcacggacaaagataaggatccaatgtcaggaattatggatttaatgaaggacatgtatgcggagggggacgataatatgaagcgcacaatagcccaggcgatgatcgacgccaggtctgggaagacagctgatccaatgaggggattacgttgagccggtagtttggctccaagcgctgctgctatatgggcctaggagtatcgtgttgctgagactgctacctgtttgatagaaatgctgtctccttttgctgctggattgttttagtttggatattatcatgccgaacctattgcgaagtcgaatgcatgtttgtgtgcatggtttttgggcagatatttctagacagaagcccatatgctagtactgattttgtggtccaacgtcttgtcatgccatgttcgtaca

SEQ ID NO: 4475 - DNA, 902 bp, Avena sativa
accgaaagccacgagcgagttgcagagatagagagtgctccgaagatgtcggcggacgagttgcggctggacctggaggagctgcggcggctggagggcctcgccacccgcccccgcgtcctctccctcctcgccaacgagatccgcagcgtcgacgccaagttggccccgcggactgcgcccgtgccggcgccgcaggcggtcgcggcggcggcccctgctggtgtgagttacgtcacgctgggatcgttcagctgggaccaggataatgagaagatcagggtctatatattccttgagaacgttgaccaagagaaggttgagactatctttaagccaatgtcagtggatattaagtttcatgatgttaaaggcaagaactatcggtgtgccataccgaaactgaacaaaaacattgttcctgagaaatgcaaggttgtggtcaagcctacaaagattgtcatcaccctttggaaagcttctacaggaacttggtttgacctgcattacaaggaagacaagttcaagccaggcacggacaaagataaggatccaatgtcaggaattatggatttaatgaaggacatgtatgcggagggggacgataatatgaagcgcacaatagcccaggcgatgatcgacgccaggtctgggaagacagctgatccaatgaggggattacgttgagccggtagtttggctccaagcgctgctgctatatgggctaggagtatcgcgttgctgagactgctacctgtctgatagaaatgctttctccttttgctgctggattgttttagtttggatattatcacgccgaacctattgcgaagtcgaatgcatgtttgtgtgcatggtttttgggcagatatttcttgacagaagcccatatgctagtactg

SEQ ID NO: 4476 - DNA, 739 bp, Festuca arundinacea
cgcacgaggccgaaagccacgagcgagttccagagattcaccggagatgtcggcggaggagctgcggctggacctggaggagctgcggcggctggagggcctcgccacgcgcccccgcgtcctctccttcctcgccaacgagatccgcagcgtcgacgcaatgttggccgctgcgcccgtgccggcggttgcggcggccgcccgtgctggtgtgagttacgtcacgcttggaacgttcagctgggaccaggataacgagaagatcagggtttatgtattccttgagaatgttgaccaagagaaggttgagactacttttaagccaatgtcagtggatattaagtttcatgatgttaaaggcaagaactaccggtgtgccataccaaaactgaacaaagaaatagttccagagaaatgcaaggttgtggtcaagcctacaaagattgtcatcaccctctggaaagcttctacaggaagttggctggacctgcactacaaggaagacaagttcaagccaagcacgggcaaagataaagatcccatgtcaggaattatggatttaatgaaggacctgtatgaggagggggacgacaatatgaggcgcacaataggccagacgttgatggacgccaggactgggaagacagctgatccaatgaggcgattaccttgagctggtagtttggttctctagaagctgcttaatgcgccgtgttggtccatatagtcagtgtgggtg

SEQ ID NO: 4477 - DNA, 1226 bp, Lolium multiflorum
gtagcagttactgggccagggtcaaggcaacaaaagccaaacccaaaattgatgaaaccgtccagttcgtcctggcctcctctggaaccttctccttccttccattccaccccaaattaaaccccccacgaaccataaccccgcaagaaccaaaccgcccgccgcaccaaaagccacgagcgagttccagagattcaccggagatgtcggcggaggagctgcggctggacctggaggagctgcggcggctggagggcctcgccacgcgcccccgcgtcctctccctcctcgccaacgagatccgcaccgtcgacgcaaagctggccgctgcgcccgtgccggcggttgcggcggcgcccgcccgtgctggtgtgagttacgtcacgctgggaacgttcagctgggaccaggacaacgacaagatcagggtttatgtattccttgagaatgttgaccaagagaaggttgagactacttttaagccaatgtcagtggatattaagtttcatgatgttaaaggcaagaactaccggtgtgccataccaaaactgaacaaagaaatagttcctgagaaatgcaaggttgtggtcaagcctacaaagattgtcatcaccctctggaaagcttctacaggaagttggttggacctgcactacaaggaagacaagttcaagccaagcgcgggcaaagataaagatcccatgtcaggacttatggatttaatgaaggacctgtatgaggagggggacgacaatatgaggcgcacaataggccagtcgttgatggacgccaggactgggaagacagctgatccaatgaggcgattaccttgagctggtagtttggttctctagtagctgcttaatgcgctgggttgttccatatattcagtgtgggtgagagtattgtgttgccgagtgcgacctgtctgatacaaatgccgtccttgtttctgggttgttttaatttggaaatcctcacgctcagcgtattgtcatatcgaatacttttttgtgcgtgtgtttttgctgcagaaatttctccacagaaagccatcgagtacctgctcattttgcacttaaacgtctcgttgtccatgtttgtacgctcatgggtgctagctggtactgccttacaccctttgttaccaacatctgatgcacaatgagccattatttctgtgccaatcatctacacccagcaggctattctagatcagcagactt

SEQ ID NO: 4478 - DNA, 990 bp, Echinochloa colona
taagccggcagaaacaagcaaccgcctcccacaggcgacaccgcatcgagaagacgagaggctgcgagaacgccaggaagaacccagagcgctccggagatgtcggcggaggagctgcagctggagctggacgagctgaggcagcttgagggcctcgccaagcgcccccgggtccagtccctcctcgccaacgagatccgcaatgttgaagccaagttggcgaaggcaactgcgccggcgccggcgccggagccacaggcggtgactcccgctcctgcacgtcctggtttgagctacgtcacgctgggatcgttcagctgggatcaggacagcgagaagatcaggatttatgttttcctggagggtgtcgagcaagagaaggtggagactaattttaagccaatgtcagtggatataaagtttcatgatgttaaaggcaagaattatcgatgtaccataccaaagctgaacaaggaaattgttcctgagaaatgcaaggttgtggtgaagcctacaaaggttgttgttaccctttgcaaagcttctaaaggcaattggttagacctgcacttcaaggaagacaagttcaagccaagcatggacaaggagaaggatccaatgtctggaattatggatttgatgaagaacatgtatgaggaaggcgacgaggacatgaagcgcacaatagccaaagcttggtctgatgccaggtctgggaaaacgactgattcattgagtggattacgttgagctggtacaatcggttgatgtacttctggctgctgtgctagtccttgctgtgtttttgacggttgtagtaggtgctagtgctggattgtcttgtttctgaaggtggacttgccatgcatatttaagtctcttggaacaaagagagttgtgataatctctgttaagtttcatgattgtgtataagcatagccttcctgtttgctgcagaacagtggtaacaagggtaacattatgaggcac

SEQ ID NO: 4479 - DNA, 954 bp, Oryza sativa
atcccaccaccggaaagacacgagaggcgacggagagagagagagagagaggaaagctaagcttccagagatgtcggcggacgagctgcggctggacctggaggagctgcggcggctggagggcctcgccaagcggccccgcgtcctctccgccctcgccaacgagatccgcgccgtcgatgccaagctggcgaaagcgaccgagccgcaggcaccgcaggccgtcgcggcgggatcgccacctgtagtggcggcggcggcggcaccggcacctgctgctgctgctggggtgagctacgtgacgttggggtcgttcagctgggatcaggatgctgagaagataaagatttatgttttcctggagggtgttgagcaagataaggtggagactacttttaagcctatgtcagtagatataaaattccatgatgtgaagggcaagaactaccgatgtgccatacctaagctgcacaaagaaattgttcctgagaaatgcaaggttttagtcaagcctacaaagattattgtgacgctttacaaagcttccaaaggcaactggttagacttgcatttcaaggaggataagttcaagccaagcatggctaaggagaaggatccaatgtctggaattatggatttgatgaagaacatgtatgaggaaggtgacgaagacatgaagcgcacaatagccaaggcctggtctgatgcaaggtctgggaagaccgccgattcagtgaggggattaccttgagtttgcccgaagcgttggctctgctgagccagttcgttgtgattgaatgcacttggttatcttattttgcatgtaacgaactggaaatcggtcacgccgggcctgttcatttgtgaagaaaacatcttctcgtgtgatattatcacttctgcgtgtgatcagcctttaatggaatgattatgtgccaatggccgcttttgcga

SEQ ID NO: 4480 - DNA, 966 bp, Setaria italica
agcaaccgtctccaccatctgcccatagaccacaccgcaccgaagagacgggaggcagcgagaacgcccggaagaaccgagagcgctccggagatgtcggcggaggagctgcggctggagctggacgagctgaggcagctggaaggcctagccaaacgcccccgcgtccagtccctcctcgccaacgagatccgcatcgttgaagccaagttagcgaaggcaactgcaccagcgcctgagccgcaggcggcgctttctgcgcctgcgcgtcctggtttgaactacgtcacgttggggtcgttcagctgggatcaggacaacgagaagatcaggatttatgtattcctggagggagtcgagcaagagaaggtggagactgtttttaagccaatgtcagtggatataaagtttcatgatgttaaaggcaaaaattatcggtgtgccataccaaagctgaacaaggaaattgttcctgagaaatgtaaggttgtggtgaagcctacaaaggttgttgttaccctttgcaaagcttctaaaggcaactggttagacctgtatttcaaggaagacaagttcaagccaagcatggacaaggagaaggacccaatgtctggaattatggacttaatgaagaacatgtatgaggaaggcgacgaggatatgaagcgcacaatagccaaggcttggaccgacgccagatctgggaaaacgactgattcattaagtggattacattgagctggtataatgggtcgatggacttctgtctgctgcgctagccctgcagtgttttgggatggttgaaacagagcgttaacagtgtgttgtaggtgtgctagtgctggattgtcttatttctaaaggtggacatgacatatgcatatttgaatctcccccttgtcaacggagaaaagattgtgtgaagctctgagaagttttatgattatgtgtgccgtatttgtgaaa

SEQ ID NO: 4481 - DNA, 869 bp, Oryza sativa
gagaggaaagctaagcttccagagatgtcggcggacgagctgcggctggacctggaggagctgcggcggctggagggcctcgccaagcggccccgcgtcctctccgccctcgccaacgagatccgcgccgtcgatgccaagctggcgaaagcgaccgagccgcaggcaccgcaggccgtcgcggcgggatcgccacctgtagtggcggcggcggcggcaccggcacctgctgctgctgctggggtgagctacgtgacgttggggtcgttcagctgggatcaggatgctgagaagataaagatttatgttttcctggagggtgttgagcaagataaggtggagactacttttaagcctatgtcagtagatacaaaattccatgatgtgaagggcaagaactaccgatgtgccatacctaagctgcacaaagaaattgttcctgagaaatgcaaggttttagtcaagcctacaaagattattgtgacgctttacaaagcttccaaaggcaactggttagacttgcatttcaaggaggataagttcaagccaagcatggctaaggagaaggatccaatgtctggaattatggatttgatgaagaacatgtatgaggaaggtgacgaagacatgaagcgcacaatagccaaggcctggtctgatgcaaggtctgggaagaccgccgattcagtgaggggattaccttgagtttgcccgaagcgttggctctgctgagccagttcgttgtgattgaatgcacttggttatcttattttgcatgtaacgaactggaaatcggtcacgccgggcctgttcatttgtgaagaaaacatcttctcgtgtgatattatcacttctgcgtgtgatcagcc

SEQ ID NO: 4482 - DNA, 1674 bp, Triticum aestivum
aggacggaagcacggaaggaaggaggaagaggcggacggcggcgacctcgaaagaaaagacggagaagagatggcgtggcggctggcgctgccgctgctcctcttctactcacccatcctcgtctgctcctcctcccaagaagtccaagacaatgacccctccaaactcttcaagagcgcctccgagatgatgagcctaaggaaatacgacggggcgctcggtctgctcaacgccgtcctcgagctcgaccccaaccattctgaagcttacaggcagcgcgcgacggtgcttcgtcacagatgcagacacaaggaagctgagagtgactataacaaattcctggagctcaagcccgggactgcttcagtggagaaggaactggctcagctgctgcaggcccaaaacgcattagaatctgcttatacccagtctgatgccggagaattctcaaaagtcctcgagtacgtcaataaaatcgtgctcgtattttctccaggttgcttaaaggcaaagctcctcaaggctaaagcattgctagcactgaaagactattcgaacgttatttcggagacaggatttattctcaaggaagatgaagataacttggatgcgctgttacttcgtggccgagcatactattaccttgctgatcatgatgttgccaacaggcactatcagaaaggccttcgtctagaccctgaacattcagaattgaagaaagcatattttgggctgaaaaaacttctgaagaagaccaagagcgctgaagataatgctgccaagagcaagtttcgcgtggctgttgaggactacaaggcagcactagcaatggatccagaccacactttgtacaacgtacaacttcatcttgggctatgtaagactctggttaaacttgggagaggcaaggaggcaatcaacacctgtacggaagcgctcagcatagatgaagaacttgttgaagctttgtcacagagaggtgaagctaaacttctaacagaagactgggaaggtgcggttgaggatctaaaagaggctgcccagaaatccccacaggacatggcaatccgagaggcgctcatgaaagcggaaaggcagctcaagctgagcaaaaggaaagactggtacaagatcctgggcatctccaagacagcatcggccgcggacatcaagcgcgcgtacaagaggctggcgctgcagtggcacccggacaagaacgtggagaaccgcgaggaggcggagaacatgttccgagagatcgcgtccgcatacgaggtgcttagcgacgaggacaagcgtgtgaggtacgaccggggagaggacctggaggagatgggcatggggggaggcggcggcggtggcttcgacccgttcggcggaggcggtgggcagcagtacacgttccaccacggcggtgggttccccggcggcttccagttcaacttcggttaaaagcaggccaggcttactgtttagttttcctgtcccggtctttggtttaggagggagagcttaacgacaacatgtgttaattatatatatctagctaagagcttttactgtcttggctcttactctggttaaagaaagttttgcttaagcaccaattatacaacaaattttccctgagattaattgtactactgtattatgattatagctggtgattctgt

SEQ ID NO: 4483 - DNA, 1722 bp, Secale cereale
ctcgaatcgaatccaacggggacggctaagatctacggaacggacggaggcagacgccggcgagcgttccgacgagaggagatggcgtggcggctggcgctgccgctgctcctcttctactccccgatcctctgctcctcctccgttgatgtccaagacaataatgacccctccaaattgttcaagagcgcctccgagatgatgagcctaaggaaatacgacggcgcgctcggcctgctcaacgctgtcctcgagctcgaccccaaccattccgaagcttacaggcagcgcgccacggtgctccgccacagatgcagacacaaggaagctgagagtgactacaacaaatacctggagatgaagcccgggactgcttcagtggagaaggaactggctcagctgctgcaggcccaaaacgcactagaatctgcttatacccagtctgatgctggggaattctctaaagtcctggagtacgtcaacaaaatcgtgctcgtcttttctccaggttgcttaaaggcaaagcttctcaaggctaaagcattgctagcactgaaagactattcgaacgttatttcggagacgggatttattctcaaggaagatgaggataacttggatgcgctgttacttcgtggccgggcatactattaccttgccgatcatgatgtcgccaacaggcactaccagaaaggcctacgtctagaccctgaacattcagaattgaagaaggcatattttgggctgaaaaaacttctgaagaagaccaagagcgctgaagacaatgctgctaagagcaagtttcgcgtggctgttgaggactacaaggcagcactagcaatggatccagaccatactttgtacaacgtgcaacttcatcttgggctctgtaagactctggttaaacttggaagaggcaaggaggcaatcaacacctgtacagaagcgctcagcatagatgaagaacttgttgaagctctgtcacagagaggcgaagctaaacttctaacagaagattgggaaggtgcggttgaggacctaaaagaggctgcccagaaatccccacaggacatggcaatccgagaagcgctcatgaaagctgaaaggcagctgaagctgagcaaaaggaaagactggtacaagatcctgggcatctcgaagacagcatcggctgcggacatcaagcgcgcatacaagaggctggcgctgcagtggcacccggacaagaacgtggagaaccgcgaggaggcggagaacatgttccgagagatcgcagccgcatacgaggtgcttagcgacgaggacaagcgtgtgaggtacgaccggggagaggacctggaggagatgggcatggggggaggcggcggcggcttcgacccgttcggcggaggcggtgggcagcagtacacgttccaccacggtggggggttccccggcggcggattccccggtggcttccagttcaacttcggttaaaggcaggccaggcttactgttttgtcactgctagtgagtagtgtggcgtggtctttgctttaggagggagagcttaacgacaacatgtgttgttaattatatatatctactagctaagagcttttactatctttgctcttactgttaaagaaagttttgctttattagtacctatacaacaagttttccctgagattaattgtactagtgtattatgattatagctggtgattcttctgtgatgca

SEQ ID NO: 4484 - DNA, 1669 bp, Secale cereale
ggagatggcgtggcggctggcgttgccgctgctcctcttctactcccccatcctctgctgctcacaagatgtccaagacaacaatgacccctccaaattgttcaagagcgcctccgagatgatgagcctaaggaaatacgacggggcgctcggcctgctaaacgctgtcctcgagatcgaccccaaccattccgaagcttacaggcagcgcgccacggtgctccgccacagatgcagacacaaggaagctgagagtgactacaacaaatacctggagatgaagcccgggactgcttcagtggagaaggaactggctcagctgctgcaggcccaaaacgcactagaatctgcttatatccagtctgatgctggggaattctctaaagtcctggagtacgtcaacaaaatcgtgctcgtcttttctccaggttgcttgaaggcaaagcttctcaaggctaaagcattgctagcactgaaagactattcgaatgttatttcggagacaggatttattctcaaggaagatgaggataacttggatgcgctgttacttcgtggccgagcgtactattaccttgccgatcatgatgtcgccaacaggcactaccagaagggcctccgtctagaccctgaacattcagaattgaagaaggcatatttcgggctgaaaaaacttctgaagaagaccaagagcgctgaagacaatgctgccaagagcaagtttcgcgtggctgttgaggactacaaggcagcactggcaatggatccagaccatactatgtacaacgtacaacttcatcttgggctctgtaagactctggttaaacttggaagaggcaaggaggcaatcaacacctgtacggaagcactcagcatagatgaagaacttgttgaagctttgtcacagagaggtgaagctaaacttctaacagaagattgggaaggtgcggttgaggacctaaaagaggctgcccagaaatccccacaggacatggcaatccgagaggccctcatgaaagccgagaggcagctgaagctgagcaaaaggaaagactggtacaagatcctgggcatctcaaagacagcatcggctgcggacatcaagcgcgcatacaagaggctggcgctgcagtggcacccggacaagaacgtggagaaccgcgaggaggcggagaacatgttccgagagatcgccgccgcatacgaggtgcttagcgacgaggacaagcgtgtgaggtacgaccggggagaggacctggaggagatgggcatggggggaggcggcggcggcttcgacccgttcggcggaggcggtgggcagcagtacacgttccaccacggcggggggttccccggcggcggattccccggtggcttccagttcaacttcggttaaaggcaggccaggcttactgttttgtcactgctagtgagtagtgtggcgtggtctttgctttaggagggagagcttaacgacaacatgtgttgttaattatatatatctactagctaagagcttttactatctttgctcttactgttaaagaaagttttgctttattagtacctatacaacaagttttccctgagattaattgtactagtgtattatgattatagctggtgattcttctgtgatgcatcgaccagttgattaggaaaaaaaaaa

SEQ ID NO: 4485 - DNA, 1764 bp, Secale cereale
aacggggacggctaagatctactgaacggacggaaggaagaggcggacgccggcgacctcgacgagaggagatggcgtggcggctggcgctgccgctgctcctcttctactccccgatcctctgctcctcctccgttgatgtccaagacaataatgacccctccaaattgttcaagagcgcctccgagatgatgagcctaaggaaatacgacggggcgctcggcctgctaaacgctgtcctcgagatcgaccccaaccattccgaagcttacaggcagcgcgccacggtgctccgccacagatgcagacacaaggaagctgagagtgactacaacaaatacctggagatgaagcccgggactgcttcagtggagaaggaactagctcagctgctgcaggcccaaaacgcactagaatctgcttatacccagtctgatgctggggaattctctaaagtcctggagtacgtcaacaaaatcgtgctcgtcttttctcccggttgcttaaaggcaaagcttctcaaggctaaagcattgctagcactgaaagactattcgaatgttatttcggagacaggatttattctcaaggaagatgaagataacttggatgcgctgttacttcgtggtcgagcatactattaccttgccgatcatgatgttgccaacaggcactaccagaaaggcctacgtctagaccctgaacattcagaattgaagaaggcatattttgggctgaaaaaacttctgaagaagaccaagagcgcagaagataatgctgccaagagcaagtttcgcgtggctgttgaggactacaaggcagcactggcaatggatccagaccatactatgtacaacgtacaacttcatcttgggctctgtaagactctggttaaacttggaagaggcaaggaggcaatcaacacctgtacggaagcactcagcatagatgaagaacttgttgaagctctgtcacagagaggtgaagctaaacttctaacagaagattgggaaggtgcggttgaggacctaaaagaggctgcccagaaatccccacaggacatggcaatccgagaggcgctcatgaaagccgagaggcagctgaagctgagcaaaaggaaagactggtacaagatcctgggcatctcaaagacagcatcggctgcggacatcaagcgggcgtacaagaggctggcgctgcagtggcatccagacaagaacgtggagaaccgcgaggaggcggagaacatgttccgagagatcgccgccgcatacgaggtgcttagcgacgaggacaagcgtgtgaggtacgaccggggagaggacctggaggagatgggcatggggggaggcggcggcggcttcgacccgttcgggggaggcggtgggcagcagtacacgttccaccacggcggggggttccccggcggcggattccccggtggcttccagttcaacttcggttaaaggcaggccaggcttactgttttgtcactgctagtgagtagtgtggcgtggtctttgctttaggagggagagcttaacgacaacatgtgttgttaattatatatatctactagctaagagcttttactatctttgctcttactgttaaagaaagttttgctttattagtacctatacaacaagttttccctgagattaattgtactagtgtattatgattatagctggtgattcttctgtgatgcatcgaccagttgattggaaataaggtactattagtagtgtgtacaaaaaaaaa

SEQ ID NO: 4486 - DNA, 1676 bp, Triticum aestivum
gaagagatggcgtggcggctggcgctgccgctgctgctcttctacgcccccatcctcctctgctcctcctcccaagaagtccaagacaatgatccctccaaattgttcaagagcgcctccgagatgatgagcctaaggaaatacgacggagcgctcggtctgctgaacgctgtccttgagctcgaccccaaccattccgaagcttacaggcagcgcgcaacggtgcttcgtcacagatgcagacacaaggaagctgagagtgactataacaaattcctggagctcaagcctgggactgcttcagtggagaaggaactagctcagctgctgcaggctcaaaacgcgttggaatctgcttatagccagtctgatgctggagaattctcaaaagtcctggagtacgtcaataaaattgtgctcgtcttttctccaggttgcttaaaggcaaagcttctcaaggctaaagcgttgctagcactgaaagactattcaaatgttatttcggagacaggatttattctcaaggaagatgaagataacttggatgcactgttacttcgtggtcgagcatactattaccttgctgatcatgatgttgccaacaggcactaccagaaaggactgcgtctagaccctgaacattcagaattgaagaaggcgtattttgggttgaaaaaacttctgaagaagaccaagagcgcagaggataatgctgccaagagcaagttccgcgtggctgttgaagactacaaggcagcactagcaatggatccagaccacactatgtacaacgtacaactttatctcgggctatgtaagactctggttaaacttgggagaggcaaggaggcaatcaacagctgtacagaagcactcagcatagatgaagaacttgttgatgctttggcacagagaggtgaggctaaacttctaacagaagattgggaaggtgcggttgaggacctcaaagaggctgcccagaaatccccacaggacatggcaatcagagaggcgctcatgaaagctgaaaggcagctcaagctgagcaaaaggaaagactggtacaagatcctgggcatctcaaagacagcatcggccgcggacatcaagcgcgcgtacaagaggctggcgctgcagtggcacccggacaagaacgtggagaaccgcgaggaggcggagaacatgttccgagagatcgcctccgcatacgaggtgcttagcgacgaggacaagcgtgtgaggtacgaccggggagaggacctggaggagatgggcatggggggaggcggcggcagctttgacccgttcggcggaggcggtgggcagcagtacacgttccaccacggcggtgggttccccggcgggggcttccccggtggcttccagttcaacttcgggtaaaaagcaggccaggcttactgtttagttttgctgtcactgctagtgagtagtgtgtcgtggtcttttggtttaggagggagagcttaacgacaacatgtgttaattatatatatctagctaagagcttttaccatcttggctcttactctggttaaagaaagttttgctttagcaccaattatacaagaaattttccgtgagatgaattgtactagtgtattatgatttatagctggcgattctgtgatgcatcggccagttgattggaaaaaaag

SEQ ID NO: 4487 - DNA, 1528 bp, Triticum aestivum
tccaagacaatgatccctccaaactgttcaagagcgcctccgagatgatgagcctaaggaaatacgacggggcgctcggtctgctcaacgctgtcctcgagctcgaccccaaccattccgaagcttacaggcagcgcgcaacagtgcttcgtcacagatgcagacacaaggaagctgagagtgactataacaaattactggagctcaagcccgggactgcttcagtggagaaggaactagctcagctgctgcaggctcaaaacgcattggaatccgcttatagccagtctgatgctggagaattctcaaaagtcctggagtacgtcaacaaaatcgtgctcgtcttttctccaggttgcttaaaggcaaagcttctcaaggctaaagcgttgctagcactgaaagactattcgaatgttatttcggagacaggatttattctcaaggaagatgaagataacttggatgcgctgttacttcgtggtcgagcatactattaccttgctgatcatgatgttgccaacaggcactatcagaaaggcctacgtctagaccccgagcattcagaattgaagaaggcatattttgggttgaaaaaacttctaaagaagaccaagagcgctgaagataatgctgccaagagcaagtttcgcgtggctgttgaggactacaaggcagcactagcaatggatccagaccatactttgtacaacgtacaacttcatcttgggctctgtaagactctggttaaacttggaagaggcaaggaggcaatcagcacctgtacggaagcactcagcatagatgaagaacttgttgaagctttgtcacagagaggtgaggctaaacttctaacagaagattgggaaggtgcggttgaggatctaaaagaggctgcccaaaaatccccacaggacatggcaatccgagaagcgctcatgaaagccgaaaggcagctgaagctgagcaaaaggaaagactggtacaagatcctgggcatctcgaagacagcgtcggccgcggacatcaagcgcgcgtacaagaggctggcgctgcagtggcacccggacaagaacgtggagaaccgcgaggaggcggagaacatgttccgagagatcgcctccgcatacgaggtgcttagcgacgaggacaagcgtgtgaggtacgaccggggagaggacctggaggagatgggcatggggggaggcggcggcggcttcgacccgttcggcggaggcggtgggcagcagtacacgttccaccacggcggtgggttccccggcggcggattccccggtggcttccagttcaacttcggttaaaagcgggccaggcttactgtttagttttcctgtcccggtctttggtttaggagggagagcttaacgacaacatgtgttaattatatatatctagctaagagcttttactgtcttggctcttactctggttaaagaaagttttgcttaagcaccaattatacaacaaattttccctgagattaattgtactactgtattatgattta

SEQ ID NO: 4488 - DNA, 1571 bp, Avena sativa
ctatctatctatctaggcgggctcaactctcattctctcggacgccggcggtgcgaggcggcggtcgacggacggcgatggcgcgcccgtggcggctgatgctgccgctgctcctcctctactcccccatcgtcagctcccaagaagcccaagacaatgatccctccacattgttcaaacgagcatcggagatgatgagtctcaggaaatacgacggggcactcggtctgctgaatgctgtcttggaggttgacccgaatcattctgaagcttacaggcagcgcgcatcagtgctccgtcagagatgcagatacaaggaagctgagagtgattacaacaagtacctggagctaaagcctgggactgcttcggtggaaaaggagttgtctcagcttctgcaggctaaaatgcattggaaactgcttatacccaggctgatgctggagacttttcaaaagtcctggaatatgtcaataaaatcgtgcttgtcttttctccaggttgcttaaaggcaaaacttctcaaggctaaagcattgctagcgttgaaagactattcgagtgttatttcggagacaggttttattctgaaggaagatgaagataacttggatgcactgttgcttcgtggccgagcatactattaccttgctgatcatgatgttgccaacaggcactatcagaaaggcctccgtctagaccctgaacattcagaattgaagaaagcatactttgggttgaaaaaacttctgaagaagaccaagagtgctgaagataatgctgccaagagtaagttacgcatggctgctgaggactacaaggcagcactagcgatggacccagaccatactttgtacaatgtaaatctttatcttgggttatgtaaaactctggttaaacttggaagaggcaaggaggcaatcaccacctgtacagaagcactcagcatagatgaagaacttgttgacgctttggcacagagaggtgaggctaaacttctcacagaagattgggaaggtgcagttgaggacctaaaagaggctgcccagaaatcaccacaggacatgggaatccgagaagcatatatgaaagctgaaaagcagctcaagttgagcaaaaggaaagactggtacaagatcctcggcatttcaaagacagcatcagctgcagacatcaagcgcgcgtacaagaggctggcgttgcagtggcatccggataaaaaccaggagaaccgagaggaagcagaaaacatgtttcgagagatcgctgctgcatacgaggtgctcagtgacgaagacaagcgtgtaagatatgaccgaggagaggatctggacgagatgggtggaggaggtggcggcggtggattccacaacccgttcggaggaggcggtggccagcagtacacattccattacgacggtgggttccccggcggtggcggcgggggatttcccggaggctttcagttcaacttcggttaaaggaggcaggccaggctttactgatacatcttcttttcttgtcactgccatgctgttttaggaggagcttaacgacaggtgttaattatag

SEQ ID NO: 4489 - DNA, 1725 bp, Avena sativa
ggggtaagatctatctatccatctatctaggcgggctcaactctcattctctcggacgccggcggtgcgaggcggcggtcgacggacggcgatggcgcgcccgtggcggctgatgctgccgctgctcctcctctactcccccatcgtcagctcccaagaagcccaagacaatgatccctccacattgttcaaacgagcatcggagatgatgagtctcaggaaatacgacggggcactcggtctgctgaatgctgtcttggaggttgacccgaatcattctgaagcttacaggcaacgcgcatcagtgctccgtcagagatgcagatacaaggaagctgagagtgattacaacaagtacctggagctaaagcctgggactgcttccgtggaaaaggagttgtctcagcttctgcaggctaaaaatgcattggaaactgcttatacccaggctgatgctggagacttttcaaaagtcctggaatacgtcaataaaatcgtgcttgtcttttctccaagttgcttaaaggcaaaacttctcaaggctaaagcattgctagcgttgaaagactattcgagtgttatttcggagacaggttttattctgaaggaagatgaagataacttggatgcgctgttgcttcgtggtcgagcatactattaccttgctgatcatgatgttgccaacaggcactatcagaaaggcctccgtctagaccctgaacattcagaattgaagaaagcatactttgggttgaaaaaacttctgaagaagaccaagagtgctgaagataatgctgccaagagtaagttacgaatggctgctgaggactacaaggcagcactagcgatggacccagaccatactttgtacaatgtaaatctttatcttgggttatgtaaaactctggttaaacttggaagaggcaaggaggcaatcaccacctgtacagaagcactcagcatagatgaagaacttgttgacgctttggcacagagaggtgaggctaaacttctcacagaagattgggaaggtgcagttgaggacctaaaagaggctgcccagaaatcaccacaggacatgggaatccgagaagcatatatgaaagctgaaaagcagctcaagttgagcaaaaggaaagactggtacaagatcctcggcatttcaaagacagcatcagctgcggacatcaagcgtgcgtacaagaggctggcgttgcagtggcacccagataaaaaccaggagaaccgagaggaggcggaaaacatgtttcgagagatcgctgctgcatacgaggtgctcagtgatgaagacaagcgcgtaagatatgaccgaggagaggatctggacgagatgggtggaggaggtggcggcggtggattccacaacccgttcggaggaggcggtggccagcagtacacattccattacgacggtgggttccccggcggtggcggcgggggatttcccgggggctttcagttcaacttcgggtaaagcgggcaggacaggatttactgatgactgtcttcttttcttgtcactgccgtgctgttttagaaggagcttaacgacaggtgttaattatggggctttactgtctttctcactgttttggttaaagttttgtatcagctactacaattttcaccggaaatcatgttattgttataactgggcactttgtgatgaatctatcagttgaatggaaataatctaccgccaac

SEQ ID NO: 4490 - DNA, 1927 bp, Brachypodium distachyon
ccttccttcatcaccaccgccttgagcgtcatcgccgacggccgccgttccttccctcgtccgccgtttctggttctcactctcgatccgccccctgcccgcggagatgctacggccatggcggatgctgctgcccctgctcctcctctactcccccatcgtcttctcgcaagaagtccaagataatgatccctccacattgttcgaacgagcctcggagatggtgagcctgaggaaatatgacggagcgcttggcctgctgaatgcggtcttggaggttgacccgaatcattctgaagcttacaggcagcgtgcatcagtgcttcgtgacagatgcagatacaaggaagctgagagtgattataacaaatatctggagctaaagcctgggaccgctttagtcgaaaaggaattgtctcagctgctgcaggctcaaaatgcattagaatctgcttatggccagtctgatgctggagacttttcaaaagtcctggaatacgtcaaaaaaattgtgctcgtcttttctccaggttgcttaaaggcaaagcttctcaaagctaaagcattgctagcactgaaagactactcaagtgttatttcggagacaggatttattctgaaggaagatgaagataacttggaagcactgttacttcgtggtcgagcatactattaccttgctgatcatgatgttgccaacaggcactatcagaaaggcctccgtctagaccctgaacattcagaattgaagaaagcatattttgggttgaaaaaacttctgaagaagactaagagcgctgaagataatgctgccaagagtaagttacgtgtggctgctgaggactacaaggcagcactagcaatggatccagaccatactttgtacaatgtacatctttatcttgggctatgtaagactctggtcaaacttggaaggggcaaggatgcaatcaacagctgtacagaagcactcagcatagatggtgaacttgttgaagctttggctcagagaggtgaagctaaacttctctcagaagattgggaaggtgcggttgaggatctaaaagaggctgctcagaaatctccgcaggacatgggaatccgagaatcactgatgaaagctgagaggcagcttaagatgagcaaaaggaaagactggtataaaatccttggcatttcgaagacagcatcagccgcggacatcaaacgcgcgtacaagaagctggcgttgcagtggcatccagataaaaacgtagagaaccgagaggaagcggagaacatgtttcgggaaatcgcggctgcctacgaggtgctcagcgatgaagataagcgtgtaaggtatgatcgaggggaggatgtggatgagatgaatatgggaggaggaggaggaggtggtttcaacccctttgggggaggaggacagcaatacacattccattatgatggaggattccctgggggcggtgggggaggaggatttcctggaggctttcagttcaacttcggctaaagcaaagcagtctctcttattatatactgatactgatggatgatgtctttttgttgttgttgttttaggatctgagaggttttccgtttagcaaatcaccaattgattttcctatcaaattatatatcatcaatatatacgtcgggactgtggaccaacctgtcaatggaaatggaatggaaataagctagcagtttggtccagtgaaacgcagggcacgaggacatggcctctcttcttcatggcttcctccttgtttgccaccattttcgctgactatatattttttttcgaaaaggaaggaacattcccagcctctgcatcaatcgatgcagacagccaaaatattttttttcgctgactatatatatagctcgcagcttctggatatctcgatttttggataccgtgaacccc

SEQ ID NO: 4491 - DNA, 1704 bp, Festuca arundinacea
ggcacgagggacggacctctgagtctgaggtgggccgggcgaggcaaggagatccatcccgcttctatctgaggaggcggaggacgccggcgggcaggtgcggtcggcggagatggcgcgcccgtggcggctgatgctgccgctgctcgtcctatactcccccatcgtctactcgcaagaagcccaagataatgatccctctacattgttcaagcgagcatcagagatgatgagcctgaggaaatacgatggagcactcggtctgctgaatgctgtcttggaggttgacccgaatcattcggaagcttacaggcagcgcgcgtcggtgctccgtcagagatgcagatacaaggaagctgagagtgattataacaaatacctggagctaaagcctgggaccgcttcagtggagaaggaattgtctcagttgctgcaggctaaaaatgcattagaatctgcttatagccagtctgatgctggagacttctcaaaagtcctggagtacgtcaagaaaatcgtgctcgtcttttctccgggttgcttacaggcaaagcttctcaaggctaaagcgttgttagcactgaaagactattcgagtgttatttcggagacagggtttattctgaaggaagatgaagataacctagatgcactcttacttcgtggtcgagcatactattaccttgctgatcatgatgttgccaacaggcactatcagaaaggcctccgtctagaccctgaacatacagaattgaagaaagcatactttggattgaaaaaacttctgaagaagaccaagagtgctgaagataatgctgccaagagcaagttacgcatggctgctgaggactacaaggcagcactagcaatggacccagaccatactttgtataacgtaaatctttatcttgggctatgtaagacgctggttaaacttggaagaggcaaggaggcaatcagcagttgtacagaagcactcagcatagatgaagaacttgttgacgctttggcacagagaggtgaggctaaacttctcacagaagattgggaaggtgctgttgaagacctaaaagaggctgcccagaaatcaccacaggacatgggaatccgagaagcatatatgaaagctgaaaagcagctcaagttgagcaaaaggaaagactggtacaaaattctgggcatttcaaagacagcatcagctgcagacatcaagcgtgcgtacaaaaggctggcattgcagtggcatccggataaaaaccaggagaaccgggaggaagcagagaacatgtttcgagagatcgctgctgcatacgaggtgctcagtgacgaagacaagcgtgtaagatatgaccgaggagaggatctggacgagatgggtggaggaggtggtggtggcggattcaacccattcgggggaggcggtggccagcagtacacgttccattacgatggtgggttccccgggggcggtggcggcggaggatttcccggagctttcagttcaactttggttaaagcaggccaggctttactgatgacgtcttcttttcttgtcactgctatgctgttttaggagagcttaacgacagatgttaattatagggctttatttactgtcttgtcactacttgggttaaagttttgtagcacctacaatttttttttaccggaaatcatgttatattgcaaaaaaaaaaaaaaaaa

SEQ ID NO: 4492 - DNA, 1902 bp, Secale cereale
ctcgaatcgaatccaacggggacggctaagatctactgaacggacggaaggaagaggcggacgccggcgacctcgacgagaggagatggcgtggcggctggcgctgccgctgctcctcttctactccccgatcctctgctcctcctccgttgatgtccaagacaataatgacccctccaaattgttcaagagcgcctccgagatgatgagcctaaggaaatacgacggggcgctcggcctgctcaacgctgtcctcgagctcgaccccaaccattccgaagcttacaggcagcgcgccacggtgctccgccacagatgcagacacaaggaagctgagagtgactacaacaaatacctggagatgaagcccgggactgcttcagtggagaaggaactagctcagctgctgcaggcccaaaacgcactagaatctgcttatacccagtctgatgctggggaattctctaaagtcctggagtacgtcaacaaaatcgtgctcgtcttttctccaggttgcttaaaggcaaagcttctcaaggctaaagcgttgctagcactgaaagactattcgaacgttatttcggagacgggatttattctcaaggaagatgaggataacttggatgcgctgttacttcgtggccgggcatactattaccttgctgatcatgatgtcgccaacaggcactaccagaaaggcctacgtctagaccctgaacattcagaattgaagaaggcatattttgggctgaaaaaacttctgaagaagaccaagagcgcagaagataatgctgccaagagcaagtttcgcgtggctgttgaggactacaaggcagcactggcaatggatccagaccatactatgtacaacgtacaacttcatcttgggctctgtaagactctggttaaacttggaagaggcaaggaggcaatcaacacctgtacggaagcactcagcatagatgaagaacttgttgaagctctgtcacagagaggtgaagctaaacttctaacagaagattgggaaggtgcggttgaggacctaaaagaggctgcccagaaatccccacaggacatggcaatccgagaagcgctcatgaaagctgaaaggcagctgaagctgagcaaaaggaaagactggtacaagatcctgggcatctcaaagacagcatcggctgcggacatcaagcgcgcatacaagaggctggcgctgcagtggcacccggacaagaacgtggagaaccgcgaggaggcggagaacatgtccgagagatcgccgccgcatacgaggtgcttagcgacgaggacaagcgtgtgaggtacgaccggggagaggacctggaggagatgggcatgggtggaggcggcggcggcttcgacccgttcggcggaggcgtgggcagcagtacacgttccaccacggcggggggttccccggcggcggattccccggtggcttccagttcaacttcggttaaaaagcaggccaggcttactgttttgtcactgctagtgagtagtgtgtcgtggtctttgctttaggagggagagcttaacgacaacatgtgttgttaattatatatatctactagctaagagcttttactatctttgctcttactcttaaagaaagttttgctttattagtacctatacaacaaaatttccctgagattaattgtactagtgtattatgattatagctggtgattcttctgtgatgcatcgaccagttgattggaaataaggtactagtcctactcttagtagtgtgcatgcggaccttttttagtaaagacaaccaaaaacggaaaacgtaggctgctttagttggattggtaggttagtaacgaggtctatgaagcaagtttcttgaactggtagtcatggagtgcttgttct

SEQ ID NO: 4493 - DNA, 2379 bp, Oryza sativa
gttgagatgggaggaggggagtgaagtggaagaagattgccggttaacttgtggggtccacgtgggactcagccaccacatcaacaaaaccgaaaagcaatactaccttgggatcaaaagtgatccgatccggttttacaggattagaggtttcatggccttttaaactcaacaagaagttagggaaccttagatgaacttttttgggagatgaaaaattccagcctcatgggcctgtgcatatgacccataggcaggcgacgacctccgcctccccaatccgtcccggccgtctcctcgcccgccggccgccgccgatctccatcctgccagctgaggtggcgccggcgtcctcctgctcccgccgcattcgctcaccggtgagcatcctaatccatcccatccggcctcggcctcggcctcggatttcgcctcctcgcccgccgcttccgccgcgagcagaggtggcgcccggcgtcctcctgcttccaccgcatcgtcgctcgccgcaggcagaactaagagagcatggtggcgatggcgcggtggccgtggagggtgctgctgccgctgcttctccttcactcctcccccgtcttcttcgtcttcgctcaagaaggccaagataatgatccctctactttgttcaaacgagccttagaaatgatgaacctaaggaaatatgatggatcacttggtctgctaaatgctgtgctggaggttgaaccaaatcactcagaagcttacaggcagcgtgcatctgtgcttcgtcacaagtgcaggtacaaggaagcggagggtgactatagcaaatacctggagctaaaacctgggagttcttcagtggaaaaggaattatctcaactgcttcaggctcaaaatgcattagagtctgcttatggccagtttgagtctcatgacttctcaaaagtcctggattacatcaacaaaattgtgcttgttttttctccagactgcttaaaggcgaagcttctcaaggctaaagcattgctagcacttaaagactactcaactgttatctcagaaacaggatttattctgaaggaagatgaagataacctggatgccttgttgcttcgtggccgagcatattactaccttgctgatcatgatgttgcatccaggcactaccagaaaggccttcgtctagaccctgaacattcagaactgaagaaagcatattttgggttgaaaaatcttgtgaagaagactaagagtgctgaagataatgctgccaagggtaagctacgtgtgtctgctgaggactacaaggcatccctagcaatggatccagatcatacttcttacaatgtacatctttatcttgggctatgtaaggttctggttaaactcggaagaggcaaggaggctataagtagctgtacagaagcactcaacatagatggagaacttgttgatgcattaacacagagaggtgaagctaagcttcttacagaagactgggaaggagcggttcaggatctaaaagaggctgcccagaaatctccccaggacatgggaatccgagaagcactaatgagagctgaaaagcagcttaagttaagcaaaagaaaagattggtataagatccttggcatttcaaagacggcatcagctgcagagattaagcgtgcctacaagaagttggcactgcagtggcatccagataaaaatgtagataagcgagaagaagcagaaaacatgtttcgagaaattgctgcagcttatgaggttcttggggacgaagataaacgtgtaagatacgaccgaggagaggatcttgatgagatgaatatgggaggaggaggaggtggtggtttcaatccttttgggggaggtggccagcaatacacattccattacgatggtggattccatggaggaggaggattccccgggggcggctttcctggaggctttcagttcaactttggatagaaagtttactgcctgtggagttggtgtttgtatgtttgtttgtttgttttaggaacgctgataagcttaacaacaggtattgattgtaggcagtcaagccgatcgatcgagatgagcatcgtatacaagtgttgttttaagcaccatcaaattttcctcaagttgtatccttccttgggattttctgacgcatatgatccaattgaaataaacttagccttacagtggagctagctgtttcactttcactagccaaggatttgcgccgaaaccataaaaaccgaaggtccattccatgtattgtgatcggagtcggcacgtaacagaaaaactaaccaaaaaaaataacttaaatcctctgaagaaacatttgaaccactcgctggatcgtctagccatcagtcaaccatgagcgtgatg

SEQ ID NO: 4494 - DNA, 1961 bp, Setaria italica
cgaaaccctaacctccccagcggcgaggagctcgcggcaacagcacggcgcccaagcaagcggaggaggagggagggacaaggagcacataaaacagttcgtgttgcgtgcccacttagagcaagtttaataacgcagctagcaagcgggctgcaaggtttctcccagcctttttctagcccactcgtacaatggttagctcttcaccattaatacatggtccacaagtcattctcacaaagtttcttggttcctgtgtccaaatcggctctcgaacggaacggggaggaagacgagaaggagaagcagagggagcgccaaagctggagacggagatcatggtgcgggcatgggggcgggcggcgctgcctccgctcctcatcctctgcctcctccacctgcagtactccccgctggtcgtcgcccaagaaggtcaagaaaaagaccctgcaactctgttcgcacgagcctcggagatgatgaacctgaggaaatatgatggggcgcttggcctgctaaatgctgcgctggaagttgacccaaatcattctgaagcttacaggcaacgtgcatctgtgcttcgtcataagtgcagatacaaggaagctgagagcgactataacaaatacctggagctaaatcctgcgactgcttcagtggaaaaggaattatctcagcttctgcaggctcaaaattcattacagtctgcttatggtcagtttgattccggagacttttcaaaagtcctggaatacatcaacaaaattgtgctcgtcttttctccaggttgcttaaaggcaaagcttctcaaggctaaagcgttgctagcactgaaagattactcaagtgttatttcagagactggatttatcctaaaggaagatgaagacaacttggatgcgctgctactacgtggtcgcgcctactattaccttgctgatcatgatgtggcctctaggcactaccagaaagggcttcgtcttgatccagagcattcagatttgaagaaagcatatttcgggttgaaaaatcttttgaagaagactaagagtgctgaagataatgctgccaggggtaagctacgtgtgtctgctgaggactacaaggcagctctagcaatggatcctgaccatactgcttataatgtacatctttatcttgggttatgtaaaactctggttaaacttgggagaggtaaggaggccatcagcagttgtactgaagcactcaacatagacagcgatcttgttgatgcacttacacagagaggtgaagctaaacttctctcagaagattgggaaggagcggttcaagatctaaaagaggccgcccagaaatctccacaggatatgggcatccgcgaagcacttatgagagctgaaaagcagcttaagttgagcaaaagaaaagactggtacaaaatccttggtatttcgaagacagcatcagctgcagagataaaacgtgcctacaaaaagctggcattgcagtggcatccagataaaaacgttgataaccgggaggaagcagaaaacatgtttcgagaaattgccgctgcttatgaggtgcttggtgatgaagacaaacgtgtaaggtatgaccgtggagaggatatcgacgagatgaatatgggaggcggcggcggcggtggcttcaatccttttgggggaggcggccagcagtacacgtttcatttcgacggtgggttccccggcggcggcttccctggaggtggaggctttcagttcaacttttgataagctgtgttaggcacgatgacagtcatattgttttgccacagtggggttgttataggaactcttagtggtagctgataactattgttaggaaggcagagactgttcttatcattgtacacaaaatgttttgagggcagctacaatttttcccatacatccgctgaatgggaaaatggaaataaagtaccacatattttttct

SEQ ID NO: 4495 - DNA, 1771 bp, Pennisetum glaucum
gaggaggagaaagaagcagcagcggctcaaggaaggcttgaaagcggacgacggagcgccagaactggagacgggagatcatggcgcgggcggcgctgcctccgctcctccccatcctctgcctcctccacctgcagtactccccgctggtcgtcgcccaagaaggtcagaaaatgaccctgcaactctgttcgcacgagcctcggagatgatgaacctgaggaagtatgacggggcgcttggcctgctaaatgctgtgctggaagttgatccaaatcattctgaagcttacaggcagcgcgcatctgtgcttcgtcataaatgcagatacaaggaagctgagagcgactataaaaaatacctggagctaaatcctgcaacagcttcagtggagaaggagttatctcagcttctgcaggctcaaaattcattacagtctgcttatggtcagttcgattctggagacttttcaaaagtcctggaatacatcaacaaaattgtgctcgtcttttctccaggttgcttaaaggcaaagcttctcaaggctaaagccttgctggcattgaaagactactcaagtgttatttcagagacaggatttatcctaaaggaagatgaagacaacttggatgcgctgctactacgtggtcgcgcctactattaccttgctgatcatgatgtggcctctaggcactaccagaaagggcttcgtctcgatccagagcactcagatttgaagaaagcatatttcgggttgaaaaatctcttgaagaagactaagagtgctgaagataatgctgccaggggtaagctacgtgtgtctgctgaggactacaaggcagctctagcaatggatcctgaccatactgcttataatgtgaatctttatcttgggttatgtaaaactctggttaaacttgggagaggtaaggaggccatcagcagttgtactgaagcactcaacatagacagtgatcttgttgatgcacttacacagagaggtgaagctaaacttctctcagaagattgggaaggagcagttcaagatctaaaagaggccgcccagaaatctccacaggatatgggcatccgtgaagcacttatgagagctgaaaagcaacttcagctgagcaaaagaaaagactggtacaaaatccttggtatttcaaagacagcatcagccgcagagataaaacgtgcctacaaaaagctggcattgcagtggcatccagataaaaacgtggataacagggaggaagcagaaaacatgtttcgagaaattgctgctgcttatgaggtgctcggtgatgaagacaaacgtgtaaggtatgaccgtggagaggacgtcgacgatatgaacatgggaggaggtgggggtggcttcaatccttttgggggaggcggccagcagtacacgtttcatttcgacggtgggttccccggcggcggcttccctggaggcggaggctttcagttcaactttggataaagcctgtgttaggcacgatgacattgtttcgccactgtgggattgttatagggaaactcttagcggcagctgatgactattattgttaggaaggcagagattgttcttgtcattggacgcaaaaatgttttgagggcagctacaatttttccttcaacatttgcttcctgcctctggactatacataagctgaatgggaaaatggaaataaagtaccacatctttttttaactaaaaaaaaaaacgtaaaaaaaaaaaagttactactagtacgttagaact

SEQ ID NO: 4496 - DNA, 1714 bp, Echinochloa colona
taggacggaacggaaacaaagacaaggaggaagacgagaagcaacggcggcggtgagggagcgcgagacggagatcatggcgcgggcatgggggcgggcggcgctgcctccgttcctcatcctctgcctcctccacctgcagtgctccccgctggtcttcgcccaagaaggtcaagaaaaagaccctgctactctgttcgcgcgagcctcggagatgatgagccagaggaaattcgatggggcgcttggcctgctaaatgctgtgttggaagttgacccaaatcattctgaagcttacaggcagcgtgcgtctgtgcttcgtcatagatgcagatacaaggaagctgagagcgactataacaaatacctggaactaaatcctgggactgcttcagtggaaaaggaattatctcagctcctacaggctcaaaattcattacagtctgcttatagccagttcgattccggagacttttcaaaagtcctggaatacatcaacaaaattgtgctcgtcttttctccaggttgcttaaaggcaaagcttctcaaggctaaagcactgctagcactgaaagattactcaagtgttatttcagaggctggatttattctaaaggaagatgaagacaacttggatgcattgctactacgtggtcgcgcctactattaccttgctgatcatgatgtggcctccaggcactaccagaaagggcttcgtcttgacccagagcattcagatctgaagaaagcatatttcgggttgaaaaatcttttgaagaagactaagagcgctgaagataatgctgccaagggcaagttgcgtgtgtctgctgaggactacaagacagctctagcaatggatccagaccatacttcttataatgtacacctttatcttggcttatgtaaaactctggttaaacttgggagaggtaaagaggccatcagcagttgtacggaagcactcaacatagacagtgatcttgttgatgcacttacacagagaggtgaagctaaacttctctcagaggattgggaaggagcggttcatgatctaaaagaggcagcccagaaatctccacaggacatgggtatccgtgaagcacttatgagagctgaaaagcagcttaagttgagcaaaagaaaagactggtacaagatccttggtatttcaaagacagcatcagctgcggagataaaacgtgcctacaaaaagctggcgttgcagtggcatccagataaaaacgtggacaatagggaggaagcagaaaacatgtttcgagaaattgctgcagcttatgaggtgcttggcgatgaagacaaacgtgtaaggtatgaccgtggtgaggatgtcgatgagatgaatatgggaggaggcgggggtggcttcaatccttttgggggaggcggccagcagtatacgtttcattttgacggtgggttccccggcggcggcttccctggaggtggaggctttcagttcaactttgggtaaactgtgccagtcacgatgacattgtcttgccactgtggaattgttttaggaattcttcacggcagctgataactgttgttaggcaggctgagactgttcttaatagtgtaaagtgttcgagggcggctacaatttttccttaagcatttgcatctgccttggactttctcgccgatacataaatttaatggaaaaatgtcttgggcaaacaattcgaac

SEQ ID NO: 4497 - DNA, 1884 bp, Sorghum bicolor
tttctttcctttccttcctcgtaatggcgcatggccactctcctaatggcgcacggcggtgcggaagcagcgagatttcagttcctgaggcagaggaggaagaagagggatatgggattgggctgggctggagcaaagaacggaacggaaaccagggtggctgggtgggagagccggagacggagacggagaggcctccacgctccacggcgagtagaggagggagggagcgccactgcgccagagctggagacagagatcatggtgcgggcgtgggggcggacggcgctgcctccgctcctcatcctcggcctcctccgcctgcacttctccccgctggtcgtcgcccaagaaggacaagaaaaagaccctgctactttgttcgcgcaagcctcagagatgatgaacctgaggaagtatgatggggcgcttggcctgctaaatgctgtgttggaagttgacccaaatcattctcaagcttacaggcaacgtgcatccgtgcttcgtcataaatgcagatacaaggaagctgagagtgactataccaaacacctggagctgaatcctgggtctgcttcagtggaaaaggaactatcccagcttcttcaggctcaaaattcattacaatctgcttatggccagttcgattctggtgacttttcaaaagttgtggaatacatgaacaaaattgtgctcgtcttttctccaggttgcttaaaggcaaagcttctcaaggctaaagcattgctagcactgaaagactactcaagcgttatttcagagaccggattcattctaaaggaagatgaagacaacttggatgcactgctattacgtggtcgcgcctactattaccttgctgatcatgatgtggcctccaggcactaccagaaagggctccgtcttgatccagagcattcagaattgaagaaagcatattttgggttaaaaaatcttttgaagaagaccaagagtgctgaagataatgctgccaagggtaaactacgtgtgtctgttgaggactacaagacagctctagcaatggatccagaccatactgcttataatgtgcatctttatcttgggttgtgtaaaactctggtcagacttgggagaagtaaggaggcaatcagcagctgtacagaagcactgagcatagacagtgaacttgttgacgcacttacacagagaggtgaagctaaacttctctcagaagattgggaaggagcggttcaggatctaaaagaggctgcccagaaatctccacaggacatgggtatccgtgaagcacttatgagagctgaaaagcatcttaagttgagcaaaagaaaagactggtataaaatccttggtgtttcaaagacagcatcagctgcggagataaaacgtgcctacaaaaagctggcgttgcagtggcatccagataaaaacgtggataaccgggaggaagcagaaaacatgtttcgagaaattgctgctgcttatgaggtgcttggtgatgaagacaaacgtgtaaggtatgaccgtggagaggatgtggaggagatgaatatgggaggcgggggtggcttcaatccttttgggggcggcggccagcagtacacgtttcatttcgacggtgggttccccggcggtggcttccctgggggtggaggctttcagttcaactttggataaactgtgccatgtacgatgacattttcttcagttcccactggaattgctttaggaattcttaacagcagctggtagctattcttaggcaggctgagagactgttcttatatattacaataacaacccccccccccccacccctctctctctctctcacacacacacatcagttgaatggaagaatggaaataaagatacgtttttttg

SEQ ID NO: 4498 - DNA, 1996 bp, Oryza sativa
gatgaacttttttgggagatgaaaaattccagcctcatgggcctgtgcatatgacccataggcaggcgacgacctccgcctccccaatccgtcccggccgtctcctcgcccgccggccgccgccgatctccatcctgccagctgaggtggcgccggcgtcctcctgctcccgccgcattcgctcaccggtgagcatcctaatccatcccatccggcctcggcctcggcctcggatttcgcctcctcgcccgccgcttccgccgcgagcagaggtggcgcccggcgtcctcctgcttccaccgcatcgtcgctcgccgcaggcagaactaagagagcatggtggcgatggcgcggtggccgtggagggtgctgctgccgctgcttctccttcactcctcccccgtcttcttcgtcttcgctcaagaaggccaagataatgatccctctactttgttcaaacgagccttagaaatgatgaacctaaggaaatatgatggatcacttggtctgctaaatgctgtgctggaggttgaaccaaatcactcagaagcttacaggcagcgtgcatctgtgcttcgtcacaagtgcaggtacaaggaagcggagggtgactatagcaaatacctggagctaaaacctgggagttcttcagtggaaaaggaattatctcaactgcttcaggctcaaaatgcattagagtctgcttatggccagtttgagtctcatgacttctcaaaagtcctggattacatcaacaaaattgtgcttgttttttctccagactgcttaaaggcgaagcttctcaaggctaaagcattgctagcacttaaagactactcaactgttatctcagaaacaggatttattctgaaggaagatgaagataacctggatgccttgttgcttcgtggccgagcatattactaccttgctgatcatgatgttgcatccaggcactaccagaaaggccttcgtctagaccctgaacattcagaactgaagaaagcatattttgggttgaaaaatcttgtgaagaagactaagagtgctgaagataatgctgccaagggtaagctacgtgtgtctgctgaggactacaaggcatccctagcaatggatccagatcatacttcttacaatgtacatctttatcttgggctatgtaaggttctggttaaactcggaagaggcaaggaggctataagtagctgtacagaagcactcaacatagatggagaacttgttgatgcattaacacagagaggtgaagctaagcttcttacagaagactgggaaggagcggttcaggatctaaaagaggctgcccagaaatctccccaggacatgggaatccgagaagcactaatgagagctgaaaagcagcttaagttaagcaaaagaaaagattggtataagatccttggcatttcaaagacggcatcagctgcagagattaagcgtgcctacaagaagttggcactgcagtggcatccagataaaaatgtagataagcgagaagaagcagaaaacatgtttcgagaaattgctgcagcttatgaggttcttggggacgaagataaacgtgtaagatacgaccgaggagaggatcttgatgagatgaatatgggaggaggaggaggtggtggtttcaatccttttgggggaggtggccagcaatacacattccattacgatggtggattccatggaggaggaggattccccgggggcggctttcctggaggctttcagttcaactttggatagaaagtttactgcctgtggagttggtgtttgtatgtttgtttgtttgttttaggaacgctgataagcttaacaacaggtattgattgtaggcagtcaagccgatcgatcgagatgagcatcgtatacaagtgttgttttaagcaccatcaaattttcctcaagttgtatccttccttgggattttctgacgcatatgatccaattgaaataaacttagccttacagtgga

SEQ ID NO: 4499 - DNA, 1515 bp, Avena sativa
caggaaatacacggggcactcggtctgctgaatgctgtcttggaggttgacccgaaccattctgaagcttacaggcaacgcgcatcagtgctccgtcagagatgcagatacaaggaagctgagagtgattacaacaagtacctggagctaaagcctgggactgcttccgtggaaaaggagttgtctcagcttctgcaggccaaaaatgcattggaaactgcttatacccaggctgatgctggagacttttcaaaagtcctggaatatgtcaataaaaccgtgcttgtcttttctccaagttgcttaaaggcaaaacttctcaaggctaaagcattgctagcgttgaaagactattcgagtgttatttcggagacaggttttattctgaaggaagatgaagataacttggatgcactgttgcttcgtggtcgagcatactattaccttgctgatcatgatgttgccaacaggcactatcagaaaggcctccgtctagaccctgaacattcagaattgaagaaagcatactttgggttgaaaaaacttctgaagaagaccaagagtgctgaagataatgctgccaagagtaagttacgcatggctgctgaggactacaaggcagcactagcgatggacccagaccatactttgtacaatgtaaatctttatcttgggttatgtaaaactctggttaaacttggaagaggcaaggaggcaatcaccacctgtacagaagcactcagcatagatgaagaacttgttgacgctttggcacagagaggtgaggctaaacttctcacagaagattgggaaggtgcagttgaggacctaaaagaggctgcccagaaatcaccacaggacatgggaatccgagaagcatatatgaaagctgaaaagcagctcaagttgagcaaaaggaaagactggtacaagatcctcggcatttcaaagacagcatcagccgcagacatcaagagagcgtacaagaggctggcgttgcagtggcacccagataagaaccaggagaaccgagaggaagcagagaacatgtttagagagatcgctgctgcctacgaggtgctcagtgacgaagacaagcgcgtaagatatgaccgaggagaggatctggacgagatgggtggaggaggtggcggcggtggattccacaacccgttcggaggaggcggtggccagcagtacacgttccattatgatggtgggttccccggcggtggcggcgggggatttcccggaggctttcagttcaacttcggttaaaggaggcaggccaggctttactgatacatcttcttttcttgtcactgccatgctgttttaggaggagcttaacgacaggtgttaattatagggctttactgtctttctcactgctttggttaaagttttgtatcagctactacaattttctaccggaaatcatgttactgttatatctgggcactttgtgatgaatctatgagttgaatggaaataatctaccagtactttgctaaa

SEQ ID NO: 4500 - DNA, 2270 bp, Arabidopsis lyrata
gagagaaatcaaattaccttcagatcttgaccttccacagaacacactctctctctatctctcttcttcttctcttcttcctcgctctcttcttcgctctctctctttgttccatttgcttcctgtaatcttcgtcaagaagccgaagaagagagaaaccaatccaaagttcctgactttaaagctacccagaagaacccaaatctcaggtactttggctgttgatttgatctgggcactgcttattagggatttgatttttcacatctggatctacaaattctccgttctgggttacttcaatttcacggatatggtgaggattcagaaagtagaatcgttctacgcgaagcttcgtgagtcagctacttcattatcttcacagaatccacttttgatatttccttcaacatctgatgttgattcactttgtgcgcttaaggttattactcatatcctcgaatcagattcgattcagtattcttgtttccctgtatcgtcttttttggagattcacaagtatgctggtcctgctggtttgtgttctacttcgtctgagtctcctcctgttactatactgttgattaattggggttgtcaccgtgatttgaagctcgtgttgaagttaggtcccgcggctcgtgtttttgttgttgatagtcataggcctattcatttgcataatcttagtgattataatgagcaagttgttgttcttcatactgatgatgatgagagacaagctgatttggcttatgatttcgatgtgttgaaattggcgaacgagagctttcagttacatgtagaagaagggggtgaatctgatgaggaggaggaggaggaagaagatgaggaagaggaagatgaggatgatgatgatgatgatggagatggtgataggccaagtaagaggagaaaaatgggagatggtgtgaaggttttcaagaagttaaagagggattattacaagatggggacttttcatgggaagccatcgggatgtttgttgtttgagctatctcatatgttgaggaagaacacaaatgagttgctgtggctggcttgtgttgctttgactgatcagtttgttcatgagaggttgactgatgaaagataccaagctgcggttatggagcttgaacaacacatcaatagctcagggaatatagataagatcacttctgttactttgaaagatggaaccaaggttcgagcacctgactgttcgagaatctcttatgaagaagagcctaggcttatgcttctcagggagtggacgttgtttgactctatgctttgttcttcatacattgcgactaagttgaagacatggagcgataacggcatcaagaaacttaagcttcttctagcacgtatgggatttgcgcttatcgagtgccagcaaaagtttccatacatgagccatgaggtgaaaaggaaaatgaagcaagagtttgatcggtttttgccagaatatgggcttaatgatttctactaccggagtttcttgaggcttcatggttatagctcaagggtctctgctgcagatgttgtgtatggtattacagcacttcttgaatcatttcttggatcaggtggctcctctgcttcaaaacagtttggcgaagcttatgatgctctgtctttgaacaatttggataaacttcggtctgggatgcaacaagcaatcaaggttcaacgagcaattcttagacaaggaagtgcagcaatcaccaaaactggatgcatccgaagtggtaggaaattcagatgggtaaagattgaagattccatggatgctaagtatttgggatatcctcaggccttaacaaaattttgttactttctaatggatgctttgagagagaaaggagctaggatgaaaccgatgctttgtgcctgtgcatctcaacaacctgggaagttactcgtggttggagtttgtgggaaaccgaggctcggggcagtcagagggaacgcttttggcaatgctttcagaaaggcagctcaagaaagtagagctgattactttcacgagcttttcgagtcttcatggattgtcttggatgcttctgcagttaactctttcatgattagattaactgagaagctctgacataggaataggaaggactcatgatatcttatcgttcttcgattcaatgtgttttcttttacagttttcagtttttatctcactgttttcattttttacgagcctgtgtaataggcagaatctgttatcaatcatgtaacttgtttaatcaaat

SEQ ID NO: 4501 - DNA, 2317 bp, Brassica rapa
actcccactccgtagatgcgatccacaaagaatccttccctccttcagcgccaacgtcaatattttggcggtcgatcaaaaaacatttcgaaatttaaagattttaacccccaaaacttttcaaaccatttcaatccctgacgaaatatacacctcaaccagatcttcatcttcctcacacattctctctctcctctctctctccatctttgttcattttgcttgttgtgattcgctccagagacaactcgaatctcagttactttgtctgtgtttcttctctctctctctctcaatccctcagagaaaattagggttcgatttagggcttttctctacacaatccgaatccaatttctgtgcgaaacccagtttcactgatatggtgaggatccagaaagtagaatccttttacgccaagctccgcgaatcagccacttcctccgattcacacaaccctcttctgatattcccttcctcatccgacgtcgactcgatctgcgccctcaaggtcatcactcacatcctcgaatccgattcgattcagtactcttgtttccccgtctcgtcgtttctcgagatccacaagtacgcaggtcctgggctctgttcttccttggagagtcctgtgactatacttttgattaattggggttgtcaccgtgatttgaagcttgttcttaagctaggtcctaaggctcgtgtctttgtggtggatagtcataggcctattcatttgcataacctgagcgatggtaatgagagggttgttgttcttcatactgatgatgatgagaggcaagcggatttagcttatgattttgatgtcttgaagttggctaatgagagttatcagatgcgtcaagaaagtgttggtgttgatgaaagtgaagacgaggatgaagaagaggaggaggaggaggaagagagtgatgatggtgataggccaagtaagaggaggaagatgggtgatgatggtgtgaagctttttaagaagctaaagagagattactacaagatggggactttccacgggaagccatctggttgcttgctctttgagctgtctcattttttaaggaagaacactaacgagttgctctggctggcttgcgtttccttgactgatcagttcgttcacgagaggctaaccgacgagagataccaagccgcggtgatggagctcgagcagcacatcaacagctccgggaacatagataaagtcacgtccgttactttaaaagacggaaccaaggttcgagcgccagactgttcgagaatctcttacgaagaggagcctaggcttatgctcctgagagagtggaacttgtttgactccatgctctgctcctcgtacatagcgacgaagctcaagacttggagtgataacgggatcaagaagctgaagcttcttctagcgcgtatggggttcgcgctcatcgagtgccagcagaagtttccctacatgaacaacgaggtgaagaggaaaatgaagcaagagtttgatcggtttttgcctgagtatggtttaaatgatttctactacaggagtttcttgcggcttcatggatacagctcaagggtctctgctgctgatgttgtgtacggtatcacagcgcttcttgagtcgtttcttggttcaggtggctcttctgcttcacagcagtttggagaagcttatgatgctttgtcgttgaacaatcttgataagcttcggtccgggatgcagcaagcaatcaaggttcaaagagcgattctcagacaaggaagtgcagcaatcaccaagacaggatgcatcagaagtggaaggaagttcagatgggtgaaggttgaggattctattgacgctaagtatttgggatatcctcaggctttgacaaagttttgttactttctgatggatgctttgagggagaaaggagctaggatgaaaccgatgctatgtgcctgcgcatctcaagagctagggaagatacttgtggttggagtttgtgggaagccgaggcttggtgcggtaagagggaatgcgtttggtaatgcttttagaaaagcagctcaagagagtagagccgattactttcatgagctgtttgagtcttcgtggatcgtcttagatgcttctgctgttaactctttcatgattagattaactgagaacctttgacatatgactctcaactctcaaggtatctttttgttattcaactcagagtgtttttcttttaccagtttacagtttatttatctcacattgtttggaaatttacgagagtttgtaataggcagaatctgttatcaatcatgtaacttgtttaat

SEQ ID NO: 4502 - DNA, 1827 bp, Eutrema parvulum
tccaatttcacggaaatggtaagaatccagaaagtagaatcgttctatgctaagcttcgtgaatctgctacttcgtcgtcttctcagaatccacttctgatattcccttcatcatctgacgtcgattcgatttgtgcgctcaaggtcataactcacgtcctcgagtcggattcaattaagtattcgtgtttccccgtatcttcgtttctggaaatccacaaacacgctggtcctgggctgtgttcttcttcggagaatcctgtgaccatactgttgattaactggggttgtcaccgtgatttgaaggttgtgctcaagttaggtcctgcggctcgtgtctttgtggtagatagtcatcgacctattcatttgcataatctgagtgatcagaatgagcaggttgttgttcttcacaccgatgatgatgagaggcaagcagatctggcttatgatttcgatgtgtcgaaattggcgaacgagagctttcagattcataaagaaagagctgatgctggtgaatctgatgttgaaaacgaaagtgatgaagaagaagaagaagaggaggaggaagaagaagagagtgatgatggagatggtaatagaccaagtaagaggagaaaattgggtgatggtgtgaaggttttcaaaaagctaaagcgggattattacaggatggggactttccatgggaagccatctggatgcttgttgtttgagctatctcatctgttgaggaagaacacaaatgagttgctgtggctggcttgtgtttccttaactgatcagtttgttcacgagaggctcactgatgaaagataccaagctgcagtaatggagcttgagcaacacatcaatagctcaggaaacatagacaagatcacctctgttactttgaaagatggaaccaaggttcgagcaccagactgctcaagaatctcgtatgaagaagagcctcggcttatgcttctcagggagtggaatttgtttgattccatgctttgttcctcatacattgcaactaaactgaagacatggagcgataatgggatcaagaaacttaagcttcttctagcacgtatgggatttgcgcttatcgagtgccagcaaaagtttccgtacatgaacaacgaggtgaagaggaaaatgaagcaagagtttgatcggtttttgccagagtatgggctaaatgatttctactacaggagtttcttgcgtcttcatggatacagctcaagggtctctgccgcagatgttgtgtatggtattacagcacttcttgaatcatttctcgggtcaggtggctcctctgcttcaaaacaatttggcgaagcttacgatgctctgtccttgaacaatctggataaacttcgatctgggatgcaacaagcaatcaaggtccaacgagcaattcttagacaaggaagtgcagccatcaccaaaaccggatgcatcagaagtggtaggaaattcagatgggtcaaggttgaggattccattgatgctaagtatttgggatatcctcaagctttgacgaaattctgttactttctaatggatgctttgagagagaaaggagctaggatgaaaccgatgctatgtgcctgcacatctcaacaaccagggaagatacttgtggttggagtttgtgggaagccgaggctcggtgcggtcagagggaatgcctttggcaatgctttcagaaaagcagctcaagagagtagaactgattactttcacgagctattcgagtcttcgtggatagtcttggatgcttctgcggttaactctttcatgattagattaactgagaagctttgacatacgact

SEQ ID NO: 4503 - DNA, 2307 bp, Brassica oleracea
gctccgtggatgcggatcgttccctcctctttcctcaattttcagcgccaacgtcaaagttttggcggccgatcaaaaatatttcgaaatttttgaagattttaacctccaaaattaaaagaattctaaacatttcattacgagagaagaagaagaagaagaaagatacctcctgcccccagatctttatcttcctctctctctctctctccatctttgcttgatttgatttacttcagtctaattaggaacctaaaaaaaaaattcagagaagaagtcgaatctcaggtactttttggctgcggtttctgctatctctcatctcaatcctattcagggtaaaaaaattagggctctctaaagcttagtgggcgaataatggtgaggatccagaaagtagaatcgttttacgccaagcttcgcgaatcggcgacttgctcgtcttcccagaaccctctcctcatattcccttcatcatccgacgtcgattccatttgcgccctcaaggtcataactcacatcctcgaatccgattcggttcactactcgtgtttccctgtctcctcgtttctcgagatccacaagtacgctggtcctggcctctgctcttcctcggcgagtcccgtcaccatactgttgattaactggggctgccaccgtgatctgaagcttgtgctgaagctaggtcccgcggctcgtgtctttgtggtggatagtcaccggcctattcatttgcataatcttagcgatgagaatcagcaggttgttgttctccacactgatgatgatgagaggcaagcggatctcgcctacgatttcgatgtcttgaaattggccaacgagagctttcagattcatcaagaaagcggtgatgaatctgatggcgaagaagacgaaagtgatgatgataggccaagtaagaggaggaaaatgggtgacggtgtgaagcttttcaagaagctgaagagggattattacaagatggggactttccacgggaagccatctggttgcttgttgtttgagctgtctcacttgttgaggaagaacactaacgagttgctctggctcgcttgtgtttccttgactgatcagtttgttcacgagaggttgaccgacgaaagataccaagctgcggttatggagcttgagcagcacatcaatagctccgggaacatagacaagatcacttccgttactctcaaggacggaaccaaggtccgagcgcctgactgttcgagaatctcttacgaagaagagcctaggcttatgctgctgagagagtggaatctgtttgactccatgctttgttcctcgtacatcgctactaaactcaagacgtggagtgataacgggatcaagaaacttaagcttcttctagcgcgtatgggatttgcgcttatcgagtgccagcagaagtttccctacatgaacaacgaggtgaagaggaagatgaagcaagagtttgatcgttttttgccagagtatgggcttaatgatttctactacaggagtttcttgcgccttcatggatacagctcaagggtctctgctgctgatgttgtctatggtattacagcgcttcttgaatcgtttctcggttcaggtggctcctctgcttctaaacagtttggagaagcttatgacgctttgtcattgaacaatctggataaacttcgttctggtatgcaacaagcaatcaaggttcagagagcaattctcagacaaggaagtgcagcaatcaccaaaaccggatgcatccgaagtggaaggaagttcagatgggtgaaggttgaggattccattgatgctaagtatttgggatatcctcaggccttgacaaagttctgttactttctaatggatgctctgagagagaaaggagctaggatgaagccaatgctatgtgcctgcgcatctcaacaaccagggaagatacttgtggttggagtttgtgggaagccaaggcttggtgcagtaagagggaatgcgtttggtaatgctttcagaaaagcagctcaagagagtagagctgattactttcacgagcttttcgagtcctcatggatcgtcttggatgcttctgctgttaactctttcatgattagattaactgaaaagctttgacatagagttctcaaaggtatctttttgttattctactcaattgtgttttttcattttctagttttcagttctttttttatctcacattgtttggaattttacaagcctttataataggcaagaatccgttatcaatcatgtaacttgtttaatcaaataacaatagagcattatgtcaaa

SEQ ID NO: 4504 - DNA, 2048 bp, Eutrema halophilum
tcttccaccatttctggataatattagggttcttattagcagggtttttagggattttgttctgggtaaactccaatttctaaggatatggtgagaatcgagaaagtagaatcgttctatgctagacttcgtgaatcagctacttcgccgtcttctcagaatccacttatgatattcccttcatcgtctgatgtcgattcaatctgtgcgctcaaggtcataactcacatcctcgaatcagattcgattcaatactcgtgtttccctgtatcgtctttctcggatatccaaaaatccacgaacgggtcgctgtgttcttcgtcggagagtcctgtgactatactgttgatcaactggggttgtcaccgtgatttgaaggttgtgcttaagctaggtcctgcggctcgtgtctttgtggtggatagtcaccgacctattcatttgcataacctgagtgaacagaatgagcaggttattgttcttcacaccgatgatgatgagaggcaagcagatctggcttacgattttgatgtgttgaaattagcgaacgagagctttcagctacatgtagaaagagaagaatctgatgtcgaaagtgatgaagaagaagaagatgaggaggaagaggaggatgaggaggaagaagagagtgatggtgataggccaagtaagaggagaaaaatgggagatggtgtgaaggtttttaagaagctaaagagggattattacaggatggggactttccatgggaagccatctggatgcttgctgtttgagctatcacacatgttgaggaagaacacgaacgagttgctttggctggcttgtgtttctttaaccgatcagtttgttcacgagaggttgactgatgagagataccaagctgcggtgatggagcttgagcaacacatcaacagctcggggaacatagacaagctcacttctgttactctgaaagacggtaccaaggttagagcaccagactgctcaaggatctcttacgaagaagagcctaggcttatgcttctgagggagtggacgttgtttgactctatgctttgttcctcgtacatcgcaattaaattgaagacatggagtgacaacgggatcaagaaactcaagcttcttctagcacgtatgggatttgcgcttatcgagtgccagcagaagtttccttacatgagccacgaggtgaaaagaaaaatgaagcaagagtttgatcggtttttgccagagtacggtctaaacgatttctactacaggagtttcttgcggcttcatggatacagctcaagagtctctgctgcagatgttgtgtacggtatcacagcacttcttgaatcgtttctcgggtctggaggctcctctgcttcgaaacagtttggtgaagcttatgatgctctgtctttgaacaacttggataagcttcgatccgggatgcaacaagcaatcaaggttcaacgagcgattcttagacaaggaagtgcagcgatcaccaaaaccggatgcatacgaagtggaaggaaattcagatgggtgaagattgaggattccattgatgctaagtatttggggtatcctcaggcgttgacgaagttctgctactttctaatggacgctttgagagagaaaggagctaggatgaaaccgatgttatgcgcttgcgtgtctcaagaaccagggaagatacttgtggtcggagtttgtgggaagccgaggctcggtgcggtaagaggcaatgcctttggtaatgctttcagaaaagcagctcaagaaagtagagctgattactttcacgagctatttgagtcttcatggatcgtcttagatgcttctgcggttaactctttcatgattagattaactgagaagctctgacatagaactcggtaaatctttttttcttattcgattcagtgtgtttattttctagttctcaaattttatctcacattgtttgcatctttacgagcagaatctgttatcaaccttgtaacttgttttacttaatcaaataaccatagtgttatgttaaaatgatttgtcct

SEQ ID NO: 4505 - DNA, 2394 bp, Brassica oleracea
gtatataataaacccacggtccagatcactcccactccgtagatgcgatccacaaagaatccttccctcctttagcgccaacgtcaatattttggcggtcgatcaaaaaacatttcgaaatttaaagattttaacccccaaaacttttcaaaccatttcaatccctgacgaaatatacacctcaaccagatcttcatcttcctcacacattctctctctctctctctccatctttcttcattttgcttgatgtgattctcttcagatacaactcgaatctcagttactttgtcagtggttcctgctctctccctctctctctctctctctctctcaatattctgggccatttctggagaaaattagggttcgatttagggcttttttcttcacaatccgaatccaatttctgtgcgaaacccagtttcactgctatggtgaggatccagaaagtagaatccttttacgccaagcttcgcgaatcagccaattcctccgattcacagaaccctcttctgatattcccttcctcatccgacgtggactcgatctgcgccctcaaggtcatcactcacatcctcgaatccgattcgatccagtactcgtgtttccccgtctcttcgtttctcgagatccacaagtacgcaggccctgggctgtgctcttcctcggagagtcccgtgactatacttttgattaactggggctgtcaccgtgatttgaggctcgtgcttacgctaggtcctaaggctcgtgtctttgtggtggatagtcataggcctattcatttgcataatctgagcgatggtaatgagagcgttgttgttcttcacactgatgatgatgagaggcaagcggatttagcttatgattttgatgtcttgaagttggctaatgagagttatcagatgcatcaagaaagtgctgatgttgatgaaagtgaagaagaggaggaggaggaggaggaagaagagagtgatggtgatagtgataggccaagtaagaggaggaagatgggtggtgatggtgtgaagcttttcaagaagctgaagagggattactacaagatggggactttccatgggaagccatctggatgcttgctctttgagctctctcacatgttgaggaagaacactaacgagttgctctggctggcttgcgtttccttgactgatcagttcgttcacgagaggctaaccgacgagagataccaagctgcggtgatggagctcgagcagcacatcaacagctccggtaacatagataaagtcacttccgttactctaaaagacggaaccaaggttcgagcgccggactgttcgagaatctcttacgaagaagagcctaggcttatgctcctgagagagtggaacttgtttgactccatgctttgctcctcgtacatcgcgaccaagctcaagacgtggagcgataacgggatcaagaagcttaagcttcttctagcgcgtatggggttcgcgcttattgagtgccagcagaagtttccgtacatgaacaacgaggtgaagaggaaaatgaagcaagagtttgatcggtttttgcctgagtatggtttaaatgatttctactacaggagcttcttgcggcttcatggatacagctcaagagtctctgctgctgatgttgtctacggtattacagcgcttcttgaatcgtttcttggttcaggtggctgctctgcttcacagcagtttggagaagcttatgatgctttgtccttgaacaatcttgataagcttcggtccgggatgcagcaagcaatcaaggttcaaagagcgattctcagacaaggaagtgcagcaattaccaagacaggatgcatcagaagtggaaggaagttcagatgggtgaaggttgaggattccattgacgctaagtatttgggatatcctcaggctttgactaagttctgttactttctgatggatgctttgagggagaaaggagctaggatgaaaccgatgctatgtgcctgcgcctctcaagagctagggaagatacttgtggttggagtttgtgggaagccgaggcttggtgcggtaagagggaatgcgtttggtagtgcttttagaaaagcagctcaagagagtagagctgattactttcatgagctgtttgagtcttcgtggatcgtcttagatgcttctgctgttaactctttcatgattagattaactgagaacctttgacatatgactctcaactctcaaggtatctttttgttattcaactcaagagtgtttttcttttaccagtttacagtttatttatctcacattgtttggaaatttacgagactttgtaataggcagaatctgttatcaatcatgtaacttgtttaatcaaataaccaaagaggtttatgtgaaa

SEQ ID NO: 4506 - DNA, 2019 bp, Brassica rapa
tctcaatcctattctgggaataatggtgaggatggagaaagtagaatcgttttacggcaagcttcgcgaatcggccacttgctcgtcttcccagaaccctctcctcatattcccttcatcctccgacgtcgattccatctgcgccctcaaggtcatcactcacatcctcgaatccgattcggttccctactcctgtttccctgtctcctcgtttctcgagatccacaactacgctcctcctgcggaaggccccgtcaccatactcttgattaactggggctgccaccgtgatctgaagcttgtgctcaagctagctcccgctgctcgtgtctttgtggtggatagtcaccgccctattcatttgcataatctcagcgacgagaatcagcaggttgttgttctccacactgatgatgatgagaggcaagcggatctcgcctacgatttcgatgtcttgaaattggccaacgagagctttcagatgcatcaagaaagcggtgttgatgaatctgatgacgaagaaagtgatgatgatgaagaagagagtgaggatgataggccaagtaagaggaggaaaatgggtgtgaagcttctcaagaagctgaagagggattattacaagatggggactttccacgggaagccatctggttgcttgttgttcgagctctctcacctgttgaggaagaacaccaacgagttgctctggctcgcttgcgtttccttgactgatcagttcgttcacgagaggttaaccgacgagagataccaagctgcggttatggagcttgagcagcacatcaatagctccgggaacatagacaagatcacttccgttactctcaaggacggaaccaaggtccgagcgcctgactgttcgaggatctcttacgaagaagagcctaggcttatgctgctgagagagtggaatctgtttgactccatgctttgctcctcctacatcgctactaaactcaagacctggagtgataacgggatcaagaaacttaagcttcttctagcgcgtatgggttttgcgcttatcgagtgccagcagaagtttccgtacatgaacaacgaggtgaagaggaagatgaagcaagagtttgatcgttttttgcccgagtatggccttaatgatttctactacaggagtttcttgcgtcttcatggatacagctcacgggtctctgcagctgatgttgtctacggtattactgcgcttcttgaatcgtttcttggttcaggtggctcctctgcttctaaacagtttggagaagcttatgatgctttgtcattgaacaatctggataagcttcgttctggtatgcaacaagctatcaaggtacaaagagcaattcttaggcaaggaagtgcagcaatcaccaaaacaggatgcatccgaagtggaaggaagttcagatgggtgaaggttgaggattccattgatgctaagtacttgggatatcctcaggccttgaccaagttctgctactttctaatggatgctctgagagagaaaggagctaggatgaagccgatgctatgtgcctgcgcatctcaacaaccagggaagatacttgtggttggagtttgtgggaagccgaggcttggtgcagtaagagggaatgcgtttggtaatgctttcagaaaagcagctcaagagagtagagctgattactttcacgagcttttcgagtcctcatggatcgtcttggatgcttctgcggttaactctttcatgattagattaactgaaaagctttgacatagagctctcaaaggtatctttttgttattctactcaaattgtgtgtttttcattttctagttttcagttcttttttatctcacattgtttggaattttacaagcctttataataggcaagaatccgttatcaatcatgtaacttgtttaatcaaataacaatagagcattatgtggaaacgattgatcccttgactcgtatggtgttaacagaaataaagttcttatttcttaacagctcttatgtca

SEQ ID NO: 4507 - DNA, 1453 bp, Panicum virgatum
cccacccatccatccaccacccatccgatccgcccgtgacccctgctctgtccacactcgctcgcaccaatccagtcatccaccactcgctcgctcgctcgtcgcggcgcggcggcggcggcaaggcaatggcgctggcctccacctacgcaccgggcggcggcgcgggggcgctcgcgccgggaagggccagggtccgcgcgcccgccggggggcccgtcctcggcccctccaaggccggcggcctccccgccccctcgccctcgccaggcggagcccccgctcgcggccgccgccaggctgcggtgcgcggcgtcctcgtcgcctgcggcccccgcgcggcccgtcacggcgccgcggttcatccagcacaagaaggaggccttctggttctaccgcttcctctccatcgtctacgaccacgtcatcaacccgggccactggaccgaggacatgcgcgacgacgcgctcgagcccgccgacctctacagccgccacctcaaggtcgtcgacgtcggcggcggcacgggcttcaccacgctcgggatcgtcaagcacgtcaacccggagaacgtcacgctgctcgaccagtccccgcaccagctcgagaaggccaggcagaaggaggcgctcaagggggtcaccatcatggagggcgacgccgaggacctgcccttccccaccgacagcttcgaccgatacatctccgccggcagcatcgagtattggcctgatccgcagagaggaatcaaggaagcgtacagggtcctgaggtttggtgggacagcttgtgtgattggccctgtgcacccaaccttctggctctcccgcttcttcgccgacatgtggatgctcttccccaaggaagaagagtacatcgagtggttcaagaaggctgggttcaaggatgtcaaactcaaaaggattggaccaaagtggtaccgtggcgtccgaaggcatggcctgatcatgggatgctctgtcacaggtgtgaagagagaacgtggagactctcctttggagcttggtccgaaggctgaggatgtcagcaagccagtgaatcctatcacgttcctctttcgcttcctcataggaacaatatgtgctgcatacttcgttctggtgcctatttacatgtggataaaagaccaaatcgtgcccaaaggcatgccaatctgagtgaagggggctgagctcaaggaagagaggatagccaatatctcgattagtcttctctatattaggcgcttcctgtctgttttgtatttgcctttcatttttcttttgttatgtatttcttctactgttgttcctgtttgtgcgaagcaataatattaagaccttgattaatctcaactgcttcttgggcatgaagtgaaacctctgttgcaggttgttggttttaaactaaatgaatgcatgttttagctgttctaaatctgcaaaacataaa

SEQ ID NO: 4508 - DNA, 1357 bp, Zea mays
tcccttccagtcccaggagcgtggcctcactctcctcgtcgcatcccccctcctcatcttcgcagcgcgggcggcggcaatggcgatggcctccacctacgcgccgggcggaggcgcgcgggcgctcgcgcagggtagatgcagggtccgcggtcccgcggggctgggcttcctcggcccctccaaggccgccggcctcccccgccccctcgccctcgccaggcggatgagcagccccgtcgcggtgggcgccaggctgcgatgcgcggcgtcgtcgtcccccgcggcggcgcggcccgccacggcgccgcgcttcatccagcacaagaaggaggccttctggttctaccgcttcctctccatcgtgtacgaccacgtcatcaatccgggccactggaccgaggacatgcgcgacgacgcgctggaacctgccgacctcttcagccgccacctcacggtcgtcgacgtcggcggcggcacggggttcaccacgctcggcatcgtcaagcacgtcaacccggagaacgtcacgctgctcgaccagtccccgcaccagctcgacaaggcccggcagaaggaggccctcaagggggtcaccatcatggagggcgacgccgaggacctcccgttccccaccgactccttcgaccgatacatctccgccggcagcatcgagtactggccagacccacagcgggggatcaaggaagcctacagggtcctgagatttggtgggctagcttgtgtgatcggcccggtctacccgaccttctggctgtcccgcttcttcgccgacatgtggatgctcttccccaaggaggaagagtacatcgagtggttcaagaaggctgggtttagggatgtcaagctgaagaggattggaccgaagtggtaccgcggtgtccgaaggcatggcctcatcatgggctgctccgtcacaggcgtcaagagagagcgcggtgactctcccttggagcttggtcccaaggcggaggatgtcagcaagccagtgaatccgatcaccttcctcttccgcttcctcgtaggaacgatatgtgctgcctactatgttctggtgcctatttacatgtggataaaggaccagatcgtgccaaaaggcatgccaatctgagtgaagggaatgagctgcatggaagagaggatagccaacgtctgaattttactcttctctatattagacgcttcctgcctgttttgtattaatacctcttgttttccttctgctatttacttcttgcactgctgttcctgtttgtggtaattaataatactaagacatcgatgttctcctgtttcttgagcatgactggttgcagtggaacctcgaaattaaatt

SEQ ID NO: 4509 - DNA, 1479 bp, Sorghum bicolor
cgcagcccatccatccatccatacacccacggcagtaccacacatcccccgctcccgtgatccctcctcttgtcctctctcacaggagcgtggccggccctcactctgctcgtcgcatccacccatcccctctcccccacttccccctcgtcgcggcgcgggcggcggcaatggcgatggcctccacctacgcgccaggcggcggcgcgggggcgctcgcgccgggaaagggcagggtccgcggccccgctgggctcggcttcctcagcccatccaaggtcggcggcctcccccgccctctcgccctcgccaagcggagtcccgtcgcggccaggctacggtgcgccgcgtcgtcgtcctcccccgcggcccccgcggcgcggcccgtcacggcgccgcgcttcatccagcacaagaaggaggccttctggttctaccgcttcctctccatcgtgtacgaccacgtcatcaacccgggccactggaccgaggacatgcgcgacgacgcgctggagcccgccgagctctacagccgccacctcaaggtcgtcgacgtcggcggcggcaccggcttcaccacgctcggcatcgtcaagcacgtcaacccggagaaagtcacgctgctcgaccagtccccgcaccagctcgagaaggcgcgccagaaggaggcactcaagggggtcaccatcatggagggcgacgctgaggacctcccgttccccaccgactccttcgaccgatacatctccgccggcagcatcgagtactggccagacccacagcgggggatcaaggaagcctacagggtgttgaggtttggtgggctagcttgtgtgattggcccagtgtacccaaccttctggctgtcccgcttcttcgccgacatgtggatgctcttccccaaggaggaagagtacatcgagtggttcaccaaggccgggtttaaggatgtcaagctgaaaaggatcggaccaaagtggtaccgcggtgtccgaaggcatggcctcatcatgggttgctctgtcacaggcgtcaagagacagagcggagactctcccttagagcttggtcccaaggcggaggatgtcagcaagccagtgaatccgatcaccttcttctttcgcttcctcgtaggaacaatatgtgctgcgtactatgttctggtgcctatttacatgtggataaaggaccagatcgtgccaaaaggcatgccaatttgagtgaaagggaatgagctgcattgaagagaggatagccaaacatctgaattagtcttctctatattaggcgcttcctgtctgttttgtattattacctcttgttttcctgctgctatgtacttcttgtactgctcctgtttgtgcgaattaataatattaagacatggatattctccagtttcttgagcatgactgctttcagtgggacctttgtagcaggttattggatttaaattatatgatgtataatttagttggt

SEQ ID NO: 4510 - DNA, 1400 bp, Pennisetum glaucum
cgcggcggcggcggcggcggcgacgcgaaatggcgatggcctccacctacgcgccgggcggcggcgcggcgggggcgctcgcgccgggaaggtccaccagggtccgcggccccgcggggttgggcggcttcagcctcaccaaggccgccggcgcccgcccactctccctcgccaggcggagccccgccgccgcggccgccggccccaggcagctgctgcggtgcgcggcgtcctcctcctcctcctcctcggcggcggcggcggcgcgccccgtgagtgcgccccggttcatccagcacaagaaggaggccttctggttctaccgcttcctctccatcgtctacgaccacgtcatcaacccgggccactggaccgaggacatgcgcgacgacgcgctcgagcccgccgacctctacagccgccacctcaaggtcgtcgacgtcggcggcggcaccgggttcaccacgctcggcatcgtcaagcacgtcaacccggagaacgtcacgctgctcgaccagtccccgcaccagctcgacaaggccaggcagaaggaggcgctcaagggggtcaccatcatggagggcgacgccgaggacctccccttccccaccgacaccttcgaccgatacgtctccgccggcagcattgagtactggcctgatccgcagaggggaatcaaggaggcctacagggtcctgaggatgggtggggtggcttgtctgattggccccgtgtacccgaccttctggctgtcccgcttcttcgccgacatgtggatgctcttccccaaggaagaagagtacatcgagtggttccagaaggctgggttcaaggatgtcaagctcaagagaatcggaccaaagtggtaccgcggcgtccgaaggcacggcctgattatgggatgctctgtcacaggtgtgaagagagaacggggggactcccctttgcagcttggtccgaaggcagaggatgtcagcaagcccgtgaacccgatcaccttcctctttcgcttcctcatgggaacgatatgtgccgcatactatgttctggtgcccatctacatgtggataaaggaccagattgtgcccaaaggcatgccgatctgagtgaaggggaccgagcggcaacgaagagaggatagccaccatctgaattagtcttccctatattaggcgcttcacgtctgttttgtatttaccttttatctatctggtgttatgtacttctacgtcattcgtatttgtgccaagtaataatattaagacatggattaatctcaagtctcaacagttccttgagcatggagtggaatttctgtagcagattatagagatggtatctgatacctctgcaaaacaaacatttttatgtgggatgatatctaaatttgattcctcctt

SEQ ID NO: 4511 - DNA, 1343 bp, Oryza sativa
catcctcttccactctctcctctccccttcgtggcggcggcggcggcggcggcggcgtgacgaggaggagcaatggcgatggcctcctccgcctacgccccagcgggcggcgttggcacccactccgcgccgggcaggatcaggccgccgcgcggcctcggcttctccaccaccaccaccaagtcgaggcccctcgtgctcaccaggcgtgggggaggcggcggcaacatctccgtggctcggctgaggtgcgcggcgtcgtcgtcgtcggcggcggcgaggccgatgtcgcagccgcggttcatccagcacaagaaggaggcgttctggttctaccgcttcctctccatcgtctacgaccacgtcatcaacccgggccactggacggaggacatgcgggacgacgccctcgagcccgccgacctctacagccgcaagctcagggtcgtcgacgtcggcggcgggacggggttcaccacgctcgggatcgtcaagcgcgtcgacccggagaacgtcacgctgctcgaccagtccccgcaccagctcgagaaggcccgggagaaggaggccctcaagggcgtcaccatcatggagggcgacgccgaggacctccccttccccaccgacaccttcgaccgctacgtctccgccggcagcatcgagtattggcccgatccgcagcgaggaatcaaggaagcttacagggttttgaggcttggtggagtggcttgcatgattggccccgtgcacccaaccttctggctgtctcgctttttcgctgacatgtggatgctcttcccgaaggaagaggagtatattgagtggttcaaaaaggcagggttcaaggatgtcaagctcaaaaggattggaccaaaatggtaccgtggtgtccgaaggcatggcctgattatgggatgctctgtgacgggcgtcaaaagagaacatggagactcccctttgcagcttggtccaaaggttgaggatgtcagcaaacctgtgaatcctatcaccttcctcttccgcttcctcatgggaacaatatgtgctgcatactatgttctggtgcctatctacatgtggataaaggaccagattgtgcccaaaggcatgccgatctaagggagatgaactgagctgcaagagaggatagccaatatctgaattaggcttctctatattaggcactttctgtcagttctgtatttacttctgttgtccctgttgttatgtacttcttttactgtggttcttgtttgtggggaaataatattatgagaccttgattaagctcatccgaactcctgagcatggaatggatcgtgtgtagcataattagaatggac

SEQ ID NO: 4512 - DNA, 1435 bp, Oryza sativa
tcctcgccactctcccccctcccatcctcttccactctctcctctccccttcgtggcggcggcggcggcggcggcggcgtgacgaggaggagcaatggcgatggcctcctccgcctacgccccagcgggcggcgttggcacccactccgcgccgggcaggatcaggccgccgcgcggcctcggcttctccaccaccaccaccaagtcgaggcccctcgtgctcaccaggcgtgggggaggcggcggcaacatctccgtggctcggctgaggtgcgcggcgtcgtcgtcgtcggcggcggcgaggccgatgtcgcagccgcggttcatccagcacaagaaggaggcgttctggttctaccgcttcctctccatcgtctacgaccacgtcatcaacccgggccactggacggaggacatgcgggacgacgccctcgagcccgccgacctctacagccgcaagctcagggtcgtcgacgtcggcggcgggacggggttcaccacgctcgggatcgtcaagcgcgtcgacccggagaacgtcacgctgctcgaccagtccccgcaccagctcgagaaggcccgggagaaggaggccctcaagggcgtcaccatcatggagggcgacgccgaggacctccccttccccaccgacaccttcgaccgctacgtctccgccggcagcatcgagtattggcccgatccgcagcgaggaatcaaggaagcttacagggttttgaggcttggtggagtggcttgcatgattggccccgtgcacccaaccttctggctgtctcgctttttcgctgacatgtggatgctcttcccgaaggaagaggagtatattgagtggttcaaaaaggcagggttcaaggatgtcaagctcaaaaggattggaccaaaatggtaccgtggtgtccgaaggcatggcctgattatgggatgctctgtgacgggcgtcaaaagagaacatggagactcccctttgcagcttggtccaaaggttgaggatgtcagcaaacctgtgaatcctatcaccttcctcttccgcttcctcatgggaacaatatgtgctgcatactatgttctggtgcctatctacatgtggataaaggaccagattgtgcccaaaggcatgccgatctaagggagatgaactgagctgcaagagaggatagccaatatctgaattaggcttctctatattaggcactttctgtcagttctgtatttacttctgttgtccctgttgttatgtacttcttttactgtggttcttgtttgtggggaaataatattatgagaccttgattaagctcatccgaactcctgagcatggaatggatcgtgtgtagcataattagaatggacatgtgacatttctgcattccaagtattctgaatggtagacaaacaaataatatctgaattcgatccccat

SEQ ID NO: 4513 - DNA, 1427 bp, Brachypodium distachyon
cccatcccctccgcttctgtccgtttctgctctccctcccttccccttccctcctcggcggcggcggcggcggcggcaatggcgatggcctccacccgagcgcctagcagcgcagggagcctcgcgccgggcaggaggaccctcaggccgcgttcccccgccggcctcccgggcttcctcggcctcagcccttccaagcccactctgcgccgcccgctcgccctcgtctccggcgccaggccctgcccgccgctgttcaggtgcgcggcctcctcctcccccgcggcggcgcggccggcgtcggcgccgcggttcatccagcacaagaaggaggccttctggttctaccgcttcctctccatcgtctacgaccacgtcatcaacccgggccactggaccgaggacatgcgggacgacgcgctgcagcccgccgacctccacagccgcaagctcaaggtcgtcgacgtcggcggcggcacggggttcaccacgctcggcatcgtcaagcacgtcgaacccgagaacgtcaccttgctcgaccagtccccgcaccagctcgagaaggcacgccagaaggaggcgctcaacggggtcaccatcatcgagggcgacgccgaggacctccccttccccaccgacaccttcgaccgatacgtctccgccggcagcattgagtactggccggacccccagcggggaatcaaggaagcctacagggtcctgaggctcggcggagtagcttgtttgatcggccctgtgcacccaaccttttggctgtctcgctttttcgctgatatgtggatgctgttccccactgaagaggagtatattgactggttcaagaaggcagggtttgaggatgttaaactgaagagaatcggaccaaagtggtaccgtggtgtccgtaggcatggcctgatcatgggatgctctgtgacgggtgtcaagagagaaagaggggactcccctttgcagcttggtccgaaggctgaggatgtcagcaagcctgtgaatcctatcaccttcttctttcgcttcctcgtaggaacgatatgtgccgcatactatgttctggtgcctatttacatgtggataaaggaccagattgtgcccaaaggcatgccaatctaagagaggaattaagctgcgatgaagagaggatagccaacacctgaattaggcttctctatattaggcactccatgtctgttttttgtttaccttttgtatttcttgttctcgtgtatttctgttactgtggttcttgtttgtgtggagaaataatatttaagactttgattgagatcaacagaactcttgagcgtgaaatggctcctttgtagcagttcactgtttctgagttagaatgaacctgtaatatttctgtaatctgtattatcgttatgctattggtagaaataggggat

SEQ ID NO: 4514 - DNA, 1354 bp, Leymus cinereus x Leymus triticoides
cctccgcgcacgcgcccagcggcgccgggagcctggcgccaggcgggatgctgagggtgcgcgccccggccgggctcggctacctcggcctcggcccctccaagtccgtgctccgccccgtgaccctcgcgaggcgcgccccctccggcgccaggtccccgctgctgaggtgcgccgcggcctcttcacccccggccgcggcggcggcgcggcccgcctcggcgccgcgcttcatccagcacaagaaggaggccttctggttctaccgcttcctctccatcgtctacgaccacgtcatcaacccgggccactggaccgaggacatgcgcgacgacgcactcgagcccgccgacctccacagccgcaagctcaaggtcgtcgacgtcggaggcggcacggggttcaccactctcggcatcgtcaagcacgttgaccccgccaacgtcacgctgctcgaccagtccccgcaccagctcgagaaggccaggcagaaggacgcgctcaagggggtcgagatcatggagggcgacgccgaggacctcccgttccccacagacaccttcgaccgatacgtctctgccggcagcattgagtactggcctgatcctcagcgaggaatcaaggaggcctacagggtcctgaggctcggcgggaaagcttgtttgatcggccctgtgcacccaaccttttggctgtctcgctttttcgctgacatgtggatgctgttccccactgaagaggagtatatcgaatggttcacaaaggcagggttcaaggatgttcagctgaagaggattggaccgaagtggtaccgtggtgtccgtaggcatggcctgatcatgggatgctccgtgactggtgtcaagagagaaagtggggactcccctttacagcttggtccgaaggctgaagatgtcagcaagcctgtgaatcctatcacttttttctttcgcttcctcatgggaacaatatgtgccgcgtactatgttctggtgcctatttacatgtggataaaggaccagattgtgcccaaaggcatgccgatctgagggaggggaattgagctgcaatgaagagaggatagccaatatctaaattaggcttctctatattaggcacttcacatctgtttttgtttaccttttatatttcctgttgtcgtgtatttattttactttgggtcttgttatgtggagaaataatatttaagacttggattaaacgcgtcagaggtcttgagcgtgaaatggctcatttgtagcaggtcattgtttccgaaatagaatgcatctgtaatatttctgcactgtatgctgacttgctaagtggtagacaaacatgttacatgagctga

SEQ ID NO: 4515 - DNA, 1181 bp, Panicum virgatum
cgccaggcggagcccccagctcgcggccgccaggctgcggtgcgcggcgtcctcgtcgcctgcggccccgcgcggcccgtcacggcgccgcggttcatccagcacaagaaggaggccttctggttctaccgcttcctctccatcgtgtacgaccacgtcatcaacccgggccactggaccgaggacatgcgcgacgacgcgctcgagcccgccgacctctacagccgccacctcaaggtcgtcgacgtcggcggcggcaccggcttcaccacgctcgggatcgtcaagcacgtcaacccggagaacgtcacgctgctcgaccagtccccgcaccagctcgagaaggccaggcagaaggaggcgctcaagggggtcaccatcatggagggcgacgccgaggacctgcccttcccgaccgacagcttcgaccgatacatctccgccggcagcatcgagtattggcctgatccgcagagaggaatcaaggaagcgtacagggtcctgaggtttggtgggacagcttgtgtgatcggccctgtgcacccaaccttctggctctcccgcttcttcgccgacatgtggatgctcttccccaaggaagaagagtacatcgagtggttcaagaaggctgggttcaaggatgtcaagctgaaaaggattggaccaaagtggtaccgtggcgtccgaaggcatggcctgatcatgggatgctctgtcacaggtgtgaagagagaacgtggagactctcctttggagcttggtccgaaggctgaggatgtcagcaagccagtgaatcctatcacgttcctctttcgcttcctcataggaacaatatgtgctgcatactttgttctggtgcctatttacatgtggataaaggaccagatcgtgcccaaaggcatgccaatctgagtgaagggggctgagctcaaggaagagaggatagccaatatctcaattagtcttctctatattaggcgcttcctgtctgttttgtatttacctttcatttttcttctgttatgtatttcttctactgttgttcctgtttgtgcgaagcaataatattaagaccttgattaatctcaactgctttttgggcatgaagtgaaacctctgttgcaggttgttggttttaaattaaatgaaagcatgttttagctgtcctaaatctgcaaaac

SEQ ID NO: 4516 - DNA, 1486 bp, Echinochloa colona
gcgcgaggctgcggtgcgcggcgtcgtcggccccggcgcggcccgtctcggcgccgcggttcatccagcacaagcaggaggccttctggttctaccgcttcctctccatcgtctacgaccacgtcatcaacccgggccactggaccgaggacatgcgcgacgacgcgctcgagcccgccgacctctacagccgccacctcaaggtcgtcgacgtcggcggcggcacgggcttcaccacgctcgggatcgtcaagcacgtcgacccgcagaacgtcacgctgctcgaccagtccccgcaccagctcgagaaggccaggcagaaggacgcgctcaagggggtcaccatcatggagggcgacgccgaggacctgcccttccccaccgacaccttcgaccgatacgtctccgccggcagcattgagtattggcctgatccgcagagaggaatcaaggaagcatacagggtcctgaggcttggtgggacagcttgtttgattggcccggtgtacccaaccttctggctgtcccgcttcttcgccgacatgtggatgctcttccccaaggaagaagagtacatcgagtggttcacgaaggctgggttcaaggatgtcaagctcaaaaggattggaccaaagtggtaccgtggtgtccgaaggcacggcctgatcatgggatgctctgtcactggtgtgaagagagaacgtggagactctcctttggagcttggtccaaaggctgaggatgtcagcaagccggtgaacccgatcaccttcctctttcgcttcctcatgggaacaatatgtgctgcatactatgttctggtgcccatttacatgtggataaaggaccagattgtgcccaaaggcatgccgatctgagtgaaggggactgagctgcaaggaagagaggatagccatcatctgatttagtcttctctatattaggcgcttcctgtctgttttgtatttaccttttatttctctgctgtcgtgtacttcttttactgatgttcgtatttgcgcgaagtaataatattaaaacccggattaatctcaagtctcaacagtttcttgagcatgtagtggaaccgtgtttcaggtttatagagaaggtatcagatagctctgcaaaagagcgttttattgggatcatatctaaattgggttcctcttttttgttcttcatatgctctgatgatgttatagttttattgcatggcatatgtgcatgtaaaaccacttgctctaacatttttaatatattaacgcgttatatttatcagcagatacaattacctaacatttctgtatcaaattatcaattttatcttacatccttttctgttaacaattacctaacatttctgtatcaaattgtacaatttattcttaacatccttttctgttgtgggacagacacagtgcagataatgatacaacctatacttaattgaccttgacctacaatttaaccaaaccttgactcg

SEQ ID NO: 4517 - DNA, 1783 bp, Sorghum bicolor
cacggccgaacgcccccgccagggcccagggccaccaccaccgcctggcgcccggtctcctcttccgtccccctcacctcgacgtcttccaccctcgaagggtggccttttcggcggcgagcgagggcgaggaataaactccgcgtcgcccacgcaccgcaacaaataatatccttccacgcgaatattcgccgcttcccacctccccgccccgcatatccttccttccgtccgtccgcccccctttcccttcccctctatttcacaaccccatcagccgcgacgatcaccggcgagactcatcaccggcgcaatccgtccacccacacacccactcactcatccactcccccctccgggaatctcattttctttaccgcggttaggaggcggcggcgtcggcggcgtcggcggcggcgatgaagttcggcaagagcctgagcgggcagatcgtggagacgctcccggagtggcgcgacaagttcctctcctacaaggacctgaagaagcgcctcaagctcatcggcgccgggaacggggccgccgagcggcagccgaagcgggcccgccgcgacgacgccggggagcctgacgcgtccgcggcggcggcggcgatgacgccggaggaggcggactttatgcggctcctggaggccgagctcgacaagttcaactctttcttcgtcgagaaggaagaggagtacatcatccgccagaaggaactgcaggaccgggtggccagggcggccggccgggagtccaaggaggagctcatgcgggtgcgcaaggagatcgtcgacttccatggcgagatggtgctgctcgagaactacagcgccctcaactacaccggattggttaagattctcaagaaatacgataagagaactggagccctgatccggctgcccttcatccagaaagttcttcagcagcctttcttcaccactgatctcctgtacaagcttgtgaagcagtgtgaagccatgctggagcagctccttccggttagtgaggcatctgtatccagtgaagatgtaaaaggagacagtaatgatgaagagaagctggcaaagccgagttcttccttggtaaatggtggtggcattccagagttagatgagattgagtacatggagagtatgtacatgaagagcaccgttgcagcccttaggtcactgaaggagatccggagcaagagttcaactgtcagtatgttctcgttgccacctcttcagggcaacaatgcacaggacagttaccagatccgggcagagcaaaccaaactagatgaagagccagagaggtggagcaaagtaacagtgatagagcaggcggccaaatgacaggtcgaatgtgcaacatctgatgcctcagttcgtcacgattttagacttacatttgctggagatgaggctgggatctcaatctccctgtcgtatattcagtaatttgtatgaattcaggattcctaacagctgtaaaatggtggaaatgttaaatcatagaatcccagcacaaccgtgagacagaacagaactgattttattcactattgtgaattgatcatgtatttttgccgatctacaatcgtttactgagtttatgattgggtgttgctactgcttgtgattatcaaagaaaaacactgaactgattttattcactttttgtgaatcgatcatgtatttttgccgatctacaatcgtttactgagtttatgattgggtgttgctactgcttgtgattatcaaagaaaaacagttttaggcttgctactcca

SEQ ID NO: 4518 - DNA, 1560 bp, Sorghum bicolor
gcggcggcgtcggcggcgtcggcggcggcgatgaagttcggcaagagcctgagcgggcagatcgtggagacgctcccggagtggcgcgacaagttcctctcctacaaggacctgaagaagcgcctcaagctcatcggcgccgggaacggggccgccgagcggcagccgaagcgggcccgccgcgacgacgccggggagcctgacgcgtccgcggcggcggcggcgatgacgccggaggaggcggacttcatgcggctcctggaggccgagctcgacaagttcaactctttcttcgtcgagaaggaagaggagtacatcatccgccagaaggaactgcaggaccgggttgccagggcggccggccgggagtccaaggaggagctcatgcgggtgcgcaaggagatcgtcgacttccacggcgagatggtgctgctcgagaactacagcgccctcaactacaccggattggttaagattctcaagaaatacgataagagaactggagccctgatccggctgcccttcatccagaaagttcttcagcagcctttcttcaccactgatctcctgtacaagcttgtgaagcagtgtgaagccatgctggagcagctccttccggttagtgaggcatctgtatccagtgaagatgtaaaaggagacagtaatgatgaagagaagctggcaaagccgagttcttccttggtaaatggtggtggcattccagagttagatgagattgagtacatggagagtatgtacatgaagagcaccgttgcagcccttaggtcattgaaggagatccggagcaagagttcaactgtcagtatgttctcgttgccacctcttcagggcaacaatgcacaggacagttaccagatccgggcagagcaaaccaaactagatgaagagccagagaggtggagcaaagtaacagagcgcctggcgtacaagctcatcttcgaggcgggcaacaagggcatgtggatgctggacatccgcaagaagttgttgatgggccccaacatcgccaccaaggtcgtgcgcaccctcgtggggcgtgggctcctgaaggaggtcagcgatgtgcgccaccgcagcaggaagatcttcatggccaccgacttccagccctccgccgagatcactggcggcacctggtaccacgacggccgcctagacaccgacgccgtaagcaccgcgcgccgctgctgccaggcgcaggtcgagaggctcggcgccgcgaccgcgcagatgatccacaacggcattctgaaggacgaccccagggccgtgtacactatcgacaagatcagagatattatcaagaccatggttctggacaaggtcctcgaggaggtcaagagcaccgggacgggggagttcacggccgtcagggccggcacaatgtgctaccggctggtgactggggctccgcagggagggatgatggagggaattccttgtggggtttgccccaggattgatgagtgctcaccggagggggtcatttcgccgagcacctgcgtttactacaagaagtggctgcagatggacttctag

SEQ ID NO: 4519 - DNA, 1658 bp, Panicum virgatum
cgccgcgagttgcaaaccaccatacgcagcccaccggcgggcatgcccttcttccccgtgtttcgccgcataactccacggcggcacacgccaccacctcaccccgtgtctgtcttccctccccgtcccgtccacctcacctcggcggcttccgtccaccctcgaagtggctttttcggcggcgagcgcggcgagaggaataagctcgcgtcgcgcgcacaccgcaacaataatatccttcctcgcgaatattcgccgcttcccacctccccgccccgcatatcctccgcccgcctcccttcctttcccctctctgcctcccctctatttcaccaccccttccggcccccagccgcgagcccgcgacgatcaccggcgcaatccgttgcagtcgtgcgctccacctcccacccgcacacccaccggaaatctcctttctttcccgcgactgggcggcggcggggatgaagttcggcaagagcctgagcgggcagatcgtggagacgctgccggagtggcgcgacaagttcctgtcctacaaggacctcaagaagcgcctcaagctcatcggcgcagggaataacggggccgagaggccgcccaagcgggcccgccgcgacgacgccggggaggcggacgccgcgtccccggcggcggcggtggcgatgacgcccgaggaggcggatttcatgcggctcctcgaggccgagctcgacaagttcaactctttcttcgtcgagaaggaggaggagtacatcatccgccagaaggagctgcaggaccgcgtggccagggcggccgggcaggagtccaaggaggagctcatgcgggtgcgcaaggagatcgtcgatttccacggcgagatggtgctgctcgagaactacagcgccctcaactacaccggactggttaagattctcaaaaagtatgacaagagaactggagccctgatccggctgcccttcatccagaaagtcctgcagcagcctttcttcaccactgaccttctatacaaacttgtgaagcagtgcgaagccatgctggagcagctcctaccgacgactagtgaaccatctgtatcaagggaagatggaaaaggagatagcaatgatgaagaaaaaccagcaaatcccacttcttccttgttaaacggcggtggtattccagaactagatgagattgagtacatggagagcatgtacatgaaaagcacagttgcggcgcttaggtccctgaaggagatccggagcaagagttcgactgtcagcatgttctcgttgccaccacttcagggcaacaatgcgcctgaagagccagagaggtggaacaaaatacctgtgatagagcaggctgccaaatgacatgacgagtgtgcaacaccagatgcttcaactcgaaacaattttagtcttgacatttgctggagatgggactgggatctcaatctccctgtcgtatattcagtaatctgtatgaattcaggattcctaacagatgtaaaatggtggaaatgtcgttcaatatagcatgttaaatcatagaatcccagcataaccatcagacagaactgaggtgattttattcactattgtgaattgatcctgtatttttgccgatctacaagtattaactgagtttatcattcgggattgtgagct

SEQ ID NO: 4520 - DNA, 1398 bp, Panicum virgatum
tccccgccccgcatatcctccgcccgcctccctctccctccctccctttcccctccccgccctccctctatttcaccacccccgtccgccccccaccgcgacgatcaccggcgcaatccgtgcagtcgtgcaatccatccaccccccacccgcacgcacgcccaccggaaatctcctttcttttcccgcgactgggcggcggagatgaagttcggcaagagcctcagcgggcagatcgtggagacgctgccggagtggcgcgacaagttcctgtcctacaaggacctcaagaagcgcctcaagctcatcggcgccgggaacggggccgagcggcagcccaagcgggcccgccgcgacgacgccggggaggccgacgcgtccccggcggcggcgatgacgcccgaggaggcggatttcatgcggctcctgggggccgagctcgacaagttcaactctttcttcgtcgagaaggaggaggagtacatcatccgccagaaggagctgcaggacctcgtggccagggtggccgggcaggagtccaaggaggagctcatgcgggcgcgcaaggagatcgtcgacttccacggcgagatggtgctgctcgagaactacagcgccctcaactacaccggactggttaagatcctcaaaaaatatgacaagagaactggagccctgatccggctgcctttcatccagaaagtcctgcagcagcctttcttcaccactgaccttctatacaaacttgtgaagcagtgcgaagccatgctggagcagttcctaccgactagtgaaccatctgtatcaagggaagatggaaaaggagatagcaatgatgaagaaaaaccagctaatcccacttcttccttgttaaacggcgatggtattccagaattagatgagattgagtacatggagagcatgtacatgaaaagcacagttgcggcgcttaggtctctgaaggagatccggagcaagagttcgactgtcagcatgttctcgttgccaccacttcagggcaacaatgcgcccgaagagccagagaggtggaacaaaatacctgtgatagagcaggctgccaaatgacatgacgagtgtgcaacatcagatgcttcaactcgcaacaattttagtcttgacatttgctggagatgggactgggatgtgggatctcaatctctccgtcgtatattcagtaatctgtatgaattcaggattcctaacagatgtaaaatggtggaaatgttgatcaatataccttgttaaatcatagaatcccagcataaccatcagacagaagtgaggtggttttattcactattgtgaattgatcctgtatttttgctgatctacaagtattaactgagttttatcatttgggattgctgattttgttct

SEQ ID NO: 4521 - DNA, 1332 bp, Setaria italica
cctccctccccttccctctatttcaccacccgcatccgccctcccccgcgacgatcaccgggtgcaatccgtccactctgcccaccggaaatctcctttctttccggcgactgggaggcggcggcgatgaagttcggcaagagcctcagcgggcagatcgtggagacgctgccggagtggcgcgacaagttcttgtcctacaaggacctcaagaagcgcctcaagctcatcggcgccggcgctgggagcggggccgagcggcagcccaagcgggcccgccgcgaggacggcgggaaggccgacgcgtcctccggcgccccggcggcggcggcggcggcggcggcgatgacgcccgaggaggcggacttcatgcagctcctggaggccgagctcgacaagttcaactctttcttcgtcgagaaggaggaggaatacatcatccgccagaaggagctgcaggaccgcgtggccagggcggcagggcaggactccaaggaggagctcatgcgggtgcgcaaggagatcgtcgacttccacggcgagatggtgctgctcgagaactacagcgccctcaactacactggactggttaagattctcaagaagtatgacaaaagaactggagccctgatccgtctgcccttcatccagaaagtcctgcagcagcctttcttcaccactgacctcctgtacaagcttgtgaagcagtgcgaaaccatgctggagcagctcctgccgaccagtaagccatctgtatcacgtgaagatggaaaagtagatagcaatgacgaagaaaagccagcaaagcccacttccttggtcaacggcagtggcattccggatttagatgagcttgagtacatggagggcatgtacatgaagagcacagttgcagcacttaggtcgctgaaggagatccggagcaagagttcgactgtcagcatgttctcgttgccacctcttcagggcaacaatgcgcctgaagagccggagaggtggaacaagatacctgtgatagaacaggccgccaaatgacatggcgaatgtgcgatgtctatgcctcaactgatcacaactttagtcttgacatttgctggagacagggccgggatcctccctgtcgtatattaagtaatctgtatgagttcaggatacctaacggctgtaaaatggtggagatgtcgtttatatgatgttaaatcatagaatcccagcataaccgtcagacagaactgagctgattttattcactattgtgaattgatccggtaattttgctgatcaacatattttgtttatggtttgttcattgttaattttgttctggcgacc

SEQ ID NO: 4522 - DNA, 1304 bp, Pennisetum glaucum
cccgcctccgttcttccctttcccctccccccctctatttcaccaccccatccgccctcccccccgggacgatcaccggcgcaatccgtccactccacccaccggaaatctcctttttcccgcggcttggcggcagcgatgaagttcggcaagagtctcagcgggcagatcgtggaaacgctgccggagtggcgcgacaagtttttgtcctacaaggacctcaagaagcgcctcaagctcatcggcgctggcggcgccggtgctgggagcgcggccgagcggcagcccaagcgtgcccgccgcgaggacgccggggaggccgatgcgtcctccgccgccccggcggccgcggcggcgatgacgcccgaggaggcggacttcatgcagctcctggaggccgagctcgacaagttcaactctttcttcgtcgagaaggaggaggagtacatcatccgccagaaggagctgcaggaccgcgtggccagggtggcggggcaggactccaaggaggagctcatgctggtgcgcaaggagatcgtcgacttccacggcgagatggtgctgctcgagaactacagcgccctcaactacactggactggttaagattctcaagaagtatgacaaaagaactggagctctgatccgtctgcccttcatccagaaagtcttgcagcagcctttcttcaccactgacctcctgtacaagcttgtgaagcagtgcgaaaccatgctggggcagctcatgccgaccagtaagccaactgtatcctgtgaagatggaaaagtagatagcaatgaccaagaaaagccagcaaagcccacttcttccttggtgaacggcagtggcattccggatttagatgagcttgagtacatggagggcatgtacatgaagagcacagttgcagcacttaggtcgctgaaggagatccggggcaagagttcgactgtcagcatgttctcattaccacctcttcagggaaacaatgcgcccgaagagccggagaagtggaacaaaatacctgtgatagaacaggctgccaaatgacatggcgattgcgccatgtctggtgcctcagctcatcataattttagtcttgacatttgctggagaggggaccggaatcctccctgtcgtatattaagtaaatctgtatgagttcaggtcttcaggatacctaatagctgtaaaatggtggtgatgtcgtttatataatgttaaatcatagaatccccagcataaccgtcatacagaactgagctgattttagaatggatccagtattttgctgatcaaaaaaa

SEQ ID NO: 4523 - DNA, 1256 bp, Echinochloa colona
ttcccctcctcctctctctatttcaccaccctatccgccctcctcccccggggcgatcaccggcgcaatccgtccacccaacccacactcacatccaccggaaatctactctcttttctttcccgcgattgaggggcggcggaggcggcggcgatgaagttcggcaagagcctcagcgcgcagatcgtcgagacgctgccggagtggcgcgacaagttcctgtcgtacaaggacctcaagaagcgcctcaagctcatcggcgccggcgccggggacggggccgagcggccgcccaagcgggcccgccgcgacgacgccggcggggaggccgacgcggcggcgatgacgcccgaggaggcggagttcatgcagctcctggaggccgagctcgagaagttcaactctttcttcgtcgagaaggaggaggagtacatcatccgccagaaggagctgcaggaccgcgtggccagggcggccgggcaggagtccaaggaggagctcatgcgggcgcgcaaggagatcgtcgacttccacggcgagatggtgctgctcgagaactacagcgccctcaactacaccggactggttaagattctcaagaaatatgacaaaagaactggtgccctgatccggctgccctacagccagaaagtcctgcagcagcctttcttcaccactgacatcctgttgaagcttgtgaagcagtgcgaaaccatgctggagcagctcatgccaactagtgagccatctgtatcaagtaaagatggaaaaagagagagcaatggggaagcaacgccagcaaagcccacttctaccttggtaaacggcggcggtattccagagttagatgagattgaatacatggagagcatgtacatgaagagcacgattgcagcccttagatcgctgaaggagatccggagcaagagctcgactgtcagcatgttctcgctgccacctcttcagagcaacactgcgcccgaagagctggagaggtggaacaagatacccgtgatagagcaagccgccaaatgacattacaaatgtgcaatgccggatgcttcacctgcggcaattttagtcttgacattcgctggagatgggactgggatcttatctccttgtcgtatattcagtaatatgtatgagttcaggattcctaacagctgtaaaatggtggaaatgttcaatataccatgttaaatcatagaatcccagcataaccatcagacagaactgaggtgattttattcact

SEQ ID NO: 4524 - DNA, 1460 bp, Oryza sativa
ccttcccccgcttgtgatttgtgaagcgaaagcgaacggagcacataaacacaattatatcctcccccgcgaatattcccatcgtctccttcctcctctcccccgcatatcctccgcctccctttcccccctctcctcctcaaccctatttcaccaccacctccaccgctgccgcggcgagaattcgatcggttcttggcagccgtagtgcagttttgtgcagttttcttctctcttgttgttgaggatgaagtttgggaagagcctgagtagccagatcgtggagacgctcccggagtggcgggacaagttcttgtcgtacaaggatctcaagaagcggctcaagctgattggtgggggtgggggtggggaggagaggcaggcgaagcgggcacgcgttgcagcggatggcggcgaggaggaggccgccgccgcggcgatgacgcccgaggaggcgggcttcatgcggctcctggaggccgagctcgacaagttcaactccttcttcgtcgagaaggaggaggaatacatcatccgccagaaggagctgcaggacagggtggcgagggcggcggggagggagtcgaaggaggagctgatgcgggtgcgcaaggagatcgtcgacttccatggcgagatggtgctgctcgagaactacagcgccctcaactacaccggattagttaagattctcaagaagtatgacaagaggactggggctctgatccgtctgcctttcatccagaaagtgctacagcagcctttcttcaccactgacctcctgtacaagcttgtgaaacagtgtgaggccatgctggaccagcttctaccatcaaacgaactgtctgtatcgagtgaagatgggagaggcgatagcactaacgaggacaagccttcgaatcccagttcatccttggttaatggtggcactattccagagttagatgagatcgagtacatggaaagcatgtatatgaagggcacggtcgcggcgcttaggtctctgaaggagatccgaagcggaagctctactgttagtgcattctcattaccacctctccagggcgacagttcgccagaggagcagcaggaactgtggaataagattccggtgattgagcaggccgccaaatgacacgaccggcatttcactacatggttatgtacactgcatgaccttgatcttgacatttgctggagatagtaccggggatctcattcccctgtcatatattcagtaatttgtatgattccaggattcctaacagttgtaaaatggtggacatgttcagtatacattgtaaaatcatagaaacccatcataaccatcagacagaactgagatgttttgattcactattgtgagttaaatcctgtactttttgctgatctacatcctctttcatgaactctcggtacagaattagttaatgttgcagtataacaattctgattttgac

SEQ ID NO: 4525 - DNA, 1491 bp, Oryza sativa
atgaagtttgggaagagcctgagtagccagatcgtggagacgctcccggagtggcgggacaagttcttgtcgtacaaggatctcaagaagcggctcaagctgattggtgggggtgggggtggggaggagaggcaggcgaagcgggcacgcgttgcagcggatggcggcgaggaggaggccgccgccgcggcgatgacgcccgaggaggcgggcttcatgcggctcctggaggccgagctcgacaagttcaactccttcttcgtcgagaaggaggaggaatacatcatccgccagaaggagctgcaggacagggtggcgagggcggcggggagggagtcgaaggaggagctgatgcgggtgcgcaaggagatcgtcgacttccatggcgagatggtgctgctcgagaactacagcgccctcaactacaccggattagttaagattctcaagaagtatgacaagaggactggggctctgatccgtctgcctttcatccagaaagtgctacagcagcctttcttcaccactgacctcctgtacaagcttgtgaaacagtgtgaggccatgctggaccagcttctaccatcaaacgaactgtctgtatcgagtgaagatgggagaggcgatagcactaacgaggacaagccttcgaatcccagttcatccttggttaatggtggcactattccagagttagatgagatcgagtacatggaaagcatgtatatgaagggcacggtcgcggcgcttaggtctctgaaggagatccgaagcggaagctctactgttagtgcattctcattaccacctctccagggcgacagttcgccagaggagcagcaggaactgtggaataagattccgcacgagcgccccatctacaagctcgtgttcgccggcggggacaagggcatgtcgcagacggagatccggatcaagaccgggatgccgacgagcaccctcaccaagcacctccgcggcctcacctccaagggcgtcctcaaggtggtcaacagcgtccacaagcgcgccgagaagatctacatggacgtccgcatcgacccgtcgccggagatcaccgggggaacctggtaccgcaacggccagctcgactccgacgccgtcgcctccgcgcggcgcaggtgcctcgaccagatcgacaagctcggcgtcgccacggcggagtccatccacgagggcatcagcagggaatgctccaacctagcctactcgaccgagcaggtcagggacatcctgcgcaccatggcgctcgacagggaggtcgaggaggtgaggagcaccggggcgggggagttcggcgacctcagggcagggagggtgtgctaccggaggggcggcccggtgcagggcggcatgatggagaggatcccgtgtggagtttgccccaggatcgatgagtgctcgccggatggcgttatctcgccgagcacctgcgtctactacaagaagtggctgcagatggacttctag

SEQ ID NO: 4526 - DNA, 1374 bp, Saccharum officinarum
ttcatccacaaccaccagcccgccccacctctaccacgcccaagtccgcctctcgcgcgagggagaagaccggatccgcggccggatggcgacgatccagcacaagccgactccgacggcgccgtcgacgacgacgggcggcgggctgcgagccatggacctgtacgagaagctggagaaagtcggggagggcacgtacgggaaggtgtacaaggcccgggagaaggcgacgggccggatcgtggcgctcaagaagacgcggctccccgaggacgacgagggcgtgccccccaccgcgctgcgggaggtctcgctgctgcggatgctgtcgcaggacccgcacgtggtgcgcctgctcgacctcaagcagggcgtcaacaaggaggggcagaccatcctgtacctcgtcttcgagtacatggacacggacctgaagaagttcatccggggctaccgcgccaaccacgagaagatccccgcacaaaccgtcaagatcctgatgtaccagctgtgcaagggcgtggctttcgtccacggccgcggggtgctgcaccgtgatctcaaaccccacaacctgctcatggaccgcaagaccatggcgctcaagatcgctgacctcggactcagccgtgccatcaccgtccctatgaagaagtacacacacgagattctgacgctttggtacagggcgcctgaggtcttcttggcgccactcactactccacgccggttgacatttggtccgtgggctgcatatttgctgagttggtcactaaccagccacttttccctggcgactctgagttgcagcagctcctccacatcttcaagttgctgggcaccccaaatgagcagatgtggccaggagtaggcaagctacccaactggcacgtgtacccccagtggaagcccactaagctgtccactcttgtccctggtcttgactccaatggctacgatttacttgagaaaatgctggcatatgagccggcgaagcggatctctgcgaagaaggccctggagcacccgtacttcaatgatgtgaacaaggaggtgtactgaagcgatccgagtagtaggattcgtcgagaggatccttgccaccttgttcttagcttagtgttttaacatggctgccctgaagcagtgcttttgcttccaggcagtatctctgtgttcaagctgctactttcttgtattgtgccattcactttggttgtgacggtagggagaattttcagcataagtgaacttatgttgacattgtttcttgcaatttgtagccggaaagcctgggatcatctcccacttactttataaagctttgtctctatggctgtgaagcacaagatgcctgtcttaatcaaaaccgat

SEQ ID NO: 4527 - DNA, 1466 bp, Sorghum bicolor
ctctccccccacgctcccacaccgtatacaaaacacaatcctcgccgcattccagttcccagatccatccacagccgccagcccgcctcctctacctgcagactaccacgcccaaatccgcctcaagcgcgagggagaagaccgaccggatccgcgttcgggatggcgacgatccagcacaagccggctccgacggcgccgtcgacgacgacgggcggcggcctgcgcgccatggacctgtacgagaagctggagaaagtcggggagggcacgtacgggaaggtgtacaaggcccgggagaaggcgacgggccgcatcgtggcgctcaagaagacgcggctccccgaggacgacgagggcgtgcccccgaccgcgctgcgggaggtgtcgctgctgcggatgctgtcgcaggacccgcacgtggtgcgcctgctcgacctcaagcagggcgtcaacaaggaagggcagaccatcttgtacctcgtcttcgagtacatggacaccgacctcaagaagttcatccggggctaccgcgccaaccacgagaagatccccgcacaaaccgtcaagatcctgatgtaccagctgtgcaagggcgtggctttcgtccacggccgcggggtgctgcaccgtgatctcaaaccccacaacctgctcatggaccgcaagaccatggcgctcaagatcgctgacctcggactcagccgtgccatcaccgtccctatgaagaagtacacacacgagattcttacgctgtggtacagggcgcctgaggttcttcttggcgccacacactactccacgccggttgacatttggtccgtgggctgcatatttgctgagttggtcactaaccagccacttttccctggcgattctgagttgcagcagctcctccacatcttcaagttgctgggcaccccaaatgagcagatgtggccaggagtaggcaagctgcccaactggcacgtgtaccctcagtggaagcccactaagctgtgcactcttgtccctggtcttgactccgatggctatgatttgcttgagaaaatgctggcatatgagccggcgaagcggatctctgcgaagaaagccctggagcacctgtacttcaatggtgtgaacaaggaggtgtactgaagcaatcccagtagtaggagtcgtcgagaggatccttgtcaccttgctcttagcttagtgtgttaacatgactgccctgaatcagtgcttctgcttccaggcaggcagtatctctgtgtttaagctgctactttcctttgtgttgtgccatccactttgggtgtaatggatagtagggagaattttcagcataagtgaacttatgttgacattgtttcttgcaatttgtagccagaaaccctgggatcatcttccaattgttttataaagcttcactctagggctctgaagcacaagatgcctgtcttaatcaaagccaataattc

SEQ ID NO: 4528 - DNA, 1336 bp, Sorghum bicolor
gcatacaaatcctcccccaaatcccaaaccctactccatccgcatccaccacgcacccacccatcctccgacgccatctccgacgatctacccaaatccgccgcgcgcgcgagagagggcgagggccggatccgaccgatggcgacgatgcagcaccaggccgctgcggcgccgccgagcacgacgactggcggcgggcagcgcgcgatggacctgtacgagaagctggagaaggttggggaggggacgtacgggaaggtgtacagggcgcgagagaaggcgacggggcggatcgtggcgctgaagaagacgcggctccccgaggacgacgagggcgtgcctcccaccgcgatgcgggaggtctccctgctgcggatgctgtcgcaggacccgcacgtggtgcgcctgctggacctcaagcagggcgtcaacaaggaggggcagaccatcctctacctcgtcttcgagtacatggacaccgacctcaagaagttcatccgcggacaccgcaacaaccgcgagaagatccccgaggccaccgtgaagatcctcatgtaccagctgtgcaagggcgtggccttcgtccacggccgtggggtgctgcaccgtgatctcaagccgcacaatctgctgatggaccgtaagaccatggcgctcaagatcgccgacctcggcctcagccgcgccatcaccgtccctatcaagaagtacacccacgagatccttactctctggtacagggctcccgagatcctcctaggcgccacgcactactccacgcctgtcgacatatggtctgttggctgcatttttgctgagttggtcactaaccagccacttttccctggtgactccgagttgcagcagctgctccacatcttcaagttgctgggcaccccgaatgaggaggtgtggccaggcgttgacaagctgcccaattggcacgtgtacccccagtggaagccgacgaagctgtccactcttgtgcccggtctcgacgctgatggctacgatctccttgagaaaatgctggtgttcgagccggggaagcggatccctgcgaagaaggccctggagcacccctacttcaacgacgtgaggaaagagatgcactgactgaagcgatccaataatccaccgaggggtgtgttgagcatgattgccctgaagcagttcttttgctaccagggcctactttaattagtttctgttttctactagactagatgatttttcctgtgtgctgtgaatcattccgctttggttgtgatggattaaaacactagggataaagtaagttgaacataagccagcaaaatcgtgtttgcgagtgaaa

SEQ ID NO: 4529 - DNA, 1557 bp, Echinochloa colona
acacgacgactcgcatacaaatcatcccccagttccaaaccctaaatccaccacgcacccccacttccccacgcccagcaccaaatccgcccgagggaggaccatccgcgcgctccagatcaaccccaccgccgatcccccacgcccagcaccaaatccgcccgaggggaggcccgatccgcgcctccccaaatccgccccgagggagcaccaaatccgcgcctccccaaatccgtgcagccccaaatccgccccgagggaggaccgatccgcgcgcgcgatggcggcgctccagaaccagccgaagcccgcggcggcgccgtcgacgacgaccggcggcgggctgcgcgccatggacctgtacgagaagctggagaaggtgggcgagggcacgtacggcaaggtgtacaaggcccgggagaaggcgacggggcggatcgtggcgctgaagaagacgcggctccccgaggacgacgagggcgtgccccccaccgcgctgcgggaggtctccctgctgcggatgctgtcgcaggacccgcacgtggtgcgcctcctcgacctcaagcagggcatcaacaaggagggccagaccatcctctacctcgtcttcgagtacatggacaccgacctcaagaagttcatccggagccaccgcgccaaccacgagaagatccccgcgctcactgtcaaggtcctgatgtaccagctgtgcaagggcgtggccttcgtccacgggcgcggggttctgcaccgcgacctcaagccgcacaacctgctcatggaccgcaagaccatggcgctcaagatcgccgacctcggcctcagccgcgccgtcattgtccctataaagaagtacacccacgagatcctgacgttgtggtacagagcgcccgaggttcttcttggcgccacccactactccacgccggttgacatgtggtccgtgggctgcatatttgctgagttggtcactaacaacccacttttccctggggactccgagttgcagcagctcctgcacatcttcaagttgctgggaaccccaagtgagcaagtatggccaggcgttggcaaacttcccaactggcacgagtacccgcagtggaagcccacaaagctgtccactcttgttcccggtctcgatgccgacggctatgacctgcttcagaaaatgcttgagtacgaaccggcgaagcgcgtctctgcgaagaaggccctggagcacccctactttaacgatgtgaacaaggagctgtactgaagctgttggcacagccttcatgagttgacatgaaggcatagcttgtacaacttgcgtttagcctggttgatgtgttaacatgatcgccctgaagcagtgcttttgcttccagggcaagtagcaagtaggtaaggtatgtctgttttcctgtgtcattgtgtgctgtgtcattcactttggttgtgatgggcaaactagaaagaattttcaacacaaagtgaactcgaattgaagagtggattgatgtttctttgcacttgttgctggaaagcctggaatcattttccatttggttc

SEQ ID NO: 4530 - DNA, 871 bp, Saccharum officinarum
accgacctgaagaagttcatccgcggacaccgcagcaaccgcgagaagatcccctcggccaccgtgaagatcctcatgtaccagttgtgcaagggcgtggccttcgtccacggccgcggggtgctgcaccgggacctcaagccgcataacctgctcatggaccgcaagacaatggcgctcaagatcgccgacctcggcctcagccgcgccatcaccgtccctgtcaagaagtacacccacgagattcttaccctctggtacagggcccctgagattcttctgggcgccacacactactccacgcctgttgacatatggtctgttggctgcattttcgctgagttggtcactaaccagccacttttccctggtgactccgagttgcagcagctgctccgcatcttcaagttgctgggcaccccgaatgaggaggtgtggccaggcgtgggcaagctgcccaattggcacgagtacccccagtggaagccgacgaagctgtccactcttgtgcccggcctcgatgctgatggctatgatcttcttgagaaaatgctggagtacgagccagcgaagcggatccctgcgaagaaggccctggagcacccctacttcaacgacgtgaggaaggagatgcactgactgaagcgattcaataatccaccaagggggtgttgagcatgattcctttgccctgaagcagttcttttgctaccagggcacaggcaccttagtttctgttttctactagctgccttagtttctattttgtactagctgattttcctgtgtgctgtctgctgtgaaccattcgctttggtggttgtgatggatgaaaacactagcagggataagtaagttgaacataagccag

SEQ ID NO: 4531 - DNA, 2293 bp, Panicum virgatum
tataaaacccactaaggcccatctattgaaaaaaatgttgaaccgatgtttcaaaaaatgttgagccaactttcgaaaaatgttgaattatttcgaaaatgttgaatcaacgtttaaaactcatcttatctgacgccggcggccaacgggcaggcagcgcgtggagaagcagggcacgcgggcagcggcggtgcgaggcgggtggtcggcggcggcagggttggaggagaggggaaggggagggaggaagctggagtttgagtatatttaaaggctgaaattgtttgtacgaatctcaagtattggaaggtcggaaagaatttttcggaagatgtatagaattggtgcaaacaagcagactgaaatgatacggcctttccacgttcccacggcccataggcttccttacaccaccatcgccgacgttgggctgcagcttcatcaggcctgcttttcagttcggcccataactcgtgtggaaggaaaaccggcccacacctccaccgaccttggcttcccctcaaacggcgtacaggattcgaaattcgaagtcacaaggagccgttggagcgcctcctcggcggcgtcctcacctcccctcaaacggctctctcctcccccccgctccctcccgcatacaaaatcctcccccaattccaacccctaatccacgcactccagatccgcccaccaccgccaccgccgtccaccacgccctgccccaaatccgccgcgagagcgagaggaccggccccccgcgcgagagcgatggcgacgctccagcaccagccgaagccggcggcggcgccgtcgacgaccacgggcggagagctgcgcgccatggacctgtacgagaagctggagaaggtgggcgagggcacgtacgggaaggtgtacaaggcgcgggagaaggcgacgggccggatcgtggcgctgaagaagacgcggctccccgaggacgacgagggcgtgccccccaccgcgctgcgggaggtctcgctgctgcggatgctgtcgcaggacccgcacgtggtgcgcctgctcgacctcaagcagggcgccaacaaggagggccagaccatcctcttcctcgtcttcgagtacatggacaccgacctcaagaagttcatccgggggcaccgcgccaaccacgagaagatccccgcgctcaccgtcaaggtcctgatgtaccagctgtgcaagggtgtggccttcgtccacggccgcggggtgctgcaccgcgacctcaagccgcacaacctgctcatggaccgcaagaccatggcgctcaagatcgctgacctcggcctcagccgcgccatcaccgtccctttgaagaagtacacccacgagatcctgaccctgtggtacagggcacccgaggttctgcttggcgccactcactacgccacgccggttgacatctggtccgtgggctgcatatttgctgagttggtcactaacaacccactattccccggggactcagagttgcagcagctcctgcacatcttcaagctgcttggcaccccgaatgagcaggtgtggccaggcgtcggcaagctccccaactggcacgagtacccgcagtggaagcccacgaagctgtccactcttgtccccggtctcgacgaagacggctacgacttgcttgggaaaatgctcgagtacgcgccggcgaggcggatctctgcgaagatggccctgaagcacccgtacttcaatgatgtgaacaaggagcagtactgaagcgatgcgagaagcaggaatcaggaatccgctgcgagccttcatgagttggcatgaaggtgaagctgcttcttgtataagctaattcttggccttgttggtgtgcaacttgattgccctgaagcagtgcttttgcttccaggacagcagtagtaatagtagtagtagaagaagagtatgtctgttttctagtacctgctttcttcctgtgctgtggcattcactttggttgtgatggataaactagaaagaagttcaacataaagtgaactagtattgacgagttttttttttcgcgaacgtgactgagtacttattttgttaagagcaagcacttgtattgacgagcggcaatcttctcctttctggtgtcttttgtaaaacttttcgtcgtggcttgatcgttttgctcgagctgtctggacattgtttgtgcagctgctccttgtccgcgtacagctcttgatcgttgcggctcgttgtccttgggcgaggaaggctgtcccgtaccccaggggaagaggtgacgtgccgagcggtatgt

SEQ ID NO: 4532 - DNA, 1202 bp, Panicum virgatum
ccagcagccgaacacagtggaacaccagccgcgagagctagaggaccggacccgcgcgatggcgacgctccagcaccagccgaagccggcggcggcgccgtcgacgaccacggggggcgggctgcgcgccattgacctgtacgagaagctggagaaggtgggcgagggcacgtacgggaaggtgtacaaggcccgggagaaggcgacgggccggatcgtggctctgaagaagacgcggctccccgaggacgaggagggcgtgccctccaccgcgctgcgggaggtctcgctgctgcggatgctgtcgcaggacccgcacgtggtgcgcctgctcgacctcaagcagggcgccaacaaggagggccagaccatcctctacctcgtcttcgagtacatggacaccgacctcaagaagctcatccgggggcaccgcgccaaccacgagaagatccccgcgctcaccgtcaaggtcctgatgtaccagctgtgcaagggcgtggccttcgtccacggccgcggggtgctgcaccgcgacctcaagccgcacaacctgctcatggaccgcaagaccatggcgctcaagatcgccgacctcggcctcagccgcgccatcaccgtccctctcaagaagtacacccatgagatcctgacgctgtggtacagggcacccgaggtcctgcttggcgccaggcactactccacgccggttgacatgtggtccgtcggctgcatatttgctgagctggtcactaacaacccactattccctggggactcggagttgcagcagctcctgcatatcttcaagctgcttggcaccccgaatgagcaggtgtggccaggcgttggcaagctgcccaactggcacgagtacccgcagtggaagcccacgaaactgtccactcttgtccctggtctcgaccaagacggctacgacctgcttgggaaaatgctcgagtacgagccggcgagacggatctctgcgaagatggccctggagcacccatacttcaacgatgtgaacaaggaacagtactgaagcgacgcgagaagaagaaacgaggaatctgctgcgagccttcatgagttggcatgaaggtacagctacttgtatgcttggcctggttggtgtaacttgattgccctgaagcagtgcttttgcttcgaggacagcagcagtagtagaagagtatgtctgtttt

SEQ ID NO: 4533 - DNA, 1110 bp, Panicum virgatum
atcgtggcgctcaagaagacgcggctccccgaggacgacgagggcgtgcccccccaccgcgctgacgggaggtatcgctgctgcggatgctgtcgcgggacccgcacgtggtgcgcctgctcgacctcaagcagggcgtcaacaaggagggccagaccatcctctacctcgtcttcgagtacatggacaccgacctcaagaagttcatccgggggcaccgcgccaaccacgagaagatccccgcgctcaccgtcaagatcctgatgtaccagctgtgcaagggcgtggccttcgtccacggccgcggggtgctgcaccgcgacctcaagccgcacaacctgctcatggaccgcaagaccatggcgctcaagatcgccgacctcggcctcagccgcgccatcaccgtccctctcaagaagtatacccatgagatcctgacgctgtggtacagggcacccgaggttctgcttggcgccacgcactacgccacgccggttgacatgtggtccgtgggctgcatatttgctgagttggtcactaacaacccactattccccggggactcagagttgcagcagctcctgcacatcttcaagctgcttggcactccgaatgagcaggtgtggccaggcgtcggcaagctgcctaactggcacgagtacccgcagtggaagccaacgaagctgtccactcttgtccccggtctcgacgaagacggctacgacctgcttgggaaaatgctcgagtacgagccggcgaggcggatctctgcgaagatggccctggagcacccgtacttcaactgtgtggacaaggagaagtgccttcatgagttggcatgaaggtgcagccgctttaataacctattcttagcctggttggtgtgttcatgagttggcatgcgaagattgccctgaagcagtgcttttgcttccaggatagtagtaagtagtgatagtagagtatgtctgttttctagtacctgctttcctgtgtgctgtggcattcactttggttgcgatggataaactagaaagagtttcagcataaagtgaactggtattgacgagttcttttttttttcgaacacttattctgttaagagcaagc

SEQ ID NO: 4534 - DNA, 1482 bp, Setaria italica
acgacatctcaagggagccgttggagcgcctactcggcggcgacatctcaaacggctctctccttcccccccgctccctcccgcgtacaaattctcccccaattccaaaccctaaatccacgcacccccacagctccagacccacccaccaccgccatccccccacgcccatccccaaacccaccgcgagcgaggaccggatccgggcgatggcgacgctccagcaccagccgaagccggcggcggcggcggcgccgtcgacgaccacgggcggcgggctgcgcgccatggacctgtacgagaagctggagaaggtgggcgagggcacgtacgggaaggtgtacaaggcccgggagaaggcgacgggccggatcgtggcgctgaagaagacccggctcccggaggacgacgagggcgtgccccccaccgcgctgcgggaggtctcactgctgcggatgctgtcgcaggacccgcacgtggtgcgcctcctcgacctcaagcagggcgtcaacaaggagggccagaccatcctctacctcgtcttcgagtacatggacaccgacctcaagaagttcatccgcagccaccgcgccaaccacgagaagatccccgcgctcactgtcaagatcctcatgtaccagctctgcaagggtgtgaccttcgtccacggccgcggggtgctgcatcgcgacctgaagccgcacaacctactcatggaccgcaagaccatggcgctcaagatcgctgacctcggcctcagccgcgcagtcatcgcccctctcaaaaagtacacccacgagatcctgacgctgtggtacagggcgcccgaggttcttcttggcgccacgcactactccacgccggttgatatgtggtccgtgggctgcatattcgccgagctggtcactaacaacccactcttccccggggactcggagttgcagcagctcctgcacatcttcaagctgcttggcacccccaatgagcaggtgtggccaggcgttggcaagctccccaactggcatgagtacccgcagtggaagcccacgaagctctccacccttgtccccggtctcgatgccgacggctacgatctgctcgggaaaatgctggagtacgagccgacgaagcgggtctgtgcaaaggcggccctggagcacccgtacttcaacgatgtgaacaaggacctgtactgaagcgattggaacccaccgagcgagccttcatcatttgggggggggggggggggcacagcttctataacttgtactgtagcttggttggtgtgttaacatgatccccctgctgaaggctgaagcaatgcttttgcttccagtgcagtagtagcgtatgcctgtttttctagctgctgctttcctttgtgttgtgccattcagttaactcgctaaaggacgaatttcagcataagttaactcgcatttgacgagtgaaatgatgtttctttgcacttggagctggaaa

SEQ ID NO: 4535 - DNA, 1328 bp, Zea mays
caatcccccaaaccctactccaccacgcgatcaccgaccgacgcctctccgacgagcaactcaaccccccaccgcgcacgcgagagccggatccccacgatggcgacgatccagcaccaggcgaaaccggcggtggcggcggcgccgagcacgactactggcggtgggcagcgcgcgatggacctctacgagaagctggagaaggtcggagaggggacctacgggaaggtgtacagggcgcgggagaaggcgacggggcggatcgtggcgctgaagaagacgcggctccccgaggacgacgagggcgtgccccccaccgcgatgcgggaggtctccttgctgcggatgctgtcgcaggacccgcacgtggtgcgcctgctggacctcaagcagggcgtgaataaggaggggcagaccatcctctacctggtcttcgagtacatggacaccgacctcaagaagttcatccggggacaccgcagcaacaacgagaagatccccgcggccaccgtcaagatcctgatgtaccagctctgcaagggcgtggccttcgtccacggccgcggggtgctgcaccgggacctcaagccgcacaacctcctcatggaccgcaagaccatggcgctcaagatcgccgacctcggcctcagccgcgccatcaccgtcccggtgaagaagtacacccacgagatacttaccctgtggtacagggcccccgagattctgcttggagccacgcactactccaccccggttgacatatggtccgttggctgcattttcgccgagctggtcactaaccagccacttttccctggcgactcggagctgcagcagctgctccacatcttcaagttgcttggcaccccaaacgaacaggtgtggccaggcgtcggcaagctgcccaactggcacgagtacccccagtggaagccgacgaagctgtctgctcttgtgcccggcctcgacgctgatggctacgatcttcttgagaaattgctggaatacgagccggcgaagcggatccccgcgaagaaggccctggagcacccctacttcaaagatgtgaggaagggagatgcgcactgactgaagcgatccaccaagggcccgccctcacgagttgacatatatatacgtgtgtgtcgtcgtgtcgagcatgattgccctgaagcaattcttttgctaccagggcacagcctactttctgttctctagttgatgttcgtgtcgtgtgtgctgtgaaccgttcgctttggctggtgatggatggaaatgttatgtttctaggattactgatgaaactttgatgtctacctggtcattca

SEQ ID NO: 4536 - DNA, 1323 bp, Pennisetum glaucum
gaagctggagaaggtgggcgagggcacgtacgggaaggtgtacaaggcccgggagaaggcgacgggccggatcgtggcgctgaagaagacccggctcccggaggacgacgagggggtgccccccaccgcgctgcgggaggtctcgctgctgcggatgctttccaaggacccgcacgtggtgcgcctcctcgacctcaagcagggcgtcaacaaggagggccagaccatcctctacctcgtcttcgagtacatggacaccgacctcaagaagttcatccgcatccaccgcgccaaccacgagaagatcccctcgcccaccgtcaagatcctcatgtaccagctctgcaagggcgtggccttcgtccacagccacggcgtcctgcaccgcgacctgaagccgcacaaccttctgatggaccgcaagaccatggcgctcaagatcgccgacctcggcctcagccgcgcaatcatcgtccctctgaagaaatacacgcacgagatccttacgctctggtacagggcgcccgaggtccttcttggcgccacgcactactccacaccggttgacatgtggtccgtgggctgcatatttgccgagttggtcactaacaacccgctcttccccggcgactcggagttgcagcagctcctgcacatcttcaagttgctgggcacccccaatgagcaggtgtggccaggcgttgtcaagctccccaactggcacgagtacccgcagtggaagcccacgaagctctccactcttgtccccggtctcgacgccgacggctacgatctcctcgggaaaatgctgcagtacgagccgcagaatcggatcaatgcgaagggcgccctggagcacccctacttcaacgatgtgaacaaggacctgtactgaagagattggaacccaccgggagagagagcccttcgtcatcagttggcatggaggcacagcttgtccttttttttagcttggttggcgtgttaacataatcaccctgaagcagcgcttttgcttccagggcagtagaagcagcgttattgtcttgtaccacattcactttggttgtgatgtgtgtcaaacttggaagaatttcagcataagctaactcgtttgacgagtggaatggtgtttctttgcactcgcaagaatttcagtatactgcttttttttatcgtgcctggttttattgggggaaaaatgctcgtgatagcagcagcctttgagtatggctacacagtactacccaacagttgtacggcggtattattggctttttcacttttttactattgtttggaaaaaaatttccccacatacca

SEQ ID NO: 4537 - DNA, 1491 bp, Brachypodium distachyon
ccccaatcgcacaaaccctagccccacaatccccaaatccatcttccatctcacgcaacccacgacaaagagagaaacagaggaggatcagatctgcgcgatggcgacgctccagcaccagaagcagggggcggcgggggcggcggcgccgatgacgacgacgggcggcggcgggcttcgtgccatggacctgtacgagaagctagagaaggtcggggaaggcacgtacgggaaggtgtacaaggcccgggagaaggccaccggccggatcgtggcgctcaagaagacccgcctcccggaggacgacgagggcgtgccccccacggcgctcagggaggtctccctgctgcggatgctgtcgcaggacccgcacgtcgtgcgcctgctcgacctcaagcagggccagaacaaggagggccagaccatcctctacctcgtcttcgagtacatggacaccgacctcaagaagttcatccgcggccaccgccagaaccacgagaagatccccgcccacaccgtcaagatcctgatgtaccagctctgcaagggcgtggctttctgccatggacgtggcgtcctgcaccgtgacctcaagccgcacaacctgctcatggaccgcaagaccatggcgctgaagatcgctgaccttgggctcagccgtgccttcacggttcctctcaagaagtacacccacgagatcctgactctgtggtacagggctcctgaggttcttctcggcgccacacactactccacgccggttgacatgtggtccgtgggctgcatatttgctgaattgatcactacccaagcacttttccctggagattctgaggtgcagcagcttctgcacattttcaagttgctaggcaccccaaatgaggttgtctggccaggagtaggccagctgcccaactggcatgagtacccccagtggaatgtctccaagttgtcttctgtgattcctggtttggacgccgatggccttgatctgcttgagaaaatgttgcagtacgagccggcaaagcgaatctctgctaagaaggccatggagcacccgtacttcaatgatgtgaacaaggagctctactgaagctgttcatctttgtctccgtgactaacaagaagcggatatcctcttacttgcgcttgccctgaagcatctcttttgcttcgagcgtgtgcttttttatctgtatgtccctagtgtgtgtcattcactgtgtttgtgatggacaatggagttctgcataattaaactcgtatcgatgagtgtagacatgttgttcttgtttttggttgtgaaaccatctgtttctcagacaaatgtgagttgtcaaatcatttttctattacttgtggtcttgtattgtacccggaaggaggggaactgattgacattatcaaatcttcatagcctcatgcggatgctgtgttggatgaatacattagcagagtccaggaagaagtaaagtattacgggcaattctc

SEQ ID NO: 4538 - DNA, 1289 bp, Lolium multiflorum
accctagccccaccacgcctccacccccaaatccaccatccacgcacaacaacagcagcggacgagagagacagagagggagcggcggatctgcgcgatggcgaccatccagcaccagggagccttggcgccgccgcccatggcgacgacggggggcgacgagatgcgcgccatggacctgtacgagaagctggagaaggtcggggagggcacgtacggcaaggtgtacaaggcccgggagaaggccacgggccggatcgtggcgctcaagaagacgcgcctcccggaggacgacgagggcgtcccgcccacggcgctcagggaggtctccctgctgcggatgctgtccgaggacccgcacgtcgtgcgcctgctcgacctcaagcagggccagaacaaggagggccagaccatcctctacctcgtcttcgagtacatggacaccgacctcaagaagttcatccgcggacaccgccagaaccacgagaagatccccgcacacacagtcaagatcctgatgtaccagctctgcaagggcgtggccttctgccacggccgcggcgtcctgcaccgcgacctcaagccgcacaacctgctcatggaccgcaagaccatggcgctcaagatcgccgacctcgggctcagccgtgccttcacggttcctctcaagaagtacacacacgagatcctgactctgtggtacagggctcccgaggtccttcttggcgccacacactactccacgcctgttgacatgtggtccgtcggctgcatatttgctgaattgatcaccacctctgccctgttccctggagactctgaggtgcagcagctcctgcacattttcaagttgctgggcactccaaatgaggaggtctggccaggagtgggcaagctccccaactggcacgagtaccctcagtggaatgtctcacccttgtcttctgtaattcccagtctcgacgctgatggtattgatctgcttgagaaaatgctgcagtatgagccggcaaagaggatctctgcaaagaaggcaatggagcacccctacttcgatgacgtagacaaggagctgtactgaagactagcatgaagccgatttcttgcgacttgtgcttgcccggaagcatctcttttgcttccacggcatactttttatcactgtttttccagctgctgtttagtgtgcgtcattcactggtatctgtgatggataatgactatgtagcgtcctgcataattaaactgtcttgctgaatgtcttatgaaacagtacttctgcttcaagg

SEQ ID NO: 4539 - DNA, 1196 bp, Oryza sativa
acaccacccaaccagcgagagagagatggcggcgctccaccaccaggcggcggcggcgccggtgacgacgacgacggacgggggcgagctgcgggcgatggacctgtacgagaagctggagaaggtcggggaggggacgtacgggaaggtgtacaaggcgcgggagaaggcgacggggcggatcgtggcgctgaagaagacgcggctgccggaggacgacgagggcgtgccgccgacggcgctcagggaggtgtcgctgctgcggatgctgtcgcaggactcgcacgtggtgcgcctgctggacctcaagcaggggcagaacaaggagggccagaccatcctctacctcgtcttcgagtacatggacaccgacctcaagaagttcatccgcgcccaccgccagaatctccagaagatccccgtgcccaccgtcaagatcctgatgtaccagctctgcaagggcgttgctttctgccatggccgcggtgtgctgcaccgtgacctcaagccgcataacctgctcatggaccgcaagaccatggcgctcaagatcgccgacctcgggctcagccgctcgttcactgtccctctcaagaagtacacccacgagatcctgacgctgtggtacagggctcccgaggttcttcttggcgcggcacactactccactccggttgacatctggtctgtgggctgcatttttgctgagttggccactaaccaacctcttttcgctggagattccgaggttcagcagcttctgcacattttcaagttgctgggcaccccaaatgagcaagtttggccaggagtgagcaagctacctaactggcacgagtacccccagtggaatccctcgaaagtgtctgatcttgtccatggtctcgacgctgatgctcttgatcttcttgagaaaatgctgcagtacgagccgtcgaagcggatctctgcgaagaaggccatggagcatccctacttcaacgacgtgaacaaggagctctactgaaggtcgattgatgatgttcaccaccaaggaaaaaaaaacgttgtgcgtcttcgtgactagcctgccctgaagcattgcttttgcttctagggggaaaagtactgtttgtgtctgtttcctggatgctgcttagtgtgcttaagaattcacttgtttgtgatggtaatgagtaatgacttaagaattcgac

SEQ ID NO: 4540 - DNA, 1374 bp, Secale cereale
caacccaccaccaaatcacccgtctcgcacggcagcccaccagagaggaagaggccgagggagagcggatctgcgcgatggcgacgctccagcaccagaaccagggggcggcggcgccgatgaccaccacgggcggcgggctgcgcgccatggacctctacgagaagctggagaaggtcggggagggcacctacgggaaggtgtacaaggcccgggagaaggcgacgggccggatcgtggcgctcaagaagacgcgcctcccagaggacgacgagggcgtgccccccacggcgctcagggaggtctcgctgctgcggatgctgtcgcaggacccgcacgtcgtgcgcctgctcgatctcaagcagggccagaacaaggagggccagaccatcctctacctcgtcttcgagtacatggacaccgacctcaagaagttcatccgcggccaccgccagaaccacgagaagatccccgcccacaccgtcaagatcctgatgtaccagctctgcaagggcgtggctttctgccacggacgtggtgtcctgcaccgtgacctcaagccgcacaacctgctcatggaccgcaagaccatggctctcaagatcgccgatcttgggctcagtcgtgccttcacggttcctctcaagaagtacacacacgagatccttactctgtggtacagagctcctgaggtccttcttggcgccacacactactcaacgccggttgacatgtggtctgtgggctgcatatttgctgaattgatcactaccacggcacttttccctggagactctgaggtgcagcagctcctgcacattttcaagttgcttggcactccaaatgaggatgtctggccaggagtaggcaaactcccgaactggcatgagtaccctcagtggaacgtctcaaagctgtcttctgtaattcctagtctcgatgccgatggtattgatctgcttgagaaaatgctgcagtatgagccggcaaagcggatctctgcgaagaaggccatggagcacccatacttcgatgatgtggacaaggcgctgtactgaagctgtcttcgtggatagcaagaagcagatttcttgtgatttgtccttgtcctgaagcatatcttttgcttccagggcaggcatctttacctccgttattccagctgccatttagttttgccccattgactgatggttgtgatggatagtgactctggagttatgcataattaaacgcctcttgccaggcgttagaaactggtcttatgaagcactacttctgcttcaaaatcaggctttacctctttttctagctgctatttatagtgtacgccatttatttttgtttctgatggataactgaaaaatcgtcttg

SEQ ID NO: 4541 - DNA, 1516 bp, Triticum aestivum
caccaccaccaaatcacccatctcgcacggcagcccaccagagaggaagaggccgagggagagcggatctgcgcgatggcgacgctccagcaccagaaccagggggcagcggcgccgatgaccaccacgggcggcgggctgcgcgccatggacctctacgagaagctggagaaggtcggggagggcacctacgggaaggtgtacaaggcccgggagaaggcgacgggccggatcgtggcgctcaagaagacgcgcctcccggaggacgacgagggcgtgccccccacggcgctcagggaggtctcgctgctgcggatgctgtcgcaggacccgcacgtcgtgcgcctgctggatctcaagcagggccagaacaaggagggccagaccatcctctacctcgtcttcgagtacatggacaccgacctcaagaagttcatccgcggccaccgccagaaccacgagaagatccccgcccacaccgtcaagatcctgatgtaccagctctgcaagggcgtggctttctgccacggacgcggtgtcctgcaccgtgacctcaagccacacaacctgctcatggaccgcaagaccatggctctcaagatcgccgatcttgggctcagtcgtgccttcacggttcctctcaagaagtacacacacgagatccttactctgtggtacagagctcctgaggtccttcttggcgccacacactactcaacgccggttgacatgtggtctgtgggctgcatatttgctgaattgatcactaccacggcacttttccctggagactctgaggtgcagcagctcctgcacattttcaagttgctgggcactccaaatgaggatgtctggccaggagtaggcaaactcccgaactggcatgagtaccctcagtggaacgtctcaaagctgtcttctgtaattcctagtctcgatgccgatggtattgatctgcttgagaaaatgctgcagtatgagccggcaaagcggatctctgcgaagaaggccatggagcacccatacttcgatgatgtggacaaggcgctgtactgaagctgtcttcgtggctagcaagaagcggatttcttgtgatttgtgcttgtcctgaagcatatcttttgcttccagggcaggcatctttacctctgttattccagctgccatttagttttgccccattgactgatggttgtgatggatagtgactctggagttatgcataattaaacgcctcttgccaggcgttaagtactggtcttgtgaagcactacttctgcttcaaaatcaggctttacctctttttctagctgctatttatagtgtatgccattcatttttgtttctgatggataactgaaaaatcgtcttgatgaaggtaaaagacttgtgagattatctaatttcgtcttgatgctcaagtcatccttgagctgaactgcctcttgatgaatgtagattgccagtcattcttctgattaccggaattgtactcgtccagtcacccttgagctga

SEQ ID NO: 4542 - DNA, 1138 bp, Avena sativa
cccaatcaatcacaaaccctaacccccaccgcaccctccatttccgatccaccatcacccatcccgcaaaacaacagcccacgagagagacagagagggaagcagatctgcgcgatggcgacgctccagcacgagaaccagggggcggcggcggcgacgccggcgctgatgtcgacgacgtcgacggggggcgagctgcgcgcgatggacctgtacgagaagctggagaaggtcggggagggaacgtacggcaaggtgtacaaggcccgggagaaggcgacgggccggatcgtggcgctcaagaagacgcggctcgcggaggacgacgagggcgtccctcccacggcgctcagggaggtctccctgctgcggatgctgtcccaggacccgcacgtcgtgcgcctgctcgacctcaagcagggccagaacaaggagggccagaccatcctctacctcgtcttcgagtacatggacaccgacctcaagaagttcatccgcggccaccgccagaaccacgagaagatccccacgcacaccgtcaagatcctgatgtaccagctctgcaaaggcgtggctttctgtcacgggcgcggcgtcctgcaccgtgacctcaagccgcacaacctgctcatggaccgcaagaccatggcgctcaagatcgctgaccttgggctcagccgtgccttcacggttcctctcaagaagtacacacacgagatcctgactctctggtacagggctcccgaggtccttcttggcgccacacactactccacgcctgttgatatgtggtccgtgggctgcatatttgctgaactgatcactaccactgcacttttccctggagattctgaggtgcagcagctcctgcacattttcaagttgctgggcactcccaatgaggaggtctggccaggagtaggcaagctcccgaactggcacgagttccctcagtggaatgtctcaacgttgtcttctgtaattccaatccttgacgccgatggcatcgatctgcttgagaaaatgctgcagtatgagccagcgaagcggatctctgcgaagaaggccatggagcacccctacttcaatgatatagacaaggcgctgtactgaagttgtcttcgtgactagcatgaag

SEQ ID NO: 4543 - DNA, 1376 bp, Ananas comosus
cgatagcgaacaagtaccgcgagggaaagagaagatcttgaaagagagcaatggcgcgtgttcagggtcagggtcagggtcagggtcgggcgatggatctgtacgagaagctggagaaggtaggggaagggacgtacgggaaggtgtacaaggcgaaggagaaggcgacggggaggatcgtggcgctcaagaagacccggctccccgaggacgacgagggcgtccctcccaccaccctccgcgaggtctccctcctccgcatgctctccatctccccccacgtcgtcaggctgttggatctgaaacaaggcgagaacaaagaagggaagacgatcctctatctggtcttcgagttcatggataccgacctcaagaagttcatcaggagcttccgtcagacccacgagatgatcccaccaaaaactgtcaagattttgatgtaccagctctgcaaaggcatcgcgttctgccatggtcgtggggtactccacagggatctgaagccccacaatctcttgatggacaataagacaatgatgctcaaaattgccgacctcgggcttagcagagcattcactatccccctcaagaaatacacccacgagattctgacgctgtggtatagagctcctgaaattctccttggtgccacacattattcaacaccggttgatatgtggtctgttggctgtatatttgctgaactggttacgacccaagcactgtttcctggagactctgaattgcaacagctactgcacattttcaggttattaggtaccccaaatgagaaagtgtggcctggagtaagcaaactggcaaactggcacgagtatcctcagtggagccccaagagtctttcctctgctgttcctaatctcgatgccgatgggattgatctgctcttgaaaatgttgcagtatgagccttcaaagaggatttctgcaaagaaagcaatggaacatccgtacttcaatgatgtgaacaaggcatactcttgagaaactgctaactgtgtagtaacatggcatcaccatatttgtactttttggtgttgcaactgttctagtaactcctactcactattgtgactcatgtgatctcagtttggtcacttgctttcctcaagcattgctattactttacctcaaggaacctcaattcgttatgtttttagtgtaacttggtttgttgttgggagtgagacactttcttttatgttctctggagagacgaaaattgcctccacaattaacatgttatgtttttagtgtaactttgtttgatgttgggagtgagacactttcttttatgttctctggagagacgacaattgcctccacaattaacatgttatgtttttagtgtaactttgt

SEQ ID NO: 4544 - DNA, 1257 bp, Cocos nucifera
caaatatccgccctagagagagagaaatggctgcgatggcgagagccatggatgcctacgagaagctggagaaggtgggagaagggacctacgggaaggtctacaaggcgagggagaaggccacgggaaagatcgtagccctcaagaagacccgcctccccgaggacgaagagggagtcccctcgaccactctccgggaggtctcgcttctcagaatgctctccttcgacccccatatcgtccggctgttggatctcaaacaaggccagaacaaagaagggaagacagttctctatctgatctttgagtacatggacactgatctcaagaaattcatcagaaccttccgtgcaaaccaggagatgattccatccaaaacagtgaagattttaatgtaccagctgtgcaagggtgtagcattttgtcacggtcgtggtgttctgcatagagacctgaagcctcacaatcttttgatggatcggaagacaatgatgcttaaaatagcggacctcggactaagtagagcattcaccattccccttaagaagtatactcatgagatcctgacactgtggtatagagctcctgaagtgcttcttggggctacacattattcaacaccagttgatatgtggtctgttggctgtatatttgctgaactagttacaactcaagcactatttcctggggactcagaactgcagcagctccttcacattttcaggttattgggcaccccaaatgaagaagtgtggccagggataagcaaattacctaattggcacgagtatcctcaatggggtccaaagaaactttcttcagtgattcaaaatctcgatgctgatggaattgatctgctttcgaatatgttgcaatatgagccttcaaagcggatctctgcaaagcaagccatggaacatccatattttgatgatgtggataaagcacaattttgagaccttcaagtacttgtaccaaataggtgttttgggtccagactatcaagtttcatggtgtttggtgtgtaaattgcttccctcaagcattgcaattggtggagtggggagttggtgtatgaccactaagatctaatctttgtgatgtttttagcctatctgatagaggtggggagaccaaaacattttcaagaatgctaacatgtatgacttgatttagtaatactctggcatgtatgggattaatatttgtttcaatttttcatgagacttgcactgaagaatgaaagtggcatcggat

SEQ ID NO: 4545 - DNA, 1518 bp, Hordeum vulgare
tgactagaccctaaaccatctctcttctccactacccctccctatcttgcctttggtcgtggaaaaagctcgaggtgctaatggcggcggcggcggacttcacgcagagcaagcaggccatgtcgtacgcgctctgcaagcacctgaacctcgatccgaatagcatatccagtacacttatcaaggagaatgatattgtgagcctattctcacatatcgtgacctcaccgcaggatgaggtcaagaagtgggttgacttttccagcaattttgctgtaagtgatggagaacagcatgcagtacttggtaatctgaatcaacatttgtcccagatgtcggtactattaggtggtttcaaaccatcagcggctgacattattgtgtttgcaaccgtgcatgttttcatgtgtcatcttagtgacagtgagttgcagaaatatccaaatatattgcggtggatggactacattcagaatgttgttgattttggtatgacgctgcaaaagataaacttgaccaaatctatcttcaacccacctgcacctgcaccttctcacccaaagaaagctgataaaggagatggtgatccaaattccaagaaagccgtttcaggacagaagaatgcggataagtcagatggagctgctgactccaaaaaggctgcaggggagaataaggttcctggggataaggcaaatcctacttctgccaaaaacaacaaaccttccggggataaaaagaaagcccaagagaagactgccggtaaaacaacagaggcagctgcagagaaagctccacagaaaagtgcagaaaaggattccgagtgcagtgtcagtatcctgaatatacaggttggcgttattcgcaaggcatggaagcacccatcagctgacagtcttttggtggaggagatagatttgggagacggcaatgtgcgtcaagttgttagtggccttgcgaagttcttcagcccagatgaacttgttaatcgccatgttgtcttgatcacgaatgtgaagcctgggaagctgcgggatgtaatgtctgctggattggtcttatgtgcttcaaataaagatcatacagttgtggagcctttgattcctccggaaggagccaagcttggagaacgcatttcttttgctgggtttgatgggaagccggaagatgttctaaacccaaagaagaaacagctggacaagataacaccgcatctccgtacagacgagaatggaattgcaacgttccgaggggtaccattcactacatcagctggtccgtgtagatcctcagttccgaatgcagatgttaagtgatgaactcattaagtttactgatttcaaacattgatgtgctaaaacacatgccagtgtaccattttgtcttgatgcccatatcaaatgttaccaaatgttaacagagtcatcagttcttgtgacttataatatctgaaaacaaattttgttttgtctatgcgcaaaaaggaaaaaatggccccgatgatattattgcgcaaaa

SEQ ID NO: 4546 - DNA, 1499 bp, Secale cereale
atctctcttcttcacttcccctatccctcctttgctcgtggaaaaagctcgacctgctaatggcggcggcggcggcggcggacttcacgcagagcaagcaggccatgtcgcacgcgctctgcaagcacctgaacctcgatccgaatagcatatccagtacacttatcaaggagaatgatattgcgagcctattctcacatatcgtgacctcaccgcaggatgaggtcaagaagtgggttgaattctccagcaattttgttcaaagtgatggagaacagcatgcattacttggtaatttgaatcaacatttgtcccaaacgtcggtactgttagctggtttcaaaccatcagcggcggacatcgttgtgtttgcaaccgtgcatgttttcatgtgtcatcttagtgacagtgagttgcagaaatatccaaatatattgcggtggatggactacattcagaatgttgttgattttggtacgacgctgcaaaagataaagttgaccaaatctatcttcaacccacctgcacctgcaccttctcacccaaagaaagctgataaaggagatggtgaaccaaattccaagaaagctgtttcaggacagaagattgcggataagtcagatggagctgctgactccaaaaaggctgcaggggagaataaggttcctggagataaggcaaatcctacttctgccaaaaacaacaagccttctggggataaaaagaaagtccaagagaattctgccggcaaaacaacagaggcagctgcagagaaagctccacagaaaagtgcagaaaaggattctgagtgcagtgttagtatcctgaatatacaggtcggcgttattcgcaaagcatggaagcacccatcagctgatagtcttctggtggaggagatagatttgggagatggcaatgtgcgtcaagttgttagtggtcttgcgaaattcttcagcccagatgaacttgttaatcgccatgttgtcttgatcacgaatgtgaagcctgggaagctgcgggatgtaatgtctgctggattggtcttgtgtgcttcaaataaagatcatacagtcgtggagcctttgattcctccggaaggagccaagcttggagaacgcatttcttttgctgggtttgatgggaagccggaagatgttctaaacccaaagaagaaacagctggacaagataacaccgcatctccgtaccgacgagaatggaattgcaacgttccgaggggtaccattcaccacatcagctggtccatgtagatcctcagttccgaatgcggatgttaagtgagcaactcgttaagcatgctgatttcaaacattgatgtgctaagacacatgcggatgtaccattttgtcgtaatgcacatattaaatgttaccatatgttaacagagttgtcaactcctgacttataatatccgaaaacaaattttgttttacctatgcgcaaaaaggaaaaaaaaatagccctgatattattagaacg

SEQ ID NO: 4547 - DNA, 1680 bp, Triticum aestivum
accactcatagaaaaaaggggccagcggcccaaaatgactagaccctaaaccatccctcttctccacttcccctatccctcctttgctcgtggaaaaagctcgacctgctaatggcggcggcggcggacttcacgcagagcaagcaggccatgtcgtacgcgctctgcaagcacctgaacctcgatccgaatagcatatccagtacacttatcaaggagaatgatattgcgagcctattctcacatatcgtgacctcaccgcaggatgaggtcaagaagtgggttgagttctccagcaattttgttctaagtgatggagaacagcatgcattacttggtaatttgaatcaacatttgtcccagatgtcggtactattagctggtttcaaaccatcagcggcggacattattgtgtttgcaaccgtgcatgttttcatgtgtcatcttagtgacagtgagttgcagaaatatccaaatatattgcggtggatggactacattcagaatgttgttgattttggtatgacgctgcaaaagataaacttgaccaaatctatcttcaacccacctgcacctgcaccttctcacccaaagaaagctgataaaggagatggtgaaccaaattccaagaaagctgtttcaggacagaaggttgcggataagtcagatggagctgctgactccaaaaaggctgcaggggagaataaggttcctggggataaggcaaatcctacttctgccaaaaacaacaaaccttctggggataaaaagaaagtccaagagaagactgccggcaaaacaacagaggcagctgcagagaaagctccacagaaaagtgcagaaaaggattctgagtgcagtgttagtatcctgaatatacaggtcggcgttattcgcaaagcatggaaacacccatcagctgacagtcttctggtggaggagatagatttgggagatggcaatgtgcgtcaagttgttagtggtcttgcgaagttcttcagcccagatgaacttgttaatcgccatgttgtcttgatcacgaatgtgaagcctgggaagctgcgggatgtaatgtctgctggattggtcttgtgtgcttcaaataaagatcatacagtcgtggagcctttgattcctccggaaggtgccaagcttggagaacgcatttcttttgctgggtttgatgggaagccggaagatgttctaaacccaaagaagaaacagttggacaagataacaccgcatctccgtaccgacgagaatggaattgcaacgttccgaggggtaccattcactacatcagctggtccgtgtagatcctcagttccgaatgcggatgttaagtgagcaactcgttaagcatgctgatttcaaacattgatgtgctaagacacatgcagatgtaccattttgtcgtaatgcccatattaaatgttaccatatgttaacagagttgtcagttcttgacttttaatatctgaaaacaaattttgttttgtctatgcgcaaaaaggaaaaaatggccctgatgatattattgcgcaaaaggtgatcaaccgagtgcacggtcctgtgctgagaatgggtttgctcagttcttaaccgtggttccagttaactattattgctctataattgtgcaacggcatatccacaataaacctgtagctgtttagagac

SEQ ID NO: 4548 - DNA, 2108 bp, Brachypodium distachyon
aagccatcctcttctccacttccccatccctccttgctcgtggaaaaaactcgacgcgctcatggcggcggcggcggacttcgcgcagagcaagcaggcgatgtcatacgcgctatgcaagcacctaaatcgtgatccgagcgacatatccagtacaattatcaaggagagtgatattgcaagcctgttctcacatattgtgaacccatcgcaggatgaggtaaagaagtgggttgaattttccagcaattttgttcaaagtgacggagaacagcatgtgttgcttggtaacttaaaccaacatttgtcccagatgtcggtactattggccggtggatttaaaccatcagttgcagacattgttgtgtttgccactgtacatgttttcatgtgccatcttagtgacagtgagttgcagaaatgcccccatatattgcggtggatggactatattcagaatgccgttgattttggtacgacggtgcaaaagataaatgtgaccaaatctgtcttcaatccaccttctcatccaaagaaagctgaaaaaggagatgttgatcccagttgcaagaaagttctatcaggtcagaagatcacggagaagtcagatggaactgccgactccaaaaaggctgcagtggagaataaagttcctggggatcaagcaaatcctacttccgccaaaaacaacaaaccttcgggggataaaaagaaagcccaagaaaagactgcaggaaaagcaacagaggcagctccacagaaaagtgcagaaaaggattcagagtgcagtgtaagtatcctgaatatacaggttggcgttatccgcaaagcatggaagcacccatcagctgacagtcttctggtggaggagatagatttgggagatggcaatgtgcgtcaagttgttagtggtcttgctaagttcttcaacccagatgatcttgttaatcggcacgttgtcttgatcacaaatgtgaagcctgggaagctgcgggatgtaatgtctgcaggattggtcctgtgtgcttcaaataaagaccatacaattgtggagcctttgattcctccagaaggagccaagcttggtgaacgcatttcatttgctgggtttgacgggaagccagaagatgttctaaatccaaagaaaaaacagctggacaagatcacgccgcatctccgtactgatgagaatggcattgcaacattccgagggataccgttcattacatcggctggtccatgtcgatcttcagttcctaatgcggatgttaagtgagcaactcattaaacatactgacatcaaacattgatgtgcttaaagcacatgctaggtggctgtaccattttatcttaacatcttattatgcccatatcaaatgttactaaatggcacggagttgtccatccatcgagtcttaatatcagaaagcaaattttgactcatctatgtgcaaaaggcaacaaaaaaaaaacatttgctttgcaaactgttgtacaaaaggtgatcaacagtttgcatagttttgtgttaggcaagagagctggaatgactcggttttctcgcccttggtttcagtttagtactaccctagttggcacgcggatagtaattaatgtactgtatctgtttgagaccttcatctcagtgctggcgcattaatatgtttagtagaacaagcaatgccttgcttcatgggagagttagcacgaggctacgggcatctgcgttcttccttgtggagctccttttgtctgtcctgcaccttttggctcttaccttgccggaagcaacgaatgtttgtgatctgttttcgtgcgtctcggccgtgggcatttgttaccctttcttgggttaattttcaggtgtcgtgtgaaaactgatggtcacctgctctcctcgcacgaaaaggagtaaataacctccttttttttgttgaacctctttagttctcagcattggctctaatcttcatcggaaaagtaattttgtttcccccgtttcgatcgttttgagattacgaaagaaaacgcttgatattggacgccgcaatggtttcgacgcgtggtttcatttctgctcttatgatggcagtggcaacagttggcga

SEQ ID NO: 4549 - DNA, 1426 bp, Leymus cinereus x Leymus triticoides
aaccatctctcttctccacttcccctatctcacttttgctcgtggagaaagctcgacgtgctaatggcggcggcggcggacttcgcgcagagcaagcaggccatgtcgtacgcgctctgcaagcacctgaacctcgatccgaatagcatatccagtacacttatcaaggagaatgatattgtgagcctattctcgcatatcgtgacctccccgcaggatgaggtcaagaagtgggttgagttctccagcaattttgttctaagtgatggagaacagcatgcattacttggtaatttgaatcaacatttgtcccagatgtcggtactattagctggtttcaaaccatcagcggcggacattattgtgtttgcaaccgtgcatgttttcgtgtgtcatcttagtgacagtgagttgcagaaatatccaaatatattgcggtggatggactacattcagaatgttgttgattttggtatgacgctgcaaaagataaacttgaccaaatcaccttcaccttctcacccaaagaaagctgataaaggagatggtgatccaaattccaagaaagctgttcccggacagaagattgcggataagtcagatggagctgctgactccaaaaaggctgcaggggagaataaggttcctggggataaggcaaatcctacttctgccaaaaacaacaaaccttctggcgataaaaaggaagtccaagagaagactgccgggaaaacaacagaggcagctgcagagaaagctccacagaaaagtgcagataaggattccgagtgcagtgttagtatcctgaatatacaggttggcgttattcgcaaagcatggaagcacccatcagctgacagtcttctggtggaggagatagatttgggagatggcaatgtgcgtcaagttgttagtggtcttgcgaagttcttcagcccagatgaacttgttaatcgccatgttgtcttgatcacgaatgtgaagcctgggaagctgcgggatgtaatgtctgctggattggtcttgtgtgcttcaaataaagatcatacagttgtggagcctttgattcctccggaaggagccaagcttggagaacgtatttcttttgctgggtttgacgggaagccggaagatgttctaaacccaaagaagaaacagttggacaagataacaccgcatctccgtacggacgagaatggaattgcaacgttccgagggataccattcactacatcagctggtccgtgtagatcctcagttccgaatgcggatgttaagtgaggaactcattaaacatactgattccaaacattgatgtgctaaaacacatgccaatgtaccattttgtcttaatgcccataccaaatgttaacagagttgttagttctcgacttttaatatccgaaaacaaatttttttttgtcta

SEQ ID NO: 4550 - DNA, 1433 bp, Avena sativa
accacctctcttctccacttccccctatctctcaccttgctcggaagaaagacgacgtgctaatggcggcggcggcggcggacttcgcgcggagcaaggaggccatgtcctacgcgctctgcatccacctagaccgcgatccgaaaagcatatccagtacacttatcaaggagagtgatattgcgagtctattctcacattttgtgaacaatccggatgatgaggtaaagaagtgggttgaattctccagcaattttgcttcaagtgatggagaacagcacacattacttggcaatttgaatcaacatttgtcccagatgtcagtaatattagccagtggttttataccatcagttgcggacattgttgtgtttgcaactgtacaggttttcatgtctcatcttagtgacagtgagttgcagaaatacccaaatatattgcggtggatggactacattcagaataccatcgattttggtacagcactgcaaaagataaacgtggccaaatccgtctttaacccaccttcaccttctcctccaaagaaagctgataaaggagatactgatccatcttccaagaaagctgtttcaggacagaaaatcgcagctaagtctgatggagctgctgactccaaaaaggctgcagaagagaataaggttcctggggataaggcaaatgctacttctgccaaaaacaacaagccttctggggataaaaagaaagcccaagagaagaccacaggaaaaacaacagaggcagctgctgagaaagctcctcagaaaagtgcagaaaaggattctgagtgcaatgttagtatcctgaatatacaggttggtcttattcgtaaagcatggaagcacccatcagctgacagtcttctggtggaggagatagatttgggagatggcaatgtgcgtcaagttgttagtggtcttgctaagttcttcagcccagatgaaattgttaatcgtcgtgttgtcttgatcacgaatgtgaagcctgggaagctgcgggatgtaatgtctgctggtctggtcttgtgtgcttcaaacaaagatcatacagttgtggagcctttgattcctccggaagaagccaagcttggagaacgcatttcttttgctgggtttgatgggaagccggaagatgttctaaatccaaagaagaagcagttggacaagataacaccgcatctccgcacggacgagaatggaatcgcaacattccgaggggtacccttcactacgtcagctggtccgtgtagatcgtcagtcccgaatgctgatgtcaagtgagcgactcattaaacatgctgatgtcaaacattgatgtgctataaaagcacatgtgacctgtaccattttgtcttgatggccatatcaaatgctgttaccaaatgtcaacagagttgccagttcgctggtttttaa

SEQ ID NO: 4551 - DNA, 1479 bp, Secale cereale
ctcgacctgctaatggcggcggcggcggacttcacgcagagcaagcaggccatgtcgcacgcgctctgcaagcacctgaacctcgatccgaatagcatatccagtacacttaccaaggagaatgatattgcgagcctattctcacatatcgtgacctcaccgcaggatgaggtcaagaagtgggttgagttctccagcaattttgttcaaagtgatggagaacagcatgcattacttggtaatttgaatcaacatttgtcccaaacgtcggtactattagctggtttcaaaccatcagcggcggacattgttgtgtttgcaaccgtgcatgttttcatgtgtcatcttagtgacagtgagttgcagaaatatccaaatatattgcggtggatggactacattcagaatgttgttgattttggtacgacgctgcaaaagataaagttgaccaaatctatcttcaacccacctgcacctgcaccttctcacccaaagaaagctgataaaggagatggtgaaccaaattccaagaaagctgtttcaggacagaagattgcggataagtcagatggagctgctgactccaaaaaggccgcaggggagaataaggttcctggagataaggcaaatcctgcttctgccaaaaacaacaaaccttctggggataaaaagaaagtccaagagaagactgccggcaaaacaacagaggcagctgcagagaaagctccacagaaaagtgcagaaaaggattctgagtgtagtgttagtatcctgaatatacaggtcggtgttattcgcaaagcatggaagcacccatcagctgatagtcttctggtggaggagatagatttgggagatggcaatgtgcgtcaagttgttagtggtcttgcgaaattcttcagcccagatgaacttgttaatcgccatgttgtcttgatcacgaatgtgaagcctgggaagctgcgggatgtgatgtctgctggattggtcttgtgtgcttcaaataaagatcatacagtcgtggagcctttgattcctccggaaggagccaagcttggagaacgcatttcttttgctgggtttgatgggaagccggaagatgttctaaacccaaagaagaaacagctggacaagataacaccgcatctccgcaccgacgagaatggaattgcaacgttccaaggggtaccattcactacatcagctggtccgtgtcgatcctcagttccgaatgcggatgttaagtgagcaactcgttaggcatgctgatttcaaacattgatgtgctaagacacatgcgaatgtaccattttgtcgtaatgcacatattaaatgttaccatatgttaacagagttgtcaactcctgacttataatatccaaaaacaattttagttaacaaaaaaaaaaaagaaaaaaaaagtaaaaactactagagtgtatacactactcgtctcgtagactagtcacgacgacaacg

SEQ ID NO: 4552 - DNA, 1702 bp, Secale cereale
gcaccactcctcatagagaaaaggggccagcggcccaaaatgactagaccctaaaccatctctcttctccacttcccctatccctcctttgctcgtggaaaaagctcgacctgctaatggcggcggcggcggacttcacgcagagcaagcaggccatgtcgcacgcgctctgcaagcacctgaacctcgatccgaatagcatatccagtacacttaccaaggagaatgatattgcgagcctattctcacatatcgtgacctcaccgcaggatgaggtcaagaagtgggttgagttctccagcaattttgttcaaagtgatggagaacagcatgcattacttggtaatttgaatcaacatttgtcccaaacgtcggtactattagctggtttcaaaccatcagcggcggacattgttgtgtttgcaaccgtgcatgttttcatgtgtcatcttagtgacagtgagttgcagaaatacccaaatatattgcggtggatggactacattcagaatgttgttgattttggtacgacgctgcaaaagataaagttgaccaaatctatcttcaacccacctgcacctgcaccttctcacccaaagaaagctgataaaggggatggtgaaccaaattccaagaaagctgtttcaggacagaagattgcggataactcagatggagctgctgactccaaaaaggccgcaggggagaataaggttcctggagacaaggcaaatcctgcttctgccaaaaacaacaaaccttctggggataaaaagaaagtccaagagaagactgccggcaaaacaacagaggcagctgcagagaaagctccacagaaaagtgcagaaaaggattctgagtgtagtgttagtatcctgaatatacaggtcggcgttattcgcaaagcatggaagcacccatcagctgatagtcttctggtggaggagatagatttgggagatggcaatgtgcgtcaagttgttagtggtcttgcgaaattcttcagcccagatgaacttgttaatcgccatgttgtcttgatcacgaatgtgaagcctgggaagctgcgggatgtgatgtctgctggattggtcttgtgtgcttcaaataaagatcatacagtcgtggagcctttgattcctccggaaggagccaagcttggagaacgcatttcttttgctgggtttgatgggaagccggaagatgttctaaacccaaagaagaaacagctggacaagataacaccgcatctccgcaccgacgagaatggaattgcaacgttccgaggggtaccattcactacatcagctggtccgtgtagatcctcagttccgaatgcggatgttaagtgagcaactcgttaagcatgctgatttcaaacattgatgtgctaagaagacacatgcaaatgtaccattttgtcgtaatgcacatattaaatgttaccatatgttaagagttgtcagttcttgacttatgaatatctgaaaacaaattttgttttgctttgtctatgcgtaaaaaggaagaaaaaatggccctgatgatattattgcgcaagaggtgatcaaccgagtgcacggtcctgtgtgctgagaatggggtggctcagttttcttgcccgtggttcctgtcaactattattgctctataattgtgcaatggcatatccacagtaattacctgtggcagtttagagacc

SEQ ID NO: 4553 - DNA, 1416 bp, Avena sativa
cctaaaccacctctgttctccactcccccctatctcaccttgctcggaagaaagacgacgtgctaatggcggcggcggcggacttcgcgcggagcaaggaggccatgtcctacgcgctctgcatccacctagaccgcgatccgaaaagcatatccagtacacttatcaaggagagtgatattgcgagtctattctcacattttgtaaacaatccggatgatgaggtaaagaagtgggttgaattctccagcaattttgcttcaagtgatggagaacagcacacatcacttggcaatttgaatcaacatttgtcccagatgtcagtaatattagccagtggttttataccatcagttgcggacattgttgtgtttgcaactgtacaggttttcatgtctcatcttagtgacagtgagttgcagaaatacccaaatatattgcggtggatggactacattcagaataccatcgattttggtacagcattgcaaaagataaacgtgcccaaatccgtctttaacccaccttcaccttctcctccaaagaaagctgataaaggagatactgatccatcttccaagaaagctgtttcaggacagaaaatcgcagctaagtctgatggagctgctgactccaaaaaggctgcagaagagaataaggttcctggggataaggcaaatgctacttctgccaaaaacaacaagccttctggggataaaaagaaagcccaagagaagaccacaggaaaaacaacagaggcagctgctgagaaagctcctcagaaaattgcagaaaaggattctgagtgcaatgttagtatcctgaatatacaggttggtcttattcgtaaagcatggaagcacccatcagctgacagtcttctggtggaggagatagatttgggagatggcaatgtgcgtcaagttgttagtggtcttgctaagttcttcagcccagatgaaattgttaatcgtcgtgttgtcttgatcacgaatgtgaagcctgggaagctgcgggatgtaatgtctgctggactggttttgtgtgcttcaaataaagatcatacagttgtggagcctttgattcctccggaaggagccaagcttggagaacgcatttcttttgctgggtttgatgggaagccagaagatgttctaaatccaaagaagaaacagttggacaagataacaccgcatctccgcacggacgaaaatggaatcgcaacattccgaggggtacccttcactacgtcagctggtccgtgtagatcttcagtcccgaacgctgatgttaagtgagcaactcgttaaacatgctgatgtcaaacattgatgtgctaagaccaacgcatgaggctgtgccattttgtcttgatgcccatatcaaatgttgttaccaaatgacaacagagctgtc

SEQ ID NO: 4554 - DNA, 3204 bp, Avena sativa
cgcagcagtcgggctcgcccacgtcgaccgccaccaccacgtcgtcgtcgcggctcacgccggagatgtcgctcgacggcgggcccgcgtccccgaggccggacgacgaccagcccaccaaggagaacgtcaccgtcaccgtccgcttccgcccgctcagcccgcgggagattcggcagggggaggaggtggcctggtacgccgacggcgacacggtcgtgcggagcgagcagaaccccaacgtcggctacgcatacgaccgagtttttgcaccaactactacaacccgccaagtttatgatgttgcagctcaacatgttgtcagtggtgccatggagggcatatttggaacaatatttgcatatggtgtaacaagcagtggaaagacacatacaatgcatggagatcaaagatccccaggaataatacctttggcagtcaaagatgcatttagcattatacaagagacgccagatcgcgagtttctcctacgcgtgtcatacctggaaatttataacgaggttgtcaatgatctactcaatcccgcagggcagagcttacggattagagaggatcctcagggaacgtttgttgagggtatcaaagaagaagtagtattatctcctgcacatgctctgtcccttattgcagctggagaagagcatagacatgttggttccactaacttcaacctactaagtagcagaagtcatacaatttttacactgacaattgagagcagctcttatggcgagtctaatgaaggggaagcagtcaccttctcacagctgcacctcatcgatctggcaggttcagagagctcaagggctgaaactactggagtacgtaggaaggaaggatcttatatcaataaaagcttgctaactcttggaacggtgatatcaaaactgactgatggaaaagctacacatattccatttcgagattcaaaactaacacggctacttcagtcatccttgagtggacaagggcgtgtttcactaatttgcacagtgactccagcatcaagcaactctgaagagacccacaatacactaaaattcgcccaccgtgcaaagcgcattgaggtccaagcatcacaaaacaaaattattgatgagaagtctttaataaagaaataccagaatgagattcgcagattaaaggaagagcttgaacagctgaaaatgggtattatttgtggaactccgtcgaaagaggccgaagaagataatatcatcctttggaaacaaaagctagaagatggtaatgtcaagctgcaatcaagactggaacaagaggaggaagctaaatctgctttgctcgcaaggatacagcgcctcacaaaacttatcttggtttccaccaaggcaacccagacttcaagattttctccacatcctggaccaagaagaagacactctttcggggaagaggagctagcttacctcccgtacagaagacgcgatatcatgttggataatgaaagcaacgaattactcacacctggtgaaggatttggtgtgacacttgaagactcttcgaaggaggagaaaaagaatcggaaaggacttcttaactggtttaaaatccggaaacgtgatggtggagcttctactctgacaagttcagactgtgacaagtccagtttgactaaatcaacggctccttcaacacctattggggggagtatgaattttcctgcagaaccaagaatatcaaattctttggttaatgacagtatatcagctgatatgttgagcattgcccatggggaatttccttccgacgatcttcctggagaagaaaccattctggccagcagtaaaacaattgaccatgttgacttgttaagagagcaattgaagattttatcgggggaggtcgcacttcatacaagtgttctaaagcgccttacagaagaagctgcgagaaacccaaatagcgaaaaaattcagatgaaaatgaagaagaccagtgacgaaattaaggcaaagcagcagcagataacttctttagaaaaacagatacctcattccttgtcagatagtcaagtgaaggttgacaagttagatctttcaccgtcgtatgctgaactacttgagcagctcaatgagaaatcctttgaacttgaggtgaaggcagcagataacagagtaatacaagaccagctagaggaaaagacaagtgaatgtttggaattgcaagaggcagtttctctcctaaaagaacatctttctcaagctcttcaagccaaggattcattgtcaaatagcattgtgatgcagaatagttcaggagcaaaccatgaagttcaacacagtgaccaagaaaaaacagtccctagagagatctctgctgaaccactgcaaaaagagcagcagtcagttgagattggcgagctaaagcaaaggctgtgtgaacttgacaaagtcaaagctcaactggaggctcgcaatcagaagttactagaggaaagtacatatgcgaaaggtttggcttcggctgcaggagtggaattgaaggcgttgtcagaagaagttactaaactcatgaaccaaaatgagaagcttgcttctgagttggcatcgctgagaagtccaacccctcgcagagcaagcaatggaccgagaggtactaatactaggagagagagcatgagtagacgaaatgaaccagctagcagaagagatggtaatgcaagccatgagagggagagagttttagaaactgtccttatggagaaggaacaaaaagaagcggaactccaaaggaaggtagaggaatcgaagcagaaagaagccttcttggaaagcgagcttgcgaacatgtgggttctagtggcaaaactgaagaagtcccagggggaggaccatgaggatttagatgccaaatacaatggctcctgacctcataactaaggctaatcaatcatcaaaggcgtgtttggcttgggtatttctttatgtatgataagtgttatgtgccttttttttgttctcattgtgaattagtgtctcctgtatattctcgggctaatcaaagttgtgagtagtgtgtagttgagagtggtgtgctaactgctgagagcttcctaccattgctgtaacgagattttggaattcctagaacatggtcgtggtaatgaagagaaacatatctggtgcttgtgccagatatctagcaaagaaacatgtattgcgt

SEQ ID NO: 4555 - DNA, 3179 bp, Secale cereale
gactctcccacgagcgagcgaagtgacacgaacgggaaagggggagaggggaaagaaaaccctagagaaaacccgcgttaaagcgaggggccgcgggatccgaatgccgggtgccgccacgtgctgccgctagatctcgcgccaatggcgacgcgcccggcctcgcgccagcggagggcggccaagggctcgcagcagcagcagtcgggctcgccgacgtccacggcgaccacgtcctcgtcgcggctcacgccggagatgatgtcgtcgctcgagggccccgcgtcgccgcggctcgccgcggggctggacgccgacgccgacgacctggccgccaccaaggagaacgtcaccgtcaccgtccgcttccgcccgctcagcccgcgggagattcggcagggggaggaggtcgcgtggtacgccgacggcgacacggtcgtgcggagcgagcagaaccccaacgtcggctatgcctacgatcgggtttttgcaccgactactacaacccgccaagtatatgatgttgcagctcaacatgttgtcagtggtgccatggagggcatatatggaacaatatttgcgtatggcgttacaagcagtggaaagacacatacgatgcatggagatcaaagatccccaggaataatacctttggctgtcaaagatgcatttagcattatacaagagaccccaaatcgcgagtttctcctgcgtgtgtcatacttggaaatttataacgaggttgtcaatgatctactcaatcctgcaggacagagcttacgaattagagaggatcctcagggaacgtttgtcgagggtatcaaagaagaagtggtattatctcctgcacatgctctgtcccttattgcagctggagaagagcatagacatgttggatccactaacttcaatctactaagtagtagaagtcatacaatttttacactgacaatagagagcagctcttacggcgactctaatgaaggggaagcagtcaccttctcacagctgaacctcattgatctggcaggttcagagagctcaagggcggaaacaactggagtacgccggaaggaaggatcttatatcaataaaagcttgctaactcttggaacagtgatatcaaaactgactgatggaaaagctacacatattccgtttcgagattcaaaactaacacggctacttcagtcatccttgagtggacaagggcgcgtttcactaatttgcacagtgaccccagcatcaagcaactctgaagagacacacaacacactaaaatttgcccaccgtgcaaagcgcattgaggtccaagcatcacaaaacaagataattgatgaaaaatctttgataaagaaataccagaatgagatccgcagattaaaggaagagctagaacagctgaaaatgggtattattactggaactccgttaaaagatgctgaagacgataatatgatcctttggaagcagaagctagaagatggtaacgtcaagttgcaatcaagacttgaacaagaagaggaagctaaatctgctttgcttgcaaggatacagcggctcacaaaacttatccttgtttccacaaaggcaaccccgacttctagattttctccacatcctgggccaagaaggagacactcttttggggaagaggagctggcttaccttccgtacagaaggcgagatatcatgttggataatgaaagcaatgaattactcactcctggcgaaggatttggtgtgacacctgaagactcttcgaaggaggagaaaaagaacaggaaaggacttcttaactggttcaaaattcggaaacgtgacggtggagcttctactctagcaagttcagaatgcgataagtccagtttgactaaatcaactgctccttcaacacctattggggagagtctgaattttcccgcagaaccaagaatatcaacttcgttggttaatgagagtgaatcagctgatatgctgagcattggccatggagattttccttctgatggtcttactggagaagaagcatctctggcgagcacaaaaacaatcgaccatgttgacttactaagagagcaattaaagattttatcaggggaggttgcacttcatacaagtgttctaaagcgcctcaccgaggaagctggaagaaacccgaatagtgagaaaattcagatgaaaatgaagaagatcagtgacgaaattaaggcaaagcagcagcagatatcatctttagaaaaacagatgcctcattccttgtcaaatagtcaagtaaaggttgacaagttagatctttcaccgtcttacggggaactacttgagcaacttaatgagaaatctttcgaactcgaggtgaaggtagcagataacagagtaatacaagagcagctacaggaaaagacaactgagtgcatggaattacaagaggcagttgcttgccttaaagaacatctttcccaagctcttcaagctaaggattcactgtcaaatagcattatgatgcagaatagctcaggagcaaaccatgaagaacaacacagtgatcaagaaaaaccagtttccagggatatttctgctgaacaactgcaaaaggaacagcagtcacttgagcttggtgagctaaagcatagggtacatgaactgacagaagtcaaagttcaactcgaggctcgcaaccagaagctattagaggaaagtacatatgcaaaaggcttggcttcggctgcaggagtggaattgaaagcgttgtcagaagaagtgaccaaactcatgaaccaaaatgagaagcttgcttccgagttagcatcgctgagaagtccaacccctcgcagagtaagcaatggaccgagaggtactgctaggcgagagagcatgagtagacgaaatgaaccagctagcagaagagatggcaatgcgagagaagagagggagagagcgttagaaaccatccttgcggagaaggaacaaaaagaagcagaactccaaaggaaagtcgaggaatcaaagcaaaaggaggccttcttggagagtgagcttgcaaacatgtgggttctagtggcaaaattgaagaagtctcgtgggatgatgaccatgaggatttggaggccaaatataatggctcctgagtcctaatcaaacgcttgtttggcttgggtgtgggtctttctgtatgtatg

SEQ ID NO: 4556 - DNA, 3146 bp, Secale cereale
cagcagcagtcgggctcgccgacgtccacggcgaccacgtcctcgtcgcggctcacgccggagatgatgtcgtcgctcgagggccccgcgtcgccgcggctcgccgcggggctggacgccgacgccgacgacctggccgccaccaaggagaacgtcaccgtcaccgtccgcttccgcccgctcagcccgcgggagattcggcagggggaggaggtcgcgtggtacgccgacggcgacacggtcgtgcggagcgagcagaaccccaacgtcggctatgcctacgatcgtgtttttgcaccgactactacaacccgccaagtatatgatgttgcagctcaacatgttgtcagtggtgccatggagggcatatatggaacaatatttgcgtatggcgttacaagcagtggaaagacacatacgatgcatggagatcaaagatccccaggaataatacctttggctgtcaaagatgcatttagcattatacaggagaccccaaatcgcgagtttctcctgcgtgtgtcatacttggaaatttataacgaggttgtcaatgatctactcaatcctgcaggacagagcttacgaattagagaggatcctcagggaacgtttgtcgagggtatcaaagaagaagtggtattatctcctgcacatgctctgtcccttatcgcagctggagaagagcatagacatgttggatccactaacttcaatctactaagtagtagaagtcatacaatttttacactgacaatagagagcagctcttacggcgactctaatgaaggggaagcagtcaccttctcacagctgaacctcattgatctggcaggttcagagagctcaagggcggaaacaactggagtacgccggaaggaaggatcttatatcaataaaagcttgctaactcttggaacagtgatatcaaaactgactgatggaaaagctacacatattccgtttcgagattcaaaactaacacggctacttcagtcatccttgagtggacaagggcgcgtttcactaatttgcacagtgaccccagcatcaagcaactctgaagagacacacaacacactaaaatttgcccaccgtgcaaagcgcattgaggtccaagcatcacaaaacaagataattgatgaaaaatctttgataaagaaataccagaatgagatccgcagattaaaggaagagctagagcagctgaaaatgggtattattactggaactccgttaaaagatgctgaagatgataatatgatcctttggaagcagaagctagaagatggtaacgtcaagttgcaatcaagacttgaacaagaagaggaagctaaatctgctttgcttgcaaggatacagcggctcacaaaacttatccttgtttccacaaaggcaaccccgacttctagattttctccacatcctgggccaagaaggagacactcttttggggaagaggagctggcttaccttccgtacagaaggcgagatatcatgttggataatgaaagcaatgaattactcactcctggcgaaggatttggtgtgacacctgaagactcttcgaaggaggagaaaaagaacaggaaaggacttcttaactggttcaaaattcggaaacgtgacggtggagcttctactctagcaagttcagaatgcgataagtccagtttgactaaatcaactgctccttcaacacctattggggagagtctgaattttcccgcagaaccaagaatatcaacttcgttggttaatgagagtgaatcagctgatatgctgagcattggccatggggattttccttctgatggtcttactggagaagaagcatctctggcgagcacaaaaacaatcgaccatgttgacttactaagagagcaattaaagattttatcaggggaggttgcacttcatacaagtgttctaaagcgcctcaccgaggaagctggaagaaacccgaatagtgagaaaattcagatgaaaatgaagaagatcagtgacgaaattaaggcaaagcagcagcagatatcatctttagaaaaacagatgcctcattccttgtcaaatagtcaagtaaaggttgacaagttagatctttcaccgtcttacggggaactacttgagcaacttaatgagaaatctttcgaactcgaggtgaaggtagcagataacagagtaatacaagagcagctacaggaaaagacaactgagtgcatggaattacaagaggcagttgcttgccttaaagaacatctttcccaagctcttcaagctaaggattcactgtcaaatagcattatgatgcagaatagctcaggagtaaaccatgaagaacaacacagtgatcaagaaaaaccagtttccagggatatctctgctgaacaactgcaaaaggaacagcagtcacttgagcttggtgagctaaagcagagggtacatgaactcacagaagtcaaagttcaactcgaggctcgcaaccagaagctattagaggaaagtacatatgcaaaaggcttggcttcggctgcaggagtggaattgaaagcgttgtcagaagaagtgaccaaactcatgaaccaaaatgagaagcttgcttccgagttagcatcgctgagaagtccaacccctcgcagagtaagcaatggaccgagaggtactgctaggcgagagagcatgagtagacgaaatgaaccagctagcagaagagatggcaatgcgagagaagagagggagagagccttagaaaccatccttgcggagaaggaacaaaaagaagcagaactccaaaggaaagtcgaggaatcaaagcaaaaggaggccttcttggagagtgagcttgcaaacatgtgggttctagtggcaaaattgaagaagtctcgtggggatgatgaccatgaggatttggaggccaaatataatggctcctgagtcctaatcaaacacgtgttttggcttgggtgtgggcttttctgtatgtatgcaagattggtggtttgggtcggttttctttgtgaattagtgtcgtcccctgtatattcttgggctaatcaaagttgtgagtagtgcctagtggagagtggtgtgctaacaactggtgagagcttcctaccattgctgtaatgagattttggaattcctag

SEQ ID NO: 4557 - DNA, 1773 bp, Saccharum officinarum
aagcactgctgctccacaccaccccaccatcccattccccaacccccaaagccgagcgagcgagcgaaccaccccgcccgcagccgcaaccaagcaaagcaagcaggagccgcctcctcctcggcctctcggcggcgtgtgaccggccgaccgaccgttccgtccaacccaccatggaggcgccgccgggaccggagcccatggagctcgacgcgccccctcccgccgccgccgaggccgcggcggcggttccccccgccggcagcgagaagaagaaagagggggaagggggagacgctgttacgggtcatatcatctccaccaccatcggtgggaagaacggcgaaccgaagcggaccatcagttacatggcagaacgcgttgtgggtacaggctcatttgggatcgtcttccaggctaagtgtttggagacaggagagaccttcgccatcaagaaggtgctgcaagatcggcgatacaagaaccgggagctgcaacttatgcgtgccatggagcaccccaacgtcatctgcctgaagcactgcttcttctcgacaacgagcagggacgaactgtttttaaacctggtcatggaatttgtccccgagactctataccgcgtcctgaagcactacagcaacgcgaaccagaggatgcctcttatctacgtcaagctgtacatgtatcagctttttagaggcctagcttatattcataatgtaccaggagtctgccatagggatgtaaagccacaaaatgttttggttgatcctctcacccaccaggtcaagctctgtgactttggtagcgcaaaagtcctggttcctggtgaaccgaacatatcttacatatgctctcgttattatcgtgcccctgagctcatatttggcgcgacggagtatacaacttcaatagacatatggtcagctggttgtgttctagctgagttgcttcttggtcagccactgtttccgggagagagcgctgttgatcagttggtagagattatcaaggttcttggtactccaacccgcgaggagatacgatgcatgaatcccaactatactgagttcaggtttcctcagataaaggctcatccgtggcacaagattttccacaagagaatgcctcctgaagctatagaccttgcttcccgtctccttcagtattcaccaagtcttcgctgctctgctcttgatgcatgtgctcatcccttctttgatgagctgcgggcgccgaatgcgcgcctaccaaatggacgtccattccctctgctcttcaacttcaaacatgaactagcaaatgcttctccggacctcatcaacaggcttgtgccagagcacattagacggcagaacggtgtcaacttcgggcatatcgggagctaggagggcaggcactgcgatggtcaagtttttggtcttggttcccccatgtgcagggccgatgcaagcaaaggtgatatttcaccatctggagaggagaggggctcagctcagcagtacctgagagaagtgagtatgtaaattatctgaccgttaaggagtaccgccagtgttaagccagtaactggcacatgttggtccagtagttaagggtaagaatgtaggaggtggagactggttaatgcttagagttgtttttggttattaccattttgtaatgttcgtcggtacttcccagcaatagtgtagctgctcctgttttgttcgtccgccatgatgtaaatgataatcacccaactgcaatgtcagttctctctgatcgtttcgt

SEQ ID NO: 4558 - DNA, 2743 bp, Zea mays
aattttttttagtaacaaatcagtgcactactgattcctaaaccaggctgaaaccggaaacggctcgctgcgctgccgctgcgtcactgtcgctggcaaagaaaacaactcccggccaggggtccgagcaggagcagcagtatattttcccgccgctaataaaaacagtcagcggcacacttcgccaagcgaggcaggcagcggctgtcccgagctgtcgaaagcgaggcgcggcggcagtcctcgcagcagggccgaccggtcaaaagcactgctgctccacaccacccccaccatccctttccccaacccccgaagccgagccagcgaaccaccccgcccgcagccgcaagcaagcagccaagcagtgtgaactgaccgtccgttccgtccagcccaccatggaggcgccgccggtaccggagctcatggatctggacgcgccccctcccgccgcagccgacgccgcagccgcggcgccggttccccccgccgtcagcgacaagaagaaggaaggggaagggggagacactgttacgggtcacatcatctccaccaccatcggtgggaagaacggcgagccgaagcggaccatcagttacatggcagaacgtgtcgtgggtacgggctcatttgggatcgtcttccaggctaagtgtttggagactggagagaccttcgccattaagaaggtgctgcaggatcggcgttacaagaaccgggagctgcaacttatgcgtgccatggagcaccccaacgtcatctgcctgaagcactgcttcttctcaacaacgagcagggacgagttgtttctaaaccttgtcatggaatttgtccccgagaccctgtaccgtgtcctgaagcactacagcaacgcgaaccagaggatgcctcttatctacgtcaagctctacatgtatcagcttttcagaggcctagcctatattcataatgtaccaggagtctgccatagggatgtaaagccacaaaacgttttggttgatcctctcacccaccaggtcaagctctgtgactttggtagcgcaaaagtcctgattcctggtgaaccgaacatatcttacatatgctctcgttattatcgtgctccagagctcatatttggagcgacagagtatacaacttcaatagacatatggtcagctggttgtgttctagctgagttgcttcttggtcagccactgtttccgggagagagtgctgttgatcagttggtagagattatcaaggttcttggtactccaacccgtgaggagatacgatgcatgaatcccaactatactgagttcaggtttcctcagataaaggctcatccgtggcacaagattttccacaagagaatgcctccggaagccattgaccttgcttcccgtctccttcagtattcgccaagtcttcgctgctctgctcttgatgcatgcgctcatcccttctttgatgagctgcgggcgccgaatgcacgtctaccaaacggccgtccattccctccgctctttaacttcaaacatgagctagcaaatgcctccccggacctcatcaacaggcttgtaccggagcacattagacggcagaacggtgtcaactttgggcatatcgggagctaggagggcaggcggctgccatggtcaagtttttggtcttggtaccccatgtgcagggccgattgcaggtgaaggtgatattgctgcaccatctggagaggaggggctcagcagtacctgagagagctgaaactatgtaaattatctgaccgcgaaggagtacggccagtgttaagccagtaaactggcgcatgttggtccagagtagttaagaatgtagcaggtggagactggtaaatgcctagggtcgtttttagttgttgttactagtattttgtaatgtaatgttcgtcggtacttcccagcagtagtgtagctgctcatgttttgttcgcccgtcatgatgtaaatgatcatcacccaactggaacccctgttatctcgttacatgcttaggcctctgatcgttccgtagttgctgtgatagagctctgacaagtctgagcaggaaagtgggtaggaattgcttctggtgaaatctggacaagttttgtcgaatacagatgcatctgctgattgatcgtctggttgcaagtagtctgcacattcccaaggccacagatcattactttcagattgttgataacgaccaaatggcaagtaacagaaacgaccgaaattcgcaagcaggcaattacagacgcggccgcgccagcacatcgccgccgtagtccttgaccttgctccacaaaaccggccatgcgtccttcctgatggcggctaggttctctccatcccagtctctggctgcgagctcctcagccatggcgaccgccgcggccacgacgtcctccacgccgccgtccacggccgcatccacgatgcctcggcgcgcggcctgcgcggccgtcatcttctcccccttcatcaccaggtccctcctagcggccgcgtcggggaccttctgccgaaccagctcgccgacaaaatcgacgatcttgatcccggcgtcgacctcgctcatgtagaggaacccgcgggaggcgcgcatggcgacggcgtcgtgcgccagcgcgagcgcgcagccggcgcccgcggcgtggcccgtgacggccgcgaccgttggcacggggagcgcgagcaggtcggcgacgaggccgcggaacgcggcgcgcatctcggag

SEQ ID NO: 4559 - DNA, 2438 bp, Zea mays
ggcgaaacgtgtgaccaaccaaactacgttcggtgctacgctgctgctcgtgctccgttcccctgcgtctcacgccttaatcctcgtctagcccttagaggatggagatgggaaagattctccatcacgcctttttttgttttcaagatgtgtaacgtaacgctgctagagcagccaagataagatccacaagcagttcattactcccgcggtttagcacctcctgattaccaaaaccaggctctccgaatccgaaatcgtgcgcggagacaggaaacggctcaccgtcgctgccaaagtagaatccgtctccgataataaaacacggcagtcagcggcacacttatcgcaaagccagccagccagccagccagcagcggctgtcccaagctgtccaaagccaagccaagcgcggcgcggcggcagtcctctcctcgcagtcgcagcagggccgagccgaccggtcaaaagcactgctgccccaccccaacccaccaccatccccgttccccaacccccaaagccgagagccatcccgcccgcagccgcaaccaggcaagcaagcgggagccgccaactcgtgcctctcggcagcggcgtctgaactctgaaccgaccgaccgaccgaccgttccgttccgttcaccccaccatggaggcgccgccgggaccggggcccatggagctggacgccccacctcccgccgccgccgccgcggcgattcctcccgccggcagcgacaagcacaaggacggggaagggggagacgctgtgacgggccatatcatctccaccaccatcggcgggaagaacggcgagcccaagcggaccatcagttacatggcagaacgtgtcgtgggcacaggctcatttgggatcgtcttccaggctaagtgtctggaaacaggagagaccttcgccatcaagaaggtgctgcaagatcggcgttacaagaaccgggagctgcaacttatgcgtgccatggagcaccccaacgtcatctgcctgaagcactgcttcttctcgacaacgagcagggacgaattgtttttaaaccttgtcatggaattcgtccctgagactctataccgagtcctgaagcactacagcaatgcgaaccagaggatgcctcttatctacgtcaagctctacatgtatcagctttttagaggcctagcttatattcataatgtaccaggagtctgccatagggatgtgaagccacaaaacgttttggttgatcctctcacccaccaggtcaagctctgtgactttggtagtgcaaaagttctgattcctggtgaaccgaacatatcttacatatgctctcgttattatcgtgcccctgagctcatatttggtgcgacggagtatacaagttcaatagacatatggtcagctggttgtgttctagctgagttgcttcttggacagccactatttccaggagagagcgctgttgatcagttggtagagatcatcaaggttcttggtactccaacccgtgaggagatacggtgcatgaatcccaactatactgagttcaggtttcctcagataaaggctcatccatggcacaagattttccacaagagaatgcctcctgaagccatagaccttgcttctcgtctccttcagtattcaccaagtcttcgctgctctgctcttgacgcatgtgctcatcccttcttcgatgagctgcggacaccgaacgcacgcctaccaaacggccgcccgttccctccgctctttaacttcaagcacgaactagcaaatgcctctccggacctcgtcagcaggcttgtgccggagcacattagacggcagatcggtgtcaacttcgggagcagctaggagggcaggcgctgtgatggtcgaagttttcggtcttggtttccccttctggagagtgggaggggctcaagcagtacctgagaaaagtagtgaaaccgtgtaaattatctgaccgtgaaggagtactaccgccagtaactggcgcatgttcgtccagtagttatggtaagaatgtaggaggtggagactggttaatgtgtagggtcgttttttttgttttgttttgatattactaccattttgttgtaatgttcgtcggtacttccagcagtagtgtagctggccacgttttgttcgtccgccatgatgtaaatgatcatcgcccaactgtaatgcatgttctctctgatcgtttcgtagtcctgatgcctgctgtgatgaagctcagagtctgaggcaggaaagtcggaagaacttccggctcccgaaataggaatcgctgccggtgtgaaactacggtgaagttgtatcgaaattttgcatgccaatacagactattctatcggttggaacttggaagttatctgatgagcggttcaatcgcaaatgttcattcccaactcccaaggccacaaatgctctc

SEQ ID NO: 4560 - DNA, 2012 bp, Panicum virgatum
ccaatgcactcctgttccagggcctcaaaatttaccagcagaaactgctactgctgaaaaagattagcagcagaaactgctactgctgaaaaagattagcagtagtaactctctgccaagaataacccccacccccagctacttaaaatgagtcagcaggcaagcggggtgtcccaagctgtcgaaagccaagccaagcaaagcaaagcaaaggcgagccgcgagcggcggcagtcctcgcggccccgaccggtcaaaagcactgccactccacacctccccacaccaccatccccattccccaaccccaagcgaaccaccccgcagccgcagccgcagctgccccccaccggcctcggactcagcggcgagcgcggcgatctccgcttcccaccccgacgcatggacgcgccgccggggccggaacccatggcgctggacgcgccccctgccgccaccgccgccgaggacgcagcggcggcggttccccccgccggcggcgagaagaagaaggaaggccaagagggggagagggtcccgggccacattatctccaccaccatcggtgggaagaacggcgaaccgaagaggactataagttatatggcggagcgtgtcgtgggtacaggttcatttgggattgtcttccaggctaagtgtctggagactggggagacctttgccatcaagaaggtgttgcaagatagacgttacaagaaccgggagctgcaactgatgcgcgccatggaacaccccaatgtcatctgtctgaagcactgcttcttctcgacaacccccagggatgagctgtttttgaaccttgtcatggaatatgttccggagacgctgtatcgtgtcctgaagcactacagcaatgcgaaccagagaatgcctcttatctatgtcaagctctacatgtatcagctttttagagggctagcttatattcatactgtgccaggagtctgccacagggatgtaaagccacaaaatgtcctggttgaccctctcactcaccaagtcaaactgtgtgactttggaagcgctaaagtcctgattcctggtgaaccaaatatatcttacatttgctctcgttattatcgtgctcctgagctcatatttggagcaactgagtatacaacttccatagacatatggtcagctgggtgtgttcttgcggagttacttcttggtcagccactgtttccaggagagagtgcggttgaccagctagtggagataatcaaggttcttggtactccaactcgtgaggagataagatgcatgaaccccaattatactgagttcaggtttcctcagataaaagctcatccatggcacaagattttccacaagagaatgcctccggaagctatagaccttgcttctcgtctcctccaatactcaccaagtcttcgctgctctgctcttgatgcatgtgcacatcccttcttcgatgagctacgggcgccgaatgcacgcctgccaaatggccgtccattccctctgctcttcaacttcaagcatgaactagcaaatgcctctccggatctcatcaacaggctcatacccgaacatatcagacggcaacatggcgtcaatttcgggcacaccggaagctaggagggcaggcactgcgattttcaactttttggtcttggttccccatgagcttgggccgatgcaagcataggcgacatggtaccatcaggagagatcaacccagcagttcctgagagaagtaaaactatgtaaattatcttgaccgtaaagaactaccgccagtgttaagccggtaactggcgcatgttggtccagtagttaaggtaagattgtaggtggtgactggttaatgcctagggctgttttttgttattatgttcgtcggtacttctcagcagtagtgtagctgctcctgttttgttcgtccgccatgatgtaaatgatcatctccttgcaatgcctgttctcttctctccttataatgcttagtcgcctcatcattttgtagt

SEQ ID NO: 4561 - DNA, 1754 bp, Echinochloa colona
ctgcccgaccggtcaaaagcactgctggctgctgctccacaccaccatctcccattcctccccaaccccaggccaagcgaaccaccccgcagccgcaagcaaggtgctgccgctgccgcccccctcggcctcccggcgtgtgagcgcggcgccctcgcttcccccatccgacccatggaggcgccgccggggccggagcccatggagctggacgcgccccctgccgccgccgctgccaccgacgccacggcggcggtggttccccccgccggcagcgagaagaagaaggaagacgcagggcgagacggcgtcccgggccacatcatctccaccaccatcggcgggaagaacggcgagccgaagaggactataagctacatggcagagcgtgtggtgggtacaggttcatttgggattgtcttccaggctaagtgtctggagactggggagacctttgccatcaagaaggtgttgcaagatagacgttacaagaaccgggagctgcaacttatgcgcgctatggaacaccccaatgtcatctgtctgaagcactgcttcttctcgacgacgcccagggatgagctatttctgaacctcgtcatggaatatgttccggagacgctgtatcgtgtcctgaagcactacagcaatgcgaaccagagaatgcctcttatctatgtcaagctctacatgtatcagctttttagagggctagcttatattcatactgtgccaggagtctgccacagggacgtaaagccgcaaaatgtgctggttgaccctctgactcaccaagtcaaactgtgtgactttggaagcgctaaagtcctgattcctggtgaaccaaatatatcttacatatgttctcgttattatcgtgctcctgagctcatattcggagcaactgagtatacaacttcaatagacatatggtcagctggctgtgtgctcgcagagttgcttcttggtcagccactgtttccaggagagagtgccgttgaccagctagtggagataatcaaggttcttggtactccaacccgtgaggaaataaggtgcatgaaccccaactataccgagttcaggtttcctcagataaaggctcatccttggcacaagattttccacaagagaatgcctccagaagctatagaccttgcttctcgtctcctccagtactcaccaagtcttcgctgctctgctcttgatgcatgtgctcatcccttctttgatgagctacgggcgtcgaatgcacgcctgccaaatggccgtccatttcctccgctcttcaacttcaagcatgaactagcaaatgcctctccagaactcatcaacaggcttataccggaacatatcaggcggcaacatggcatcaacttcgggcataccgggagctaggacaggcattgcgatgttcaacattttggtcttgttccccatgtgctgggccgatgcaagcttaggtgacattgcaccatctggagagaacggcccagcagtaccgagaaaagtaaaactatgtaaattatctgaccgtgaagaactaccgccagtgttaagacagtaactggcgcatgttggtccagtagttaaggtaagaatgtaggaggtggtgactggttaatgcctagggcagtttttggttatgtttgtcagtactttctcagcagtattgtagctgctcctgttttgttcgtccgccatgatgtaaatgatcatcaccccaattgcaatgactgttcttattaatgctt

SEQ ID NO: 4562 - DNA, 2222 bp, Setaria italica
cgcttatcgctaagcagcaggcaagcggctgtcccgagctgtccaaagcaaagcaaagcaaaggcaagcggcggcagtcctcgcagcccgaccggtcaaaagcactgctggttgctgctccacaccaccctcccctcccattccccaacccccaacccaagcgaactaccccgcagccgcagccgcagccgcagccgcaagcaagctgcagttctgccccccataggcctcggacgcggcgtgtgagcgcggcgacctcgcctcccactccccggacccatggaggcgccgccggggccggagcccatggcgctggacgcgccccctgccgctggtgacgccacggcggccgcggcggcggttgcccccgccggcgacgagaagaagaaggaaggcgaagggggggacaagatgccgggccacatcatctccaccaccatcggggggaagaacggcgaaccgaagaggaccataagttacatggcagagcgcgtcgtgggtacaggttcatttgggattgtgttccaggctaagtgtcttgagactggggagacctttgccatcaagaaggtgttgcaagatagacgttacaagaatcgggagctgcaactgatgcgcgccatggaacaccccaatgtcgtctgtctgaagcactgcttcttctcgacgacgcccagggatgagctatttctgaacctcgtcatggaatatgttccggagacgctgtatcgtgtcctgaagcactacagcaatgcgaaccagagaatgcctcttatctacgtcaagctctacatgtatcagctttttagagggctagcctatattcataccgtgccaggagtctgccacagggacgtaaagccacaaaatgtgctggttgaccctctcactcaccaagtcaaactgtgtgactttggaagcgctaaagtcctgattcctggtgaaccaaatatatcttacatatgctctcgttattatcgtgctcctgagctcatatttggagcaactgagtattcaacttcgatagacatatggtcagctgggtgtgttctcgcggagttacttcttggtcagccactgtttccaggagagagtgcggttgaccaactagtggagataatcaaggttcttggtactccaacccgtgaggaaataagatgtatgaaccccaactatactgagttcaggtttcctcagataaaggctcatccttggcacaagattttccacaagagaatgcctccggaagctatagaccttgcttctcgtctcctccagtactcaccaagtcttcgctgctccgctcttgatgcatgtgcgcaccccttctttgatgagctacgggcaccgaatgcacgcctgccaaatggccgtccattccctccactcttcaacttcaagcatgaactagcaaacgcctctccagaactcgtcaataggctcataccagagcatatcagacggcaacatggcgtcaactttgggcatgctggaagctaggagggcaggcgctgcgatgttcaactttttggtcttggttccccatgtgctgggctgatgcaagcgcaggcgacattgcaccatctggagagatcgacccagcagtgcctgatgagagaagtaaaactatgtaaattatctgaccgtgaagactaacgccagtgttaaaggcagtaactggcgcatgttggtccagtggttaaggtaagaatgtaggtggtggtgactggttaatgcctagggctgtttttggttattatgttcgtcagtacttctcagcagagtagctgctcctgttttgttcatccgccatgatgtaaatgatcatcgccccaattgccatgactgttctctcgtgaatgcttaggctcctgatcgttttctagttcagatgcgtgtgtgatgcagctcttgaggccggaaagtgggaacgactcctactgaaatggaattgcttctggtgaatcttctttgaatttttgcgttccaaacatccaaatacaaatgcatctgtcgatcgttctattggcgagaactctaagtagtctgatgagtggcttcgcagatgctcattttgatccattgcaaggatacaaatgcagtggaattggaatgggattccactaattattcccccaaatcatagtttgtttttgattttacatggagtcatcgatcgaaattggaaagcaaacaaacacctgcagcttacagacgcgccc

SEQ ID NO: 4563 - DNA, 3366 bp, Oryza sativa
tccatacccaattctttatcctaatcaataccaccaaagactccttctaaactaagaaactcaagattttcaccttggttcatctctcatgcaaatcctctaaaattcctcctataaaacatcccagttcatgaaagaaaacccttcaaaaatatcatactgagcacagttattagctggaggagtcagcacagttatcggtaaaaccacttccccatctgtccaaactccaaagccggcctcaccggcagcagccacaccacaccacaccacaacaccccgcagccttgctgcctcccctccctgaccggtcaaaagcacaccaccaccatccccccgcaaagccaagcaccaacgctcagcagcagcagccgcctccctccccagctcagctcagctcccccccgcatggaggcgccgccggggccggagcccatggagctggacgcgccaccgccccccgccgccgtggcggcggcggcggcgaccgccggcatcagcgagaaggtgctgcagaagaaggaggagggcgggggcgacgccgtgacgggtcacatcatctccaccaccatcggcggcaagaacggcgagccgaagcggacaattagttatatggcggagcgagttgtaggaactggttctttcgggattgtgttccaggctaagtgcttggagacgggggaaacggtggccatcaagaaggtgttgcaggaccggcgttacaagaaccgtgaactgcagcttatgcgcgcaatggaacaccccaatgtcatctgcctgaagcactgcttcttctcaaccacaagcagggatgagctgttcctgaatcttgttatggagtacgtccctgagacactctaccgtgtgctcaagcactacagcaatgctaaccagcggatgccattgatctatgtgaagctttacatctatcagcttttcagagggttagcttatattcatactgttccaggagtctgccacagggatgtgaaaccacaaaatgttttggttgatcctctcactcatcaagtcaagctatgtgactttggaagtgcaaaggttctggttcctggtgaaccgaacatatcatacatttgctctcgctattatcgtgctcctgagctcatatttggtgcaaccgagtatacaacttcaattgacatatggtcagctggatgcgttcttgcagagttacttcttggtcagccactgtttcctggagagagtgctgttgaccagctagtagagataatcaaggttcttggtactccaacccgtgaggaaatacgatgcatgaaccccaactatactgagttcaaatttcctcagattaaggctcatccttggcacaagattttccacaagagaatgcctccagaagccatagaccttgcttcccgtcttctccaatattcaccaagtctacgctgcactgctcttgacgcatgtgcacattccttctttgatgagctacgagagcccaatgcacgcctgccaaatggtcgtccattccctcctctgttcaacttcaagcatgaactagccagcgcctctccagaactcatccacaggctcataccggatcatatcagacggcaacatggcctcaactttgcgcatgctgggagctaaagggcaccgcgacgccaccgttttgttcgtttatttttccatgagctggacattgcaatcctagatgactccattgtcctggacttggactccatctcagattgcaccatccatgttccatgatccatccatccgtcaagccatttccgcaaggactcagtaccagagaagaagtacaattatgtaaattatctaaccatggagaaatgcgtgctgctgctgctggtgttaagtacgtgacggggcatgctggttgagtagtaggtaaggttaaggataaatgtagttggtggagactgagagacatgttaagctagggaaccctgctttccttcttttttttttctcctttcattttggtttcttcccattttgtgatccttagcattgccctacagtagtgtagctgctccctgtttttgtttgctctttcatcatgtaaatgccaatcccaatcgcaatgaaccctctttccttcacatcctggtctactccctgtcttgattttgcagctttgtttgttgatgatcaagtagtgaacctgaacatctctgcaattcagtgcaagaacacaagaattcagcagaatcatgtgatacaaatcatgcaatcctgcgaggatacatttgcagcgcaccaatcttgatgcagcggaagcatacacgatacaacatacggtaaggtagactacagcagcggccgtggcggcggcggcggaggctcgtcggtggcgtggtccttcaccttggcccagagctccggccaaatcgccttcctggtctcggccacgatctccccgtcccatcccctcgccgcgagcgcctccgcctcccggacggcggcggccaccacgtcgtcgacgccgccgtcgacggccgcgtccacgatgccccgccgcagggcgtcggccgccgtcatcttgtcgccccggaggactagatccctcctgttcacggcgtcggggaccttctgccggatcagctcggcgaagaagtcgacgatcttgaggccggcgtccacctcgctcatgtacaggaagccgcgggaggcgcgcatgaccacggcgtcgtgcgcgagcgccagcgcgcacccggcggccgcggcgtggccggtgacggcggcgacggtgggcaccgggagagcgaggaggtcggcgacgaggccccggaaggcgccgcccatggaggcgtgcagctcggcgggcacggtgcgcgcccagtccaggtcgaacccgttggagaagtacttgccctcgccggcaatcaccagcgcgccgccggcgcccgcggcggcggcggcgcggacggcggcgacggcggagcggagcgcggacaggaggggcgggccgaggcggtgctcgccggcgccggtgagggtgatgacgtggacggcgccgcgcttctccacggtgcacaagctcgccgtgtccatttggggatttcggcgatgaatgccgtcaagacctggatgtctggactcctttggcgtttcagttcacgtttatcttttcgacatgagcttcccagcatcttcgttttgtttaatcagctgtcaagagcaagttcaatagtatagtccactactagctccaatttatctatagctaatctaatagccaattaatataatagttgcttactatactattagcatatggtcccactgtcatacacacattgcgtcttgtagtccgtgctgcagctggctacagatttgtaacccgctgctcttctc

SEQ ID NO: 4564 - DNA, 1442 bp, Oryza sativa
tctgtccaaactccaaagccggcctcaccggcagcagccacaccacaccacaccacaacaccccgcagccttgctgcctcccctccctgaccggtcaaaagcacaccaccaccatccccccgcaaagccaagcaccaacgctcagcagcagcagccgcctccctccccagctcagctcagctcccccccgcatggaggcgccgccggggccggagcccatggagctggacgcgccaccgccccccgccgccgtggcggcggcggcggcgaccgccggcatcagcgagaaggtgctgcagaagaaggaggagggcgggggcgacgccgtgacgggtcacatcatctccaccaccatcggcggcaagaacggcgagccgaagcggacaattagttatatggcggagcgagttgtaggaactggttctttcgggattgtgttccaggctaagtgcttggagacgggggaaacggtggccatcaagaaggtgttgcaggaccggcgttacaagaaccgtgaactgcagcttatgcgcgcaatggaacaccccaatgtcatctgcctgaagcactgcttcttctcaaccacaagcagggatgagctgttcctgaatcttgttatggagtacgtccctgagacactctaccgtgtgctcaagcactacagcaatgctaaccagcggatgccattgatctatgtgaagctttacatctatcagcttttcagagggttagcttatattcatactgttccaggagtctgccacagggatgtgaaaccacaaaatgttttggttgatcctctcactcatcaagtcaagctatgtgactttggaagtgcaaaggttctggttcctggtgaaccgaacatatcatacatttgctctcgctattatcgtgctcctgagctcatatttggtgcaaccgagtatacaacttcaattgacatatggtcagctggatgcgttcttgcagagttacttcttggtcagccactgtttcctggagagagtgctgttgaccagctagtagagataatcaaggttcttggtactccaacccgtgaggaaatacgatgcatgaaccccaactatactgagttcaaatttcctcagattaaggctcatccttggcacaagattttccacaagagaatgcctccagaagccatagaccttgcttcccgtcttctccaatattcaccaagtctacgctgcactgctcttgacgcatgtgcacattccttctttgatgagctacgagagcccaatgcacgcctgccaaatggtcgtccattccctcctctgttcaacttcaagcatgaactagccagcgcctctccagaactcatccacaggctcataccggatcatatcagacggcaacatggcctcaactttgcgcatgctgggagctaaagggcaccgcgacgccaccgttttgtt

SEQ ID NO: 4565 - DNA, 2188 bp, Brachypodium distachyon
tccggtactcatagccagccccacgacacgccaccccacaccccagacagaccggtcaaaagcaaagcgcgcagccagccaccatcccattcccaacccccaacgcaaaggcaaaacaaagccaagcggagagaagtaggagagcgcagcaggagcagcaagctgttgtaggtggtgtgtgcgcgtcgccctccttgctgctgcggagcacacgcaaccccgaccgacccatggaggcgccgccggggtcggaggccatggcgctcgacgcgcccccgccaggcgccgccgtcgcgggccccgctgtcggcgacaagaggaaggaggaggggggcgaccccgtcaccggccacatcatctccaccaccatcggcgggaagaacggcgagccaaagcggacaattagctacatggccgagcgagtagtaggaactggttcatttgggattgttttccaggctaagtgcttggagacaggggagaccgtggccatcaagaaggtgctgcaggaccggcgttacaagaaccgtgagctgcagcttatgcgctccatggaccaccccaatgtagtctctctgaagcactgcttcttctctaccacgagcagggatgagctgttcttgaaccttgtcatggagtatgtacctgagactctataccgtgtgctcaaacactacagcaatgccaaccagcggatgccgcttatctatgtcaagctttacatgtatcagctttttagagggctggcttacattcatgctgttccaggagtttgccacagggatgtgaagccacaaaatgttctggttgatcctctaactcaccaagtcaagatctgtgactttggaagtgcaaaagttctggtacctggggaacctaatatatcatacatatgctctcgctattatcgcgcccctgaactcatattcggtgcaactgaatatacaacttccatagacatatggtcagccgggtgtgttcttgcagagttacttcttggccagcctctgtttccaggagagaccgcggttgatcagttagtggagataatcaaggttcttggtactccaacacgtgaggaaatacgatgcatgaaccctaactacaccgagttcagatttcctcagataaaggctcatccttggcacaagattttccacaagagaatgcctgctgaagccatagatcttgcctctcgtcttctccaatattcaccaagtctacggtgcactgctcttgatgcatgtgcacattccttcttcgatgagctacgtgagccaaatgcacgcttgccgaatggccgtccattcccccctctgttcaacttcaagcctgaactagtaaacgcctctccggagcttatcaacaggctaatcccagaacatgttcgacggcaaaatagcctcaacttcgcgcattctgggagctagaaaccgtgctgcaaccctcaactttttggttcttcatccgtgagctgcgcatgcgcaggctcagatcaccccatcttcgaagccactctcctaaagccagtggagagaccgatccagtgccagagaaaggagagtacaattatgtaaattatctgaccgtgaagaattgatgtttgttgctgctgccgttgttaagtatgtgacggcgcatgttggtcgagttattacttatttttaggtaaggtaatgatgtaggttggtgaagacatgttaatgctagggcttgtgacctgttgatcttgccatttttgtactgcttagtagtattgccgtgcagcttgtgtagccgcactccctgttttgtcggttctactacctgatgtaaatgtcgtcgcccagtcgcaatgactagtcttctgttacatggtctggttccttgttatgatgcatgtttttaggaactgtgagatcaagcacagggcggcttgactatttctatggcgttgttgctaacatactgtgccaattggtcatttttactcgttaacgctaacatgtaagcaaacgagtttcatgagcagctgttatttttctagaagccgagtgaactcagcccatgtaagagggcagctcgagcagccctcagccggccggcccagcatttctcttcctgagttctaatctcaatcgaaggttcgcagcccgtctcttcttttcaattgctccactcatggtcaccagacccacaatttaagaac

SEQ ID NO: 4566 - DNA, 1449 bp, Avena sativa
cacctgtccaaagcggcatctcgggcatctccgcactcattttagccacacccgcgaccggtcaaaagcacagcgcagcaccaccatcccaatccccaacatcacaaagcagcgcagggcagcacaagcaccgcagcgcagcacagcagctctcgctaggccttcctccgcggcgcgcttctcacccaccctcgtccccggtccccgcgcacacgtacacgccaccccatggaggcggcgccggagcccatggagctggacgccccgcccccgctcgccgccgccgtcccggctcacgcgggaaacgagaagaagagggaggatggtggcgaccccgtgaccggccacatcatctccaccaccatcggcgggaagaacggcgagccgaagcggacaatcagctacatggctgagcgagtagtaggaactggttcatttgggattgtcttccaggctaagtgcatagagactggagagactgtggccatcaagaaggtactgcaggaccggcgttacaagaaccgtgagctgcagcttatgcgctccatggaccaccccaatgtcgtctccctgaagcactgcttcttctcgaccacgagcagggacgagctgttcctcaaccttgtcatggagtatgtccctgagactctataccgagtgctcaaacactacagcaatgccaaccagcggatgccgcttatctatgtcaagctttacatgtatcagcttttcagagggctagcttacatccatactgtccctggagtttgtcacagggatgtgaagccacaaaatgttttggttgatcctctaacccaccaagtcaaactctgtgactttggaagtgcaaaagttctggtacctggtgaaccgaacatatcatacatatgctctcggtactatcgtgctcctgagctcatatttggcgcaactgaatatacaacttcaatagacatatggtcagctggatgtgttcttgcagagttacttcttggtcagcctctgtttccaggagagactgcagttgatcaactagtggagatcatcaaggttcttggtactccaacccgtgaggaaattcgatgcatgaaccccaactacactgagttcagatttcctcagataaaggctcatccttggcacaagattttccacaagagaatgcctgctgaagctatagatcttgcctcccgccttctccaatattcaccaagtctacgctgtactgctcttgatgcatgtgcacattccttctttgacgagctacgcgagccgaatgcacgcttaccgaatggccgcccattcccccctctcttcaacttcaagcctgaactagcgaacgcctctcctgacctcatcagcaggctgattccggagcatgttcgacggcaaaatagcctcaacttcgcgcatgctgggagttagaaggggtgagcgccacaatgccca

SEQ ID NO: 4567 - DNA, 1814 bp, Secale cereale
tctcgggcatctcgcagtactcatagccagccaccccccaccccccgcagcctcccccctcgaccggtcaaaagcacgcaccaccaccatcccaatccccaacgcaagagcaaagcagcagcacgctccccccctccacgtacggtgtccccgcggctcgcccctcccccacccccgtccccgcacacgccaccaccccatggaggcgccgccggggccggagcccatggtgctggacgcgccgcccccgctcgccgccgctgtcccggcccacgcggccaccgagaaggcgaggacggaggggggcgaccctgtcaccggccacatcatctccacaaccatcggcgggaagaacggcgagccgaagaggacaattagctacatggctgagcgagtggtaggaactggttcatttgggattgtcttccaggctaagtgcttggagactggagagactgtggccatcaagaaggtgctgcaggaccgtcgttacaagaaccgtgagctgcagcttatgcgctccatggaccatcccaatgtcgtctctctgaagcactgcttcttctcgaccacaagcagggatgagctgttcctgaaccttgtcatggagtatgtccctgagactctataccgtgtgctcaagcactacagcaatgccaaccagcggatgccgcttatctatgtcaagctttacatgtatcagctttttagagggctagcttatgttcatactgttccaggagtttgccacagggatgtgaaaccacaaaatgttttggttgatcctctaacccatcaagtcaagatctgtgactttggaagtgcaaaagttctggtacctggtgaacccaatatagcatacatatgctctcgctactatcgtgctcctgagctcatatttggtgcaactgaatatacaacttcaatagacatatggtcagctggatgtgttcttgcagagctacttcttggtcagcctctgtttccaggagagactgcagttgatcagctagtggagattatcaaggttcttggtactccaacccgtgaggaaattcggtgcatgaaccccaactataccgagttcaggtttcctcagattaaggctcatccttggcacaagattttccacaagagaatgcctgctgaagctatagatcttgcttcccgccttctccaatattcaccaaatctgcgttgcactgctcttgatgcatgtgcacattccttctttgatgagctacgtgagccgaatgcacgcttgccgaatggccgcccattccctcctctgttcaacttcaaacctgaactagccaacgcctctccagagctcatcaacaggcttgttccggaacatgttcgacggcaaaatggcctcaacttcgcccatgctgggagctagacgggtgcgctcgcatcgcccatattttttgtttgtccgccatcatcgaagaatcaactctctctcctaaatcctgaggagagaccgatccagtgccagtgccagtgccagtgaaagaagtacaactatgtaaattacctgaccttggaagaatcgttgttgttgttgccggtgccggccatgtttaagtacatggcggcacatgttggttgagttgttacttattattagtaggtaagagcaatgatgtaggaggtgggagacatatgttaatgctagggctgtgacctgttttaagtacatttttgtaatgcttggtagtggtactgtaatgcggcggcagtagctgctccatgttttgtcccttgtccctgatgtaaatgtcgtcgtcctgcagcaaatgactgttctt

SEQ ID NO: 4568 - DNA, 1532 bp, Pennisetum glaucum
cggcggttgcccccgccggcgacgagaagaggaaggaaggcgaaggggaagacaagatgccgggccacatcatctccaccaccatcggtgggaagaacggcgagccgaagaggaccataagttacatggcagagcgtgtcgtgggtacaggttcatttgggattgtcttccaggctaagtgtcttgagaccggggagacctttgccataaagaaggtgttgcaagatagacgatacaagaatcgggagctgcaactgatgcgcgccatggaacaccccaatgtggtctgtctgaagcattgcttcttctcgacgacgcctagggatgagctatttctgaacctcgtcatggaatatgttccggagacgctgtatcgtgtcctgaagcactacagcaacgcgaaccagagaatgcctcttatctatgtcaagctctacatgtaccagctttttagagggctagcttatattcatactgtgccaggagtctgccacagggatgtaaagccacaaaatgtgctggttgaccctctcactcaccaagtcaaactgtgtgactttggaagcgctaaagtactgattcctggggaaccaaatatatcttacatatgctctcgttattatcgtgctcctgaactcatatttggagcaactgagtattcaacttcgatagacatatggtccgctgggtgtgttctcgcggagttacttcttggtcagccactatttccaggagagagtgcagttgatcagctagtggagatcatcaaggttcttggtactccaactcgcgaggaaataagatgcatgaaccccaactatactgagttcaggtttcctcagataaaggctcacccgtggcacaagattttccacaagagaatgcctccagaagctattgaccttgcttctcgtctcctccagtactcaccaagtcttcgctgctctgctcttgatgcatgtgctcatcccttctttgatgagctacgggcgccaaatgcacgcctgccaaatggccgtccattccctccacttttcaacttcaagcatgaactagcaaatgcctctccagaactcatcaacaggctcataccagaacatatcagacggcaacatggtgttaactttgggcacactggaagctaggaaggcaggtgcttcgacgctaaactttttggtcttggttccccatacgctgggctgatgcaagctgaggtgacattgcaccatctggagagatagacccagcagtacctaatgagaagtaaaactatgtaaattatatgactagcgccagtgtaaaagtcggtaactggcgcatgttggtcccttagttaagttcagaatgtaggtggtggtgactggttaatgcctagggctgtttttggttattatgttcgtcagtacttcttagcagagtacctgctactgttttgttcgtctgccattatgtaaatcatcgccccaattgccatgactgttctctgctagattacggggatctaacaggtgcgcacatctagttgggtaaaa

SEQ ID NO: 4569 - DNA, 1738 bp, Panicum virgatum
tgccgccaccgccgccgccgaggacgcggcggcggcggttcccccgccggcggcgagaagaaggaaggcgaggggggagagagggtcccgggccacatcatctccaccaccatcggcgggaagaacggcgaaccgaagaggactataagttacatggcggagcgtgttgtgggtacaggttcatttgggatagtcttccaggctaagtgtctggagactggggagacctttgccatcaagaaggtgttgcaagatagacgttacaagaaccgggagctgcaactgatgcgcgccatggaacaccccaatgtcatctgtctgaagcactgcttcttctcaacgacacccagggatgagctgtttttgaacctcgtcatggaatatgttccggagacgctgtatcgtgtcctgaagcactacagcaatgcgaaccagagaatgcctcttatctacgtcaagctctacatgtatcagctttttagagggctagcttatattcatactgtaccaggagtctgccacagggatgtaaagccacaaaatgtcctggttgaccctctcacccaccaagtcaaactgtgtgactttggaagcgctaaagtcttgattcccggtgaaccaaatatatcttacatttgctctcgttattatcgtgctcctgagctcatattcggagcaactgagtatacaacttcgatagacatatggtcagctgggtgtgttcttgcggagttacttcttggtcagccactgtttccaggagagagtgcggtcgaccagctagtggagataatcaaggttcttggtactccaactcgtgaggaaataagatgcatgaaccccaactatactgagttcaggtttcctcagataaaggctcatccatggcacaagattttccacaagagaatgcctccggaagctatagaccttgcttctcgtctcctccaatactcaccaaatcttcgctgctctgctcttgatgcatgtgctcatcccttctttgatgagctacgggctccgaatgcacgcctgccaaatggccgtccattccctccgctcttcaacttcaagcatgaactagcaaatgcctctccggaactcgtcaacaggctgataccggaacatattagacggcaacatggcgtcaacttcgggcacaccggaagctaggagggcaggcacagcgatgttcaactttttggtcttggttccccatgagctgggccgatgcaagcgtaggcgacatggcaccatcaggagagatcgaccctgcagttcctgagagaagtaaaactatgtaaattatctgaccgtaaagaactaccgccagtgttaagtcggtaactggcgcatgttggtccggtagttaaggtaagaatgtaggaggtggtgactggttaatgcctagggctgtttttggttattatgttcgtcagtacttctcagtagtagtgtagctgcacctgttttgttcgtccgccatgatgtaaatgatcatctccccaatcgcaatgcatgttctatcgttaatgcttagtcgcctgatcattttgtagttcagaacttaagatgcgtgttgtgatgcaactctaaggccggaatgcgggagccacaactcctgttgatatggaagtgctcctgagattttttttttagagattctggtgaaatttagcattccaaacatcagatacaactcatctgtagatcgttgtgttggctggaactggaagta

SEQ ID NO: 4570 - DNA, 2426 bp, Oryza sativa
ccgaactgcacgtaagaacggtcaagaaaccatttcggttacatcacacaacacagcctcatctctcatgctgtcatgcttgtggtgcacctagcaattcctccctccccatctgtcttcctcctctaatctaatccacctccccactaatccaccagctgtgtacactgcagcagcagcagcagctaaccactctcactaaaaactatagcagctgcagtaacagcagcagcatcacccaccttcttcttggtcaaagccatccatcccaccactcacccatccctcccagtataagccaaaccaatccatagaggaggaagaggaggaccaggtggtggcacacctaagctttgtgcagtgccattcacgcacctgcagcttccagctttgccacatggaccagccggcgccggcgccggagccgatgctgctcgacgcgcagccgcccgccgccgtcgcctgcgacaagaagcagcaggagggggaggcgccgtacgcggaggggaatgacgcggtgaccgggcacatcatctccaccaccatcgggggcaagaacggcgagcccaagaggacaattagctacatggcggagcgcgttgtgggcactggttctttcggtatcgtctttcaggctaaatgcttggagacaggagagactgttgccattaagaaggtattgcaggaccgacggtacaagaaccgtgagcttcagcttatgcgcgccatggaccaccccaatgtcatctccctgaagcattgcttcttctcaaccacaagtagggatgagctgttcctcaatcttgtcatggaatatgttccagaaacactctaccgtgtgcttaagcactacagcaatgccaaccaccggatgccacttatctacgtcaagctttacatgtatcagttatttagggggcttgcgtacattcatactgttccaggggtctgtcatagggatgtgaagccacaaaatgttttggtggatcctctaactcatcaagtcaagctctgtgactttgggagcgcaaaaacactggtcccaggtgaacccaatatatcatatatatgctcacgctactaccgagcaccggagctcatatttggtgcaactgaatatactacatcaatagatatatggtcagctgggtgtgttcttgcagagctactccttggtcagccattgtttccaggggagagtgcagtcgatcagcttgtagagataattaaggttcttggtacaccaacccgtgaggaaatacgttgcatgaacccgaactatacagagtttaggtttccacagataaaagctcacccttggcacaaggttttccacaagaggatgcctcctgaagcaatagacctcgcttcacgccttcttcaatattcaccgagtctccgctgcactgctcttgatgcatgtgcacatcctttctttgatgagctgcgagagccgaatgcacgcttgccaaacggacgtccatttccaccactattcaacttcaaacacgaactagcaaattcttctcaagagctcatcagcaggctcataccagaacatgttcgacggcaagctacccacaacttcttcaatactgggagctaaaaatgctaaatgcacaccaccagaccttttgttggatcgttttcgcggaaccggtgaagttcacatgaaggctgagtcagatgattcttcgaatccccgcaaaacaagaagaatagaaaatatgattcctcagatgatgatatgcaaatgcttcgttggaagttcaattcaatcatcgaagaagaacaacattgtaaatcgagaagtttttgcatcgcgagtttggtagtgaaaccgggatcagctggtatgacggaggaaaccgaaatgtttagatccatgactgagttttctttcattttttttgcccaattgtaacagaagaatatagttccctaatgtaggcgtagttgtaacctgtaaactgccactgttttgttcacattccatgatgtaaatgccaccatgcctctgatgaataactctccttgtaaccttgttccttccatccttgactgtttaccttaaagccgtggacagtgtacactgtacatgtaccgtgctacacggaaggacatatttgaattttttttctctctctcgaaagactacatcaagcattgctggatttttttttaaaaaaatggcacaactttcgatggtcaaccataagcaattagtgtcgttttaaaaccccttactcccatatgcacaatacttatctttcatttttctagattgtttagcataaaataagatttaaaaagaaagaaaactatattgctatttaattgttgggtgtagaatgggaaaactttttaaatgaaagatgattatttcttaatgtaacaagtagtactgtagtgtggattgaattggg

SEQ ID NO: 4571 - DNA, 1896 bp, Oryza sativa
cttggtcaaagccatccatcccaccactcacccatccctcccagtataagccaaaccaatccatagaggaggaagaggaggaccaggtggtggcacacctaagctttgtgcagtgccattcacgcacctgcagcttccagctttgccacatggaccagccggcgccggcgccggagccgatgctgctcgacgcgcagccgcccgccgccgtcgcctgcgacaagaagcagcaggagggggaggcgccgtacgcggaggggaatgacgcggtgaccgggcacatcatctccaccaccatcgggggcaagaacggcgagcccaagaggacaattagctacatggcggagcgcgttgtgggcactggttctttcggtatcgtctttcaggctaaatgcttggagacaggagagactgttgccattaagaaggtattgcaggaccgacggtacaagaaccgtgagcttcagcttatgcgcgccatggaccaccccaatgtcatctccctgaagcattgcttcttctcaaccacaagtagggatgagctgttcctcaatcttgtcatggaatatgttccagaaacactctaccgtgtgcttaagcactacagcaatgccaaccaccggatgccacttatctacgtcaagctttacatgtatcagttatttagggggcttgcgtacattcatactgttccaggggtctgtcatagggatgtgaagccacaaaatgttttggtggatcctctaactcatcaagtcaagctctgtgactttgggagcgcaaaaacactggtcccaggtgaacccaatatatcatatatatgctcacgctactaccgagcaccggagctcatatttggtgcaactgaatatactacatcaatagatatatggtcagctgggtgtgttcttgcagagctactccttggtcagccattgtttccaggggagagtgcagtcgatcagcttgtagagataattaaggttcttggtacaccaacccgtgaggaaatacgttgcatgaacccgaactatacagagtttaggtttccacagataaaagctcacccttggcacaaggttttccacaagaggatgcctcctgaagcaatagacctcgcttcacgccttcttcaatattcaccgagtctccgctgcactgctcttgatgcatgtgcacatcctttctttgatgagctgcgagagccgaatgcacgcttgccaaacggacgtccatttccaccactattcaacttcaaacacgaactagcaaattcttctcaagagctcatcagcaggctcataccagaacatgttcgacggcaagctacccacaacttcttcaatactgggagctaaaaatgctaaatgcacaccaccagaccttttgttggatcgttttcgcggaaccggtgaagttcacatgaaggctgagtcagatgattcttcgaatccccgcaaaacaagaagaatagaaaatatgattcctcagatgatgatatgcaaatgcttcgttggaagttcaattcaatcatcgaagaagaacaacattgtaaatcgagaagtttttgcatcgcgagtttggtagtgaaaccgggatcagctggtatgacggaggaaaccgaaatgtttagatccatgactgagttttctttcattttttttgcccaattgtaacagaagaatatagttccctaatgtaggcgtagttgtaacctgtaaactgccactgttttgttcacattccatgatgtaaatgccaccatgcctctgatgaataactctccttgtaaccttgttccttccatccttgactgtttaccttaaagccgtggacagtgtacactgtacatgtaccgtgctacacggaaggacatatttgaattttttttctctc

SEQ ID NO: 4572 - DNA, 2136 bp, Brachypodium distachyon
agaattaaatcttgtatccataaaaccgaacgtcatggctgggtgctcctagccgtttaatcccggagtgattctcttctaatctaatccacctccccactaatacaccagctgtttacactgcaccggctaaccactctcactgaatcaacgtcacttccccatcttgttcttcttggtcaccaccacccctccttccccctcttcactggtcaaaggcaccaccccccaacgcagtacaagccaagccaaaccaagccagagagagaaagagggagaggaggaccaggtgtaggtgtatgcgaggagtgtgagcccactgtccccatttccatacacacgctagccacatggagcagacggcgccagcggcgccggagccgatgttgctcgacgaccagccccccaccgcggtcgcctgcgagaagaagcagcaggatggcgaggcgccgtacgcggaggcgaacgacgccatgacgggtcacatcatctccaccaccatcgggggcaagaacggagagccgaagcagacgattagctacatggcggagcgcgttgtgggcactggttcttttggcattgtctttcaggctaaatgcttggaaactggggaaacagtggctatcaagaaggtactgcaggaccgacggtacaagaaccgtgagctgcagcttatgcgctcgattaaccatcccaatgtcatctccctgaagcactgctttttctcgaccacaagtagagatgagctgttcctcaaccttgtcatggagtatgtccctgagacgctctaccgtgtgcttaagcactacagcaatgccaaccaacggatgccacttatctatgtcaagctttatatgtatcagctattcagggggcttgcctacattcatactgttccaggtgtctgccatagggatgtgaagccacaaaatgttttggttgatcctttgacccatcaagtcaagatctgtgactttggaagcgcaaaagttctggttgcgggtgagcccaatatatcgtacatatgctcacgctactaccgtgctccggagctcatatttggtgcaactgaatatacaacatcaatagatatatggtcagctggttgtgttcttgcagaactgctccttggtcagccactatttccaggagagagtgcagttgaccaacttgtagagataatcaaggttcttggtacgccaactcgggaggaaatacgttgcatgaacccgaattatacagagtttaggtttcctcagataaaagctcacccttggcacaaggttttccacaagagaatgcctccagaagcaatagatcttgcttcgcggcttcttcaatattcaccaagtctccgttgcaccgctcttgaggcatgtgcacatcctttctttgatgaactacgggagctgaatgcacgcttgccaaacgggcgcccattcccacctctattcaacttcaagcatgaactggccaacgcctcagcagatctcatcaacaggcttgttcctgaacatgttcggcggcaacccggcttcaacttcttccatgctgggagctaaatacgcagcaacgtgctcaatcttgcactttgttgttttgctgacgggcgaagggcggtttaggtcaaggcaaagccagatgatccctcgtgcgatatgtcaggttatgtcgccagaagcacagttggagcaccttagaagaactgtgtaatttatcttatctgtcaaggaagaagccttgcttcacatgtttggtaatgaattgcggaacgcgggtacggtggaagtcgtagcgttaggcctgtgacatgagttgtattttgatttttggccctgttgtaagctgtaataacagagtatagctatcttaatgtagcctagctgtaagctgcccccctgttgcgttctccattccctcgtgtaaatgttgccatgctgctgatgaattcccttttcctttcagctggtgacgcttgattgttccgctgaatcattcttcgtgtcggccttctaagcctaaaaaacgatggaagaggtatatataacccaacgctagagagcaatccgttttctcttgagtgtgagaaaggtaaaagctctgtggtctggagtctgggttggttgttgccggaga

SEQ ID NO: 4573 - DNA, 1934 bp, Secale cereale
tcagttatagatcaacgtcactctggtcaaaggcagcaccacccacatcacagtacaagccaagccaagcccagccagagaggaggaccaagcgtaggtggatgcaagtgtgagcccaccgcgtcgcccattcacacgctagccacatggagcatccggcgccggcgccggagccgatgctgctcgacgagcagccccccaccgcagtcgcctgcgagaagaagcagcaggatggcgaggcgccgtatgcggaggggaacgacgccatgaccggtcacatcatctccaccaccatcggcggcaagaacggcgagcccaagcagacgattagctacatggcggagcgcgttgtgggcactggttcgtttggcatcgtctttcaggctaaatgcctggaaactggggagacggtggccattaagaaggtactgcaggaccgacggtacaagaaccgtgagctgcagcttatgcgttcgatgatccattccaatgttgtctccctcaagcactgcttcttctcaaccacaagtagagatgagctgtttctgaaccttgtcatggagtatgtcccggagacgctctaccgcgtgcttaaacactacagtaatgccaaacaggggatgccacttatctacgtcaagctttacacctatcagctattcagggggctggcgtacattcatactgttccaggagtctgtcacagggatgtgaagccacaaaatgttttggttgatcctttaacacatcaagttaagatctgcgactttggaagcgcgaaagttctggtggcgggtgagcccaatatatcatacatatgctcacgctactaccgtgctccggagcttatatttggtgcgactgaatatacaacatcgatagatatatggtcagctggttgtgttcttgcagaactgctacttggtcagccattatttccaggagagagtgcagtcgatcaactcgtagagataatcaaggttcttggaacaccaactcgggaggaaatacgttgcatgaacccgaattatacagagtttaggtttccgcagataaaagctcatccttggcacaaggttttccacaagaaaatgcctcctgaagccatagatcttgcttcacgtcttcttcaatattcaccaagcctccgttgcactgctcttgacgcatgtgcgcatcctttctttgatgagctacgggagcctaacgcgcgcctgccaaacggacgtccgttcccacctctgttcaatttcaagcatgaactggccaatgcttcacaagacctcatcaacaggcttgtgcctgaacatgttcgccgacaagctggtctcgctttcatgcacgcggggagctaaatatgcgcactggtgccctcaacctcgcaccttattgttttgccatgggcagaagggtggtggtttaagatggaggcaggtcagatgatccctggagagatatgtgccagattccatcatcagcagtaccggtagagcatcaaataataacaactgtagatcatctgccagcgaaggggccttgcctagagtattcagttgtgaattggtaatatcattcggattggtgggtacggtcgaggagatggaaacagcatagccttacgccgtggaccagagttttcttccagtttttgcccaattgtaagagttaatagcttcataatgtaccgtggctcgtaagttgtcaactgtttcgttctccattcattgatgtaaattgttgcagtaaacttcgctggtcaataagttgtgccatggcagagcttgcacgcccactgcctgtcaaggcatggccaatgggtagccccaaaggtgatgcttcataagccaactaggctcggatgccacagtggcagcaggaccgctgcttgtatgcgccaggtgaagcttgcagaggagacgggttcttcagcgcat

SEQ ID NO: 4574 - DNA, 1468 bp, Echinochloa colona
agggcgagacggcgtcccgggccacatcatctccaccaccatcggcgggaagaacggcgagccgaagaggactataagctacatggcagagcgtgtggtgggtacaggttcatttgggattgtcttccaggctaagtgtctggagactggggagacctttgccatcaagaaggtgttgcaagatagacgttacaagaaccgggagctgcaacttatgcgcgctatggaacaccccaatgtcatctgtctgaagcactgcttcttctcgacgacgcccagggatgagctatttctgaacctcgtcatggaatatgttccggagacgctgtatcgtgtcctgaagcactacagcaatgcgaaccagagaatgcctcttatctatgtcaagctctacatgtatcagctttttagagggctagcttatattcatactgtgccaggagtctgccacagggacgtaaagccgcaaaatgtgctggttgaccctctgactcaccaagtcaaactgtgtgactttggaagcgctaaagtcctgattcctggtgaaccaaatatatcttacatatgttctcgttattatcgtgctcctgagctcatattcggagcaactgagtatacaacttcaatagacatatggtcagctggctgtgtgctcgcagagttgcttcttggtcagccactgtttccaggagagagtgccgttgaccagctagtggagataatcaaggttcttggtactccaacacgtgaggaaataaggtgcatgaaccccaactataccgagtttaggtttcctcagataaaggctcatccttggcacaagattttccacaagagaatgcctccagaagctatagaccttgcttctcgtctcctccagtactcaccaagtcttcgctgctctgctcttgatgcatgtgctcatcccttctttgatgagctacgggcgtcgaatgcacgcctgccaaatggccgtccatttcctccgctcttcaacttcaagcatgaactagcaaatgcctctccagaactcatcaacaggcttataccggaacatatcaggcggcaacatggcatcaacttcgggcataccgggagctaggagggcaggcattgcgatgttcaactttttggtcttgttccccttgtgctgggccgatgcaagcgtaggtgacattgcaccatctggagagaaccacccagcagccagcagtaccgagaaaagtaaaactatgtaaattatctgaccgtgaagaactaccgccagtgttaagacagtaactggcgcatgttggtccagtagttaaggtaagaatgtaggaggtggtgactggttaatgcctagggcagtttttggttatgttcgtcagtactttctcagcagtagtgtagctgctcctgttttgttcgtccgccatgatgtaaatgatcatcaccccaattgcaatgactgttcttattaatgctt

SEQ ID NO: 4575 - DNA, 1675 bp, Triticum aestivum
caagccagagaaaaggaccaggcgtaggtggatgcaagtgtgagcccaccgtgtccgccccattcacaccctagccacatggagcatccggcgccggcgccggagccgatgctgctcgacgagcagccccccaccgcagtcgcctgcgagaagaagcagcaggatggcgaggcgccgtatgcggaggggaacgacgccatgaccggtcacatcatctccaccaccatcggcggcaagaacggcgagcccaagcagacgattagctacatggcggagcgcgttgtgggcactggttcgtttggcatcgtctttcaggctaaatgcctggaaaccggggagatggtggccattaagaaggtactgcaggacagacggtacaagaaccgtgagctgcagcttatgcgttcgatgatccattccaatgttgtctccctcaagcactgcttcttctcaaccacaagtagagatgagctgtttctgaaccttgtcatggagtatgtcccggagacgctgtaccgcgtgcttaagcactacagtaatgccaaacaggggatgccacttatctacgtcaagctttacacctatcagctattcagggggctggcgtacattcatactgttccaggagtctgtcacagggatgtgaagccacaaaatgttttggttgatcctttaacacatcaagttaagatctgcgactttggaagcgcgaaagttctggtggcgggtgagcccaatatatcatacatatgctcacgctactaccgtgctccggagcttatatttggtgcgactgaatatacaacatcgatagatatatggtcagctggttgtgttcttgcagaactgctccttggtcagccattatttccaggagagagtgcagtcgatcaactcgtagagataatcaaggttcttggaacgccaactcgggaggaaatacgttgtatgaacccgaattatacggagtttaggtttccgcagataaaagctcatccttggcacaaggttttccacaagaaaatgcctcctgaagccatagatcttgcttcacgtcttcttcaatattcaccaagcctccgttgcactgctcttgacgcatgtgcgcatcctttctttgatgagctacgggagcctaatgcgcgcctgccaaacggacgcccgttcccacctctgttcaacttcaagcatgaactggccaatgcttcacaagacctcatcaacaggcttgtgcctgaacatgttcgccgacaagctggtcttgctttcgtgcatgcggggagctaaatatgcgcaccggtgccctcaacattgcaccttattgttttgtcatgggcagaagggtggtggtttaagatggaggcaggtcagatgatccctggagcgatatatgccagattccatcatcaggagtaccggtagagcaccgaggaataacaactgtctagatcatctgccagggaaggagccttgccagggaaacagcatagccttacgccgtggacccgagttttctttcagtttttgccctattgtaagagttattaatagcttcttaatgtactgtggctcgtaagttgtcaactattttgttctccattcactgacgtaaattgttgcagtaaactttgctgttcaatatgttgtgtcatggcagagtgcacgcccactgcct

SEQ ID NO: 4576 - DNA, 1813 bp, Triticum aestivum
ccacgcgtccgccactttcccttcatggtcaaaggcaccaccacccacatcacagtacaagccaagccaagccaagccaagccagagaagaggaccaggcgtaggtggatgcaagtgtgagcccaccgtgtccgccccattcacaccctagccacatggagcatccggcgccggcgccggagccgatgctgctcgacgagcagccccccaccgcagtcgcctgcgagaagaagcagcaggatggcgaggcgccgtatgcggaggggaacgacgccatgaccggtcacatcatctccaccaccatcggcggcaagaacggcgagcccaagcagacgattagctacatggcggagcgcgttgtgggcactggttcgtttggcatcgtctttcaggctaaatgcctggagaccggggagacagtggccattaagaaggtactgcaggaccgacggtacaagaatcgtgagctgcagcttatgcgttcgatgatccattccaatgttgtctccctcaagcactgcttcttctcaaccacaagtagagatgagctgtttctgaaccttgtcatggagtatgtcccggagacactctaccgcgtgcttaagcactacagtaatgccaaacaggggatgccacttatctacgtcaagctttacacctatcagctattcagggggctggcgtacattcatactgttccaggagtctgtcacagggatgtgaagccacaaaatgttttggttgatcctttaacacatcaagttaagatctgcgactttggaagcgcgaaagttctggtggcgggtgagcccaatatatcatacatatgctcacgctactaccgtgctccggagcttatatttggtgcgactgaatatacaacatcgatagatatatggtcagctggttgtgttcttgcagaactgctccttggtcagccattatttccaggcgagagtgcagtcgatcaacttgtagagataatcaaggttcttggaacgccaactcgggaggaaatacgttgtatgaacccgaattatacggagtttaggtttccacagataaaagctcatccttggcacaaggttttccacaagaaaatgcctcctgaagccatagatcttgcttcacgtcttcttcaatattcaccaagcctccgttgcactgctcttgacgcatgtgcgcatcctttctttgatgagctatgggagcctaacgcgcgcctgccaaatggacgcccgttcccacctctgttcaacttcaagcatgaactggccaatgcttcacaagacctcatcaacaggcttgtgcctgaacatgttcgccgacaagctggtcttgctttcgtgcatgcggggagctaaatatgcgcaccggtgccctcaaccttgcaccttattgttttgccatgggcagaagggtggtggtttaagatggaggcaggtcagatgatccctggagcgatatatgccagattccatcatcaggagtaccggtagagcaccgaggaataacaactgtctagatcatctgccagggaaggagacttgccagggaaacagcatagccttacgccgtggacccgagttttctttcagtttttgccctattgtaagagttattaatagcttcttaatgtactgtagctcgtaagttgtcaactattttgttctccattcactgacgtattgttgcagtaaacttcgctgttcaataagttgtgtcatggcagagcttgcacgcccactgcctgtcatgtagtcaagctgtctattttctgttgggtagttgcgacccgtcgtgaaaaaaaaaa

SEQ ID NO: 4577 - DNA, 1736 bp, Triticum aestivum
gcgtaggtggatgcaagtgtgagcccaccgtgtccgccccattcacgccctagccacatggagcattcggcgccggcgccggagccgatgctgctcgacgagcagccccccaccgcagtcgcctgcgagaagaagcagcaggatggcgaggcgccgtatgcggaggggaacgacgccatgaccggtcacatcatctccaccaccatcggcggcaagaacggcgagcccaagcagacgattagctacatggcggagcgcgttgtgggcactggttcgtttggcatcgtctttcaggctaaatgcctggaaaccggggagacggtggccattaagaaggtactgcaggacagacggtacaagaaccgtgagctgcagcttatgcgttcgatgatccattccaatgttgtctccctcaagcactgcttcttctcaaccacaagtagagatgagctgtttctgaaccttgtcatggagtatgtcccggagacgctctaccgcgtgcttaagcactacagtaatgccaaacaggggatgccacttatctacgtcaagctttacacctatcagctattcagggggctggcgtacattcatactgttccaggagtctgtcacagggatgtgaagccacaaaatgttttggttgatcctttaacacatcaagttaagatctgcgactttggaagcgcgaaagttctggtggcgggtgagcccaatatatcatacatatgctcacgctactaccgtgctccggagcttatatttggtgcgactgaatatacaatatcgatagatatatggtcagctggttgtgttcttgcagaactgctccttggtcagccattatttccaggagagagtgcagtcgatcaactcgtagagataatcaaggttcttggaacgccaactcgggaggaaatacgttgtatgaacccgaattatacggagtttaggtttccgcagataaaagctcatccttggcacaaggttttccacaagaaaatgcctcctgaagccatagatcttgcttcacgtcttcttcaatattcaccaagcctccgttgcactgctcttgacgcatgtgcgcatcctttctttgatgagctacgggagcctaatgcgcgcctgccaaacggacgcccgttcccacctctgttcaacttcaagcatgaactggccaatgcttcacaagacctcatcaacaggcttgtgcctgaacatgttcgccgacaagctggtcttgctttcgtgcatgcggggagctaaatatgcgcaccggtgccctcaaccttgcaccttattgttttgccatgggcagaagggtggtggtttaagatggaggcaggtcagatgatccctggagcgatatatgccagattccatcatcaggagtaccggtagagcagcgaggaataacaactgtctagatcatctgccagggaaggagccttgccagggaaacagcatagccttacgccgtggacccgagttttctttcagtttttgccctattgtaagagttcatagcttcttaatgtactgtggctcgtaagttgtcaactatttcgttcaccattcactgacggaaattgttgctgtaaacttcgctgttcaataagttgtgtcatggcagagcttgcacgcccactgcctgtcatgtagtcaagctgtctattttctgttgggtagttgcgacccgtcgtgagatggcatggctgaactggaattagggttcg

SEQ ID NO: 4578 - DNA, 1945 bp, Hordeum vulgare
ccccactaatccaccagctgtttacaccgggtcagctaaccgccctctcaatagatcaacgtcactccccatcttgttcctcttggtcgccaccacccccactggtcaaaggcagcgccacccacatcacagtacaagccaaggcacgccaaggcagagaggaggaccaggcgtaggtggatgctgtgagcccgccttgtcggcccccattcacacaccaggcacatggagcatccggcgccggcgccggagccgatgctgctcgacgagcagccccccaccgcagtcgcctgcgagaagaagcagcaggatggcgaggcgccgtatgcggaggggaacgacgccatgaccggccacatcatctctaccaccatcggcggcaagaacggcgagcccaagcagacgattagctacatggcagagcgcgttgtgggcactggttcgtttggcatcgtctttcaggctaaatgcttggaaactggggagacggtggccattaagaaggtactgcaggaccggcggtacaagaaccgtgagctgcagcttatgcgttcgatgaaccattccaatgttgtctccctcaagcactgcttcttctcaaccacaagtagagatgagctgtttctgaaccttgtcatggagtatgtcccggagacgctctaccgtgtgcttaagcattacagtaatgccaaacaggggatgccacttatctatgtcaagctttacacctatcagctattcagggggctggcgtacattcatactgttccaggagtctgtcacagggatgtgaagccacaaaatgttttggttgatcctttaacacatcaagttaaggtctgtgactttggaagcgcaaaagttctggtggcgggtgagcccaatatatcatacatatgctcacgctactaccgtgctccggagcttatatttggtgcgactgaatatacatcatcgatagatatatggtcagctggttgtgttcttgcagaactgctccttggtcagccattatttccaggagagagtgcagtcgatcaactcgtagagataatcaaggttcttggaacaccaactcgggaggaaatacgttgcatgaacccgaattatacggagtttaggtttccgcagataaaagctcatccttggcacaaggtttttcacaagaaaatgcctcctgaagccatagatcttgcttcacgtcttcttcaatattcaccaagcctccgctgcactgctcttgacgcatgcgcgcatcctttctttgatgagctacgggagcctaacgcgcacctgccaaacggacgcccgttcccacctctgttcaacttcaagcatgaactggccaatgtttcacaagacctcatcaacaggcttgtacctgaacatgttcgccgacaagctggtctcgctttcttgcatgcagggagctaaatatgcacacgggtgccctcaaccctgcaccttgttgttttgccatgggcgaagggtggtggtttaagatggaggcaggtcagatgatccctggagtgatatatgccagattccaattatcagaagtaccggtagagcaccgaggaataacaactgtgtagatcatctgccagggaaggagccttgcttgagtattcagtagtgaagtggtaatatcattcggattggtgtaccggttgaggagatggaaacagcatagccttaggccatggaccgagttttctttcagtttttgccctattgtaagagttaatagcttcttaatgtattgtactagctcgtatgttgtcaactgtctcgttctccattcctgatgtaaattgttgcagtaaacttcgctgttcaataagttccctgacatgcagagcttgcacgccaactttttttagcctcaattacatggaggtaccgtagactggaacacaccacacacacttgctatgtgtctatg

SEQ ID NO: 4579 - DNA, 1289 bp, Avena sativa
cacgcggggaacgagaagaagagggaggagagcggcgaccccgtgaccggccacatcatctccaccaccatcggcgggaagaacggcgagccaaagcggacaatcagctacatggctgagcgagtagtaggaactggttcatttgggattgtcttccaggctaagtgcatagagactggagagactgtggccatcaagaaggtactgcaggaccggcgttacaagaaccgtgagctgcagcttatgcgctctatggaccaccccaatgtcgtctccctgaagcactgcttcttctcgaccacgagcagggatgagctgttcctcaaccttgtcatggagtatgtccctgagactctataccgagtgctcaaacactacagcaatgccaaccagcggatgccacttatctatgtcaagctttacatgtatcagcttttcagagggctagcttacatccatactgtccctggagtttgtcacagggatgtgaagccacaaaatgttttggttgatcctctaacccaccaagtcaaactctgtgactttggaagtgcaaaagttctggtacctggtgaaccgaacatatcatacatatgctctcggtactatcgtgctcctgagctcatattcggcgcaactgaatatacaacttcaatagacatatggtcagctggatgtgttcttgcagagttacttcttggtcagcctctgtttccaggagagactgcggttgatcaactagtggagatcatcaaggttcttggcactccaacccgtgaggaaattcgatgcatgaaccccaactacactgagttcagatttcctcagataaaggctcatccttggcacaagattttccacaagagaatgcctgctgaagctatagatctcgcctcccgccttctccaatattcaccaagtctacgctgcactgctcttgatgcatgtgcacattccttcttcgacgagctacgtgagccgaacgcacgcttgccaaatggccgcccgttcccccctctgttcaacttcaagcctgaactagcgaacgcctctcctgacctcatcagcaggctgattccagagcatgttcgacggcaaaatagcctcaacttcgcgcatgctgggagttagaaggtgcgagcaccacaatgcccttatttttgcgttcttccgcgagctgctagacaaaatctgcgagctcagaccccataacgttgttgaagccactctacctaaagcgccgcctggcgagacgacggtctaggttcagtgacaagaagaaagagacc

SEQ ID NO: 4580 - DNA, 1332 bp, Avena sativa
cacctgtccaaagcggcatctcgggcatctccgcactcattttagccacacccgcgaccggtcaaaagcacagcgcagcaccaccatcccaatccccaacatcacaaagcagcgcagggcagcacaagcaccgcagcgcagcacagcagctctcgctaggccttcctccgcggcgcgcttctcacccaccctcgtccccggtccccgcgcacacgtacacgccaccccatggaggcggcgccggagcccatggagctggacgccccgcccccgctcgccgccgccgtcccggctcacgcgggaaacgagaagaagagggaggagggcggcgaccccgtgaccggccacatcatctccaccactatcggcgggaagaacggcgagccgaagcggacaatcagctacatggctgagcgagtagtaggaactggttcatttgggattgtcttccaggctaagtgcatagagactggagagactgtggccatcaagaaggtactgcaggaccggcgttacaagaaccgtgagctgcagcttatgcgctccatggaccaccccaatgtcgtctccctgaagcactgcttcttctcgaccacgagcagggatgagctgttcctcaaccttgtcatggagtatgtccctgagactctataccgagtgctcaaacactacagcaatgccaaccagcggatgccgcttatctatgtcaagctttacatgtatcagcttttcagagggctagcttacattcatactgtccctggagtttgtcacagggatgtgaagccacaaaatgttttggttgatcctctaacccaccaagtcaaactctgtgactttggaagtgcaaaagttctggtacctggtgaaccgaacatatcatacatatgctctcggtactatcgtgctcctgagctcatatttggcgcaactgaatatacaacttcaatagacatatggtcagctggatgtgttcttgcagagttacttcttggtcagcctctgtttccaggagagactgcagttgatcaactagtggagatcatcaaggttcttggtactccaacccgtgaggaaattcgatgcatgaaccccaactacactgagttcagatttcctcagataaaggctcatccttggcacaagattttccacaagagaatgcctgctgaagctatagatcttgcctcccgccttctccaatattcacctagtctacgctgtactgctcttgatgcatgtgcacattccttctttgacgagctacgcgagccgaatgcacgcttaccgaatggccgcccattcccccctctgttcaacttcaagcctgaa

SEQ ID NO: 4581 - DNA, 1877 bp, Cocos nucifera
tgctggccgtgtcgtctcgcatggcctcgctgcctccgctgggacctcatcaccatcccgacttccaggccttgaacctcgccgccgttcctcgccgcccggagatggccgaagacaagcaagcatctgttatcgaggggagtgatccggtcactggtcatatcatctccaccaccattggaggcaagaatggtgaaccaaagcagaccattagttacatggcagaacgggttgtggggactggttcttttggtatagtctttcaggccaaatgcttggaaacaggggaaactgtcgcaataaagaaggtcttgcaggacagaagatacaaaaatcgcgagctacagttgatgcgttcaatggatcatcccaatgtgatatctctgaagcattgtttcttctccaccacgaccagagatgagctctttctcaacctagtcatggaatatgtcccagaaaccctgtaccgtgtccttaggcactacagcaatgtgaaccagaggatgccactcatctatgtgaagctttatacgtatcagctatttaggggcttagcttatattcatactgttccaggagtttgccacagagatgtcaagccccaaaacgtgttggtggatcctcttactcaccaagtcaagctttgtgattttggaagtgcaaaagtcctggttaaaggtgaagcaaacatatcgtacatctgctctcgttattaccgtgcaccagagctcatttttggtgcaacagaatatacaacatcaattgatatatggtcagctggctgcgttcttgctgagttacttcttggccagccattgtttcctggagaaagtgctgttgatcagcttgttgagataatcaaggttcttggtactcctacacgagaggagattcggtgcatgaatcctaactacacggagtttaggtttccacagataaaagcgcacccttggcacaagattttccacaagcgaatgcctccagaagcaatagatcttacatcacgtcttctccaatactcgccaagtcttcgttgcactgcactagatgcatgtgcccattcttttttgatgagctacgggagcctaatgcgcgattgccaaatggtcgccctcttccacctttgtttaacttcaaacacgtgttggcaggtgcctcacctgagctcattaacaagctaattccagaacatgtgaggaggcaatcaggtctcagtttcttgcattcagcagggacgtaacaaaacccttaagtcttttcaactatattgtgatcaaaagcaagagggagattaaatggttttggtgcactgaaaaatgcttagcaagcgaggtggttcgcatgatggaaagctaaaccaccagtgctgctggtttgtttggatggctcttaagataccgtcctacctatatttttaggctttgtatattgtatggtatcaaagatcattatgaactggatgctgtaattgttgatgctgagtgtccaaaagtccaacaagcatggtggagaagaagagagaggttcttcacaggatcgagtggctgtttgtgttggacaatgttgaaattgtcgtgtctcattttatgttctatagtagttgtcagtgcatgtggcttgtaggctgttttatgtatatgcatgttcctaggtccaaagttttgaagccatggagctggaagttcaaaatttctgtaatgctctattgaagatgtcaaacttgcccctaagaattgatttaacattggtgtctcctgtgggaagtttatcagtccccacttataatgcatggttttgaccagcccggtgctgttttatggctaatatattccagtatgtctggtgtgattgtaatgaattgtctcgttatattaaaa

SEQ ID NO: 4582 - DNA, 1603 bp, Festuca arundinacea
actagccacatggagcgtccggcgccggcgccggagccgatgctgctcgacgaaaagccccccaccgcagtggcctgcgagaagaagcagcaggatggggaagcgcggtacgcggaagggaacggcgcgatgaccggtcacatcatctccaccaccatcggcggcaagaacggcgagccgaaaaagacgattagctacaaggcggagcgcattgttggctctggttcgtttggcatcgtatttcaggctaaatgcttggaaactggagaggctgtggccattaagaaggtaatacaggacccacggtacaagagccgtgagctgcagcttatgcgctcgattaaccatcccaatatcgtctgcctcaagcattgcttcttctcgaccacaagtagagatgagctgtacctcaacattgtcatggagtttgtccccgagacgctataccgtgtgctcaagcactacagtaatgccaaacatgggatgccacttatctatgtgaagctttacatgtatcagatattcaggggtctagcttacattcatgctgttggagtctgtcatagggatttgaagccacaaaatgttttggtggatcctttaacccaccaagtcaagatctgtgactttggaagcgcaaaagttctggtgaagggtgagcctaatatcgcatacatatgctcacgctactaccgtgctccggagctaatatttggtgcaactgaatatacaacgtccatagatatatggtcgagtggttgtattcttgcagaactgctccttggtcagccattatttccaggaggcactgcagtcgaccagcttgtagagataatcaaggttcttggtacgccaactcgagaggaaatacgttgcatgaacccaaactatactgagtttaggtttccacagataaaagctcatccttggcacaaggttttccacaagagaatgcctcctgaagcgatagatcttgcttcgcgtcttcttcagtattcaccaagcctccgttgcactgcgcttgacgcatgtgcacatcctttctttgatgagcttcgggagcctaatgcacgcttgccaaacggacgcccattcccgcctctgttcaacttcaagcatgaactggccaatgcttcaccagacctcatcaacaggcttgtacctgaacatgttcggtggcaagctggcctcaacttctcgcatgccgggagctaaatatgcatctgccccctgctcaaccttgcaccttgttgtttttgctgatgggcgaagggcggtatagatggagaagcagaccagatgatccctccaagtgttacaatgtcagattgcatcttcagaagcaccgcccaagcacccaagaagaaacaaccgtgcaaattatcttataggggaggagtcttcacttgagtattcggtagttaagtcgtaatatcaaattggtgggtacggttgaggagatgagaagagcatatcaataggccgtgacccaaaagttatctttcgttttttgccctattgtaagacttttagttttatataatatatagtgcagccttaagctgccccctgtttcgttttccaaaaaaaaaaaaaaaaaaaa

SEQ ID NO: 4583 - DNA, 2634 bp, Setaria italica
agccagactgacacattgaccatgtcccccaccccccactaccaaaccccattcttccacctcgtagtcctcggaatcacaaatacgtccatccagggacacaattgtaaaagttgcacagagacgtcaacaccggcgcggtattcacgtaaagtgcccgtccttgtccggaaaaatgcctccttcccgtagcagcgtagtgggtggcggaggacgggaataaaaaacatgttgggaaaaaaaggcgaggggcgggtctcatggcgctgcctcgctagccaagccgccctccctcccccaacctcctcaccgaggagagagagagggtagagagagagagagagagaggacagaggagagagagaggggaggtccatttccgcgtcgtctccgcccgcagccccaccctccacatggccgctctgccgggtggggcccacgccgccggcgccgcggacccgatgcaggtggaccagccgcgccccgccgccgccggcgcagcagcggcagcgcccgccaccgctgacgccaagcatgctggttctatgattgaagggggcgatccagtcactggtcacataatctcaacaaccattggaggcaagaatggagagcctaaaaggactatcagctacatggcagagagagttgtgggaactggatcattcggaatcgtcttccaggctaaatgtctggagactggtgagactgttgcaattaagaaggttttacaggacaagcgttacaagaatagggagctgcaaatcatgcgatccatggatcactgcaatgttgtctccttgaagcattgcttcttctctaccacaagcagagatgaacttttccttaacttggtgatggagttcgttcccgagtcactatatcgtgtgttgaagcattacagcaatatgaaccagaggatgccgcttatatatgtcaagttatacacgtaccagatatttcggggtttagcctatattcacactgtaccaggtgtttgccacagggatgtgaaacctcagaatcttttggttgatcctctgactcaccaagtgaagatatgtgattttgggagcgccaaaatgttggtcaaaggtgaagcaaacatatcatatatatgctcacgttattaccgtgctccagagctcatatttggggcgactgagtacacaacatcaattgatatctggtcagctggatgtgttctcgctgagctgctgcttggccagcctctcttccctggtgaaagtgctgtggatcagcttgttgagataataaaggttcttggtactccaacacgtgaggaaatccgatgcatgaatccgaactacactgaatttagatttcctcagatcaaagctcatccatggcacaagattttccacaagcggatgcctccagaagctatagatcttgcttcacgtctgctccagtattcaccaaatctacgatgcactgctcttgaagcgtgtgcacatccattctttgatgagttgagagaaccacatgcaaggttgccaaacggacggccatttcctccactgttcaacttcaaacaggagctagcaaatgcttccccggagctcatcaacaggttgatcccagaccatgctaggcggcatcttgggctcactttcttgcccgcaactggaccatagggaaggttgtacggtgttctaccttgcacttcctatgcttctatgtgccgaagggcaacctgcatgttctcacatttaaggtgtagaatctgaccattattggaaagccaaacgtgagctggcgccaatgtgttgcataatgggaggtggtgtctttcgcgcagccagccattgttgcttgttttaatgcttcatccaatttagcctaagtagtgggagagggggagggggaggtgtattgttaagccatttgaaggaattcaatctctactatcgtattactttctccaatgttaatgttgtagtgcgcctgtaagtgttccatatccctgggtgtcagtcaatgtaattctgtaaatgttattgatgggaaaattatcttgtgttatggtaattatcatgtcatttatccttcgcctcgccaactccactcgcatataacctgttttacaggaatcacgtaaattgtttcattttcaatttcaatctggttgagcatggattgtgcaattgtttgctatcatttccgctggcatcctgcaaatggggtttatcagaagatattgccatcctaaatatgaatttccaatcctttctatgttacatggatatggatgatctgaccctggatgaactgtcttggaaagatcatgaaataggcatgtgtctagtgcaaagcagaagagccaacaaagctataatgggggaataaaaggcacaggtgagggcgaatgggttctgtcggctacgggcgtggtccaccggcgattgattctgttcgttagcgtggttgagcaagccgccacttgttcgctttatcgctgacgccgacaccgtgatacacctgctcagttttctgtctcaacggcttttggagttgacctgtcatcagcctacaagttgctaaaggcaggcagttgttttcctctttgaaggtttattgatttcacactggtcgatacttgaatctgatacg

SEQ ID NO: 4584 - DNA, 1918 bp, Pennisetum glaucum
ggggaaaagggcgaggggcggggtttcatggcgctagcctagccggcctcccccccaacctcctcaccgaggagagagagagagaggacagaggagaggtccatttccgcgtcgtctccgccccgcagccccacccccaccctccacatggccgcgctgccgggtgggggccacgccgccggcgccgcggacccgatgcaggtggaccagccgcggcccgtcgccgccgccgcagcgcccgccaccgcggacgccaagcatgccggtcctatgattgaagggggtgatccagtcactggtcacataatctcaacaaccattggaggcaagaatggagagcctaaaaggactatcagctacatggcggagagagttgtgggaactggatcattcggaatcgtcttccaggctaaatgtctggaaactggtgaaactgttgcaattaaaaaggttttacaggacaagcgttacaagaatagggaactgcaaatcatgcgatccatggatcactgcaatgttgtctccttgaagcattgcttcttctctaccacaagcagagatgaacttttccttaacttggtgatggagtttgttcccgagtcactgtatcgtgtgttgaagcattacagcaatatgaaccagaggatgccgcttatatatgtcaagttatacacctaccagatatttcggggtttagcctatattcacactgtaccaggtgtttgccatagggatgtgaaacctcagaatcttttggttgatcctctgactcaccaagtgaagatatgtgattttgggagtgccaaaatgttggtcaaaggtgaagcaaacatatcatatatatgctcacgttattaccgtgctccagagctcatatttggggcaactgagtacacaacatcaattgatatctggtcagctggatgtgttcttgctgagctgcttcttggtcagcctctcttccctggtgaaagtgctgtggatcagcttgttgagataataaaggttcttggtactccaacacgtgaggaaatccgatgcatgaatccgaactacaccgaatttagatttcctcagatcaaagctcatccatggcacaagattttccacaagcggatgcctccagaagctatagatcttgcttcacgtctgctccagtattcaccaaatctacgatgcactgctcttgaagcatgtgcacatccattctttgatgagttgcgagaaccacatgcaaggttgccaaatggaaggcaattccctccactgttcaactttaaacaggaactagcaaatgcttccccagagctcatcaacaggttgatcccagaccatgctaggcgacatcttgggctcactttcttgcctgcaactgggccatagggagggctgtatggtgctctaccttgcacttcctatgcttgtgtgcagaagggcaacctgcatgttctcacatttaaggtgtagaatctgaccattattggaaagccaaacgtgagctggcgccaatgtgttgcataatgagaggtggtgtgttttgcgcagccagcccttgtcgcctgttttaatgcttcatccaatttagcttaagtagcgggagggggaggggaggtgtattgttaagccatctgaaggaatataatctccactgccatattactttctccaatgttaatgttgtagtgcgcctgcaagtgttccatatccctgggtctcagtcaatgtaattctgtaaatgttattgatgtgaacattatcttgtgttatggtagtaattatcatgtcatccttcgccttgccaactccactcgcatgtaacctgtttaccttacatcatgtaaattgtttcattttcgatctggttgagcccagttgtttgctagcatttccgctggcaatggcatcctgcaaacggggg

SEQ ID NO: 4585 - DNA, 1777 bp, Saccharum officinarum
cctcaccgaggagagaccgagacacagagagagagcaacaggacacgggagagaagaggtccatttccgcgtcgtctccgccccgcagccccacccacctggccaccacatggccgcgctgccgccgggtggggcccacgccgccggcgccgcggacccgatgcaggtggaccagccgctccccgccgccgcggcagccgcagcacacgcccccgccgacgccaagcatgctggttctatgattgaaggaagtgatccagtcacgggtcatataatctcgacaaccattggagggaagaatggagagcctaaaaggactatcagctacatggcagagagagttgtgggaactggatcatttggaatcgtcttccaggcaaaatgtctggagactggtgagactgttgcgattaagaaggttttgcaggacaagcgctacaagaacagggagctgcagatcatgcgatccatggatcactgcaatgttgtttccttgaagcattgcttcttctctaccacaagcagagatgaactttttcttaacttagtgatggagtttgttcctgagtcactatatcgtgtgttgaagcattacagcaatatgaaccagaggatgccacttatttatgttaaattatatacctaccagatatttcgaggtttagcctatattcacacagtacctggagtttgccacagggatgtgaaaccacagaatcttttggttgatccgctgactcaccaagtgaagatatgtgattttgggagtgccaaaatgttggtcaaaggtgaagcaaacatatcatatatatgctcacgttattaccgtgctccagagctcatatttggggcaaccgagtacacaacatcaattgatatttggtcagctggatgtgttcttgctgagctgcttcttggccagcctctcttccctggtgaaagtgctgtggatcagcttgttgagataataaaggttcttggtactccaacacgtgaggaaatccgatgtatgaatccgaactacaccgagtttagatttcctcagatcaaagctcacccatggcacaagattttccacaagcggatgcctccagaagctatagatctcgcttcacgtttgctccagtattcaccaaatctacgatgcactgctcttgaagcatgtgcacatccattctttgatgagttgcgagaaccacatgcgaggttgccaaatggacggccatttcctccactgttcaactttaaacaggaactagcaaatgcctccccagagctcatcaacaggttgatcccagaccatgctaggcggcatcttgggctcactttattgcccactaccggaccataggcgaaggctctatggtgtctaaaccttgctcttctgatgcttcgttgtgccgaaggcaacctgcatgttcctcacattcaaggtgtagaatctgaccattattggaaagccaaacatgagctggcgccaatgtgttgcatgaggagaggtgatatgttcgtgcagccagcctttgtcgcctgttttaatgcaaaatctgtttttgcctaagtagtgagagggaaagggttggtgtattgttaagctattgaaggaattcaatccctgctattgtattactttctccaacgttaaatgttgtagtgcgcctgtaagtgttccatatcccctgttgtcagtcagtgtaattctgtaaatgttattaatggaaaattatattgtgctatggtaatgatcgactcaattatcattccccttgccaattcc

SEQ ID NO: 4586 - DNA, 1444 bp, Ananas comosus
ggagggagggaggaggttgttgtaggtggtgtcgttccccatggcgtcgcttccgatgggacccaaccgtgcgccggagccggagccggagccgatgatcgtcgatccgcggccgccggaggcggcggagaagaagcatgaagcatctacaatagagggcaatgatccggtcactggtcacattatctccactactatcggaggaaagaatggcgaacctaaacggaccattagttacatggcggagcgtgttgtgggaactgggtcttttggaatcgttttccaggcaaagtgcttggaaaccggggagactgttgccatcaagaaggtcttgcaggacagacggtacaagaatcgcgagttacaactgatgcgctcaatggatcattccaacgttatatctttgaagcactgcttcttctctaccactagcagggatgagcttttccttaacttagtcatggaatatgtgcctgaaaatttgtatcgtgtcctaaagcattacagcaatgcgaatcaaaggatgcctcttatttatgtgaagctttatatgtatcagatatttagggggctagcttatatccacacggctctgggagtttgtcatcgagatgtgaagccacaaaatctgttggttgatcctctcactcaccaagtcaagctctgtgattttgggagcgcaaaaattctggttaagggtgaggcaaacatatcatacatatgctctcgctactaccgagctccagagctcatatttggtgcaactgaatatactacatctattgatatatggtcagctggatgtgttcttgctgagttacttcttggacagccactctttcctggagaaagtgctgttgatcagcttgttgagataatcaaggttcttggtactccaactcgtgaggaaattcgttgtatgaatcctaactacacagactttaggttccctcagataaaagctcatccatggcacaagattttccacaagagaatgcctccagaagcgatagatcttgcttcaagacttcttcaatattcgccaagtcttcgctgtactgctcttgaagcttgtgcacatcccttctttgatgagctcagagaacctaatgctcggttgccaaacggccgtccttttcctccccttttcaacttcaagcaagaattagcgggtgtttcacctgagcttatctccaggttgataccagaacatgtgaggcgacaaaccggcctcaactttcttcaccctagtggaacataaatggtttaaatagttttgctcctttttgtcaaagtgcaccacctgaagcatagcagggtacaagttctggtgctcctaaattgtaccatcaccaagtttttctctttagttgggggtagaactagtgcttctggtgaatcagagaggtgccaaattcctcgcagcttttgtcgcaacctgtat

SEQ ID NO: 4587 - DNA, 2060 bp, Panicum virgatum
agagagacgagaggaggttccatttccgcgtcgtctccgcccgcagccccaccctccacatggccgcgccgccgggtggggcccacgccgccggcgccgcggacccgatgcaggtggaccagccgcgccccgccgccgccgccgcagcagcgaccgcccccgcggacgccaagcatgccagttctatgattgaagggggtgatccagtcactggtcacataatctcaacaacgattggaggcaagaatggagagcctaaaaggactatcagctacatggccgagagagttgtgggaactggatcattcggaatcgtcttccaggctaaatgtctggagactggtgagactgttgccattaagaaggttttacaggacaagcggtacaagaatagggagctgcaaatcatgcgatccatggatcactgcaatgtcgtctccttgaagcattgcttcttctctaccacaagcagggatgaacttttccttaacttggtgatggagtttgttcctgagtcactgtatcgtgtattgaagcattacagcaatatgaaccagaggatgccgcttatatatgtcaagttatacacctaccagatatttcggggtttagcctatattcacactgtacctggcgtttgccatagggatgtgaaacctcagaatcttttggttgatcctttgactcaccaagtgaagatatgtgattttgggagtgccaaaatgttggtcaaaggtgaagcgaacatatcatatatatgctcacgttattaccgtgctccagagctcatatttggggcgactgagtacacaacatcaattgatatctggtcagctggatgtgttcttgctgagctgcttcttggccaacctctcgtccctggtgaaagtgctgtggatcagcttgttgagataataaaggttcttggtactccaacacgcgaggaaatccgatgtatgaacccgaactacactgaatttagattccctcagatcaaagctcatccatggcacaagattttccacaagcggatgcctccagaagctatagatctcgcttcacgtctgctccagtattcacctaatctacgatgcactgctcttgaagcatgcgcacatccattcttcgatgagttgcgagaaccacatgcaaggttgccaaatggtcggccattccctccactctttaactttaaacaggaactagcaaatgcttctcctgagcttatcaacaggttgatcccagaccatgctaggcggcatcttgggctcacttaaatccctgcaactggaccatagggaagctgtatggtgttttaccttgcgcttccgatgcttctttgtgccgaagggcaacctgcatgtcctcacatttaagatgtagaatctgaccattattggaaagccaaacgtgagctggtgccaatgtgttgcatgaggagaggtgtgtttcgcccagccagccctcgtcacttgttttaatgctccatccaatttagccgaagtagcgggagggaagggggtggtattgttaagctattgaaggaatctctactatcgtattacattctgcaatgctaaatgttgtagtgcgcctgtaagtgtcccgtatccctgggtcagtcaatgtaattctgtaaatgttattgatgggaaattatcttgtgttatggtaattatcaagtcgtttatccttggactcagctaatctactcacatataacctgttttgttagaatcaagtaaccttttttcattgtcaacccttgttgaacgtggatcggaattgtttgtaattatttccgctgccatcatgcaagtggcatttatcggaatctactgtcaacaggagtatttctaaactgtttatgttatgaccctcgacgacttgccctgaaagtagcatgaaataggcatgtgtctaatgcaaggcaggagagccaaacaaagctataatggggaataaaaggcacaggtgagggcgaatgggttctgtcggctacgcgccgtggtccactggcgattgattctgttcgttagcatggttgagagaaagtacag

SEQ ID NO: 4588 - DNA, 2518 bp, Sorghum bicolor
ccagccggactgacacattgaccatgtccccctccggcctcctccactgccaaatcccattcttccaccccacactccttcaaattacaaccacaaccatccagggacccatatgtaaagctcttacagctccatcgacactggtacggcattcccgaaactctccggtccttgcccgaaaacctcctcattctcgtcgcagcgtagtgggtggcggaggacgggaataaaactagtaaaaaaaaaacaaggcgaaaaaaagaggctcggggcgggtgtcatggcgctgcgtgccccctagcccagccgcctcccccaacctcccccctcaccgagaggagagaccgagacagagagagagagagagaaagaagggaacaacaggacacgagagagagagaggagaggtccatttccgcgtcgtctccgccccgcagcagccccacccaccacatggccgcgccgccgggtggggccgccggcgccggcgccgcggacccgatgcaggtggaccagccgctccctggcgccgccgccgccgccgccgcagccgcagcacacggccccgccgacgccaagcatgctggttctatgattgaagggagtgatccagtcacgggtcatataatctcgacaaccattggagggaagaatggagagcctaaaaggactatcagctacatggcagagagagttgtgggaactggatcatttggaatcgtcttccaggcaaaatgtctggagactggtgagactgttgccattaagaaggttttgcaggacaagcgctacaagaatagggagctgcaaatcatgcgatccatggatcactgcaatgttgtttccttgaagcattgcttcttctctaccacaagcagagatgaacttttccttaacttagtgatggagtttgttcctgagtcattatatcgtgtgttgaagcattacagcaatatgaaccagaggatgccgcttatttatgttaaattatatacctaccagatatttcgaggtttagcctatattcacacagtacctggagtttgccacagggatgtgaaaccacagaatcttttggttgatccgctgactcaccaagtgaagatatgtgactttgggagtgccaaaatgttggtcaaaggtgaagcaaacatatcatatatatgctcacgttattaccgtgctccagagctcatatttggggcaaccgagtacacaacgtcaattgatatttggtcagctggatgtgttcttgctgagctgcttcttggccagcctctcttccctggtgaaagtgcggtggatcagcttgttgagataataaaggttcttggtactccaacacgtgaggaaatccgatgtatgaatccgaactacaccgagttcagatttcctcagatcaaagcccacccatggcacaagattttccacaagcggatgcctccagaagctatagatctcgcttcacgtttgctccagtattcaccaaatctacgatgcactgctcttgaagcgtgtgcacacccattcttcgatgagttgcgagaaccacatgcaaggttgccgaatggacggccatttcctccgctgttcaactttaaacaggaactagcaaatgcctccccagagctcatcaacaggttgatcccagaccatgctaggcggcatcttgggctcactttattgcccactaccggaccataggcaaaggcctctatggtgtttaaaccttgctcttctgatgcttcgttgtgccgaaggcaacctacatgttcctcacattcaaggtgtagaatctgaccattattggaaagccaaacatgagctggcgccaatgtgttgcacaaggagatgtgctatgttcgtgcagccagcctttgtcacctgttttaatgcaaaatctgattttgtctaagtagtgagagggaaggggttggtgtattgttaagctactgaaggaattcagtccctgctattgtattactttctcccaacgttaaatgttgtagtgcgcctgtaagtgttccatattccctgttgtcagtcagtgtaattctgtaaatgttattaatggaaaattatatcgtgctatggtaatgatcgactcatttattgttccccttgccagttccaatcacatatccccagtcttgttggaaacaaattcgttttcattgtcagtcgtgctgatctgatcggggaattgtttcttgcagcttcctgtaagaaaaattttacttctgaatggtctatcattttccccgctatgagtttctgaacttcgttttatatacggaagatctaatcctggatgaattgtcatcctagagtagcatcagatcgacatgtgtctagtgcgaaggcagaagagccaacaaagatataatgggggaataaaaggtacaggtgagggcgaatgggttctgtcggctacgggcagtggcgtggtccattggtgattgattctgttcgttagtgtggttgagcaggccgccatttattcgctttatttgtcgcg

SEQ ID NO: 4589 - DNA, 2232 bp, Zea mays
gaaaaagaggctcggggcggtggcgctgcctccctctctctctagcccagccgcctccccaacggcccaacctcaccgaggagagagagaccgatacagagagagagaccaagaggacacgggagagaggacgttcatttccgcgtcgtctccgcccgcagccggcagccccaccacccaccacatggccgccatgccgggtggggcccacggcgccggcgccgcggacccgatgcaggtggaccagccgctcccccctgccgccgcaggcacagcacacgcccccgccgacgccaagcatgctggttctatgattgaagggagtgatccggtcacaggtcatataatctcgacaaccattggagggaagaatggagagcctaaaaggactatcagctacatggcagagagagttgtgggaactggatcatttggaatcgtcttccaggcaaaatgtctggagactggtgagactgttgcgattaagaaggttttgcaggacaagcgctacaagaacagggagctacaaatcatgcgatccatggatcactgcaatgttgtttccttgaagcattgcttcttctctaccacaagcagagatgaacttttccttaacttagtgatggagtttgttcccgagtcattatatcgggtgttgaaacattacagcaatatgaaccagaggatgccactcatttatgtcaaattatatacctaccagatatttcgaggcttagcctatattcacacagtacctggagtttgccacagggatgtgaaaccacaaaatcttttggttgatccactgactcaccaagtgaagatatgtgattttgggagtgccaaaatgttggtcaaaggtgaagcaaacatatcatatatatgttcacgttattaccgtgctccagagctcatatttggggcaactgagtacacaacatcaattgatatttggtcagctggatgtgttcttgctgagctgcttcttggccagcctctcttccctggtgaaagtgctgtggatcagcttgttgagataataaaggttcttggtactccaacgcgcgaggaaatccgatgtatgaatccaaactacaccgagtttagatttcctcagatcaaagctcacccatggcacaagattttccacaagcggatgcctccagaagctatagatctcgcttcacgcttgctccagtattcaccaaatctaagatgcactgctcttgaagcgtgtgcacatccattctttgacgatttgcgagaaccacatgcgaggttgccaaatggacggccatttcctccactgttcaactttaaacaggaactagcaaatgcctccccagagctcatcaacaggttgatcccagaccatgctaggcggcatcttgggctcacattattgcccgctactggaccataggcgaaggctctatggtggtgcttcgttgtgcggaaggcaacctgcattcaaggtgtagaatctgacaattattggaaggtcaaacatgagctggcgcgtaaggagaggtggtatgttctcgtgcagccagccttaatttgtcgcatgtcttaatgcaaaaatctgatttttgcccaagtagtgagaggagggaagggggtggtcggtgtattgttaagctattgaaggaattcgatccctgctattgtgttactttctccaacgtttaaacgttgtagtgcgcctgtaagtgttccatatatcccctgttgtcagtcagtgtaattctgtaaatgttattaatgggaaattatttcgtgcttttccaaccacataactaatccctaccttgttggaagcaatctcttgttttcgttgtcagttgtgctgatctgggaattgtttccttcaactccatgcgagcaagttttagttctgaatgaattgtcatcctagagtagcatcagatgggcacgtgcctagtgcaaaggcagcaaagatataatgggagcacaggtgagggcgaatggggttctgttggctatggtccattggctgtggttgagcaggccgccatttattagtcgctctgtttatcgcgacgccgacaccgtgctcagttgcatgttccaacggcattttgctttcttgacttcacacactggctatcactgcgtaatgttcagtattctatggtcaataatcacggtattgacaggttcaaattgaaaatgaacggtgctgcaggtttcaaagtgagcaggtgaagc

SEQ ID NO: 4590 - DNA, 1695 bp, Avena sativa
ccctctaatccaccagctgtttacactgcagcagctaaccaccctctttcccttcattggtcaaaggcagagccacccatcacagtacaagccaagccaaagccagagaccaccaggaccaggtatgtaggtgtatgcaagtgtgagcccaccgtgtccactcccgttcacacactagccacatggagcgtccggtgccggcgccggagccgatgctgctcgacgaaaagtccgccaccaagaatcagcaggatggggaagcgccgtacgcggaggggaacggcgcgatgaccggtcacatcatctccaccaccatcggcggcaagaatggcgagccgaagcagacgattagctacaaggcagagcgcgttgtgggcactggttcgtttggcatcgtctttcaggctaaatgcttggaaactggagagtttgtggccattaagaaggtattgcaggactcccggtacaagaaccgtgagctgcagcttatgcgctcgattaaccatcccaatatcgtctgcctcaagcactgcttcttctcaaccacaagtaaagatgagcttttcctcaacattgtcatggagtttgtccccgagacactatatcgtgtgctccagcactactgtaatgccaaacaggggatgccacttatctatgtgaagctttacatgtatcaggtattcagggggctagcttaccttcatgctgttggagtctgtcacagggatgtgaagccacaaaacattttggtggatgctttaacccatcaagtcaagatctgcgactttggaagtgcaaaagttctggtgaagggtgagcctaatatatcatacatatgctcacgctactaccgtgctccggagctcatatttggtgcaactgaatatacaacatccatagatatatgggcagctggttgtgttcttgcagaactgctccttggtcagccattatttccaggagacactggagtcgaccagcttgtagagataatcaaggttcttggtacaccaactcgtgaggaaatacgttgcatgaacccaaattatacagagtttaggtttccacagataaaagctcatccttggcacaaggttttccacaagagaatgcctcctgaagcgattgatcttgcttcgcgtcttcttcagtattcaccaagcctccgttgcactgcgcttgacgcatgtgcgcatcctttctttgatgagcttcgggagccgaatgcgcgcctgccaaacggacgcccgttcccgcctctgttcaacttcaagcatgaactggccaacgcttcaccagacctcatcaacaggcttgtacctgaacatgttcggcggcaagctggcctcaactcctcgcatgccgcacgctaaatttgcaccagcccgtgctcaagcttgcaccttgttgtttttgctgatgggcaaagggtggtagagatggagaggcaagccagatgatccttcaagtgttacaatgtcagaaattgcgtcgtcggaagtaccgtccgagcacagaagaagaacaacagtttagatcatcttataatataggggaggagtctttgcttagagtatccggtagttgagtcgtaaaatcatatcagtgggtacggttgaggagatgaaagcagcatatcaataggccgtcgcctgagttatctttcttgtttttccttattgtaagagatactag

SEQ ID NO: 4591 - DNA, 1916 bp, Panicum virgatum
gtgggtggcggaggatgggaataaaaaacaggggaaaaaaggcgaggggcgggtctcatggcgctagcctagccgcctccccaacctcctcaccgaggagagagaggacagaggagagagaggaggttccatttccgcgtcgtctccgcccgcagccccaccctccacatggccgcgctgccgggtggggcccacgccgccggcgccgcggacccgatgcaggtggaccagccgcgccccgccgccgcggcagcagcgaccgctcccgcggacgccaagcaagctggttctatgattgaagggggtgatccagtcactggtcacataatctcaacaaccattggaggcaagaatggagaacctaaaaggactatcagctacatggccgagagagttgtgggaactggatcattcggaatcgttttccaggctaaatgtctggagactggtgagactgttgcaattaagaaggttttacaggacaagcggtacaagaatagggagcttcaaatcatgcgatccatggatcactgcaatgtcgtctccttgaagcattgcttcttctctaccacaagcagggatgaacttttccttaacttggtgatggagtttgttcctgagtcactgtatcgtgtactgaagcattacagcaatatgaaccagaggatgccgcttatatatgtcaagttatacacctaccagatatttcggggtttagcctacattcacactgtacctggcgtttgccacagggatgtgaaacctcagaatcttttggttgatcctctgactcaccaagtgaagatatgtgattttgggagtgccaaaatgttggtcaaaggtgaagcgaacatatcatatatatgctcacgttattaccgtgctccagagctcatatttggggcgactgagtacacaacatcaattgatatctggtcagctggatgtgttcttgctgagctgcttcttggccaacctctcttccctggtgaaagtgctgtggatcagcttgttgagataataaaggttcttggtactccaacacgcgaggaaattcgatgtatgaacccaaactacactgaatttagattccctcagatcaaagctcatccatggcacaagattttccacaagcggatgcctccagaagctatagatctcgcttcacgtctgctccagtattcaccaaatctacgatgcactgctcttgaagcatgcgcacatccattctttgatgagttgcgggaaccacatgcaaggttgccaaatggtcggccattccctccactgtttaactttaaacaggaactagcaaatgcttctcctgagcttatcaacaggttgatcccagaccatgcgaggcggcatgttgggctcagttaattgcctgcaactggaccatagggaagctgtatggtgttttaccctgcgcttccgatgcttcttcgtgacgaagggcaacctgcatgtccgcacatttaagatgtagaatctgaccattattggaaagccaaacgtgagctggtgccattgtgttgcatgaggggaggtgtgtttggtgcagccagccctcgtcacttgttttaatgctccatccaatttagcctaagtagcgggagggaagggggtggtgtattgttaagctattgaaggaatccctactatcgtattactttctccaatgctaaatgttgtagtgcgcctgtaagtgttccatatccccgggtgtcagtcaatgtaattctgtaaatgttattgatgggaaattatcttgtgttatggtaattatcaagtcgtttaccctgtttagttgaaatcaactattttttttcattgtcaaccttgttgaacgtcgatcggatttgtgtgcaattatttccgctgccatcatgcaatgcaagtgggatttataggaa

SEQ ID NO: 4592 - DNA, 1721 bp, Avena sativa
ccctctaatccaccagctgtttacactgcagcagctaaccaccctctttcccttcattggtcaaaggcagagccacccatcacagtacaagccaagccaaagccagagaccaccaggaccaggtatgtaggtgtatgcaagtgtgagcccaccgtgtccactcccgttcacacactagccacatggagcgtccggtgccggcgccggagccgatgctgctcgacgaaaagtccgccaccaagaatcagcaggatggggaagcgccgtacgcggaggggaacggcgcgatgaccggtcacatcatctccaccaccatcggcggcaagaatggcgagccgaagcagacgattagctacaaggcagagcgcattgtgggcactggttcgtttggcatcgtctttcaggctaaatgcttggaaactggagagtttgtggccattaagaaggtattgcaggactcccggtacaagaaccgtgagctgcagcttatgcgctcgattaaccatcccaatatcgtctgcctcaagcactgcttcttctcaaccacaagtaaagatgagcttttcctcaacattgtcatggagtttgtccctgagacgctatatcgtgtgctccagcactaccgtaatgccaaacaggggatgccacttatctatgtgaagctttacatgtatcaggtattcagggggctagcttaccttcatgctgttggagtctgtcacagggatgtgaagccacaaaacattttggtggatgctttaacccatcaagtcaagatctgcgactttggaagcgcaaaagttctggtgaagggtgagcctaatatatcatacatatgctcacgctactaccgtgctccggagctcatatttggtgcaactgaatatacaacatccatagatatatgggcagctggttgtgttcttgcagaactgctccttggtcagccattatttccaggagacactggagtcgaccagcttgtagagataatcaaggttcttggtacaccaactcgtgaggaaatacgttgcatgaacccaaattatacagagtttaggtttccacagataaaagctcatccttggcacaaggttttccacaagagaatgcctcctgaagcgattgatcttgcttcacgtcttcttcagtattcaccaagcctccgttgcactgcgcttgacgcatgtgcgcatcctttctttgatgagcttcgggagcctaatgcacgcctgccaaacggacgcccgttcccgcctctattcaacttcaagcatgaactggccaacgcttcaccagacctcatcaacaggcttgtacctgaacatgttcggcggcaagctggcctcaactcctcgcatgccgcacgctaaatttgcaccagcccgtgctcaagcttgcaccttgttgtttttgccgatgggcaaagggtggtagagatggaggcaatccagataatccttcaagtgttacaatgtcagaaattgcgtccgagcacagaagaagaacaactgcgtagatcatcttataatataggggaggagtctttgcttagagtatccggtagttgagtcgtaaaatcatatcagtgggtacggttgaggagatgaaagcagcatatcaataggccgtcgcctgagttatctttctgtttttgccttattgtaagagatacagtttttttaatatagtgcagccttaagctgccccctatttcgtct

SEQ ID NO: 4593 - DNA, 1731 bp, Musa acuminata
ccgaggctctaaaaagcggcctgtgagaacccttctcttccgccacatggcttccctgccgcttggacctcataatccgccgccgccggagcagggcgccttcgtccccgccgtaccttccagccatccggagatggcccaagacaaggcatctgttgtggaggggaatgatgcagtcactggtcatatcatatccaccaccattggaggcaagaacggtgaacctaagcagaccattagttacatggcagagcgtgttgtgggaaatggctcatttggaattgtcttccaggcaaaatgcttggaaacaggtgagactgttgctataaagaaggttttgcaggaccggagatacaaaaaccgtgagctgcagttgatgcgctcaatagatcatccaaatgttatctctctaaagcattgtttcttctccaccacaagcagagatgaactttttctcaacctagttatggaatatgtgcctgaaaccttatatcgtgttctaaggcattacagcagtgtgagtcaaaggatgccacttatctatgtgaagctttacacgtatcagatatttagagggttggcttatatccatacagttcctggcgtttgccatagagatgtaaagccacaaaatgttttggtagatcctctcactcaccaagtcaagctatgtgattttggaagtgcaaaagttttggtcaagggtgaaccaaacatttcctacatttgctctcgctattaccgtgctccagagcttatttttggtgcaacagaatacacaacatctattgatatatggtcagcaggttgtgttcttgctgagttgctccttggtcagccattgtttcctggagaaagtgctgttgatcagcttgttgagataatcaaggttcttggaactccaacccgtgaggaaattcgttgcatgaatcctaattatactgagttcaggtttccacagataaaagctcatccatggcacaagatattccataaacgaatgcctctggaagcaatagatcttacatcacgccttctccaatactctccaagttttcgctgcactgcactggaagcatgtgctcaccccttttttgatgagctgcgggaaccaaatgcaaggttgccaaatggtcgtcctctgcctcctctttttaacttcaaacaagaattagcaggtgcatcaccagagctcatcgacaagctgattccggaacatgtgaggcgccaatctggtctcagtttcttgcaaatgcccgggacgtaaaactacaaacacttcagatgtgatagtcaaaagcaagtggaacatggttttcactgcccttgaggaagtctgccagtgcgagtgctcgatggcagcgggagcttctgcagttgagcttctgggagggggttgttgcttcttccctatcttcttaccgatctcccaagccttgtatattgtaagatgttaggatcattgtaatgtagtcgctgtcaatccctcgggatcagattgtatcttgtatgataggacaacctttgcaacgcatatgaactctggcttcttccacgttgacccccatggagtctcgtcgctgctttgactctactcgttagacggtacaagcgacgcagctccatagtctcatttagattgtttctcttggtgatacttggatatctttgtcattgtacttgttttcatgttctctttttactttttggtaaaagataagttacgtaggc

SEQ ID NO: 4594 - DNA, 1744 bp, Echinochloa colona
ggagagagagaggaggtccatttccgcgtcgtctccgcccgcagccccctcccacccacatggccgcgctgccgggcggggcccacgccgccggcgccgcggacccgatgcaggtggaccagccacgccccgccgcggcggcggccgcccccgcggacgccaagcatgctggttctatgattgaagggggtgatccagtcactggtcacataatctcaacaaccattggaggcaagaatggagagcctaaaaggactatcagctatatggcagagagagttgtgggaactggatcattcggaatcgtcttccaggctaaatgtctggagaccggtgagactgttgcaataaagaaggttttacaggacaagcgttacaagaatagggagctgcaaatcatgcgatccatggatcactgcaatgttgtctccttgaagcattgcttcttctctaccacaaccagagatgaacttttccttaacttggtgatggagtttgttcctgagtcactatatcgcgtgctgaagcattacagcaatatgaaccagaggatgccgcttatatatgtcaagttatacacttaccagatatttcggggtttagcctatattcacactgtacctggcgtttgccacagggatgtgaaacctcagaatcttttggttgatcccctgactcaccaagtgaagatatgtgattttgggagcgccaaaatgttggtcaaaggtgaagcaaacatatcatatatatgctcacgttattaccgtgctccagagctcatatttggggcgactgagtacacaacatcaattgatatctggtcagctggatgtgttcttgctgagctgcttcttggccagcctcttttccctggtgaaagtgctgtggatcagcttgttgagataataaaggttcttggtactccaacacgtgaggaaatccgatgcatgaatccgaactacaccgaatttagatttcctcagatcaaagctcatccatggcacaagattttccacaagcggatgcctccagaagctatagatcttgcttcacgtctgctccagtattcaccaaatctacgatgcactgctcttgaagcatgtgcacatccattctttgatgagttgcgagaaccacatgcaaggttgccaaacggacggccattccctccactgttcaactttaagcaggaactagcaaatgcttccccggagctcatcaacaggttgatcccagaccatgctaggcggcatcttgggctcactttcttgcccacaactggaccgtagggaacgccatgtggtgttcttgcgcctacgatgcttctttgtgccgaagggcaacctgcatgttcttgcatttaaggtgtagaatctgaccattattggaaagccaaacgtgagctggcgccaatgtgtttcataaggagaggtggtgtcttgcgcagccagcccttgtcacttgttttaatgctccatccaatttagccaaagtagcgggagggaagggggtggtgtattgttaagctattgaaggaatcgaatccctactatcgtattactttcgtcatgttaaatggtgtagtgcgcctgtaattgttccataatcccctggtgtcagtcaatgtaattctgtaaatgttattgatgcgaaattatctcatgttatggtaacgatccatgtgttcatcctcgctgccaaactctactcacaacctgttttgctggaacaactttactcattg

SEQ ID NO: 4595 - DNA, 1489 bp, Echinochloa colona
gagagaggaggtccatttccgcgtcgcctccgcccgcatccccccacatggccgcgttgccgggcggggcccacgccgccggcgccgcggacccgatgcaggtggaccagccacgccccgccgcggcggcggccgcccccgcggacgccaagcatgctggttctatgattgaagggggtgatccagtcactggtcacataatctcaacaaccattggaggcaagaatggagagcctaaaaggactatcagctatatggcagagagagttgtgggaactggatcattcggaatcgtcttccaggctaaatgtctggagaccggtgagactgttgcaataaagaaggttttacaggacaagcgttacaagaatagggagctgcaaatcatgcgatccatggatcactgcaatgttgtctccttgaagcattgcttcttctctaccaccaccagagatgaacttttccttaacttggtgatggagtttgttcctgagtcactatatcgcgtgctgaagcattacagcaatatgaaccagaggatgccgcttatatatgtcaagttatacacttaccagatatttcggggtttagcctatattcacactgtacctggcgtttgccacagggatgtgaaacctcagaatcttttggttgatcccctgactcaccaagtgaagatatgtgattttgggagcgccaaaatgttggtcaaaggtgaagcaaacatatcatatatatgctcacgttattaccgtgctcccgagctcatatttggtgcgactgagtacacaacatcaattgatatctggtcagctggatgtgttcttgctgagctgcttcttggccagcctcttttccctggtgaaagtgctgtggatcagcttgttgagataataaaggttcttggtactccaacacgtgaggaaatccgatgcatgaatccgaactacaccgaatttagatttcctcagatcaaagctcatccatggcacaagattttccacaagcggatgcctccagaagctatagatcttgcttcacgtctgctccagtattcaccaaatctacgatgcactgctcttgaagcatgtgcacatccattctttgatgagttgcgagaaccacatgcaaggttgccaaacggacggccattccctccgctgttcaactttaagcaggaactagcaaatgcttccccggagctcatcaacaggttgatcccagaccatgctaggcggcatcttgggctcactttcttgcccacaactggaccgtagggaacgctgcgtggtgttttaccttgcgcttcctatgcttctttgtgctgaagggcaacatgcatgttctcgcatttaaggtgtagaatctgaccattattggaaagccaaacgtgagctggcgccaatgtgtttcataaggagaggtggtgtcttgcgcagccagcccttgtcacttgtttaatgctccatccaatttagccaaagtgcgg

SEQ ID NO: 4596 - DNA, 1738 bp, Cocos nucifera
tgctggccgtgtcgtctcacatggcctcgctgccgccgctgggacctcatcaccatccggaccgccaggccttgaacctcgccgccgttcctcaccgcccggagatggccgaagacaagcaagcatctattatcgaggggaatgatccggtcactggtcatatcatctccaccaccattggaggcaagaatggtgaaccgaagcagaccattagttacatggcagaacgggttgtggggactggttcttttggtatagtctttcaggccaaatgcttggaaacaggggaaactgtcgcaataaagaaggtcttgcaggacagaagatacaaaaatcgcgagctacagttgatgcgttcaatggatcatcccaatgtgatatctctgaagcattgtttcttctccaccacgaccagagatgagctctttctcaacctagtcatggaatatgtcccagaaaccctgtaccgtgtccttaggcactacagcaatgtgaaccagaggatgccactcatctatgtgaagctttatacatatcagctatttagggggttagcttatattcatactgttccaggagtttgccatagagatgtcaagccccaaaatgtgttggtggatcctcttactcaccaagtcaagctttgtgattttggaagtgcaaaagtcctggttaaaggtgaagcaaacatatcgtacatctgctctcgttattaccgtgcaccagagctcatttttggtgcaacagaatatacaacatcaattgatatatggtcagctggctgcgttcttgctgagttacttcttggccagccattgtttcctggagaaagtgctgttgatcagcttgttgagataatcaaggttcttggtactcctacacgagaggagattcggtgcatgaatcctaactacacggagtttaggtttccacagataaaagcgcacccttggcacaagattttccacaagcgaatgcctccagaagcaatagatcttacatcacgtcttctccaatactcaccaagtcttcgttgcactgcattagacgcatgtgcccatcctttctttgatgagctacgagagcctaatgcacgattgccaaatggtcgggctcttcctcctctgtttaacttcaaacatgaattggcaggtgcctcacctgagctcatcaacaagctaattccagaacatgtgaagaggcaatcaggcctcagtttcttgcacccggcagggacgtagaagcttccatcatcgaaagcaagagggggatttaatggttttagtgcactggaaagtgtttagcaagtgagattgttcgcatgatgggagctaaaccagcagtgtcgctggttcatttggatggctctcaacgtaccatccagcctatgttttaggctctgtatattgtatggtataaaggatcgtggtgacctgaaagctaactgttgatgctgattgttcagaagtgagataagaatggtggaggggtagagagcactcctggcaatgttgtttggcttgtgttggacccatagcaattgtctttgtttctcattttatttttcagtgatagtagcttgttagttgtaagtgcatgtggcttgtagcttgttgtttcatgtaatgtacctacatccagagttttgaagccatggagctggaaatttaatatatgtaatgctatgattaatggatttgtcctgactttttgaatggccctaagaatcgatttaaca

SEQ ID NO: 4597 - DNA, 1812 bp, Vitis vinifera
gatggaatgtgatatgctccttcatttgtatgaatgttcttaaaagagaatttagaattttgtttcttttttaaatgattctggttgcggtgccaaacaggctgaaatggttcaaccaggtacaagtcaggattgcctcaattgatccgttgattagaggaaagagagagaaaggatagggtacaagtcaaataagcgtgaattaattaatgaaacggcttgattggggggcgttgtcgtactcgcaccggggctagcgtgggtctacccctgtctctccctctccttatccccaaacaccatttctagagagagaaaaacagcccccaaaaaaaaccaagaaaaaaaaaaaagagggaaaataggcaggtagagagagaaaaagagggagagggacagggagagaaagctgtattccacatggcctcgctgcctctgggtcctcaaacccaccaccaccaccaccaccttccgccggaacacgaccctctcaaacctcctttccgccgccccgaccacctcgactccgacaaggaaatgtcagctgctgttattgaggggaatgatccagtcactggtcatataatttccaccaccattggaggcaaaaatggagagcctaaacagaccatcagttacatggcagagcgcattgtaggcactggatcgtttggaattgtttttcaggcaaaatgcttggaaactggagaaactgtcgcaataaaaaaggtcttacaagacaggcggtataaaaatcgtgagctgcagttattgcgcttgatggatcacccaaatgtggtcaccctgaagcactgcttcttttccacaacaagtagagatgaactttttctgaatttggtaatggaatatgttcctgagactatgtaccgggtcttgaagcattatagcaatgctaaccagaggatgcctctcatatatgtcaaactttatacatatcaaatttttagggggctggcctatattcatacagtgcctggggtttgccatagggatgtgaagcctcaaaatgttctggttgatcctctcacccatcaggttaagctttgtgattttggaagtgcaaaggttctggtcaagggtgaagcaaacatatcatacatttgttctcgctactaccgggccccagaacttatatttggtgcaactgaatacacaacatcgattgatatttggtcagctggttgtgtttttgctgagcttctactaggccagcccttgtttcctggagagagtgcagtagaccaacttgttgaaattataaaggttcttggtactccaactagagaagaaattcgatgtatgaacccgaattatactgatttcaggtttcctcagatcaaagctcatccttggcacaaggtgtttcacaaacggatgcctcctgaagctcttgatcttgcttcacgacttcttcaatattcaccgagccttcgctgcactgctctagaagcatgtgctcattctttctttgacgagctcagggaacctaatgcccgccttccaaatggccgccctttacccccgctgttcaactttaaacaggaattagctgcagcttcaccagaactgctgcataggctgataccagagcatgtccgccggcaagttggtctcagtttcccccatcctgctggcacgttggtgctagaggcaatgttaatggctgggctttgggcaattagcgttaaacccaattatgaggggcatatggtaggaggtattaagcaacaattgaagcttgcatgctatggtcatgttgagaagaccatacaagtccatttgtatgtgtga

SEQ ID NO: 4598 - DNA, 1978 bp, Euonymus alatus
cggccgggggagacgcaatagcgagaggaaaggaaaatactgtattaagagagagaaagcaaagttgaaacttgaaagctgtagagcacatgaggggtctgaccaaaccatctcaaccaccaccaccacaatactgaagcccacgctatgtcccactcttcctgagccaccggcaccactacttgcctcggcgctccaattatggactccgataaggaaatgtcatccgctgttattgaagggaatgatgcagttactggtcacattatatgcacaaccatcggaggcaaaaatggggaacctaaacggacgatcagttatatggcagagcgtgttgtaggtactggatcatttggaattgttttccaggcgaaatgcctggaaatgggagagacagtggctattaagaaggtcttgcaggaccggcggtataaaaatcgtgaacttcagttaatgcgcttgatggatcaccctaatgttgtctccctgaagcactgtttcttctctacgactagtaaagacgagcttttcctcaatttggttatggaatatgtccctgagaccatgtatcgggttctgaagcattacagcagtatgaaccagaggatgccacttatctacgtaaaactttatacgtatcagatcttcagagggctggcatatattcattctgttcccggagtttgccatagagatgttaagcctcaaaatttgttggttgatcctctcacgcaccaggttaagctatgtgactttggaagtgcaaaagtattggtcaagggagaagcaaacatctcatacatatgctctcgttattaccgagctccagaactcatattcggtgcgacagagtatacaacgtcaattgatatttggtcagccggttgtgtccttgctgagcttcttctgggccagcccttgtttccaggagaaaatgcagtggatcaacttgtagagatcatcaaggttcttggtactcccactcgagaagaaattcgctgcatgaatcctaattatacagacttcaggttccctcagattaaagctcatccttggcacaagattttccacaagcgtatgcctcctgaagcaattgacctcgcttctaggcttctccagtattcaccaagtcttcgctgcactgcgcttgaagcatgtgcacatcctttctttgatgagctccgtgagcccaattcccgccttcctaatggtcgccttttacctgctcttttcaacttcaaacaggaattagctggagcctcttctgaactgattaacaggctcatacccgagcatatgaggcgataggctggtcttagcttatcacatcctgcaggtacgtaaaagggaaggcgtgaaataagaaatcaattctattcttggagtgaatgcttatgaaacagaggatgaccttggtatgatcaatataatcaatccgttgtctgtggattctcttgccctatgaaggtgtctaccgtgtagttaaatcatatcgtttatgcgccttgtacattgttttgataaaaaagagtggaaaagctgggggtaaaaagaggtattgcaatctgtcaacaataaaatcccagctggagctcaagagctcgttagtagtttggcttgctattatgtaagagtatgacactgtatcgtctgttgtttaccgctttcaggcggacacaaaactgaattccacaatttatggtctactaccagatctttctcatccccctcgctttgtgataattcaattcttctgaaggtttaaagtatttttcaatttttttagagttgtgcttgctggcatgttgcttgcttgagggaatattccagtaaaactggatgattttttgaaatgactcttcaattgttagtgaagactagtgtcgcttttgttgatttttcatcctgttagttttatgttaaactcattttgaaaacctaattacatattagctggagcctctcccgaactgattaa

SEQ ID NO: 4599 - DNA, 1942 bp, Cocos nucifera
cctagggatggttaagaggtaattcgccacttgaagatggaagcgaggaacagcgattgctggccgtgtcgtctcggatggcctcgctgcctccgctgggacctcatcaccatcccgacttccaggccttgaacctcgccgccgctcctcgccgcccggagatggcggaagacaagcaagcatctgttatcgaggggagtgatcaagtaactggtcatatcatctccaccaccattggaggcaagaatggtgaaccaaagcagaccattagttacatggcagaacgggttgtggggactggttcatttggtatagtctttcaggccaaatgcctggaaacacaggaaacagttgcaataaagaaggtcttacaggacagaagatacaaaaatcgtgagctacaactgatgcgtgcaatggatcatcctaacgtgatatctctaaagcactgtttcttctccaccacgagcagagacgagctctttctcaatctggttatggaatatgtcccagaaaccctgtaccgagtcctgaggcactacagcaatgtgaaccagaggatgccactcatctatgtgaagctttatacgtatcagctatttaggggcttagcttatattcatactgttccaggagtttgccacagagatgtcaagccccaaaacgtgttggtggatcctcttactcaccaagtcaagctctgcgattttggaagtgcaaaagttctggtgaaaggcgaagcaaacatatcatacatctgctctcgttattaccgtgctccagagctcatttttggtgcaacagaatatgcaacgtcaattgacatatggtcagcaggttgtgttcttgctgagttacttcttggccagacattgtttcctggagaaagtgctgttgatcagctcgttgagataatcaaggtgcttggaactccaacacgggaggagattcggtgcatgaatcctaactacacagagtttaggtttccacagataaaagcacatccctggcataagatattccacaagcgaatgcctccagaagcaatagatcttacatcacgtcttctccaatactcaccaagtcttcgttgcactgcattagacgcatgtgcccatcctttctttgatgagctacgagagcctaatgcacgattgccaaatggtcgtgctcttcctcctctgtttaacttcaaacatgaattggcaggtgcctcacctgagctcatcaacaagctaattccagaacatgtgaagaggcaatcaggcctcagtttcttgcacccggcagggacgtagaagcttccatcatcgaaagcaagagggggatttaatggttttagtgcactggaaagtgtttagcaagtgagattgttcgcatgatgggagctaaaccagcagtgtcgctggttcatttggatggctctcaacataccatccagcctatgttttaggctctgtatattgtatggtataaaggatcgtggtgacctgaaagctaactgttgatgctgattgttcagaagtgagataagaatggtggaggggtagagagcactcctggcaatgttgtttggcttgtgttggacccatagcaattgtctttgtttctcattttatttttcagtgatagtagcttgttagttgtaagtgcatgtggcttgtagcttgttgtttcatgtaatgtacctacatccagagttttgaagccatggagctggaaatttaatatatgtaatgctatgattaatggatttgtcctgactttttgaatggccctaagaatcgatttaacactggcgtgtctcctgtggggaaatttatgtccccacatagtacatggttttggcctgcctgctgctgtttatggctggtgtattgttgttgttactgctatgattgtaaagaatagatttggaatcaaaaattaaaaagcaaatatg

SEQ ID NO: 4600 - DNA, 1878 bp, Cocos nucifera
tgctggccgtgtcgtctcacatggcctcgctgccgccgctgggacctcatcaccatccggaccgccaggccttgaacctcgccgccgttcctcaccgcccggagatggccgaagacaagcaagcatctattatcgaggggaatgatccggtcactggtcatatcatctccaccaccattggaggcaagaatggtgaaccaaagcagaccattagttacatggcagaacgggttgtggggactggttcatttggtatagtctttcaggccaaatgcctggaaacacaggaaacagttgcaataaagaaggtcttacaggacagaagatacaaaaatcgtgagctacaactgatgcgtgcaatggatcatcctaacgtgatatctctaaagcactgtttcttctccaccacgagcagagacgagctctttctcaatctggttatggaatatgtcccagaaaccctgtaccgagtcctgaggcactacagcaatgtgaaccagaggatgccactcatctatgtgaagctttatacgtatcagctatttaggggcttagcttatattcatactgttccaggagtttgccacagagatgtcaagccccaaaacgtgttggtggatcctcttactcaccaagtcaagctttgtgattttggaagtgcaaaagtcctggttaaaggtgaagcaaacatatcgtacatctgctctcgttattaccgtgcaccagagctcatttttggtgcaacagaatatacaacatcaattgatatatggtcagctggctgcgttcttgctgagttacttcttggccagccattgtttcctggagaaagttctgttgatcagcttgttgagataatcaaggttcttggtactcctacacgagaggagattcggtgcatgaatcctaactacacggagtttaggtttccacagataaaagcgcacccttggcacaagattttccacaagcgaatgcctccagaagcaatagatcttacatcacgtcttctccaatactcgccaagtcttcgttgcactgcactagatgcatgtgcccattcttttttggatgagctacgggagcctaatgcgcgattgccaaatggtcgccctcttccacctttgtttaacttcaaacacgtgttggcaggtgcctcacctgagctcattaacaagctaattccagaacatgtgaggaggcaatcaggtctcagtttcttgcattcagcagggacgtaacaaaacccttaagtcttttcaactatattgtgatcaaaagcaagagggagattaaatggttttggtgcactgaaaaatgcttagcaagcgaggtggttcgcatgatggaaagctaaaccaccagtgctgctggtttgtttggatggctcttaagataccgtcctacctatatttttaggctttgtatattgtatggtatcaaagatcattatgaactggatgctgtaattgttgatgctgagtgtccaaaagtccaacaagcatggtggagaagaagagagaggttcttcacaggatcgagtggctgtttgtgttggacaatgttgaaattgtcgtgtctcattttatgttctatagtagttgtcagtgcatgtggcttgtaggctgttttatgtatatgcatgttcctaggtccaaagttttgaagccatggagctggaagttcaaaatttctgtaatgctctattgaagatgtcaaacttgcccctaagaattgatttaacattggtgtctcctgtgggaagtttatcagtccccacttataatgcatggttttgaccagcccggtgctgttttatggctaatatattccagtatgtctggtgtgattgtaatgaattgtctcgttatattaaaa

SEQ ID NO: 4601 - DNA, 2006 bp, Elaeis guineensis
attggatgatggctacatctagaaaatataaagttggatgagggtttacacgcaaaagcctattaccgttttttttttaacaatattttttcttaggatggtgaagtggtaagttgaaggatggaagagaggaacaagtgctggccgtgtcgtctcacatggcctcgctgccgccgctgggacctcggcaccatccggaccgccaggccttgaacctcgccgccgttcctcaccgcccggagatggccgaagacaagcaagcatctattattgaggggaatgatccggtcactggtcatatcatctccaccaccattggaggcaagaatggcgaaccgaagcagaccattagttacatggcagaacgggttgtggggactggttcttttggtatagtctttcaggccaaatgcttggaaacaggggaaactgtcgcaataaagaaggtcttgcaggacagaagatacaaaaatcgtgagctacagttaatgcgctcgatggatcatcctaatgtgataactttgaagcattgtttcttctccaccacgaccagagatgagctctttctcaacctagtcatggaatatgttccagaaaccctgtaccgtgtccttaggcactacagcaatgtgaaccagaggatgccactcatctatgtgaagctatatacatatcagctatttagggggttagcttatattcatactggtccaggagtttgccatagagatgtcaagccccaaaatgtgttggtggatcctcttactcaccaagtcaagctttgtgattttggaagtgcaaaagttctggttaaaggcgaagcaaacatatcgtacatctgctctcgttattaccgtgcaccagagctcatttttggtgcaacagaatatacaacatcaattgatatatggtcagcaggctgcgttcttgctgagttacttcttggccagccattgtttcctggagaaagtgctgttgatcagcttgttgagataatcaaggttcttggtactcctacacgagaggagattcggtgcatgaatcctaactacacggagtttaggtttccacagataaaagcacacccttggcacaagattttccacaagcgaatgcccccagaagcaattgatcttacgtcacgtcttctccaatactcgccgagtcttcgctgcactgcactagacgcatgtgcccatcctttttttgatgagctacgagagcctaatgcacgattgccaaatggtcgccctcttccgcctttgtttaacttcaaacacgaattggcgggtgcctcacctgagctcattaacaagctaattccagaatatgtaaggaggcaatcaggtctcagtgtcttgcattcagcggggacgtaacaaagtttttaggtcttttcaactattttgtgatcaaaagcaagagggagatttgatggttttggtgcactgaaaaatgcttagcaagcgaggtggttcgcaggatggaaagctaaaccagcagtgctgctggtttgtttggatggctcttaacataccgtcctacctatatttttaggctctgtatattgtatggtgtcaaagatcattgtgaactgaatgctgtagttgtcgatgccaagtgtccaaaagtccaacaagcatggtggagaagtagggacaggttcttcgtgggatcgcattgctgtttgtgttggacagcgttgaaattgtctcgtgtctcattttatgttccacggtagtttgtaagtgcatgtggcttgtaggctattttatgtatatgcatgttcctaagtccagagttttgaagccatggagctggaagttcaaaatttctgtaatgctctaattaatggagatgtcaaacttgccccgaagaattgatttaacattgttgtgtctcctgtgggaagtttatcagtccccacctatgatacatggtttagaccagcccagtgctgttttatggttaatatattggagtatgtctggtgtgattgtaaggaa

SEQ ID NO: 4602 - DNA, 1460 bp, Panax ginseng
gagagaaacacacacagtcaagtattattgtatagagagagaaagacgggcacatggcctcgttgccgctgggacctcagcatccgccagacaaccatgacccgttgaagctcgccgctcctcaccggacggagatggactccgataaggagatgtcagctgctgttattgaggggaatgatcaagttactggtcacatcatttctacaacaataggtggcaaaaatggcgaaccaaaaaggactattagttacatggcagagcgtgtcgtgggtactggatcattcggaatcgtttttcaggcaaagtgcttggaaaccggagaaaccattgctataaagaaggttttgcaggacaggcggtacaaaaatcgtgagctacaattaatgcgcttaatggatcaccccaatgtggtttgtctgaagcattgttttttttccacaactactaaagatgaacttttcctcaatctggtaatggaatatgtccctgagactatgtaccgggttctcaagcactacagcaatgtaaatcaaagaatgccacttatttatgtcaaactttacacctaccagatatttagggggctggcttatatccatactgttccaggtgtttgccatagggatgtgaagcctcaaaatcttctagttgatcctctcacccaccaagttaagctttgtgactttggaagtgcaaaaatttggtcaagggtgaggctaatatatcgtacatatgctctcgttattaccgagccccagaactaatatttggtgcaacggaatatactacctcgattgatatttggtctgctggttgtgtccttgctgagcttcttttggggcagccattgtttcctggcgaaaatgcagtggaccaacttgtagagattatcaaggttcttggtactccaactcgagaagaaatacgatgtatgaatccaagttacactgattttagattccctcagataaaagctcatccttggcacaaggttttccacaaaaggatgcctcctgaagcaattgatcttgcttcacgcctcctacagtactcaccaagtcttcgctgtactgctctagaagcgtgtgcccattctttctttgatgagctaagggatcccaatgcccgccttcccaatggtcgccctttacccctcttttcaacttcaagcaggaattaactggggcttcgcctgagctgatcaacaggcttattccagaacacatccggaggcagagtggtctaagcttcccacatccagctggtacgtaatcaaattgatcaactgttgtgctagttgatggatggtgaacataaggggtctctttgtttgtttatatcgccagtctttttgccctaaccagtgattttctttctcaagagagatgtatgcgtgaactggttgttttggcttagcagaagctgaaagaacttcccctacttgtgtaaattgtttt

SEQ ID NO: 4603 - DNA, 2117 bp, Medicago truncatula
caacactcttcttctctcactcctttatctttcgttgaacccaaaacactattccttcaaaacagagagagattctagagagagattttagagagagaaagaaagtgttttttttgagagagaaactagagagagaaagaaaaaagagtgtgagagtgtagctttctgaaatggccaccatgccgttggggccacatcaccaccatcaaccaccgcaacaagcaccactaccgttaccaccgccgttacagttacaacaaccacaaaccgtgaatgagacggtgaaaacaacggcggctaacggcggctccggtatggacactgataaggaaatgtcagctagtgtcgttgacagtaatgatgcagtcaccggtcacataatctcaaccaccattggaggcaaaaatggtgaaccgaaacggacaatcagttacatggccgaacgtgttgttggcacgggatcattcggaattgttttccaggcaaagtgcttggagactggtgaggcggtggctataaagaaggttttgcaagacaagcggtacaaaaatcgtgaactgcagttaatgcgcgtgatggatcacccaaatgtaatttccttgaagcactgtttcttctctacaacaagcagagacgaactttttctgaacttggtcatggagtatgtccctgagacgatgtaccgagttctaaaacactataataatatcaaccagagaatgcccctgatctatgtgaaattatatacataccaaatcttcaggggactagcatatatccatactgtgccaggagtttgccatagggacgtgaaaccccaaaatcttttggttgatcctctcactcaccaagttaagctttgcgattttgggagcgcgaaagttctggtcaagggtgaagcgaacatttcatacatatgttcacggtactatcgggccccagaactaatatttggtgcgacagaatacacaacttctattgatatctggtcagctggttgtgtccttgcagaacttcttctaggccagccattgttcccaggagagaatcaggtggaccaacttgtggaaattattaaggttcttggtactccaactcgagaagaaattcgttgtatgaaccctaattataccgattttagattccctcagattaaagctcatccttggcataaggtttttcacaagcgaatgccccctgaagctattgaccttgcatcaaggcttcttcaatattcaccaagtcttcgttgcagtgctctggaagcatgtgcacatcctttctttgatgagctccgagagcccaatgcccggcttcctaatggccgtcctctgcctccgcttttcaactttaaacaggaattatctggagcatcccccgaactgatcaacaaactcatcccagagcatgtcaggcggcagactggtcttggcttcccatatcccggctagcacataatgtaaagagataatgaaagaatgagtcaacccttctagttattaatgttaaacacaggtcccctttatggtcaatagattaggattcaggccttatatatgaagttttcctccaaaccccaatcaccctgtccctgaagatgtatgtatacaacatgtactggctgctcaatgtaacatgaaaaatcttgaatctgtctaaatatctcattctggtcatagcatgcatacaccttgcatttattcattgttttctgtagatttccattaaataggacagtcgaaattatactgttttccacattggtaggggtatggctagctgtagttcataaaaaattatgggtcaccttggtagtattttggcttactttttatacgatcagattaatttttgtttgtatgtcaatatgctacaacgatgtattgattcgaagctaaatttagccgttaattattcagtggtctacactcacgtaaaggttccattctgcagtaagaatcagaattttttaaaggagaaaggaatcagtccaaaaagttgacaatggaagagaaacaacttattcgttgtacgtaggctgttcgacgagagtgaaagttctaaggttattgagggaaataacggcaatgttacaatgagataggggtgacaatgac

SEQ ID NO: 4604 - DNA, 1849 bp, Triticum aestivum
acaaccatcggcgggaagaacggcgagccgaagaggacaattagctacatggctgagcgggtggtaggaactggttcatttgggattgtcttccaggctaagtgcttggagactggagagactgtggccatcaagaaggtgctgcaggatcgccgttacaagaaccgtgagctgcagcttatgcgctccatggaccatcccaatgtcgtctctctgaagcactgcttcttctcgaccacaagcagggatgagctgttcctgaaccttgtcatggagtatgtccctgagactctataccgtgtgctcaagcactacagcaatgccaaccagcggatgccgcttatctatgtcaagctttacatgtatcagctttttagagggctagcttatgttcatactgttccaggagtttgccacagggatgtgaaaccacaaaatgttttggttgatcctctaacccatcaagtcaagatctgtgactttggaagtgcaaaagttctggtacctggtgaacccaatatagcatacatatgctctcgctactatcgtgctcctgagctcatatttggtgcaactgaatatacaacttcaatagacatatggtcagctggatgtgttcttgcagagctacttcttggtcagcctctgtttccaggagagactgcggttgatcagctagtggagattatcaaggttcttggtactccaacccgtgaggaaattcggtgcatgaaccccaactatactgagttcaggtttcctcagattaaggctcatccttggcacaagattttccacaagagaatgcccgctgaagctatagatcttgcctcccgccttctccagtattcaccaaatctacgttgcactgctcttgatgcatgtgcacattccttctttgatgagctacgtgagccgaatgcacgcttgccgaatggccgcccattccctcctctgttcaacttcaaacctgaactagcgaacgcctctccagagctcatcaacaggcttgttccggaacatgttcgacggcaaaatggcctcaacttcgcccatgctgggagctagacgggcgcgccgcatcgcccatattttttgtttgtccgccatcatcgaagaatcaactctctctcctaaatcctgaggagagaccgatccagtgccagtgccagtgccagtgaaagaagtacaactatgtaaattacctgaccttggaagaatcgtcgttgttgttgttgccggtgtcgcccatgtttaagcacatggcggcacatgttggttgagttgttacttattattagtaggtaagagcaatgatgtaggaggtggagacatatgttaatgctaggtctgtgacttgttttaagtacatttttgtaatgcttggtagtggtactgtaatgcggcagtagctgctccatgttttgtcccttgtccctgatgtaaatgtcgtcgtcctgcaccaaatgattgttcttctgttacattgcctgattcccagttgtggcgcatggttttcggcaagtcgggaaatgtgattatcccccacttccaagttccaaggccatgtacatcctacagtgaggtttgttgctaaaattgacacgctggagacaggtcaattgggataccaacaagtttgggagggcccttaggtttggagatggccttgctggttgagttgggaagggaaaccaaacccaacccaaaggattaattggggtttggggaccggggttaggttccttgtctgaagttgggacctccgattattctatctcttcgcatcatcaccccaacggtgcctgctccccgttttgggactaccgtaatttccattctacaaggt

SEQ ID NO: 4605 - DNA, 1512 bp, Amsonia hubrichtii
acctcctccaccaccatcatcatcatgaccaaggagccggagcagctgcagctgcactgaagcttgccgcccagtctcgccgttctgacatggactccgacaaggatatgtctgctcctgtcatcgaagggaatgatgctgttactggccacattatatcgactacaattggaggcaaaaatggggaacccaaaaggaccatcagttacatggctgaacgcgttgtcggaacaggatcatttggaatagttttccaggcaaagtgcttggaaaccggagaaaccatcgccataaagaaggttttacaggatagacggtataaaaatcgtgaattgcaattaatgcgcctcatggaccacccaaatgtgattgctttaaagcattgtttcttttctacgacaacaagagatgaacttttccttaacttggtgatggaatatgtccccgagaccttatacaaggttttaaagcattacagcaattccaatcagaggatgccactcatatatgttaaactgtatacataccagatatttcgagggctagcttatatccatactgttcctggtgtttgccatagggacgtgaagcctcaaaatcttttggttgatcccctcacccaccaagtcaagctttgtgattttggaagtgcaaaagttctggtgagaggtgaagcaaatatatcatacatctgctcacggtactaccgggcaccagagctcatatttggtgcaacagaatatacaacatctattgatatttggtcagccggttgtgtcctcgctgagcttctcttgggccagccattgtttcctggagaaaatgcagttgaccaacttgtagagattatcaaggttcttggtactccaactcgagaagaaattcgatgcatgaatccaaattatactgattttaggtttcctcagatcaaagctcatccttggcacaaggttttccacaaacggatgcctcctgaagcaattgatcttgcttcacgactgcttcaatattcaccaagtcttcgctgtactgctttagaagcatgtgcccatcctttctttgatgaacttcgggatcctaatgctcgcctaccaaatggtcgccctttcccgccccttttcaactttaagcaggaattaactggagcttcacttgagttgatcaaccggctaataccagagcatgttcggcggcaagctggcccgtttccacatcctgctgggacataatcagtgccaaattttctgttcttgttgaaggatgtcaagcaaaatggaagctggctcatccagctgggcgttttgtcaaggcagtggtttttgtcaccccaaaaagcatatagtggtcatttaacgtggcctgcaatttggtgattctgtctactcatcttaagctaaaaacaaactcttcaccgcttctgtacattattttggtcaaagatttcagaaatgtaggaactaaaatggtaatgctatgtttgtccagctaggcagattccccaaagagacagtg

SEQ ID NO: 4606 - DNA, 1899 bp, Elaeis guineensis
gttaagaggtaattcaccacttgaaaatggaagcgaggaacagcgattgctggccgtgtcgtctcggatggcctcgctgcctccgctgggacctaatcaccacccagacctccaggccttgaacctcgccgccgctcctcgccggccggagatggccgaagacaagcaagcatctgtcatcgaggggaatgatcaagtaactggtcatatcatctccaccaccattggaggcaagaatggtgaaccaaagcagaccatcagttacatggcagaacgggttgtggggactggttcatttggtatagtctttcaggccaaatgcctggaaacacaggaaacggttgcaataaagaaggtcttacaggacagaagatacaaaaatcgtgagctacaactgatgcgcacaatggatcatcctaacgtgatatctctaaagcactgtttcttctccaccacgagcagagacgagctctttctcaatctggttatggaatatgtcccagaaaccctgtaccgagtcctgaggcactacagcaatgtgaaccagaggatgccactcatctatgtgaagctttatacatatcagctatttaggggcttagcttatattcatactgttccaggagtttgccacagagatgtcaagccccaaaatgtgttggtggatcctcttactcaccaagtcaagctctgcgattttggaagtgcaaaagttctggttaaaggcgaagcaaacatatcatacatctgctctcgttattaccgtgctccggagctcatttttggtgcaacagaatatgcaacatcaattgatatatggtcagcaggttgtgttcttgctgagctacttcttggccagccattgtttcctggagaaagtgctgttgatcaacttgttgagataatcaaggttcttggaactccaactcgggaggagattcggtgcatgaatcctaactacacggaatttaggtttccacagataaaagcacatccttggcataagatattccacaagcgaatgcctccagaagcaatagatcttacatcacgtcttctccaatactcaccaagtcttcgttgcactgcattagaagcatgtgcgcattctttctttgatgagctacgagagcctaacgcacgattgccaaacggtcgccctcttcctcctttgtttaacttcaaacacgagttggcaagtgtctcaccggagctcattaacaagctaattccagaacatgtgaagaggcaatcaggtctcagtttcttgcacccggcagggacgtagaagcttccatgatcaaaagcaagagggggatttaatggttttagtgcactggaaagtgtttggcaagtggattgttcgcatgatggctaaaccagcagcatcgctggttcgtttggatggctcttaacataccgtccagcctatgttttaggctctgtatattgtatggtataaagatcgttgtgacctgaaagctaactgttgatgctgattgttcagaagtgagataagcatggtggaggggtagagagcagtcctggcaatgttgtttggcttgtgttggacccatagcaattgtcttgtttctcattttatttttcagtgatagtgcatgttagttgtaagtgcatgtggcttgtagcttgttgtttcatgtactgtacctaaatccagagttttgaagccatgaagctggaaatttaatatctgtaatgctctaattaatgatttgccttgacttttgatggcctagatcgattaacactggcgtcgccgtgtgggaatttatgtccccacatagtacgtggctttggcctgccgctgctgttttatggtctggtatattggttgtaggtttgctcctgtgattgtaaagtatagttttggaatac

SEQ ID NO: 4607 - DNA, 1632 bp, Vinca minor
tgccaccaccacccaccaccctcatgaccaaggagccggagcagctgcagctgcactgaaactagccgcccagtctcgacgttctgacatggactcctccgacaaggatatgtctgctcctgttgttgaagggaatgaggctgttaccggccacattatatcgaccacaatcggagggaaaaatggggaacccaaaaggaccatcagttacatggctgaacgtgttgtgggaacaggatcatttggtattgttttccaggcaaagtgcttggaaactggagaaactgttgccataaaaaaggtcttgcaggacagacggtataaaaatcgtgagctgcaattaatgcgtctgatggatcatccaaatgttattgctttgaagcattgtttcttttctacaacaacaagagatgaactcttccttaacttggtgatggaatatgttcctgagaccttatacaaggttttgaagcattatagcagttccaatcaaaggatgcccctcatatatgtcaaactttacacataccagatatttcgagggctagcttacatccacactgttcctggtgtttcccatagagatgtgaagcctcaaaatcttttggttgaacctcttacccaccaggtcaagctttgtgattttggaagtgcaaaagttctggtcaggggtgaagcaaatatatcatatatctgttcccgctactaccgagcaccagagctcatatttggggcgacagaatatacatcatctattgatatttggtcagcgggatgtgtccttgctgagcttctcttgggccagccactatttcctggagaaaatgcagttgaccaacttgtagagattatcaaggttcttggtactccaactcgggaagaaattcgatgcatgaatccaaattatactgattttaggtttcctcagatcaaagctcatccttggcacaaggtgttccataaacggatgcctcctgaagcaattgatcttgcttcacgactccttcaatattctccaagtcttcgctgtactgccttagaagcatgtacccatcctttctttgatgaacttcgggatcctaatgctcgtctaccaaatggtcgccctctgccgccccttttcaactttaaacaggaattaaccggagcttcacctgagttgatcaatcggttaataccagaacatgttcggcggcaaaatgggcccttcccacatcctgctggaacataatcaagtctcaaattcatgttctgtcaaaacaaaacagaggctttctatggagacgtttcgtgaaggcagtggtttttgtcaccccaaaaagcatagatagtggctgtcttgcaatttggtgattctgtctactcaaatcttaagttaaaaacaactctactctgtacattattttggtcaaaggtttcagaaaaatgtaggagactctgtgtccagctacgcagattccctaaagaaacaatggttgtagtcatcttgtttgtattattacgtctcagttgaattgttattattttagtatattgtctttgcaatttgaaagtgctactggaagtttacttctttttccctgtcatggaaatacttctttcctatttcttaatataagtcgtttaggacta

SEQ ID NO: 4608 - DNA, 1736 bp, Sesamum indicum
gaggggaaaagtcacatggcctcgttgccgctggggcctcagcagcatcaccataatccaccacccgaccatcatcatcaatatcatcataatgctcttcttgaccaagctccaccaccccccgccgccgtgaagttcgcttccgccgctgcccacaatatggaagccgacaaggagatgccatcgtctatggttgagggtaatgatccagttaccggtcacattatttctactactattggaggcaaaaatggcgagcctaaaaggacaattagttacatggcagagcgcgtcgttggcaccggatcatttggaatagtttttcaggcaaaatgcttggaaactggagagtcagtagccataaagaaagtcttgcaagacaggcggtataaaaatcgggagcttcagttaatgaggttgatggaccattctaacgtgatttcgctgaagcactgtttcttttcaacaaccaccagagatgagcttttccttaacttggtcatggattatgtgcctgagactatgtacaaggtcttaaaacattataccaattcaagtcaacggatgccactcatctatgtcaaactctacacctatcagttgtttaggggccttgcatatatgcatacagttgcaggggtatgccacagggacataaaacctcaaaatattttggttgatcctcttacccaccaggtcaagatttgtgactttggaagtgctaaagttcttgtgaagggtgaagctaatatatcctacatttgctctcgttattatcgagctccagaactcattttcggcgcaacagaatataccacctctattgatatctggtctgctggttgtgtccttgctgagctacttttggggcagcctcttttccccggagagaatgctgttgatcaacttgtagagattatcaaggttcttggtactccaactcgagaagaaattcggtgtatgaatccaaattacactgacttcaggtttccccagattaaagcccatccatggcacaaggttttccataagcgaatgcctcctgaagccattgatcttgcttcacggctacttcagtactcaccaagtcttcgatgcacagcacttgaagcatgtgcccatcctttctttgatgagcttcgtgagccaaatgctcgcctcccaaatggtcgccctttccccccactttttaacttcaaacaggaactagctggagcgtcgcctgagttgatcaacaagttgatacccgaacatatccgtcgacaagctgggctgaattttcctgtttcccatcctgctgggacgtgatgattgacatcagaattgcggccctcttcatttagttggcggataagtagcaaaagcaaaagctctctgtttagtattatcaggcgtttctacccaggtcagtggtctttgacgccccttatgatgtatgcatatagcgtctgctcggattaacagcatagttggtggtaccggtctagtactccgcctagctaaacaagtttcgttgcttctgtacatttgtctaggtcaaaactcaaaagattctgaaatgtagtagaaaatatgatgttggtgttggtgtcaatcgatgcagatttccttgaaacagcatagtgcgaggatttcaattgtatttctattttattttcatctgaggttgtgtttgtttctggtaccattaagttgtctcatgctaaaagccctattagacttcgctctgttcgtac

SEQ ID NO: 4609 - DNA, 2110 bp, Musa acuminata
ctccaaagggatgctactgtgagatggagacccgagcccccaccgtggcgtggaaagctatcaatgaatgacccgaagccttgttgctcaatcattctgcactcatatctgtcaaatgttctacagttctttattggtcgaacaatttattcacagatttggttgtcgagatccattgcgttttacattgcttggtcgaacaattcttccatcacatttattgggggatatgatgtcggttaaagcggctgttataaagacgatgtggattacgagcaagccaatagaacaatttcgaaaagtctttttctttcgagtcgaaattgttgctcgtttcctacattttttgatatgcggcagtgcggaatccgctggaaaaccgtgagaccgaggagttgaaaaggtcgagtctttccttccctctttcgttgccctcgtccttccccaccttatcacatggcctcgctgccgctgggaccccatcatccgccgccgctgccgccgcaggagcacgacacgctcaaccccgccgccgctcctcgccgacctgggatggatgaagacaagaaaacatctgttttggaggggaacgatgcagtcactggacatatcatttccaccaccattggaggcaagaatggtgaacccaagcagaccatcagttacatggcagagcgcgtcgtagggactggctcatttggaattgtattccaggcaaaatgtttggaaacaggggagactgttgcgataaagaaggttttgcaggatccaagatacaaaaaccgtgagctgcagctgatgcgttcaatggatcattcaaatgtgatctcactaaagcattgtttcttctccaccacaagcagggatgagctttttcttaacctggtcatggaatatgtgcctgaaactctttatcgtgttctaagacattacagcagtgtgaatcagaggatgcctcttatatatgtgaagctttatacgtatcagatatttagagggttggcttatattcatacagttcctggtgtttgccatagagatgtaaagccacaaaatgttttggtagatcctcttactcatcaagtcaagctatgtgatttcggaagtgcaaaggttttggtcaagggtgaaccaaacatttcttacatttgctctcggtattatcgtgctccagagcttatttttggtgcaacagaatatacagcatctattgatatatggtcagtgggttgtgttcttgctgagttgctcctcggtcagccattatttcctggagacagtgctgtcgatcaacttgttgagataatcaaggttctcgggactccaactcgtgaagaaattcggtgcatgaatccaaactatacagagttcaggtttccacagataaaggctcatccatggcacaagatatttcataagcgaatgcctcctgaggcaatagatcttacgtcgcgccttctccaatactctcctagttttcggtgcactgcattggaagcatgtgctcaccccttctttgatgagctacgagaaccaaatgcacggttgccgaatggtcgtcctctgcctccactttttgacttcaaacaagaattaaatggtgcatcgccagagctcatcgacaagctgattccggaacacctgaggcgacaatcgagtctcagtttcctgcgagttcctgggacgtagtgtgcagcaatcaccttcgtgatgttatggtcaagatcaagtaatcccactgcacagttttcatgccatcgctaaatttcggcaagaggtgtgcaagatgaaccaggtggagctgccgggttaaaagcaaggttgttataacctatcctgcctactgccgaaatctgtatattgcaacttatttaggatcattaggatcttgtttcttctgtggatggctccgaatgttcaaagaagtatgttttgctggaggggacgactatgtacgtggcttttaactgtggtttgatctctttcgttgttgtttgatgatgtcggtgcatggtaggatgtccaagtcgagtgcagctcatgagagcttctcttttcttcatccgttcttattgtaaatgtatgtaatttagaagattgaagatttgag

SEQ ID NO: 4610 - DNA, 2055 bp, Oryza sativa
aggtctcatctcatggtcgcctagccaagccaagccaagccaacctcctcgccgaggagagagaagagaggagaggagacgagaggagagagaagccgaggaggaggagagagagagagaggaggccgctccatttgcccccccccacatggccacgctgccgggcgggccccaccccaccggaggcggcgccgcggcggacccgatgcaggtcgaccagccgcgctccgccgcggccgccgcagcggtcgcccccgccggtgaaaagcacggtgcttctcttatggaagggagtgatcctgtcaccggccacataatctccacgacgattggagggaagaatggagaacctaaaaggacgattagctacatggcagaacgagttgtgggaactggatcatttggaatcgtctttcaggcaaaatgtttggagactggtgagactgtcgccattaagaaggttttacaggacaagcgttacaagaacagggagttgcagattatgcgatcaatggatcattgcaatgttgtttctttgaagcattgcttcttctctacaacaagcagagatgaacttttccttaacctggtcatggaatttgttcctgagtcactgtatcgtgtgttgaagcattatagcaacatgaaccaaaggatgccacttatatatgtcaaattgtatgtttaccagatattccgtggtttggcttacattcatactgtacctggagtttgccacagggatgtgaagcctcagaatcttttggtcgatcctcttactcaccaagtcaaaatatgtgattttgggagcgcaaaaatgttggttaaaggtgaagcaaacatatcgtatatatgttcacgttattaccgtgctccagaactgatatttggggcaaccgaatacacgacatcaattgatatatggtcagctgggtgtgttcttgctgagttgctccttggccagcctctctttcctggtgaaagtgcagtggatcagcttgtcgagattataaaggttcttggtactccaacacgtgaggaaatccgctgcatgaatcccaactacacagaattcagatttcctcagattaaagctcacccatggcacaagattttccacaagcggatgcctccagaagcaattgaccttgcatcacgtcttctccagtattcaccaaatctacgatgcactgccctcgaagcatgtgcacattcattctttgatgaattgcgagaaccccacgcaaggttgccaaatggacgtccattccccccactgttcaactttaagcaagaactagcgaatatatcgccagagctcatcaacaggttgataccagagcatgctcggcgacattgtgggttcaatttcttgcctgctgccggaccataggacggctggattttatttttactttgcgaagccgatgcttgtttgtgccgaagggcaacttgcatgttctcacatttaaggtgtagaatctgaccattattgggaagctgaacatgagctggcgccaatgtgttatatgaggggggtgtgctaggcacagccaacccatgttaatttaatgcttctcctccattattaggaggccatggtggtcaggattagccaagtactgtggggatagctggagggaatggggatggtgtattgttaagctattgaaagggatcagatcccaagtactgtactactttctcccacgattaatgttgtagtgcccctgtaagtgtttctcatgccctattgtcgatgtaattgtgtaaatgttcctaatggaaaaatctcttgttatgataccccatgcccaaacttgtttaccccccccccccctactggtttcctctaccatatggttcagagaactttcctcatctgttggctgcaaagatgaatgttgtgattatcattgtcactggaatactaggataaaattgttgataaatgagtaatatatttgaggtctgcatttgtgagttgtgtaaggatttaaggcaggtgtctgcaccaatcctatattgagagaataaaagcaacagttgagaacc

SEQ ID NO: 4611 - DNA, 1484 bp, Castanea mollissima
aaagagagtgagtctagtctgtctctcacatggcctcaatgcccttggggctaaaccatcaacaacaactacaactacagccacagccacagacacaggcagagattaatgagccacagaagctagggcctcgccgcacatctgaaatggactctgataaggaaatgtccgctgctgtaattgaggggaatgatgcagttactggacacatcatttcgaccaccattggaggcaaaaatggcgaacctaaaaggactatcagctacatggcagagcgtgttgtaggtactggatcttttggaattgtttttcaggcaaaatgcttggaaactggggagacggtggctattaagaaggtattgcaggacaggcggtataaaaatcgtgagctacagttaatgcgcttgatggatcacccaaatgtggtttccctgaagcattgtttcttctctacaacgagtaaagatgagctttttcttaatctagtcatggaatatgttcctgagactatgttccgagttctgaagcattacactagtatgaaccagaggatgcccctcatatatgttaaactttatacatatcaaatttttagggggctggcatatatccatactgttcctggagtgtgccatagggatgtgaagccccaaaatcttttggttgatcctctcacccaccaggttaagctttgtgactttggaagtgcaaaagtcctggtcaagggtgaagcaaatatttcgtatatatgctctcgttactatcgggctccggaacttatatttggtgcaacagaatatacaacatcaattgatatttggtcagctggctgtgtcctcgctgagcttcttctgggccagccattgtttccaggagaaaatgcagtcgaccagcttgtagaaattatcaaggttcttggtaccccaactcgagaagaaattcggtgcatgaatccaaattatacagattttaggttccctcagattaaagctcatccttggcacaaggttttccacaaacgaatgcctcctgaagcaattgaccttgcttcacggcttcttcaatattcaccaagtcttcgctgcactgcgttagaagcatgtgcgcatcctttctttgatgagctacgtgagcccaatgcccgccttccaaatggacgcccattgccccctcttttcaactttaaacaggaattacaaggagcatcacctgaattgatcaacaggcttataccagagcatgtacggcggcagaccggtctaagtttcccacatccagctggtacgtaaatgtgaaggcatgatgtaacaaggaatcaactatggtagcaatgaaagcgaaacaaaggatggcctcttttgcggtctatgtaaccgagcattctggcttaatgagcagttttttctcggcctgtgaagatgtatacatatactggctcttcagcttaacctggaaattggtgattctgtctactatgtcatttt

SEQ ID NO: 4612 - DNA, 1643 bp, Musa acuminata
gccatgaaaacgaggatctaaaagaggtggggttttcaccgtactgcccttcctcctcccaccactaccacatcacatggcctcgctgccgctgggaccgcatcaccacccgccgccaccggctccggagcacgatgccgtcaattcggccgcccctccttgcgaccaggagatggccgaagacaagcaagcatctgtgatggaggggaatgatgcagtcactggtcatatcatttccaccaccatcggaggcaagaatggtgaaccgaagcagaccattagttacatggcggagcgtgtagtagggaatggctcatttggaatcgtattccaggcaaaatgtttggaaacaagggagactgttgctataaagaaggttttgcaggatcggagatacaaaaaccgtgagctacagctgatgcgttcgatggatcatccaaatgttatctctttaaagcattgtttcttctctaccacaagcagagatgagctttttctcaacctagtcatggaatatgtgcctgaaactctatatcgtgttttaagacattacagcagtgtgaatcagaggatgccacttatctatgtgaagctttatacatatcagttatttagagggttggcttatattcatacggttcctggtgtttgccatagagatgttaagccacaaaatgttttggtagaccctcttacccatcaagtcaagttgtgtgattttggaagcgcaaaagttttggtcaagggtgaaccaaacatctcttacatttgctctcgctattaccgtgccccagagcttatttttggtgcaacagaatatacaacatctattgacatatggtcagcaggttgtgttcttgctgagttactactcgggcagccattgtttcctggagatagcgctgttgatcagcttgttcttggaacgccaacccgtgaggaaattcgatgcatgaatcctaactatacagagttcagatttccacagataaaagctcatccatggcataagatattccataagcgaatgcctccagaagcaatagatcttacctcacgtcttctccaatactctccaagttttcgttgcactgcactggaagcatgtgctcaccccttttttgatgagctacgagaaccaaatgcacggttgccaaatggtcgtcctctgccttctcttttcaacttcaaaccggaattagcaggtgcatcaccagagctcatcgccaagctgattccagaacatgtgcggcggcagtctggtctcagtttcctgcagatgcctgggacatagtaccacaaaagctttcgagatgttctggtcaaaatgcaagtaacccactacatgtttttcacggaggcgagtaggagtgctctaccgttgggagctataatgatggagctgatgggatgtttggagggttccttaaatcgtatcctgcctttctgccggtctttgtatattgtaagatatttaggatctcattctgatgtagtcgctgtatctgatgaattctaaatggtcaaagaattatgttctgcccttgtagaggacattataggtgtcttcgtagtgtggtttggctgcttcttatctgtactggctgcagcacaacttaacaggctggttctcttcatttttg

SEQ ID NO: 4613 - DNA, 1745 bp, Festuca arundinacea
gagaaagccagagcagaagcaagggagggaggagctccatttcggcgtcccgtccggccccctcccccacatggcgacgctgccgagcgggccccaccccgccggcgccgcggctgacctcatgcaggtcgacgagccgcacgccgccgccgcggctcccgtggtcgagaagcatggtgcttctattatccaagggagcgatccagtcactggtcacataatctccacaacgattggagggaagaatggagagcctaaaaggactattagctacatggcagagcgagttgtcggaactggatcttttggaattgtcttccaggcaaaatgtctggagacaggtgagactgttgccatcaagaaggttttacaggacaagcgttacaagaacagggagctgcaaataatgcgatcaatggaccattgcaatgttgtttgtttgaagcattgtttcttctctaccacaagcagagatgaacttttcctcaacttggttatggagtttgttcccgagtcattgtatcgtgttctgaagcattatagcaatatgaaccaaaggatgccacttatatatgtcaaactgtacgtgtaccagatatttcgaggtttagcttacattcacagtgtgcctggagtttgccacagggatatcaagcctcagaatcttttggtggatcctctgactcacacggtcaaaatatgtgattttgggagcgccaaaatgttggttaaaggagaagcaaacatatcgtacatatgctcacgttattaccgcgcccctgagctgatatttggggcaacagagtacacaacatcaattgatatatggtcagctggatgtgttcttgctgagttgcttcttggccagcctctatttcctggtgaaagtgcagtggatcaacttgttgagataattaaggttcttggtactccaacacgtgaggaaatccgctgtatgaatcccaactacactgaatttagatttcctcagataaaagctcatccatggcataagattttccacaaacgaatgccgccagaagcaatagacttagcgtcacgtcttcttcagtattcacccaatctacgatgcactgctctcgaagcatgtacacatccattctttgatgaattacgagagccccatgcaaagttgccaaatggacgcccattccctccactcttcaacttcaaacaggaactagcaaatgcttcaccagacctcatcagcaggttgataccagagcatgcaaggcgacattgtgggttcaatttctcgccttccaccggacagtagggaaggctgtacgatattattttacctggcacaccaccattgcttgtctatgccaaagggcacctgcgcattatcacaaatttagaatctgacaacccattattggaaagccgaagacaagctggtgccattgcctttgtatgagggggtatgtatttgccgagccgcccctgatgtaacatttaatgctcgagctcctttatgaggagacaatggttaccagaagctcaagattagccaagaactgtgcgcatgggtggagagaattgggaagggtgtattggtaagcagttgatgggactagaggaaaaccatgtattgtaacttctccatgttcaatggtgtagtgcgcctgtaagtgtttcacatgttcctaccgtgatgtagctgtgtaaatgttcctgacgggatgtctcgtcatgatggtcttgctcgaaaccttgtatcc

SEQ ID NO: 4614 - DNA, 1946 bp, Arabidopsis thaliana
atttgataccattattattcagttagaatatttaatggagttctaactcaacttagtaatttagttatcattaaatgctaaggaagtgtttatcagaatttttcagtgctttatcaattaaaaagtagttttctcattggaccgttacattcacgcgctctagtcttccgtgggtcctccattgtctttgaaccatttctgaaatttagaagcaaagagagaggaaaaattagactttactcattgttcagtggttgagagagaaaagagtaaaaaagcacatggcctcattaccattggggcctcagcctcatgctcttgctccgccgctgcagcttcacgacggcgacgctttgaaacgccgtcctgaattggattctgataaggaaatgtctgcagctgttattgagggaaatgacgctgttactggtcatatcatttccactactattggaggcaaaaacggcgaaccaaagcagaccattagttacatggctgagcgggttgttggaacaggttcattcgggattgtttttcaggcgaaatgcttggaaactggagaatcagtagccattaaaaaggtcttgcaagatcgacgctataaaaaccgtgagttgcaactaatgcgaccaatggatcacccaaatgtcatctccttgaagcactgtttcttctctacaacgagtagagatgagctcttcctcaaccttgttatggagtatgtacctgagactttataccgggttttgaggcactatactagttctaatcagaggatgccaattttctatgtcaagctttacacatatcaaatctttagaggtttggcttacatccatactgttcccggtgtttgccacagagatgtgaaaccacaaaatctcttggttgatcccttgacccatcaggttaagctgtgtgattttggaagtgcaaaagtattggtcaaaggtgaaccaaacatatcatatatctgctcccgttattatcgtgctccagaactgatctttggcgccacagagtatacagcatccatagatatatggtctgctggttgtgtactggcagagcttcttctgggccagccgttatttccaggagaaaattcagttgatcagcttgtggagatcataaaggttcttggtactccaactcgtgaagaaattcgatgtatgaacccgaactacacagattttaggttcccacaaatcaaagctcacccttggcacaaggtttttcataaacggatgcctccagaagcaatagaccttgcatctcggcttcttcaatattcaccaagtctacgctgcactgcgctcgaagcatgtgctcatccgtttttcaatgaactccgagagccaaacgcccgtcttccaaatggtcgtccattaccgccattgttcaatttcaaacaagagttaggtggagcttcaatggagctaatcaacaggctaatacctgagcatgtgagacgacaaatgagcacaggattacaaaacagttaaaaactgtgcatgtctgaagagaaagaggagaaaagcagcctggagagtggagagagacactgttcctcgtgtatttttgtatatgtttttgtctgtaaaacaattctgacagatacgtagagacaaaagaaaaacgaggtgataatattaaaccatgtcatgtccaaaagattagctacagatgtttttttgttttcttctctcaacacaaaagactagagggataaataatcatcctcttaaattaaaagtcgctagatctattttcgaaatgttacgtaggtgatgatttgcatttcttcagtttattacaagtttacaaattacaagtggtgggagtgttgaaaacaaattaccaatcatgtacttaaattttaaaggaccttacaggccaaagttaccaaagcatacacatgatcttaaaagtaatcgtttcttatt

SEQ ID NO: 4615 - DNA, 1809 bp, Solanum lycopersicum
agtagtggggttaagagaaaaaataaataaagcaattattaattttagtagagaagtaagaaaaagagtgaagagtagcagaggagaagagagcacatggcctcgataccgctgggacctcagcaccataatccgccggaaaatcaccatcaccaccaccttcagccgccgccgcagctggtgcagcagcagcagcaacagcctgtgaatcgtgaactaggaggaggaggaggagctgcagtaaggaacgccggagcacgaccggaaatggaatccgaaaaggaaatgtcagctgctgttgttgagggtaatggtgccgtcactggtcacataatttccaccaccattggaggcaagaatggagaaccaaaaaggaccatcagttatatggcagagcgagttgtcggtacagggtcctttgggatagtgtttcaggcaaaatgcttggaaactggagagactgtggccataaagaaggttttacaggacaaacggtataaaaatcgtgaactacaactgatgcgcttgatggatcacccaaatgtcattactctaaagcactgcttcttttccacgactagtagagatgagctttttcttaatttggtcatggattatgtccctgaaagtttatacaaggttttaaagcactatagcaattcaaatcaaaggatgccactcatatatgtcaaactttacatgtatcagatattcagagggctggcttacattcataatgttccaaggatttgccatagagatgtgaaacctcaaaatcttttggttgatcctctgacccatcaagtcaagctgtgtgattttggaagtgcaaaagtcctggtaaatggtgaagcaaatatttcatacatttgctctcgctactacagagctccagaactcatatttggtgccacagagtatacaacatcaattgatatttggtcagcaggctgtgtccttgctgagcttcttctggggcagccgctctttcctggcgaaaatgcagtagatcaactggtggagatcatcaaggtccttggtactcctactcgggaagaaattcgatgtatgaacccaaactacacagatttcagattcccacagataaaagctcatccttggcacaaggtattccataaaagaatgcctcctgaagcaattgatcttgcctcacggcttcttcaatattcaccaagtcttcgctgtactgcactagaagcatgtgcacattcgttctttgatgagcttcgtgagcccaatgcccgtctccctaatggacgtccatttccacctcttttcaactttaaacaagagttaactggagcttcacctgatttggtcaacaagctgatccctgagcatgtgtggaggcaacttggtttgaatttcccatttcctggtgcgacgtaattgtactaatgtaatatagagttggtgtatcagaaaaaatatatagggagtccttgtggattaatgtaaccatgcattttggcgtaaccagtggctatgcacgcatgtaaaagttgtatgcatatagccgctgtttggcttacaagaagtgatcctgtctctacttgtgtcctcttttagctaatagcagacctgttgcctcttttgtacattgtttttgataagaagaattcagataggagtataaagtgataaatattgtaatgtctagttaagcagatttccttgagagaccttctggagcactaggacttgtagctttgggttgtagttatatttatatgcaagttgtttttagctctatttttattttttaatataaggcatatatgaattatc

SEQ ID NO: 4616 - DNA, 1748 bp, Quercus alba
ctagtctgtctgtctctcacatggcctctatgcccttggggctaaaccaacaacaacaacaacaattacaactccagccacagacacaggcagagattaatgagccacagaagctagcgcctcgccgcacatctgaaatggactctgataaggaaatgtctgctgctgtaattgaggggaatgatgcagttactggacacatcatttcaaccaccattggaggcaaaaatggcgaacctaaaaggactatcagctacatggcagagcgtgttgtaggtactggatcttttggaattgtttttcaggcaaaatgcttggaaactggggagacggtggccattaagaaggtattgcaggataggcggtataaaaatcgtgagctacagttaatgcgcttgatggatcacccaaatgtggtttccctgaagcattgtttcttctctacaacaagtaaagatgaactttttcttaatctagtcatggaatatgttcctgagactatgtaccgagttctgaagcattacagcagtatgaaccagaggatgcccctcatctatgttaaactctatacatatcaaatttttagggggttggcatatatccatactgttcctggtgtgtgccatagggatgtaaagccccaaaatcttttggttgatcctctcacccaccaggttaagctttgtgactttggaagtgcaaaagtcctggtcaagggcgaagcaaatatttcatatatatgctctcgttactatcgggctccggaacttatatttggtgcaacagaatatacaacatcaattgatatttggtcagctggctgtgtcctcgctgagcttcttctgggccagccattgtttccaggagaaaatgcagtcgaccagcttgtagaaattatcaaggttcttggtaccccaactcgagaagaaattcggtgcatgaatccaaattatacagattttaggttccctcaaattaaagctcatccttggcacaaggttttccacaaaagaatgcctcccgaagcaattgaccttgcttcacggcttcttcaatattcaccaagtcttcgctgcactgcgttagaagcatgtgcgcatcctttctttgatgagctacgtgagcccaatgcccgccttccaaatggacgcccattgccccctcttttcaactttaaacaggaattacaaggagcgtcacctgaattgatcaacaggcttataccagagcatgtacggcggcagattggtcttagcttcccacatccagctggtacgtaaatgtgaaggcatgatgtaacaaggaatcaactctggtagcgatgaaagtgaaacaaaggatggcctcttttgcggtctatgtaaccgagcattctggcttaatgagcagttttttctcggcctgtgaagatgtatacatatactggctcttcagcttaacctggaaattggtgattctgtctactatatgtcattttagctataaaaaaaaaagtactatttccctacttctgtacattgttttgatcgcaaagattccagagctaggagtataaaaggtgatgctattcatatctagtagctaggtaggggctgcagaagcttaagaggctcagtagtagtttggcttgctattctattcttcccccttttattaattacttaatcatgttgttatttctatttatgcttgtgccggtctttggttgcgaactgaatttctcaattgaaggttaccttttcctcacc

SEQ ID NO: 4617 - DNA, 1838 bp, Citrus sinensis
agacagaagagagagaaagtaaagcaaagcgaaaaagaaagaaaagaggggagagagaggagagagagagtgagtgtatgtgtattgaattgagagtttgaagctgtagcagctgtaacccacatggcttcaatgcccttggggcctcagcctcagccaccgccgccaccacaagcacaagccccaccatcgcagcaaccgcacttcgacaatgacctgctgaaacgacaccgtccggatatggactccgacaaggaaatgtcagctgcagttattcaggggaatgatgctgtcactggccacatcatttctaccacaattggaggcaaaaatggcgaacccaagcagacgatcagttacatggcagagcgtgttgttggtactggatcattcggtatcgtttttcaggcaaaatgcttggaaactggagagacagtggctataaaaaaggtcttgcaagacaggcggtataaaaatcgtgaactgcagttaatgcgtttgatggatcacccgaatgtgatttcccttaagcattgtttcttctccacaacaagtaaagatgagctttttttgaatttggttatggaatatgttcctgagactatgtaccgggtgctgaagcattacagcagtatgaaccagaggatgcccctcatctatgtaaaactgtatacatatcaaatctttaggggcttggcatatattcatacagttcctggggtctgccatagggatgtgaagcctcaaaacctcttggttgatccactcacccaccaggttaagctttgtgattttgggagcgcaaaagttctggtcaagggcgaagctaatatatcgtacatatgctctcgatattaccgagctccagaactgatttttggtgcaacagagtatactacatcgattgatatttggtcagctggttgtgttcttgccgagctgcttctaggccagccattatttccaggggaaaatgcagttgaccaactagtagagattattaaggttcttggtactcctactcgggaagaaattcgatgcatgaatccaaattatacggattttagatttcctcagattaaggctcatccttggcacaaggttttccacaagcgaatgcctccggaagcaattgaccttgcatcaaggcttcttcaatattcacctagtctccgctgtactgcgcttgaggcatgtgcacatcctttctttgatgagcttcgtgaacctaatgcccgccttccaaatggtcgcccctttcctccgctttttaactttaaacaggaattagctggagcttcacctgaactgatcaacaggctgataccagagcatgtgaggcggcaaacaggtcttagcatgccacattcagctggcacgtaaatatggtgacatgaaacaagtatcaagaatgccattggtggagggaagtgaatgaaagaaccttcctggtcaacatatattcaacattttggcctagttggtggatcttcgcaccgtgcaaagatgtatgcatatactggcttttgtgcaaagatgtatgcatatactggctttttggcttaaccttgaagttgatgattctgtctactatgtcgatcatgctatttccctacttttttgtacattgttttgagtgcaaggattctgaaaagctaggagtataagaaaaggtgactgtatttatgtctagctaggtaggagttgcaaatcccagcaagagctcaagggctcagtactgtagtagtttggcttgctttcttgcttgaacttggtgttattttcacattatgtccatgctgatcttcaaatggaaactagatttcgctattgatccc

SEQ ID NO: 4618 - DNA, 1718 bp, Tabernaemontana elegans
gagagaaagtgaaagtgaaagtgagagtgtcttttcacacatcacatggcttcgttgccgctgggacctcagcagcagcagctacatattccgccgcaggacgccacccaccaccaccatctttgtcatgaccaaggagccggagctgctgcagctgcactgaagcttgccgcccagtctcgccgttctgacatggactccgacaaggatatttctgctcctgtcatcgaagggaatgatgctgttactggccacattatatcgactactattggaggcaaaaatggggaacccaaaaggaccattagttacatggctgaacgcgttgtgggaacaggatcatttggaatagtgttccaggcaaagtgcttggaaactggagaaaccgttgccataaagaaggttttgcaggacagacggtataaaaatcgtgagctgcaattaatgcgcctgatggatcacccaaatgtgattgctttgaagcattgtttcttttctacgacaacaagagatgaacttttccttaacttggtgatggaatatgtccctgagaccttatacaaagttttaaagcattacagcaattccaatcaaaggatgccactcatatatgtcaaactttacacataccagatatttcgggggctggcttatatacatactgttcctggtgtttgccatagggatgtgaagcctcaaaatcttttggttgatcctctcacccaccaggtcaagctttgtgatttcggaagtgcaaagtttctggtgaggggtgaagcaaatatatcatacatctgctcacgctactaccgggctccagagctcatatttggtgcaacagaatatacaacatctattgatatttggtcggccggatgtgtccttgctgagcttctcttgggccagccattgtttcctggagaaaatgcagtcgaccaacttgtggagattatcaaggtccttggtactccaactcgagaagaaattcgatgcatgaacccaagttatactgattttaggtttcctcagatcaaagctcatccttggcacaaggttttccacaaaaggatgcctcctgaagcaattgatctggcttcacgactccttcaatattcaccaagcctacgctgtactgctttagaagcatgtgcccatcctttctttgacgaactccgggatcctaatgctcgcctaccaaatggccgccctttcccacctcttttcaactttaaacaggaattaactggagcttcacctgagttgatcaaccggctaataccagagcatgttcggcggccaaatggcctcttgccacatcctgctgggacataatcagtgtcgaattttttgttcttgttgaaggatgtcaaacaaaaaggaggctctctgtggctcatttagccaggcgttttgtcaaggcagtggtttttgtcacccctaaaagcatatagtggctgttcaatatggcctgcaatttggtgattctctctactcatcttaagctaaaacaaactcttcgcctcttctgtacattattttggtcaaggattttggaaaatgtaggagactgaaatggtaatgctatgtgtgtccagctaggcagattcccccaaagagacagcgggagtactatatacttattgtagttatattgtctttattattacatgttgagctattatgttagcaaaatgtcttttcaaattgaaagtgttact

SEQ ID NO: 4619 - DNA, 1854 bp, Amorphophallus konjac
taatcgcaggatggaagagtgtgtggccgactggttttggacgattcgctgacgggtgattggtgaatggcggggagagagggggaggagtgaggaaggaagaaaggggaggcgtcggggtgttgtgctgtttctcacatggcgtcgttgccgctgggggcttaccatcccttagagcagccgcagctgcagcagcagcagcttctgcagcaacagcaacagccgcatgaggcaccggggaagatcccggcgcgcggggcggagacgggcgacgagaaggaagcatcagttgttgacgggagtggtccagtcactggccacattatttctactaccattggaggaaagaatggtgaacccaaacagaccatcagttatatggcagagcgggttgtaggaactgggtcttttggaattgtcttccaggcaaaatgcttggagactggagaaacctttgcaataaagaaggtattgcaagacaggaggtacaaaaaccgtgaactccaattgatgcgctcaatggatcatccgaacgtgatatctctgaagcattgtttcttctccaccacaagcagagatgagctttttctaacttggttatggaatatgttccggaaactgtgtaccgtgtcttgaaacattacagtagcatgaaccaaaggatgcccctaatttatgtcaaactttatacttaccagattttaggggattggcttatatccataatgttcagggagtttgtcatcgagatgtgaagcctcaaaatctcctggtcgatcctcttacccaccaggtgaagctttgtgattttggaagcgccaaagctctgatcaagggtgaagcaaacatatcatatatttgctctcgttattatcgtgctccagagctgatatttggcgcaacagagtatactacgtccattgacatatggtcagctggttgtgttctggcagagttacttcttggccagccattgtttcctggggagagtgctgttgaccagctggttgaaataatcaaggttcttggaaccccaacaagggaagaaattcgatgcatgaatcctaactatacagagttcaggtttccacagataaaagctcatccatggcataaggttttccacaaacgaatgcccccagaagcaatagatcttacatcaagacttctccaatactcaccaagtcttcgttgcactgctctagaagcatgtgctcatcctttctttgatgagctacgggagcccaatgctcgcttgccaaatggtcgtgctttgccgccactttttaactttaaacaggagttggcgggtgcctcacctgaactgatgaacaggctgattcctgaacatgtgagacgtcaatctggtcttagtttcttgcacatggccggcacatagtgctactgttagtaatgcttctctgagattgagaaatcaaaaatcatgaaggggagccgagccgcctgttgttctgaagcgcagtaggtttggcagcgttggatcgtggtgtaatgatgaagctcaaaccaacaggaagctgttgggcaatgcttgtcctatcctgttgatatgatattactggcatgtgtatatgttctttttagtatagcttttatcggaattgagtacatgatataagaggatggaaggctgggaagaggagcggatttgttcggggtggtgtctgcgcaagagtctaattccggttttccttccgtggtatctggctagtttaggtttttgttgtatgttgggtggtggtgttttttttgttttttgaagcttttcaagttttatgtacatgttatgaagcaagaaatttgaagtttcagcagtgttccgtgtaatgcaat
